United States Patent 9,328,346 (POLYCOMB-ASSOCIATED NON-CODING RNAS) - sequence listing, part 54

SEQ ID NO: 9787 - RNA, 42359 nt, Mus musculus
uggccgugguguuuuaucacagcaacagaaaccuaauuaagacaguuuugaaucaaaaauggcuacauggacacugugaaaggagcagaaaguguauaagggauaugucagggaaaugcugcgaacggcugccugaaaauugguaagggacaggcccauaccacaaaggaccccuacuuggccugagaaguucacuagccuaggagauguuguaggcaccaucuuuaccuuuccuuuggccgcuucuuccugugccuagcuuccuggacuagagugguaguaaaguaucaagaucaagcuccuuugggugucucuucugcuaccuccaacucucacuggaaaccaauggcugggcaaaggcaagacccuugauugaaacuuaguaucaaaguggaccuggggcagggguacucccuguuuccugguguuuaccuuucagcauagacuaaaagacucauaaggcagggaggucuaagccaugcucccaccccugaaagccacccaaagagggugagugagauauaucacuacauuucuagcaacuggaaauccugggaaaggggagaaauggagcaaaauaauccuucugaacauauaaaugaggaagggcaaaguaagagugcuggugugcugaguuccugagcuagggaucaagacuugacuuuagccuguaacaccucauacaaccuugagaagaggaaaaaccuuggagaagccagggaugccuggaaguuagcuagugaaaacagggccuccaagcuuuugcuuccuccuauaucuccuagguaaacucuggacagagaacucucagaaccauaagaauguucuuagucuuuagaggguuaugguuccuucaugaauaugaugcaaucuggugggucuuaaucugagaaaaaugcauauagauacccacaaaaacauguauaaauguauuucagaggucagucccugaucaagcguagucccuucuuucaggcucagaagggcgaaaauacaacuacuguaggacuguuaauaggcuaagucaaagaaggcagacacaaaaggagcgcauauuguaucauuucauuuauauaaaauguccagaagagacaaaugggaggaaggagggacuaccuaggcaaugucuucugggguuguaaaaacagucuaaacuuuuugcagugauucaaugacugaaauauacuaaaagucacugaauuguauacuugaaguggaugaacuguaucuaugcacauuucaucucaacagagcaguuuaacagugacacagacguuacaaauuaaccacacauucauuaggggcaggaagaacuaauggagaaacaccaaggauggucugacucaccaaauuacauauuuaaaacagcucaacuuuauagcauggaaacucuaccucaauaaagccaugaagaaaaagucccccagagaauagaaaaucaagagcacaaagcuaggggaagcugucgugcaaauuaucaaagggggccagugcccaccagucugcaauggcuugggggaagaccaggaaggauaucuuuuccaagguuagagagaaguuggugagauuugaauucagagcccugcuucccuggcccuggcacuacuacuaacuggcacugcagcugcuccacuaacaggcgaggaagguucugcucucuuuuugaagagaaaugcacuucagaaacauguuuccaaaaaaaaaaaaaaaaaaaacauuccuaaggguuuuauuucuaaugaggaaaauaauaaaauaaaauuaaaauaggcuuuaguugaaacaaaguuuguuuugcuuuuuuuuuucuccuuuugaacaaauuaauuacacaccaacaaucuucuuuauuacagcaugaacccaggaggaggaaaggagauaggggaggaugggcaggaaggguugagguggguguguggacaagcaccaaaagccuucagaccauaggcagcccugcucaaccccaacaaaauucauuuaaaauaaaagggugaggacagcuaugugaaguuuccuccuccuggguggaacaguaaggggaagggaaaagaugaaggggagaggaaagaaguaaaauggacugggaggggggggggagcaaaagugugaaguggggagggaagguuaguguagcauggccugacccagggucagaacuggggauaagggagaggucccccaguuugcaugugcccuggauuugucucuggaauggugcuggcccagccccaguagauccccugcccaccugucuaucugccucuggugucugggaaugcugguuagagguuaccagggacgcaggacuccaggggccggcccccaggagcugaggucugaacaauaccuuggagucagaauauaaaagucacgaucuuggggaugguggugagggggaagucucuccaccuacccgcccaccuccaagaagcaggcuugauggucagaaaggauccuugaggccaaggaaggaucuuuguuggggucugugcuaggcucagccacugucacaauuguugcagagauggcugcugugggcaggacaucaacagccgggaagucagaguagagaaaggggcugaggugucagaaccagccucuaacacugguucuaagccauccugguccuccuggaugcuggggcugccacuguuggggaaggguacaggagggaccucacccccagucuccuccuccagcuccucuuccuccuggacuuccucggcuucugguccugagcuucguacccucuuuggcucuagcuccucucgugccgggucauccggcuccccaccccgauccaccuuccuccgucgucuccucucuagggcucggccucguguccgacucccauggcgcucugccuucuccagcugugaacacagaaggcaaaaagacuaaauuguaaguggggucugguggugcaugacuguaaucccagcacuugcaaggcuaaagcaggaagauugccacgagccaggcagugguggcgcaugccuuuaaucccagcacuugagaggcagaggcaggcggauuucugagcucaaggccagccuggucuacagagugaguuccagaacagccagggauacacagagaaacccugucucggaaaaaaacaaaacaaacaaaacaaacaaacaaacaaacaaacaaacaaagccaugaauucuaaggcuagccuggacucucuauauagcaaaauccuaucccacucucccucuccuugcguacaugcaaguagucagggcucucugccuacuuggccugaccaggccaugucaauaauggcuccuccucuccuuaccuccagaagugucuggacccucuucaagucuggaggcugcccagccugcagcagcugccagaugcuaugauucucaucuagggucaccucaagcagauccccuuccaucauaaguuccuccaguggggcucggguugccucaggcaguuccaacacagggccagacaacugugguaauauugaggauagcagcuccagaucuggaagaugcagggacaggauggauuagaggcuucccuuggucuuauccuacaccgcuauaacaaagcugaggacaucaggggccacacugauaauauccauucaacaucccacucacacuacagcuagaccuaccucucuuaccugagcccuccucuguggcuaccuuuucaggacuggucacacuguccccauucuccaacagccccuggaccuaucaaauaucaagaucaggaaaaggcaagggguaacugaacugaagagccaggcccuacucuuccuucacccaugccaaaccuggaagacuaucucuuggaggaaggcaaacauggggugucagcugagagcaggguuuaggaauuuggacagauaauaggauggaacaaaaaggcugggccaaaggagauuuaaaacaggagaaacaggggcagagcuagggggacaggaauuugaaguuaagagcuaggcuaagcagcucaccuucggcauauugccagugcccucuccaccaucugaaggguaagccagggacuccucaggcuuggauucagccuguagccguuggcgcaguucagccagccgucccaacagagcagucacuuccucagaggccaaaaccugucuggcacggccuugccagcugauggcucucucugugaggcacuguagagccucacccucaggcagccgcacaggcagucucuguagggcuaccagcagugccaggaugguuuccaagcgugggcgccgugagcgcauacacagagggcacaagaauuuggugucccauucccaccaggccagcaguggggaugagggaagacuggaccucugggagcugaggaggcgggguacugucacacagcgcccauggaaccaguccugacacaggucacacugcagagcucccaccccagcuggcacuugcccacacacgcagauagaagcuguagaggaggcuguugucaacagugccaguggacuuggcuuggcugaguugguacgacgaagcugcaguaucccuuccuucuccuucugcucccccucuuugaaggccacgaucugccgugcccaggaaagggggaagaauagguaaacaagcugauucuuucguucucugaacgcaauaccccacucccaaaccaggaaaacugagcucaggaagcaaguggucugcccauggucacagggcucagacaaucaucaccaggcucuuuacccaucuggagcuaagcuucuuaccacagagccugggucccugagguccugcgcagacagccccaacagcucugugucagauuuguacaaccccagcuccuucuccauccaccggcugcguuuggugcugucugagccggcgucugcacacgggcagagcaccugaggcaggcagacagaggcaaaugaccaggcuucccuaccuccccggauucuuuccuccccucacccaugcccccucaaaaacucauauucucauauaaacuaccucaaaacaagucagucuuauaaaaagaggcuauagguaaaagugcucggucucaccuccaauaauguauagcaggaguucuucuugaggaaggucuuggaggccuuuucucuccaggagugugcugucaauaccuguagcucuagcugucucaguuccuccagccccacagggaggucccgacccacagcuacgaggcccuccaagucauccaagcaaggguaguggucaccauucugagcacaggugagagaaaagggcaaguugaacuugcaaauaucuccuaauucucuaugucuggucugagcugggaagauggucugcccuuauaaucucaaagcagaaacaaauaacauuguccucaggaguacccucuaccaugcaugaccccuacaucuacuaacuggcucaguccagguagccagucagccuucagggauacugacuggacuaugcuuuuguggucuuccuuuucuaccuacugccagguaccugucccuuucuacucucauaacacuugucuccuugcucuaccauccacaucccggccagccccccacauccuucaggccagccucagaagacccucucuuaauauuguucugcaaacacuuugccuccucacaauaugugguaccucaucacucucucuagccaugcaacacagcacaagccuauauaucaucucuucuagcaacauggaaaaucuagguguggaugggggugguccuuacuuggaucucauccacaucagcaauccaugcccgggccuuagcaagagccuccuugagagacuggauauugggcaagugaacagggauguuuucugcuucauggauuauggccucaaguguggcugguggaugcuucugccuaaaaacaacaaaagaaggggcggggaaacaggccgguuugcucuauggaucagagcacagccugaucaguacuuguacacagcugugcucuuguuauucuuucugccacuucugugcuuuuauguugguaaagaugguugccagguucugcuugcuucagauugcaugcacccacauagccuccaccauagcucuugcaccuauguuugccacucugucagccugcuacaaguuuacacucugaucacuuguguauccuguggcaucuuuuuacaaauauccacucaucugcuuguuuccugugcuucugaacauguuuacaugcuggucuauugguacugggcuacacacacacaccccagccuaccucugccucuauguauccagacuuaaaaugaaaaagaaacaaagaaaaaacaaacaaacaaacaaacaaaacuaaaaaccaagaccagaaacaaaagagcagagaaacucaauauaccuacacuggggaguaaugcccaaggccacccacagccauuuucuucagauucuccacuaaaauuugaaaguaaagaauggcagggaggggaaggguuggacuuaccuggccucuaagcagaggugggcuuucucuucccagcguucagcgauggucagcagcuccugaagcucugccugggccuuauccacagcagggcuaggggcuacacuggcgcccgcaaccaacaguccccgcaugauggccaggguaccccuucgggcagagggagccagcgugcguuuuaccucauccagccaccgcgccuguuccaccugccuuuggagcugcugggcuucagguaccuccacacccagcuguuguccucucuccaacaaggacugcagcagcccuggacuggaaggcugugagaccagggccucacgggccucagucugguaggcuuccaccuguuccagaauacccuaccagauacaggaugaauaaagaacaaacccuucagaugaggccacuuaagaggacccacaacacauccuguuccagcaccucccaacacaaccuuuugagaaauggaaaucugccauggacucaacugucacugucugaacucuaaaacaguaguuccuguaacauuugacugcucauuacgauauccuacggaaugcauuaaaauguauauuccuaggcagcuuuauucaugauugaucauaaauuuguacuuuacuacuucucucuacaugggacucuguucucaaagcacccuaagaaauauuaugcuauguaaaacccucaugcucacucugggguccccugccuucuccauccuacuucuauuuuuuuuuuaagauuuauuuauuauuauauaugucacuguagcuaucuucagacgcaccagaagagggcgugagaucucauuacaggugguugugagccaccaugugguugcugggauuugaacucaggaccuuuggaagagcagucagugcucuuacccgcugagccaucucuccagcccccuacuucuauuuuuauaaacuuuauuuauuguuucaggcucaauaagcaccuuuguuaccuuuuacuuucucagguaaaccuuccauugucucaacagcuuguacucauaucucuguuccuugucccaaaucccaaaccuaaaaccuugcucauacuuugcacuauuuucucacacaugcacccugucuuaccuaaacccaccucuccucaccuugacauccccaaucuggugcauggcacagggcagguuguucaucuggcccagaaaaucccguagcucagccagggucaucuguaggccagccacccugucagggcuauggaguuucauguaugagauuucagaugcaaacccaggucccuccuuucaugugugccaaaaccacuccucaccguaucuguucaacuucaaucuugugucucaauguucccacaauugccuaggcuacagggagggguuuuaaaucuaagccuauucauagggugaagggauaggagcagagaggcaaacaguuggagggugaaggagcuuauaagcuagugaugcuaacagaagccacacuuuauucuuacaucuccacuaaccggcauggaguuggagagagaaccccaagccucauauacuagaaaaacaggaagguacacugcaagccccuagacuuuacaauccacugucuacugcaacuaugcugcuuuucuuguuuguguccuauucuagcccuuaaaccucccacacuccucccugcucacaaacucccucaaccuaccucucaaaucuucuacagauguugauuauaaacacuucuaauuuuucuuauugucaaggcucucauucuccaugaaaaguugccuauccuugcacucugcaguacuucccaggcuaucaccucauacuuggcaacuuccugcuaauguuccaaggaccccacuguauucagaauccaccccuuguaacacacuuuucaccucacaucaacauacccagcuuccuggccacugaccaaucccagagcccgggacacacaagccucugcuucacucaggcaguuuuucagucgcuguagaagcucacuguuaggaaaccuucgcucacgagccucagauucuagugcucucaguucuuccaggccuggagaaagagcaggaaggauuaggcaauauuaauucaaggcagaggagaagggccagagauacagaagaaacaagaauagaacuugucugaagagucccucuaaccuccccaucccaacccccagccccagucacucacugcgcuuccgcccaucuuccaccuccagggccacucguacuuuguuagcccaggugucaaaggacucagcucuaacuuucaguuuaugcagcauggcagggagcucauccaagguguaccgauaccuggaaaagcacagcgcagaguacacuuuagcccaacuuggcacucuccuccuuccuucauauaggcccuagacuuaccgaagguacuggcggcuacuggagcacuugcagaggucauugaugugagaaaggcagacaaggccaucugggcagucauagcaagccagggcagauaggaaacauguggucuugcacuuuaugcacugacguucaucaucuggaagcagcucaaaagccucucgcucagccucggugauacccuggggcauacaacccacacauuguucagaaccagucaggguggcagaaaucccaucucacuaucagaguaacucaaaccuuucaugaugguugugaagacuggaaagccaagcuucacaucacaucugccuucugucaacucuacaaucucaaagcagggguucugauggaucauaauugacaagaucaguauggacuucaggacaaaaaaaagagaagaagauagaaaaaguuggguaagauucagauuaggagcugggcauuguagcaaguacuuauaauuccagcauucagaaggaugaggcaggguuauugugaacucaaugccagccagggcaauauagcuaaauauuucacaagaguaaaaccaaggacaagugagaugagucagcagauaaaggcucuuguugcauaagccuggcagcuugaguucaauucccagaagccauguuaaggaagaaggaaaaagacggacuccccaaaguugucuucguaccuccauaggcucacuauuguacaugcaccacacacccaauaaugaaaaaaaaauuaaaauguuuaagacaaaaauaaucaaaaagagauuaaaaugagaacaaauggucuuuuagugagagagaugaagacuguacaccuaggcaguagagaggucgaaauguaaggucuguccuaggaaacgaugcuggcuucaguuccucgauagucacauguuucagacacuacucaugcuuagcaaauggaaacacugggcaccaauagggcuuacagaagaacaacuucuggguuucagggguuuuuugugugcuuuuuuuuuuuuuuuuuuuugauuaaaaaagcaauccaugccuaaaaaugaaaagccaaauaugcaaauauguuggcaucacugaagacaacaauuacgagcaacuucaggaauuuuaagaagaaauguuggcuccaauagcuuugucuuacacaucaacuuuaagccucaggacuuaccugugcucaggaagcauaacuuauugaauuaugcuaccauaucuuucuuuuuuuuuuuccucuguauagcccuggcuguccuggaacuuacuuuguagaccaggcuggccuuaaacucagaaauccgccugccucugccucccgagugcugggauuacaggcaugcaccaccacgcccggcuucuauuuuuuuaauuaguaaaauuucuugaaacuucuauguaaggcaugaggucaacaaaaauuacagaucuugcuccacuaaugggucgccacccauucaucaugugaaaauuacuuaaaucuuucuagauuuguuuaugcucuuaucagcaguaacuaucauccuuauuagauuguuuuaaguauuucaauuaagaauuuaguauauugccgggcagugguggcgcacgccuuuaaucucagcacuugggaggcagaggcaggcagauuucugaguccaaggccagccuggucuacagagugaguuccaugacagccagagcuauacagagaaacccugucucgaaaacccaaaacaacaacaacaacaacaaaaaaacccaacaacaaaaaaagaauuuaguauauuaacacuauggaauaugaaguacucaacaaauauuauucuaguuuuuagguaagaauaugcaucucauaagcauaacucauucuacuaaaggauaacagaagaaaaccugcaauaaguaagggucugacuacaauuuugaauccaaaguuagagaaugcuagaaagauaaagccccuagaguucuuuagaucacacacauggguacauauugagucaucuucauaaaaauacucaaaaacgccgggcacgccuuuaaucccagcacucgggaggcagaggcaggcggauuucugaguuugaggccagccuggucuacagagugaguuccaggacagccagggcuacacagagaaacccugucucgaaaaaccaaaaaccaaccaaccaaacaaauaaacaaaaaaaacaccucaaaaacacacaucaucucuuaaagaucucaugauuaucguguccagaacucaucuuugaguuaagugucaaauguacacaauucuguccaaauaggaagguaggucucuauucuuacaaacuugauuuuguuccuuuucauacugugacauagcauggggcuaucauuuaauaauguagaggauaugacacauuggaaaagccaagaaauuuaccaacuaauacaaaaaugagccgggcggugguggugcacgccuuuaaucucagcacuugggaggcagaggcaggcagauuucugaguuucagggccagccuggucuacaaagugaguucaaggacagccaaggcuauacaaagaaacccugucuagaaaaaccaaaccaaaccaaaccaaaccaaaccaaaccaaacaacaaaugagaagccacacacuuccaacauuacuauagcugaaacuuggccuaguucuaacacucagcaaaguugugaaugugucuuauguguguaugcuuuaagacaagcuuugcuauguagccugggcuggccugaaacuuaggguaauccuccuuuauaugcuugccuuuauaugcuugcuaaaugcugagauuauaggcaagcaccaccauaaccagccuguacaugaacuuuaaacuaaaaaugcauuacucugaaaacaggccacucaggaucccuuaggaccagcauucuuuguaauuuuuucucuuuuccaauuaaacccaguaucuuccacaugcuaggugguacucugccauugagcucuaauacuaaauuucuaacaccaucucauggaggauccucauuacagcaguuagguagaacaguaauagccacugggccacacacaacugauccacacauauggaaaaaucuauuggaguagggucacuuucuacuugauagcauuauuuuauccaaguuaacagacaauuaggaauuaagaaaauagcuaagggugcuagaaauauaguuuaagagcauuugcugcuauugcagaagaccugguaccuacauggcaguucacaacugucauuaacuucaguuccuggggaucucacacccgucuuuugaccuaaacacauaaugcauacacacagaguacguaugugcaggcaaaaauacguauacacauaaaaguaaauaaaaaaccucccccaccccuuuugagacaggaucuuacuauauagccuuggauggccuggaacacauuauauagaccaggcuguucucacauuuauagacaccuaccugccucucugccuuuggagugcugggacugaaggucugcaccauuaugcucagucauaaauuacaacaccaaaaaucuuuuacaaauuaaaaaaaaaaaaaaaaagcuagguaugauggagcaugccuaauaauuucaggucucaggagacugugaugaaggaucaaaagauaccaggucucaaaaaauaaauaaaauagaauuuccuaugaaacauuccacauuuuaaucaccuucuucaugcauuaauacuacugacaccagcagcuaguauacugcaaggguaguaauaaauucuuuuacaaauauccaaucacucaagcuuuacaacuaccauuacaaauaucaagcuuaagcugcgcgugcuggcacacaccuuugaucccaacacugggaggcagagcuagguagaucugauuuugaggccagccuaaucuacacagcaaguuucaagauagccagggcuacauggagaaacccuaucucaaaaacaaacaaaaucacgcuuacauauuuacuaccauuuuacaaggcaggaaagugagacuaucagugauauuuuaaguaacuugaagggacuaaaugaucagcaacagggguuuauaugucuauuuuagugggucuuuggcauaaggguaauagcuacuaaaccauagccugaaauuaaugaacaaauauucuuaacucacucagcuaccuaaaaagacaaacagauuucccauuuuucagauguggaagcucacccucagugaaguaaacugaccugugcaaaguugccagguacuauaaagacuaguauuacauguguuuuucaauucagguguaccuagcucuuuucccuacaugccaagaauaacagaggccacaucuauccccggaauuuacccuuuucuuccccaaccuuuaccagccuaggaucccggaucaaaagcaccaccacuuacuuuuuccaacagagccuuucguagacgccgcuccucuugcaccauaaugaacaucuccuuauguacagcugcugccagguucagguccaguuucucagggcaggcagccaucuugcaaaugagcuccucaugagaaaagacacaguaucuucguagucggcgguagugcucaaugcauuggcgcccagcaggcagcuguggacagguucaaaguugaacuugaccaagccugaaggaagcaguguagcggcuuuccuaucuuucugcuucucccgaccagcccaccacacuccagacuuacccagucagcagugcaaaaguugacugccucagcaaaguuguagccuugguugaaaccacugugguaagcacgaggaaaagugaugacaaauucuccugcacacugguuugugcggacaaccuaaaggagguaaaaaaaggcuaagaccauagagauaaacugaggcuuucaaguuguaggcaacuugaccuaaaagcaucgcccuaaaggagagaaaggaaagcuucaggaaagggaguaugaccacaaaguccuaggccucugcucugaaaggugaugugagucacaacuggcaggaaauauaugcauuaaaucacuucaacuuuccuaguaauauuuuaauaaaauuauaaauaucauuuucuacuaagauggccacaguuuuccauuugauauucauuuuaauacagcuuugagagucaaaugcuucuauaauauuuauuauaaaaccaucagaugcuauuauucucuccuucccauuuaucucuucugauuauuugaacaauagcuuuaaccaauuuaaauaauauggaucuggacuaaauuaacaguaguguuggcuggcuagaaaaauggcucagcaguuaagaauguacacugaucuugcagaggacuagaguuaaguucucaguauccauacuggguggcuuauaaccaccuauaacuccaguuccaggggauccaauguccuuuucugaccuccacuggcaucuacacucacauacacauauaacuaaaaaucuuuuuaaaaagaacaaaaaagcaauagcaucccccuuuucaauuuguuuaguuuucuauacauauacuaacuugaguccuaacuuucugauaagagucuaaacauccuuuccuauacauuuuugccuuucuguuaagucaguuuuggguuuuuugggggaggugugagggagguuacuuuuuuuuuuuuuuuugagauugcguauuacuacauauguagcucaggcuagccuugaacccacagcccugcuucagccacucuacugcugggauuauagguguguagcaacacuuccagcuucauauagauuucuuaucuuucucaucuguaccacuuaucuuccuucaaucuugugacagaucucacuucuuagauccuaugcucuuuguagauuuauuacuuugcuguggcugaacauggucagaaagcguauuugggagggagguguuagucuaacucuuacaguugauugcauauagaauuccaaaauaaaaaucauuucaaaggguuuuuguuguuuuaggcuagcccuagcugacuacucuguauguagaccacaguagccuugaacuuguggcaauuaucuuacuugauucucacaacuacugagauuacagguauucugaacucuuucugaacucuuccugaagauuucaaugcuauuaaaagaucucuuauugaaaccuguuucuucuucaagauguuuaugugauucuucugcucucgguguuuaacaacaauaaaaaaguucacaagaucuaucuuuguguggaucuauuuuuauuccuauacuagguaggccacuuugauucaagaaacaauccuucaagaaaauuuuuuuagggcuacagaggcacagcaguuaagagaacuggcugcuuuucccuaggacccagauucaauagccaacacucacauggugacuaacaauuucugcagcccuacuuucaggcgaugcaaugcccucuucuggcuuucaugaguaccaguaaugcacauggugcacagauauacaugcagccaagacagccauacauauaaaauaagaaucuuauuuuuaaaauuuuauuaauaauucuaccauuuaucuacuuggugauuucuauuaucugauacuauacagauuuuauaacuuuuuccuaccuuuucucauuuuuaucuuuucauccuauuauuucaaguacuuauuuucuguuuuacccccuuuccuggauuucacuuuugcuaucaaaauuucaaugccccaagagcucaguaguuucucuauaugguuuuugaaacagcauaccacuuuucagagaggcagucccucuuauucaagacuuuuuguggaagccccccauauauaacauacauauaaauguauguuuuuccuacacauacauauaaaugggaauuugauagggacaucuuaacaauguacucuuugcagucugcagugugauaaaccuggcacccuuuuccccccuuuauaagaucuuagcaaccucaguuuauauauuuuuuuaaguugaaacuucacagaaaaaaauaaacuucucuuguuauacuuaucggaccucccuacaucacuacucuuauacuuaaggauauuauuauguaagucaaggguuguuugaaagcaagcacuaccauaccuuggcagucaacuaaccaagacagacucagugacuaacaauauggguagcaucuagggcauggcgcaacggacagauucauaccucagguagggccuuaggacagaguacaguaacauuagaucucacgaccuuauacaaaaaaaagaaauauaauuuuaaagcaauuguucaauucuggaauuucuuacugaguaucuuugggcugcaguugaccauggaucuaugaaagcaaaauaaugaauauuugaucauguuaguagagucuguuuuccuuuuaaaguuuauuccuuccuggcaagccaauuucuccaaguugcuuucuuacuauuugguucuauuuuuuucuuagguuuuuuguuuguuucauuuugauuaccugauagucuaggauucccuacuuauucucuuguuuuuuuuguuuuuuucuuuuuucuuuuuuaaagauuuauuuauuuauuuauuuauuuauuauauguaaguacaccguagcugucuucaaacacaccaaaagagggcgucaggucucauuacagaugguuguaagccaccaugugguugcugggauuggaacucaggaccuuuggaagagcagucagugcucuuaacuguugagccaucucuccagccccuguuuucuuuuuuaaagaagaccugaguuuagcucuuuuucuuuuuuuuuaagagacuuauuuauucauuauauguaaguaaauuguagcugucuucggacacuccagauguccgaaugguacggaugguugugagccacaaugugguugcugggauuggaacuuaggaccuuuggaagagcagucagcacucuuauccacugagccaucucuccagccccucccuacuuauucuuaagaaacaaaaaacaacaacaaaaaaagcugaaugaaagcuccacuccaaaaaguacauaggugacauuuaucaacuugugagcuucacugcagaaugaucugggaaauucugagcuguuuucuucuuacaccagucaagauucucaaauuccccuucccuucuaaaaaauacucauacuuucugucugcaggaaacgacccaguugucaacaaacuaauaggcaaaugaggaaaguggccaggauccauuauguacacaaagaugaauccuguuuuuacccugauuagaguaaaaccaccuuuaacuauacuagcuauaccauggagaucucaauccucuguucuaauuuuuucagaaauaagucuucagaaauaugugaggugaugucacauaucaaauaaaaugauggaaacucaguuucuuuuauggacaugaaaucauccacuauuaccuccagaaugccagguacugcugaguacagcccuuaagugaucauaaaguauuaaaucauguuggcucuuauuuucucaguaggggcucaagauucaauugauuggggcuggagaaauggcucagugguuaauaauacuuguugcucuagaaaagacuugaguuggguuuccaguacccacaucuggcagcuuacagccuccuguuauuccaggaucaggggauuaaucaucuauuggccuccaagggcagcucuccugcacccccaccauguacaugcucauacacacguacucacauauacacaaaaguaaaauaaaucuaauuucuuaaaaaccagacugaauuguagugucuccguuuuaggguuaagacuuuuauuguuggggcuggaaagauggcucaaugguuaacacuuguuauucuuauagaaaacuccgauuugauuccuaguaccuccaugguggcugcuaaccaucuguaacuauagucagugcugggaucugauacuuucugacuuccucacgcacaggcauacacauaguacacauaaauacaugcaggaaaaacacucaggcacaaagguaaaaauacuguuuuuaacgucaauuuaaaaaaaaggauuuuaucauucuguccuguuuuuuccaucuuuaugauuuaucuuuuucaaaucacuuuuugucauuuuacugggucucaauaaggaguagaaguagccauuuacauguuuaauuuguuucuuuaaccaagaaguuucacaaaauguuuuaaaaugaacauuuaauacguagugaaaggauaaaugccagguuuaagaauuaaauucucccugaaaaguacauuuucuuucuuucuuucuuucuuucuuuauuauuauuuauuuacuuggugcgagagguuaaagccaugaucuuugacuauauagccaucucacuaaccugcuaauacacaucaagaaccugguuuguuucagcucaguaaaucugcuacaauuccagaaaaauuugaagcauaucaauaucuaauauaaaucuuccuauugaugauguaucaccaucacauuuucuucuuaaauaaagucagccucaaaacacuucuugcuuuuauuauugcuauggcuuccaccaaucaccagaaauguuuuguaaauaauaacaacaacaacuccucuauggcacgccucacccaaagccucuagaauaaauuucaugauuacauagauaaaguuuagcagguaaauucuuacucuuuuaaauaggacugugaaauggauagccccaaauguucaccuucuaaaacuuugugaaacuucuuauuuaaagaaacaaauuaaauauauaaauacuuuuaaaaaccugguccagauaacgcaaauccuaaaaggcccacucugcuguucuauggugucucccaacuuauuuuaauuguuuacuguucucuuucuuccacuuaugggcacacacccaaggcaggaauuguuuuauugaccuucaggguggugaccagugguuuuauacacagaaaguacuuuagcaauaucuauuuuauaauuucauagauguaaaaaccaaguuccagagaagccucagcuagcagaccaggaaaagaauguuccuaauuuccucuuaagcuuauuuugccaguguuacuuuucuguucguuucaugguacuuuaaaaaaaacaccccuauccagauacauuugcagguacauuucgacaaucccagcaucuggaaggcuaauguaggagaaucacaaguuugaugucaggcugaacuaccuaacaaguuuaaggcuggccuagguuacacagugaaacaguaacucaauaacaaaacaaacaacaagaaguagucauucuauuuuacagcuauuaaaaaugagaaauaugguucuuucacuacauggacccuggaguucaaacucaggucucuaagacccacugagagaagccccccacaaaagaccaaacaguauucuacuuguaugaacaagcaaggaaggcaaauauagaaccagaaaauuaaacagucaccuaguccuauaggauagaauggagaaugacugugaauaagggguuuuucugggguggcaaaaauguuuuaaaacugaauuacagugacaacagcaaacaucucuaaggacaucuagguuauacacuuaaaauggaugaauuuuacacaauacaggucauacugcaauaaaguuguuuuuaaaaaauacaauaguaguuauagaccagcacugucaagagaaauauaccaaguauauuucuaagcacaaagguacuuggaaaaaguuucuuuccuugccugguacugcuagagcacagauacugaacacaggcccuugugaaugcuagacaaauguucugcugagcuacaggcauugaacucuugacucagcuucucaaacaguucauguuauaaggcacauaacaucaugccuggcuauuuuaaaauucuuuaguagccacauuaaaaaaauauauauaaauaaacaaguuugaaaaaaacauaaaauaauuuuaguguauuuuacuuaacaaagccagaauauuguugucucgguauuuagguaguaaacaaaaguauucaugagauacucuauacuuuacauuaguacuaaaucuugaauuacaacauccauuuuauacucucaguacauuugauaugggacuagacacaucugaaaugcuugguggccacaugugacuaauggguauuaagcuagaaauacauacaagaaauuauaaauucacaguuuuacugauauaucaaacuugacauaaaaaaaaaaucaccacggaaauauaacauauguuuaggauaguuggaauagggaaugaucaauuuuccauuuuugggaaaggagauaugcuuuuuaaaaauaaaugaccuuucccaaaggaagggaaguguguauguugggguugggugacacacaugacaugguacaaagacuuaaacaaagcuuuaauguagugcucaccaguuccaucugugaugucacaaauaauaugauuuuauccuuuuuaauuucugaauagcauuccaguguguauauuauauauuacauuuucuuuaauuuagacaucuuaggcagguuuucuuuucuuggcuguuuuguaaauaguguuacaauaaacaugggagugcagauaucuuuucaaaaugccaauuuuguuuccuuugguuauagaaccuguaguagaauugcuacaucaugggcuggagagauggcucagcaguuaacacagacugcucuuccagaggucccgaguucaauucccagcaaccacaugguggcucacaaccaucuguaaugggaucugauguccucuucuggugugucugaagauagcaacaguguacuaacauacaauaaauaaaucuuaaaaaaaauaauuaaaaaaaaggauugcuacaucauaugguaguuuuauuuucaaagguuugaagaacuucccuguguuuacuacacuauuuggggcuucccacaucauugcuaguguuuaugaucauuuugcuauacuggagacugaacccagggcuuugugcauguuaggcaaguacucuaccaccugcuuucaucccuugucugucugucucuuuuucuuuuuuuaauuuaccaaaacuuuuuuuaaaaaaaauuuauuagauuaccaaaacuuuauuguacaaaauuuacaaaaaaaaaaaaaaaaaaaaaaucaccacacaaaauuguagccugccaaguuaaaacaaaaaucacaggugauuuggauuagacuauauacugcuaauccaaagagcccagagauacuaaagaggacaggcuggggagauggcucagcggauaagagaauuugcuacucuugaagaguuugguucucaacacucacauaguggcucauaaccaccuauaacuucuauucuaggagauuuaacacccuuauucucuggccuccaugggcacagaacacacguggugcauauacagaaacauaggcacacacauacacacaaaaauauauauaauuaaaaagaaaagcaaaaagacuuucuuuuuugguuuuucgagacaggguuucucuguguagcccuggcuguccuggaacucauucuguagaccaggcuggccucgagcucagaaauccaccugccucugccucucgagugcugggauuaaaggcgugcgcaaccagugccuggcaaaaagacuuucuaaaccuguccucucuccauucccuuuuuuacuagcuagaaccuagagaugauaacaagcuaucccuaagguagccuaaaguaucccucaaacccauggaaagaacucacuaucacauugcauaucuaaccaaccacgaugaucacagaccucaaaacagucccaucaaggcagaagaggaauaagagaaagcagggauaaaccacaagugaagacuacaauugcuagcauaaaagucaucaguacaucauuccuauaccuuccuaugguuucugggcacucaccggcacaccaugggacaugagcguguuaggauucaugagggugacgaguuggugaaggagaucaggcuggcuaucaaaaagcucaggugucagcuucuucaucacuucuuccaaguguuccgcugcaagcgaugggacuccauaccagguuuuuggcucaccccuguucacguuagaggacacagaauggucaugugcauaguuauguagggagaucacccugacuaccuccccagcuugccauagccccacucaccaguggagguaguuaauagaguaacuccagugaucuucaauaugccagcaaaaggcugagaagaccauucccacauacagccacgguaccuucaugccagauauaucugcauugauguggcacaguacagacugcuccaauacaggcaucacauucagguuccaaccacuuguagcauacuccugucaggucaaguguuuguacagaaggaugaggauuaugcuaaggaacugaguuucugccccaggacugaggauugaacucugggcucacaaaugcuaggcaaauguucguucuaucacuguaaccugaguuccuucuacuuugagacacagucucacuaaguuacccuagcaggccuugagcuuaugauccucuugccucaaccuccugaguagcuggggaaucauaggugaaaacuaccaagcccagcauuuuuuuuuuuacauuuucuuguguguguguguguguauguguguguaguauauuuucaguguauguuuguguggguacacaagugugaauauacauguggaggccagaggucaacaucagguaucuuccucuaucauucucuauguuauugagaauguuauugagagagggccuaucacugacccccaaaguucagcaguugccaaaacuggcucugccugccuucccucagcuagugguuaaagaggcaagcuauuacuacaccuggcuuuuauuugguuucuagggauccaaauuuggacccucgugcuuacagaacagccacuuuaccaauuaagccaucucuuuagccucauuuuuuuuuugguuuaagacaaaaccucauucuguagaucaggccaacaucaaugucacaguaagccaccugagccucuugaaggcugagauuacagauguugaaugaucacacucaacaagaacuuaguuauuugcuuucguacagggacucuuaauaugggcaucauaccaaacaacguuugagucuucucugcucccccccaccccaaugcacacacaggaauuuucaauucaauucacuuuaauuucauaaagauuauguauauguaucuaccauaaggccugcucugcaaacugguuuucaacaaguccuaggaacuugaaguaguacauaccaguuaauguuagcaauugggagguugagacaggaaguucacaaauuugaggcuagucuggucuacacugaaauagcuuuugucaaaaaauaaugaaacuguaugcagcaauacaugccuuuaaucccagcauucaggaagcaaacacagacugugaauucaaacucagucuggucuacauaguggguucuaggcuagccaaggauauaaagugaagccccaucucaccaaaacaauuuagcaaauaaacaaaggauagucuuucuaauaaauaaugcuacauaaauugauguagcuauaugcaaaagaauaaaaauagauccauacucaguaauaaaaguaaacuauaaacagaugaaaacuuaaguguaagucuuuuuucuuucuuuuucuuuuuuugauuuauuuauuuauuaauauguaaguacacuguagcugacuucagacacuccagaaaagggcgucagaucucguuacggaugguugugcgccaccaugugguuuaacuauugaccuuuggaagagcagucagugcucuuaccugcugagccaucucaccagcccuuaaguguaagucuuaaaacuacagcuaggcagugauggcauacaccuuuaauuccagcacucaggaggaagaagcagacagaucucugaauuuaaggucagccuggucuacauagugaguuucaggaaaagagagagagagagagagagagagagagagagagagaggagagaggagaaaggagagagagagaaugaaaaagaucuaacuaugaauuuaugagauaaauugaacauuuaucuuauuaucucaggacacugaaaugggcaacaauuucuuauacaaaacuugaaaaccacaagaaacaacaaaacaagauaaaugcuauuguaacaaacuaaaaagcucugcauagcaaaggaaacaaaauagcaagcuaguuauacgugcuuggcaucccagcacucagaaggcugaggaaaaagaaagacugccauacaaguuuaacaggagcccaggccagggcuacauagcaagaccugguuucaaaggagaaaaaaaucaugaagccaaaacucaaaaagaguaacacacacacacacacacacacacacacuagcaaaaagacaauauacugaauaaguauuugcaaacuauuugccuaacaagacauuaacaaccacaguuuaaaaauguaaaaaaaaaaaaaaaaaaaaaaaaaaccaccucaaaaaaauucaacaacaacaacaacaacaaaaaaaaaaaacagauaaaaucagauuuaaaauauaguagauaaacaguuaccaacaauugaaagauucaauaauaguuaaaaugaugacauauaaacagcaagcaaguauaugaaaaauguucaauauaauuaauccuuaaagaaacacuaucagccggcuucaguaaggaugacuuuuauugcugggcaugguggcgcacaccuuuauuucuaacacuugggaggcaaaggcagcaaaggcagccaggucccugaguuuguggcuagccugguuucaggguaaauuccagaacagccaagacuacacagagaaaaaccuugucucaaaacaaaaacaaaaacuuuaaucaaaaaacaaaaacaguuuuaugugaugauuuuuacuuauaaguuuuguacauuaaaguuuugguaaauuaaaaaaaaaaaaaagaaaaagagacagacagacaagggaugaaagcaggugguagaguacuugccuagcaugcacaaagcccuggguucagucuccaguauagcaaaaugaucauaaacacuagcaaugaugugggaagccccaaauaguguaguaaacacagggaaguucuucaaaccuuugaaaauaaaacuaccauaugauguagcaauucuacuacagguucuauaaccaaaggaaacaaaauuggcauuuugaaaagauaucugcacucccauguuuacuguaacacuauuuacaaaacagccaagaaaaagaaaaccugccuaagaugucuaaauuaaagaaaaugucauauauaauauacacacuggaaugcuauucagccauuaaaaaggauaaaaucauauuauuugugacaucacagauggaacuggugaccacuacauuaagugaaauaacccaggcacaggaagggccagugccaugugaucucagcccaauguggaauauaaaaaaguugauuucuuugauauuuaaaguaaaaaguugguucuuagaagcaggagagcacaaggggagagagauucaugaaaagauugauuaaugaauacuaaguuaaagcuagacagaagcaggacauccuuaucuauuauugcacagagggacgacuagauaaaauuauguacuauauacuuuaaaaagcuuuaugaaaagauuuugaauguuuucacaauaaaaaauguuucagaauaugcacuggcucacacaauguaguuauguuuuagaaacaucacaugguauccuauaaauacaaguaauuuauuucuugagauuaauuuuuaguuuuaacuaagugugugcauguguucuaccuaaguacacauacaggccagaaaaauauguuguuggauccccuggagcuagaguuacagccaguagugagcugcccaaugugggugcuuggaucaaauuugggucuucugcaaaagcagccaucuuuccagccccauuauguagaauuucaauauuuuuauacaucaauuuuucaaaaguucaaauuaaaaccuaacaagccagaaacaaaaacaaaauaagcaaaaaucugaacccaaaugcauuuuuugcauucaguuaagccuggacucucaauucucccuguacaugccaauccuccuuacagaacacauaugaaaagacccagcacuccuuagggcacuuuaccuacuucucacaucauucuuacaacaaauuugcaggcuguguggugguggcacaugccuuuaacccaagcacuugggaggcagaggcaagaggucucugaguucgagggcagacuaaucuauaaagugaguucaaggacagccagagcuacaccgccccccccaaacccuguuugucuugaaaaacaaaaccaaaaaccaaaauaaaacaacuagaaaaaagaauaaagguaggaauaucaccauauuacacauaaggaaacagguucagagggucaguuaauauccuugggaggccuguucuuuuucugaagaggaguggauaugggggagagaaaacacgaggugaggaggcuggaaggaggugaaacagugguugggauguaauguaugagagaagaauuuuuuuuuuucaagacaggguuucucuguauagcccuggcuguccuggaacucacuuuguagaccaggcuggccucgaacucagaaauccgccugccucugccucccgagugcugggauuaauggcgugugccaccacaccuggcaagaagaauuuuuaaaacagcaucucauccaugcacauuccagauacuaccuaggcuguguucuuuacucuauagcaguucaucuacacuucaaaguaacuaccugaggcaggcaucaaaagggauuuugaugucuuucagauacuaaauaacuugcccaagcucauguaacaugacauauaaccaugagaaucacccacucaccuccuccucugggguuaggugccgcuuacugucacugacagggaaaccgcugccaaauucuuuggaauggaugucagccccauacuccacaguuacgucuuccucgaugcuauucaccagccgccaaaacuccuucucuacaaguucuguggguaccaucugggggaacaggauaguaaaugacaucuuauccugucaacauuaauuuagggagguacaguaccagugccuaugaaccuagucucagcacuaccccagcccugcaucaccuacaugcacaggcauguugaaguagucagcuuuaaaggagucagccaucucuccaaagcucugcagaguauauucccggguagcuugcucaaagccaaaggcuucagggggccgcuuacacuccuguaacccaaacgagaacaaaucauaaaaauagaggcaaagagcaaaucaucucaaguggaacugaaacaugagacagaaggagggagggagggagggagggagaauugcucucacucagccuuccaggauccuagggaaagccuugcuuugcagcucuaucuuuuccuuccucccacaugagcuagcucaucacauguauucaugccacaggcauuucucucauacuucugcucacuguuaggguuugaaguguccuucccaaaaaguucaccuauuaaagacuuugucccaagaugguagugcuauuuuggaauguucuauaguguucuggagguggggccuaguuguagaaaguagguuguacguugaguuccuuggaggcaguaucuuugcccagccguacacugucuuugucuuucugauuucuaccuauaauaaugugaguggagccauaagcaccuccccaucauaaugggcugaaaccucuacaacugugagccaagaucuuuuuuccuuuaaauuguuucucucaggggcugcagagauagcucaguucagagcacuuguugcucuugcagaagagccagguucaguucccaacacccacauagugcucacaaccaccuguagcccuagauguuagguaccuggcccuccucacugcugcuauuguggcuccuccuuacuacacuacaccuaccugcucuaggcaaauuuucuccugaauaccucuguuccuacaaaauccuguuucccuaccuggaaaaugaaccaaaucuaaauaccauaauaagaggaaagcaaguaaucauuauauucauuugauaaaauuuccuaucuucaauucauuuaauacagaaguaugaaguuagaagucuuuauaaagauuuucuuuauuuuauauaugaugaggacacuguaacucucuucugauacaucagaagagggcaucagaucucauuacagaugcuugggagccaccaugugguuucuaggaauagaacucagaaccucuggaagagcagucagugcucuuaaacgaugagccaucucuccagcccuagagguuuuuauaaacuauagaacaagauuuuuuuuuaaagcgucuuaaagauaauuauauguaagacagaaaaaagaaaauauuugggagucaaaagagcauuuaaaagguuuuuauuucuagccaggacugauggugcaggccuacaguuccaguuacuuugaaggcugaggggggcuccaaacguaaaaccuaccugggccacaaagugaauuugaaacaauaauaaaaaccacagccuggagauccagcucagugguagagaacacuucuuuagcaugcucaaaucccuaaguuuaauaaacagaaagaugcucuaucuauagcuaguuaauccuaucauuuaaagcucauucuuacucacuaccuuuaauuauccuggccaugguggcucauacucauaauccucuggcaggcugaggaagaaggacugaauuuugaggcuagccggugcuacagaauaagacccuaucacaacuaaacaaaccaaaccaacuaaccaaccaacaaacccaccuuuucuaucuguucaacuacaacucaggguuucuuuucuuuucuuuuuuuuuuuguuuuuuuuuuuuguuuuuuguuuuuuguuuuguuuuuucgagacaggguuucucuguauagcccuggcuguccuagaacucacuuuguagaccaggcucaacucaggguuucuaacaucaauuuuaauaucugcuuacaugucagcacacauaguucaccaucacacacaguccaucuaaauguaauaccccauagauagucugggagcucccagaggauaggagcauaaauuacauccucuuuuucucacaaagcucugcagaacuugaggucccaaaacacaguaauacuauagcugaggcagaaggcuccccuuaagacuauacaaaggcaggcaaagauaucccaugugaacugggacugggaaggccuuaccgccaugacacacuuuggacaccuccagacaccuuucgggauuucaggcaaaggaggcagcaggcaaaagaugugguaauugucaucacagccaucacacaguaagaguuugucaucuucaucuccucgggaacacauucggcauacguaugacucaaucugccagagaaaagcaaaggguuaugaauauagacccuucccagucuucaaacaccaggccccuccagacaauaucccguuccagagagcucuguuagaagccagagguguuugcuggguuguucauggcccuaaauaggcuagucuuucaaggccuggaguucaguugaaugcauguaccacuuccccagauaaauacagauaugagaagucuuuauuagucuucagucuucucaguuuuauucauucaauaaauaguguucuauggcagagaugaggaaaaucuaguaucugccuucaagaggcacacaguacucuauucauaacaacugaaaacagccauagcagcccauaagaaauacuuuggguauccagcaaaggaagcagcacucguguuacuuggagaugagggaggacugcaaggaaguacuccauucugaaggggacacuuggaauaacagaaacuugaaagcaugcugguauuuggcaauuggagcagagcacaaagaccaauucuuugaggcagaaaaaaaaccauauguacaaggaauguaagacuaugaaagacauacugguacaucagaaaaaaaaaaaaaagaauauaccuacaaguaauucagaacagcaauagcugaaaagugagguaggcagugguggacaaugagguuagaggucagccgggacuggaucauguacaauaaugaagauaaugaagaucuuagccuuuauccugaagcacuggacaauaggauuuuccuccuagcacuuuaugugaacaguagcuauuuacucuguuuugguuuuuguuccaaauuagcugaccuugucuuccccaauuaaguguugccuguaggcagggcccucuagauccacuuuacuacuuaaugcagccuaguccagugccaugcuggagaaaugcucacugaagggaugagaagcagagcucuaggaagucagggcuggguccuuacaaacugggcauugcugugguuccuucgaagccucauggucaucuuggugcagggcucagggcuaugacucaguuccuccuugccuucuaggaaggucuugggugagguugauuccaucuugacauccccaccuaauuccuccuuuaccaccacaguggggggacacucaggcccuucuuuaucuguaggagaaaaaagugguucuaaauuucaaucugaaacauuuacaguccugccuccugccuucugccucuguaugaagccaccucuaguaucuuagacaucaccuuuuuuccgcagagucuuaucuuuggccauuaggcccagccccaucaucuuggggccugcuccauauaucuguaauuucuucaguucuggauucuuuucaaugucuuccucuguggguuccggcuacaaagaaaguaggaaaaaaaugagucaagauuacuauuuggagcagacuacccaauccuaaaagaaaagcucagaauaugaauaaauaaauauauauauguucaugccaagaacucaagcccaccaagaugacucagcaggcuaagucaucaagccugacaaccugagcugagucccugggacccaggugguagaagggaagaaucaacucuaguaaauuguucucuaguaccugcuuaucaaagcaaaaccacagauauacacacucacacaauaaaucuaauaaugacaauaaaaaaauuagggguuccuaagguuccuucucuaggugaggagcuuugaguagcugacaguugccagggcaaggaguggccacugguagguuccucaugcccugguggaugaccacacacccauguaugaugagcaacacaaacuaaacucaguacauuaaaaaacuuuacuuaacuaaaaaauauuuuaaaaagacaugaaguugggagauauaauuagaggauccaggaggaaguaagggguggugguggugaaggguguauaugaucaagauacacuuuaaacaaacaugaaauuuucaaauaaauaacuauaaaaauuucaggaguggggcuggagagauggcucagcgguuaaaagcacugacugccuucggaagguccugaguucaauucccagcaaccacaugguggcucaccaucuguaacgagaucugaugcccucuucugguguaucuaaaggcagcuacaguguacuuauguauaauaauaaauaaaucuuaagagagauggcugaauuguuaaagaguacccacaagcagcucacaauuaccuauaacuccagcuccaaagaaucagacucuuucuggccucucuggguaauuuacucacaugcucauacuucuccacaaaaacacauggcauacacagaauuaaaaacuauacgucuaggggcuggagagaugacucagugguuaagggcacugugagcuguucuuccaggacccagguucaauucccagcauccacauggcaucucacaaucaacaguaacuccaguuccaggaaauccaacacccuguucuggcauccaugggcaccaggcacacacauguacauaaacauacaugaaaguaaacacccauauacauaaaauuuuguaaaacucuaaaaauaaagaagggugguuuuuuuguuguuuuguuguuuuuuuugagacaggguuucucuguauaucccuggcuguccuggaacucacucuguagaccaggcuggccucaaacucagaaauccgccugccucugccucucaagugcugggauuaaaggcgugagccaccaccacccggcuaagaaagaaguuuuuaaagcauuuuaaaaagaaagaaaagaaaagaaaagaaaagaaaaggaaaggaaaggaaaggaaaggaaaggaaaggaaaggaaaggaaagggaagaaaagaagggccgaaaggagcagggccagugcgagcgaggccagagaaagcaaccaucuguaaugagaucuggcgcccucuucuggagugucugaagacagcuacaguguacuuacauauaauaauaaauaaaucuuuaaaaaaaugaaaaggaauuaaaggcagaaucucaguuuuaccaaccauaaauaaaaauauuaacuucuaccuuauagcuuagggauaauauacagaaguaaagugguguuugagccaccuuuccugaauaaauauagcuaccauuccuaaugaaagaagccgcccuuuacagcaaauggaaacuaucacagaaaaccacaacuggacauaaugcagagagaucaauggauccuguggagcccagccccagugacuaaaucugcaucauagcuuuuccgucuauggcucagggaauaucauggaggaaaaugaaaagauucuaagagccagaacaccaagaagucugcugugaaagucucuccuaaaaauggcugcauagauaagauaggaacaauaguauuaucagugaaaauguuaauauagaggugggaggggauuucaugaggucucauuccuaaacaaagaacuacaggcaaauacugauugcuguguguauauguacacacacacacacauauauauacacauauauauguacauacacauacauauacauacauacauccacauacacacauaugagggauuugagggagaguaaaugggaguagauggaggaaggaaauuauguaauuaagucuauuucaauuaaaaacauuaaauagaguaacauuauugcuggggggggggugcaaaccuuuaauccuagguuuugggaggcagaggcagguaaaucucugaguucaaggccagccuggucuacagagccaaguacaaauacugccagaguuauaccgagaaacccuaucucaaaaagagaaaagaaaaaaagaaaaaggacauuuguucuaugagcagauugucugaagaaaggagcaaaccagucacacaggucagauacaaaaaguauaguucaaacagcucuccaacuaaacugaguagagaaaugaucaaaaaagcccagaaagggcaugcuaaugcuuaaggcacaaaagaagugcaacaauguuauacaagguuucagucaacaagcaugauucuuuccaccccaaagccccuguaaguggcaagaagaaaagaacucacaucaggcuguagucucuuugcccgucguccauaacuguugaacuuggaaggcugcacagacugucgaagggggaugcugugggguuuauauuccuuguccuuuuccucauuaucaaaugggcguguguuacacugcuagagauaauaaguaaagaguaaggcccagggcacagaaccucagcccccaaaguaaaaucuuccuuuggccaauggacaaaguuguggcccauaucccugaccaacaccaguaaucccaguucaaccggucuuuauugcugacaccuuacaaacuuuaggaauucguuuuuuuaauuccuuuuuuuccuuuuuuuuaaaaacauuuacuuuguguguguaugugaugugugugauguguguggcaguauggcauucaugccacagugggcaugcaaagaucacaggacaaccccugagagccaguucucucccuccaccaugugcauuccaggucaaaaucaggucaucaagcuuggaagcaagcacauuaacccaaugagucauuugccuaccacuaaugaggccuuuucuucuuuucuccucccacccccucugguaggggaggagugugugcuggaacugaacccaggguucuacagauaggacuuuugacuacagauacuaucagaagauaagaaaguaucacuaggaaaagguaaggucuaguuuucucaguuuccaauccauggaaccaauccuauuaagaauagucccaggcuggagagauggcucagcuacaguguacucacauacaaucaaucaaucaaucaauagaauagucccagcacuuaagaagcugagaaagggcuggagagauggcuuggcaguuaagagcacugacugcuguucuagaaguccugaguucaauucccagcaaccacaugguggcucacaaccauccguaaugagaucugaugcccucuucugguacuucugaagauagcuacaguguacuuagauacaauaaaucuuuaggcuggagugagcagggcuagagcgagcugggccaaugagagugagcagagguccugaauucaaauucccagcaaccacaagauggcucacaaccaucaguacagcuacagugcacucauauacauaaaauaaauaaaauccuaaaaaaaaaaaaaaagcagcagcugagauaaagaggaucaaggguucaaggccaagggaccagcaacauggcucagggacccacaugguggaaaaagagaacaaaguucucuaaguuauccucuuaccuccacauacauugaugcacucacaauaaauguaauguauaaaguucaagguagggaccuggggauacagcucccguuaguauuugccuaacgugggcaaacucagcauggugauacaugccucuaaucugugaccugggaagugaaaggaggaccaggaguucaagcuggucuuuuuguuuuuuuuuuuuuugagacaggguuucucuguauagcccuggcuguccuggaacucacuuuguagaccaggcuggccucgaacucagaaauccaccugcucugcaucccaagugcugggauuaaaggcgugcaccaccaccgccuggcuuuuuuuuguuuguuuguuucaagcuugucuuuaccuacaaaguuugagaccagccagugcuauaggacucggacucaaaagaaaauaaaagagaaucuaagacaacaggacaugguagcugaaaucccguacuuggggaacugaaggacuauaauaaauuccaaauaacgaaaucacguccagacuucucaccaaaaaggaguuuuaaguccagucugagcuacauggucagugggcuaacuacaugguaacuucuaggccagccugucagauauuaagaccucaugucaaauuaaaaaaauaaaaagaaacaaaaacagaaguaugccaauauguacccgcagaucaagaccuccuuaacuccacuacugccuggcauccuuaccacaagguuggcuccagacugguacauuucauagggauaaacaaugcguucauagugagagcguagcaaggaaccaauguuuuugccagguggguaguugagacgcugggccacacgggcccaucgacgguccuugcagauaguuucauaaccaccuucuuccaccacaaucugaaaggaagagcaggaagggacaugaugcacuguguaugugaccaugcagaagguaggccuacaggaaggguaaggaaaacaacugcagccucucacuucaccaggagcuaccccuucucccaaucucaaacugcugcaagaggugguaaaacacgcugaugugcuaccagucuaccccuuccauuauagcccagagacacgguauccaaagcaaaagggguccuaaaguagcauggguuuauugaauauuugagaaaaaccuguucuuacuuugcugaggcuauagagguccaagauccgccguucuacauugggaaucuuuaaggaugagcccuggaucucccagaauuuggcaaucugguccaaauaguucaguuucacucuugucugggccuaaaggagaaauggcucaaaaacacuggccaccacccacccauuaccaucaauacuccaucccaccccaccccuccccccaacacuccacagugacccaucuucuggcuaaaacuuaggggaagagaaagggaacaaaguagacuucucccaaugaaaugagauuuguacucuagacaguccuuggccuugcuuuucucucguuucccaggugaaggucauuacagucuuuauauaucuuuccucccauucuugugacaagguugucuauauauuauuauaucuuguacagaugaaaaaucagggccaaaagaguuaauucacacaagccccaagauacauguauaucaaauaccucuaagcuuugcuuucucucugcuacuacugauuugcugcauuugagcaaaugaguaccacucacugcauccccauauuuuuauuagaaaauaagugccaggcaugguagcucacacccguaaaucccaccauuugaaaaguagaggcaggaagaugaguucaagucuagccuccauuacauaugagauuugaggccugccuggguuacucgagacacugucucaaaacaaacaauaggaaaaggaaaauagcacacuuaccccagagauacagaauuaagaagagcagugaggaccaccuagaaacuucagaauuguaucuaaguucuacauagggcuccagaaaagcauauucaucuccuuuuguaccacacaaaauauuuugugguggcugaauuaugagaauggccugaagaacuaaaaugacauacuggcuaacucaagaccugauauggaugaaagauccuagaauaaggcuguccaugcuuaacugaaaucucaaguggccuaagaaggguucucaaagguccuaagucuguaacuuuaucacuugagucccagucuagagaaccagguuacauguaggucaguuuuuugagucuuaguugagaagaauuaagguaagaaauaaacuaaagccccuuggcuguaaaaauccuuaaggggcaaacaccuuccaucugaaccccuuaucuuucuaaacuuggccucaucccugcuccuuccuccccucauuaacuagcaagaaaucucuguaagacugcccuuguucggugcuagguaauaccugcccacagauguaccacccacagaccuaguuacauuuauuucuccaaggaacucauaccacauacaacacauuacucuuguucugacuugaacaauaucaggcuugagacuguccugggaugauaagaguggauauccuaaagcugguuuuagguauaguucuagaauuuuucauagaagauacaaguuaaauguauguucccuucccacuaauuaauuaauuccuauuaauauguaccuuugagucuuauuaaauauucuaguagaguacugggcccagaugaauaccaguaccguaauauauauauauauaucauuccagcaucuaguguguguguguguguguguguguguguguguguguauguauguauguauacacacacacacacacacacacacuaaccauuccagccucuacaaagaccaguuccugugcucuuuuaccuuaccauccacucuaccaaguaugaaagaaggaauguaagaagcacagagccauggauaaaucagauauauaagauauauaaggccacaauaagcuggucaaggaaggaaggucucagcuaccuuuugcugauccagguaacguagguacuaauagggaaaacucuuaaauaacaaaguuuuauggggaaaagagcauucccagccuuugggcuaucaaauaaaaaacgcgaauuccugcccuuauaucuggagcuccgaagcugcuucuacguccuaggcacgcuuauccuuucuccaaaucccaucaccagcugcuaaucucaccuccagcucauucaaccucuggauucggggaguaaaccugaaguuauccacuuccacggcaaaggguggcugccaguccuaggagaaaaaaaaggggaaaggaacuuggguuauccuacuuuaaugcaagaucagacagcaucaaaagcagcgccauaauccauuaauaccuccuaaaacuucuagccaccucagaucuaucaaccugggaagcauccaaauggacccacucccaacucuaccuaagacuuauaacagggcauaaaagccccucaggcccauauucaaggccgcauguacaugcccugguaaacuucuaagucuuccccaacaguacagugcuaggauuuugacaaauaaaaaaagcucaaaucaguuaaccacaaacccuccucacacccacauugucacccuucccugggcaggacacauagcccagaguucuggcaaccaugcaggaccuggagacaggagauguggguucauauuguagcucuacugcuuacuagcuaugagcucuuaccuuucugaaucuguuuucuuaucuguaaggugggcauaugaauucuugccuuggcuuccucacuaaaucuaaauaaaaucuaaaucuaaaucucuaaaucugaccccaccaaugaauacacaugcagaguagcucagcucugguucaggcagggauuaauacuuuaggccaucaaugccuguuuucucaguuaaaggcucacagaagacacugcagggaagaccaaggaagaugaaucugcaccucuuacucacuccccagguuggaaaggcuuccuguggguccucucucauauacuugucugcuguaagaggcggggaaagaagucugggagugagugggaagcccaaaagugguggcaacgaaugcaagaauuuacagaggggaagccaggaaaaaauuaaugaaagcagggaaagcuuuacccugccaagcuggaguuuuuucuguccuacccaaaagauagcuaugaagacuccccuucugcagccucaugaaugcuuccccagagaguccucucucuccccuggagcucuggugcuuaagaaaugguaaaaggguuggugagauggcucagcggguaagagcacugacugcucuuccaaagguccugaguucaaaucccagcaagcacaugauggcucacaaccauccauaaugagaucugacgcccccuucugguaugucugaagacagcuacaguguacuuauguauaauaauaauaaaucuuuaggccaggagugagugggguaguccggagccccauccggagugagcagcuuucauucccagcaaccacaugauggcucacaaccaucaguacaacuacucauauacauaaaauaaauaaaucuuuaaaaaaauuuuaaaaugguuaaaaaaaaaagacccuaaaauaaccuagaucaacgucuucauuuuacagacguggaaaguaaggcuaggagaggaaauccuaugcuaguuagcagcagagccaacacuagaacccauguccucugaucgcugguucuuucuacuacacuaagcuaccagcauucacacacaagugaacacauauggaaggacagaaaagguauaggaaaagagagaaagagcuguugaucucuguaugcaggcucuuucucuuaaaaaaaggaaccagaggccucauauuugcaagugcacacauucuuccccaacccaugguaauagacagaaagcacuugaggcugacgaaagcaggaggggugaaaaaaaaaaaaaaaaaaaaaaaaaaaacaaaccuuaggcuaaaaugcuacggcuuaagccaggugaagcuuuccauacccucuuaucucccaucagacaacacuccccucagcacagauaacccagacagaaaggugcucaaaccccaaacucuaagcacugcuuuucucugcucugccaaguucuaaacaauuugaaguccuaaggcaggagcuauaggugcaacaguagauggggaagguccaacaaaccucucaucucaguccuguauuaguacaaaugcucaagaugauggcauuucgaauguggugacaaacaggauggcgaauucaagaaguugugugaugccaccauuaacuacccuguccuccauccaucuaugccaaguguagcaagcagccacaugcuaugaaacacaaacccaaaaccaccccucuaagaaaaacuccaauaccuacucacacacagguuugcauccugggccuaagaaucacuugggugaguaauucaaguuccaaacagaagaaagccaacugcuuuagagccuaaaggugguuuaagagaauugugggcacguacacaaaaucaugaacaacaaaaacaaaagucaggacuggaaagaaucaaagcuacuggaguggagaaaagaagccuaccaaagaacaguccccuggggacaaacggacagauggacagaugaacagauggacgaaaggauggacacacacaccgauguccuugucauuucuuccauccugguuccccaagacaagguaagagcaccuacauaaggccaaccugcccaaaagcccaagggagaaaaaagggaaauugagaccucaauuauccccauauuaggcgucuccugaccacgucaaggaauauuuccauaaggccauccaggaguccaaccuuucccuucugcuagccuuccuggcuugucacuaauagcugugacucccucacaacagaaacccaucuucagacaccugugaccaacaaggacucuagacucuagggcccggaggauccaucuaaaaccagccuaugaaagggcaacaaaagcacugaauuggauaagaagaccuaagaugcucuugucaagugggaauaaggcuuccacauccagaagcaccuccucgaagauacauuguugcggauaaauucaaaccagcccaggaaucucaagugguuacuaaacacuguucaccauuguuuccuccagugugucagcaaggcagcagccuguccuagccuuuggaaaacuuccccugggcuagucaggacuagaagcaacaauaugguccuuuuugcugaacauuugggaagcaaaggaagauuuccauaucuccacuauuguuccuggggacccaagaaaaccuuaucuuauaggaucaucuacauucugagccugagguagaauccagaucuucugagaaggccauaccaagcuaacuggucuaaacuucuccauaggaaggcuguggggaccaugugcaagaagguucugacauuaccuucaacuagaaaacgcaggagccagaaagagcacucccugugagaaugauuuccugacuggccaccaggcuaggauauuaucagagaugaauuggccugacagcgugaguaaacaugagucaacacacacagaagcaaaccaaugaccacaucaagcaccuucacagucacaguaauuaccacuuaccagagugcacuauguuaccugguuuaaucuaauuauucccagcacacaauucacaggcucagggauuacuuuacaugcccaaggucauacagcugcuaaccuucuaaguaguuuuaaacucacgucugacucccuuuugagacgugaucuuuccacuacaccacacagcuugccuuaaagggaauaaugacaguagucguuacuuuguaacugccucgaccagggugauacaaaguaaaagaugggagucucugugccucccugcgaacucuccccagcccauuaagcaucuguguauugaaucaagggaaauucucaagagcagagugggagugggucucagaccccaggucacuuguaugccacaaaacgaggagcccugaccccagcacccuuuuuccgcuucgugaggcauccacaaaauaccagccaucccauauucuucccacaccugcugcccuccgcccgggacuucaccacuggcuacccggauccacccacaaacucgccgcuggcgaccaucagcucccagccuuaccgcgggugggcggaucuugcaaaugccggacuucucggcgaugggucugauuuucgcgauguagccaagagggucucggaacucggcccagcuaggcucgaacaccggacacuccggcggcgguaggaaaucgucggaccccagcuccauggugggcccgagggcugggccagagaucgggagggcucaggucgcccuuaaggacgcauggcgccgccgcugucugaaaccgagguacuucucggagucuaggcccuaagcaggacggccaccgcccgucaagggcuuaggggggcgggugccgugcucuaaaagucucaggcugagguuccuuuuacagguucuuaguccuguuccguuucuuccacaccuuaccgcugccucccaacuacugaagccuucacuacuacaguuaagucccagucgcggcagguuucaccgcugccaccgccaucuugguuugucagcgucuccucccccccacc

SEQ ID NO: 9788 - RNA, 3402 nt, Mus musculus
cuggcuugcucaucaugacuugcucagccuacauacugcacccaggaccaccagcccagggauggcacagcccugugagcuagguccugcaauaucagacgucaauaaagaaaaugcacccugggcuugcccaaaggccaaucugaagggggccauuuuucaauugggcuuucccuccuccucugggagagcaccgagugggcaaguuuuaccucagagucauuuaguuuacagacaccaucuugcugcuacauccuaccagacaguucacuccugccaggguagcaccugaggaugcagggguggaaagagauacugcuucuauuaaggacaaaucucucucccuccuccccuguuccccauucuccucucuuacugagacagagucaguaucccuggcuguccuggaacucacuauguaggccaggcuggccucaaacucacaggaggccugccucugccuccugagugcuuggauuaaagaugugccaccacauccagcaucuaaauuccucucuuggcccaacucugcauuucuuccuguguagcuuuucagugucuccacugugccuuaaaucauguccaaacacuagguuuagugaguuuuuuuccccaaucuaccugaaaguaccuauucugagaguuccuggaggagaaaaacaagaaccaggucugaguccucugcuacuucaaggcuggggguugggagggugggaaucuuguauggucaguucagaaagaggcagaucaagcagcauuuccagcccuacacugcuugugaauucuguuccuuaugcacuguaugaagucugcugauccaggaugacacucuggaagucauuugggucuggaccaagaccaccagagcccugaaagagaaacauuaaccauguguccuagaccugaaauuagggggugcuuaaauccugggugccacacucaaguauguaagauacuuggcaaguucugaguaagcauauaaggaauagaccccuaggauaauacgcugggcccagccaaaacaugacaggguuguaauaaccauuuucgaugcaaaauaaagcccuauuuauuucagaggggggucuaaguauggugugccaccaggcuauuguucauaauggaacuguuagucaacugggacaucagcaaugccagcuagguagaagcuuguauugcuauuguucuguggcaucauugccaugccugucuguguucaguguguauuacuguaaagcaguaacaugguuggcacauaccuuuaaaaccaaaccuauggaaguaagagcagguaagauugcaaauuugaaacuagccugaguuguagaaugggacccugucucaaacaaaagucaaaacugccauuuagcugacuucaaggucauucacaggcauccaucaagaugucagccagugcagcugucaucuucuggcauauuggguuaggauguacuuagaaguucuguaguuggcaggacucaguuucuuacaaguucaguuucuugaauguggguggauuuuucacagggcagcucacaauauggcugauugcuucaugagaucaagaugggcaagaaacagaaaugacuaucucagaaauaacauuccauuguuuuugcaauugacaauauuaauuagaagccauuaggaggggaaaggggggaaggucuagaccauauucagaaggaaggaauuaagaggaugggguucauugggggggucaucuuggaaaugaacuauuaugguuugcucucugauacuuaauuucauuaauguuccauccauguacaaaauauaucuacuccuuaaguuuucuuaagucccaucccauuacugcauaaccucaaaggugcuaaauaugaaugaauugccuugggcacaaucccuacauauggcucaaguacuguuuuucucuauggauggaacugugaaauguaaaaauacgcauuauccgucccuaccacuuccuaauauacaauggugggaaggcauauacagacauuccaguucaaaaagggcaaaggauaugugugugccuguagcaguuggaaacaggagcuguuuccaaacugguccguuacaaguuaaauccaucugggcauaugaaguuccuugaauugauuccaaaacugaggaugguuuuucauaccccugucucugcuuucugggcucuugcugucaccugugauuuuuuucaugagagguagcacaugcuugcaaccaagauuuuuuuuucuguuuccugccagaauuuuggagggccaggacugacuucuugcagugcauguguaaucaauuaucaucaaggcaaaggacuucuuuuuggcauguugagcauucaacaguaaacuacaaugagauuggccuucagggcaacccugacuuagagcccaugccugcuaucauggccacuuuguucagaagccuauuggcaaagauaacggugacaggauagagauuggccacacccauagaauggaauaucucuuuugagauuuucuauacuggugcuuguuuacgugggucaugaaaauucucacugugcucauuccaaaauggacagcuauuugcauaggccuuuuuccucagaugucucuucaacauuucagucuuguuauuuccaaauccuugacuguaugcagacaugaaccagcaagcugucuaugcuuuugacuguuucuguaauaguaacccaaaguggagcuguaacucugaaacuagccacuuguagcagaggcuagcauguccugcagaacaucuguaagccaagcgugaauauuguaucccucaguugucuggucucaaggaaacuccccauggggucucaaaggaggaaaaaaggaugacaauguagcaagugugaguuuccagaccugcacauaauuuuagcggacaugauggaacaguugcaaauuauuguuugaugucauggacucagauguucauuugagaaaaugaaaaaguccacuuuucuauuuuuauuuuucuuugcuucugagaucuugcuacuugcaguuuugcccuccauuuuuguuuguuuugucuuauaaauauguuguaucuugggccagugagauggcccaguggguaaaaguacuugcuacacgagccugguggccugaauucaaucccagggauccacgcgguaagagagaaucaacucaugcaaguuguccuggucaccauuugugugcgugcacacauaaaauagauguaauaaaaauaauuuuuaaaauguuguaucucuuuauuauuuccuguugaaucccagaggagaaaugagucuuccuccccuaccagggcccuucucuucuuuaugucauguauauuguguauauuuacaugauguauccagaaacuggaaaaaucuccuggaccaauaaaaugacucaggacaaaaac

SEQ ID NO: 9789 - RNA, 1932 nt, Mus musculus
uaaaacuuagcaaguuuuguuuacauucccuucaggguguuugcaauuguuucuacuauuacuuucuuauuuugacuuucugcuacuuuuuucuaugcuuccuuuucuccuuuuucaccugcuuuuuuguuuuuguuuuguuuuuuaguuuuaagguuuuuuuuuucuauuuucuacucuuugguuauccuugacauucuaccaugaacuuacaaaguucaaacaauauuuucaguguucuugaagagcgcaggauggugagaaaccugauuuuagucauuccucugcucagcacuugauuuuguuuucaaguauaugaauuuauuccuuguuuuuugcuuguuuguuugugaucucagaguuauauaugaucgguauuguuuauuauagacaggcaguauuuguucggcugcacaugcauacauucuugcaucucagacucccccccccccuuauggcauuauucucuuuccuuaugaauauaguguuugucuacuguuuuaguucagcucuccaguauuaaauuccccaaaucuuugcugugaguuaaaggcuuuaucuucauccuuaggagaguuugcucaaccuuuaaaauacguguauaugccuuguugccuuuaaaaaguacaucaccagucuaauugugguuugcuuucauuagguuagugaguggggugcacaaggaauacugcgcuuucauucuaacguguuuagacuuguuacuuuuuuauuuauucugcuuuugaaauguguuucaugacuuaguagaugcacuuuuuuauaauuucuggaaaguucucaacuauuaaagucuuucugguuuauuuuuuuccucaaaauccaacugcccauauuuugugccuccuaauuaauucuguuuuucauaacuccuaacaacucuuugauauuuucugucuccuuguacuucauuuggggacauuucaucagguauagguuuuaguuuauucucuucuccagcuauguuuaauuugccuucuacuuuuuccauugaguuuauuuuguguuuuucuuuguaaaagguucguuuacuuucuagucuuucugaucccuaauuaagucauuuguugcuugcucaaauugugauuacaucuacuacuucuuuaaguauaauuuuuguuaaaucagaauucacuuuuuuguguauggcauuguaaauauuguucacaucugaacuacacagcacacugacuauaucaucucuacugcuuuuuguuuuccuaaaauucaguguucuaggagguuuuuuuuuuucuuuuccuaguguuguagcacuugcuacuaauucucaguaauucuauaagaguuaaaaauucuucuuagaaauuauuuguggaauccaaaucagaucauaccccuagccugcucaaaauucucccaugacccccaauuccuucaguacacuagccagaaucuucuccauggacuagauguuccuacacaggcuagauccuguaccuccuucaucuuguugcuaucacccucacucuucucuagcuauccuggccuuuuuuuccuauuccucaagcaugcuagggaccuuccaccugcaggacuucuguauuuccuguuuuuccuaccugagacauccuucuuccuaaauacuuugaugacuuaacuaagucuuucuauuauguuuuuccuagagaaguauuuccuaacuaacauauauaaaacagcccuguccaucuccauguugugucauauccuauuuuauguuaugucuucuacaaagcacugaucacuauuugauaaaucuuuauuuauugugguuaguguuuguuucuaccaaauaagcuguaagcuccucaaagcagagauuucuguguuguuuacugcuguaacuccagugucaagagcaguguguaauaauauucagugaaaacucaauaaaauauuuguggaauaaaguga

SEQ ID NO: 9790 - RNA, 30742 nt, Mus musculus
aaugggagcugaggagcccgugguaagugguggagcaucgcuauccugccaggguucgguggagcauugcgugaagcgucugcgugucugcgagaucuugcugugggccagguauccauucuccugcggcagcuuagacccuacggagacuagagguaucccaagagaagcaguaaagauggggugguggguuagaaaacggcgggaggggagagaacggcccagaacgcguguggggagggaccuggcgcgcuuuuaccugggcggccuuucgacucuagguccgugggugguggaggauccuuugcguagcaaaaaaagaaggcgagugccccugcauccucuccagacgguacccaggugaguauuacccucuugaacccaccacccgugcccacccucugggagccucccaaucccggucucuggggaaaagauuucgugcaggucugcugcucacgugauuguuuguguucuagucuugacuccauaucugccucuacccaacauuuucucucucugagacguacuaagauaucccagacucaggaggccuaauccuuaccugaccccuugaaaccagcuaugaaauuuuaaacuauccguuuuauucauuugggucuugguuucaucaucugccaaaugggggucugucucuaccugagccaaugcgcaugcuuggucccuaaaauuuuuuucaauaaauaauuaugauugugauugaaagaauauugauucucuuagucucugacuuuuuuucacccuugucugucucugacccucuccccacuggaccuuuuuuugaaugcuacuguccucucauuuuccacacugaaccuaacucuuuccuaucccuaaugugguuggagguacaauauauauaacaaugagaguggcccaaagguagggcacaaaacuggagccuggucuugagcuacuuguaagucucauugaggagucucuguuucuuggccuucucuguuaaacagguagaaacaccaaggauggggagaaauuuauauuaagcuacuuuucagccagcuuugaugguggugcaugacuacauucacagcauucaggaggauugccacaaguucaagaucagccucagcuacauaaugaguccaaaguaaaccuggguuacaauguaaaacacugucuugcccccccccaaccccaccaaaacauuuuuauuuuguugguuuuuuuuucaagaaaggguuuugcuguguaacagcccuagcugucuuagaaaucacucuguagcccaggauagccuugaacucacagagaacagcuugccuuugccuucugagugcugggauuaaagacaugcaccaccaccagggcuacaaaacaguuuaauagccauuauguaauguuggucaccacagauaguccaaggaucuucuaauuauauccccuuguaggccugagcaucuuuucuguccuuaucuaggaguucuucuagaucagacauuuugaaacucccugucaaguaucacaacucucuucccauuccuaugcuaauuuuuccauauucuugcuauaccuuugucauucugacaacuauagacccaauagucuauuuuaauaauguguaguuugccuccuucacuauuuuuuaaugaagagcauaaaaaguagacucugcauacacaauccucccacagcuuauaaugacauuuuaauuguaauauaauagagaaauuuuuuuguuuguuuuucaaggcaggguuucucuacguacagcacugguuguucuggaacucacuuuguaaaccaggcuggccucaaacucugccuccugaguguuggggcugaagaacaauguauaauaaaacaguaugcacuucaauacguaaaugcuuugauauaacuucacuaaaagaaauaauuuuacacauuauuucauguaucugacuuguacaugugacagcuacauguguauugauugaguggugacucagaaaccauauauaggauauaguuccuuuuccauaaaugaugaguaauucuucauaaaguucuaaacaaaagaacguguauguauaugucucuuuguuugguugcuagauuucuaaaaaagcgaguauaaaugaauauccuuguuuaguaacuccucuagccuuauguccuaccacucugcccuccuacuccauuucaccuauaauagccuccuuaagguuauuucaauguauuaggccuuccccucccuuucaaauaaauacucuuccccagauuauccacagaucucauucccucacuucagguuucuguugucauuuucuuguugagaucuaccaugaagauccugcuuaacaacuccauucuagucugaacacuaacccaacuuuauuaguucccauugcauuccaucuucuuacaucguacaguuaguuauguguugcuuaacaaugggaauauaaccugaggaaaauaucauuauguaauuuugucauugcgcaaaaauauagagugcuuacucaaacuaagaccuuugugacaucacagaggauacaauuuuaugggaugaacgucauuuaagcaggccauuguugaccauaacuucauuauauaguguauggcuguauguuauuuacuucuauuguauuuguaguuuguugucuaauuauccacucaauuguaagcucuagaaaaggggacggguuuuugucuuuuucuuuuuuuacuuacugaugggucuguaguaccuaaaacacuucuugguacuugacaggcuuucuuuaaauguuggucacguggauaaauuagaaaugaauaagcagacuucuuuaaacuuaaauaaugguuuggugagccaaucuaaaguuguauggaugugguacaauucuuugcuauguggugcugucugguguacugcagaacguugggcaucuaccagagauaguagaugcccacuaauggcacuaaggcucuccaauaaucaugccaguuagaaauccccaccccaccccgaaacacucuuugacuugagcagugaucuggcuuuccacugaacacucuugcccacccuuguagccuucuaauacuccacugugugaggggugggaguagguauccuugauucuaauugcccuuuccacguauuuucuuucuuuucuuuuuaacccuguuuuuguuuucugauuacuuucagugcuggggagugaacucauguucucucacaugcuaggcaagcacuccaccacugagcuauauccaaacccuguuuucagaaaguuuuuuuaguuuuauuuuuuuagauuuauucauuuuuucauauguaugaguauucagccguuauguauguacaugcacuguaugugugccuggugcagaaaaaagucagaagagagcaccgggccucuggaucugggguuauggauaguugggagucaccacauaggugcugggaauugaaccuagguccucugaaagagcaacaggugcuuucagccucugagccaucucuacagcccuauguuuucauuuuuuguuuguuuuguuuuucaagauaagguuucucuguguagugcuggcuguugugaaacucauucuguagaccaggcuagccugaaacucagauccaccugccucugccucugccuccaccugccucugccucccaagggcugggauuaaaggugugcgccaccacugccugacuguguuuucauauuuuuaaaaagauauauuuauuuuuuauguguuuugcugacaugugaaugcacugcccacagaggccagaagagggcauaguauucucuggaacuggaguuacaggugguuugcaagaucucucuccagccugaguuuucagaauuuuuaaacuuuuuggaagaguuucaauauauacuucagucaaaauacccaaauuagauaauugucauucagucauguuuccucaucuggaacaguucuuuuagucuuuuuuuuguauuucuuuuuguuuuuuaagacagaaucucucuacuuaucccugguuguccuagaacucucuauauagaccaggcuggccucaaacucacgaagauucaccugccucugucuccugagugcugggauuaaaggaauaccaccacucuuagaugaauuuguuauuuuucuaaguauccuggcuaguuauuugauagaauucagguuuguguaaguuuuguugugauuauauuaguuuuaaggucugcauuuuaggcaugcauaccagaagauauguuacauguuuguuguuauaucaggagagacaugguaacauuuuguccuaauauuuuguuuguuuguuuguuuguuuguuuguuuuuggcugggagccagaacggccuggaaugguuugaaguaggacacagaauuggacauauuuuuaaaaacugauggugucagagguagcuuuaaagacugguggucucuggccuucgagcucucuagcuauaaugaaugcuugcugauaacuucuaaaauguccuacuaaaaaauuucuugcuuauucugugguuaaaaaccacuggcuugggcaauuaacaccuguugccuagcagcggguacauuucuccuuuuuucuguccaggcagccagaagccucucuugcuaggcugguuaacucuuugugaaccagagaggaaggaaaaaaaaagaacuaagauguguuauacaggcagauauggacacagaaacauauacauucauacauacauuuagauucucauucacauucucauuugcacauuaacacauucacauuuuuguugggcccaaccacccgucucauauauuccacaaguauuuauacaugcuuacauacauauacacauauaucuacaaauguauguacagagaaacaggcauauacauuggauggauggauggguggguggauggguggggcauacucccccccaagccaaaccauccaaccaacaauuuuauuuauuuucuuuggucuuuuuaaaccuucucagacaaaauguucuuuagaaaaucaccucagagauaagauguuacguaaaaugggaguuacagaaggauguuaauauuaaguucaaggcaauaguuuuuacauggcugugccuuaucauagugcacaccugugacuucacccuuggaccugaaugcuuuuccuugaacacaaauuugucccaaguuuaauucucuuuuuaguguaauuaagaaagcucauuguuccacgagauccagcugcaaggcauuuucucaauuagugaucaaggagggagucuuguggguggugccaucucugggcugguagucuugguucuauaagagagcaggcugagcaagccaggggaagcaagccaguaaagagcaucccuccauggccucugcaucagcuccugauuccugaccugcuugaguuccagucuugacuuccuuugaugcugaacagcaguauggaaguguaagccaaauaaacccuuuccuccccaccccaccccccccaaaaaagaaaucucauuguauuucuuauuaugcagccuuuacuauuaugaggagugggcacguucuauucuugagucuaacuuuguuacaucuuucuagcaaagugacuaagaccaucucuuaaaaccuucuuccuaaaauuauuugaaucaaaucaggaauucuauaaggucauuaacucaucuaaacagcauuaauucaugaaaguucaucuuuuuguugaucugcaggaaaucugaucacuagggugggcuaaugcccagggauuauuauauuauuuaaugaugagagggaaggcauaucaggugcaagaagcaauccugaaaucaacucucuuuggaaccuugccaucgaguuaacccauuguagacuaaugcaaaaaugauaggccacuuccaggaaggcuaccugguagccuuaaccuauccuagauggcucuugacguuuuuuuuuuuuuuucuuuugcuuggacugcuuguucaaugugaugccugccgcguuccuucaccauaguuacauucguaugcuguaucacaauguuuuggccaacaacaaacugaaaauacggcacuggucucauaagauuaaucaucuaguggcaucauacacauugguuuguauaaguacaugcugauaaaagggaacacgugagaaaagcaucaccaugaacaagacugaccucaucugaucuuagaagcuaagcagguucagggccugauuagaaacaaauuuugauguguauuauucccagaguagcucaguugguagaacauaagacccuguaaaaggaccagugaguuucuuagaauguaucugcuguuaagcaacacauuacuguacuuauauugcauuuaucuauucaucuauuguguguauggguacacacaugccacacacagcacauauauggaggucaaaggacagcuugugggaaucaguucuuuccauacccaaugagugcucuggggaugaaauucagguaaugaggcuugacagcaaacacguuugcccaauaaagcccucaugcuagacccaaacucuaugugguugcuuuuguguuuguugccaaugacggaauccaggaauggugagcacugucccaaaccuguuguuuuucuucuguauaauuaauaagugauaaauguauauuaaacuacucugcuucaaaucuuaaacuauucaccgcuccccuauguuaguuguacguacacaugacaaacagcugccccugccacuccucauuccuagaauuugaccccaugaacucuucgcuucccuuccucccugguacuguaauucagaaccuugcacaugcugggcaggagcuuaucuacaaugcuagucacugccacccacuuuuucccccuccauccccuucuaggcuaacuguaggugauuuuaaucuccuuagagauggucuuucucaguucucaguucugugccccauuuuccucucugcugaaaucuccaugcuuugguccucaugcucgggugcucaggccuguugcuuaccuaacauguaaagcuuucagaaacaaaugucuaucacucaggcugaagcaugagaacccucagugccaggcagagucuggguacaaaaguucaagcaagauccuaucucacaaaaagaaggaaaggaggucccuagauccccacuaucugcuguguaccacgugaauucauuuaccucgucuuaaucauuucuugcugucauuaaaaucaaaucuuuccacuucaauuuuuuaaaaagucccauauucucuuguguguuuucucccgagacagggucucgcuuuucagaucuagcuguuguggaccucacugagauccccaucugccuacaaagugcugggauuaaaggugcguaccacuaugccuggcaaaaagccccauauugucuugaggacaucucuucaccaguuuuaucucccauauaaaacagcauuaacacacaaauguucucuuacuacuucccaucuuuucuagucccauauuucuagugcugagaauugagcuaucucaaaugcuaagcauacaccuuaccacuaagccacacccucugccuacuuccaucuuuuuugucacaacuuuagugagauguauuuuacaugcuguaaaauuuaacuuuuuuuaaaauuuuuauuuauuuauuauauguaaguacacuguagcugucuucagacacuccagaagagggcaucagauuucguuacggaugguugugauccaccaugugguugcugggauuugaacuugggaccuuuggaagagcaguuggugcucuuaaccacugagccaucucuccagcccuaaaauuuaacuuuuugaaagguauucagugguuguaguauauucaugacaugcaacaaucagcaugaucaaucucuugaaccuuuuuauccuugucuccugcuaaaguugcuucauacucauuauuagucaguuccuaguauuuuucucccugcuccucccccaccuccauaguccauauaaaugauuccauguaaccaagcaugauagauagugugugccuuuaguuucaguacaugagaaguggaagcaggcagaccugugugaguucaugagcagccuggucuacauagcaagcuccaagccagccagcucuacauaugacugucucaaaaauuaaaaaaaaaaaaaagauuccauguguaauauacugcacuggccucuuucacuuaaaaauaauguuuuccaggggcuaaggaaauggcucagucaguacagugcuugcuguacaagcacgaggaggaccugaguucaaccccaagaacccauguaaaaaaccccaggcauugugguacacacuuguauucuguccacugggaaaggaaagcuaggcugguccacggggcucaauaauggcuugggcagccuagcuuacuugucgcuccagaccagugaaagaucauaucucaaaaaugaggugaguggcaccuaaagugagacacucaagauugaccuuuggucuccaugugcacaugcacaaaaaaauguuuuccaaguucauccauguuguuauauauguugcuuauuuuuauuacaagauaauauucuauuguacggauauucuguguuuuguguauccauuggucaguugauaagcauuucagcuucuauauuuuugcagauuuucuugaaugucuguguggaaguguuuaugugaauguuuucuucucuccuuaauagaaucacugugucguauggcaucuauauuuaacuuuucugaggaaaacuuguuuguacaggugccucuaccauuuuguauccacuaacaauguaagcauguggcaguuucuccacaucgucaucagcacauuguuuugccguuuuguuuuuguucugccuuugaauauagauauucuaguaaguauaaaauaguaucucaugaugguuuugauuuucauuucauaauagugcucugaaauccccuuuucugcauuuauucucuuuguguauaaucauuaaagaaauaucuauuuaaacacuuagucauuuuuaauuggauuauuuauuauccuuacagucuugagguaugagaaguuuuuguuuuugcuuugauaucugaauagaagacccuugucaaaaauaguaauugcaaauacuuuguccugaucucuggguuguccuuuuguuuucuucacugugucuuuuuucccccuaagacaaggucucucuguguaucccuggcuguccuggaauuuguuguauauaccacgcugggcuugaauucagacaucugccuuccucucugccucuuugauacacagaaauuuuacauuuugaugaaguccaauuaauaucuuuuuccauuugucacuugggcuuuuggugugguccaagaaaucauuguuuaacucgguaucacaaagauggauuucuguguuuucuucuaggaacuuuauagcuuuaggucuucauauuuagauugaugagccauuuaacuuaauuuuucuguuuggugugaaguagggcucugucuuaaucuauuuuguguugcuacaacagaauggcugaaacuggguaauuuauaaagaaaagaaacuuguucacuguucuugaggccaagaaguccaagaccaagggugagcgccuucuugcugucagaacagacacuguguaauggaaacaggucucuuucucuucuuaggaagucacacaucacuauaucauccuuagugagguaacucaaucacaaaagaagucacaugauaugcacucacugauaaguggauauuagcccagaaacauagaacacccaagauacaauuugcaaaacacaagaaaaucaagaagagggaagaccaauggguggauacuucauuccuccuuagaauagggaacgaaauacccaugaaaggaguuacagagacaaaguuuggagcuaagacgaaaggaugggcuauccagagacuaccccacccagggguccaucccauaaucagccaccaaacccagacacuauugcauaugccagcaagauuuugaugaaggauagcauuugaaauuugaaauguauauaaagaaaauaucuaauuaaaaaaaaaaagaaagucacacaucugcucauggggacccacuaucgagccucacaacauucugauuaccuuacaguggccucacuuccaaacacuaucaguauggaggauuaaguuuccaacacaugaacuuccggaggacacauucaaacaauaguggguacauauucuuuccuauaauagagauaucuaauugucuuggcaccuuuuguugaaaaggaaauuauuuuccccacuacauugucuugacaacuaugucuaagucaauggacuauauuuuauaaauauaaagguuaaugucuggacucuaaauuucauuuaucuauaugcuuuaucacucacuacacaagguauugucuuuauuacuugcuauauuugaguagcauguuuaaaauuaaaaaaaaauaugaguacuccaauuuuguacuuuuaaaagcuuauuuuggcuauugaaggcccuuacuuuaccauaugacuuucucuaucagcuuaucaguuucuuuuuaauuuugauuauuuuagcacauuauaugucuagcuagcaguuuaucuaguguucuagauuuuccaggagugguugaaguuuaauuguggguugagaguauuuaaucucguauuuguuuuuaagacaaggucugucuguguaucccuuacuaagcuagaacuugcuauauagaugaggaugcucuuuaacuuacacagauccuucuauugcugcccccaaacgcugugauuagaagcauguagcacuaugccuggcuggaauauauuuucaaaauauucccuaauaagagacaggaggauuucugugacuuugaggucagcuuggucuacauagugaguucuaggacaaccagagauacaugaugaaucccugucucaaaaacagaaaguauucucuaaugauccucuagauuguauuaaaauuaauuguaauauuccuuuuuccaucucugaucuuaauuaauucucacauuucuugucuuuaguuuggcuagggguucacugcucuuguuuuuuucuuuuccuuauguuuuuuuuaaagauuuauuuauuuuauguauaugacuacacuguagcugucuucagacacacacuagaagagggcaucagauuccauugcagauggugugagccaccauguaguuacuaggaacugaacucaggaccucuggaagagcagucagugcucuuaaccacugagccaucuucucuagccuccuucuauuguucuuuuagucuccauuucacuaauuucugccauaaccuuuuauaaaaucugucucuguaugcauguuuguguaugcaugcgcaagugcgugcauacacacacacacacacacacacacacacacaugccugcacucucaagcuaacuacuguuaucuguggaacccacaggugucaggucucccuggaguugcagaugguugugagccauccuguauuucucugugcagucguacugucugggacucucuuuguagaccaggcugaccuggaacuuauagaaauccacuugccucugccucacgagugcuggaauuaaagacaugcaccaccacugcccagccaauuucucuuuuguguuaaauauauccuaccuacuuuuauuccuuuguaacuauguuuuaaguuaaauuuucagagauuacucuagguguuaacaauugaaauuacaacuugaaaugauauacuuuggguguguaucaaaagcuugcugugcugcugaggcaggaagugagcaagagccuguaguacacagcaaaaugcugucaaagaagggagugaggggaaagggggacuuucuccagaauaagaaaaaucauuaagagcugggugugguggugcacuccuuuaaucccagcacucaggaggcagaggcaggcagauuucugaguucaaggucagccuggucuacagagugaguuccaggacagccagggauguauagggaaacccugucucgaaaaaccaaaaaagaaaaagaaaaagaaaaaagaaaaaagaaaacaguuugcuucauaaaauucguguaaucuucaagcuauucauaugaaacaaacacaaauccguuuuuaugucuuccagguuugcuuugagcaucucgucauuaaaccauugaucguugagacuucuuucaaguaugagguuucuaacauuaguauuuucaagacuagggaugcaguucacugguaaagugauagagcaccugccgggcagucauaagguccagguucuuuccagagcacugcaaaaagguccacauagagagcuuugaaauuaucuucuaccaaaaaaaaaaacaaaaaaaaaaacaaaaaacaaaaacaacaaaagcggcccagcaagauagcuaaguggauaaggcaauuauagcagaugacucaguuuguuugauuccuagaaccuacguaaagguggaaggagaaagcaacucuagaaagcuguccucugaucuccauguguauaccaugauguguguacgggcacacacacacacacgggcacagagacaauaauaauuuaaaaauuaccuucuacauacuucaccucuacccucccgcugccucuccaccagcacaucuguugcugaaguaaacaaugaugugguuuacuaucuaaugggggaaaaaagcaaacccuuagauuucuaaaaugucaacuuucagccaauacaaaugaaaguauuuaagugaccaaaacuuaacaguuaauagugaggaaaauauaaacuaugaagauuauuuugcuaaaacuucauacccuuuuuucuuuuuuuuucuuuucuuuuuucuuuuuuauuagauauuuucuucauuuacauuucaaaugcuauccccaaagcacccuauacccucaaccccgcccugcucuccaauccacccacuccugcuuuccuggcccuggcauuccccuguacuggggcauaugaucggggucugcaacccuauagguggaacaacaauaugaacuaaccaguaccccccagagcucgugucucuaguugcauauauagcagaggauggccuacucggccauuaaucggaggagaggcccuuggucuugcaaagaucauaccuuucaaguaacaaguauucucaaggggcuggagagauggcucagcaguuaagagcacugacugcucuuccauagguccugaguucaauucccagcaaccacaugguagcucacaaccaucuguagugggauccaaugaucucuucuggugugucuaaagacagcgacaguguacucacauacauggauuaaauaaauaaaucuuuaaaacaaaaaaguauucucaagauuagcacugaauucuguuuaguucauugugcauacacaauucuaaaccauacaaccucauuaaauauuacuuucuguuucaugguuuaauuuauuauuaaagaauuuccuuaaggggaaacaaauauuuuguguuauuugagaaacuagugggggccuuuaaucccuuagagaagaagaaagacauacuaugcaaaccaaaaucuaugaaaucaagaaacugauuucaccuuuuaaagaaaggaagcagagcaucuaauagacgaagggacucucauagaaauuaaggcaagcacaaauacagaggcuguaccauggcuuugacacagggaaaauaaauaaaauaaaacuuaauaaggcuucuugucagugauaugucaguguacaaaauagcagcauugggaucuagaguuuccuucguaaguuuauaaugauuaucaagcuuuuaaacauuuauuuaauuucaugaguauggauuugugccugaguguauguguaugcaccacauuugugcaagaggcauuagcucuccuggagcuggaguuacagacaguugugaaccagaguguggaugcuaggaacuaaacugauccucuggaagaacagugaagagccuuaaccacugagccaucucaccagcccuccagacauccuuuuugcauuuaccuuugagauguaccuucucuguuuaguaacaucugcuauacaaguauguguuuccuuuuuacccauacugaccuauguuuuauuucuauuacaagacacuuaaucauuuucuaaugguacauaguacaauucuaaucaacauuacauauaaagaauauugaaucuuuuuucuucaucuuuuuuuuaauuagguauuuucuuauuuuacauuucaaaaaagucccucauacccuccccccacccacuccccuacccacccacucccacuucuuggcccugguguuccccuguacugaggcauauaaaguuugcaagaccaaugggccucucuuuccacugauggccgacuaggccaucuucugauacauaugcagcuagagacacgagcucuggggguacugguuaguucauacguugacccaccuauaguguuguagaccccuuuagcuccuacgauacuuuaucuagcuccuucauugggggcccuguguuccaugcaauagcugacugugagcauccacuucuguguuugccaggcacuggcauagccucacaagagacaucuauaucaggguccuuucagcaaacucuugcugguguaugcaauggugucugcauuuggaggcugauuaugggauggaucccuggguguggcagucucuagaugauccauccuuuugacucagcuccaaacuuugucucuguaacuccuucuauggguguuuuguucccaauucuaagaagggauaaagugaccacacuuuggucuucguucuucuugaguuucauguguuuugcaacuuguaucuuggguauuccaaguuucugggcuaauauccacuuaucagugaguacauuucauuugaguucuuuugugauuggguuaccucacucaggaugaugcccuccagguccauccauuugccuaggaauuucauagauucauucuuuuuuuuuccauuuuuuauuagguauuuagcucauuuacauuuccaaugcuauaccaaaagucccccauacucaccccccccacuccccuacccacccacucccccuuuuuggcccuggcguucgcauauaaaguuugcaaguccaaugggccucucuuucaagugauggccuauuaggccaucuuuugauacauaugcaacuagagacaagagcuccggggaacugguugcaguucccuuuaguuccuugggugcuuucucuaguuccucagauucauucuuuuuaauagcugaguaguacuccauuguguaaauguaccacauuuucuguauccauuccucuguugaggggcaucuggguucuuuccagcuucuggcuauuauaaauaaggcugcuaugaacauaguggagcauguguccuuauuaccaguuggaacaucuucuggauauauucccaggagagguauucugggauccucugguaguacuauguucaauuuucugaggaaccgccagacugauuuccagagugguuguacaagcuugcaaucccaccuacaauggaggaguguuccucuuucuccacauccacgccagcaucugcugucaccugaauuuuugaucuuagccauucugacuggugugagguggaaucucaggguuguuuugauuugcauuucccugaugauuaaggauguugaacauuuuuucaggugcuucucugccauucgguauuuuucaggugagaauucuuuguucaguucugagccccauuuuuuaaugggguuauuugauuuucugaaguccaccuucuugaguucauuauauauguuggauauuaguccccuaucugauuuaggauagguaaagauccuuucccaaucuguugguggucuuuuugucuuauugacagugucuuuugccuugcagaaucuuuggaguuucauuaggucccauuugucaauucucgaucuuacagcacaagccauugcuguucuguuuaggaauuuuuccccugugcccauaucuucaaggcuuuuccccacuuucuccuccauaaguuucagugucucugguuuuauguggaguuccuuaauacacuuagauuugaccuuaguacaaggagauaaguauggaucgauucgcauucuucuacaugauaaccaccaguucugccagcaccauuuguugaaaaugcugucuuucuuccacuggaugguuuuagcucccuugucgaagaucaagugaccauaggaguguggguucauuucugggucuucaauucuauuccauuggucuacuugucugucgcuauaccaguaccaugcaguuuuuaucacaauugcucuguaguacagcuuuaggucaggcauggugauuccaccagagguucuuuuauccuugagaagaguuuuugcuauccuagguuuuuuguuauuccagaugaauuugcagauugcucuuucuaauucguugaagaauugaguuggaauuuugauggggauugcauugaaucuguagauugcuuuuggcaagauagccauuuuuacuauauuaauccugccaauccaugagcaugggagaucuuuccaucuucugagaucuucuuuaauuucuuucuucagagacuugaaguucuuaucauacagaucuuucacuuccuuaguuagagucacgucaagguauuuuauauuauuugugacuauugagaaggguguuguuucccuaauuucuuucucauccuguuuauccuuuguguagagaaaggccauugacuuguuugaguuaauuuuauauccagcuacuuuacugaagcuguuuaucagguuuaggaguucucuguuggaauuuuuaggaucacuuauauauacuaucauaucauccucaaauagugauauuuugacuucuuccuuucuaauuuguaucuccuugaucuccuuuuguuguugaauugcucuggcuagaacuucaaguacuauauugaauagguagggacuagccuugucuagucccugauuuuagugggauugcuuccagcuucucaccauuuacuuuguuguuggcuacugguuugcuguagguugcuuuuaucauguuuagguaugggccuugaauuccugaucuuuccaagacuuuaucaugaagggguguugaauuuuaucaaaugcuuuuuccucaucuacggagaugaucaugugguuuuugucuuugaguuuguuuauauaguggauuacauugauggauuuccguauauuaaaccaucccugcauccuuggaaugaaaccuacuuggucaggauggaugauuguuuugauguguucuuggauucgguuagcgggaauuuuauugaguauuuuugcauugauauucaugagggaaauuggucugacguucucuaucuuuggaauagugaaucuuaaaugaauacucuuaguacuuguagcaugauggguuuaauaguuuaagcauacuaggauagcuauauuacacuguuuaauucagagcuguagaauguuugacuuuuaaaguacaaggaagauucauaacugccauaugaauaaugaaauacuagaaacggugaauauuuaagugagguaauuguucauugguggccauucauaauuuuuccccuuagaaauaugaaaauaauuauuaucuuugaccuaaaaauguagauguagucauuuuuuuuagaauuaaguuuuuuuauuagggauguagucauuuuuaacuucuauaauaucuccuagaauuaguggaauaauugacuaaagaaaagguuucuuucuuuuuuaauuucuuuuauaggguuucuauacaguucuggcuuuccuuggccuaaaacucagugcucuuaaucaaggaucucaaacuuuuguuuguuuguuuguuuguuuguuuguuuguuuugagacagaguuucucuguguagcccuggcuguccuagaacucacucccaaaugcugggauuuaaggcauacaccaccacugccggaugaucucgaacuuuuuugugcugggauuaaaggcaauacuacaccuugcucaggacuauuuuauggucaaugauggcugucuguacugaagaucuccccacagaaaaccccuuugaagaugugcaugaugugaauuuucacaaacuuauuuguucuuguacuaugguuucuguccuaugcucaccaacauuguaaauaucacuacuucugacacuggccaaaacacuuaauagaauuagcuggggauagaaucaguagggauaccuggcuguuuggagccauagccaagcccugcaccacuucugcaagucuaaaggguauagacuuuggccugcuucaagggagaugcuaaggggguauacccagcccuaccuuucugaccccccccacacacacacacacagaauaagcucuucuggauagauggacacgccacaagcgaggugauauuggcugggauauaccuggacccucauucugcuagaauagccuagacuggaucuuauggaauguaagagauauaggggccagccuaucacuagguaagccuagagcaugugucuuuaguaucagcuugguaacuacagcagagagggcugaccgugggcugagacaagucagagaguacaaaggcuggccuagugcuagaguggaccugaaguuuggggcccagggucacuggggcauguuuggcuaugaaguaaauguaagcaugugaggucugauguaguacuuagacagguuugguacuuuggccauucuggagccuguggccauuuaaguccuccuggugugggcuugguucuaaacccaucaggagccugaagccuaaagccuugaggaaucuggugccgggaugggccuugaggaugucaucggguacugaccuagagucuaggaguguaauuagaugcccagaacugggcuugacuggagucaguucaguuuggguauccaaaacaagaaggcauuuucucaauugagauucccucuucucagaucucucuagcuuagaucaauuugacagaaaacuaacuagcauaaucauggagaggaaguccuaccaggaagagcuuagauuuauuuaguccaggaccuaacccaguaccaugguuccacccacaucuaaggugagucuuuucuucucuuaaucuggaaucuaaauucuagauaauccugagcagaucugcccagauuuguuuguucagugacucaaaauccugucagguugacaggauuaaucucauauuaaucaucacaacuccaucccuugucaacuuggcacccaaacacaucacuuucaaacuauaauuuucuaccccuugucccuaaaguguugugaauaucucacaaugcaauguuauguauuuaaaguccuuacagucuuuaacaguuucaacaguuucaaagucaagccaggugguggcagcagaggcugcuagaucucugaguuccaggacugccugaucuauagaguucguuccaguauagccaggacuguacagagaggcacugucucaaaaaaguucaguguucauaucucaugucagguucaaggcaaucucuuagaugugaugugaguuccuauaaaguaaaagccaaguuacguauuucuuguacauaauggcacagaauaaauguucuuguuccaaaagaaaagcauggggcauagcaaggaauaauuggaccaaaguaaaaaaaaaaaaaaaguauagaaacacaaacuccaagccgggcgugguggcgcaugccuuuaaucucagcacucgggaggcagaggcaagcagauuucugaguucaaggccagccuggucuacaaagugaguuccaggacagccagggcuacacagagaaacccugucuugaaaaaccaaaaaaaaaaaaaaaaaaaaaaagaguauagaaacacaaacuccugcaguuucaugcuaagcagcuggaagucaugauaaaauuaucugggcccaaagggcuugaguauccccacccuuccaucucugcuuccagcaguucauauaaccucuuagaguggcucaucacugccugcagaccucccauggcuuuaucuucacagcuucacacaguggcuuccuacuccuuucagagacuccagccuugucauacauugucuggccucaggccacagagcaagaguuugugaccuccuucaauccucuuucaugccuucaaagccagcagcaugugaacuacucugucaaguucuacuagcacagaaugagaacuggucccacuucuguguuauuugugacauugcuucaacaaaagcaaccuauagaaacuuuuuuugugugaaauauagcauuuuuauuaauuuguuugguauuucacacauauauauaggggcuuuggggagguugaugcuauguguuuuuguuuguuuguuuguuuguuuguuuuaaagaagaugucauuauggaggcuugguuggcccagaacucauacagaccuaccugccgcugccuuguguaugcugggauuaaaagguuuacuggggcuagacagauggcucagugguuaagaagagcacugacuagcucuuccagaaguccugaguucaauucccagcagccacaugguggcucacaaccaucuguaaugggacccaauguccuguucuggggugucugcaggguauacccacauacaugagacagaggaaggaaagagguaugcacaaccccacauguccuacuuacaauguauuucaaucauuucacacuccacucuuccuaacuuucaccauugccauccacauccaacuucauguccucuuuaauaucucccugauucuaauuuauguuucucauauacucauggccauccaccaggauauauauggucaaccuaccagaggccacaccagaaaacuaauucucuuucuuccagaagccaucaacugucaguagcuccucuauuagguguggagacucuugagccuuucuccuuccauacugggauauugacuggcuugaucuugugaguuuauaguacagcacuccugugguauccagaagacauuguuuagccuagugcucccugaacacugguucuuacaaucauucuauccccucuucuuugauagucaaaaagguuucuuuugacucacagucggagguuacaguccuuugugaugggaaggucguggcaaaagcuugaggcaguuuuccacauuguguucacaaucaggagcaguuauggauaaauacacugagcuuacugucuccuuuugauucagucuaggagcccaguguauagaaauggcaccauccaguuugggugggucuuuccagccauuauccuaaucuagauaaucccucacagacauccccaaagguuugaucuccaguauucuagauccugucaaguugacagucaguauuaaccaucguaugaacuaaugaguuuguuggagcuacuuuagaagcauggaugauugaaagucagcggcauugcugaaaugcccaccccagcauggaugauagcucacaaaagguaccucccuagaguucuuugccugcccuguaugaagcuccuaucaggacuuucuacuccccauuaauuucuuacugcuuuuauaaacuugggaagaggucuuguaaacuuacugaacuugcuggcccuuggaaaucugguuugguuuguuuuuuuaagauguauuuauuuauuauauguaaguacacuguagcugucuucagacacuccagaagagggagucagaucuccuuacggaugguugugagccaccaugugguugcucggauuugaacucaggaccuuuagaagagcagucgggugcucuuacccgcugagccaucucaccagccccauggaagucuguuuugcuucuucaauuucacaugcccaccuuucucccuuccagagaauguuucuuuuauuuuuuuaaauuuauuuauauacugugaauacacuguagcaguccucagacacaccagaagagggcaucagaucccauuacagaugguugagagccaccaugugguugcugggaauugaacucaggaccucuagaagagcagucagugcucuuaaccgaugagccaucucuccagcccccaggagaauguuucaauuccgaugaaauaacuacagaacacuauuauguaugguuuucugucauuuuauuuuuucacugauacuauaucccugagacucacaucuuuugcugcaugugguuguaguucacuauacuucaagugaugguaaaacaaauaauccauguuucuguucauggacauuugaguccuuuccagcuuuuugcucuuaaaaacagcacugcuuacauguucuuccgugugucucugcuuuccauacacagcucuuguucuaagguauauccaaucuaaggaggggguugcuaguuaauaggguauauaaaagucccaccugacaggguucugucaaacuguuuaaacuaugauacaacuugugcucuuuuuaauguauaaaagauucuauugacccacacccuuauaaaccugucucuuuugucaauauaguguaaagugaaauucuuuuguuuuggagucucauuuuuuuccacauggauaaccuaaugccaccucugucauacaucaauucuccuaaauuaguuacuuuucucauugcuauacucaaauaucugacaauaagcagguucagggugcaguccauccagggggcuggagacugucggcucauuaucucaguggauccaaaaacagaaacaaaggaaugucaacauucugcuggcugcuuuuuuugcuuuugcauuacucuggaccucagcccacaggcagugccacucacauucaggaugggucuuucuuucucaguuaagcaucucucuagucacccucauaaccacagccaagagauguaccucacuaauguucuaggccagguauuaauuaaucuaguaaaguuaaccgucaguauuagccacaguuugucugauaagucugauuauagacuuucuuugccguugccuaacuuuuugcccccaaaucacuaucacacucccuaaauuauuucaguuuccuaguaaauauugguauuuaacaaagcaaaacauuuccaccuuuuugcccauauauucugcuuacuuuauuuuuauuugcaagaaggucucacuauguagcucuggggggcccaaaacuauuuagaccgggcuagacucaaacucacagaaauucgccugccucuuucucccaauugcuggaauuaaagguguguacaaccauacucaaccuucuuuagauuuuuuaaaaauauauuucagaauccacuuguuauguuuuauaauguuuugggaauugcaguuacuauauaaaccaguuugaacauaauugaugcuuaugaaauuuagucagcuauaaacuuuggcauauucuucuauuuuaaauaaacuauuucaugucuuuuugucuaaguguaauuuuuuaaaaauaauuuuguuuagccuacagcacccaguauuauuucccauuucaaguacuaaccaagcucaacccugcuuagcuucugagaucagacaagaucaaccuguuuggggcaauauggcuauagauguuuuaugauuuuuuuauauaaaaccuuuuauauauuguauuagauauaccccuucauauuuuguggauuugugugcuguaauaagugaaaauuuuuuucucaugguauuggguauuaaauugaaagccucaugcauguccuaccaccuagcuauuccuugaauccaagagacacuuucacuuaauauauuuuuauccauuuucuagauauauaaaaaugaaauagaauuuuuuuuuuuuugguuuuucgagacagggucucucuguguagcccuggcuguccuggaacucacucuguagaccaggcuguccucgaacucagaaaucugccugacucugccuccugagugcugggauuaaaggcgugcaccaccaagccuggugaaauagaauuuuguugauaauuuuguucgcauaaucauucacuauauaaaccauuauugcugcugcuguugaucuauaaucuagguugaccuacaauuugcuauauagccaaagcugaccucaaacuaugauccucuugccucaacccccaaguacuagaauuuacagcuaugcaccacugugucuacacuuuauaaguuguacaaaaaguuaguaaaguuuaggaaggagugaguuccuacaggaacuuccuaugccucacuguggaacauuuuugaaaaguaagaaagcaacaucaauauauuccuguuaacuagauauccuaccuuuccaagaauuugucaguuuucuuacuauuguucaguucaaaauacuccuuuguauuugguugucauaucuucauaguguucucuggucuaagccaauucuucuauugguccccuuuuugcucccagugauuuuuauuuuuugaaauuaaaauguaauuaaaucauucuccccuucucuuucuccuucuagcccuuccuguguuucuucuaaaguuucuggccuccuuuuccuuguuauuguuaccuauauagauuguauaugcauacaucuauguauauguacaugaauacaauuugcucagucuauuuaguguuauuuguauguguauaauuucagggcugacuaauugcuauuggauagcccauugggggcuuaucccuggggaagacuauauucuucuggucucagcaguuagucuuaguuauuuaggguagagcccuauaugaguucccccgucuauguuaacaugccuguugguguugcacuuguucaggucuuguuuaggcagccaugguaaugagacuucacaggugaagccugaaccugagcucuaggagacacagucucacagcggauuuccugguccuuugacucuuagaaucuuucugccaugauguucuuugaguccuaggugaaugaguauuguuguagguguaucuguuggggccagguaccccaugaucaacuguucuuugaccaguuguaguuuucugcaaugcucucuccaugugucacaagggaaaguuuccccuuuuuugggggggggggcgguucaagacaggguuucucuguguagcccuggcuguccuggaacucacuuuguagaccaggcuggccucgaacucagaaauccgccugccucugcuucccgagugcugggauaaaaggcgugcgccaccacgccuggcugggaauguuuccuugaugcagcaugagagcugcacuuaccuaugaguauaaaaauagguauuuagaaugcagguaggaauucugcuguuuuaguaaacuggagguagaagguguuccugugaaauccauguccauggucucacuggcuccaggaagguugguagguuuccaguaucaggaaugcuuuccuuucuguuguagugggucuuaaguccaauuagacagcuauugguuaccacgaacaaaugaaugccgcaauugcacuuuuagagcuaucuuguuacgcugucggugcugugguucauaggcaucacagcuggguaggacuauugauugcuuucuucccuuggaagcuugcauagcaccuuccaguccuaaaggaagcuaguccucaggaaggagacuuucgggucagauccagcucagaucacacagauccuauguccaaagcauuuugugucuucaacaauagggacuuaacuucagccucugagaagcaaccaagggcaauggcaauagccuacauuguuaggggauuucagacaaccuugaucuuuuuuuuuuuuuuuuuuaugccauuaacgauuuugaguacuguagaaugcuccucaauuuggaguugugucuuacguaggguuuacugcuauaaacagacaccaugaucaaggcaacucuuaggacaacauuuagcugggggcuggcuuagagcuucagagauccagucaauuaucaucaaggugggaucauggcaacauccaggcaggcacggugcaagcagagcugagaguucuacauuuuuaucugaaggcugcuaugagacuacuggcuuccaggcagcuaggaugagggucuuaacacgcccacagugacagaacuacuccaacagggccauaccuucuaauaaugccacucccugggccaagcauauacaaaaaccaucauaaguugucugaaguuuuuguuguaauuaggcugagcuucuuuuuagaaagaaugcaacagaauucaaauguucuucucaucacacauaucaaggaguacaugguaucuacaugacaucgcuggugauaugaacuauaaucuguugcuuacaguaguauuuacuguguuucugcaugggaaaguugcuggguuuuuuuucccuuuuaauauuuuguucuuuggaggaaucuaauccacucucacagagaggaggaacgauuaagcuccagccccuaaaagaggauguaucuauguauauguuacuugaaauucuucuguaaugauuuaugucuugucuuuuauuauucugucacuuguuuguauccguaugagcuuauguauauuuguuuuaauaauuugcguuaugaauccaguacucuguucuuugguuugaugcucaaaugguuucaccuuugcccacugacaacucagaauggcuccuguguccccuuggcauguucucauucuuguuggccauuuacauuuauauguauuucuguaugucugugugcguauauaccauagguguagagguguccauggaggccauaauaggauacugggucccuuagaacuggaaucgcaggcuguugugagccaccugauaugggugcuaggaucugcauuugaguccuuuguaaaagcgguaagcacucuuaacugcugaacuaucucuucagccccucauucauaguuuuuuuuuugguuuuuuuuuuuugaaacaggguuucucuguguagcccuggcuguccuggaacucagaaaucucucugccucccgagugcugggauuacaggcgugcgccaccaugcccggcuuaaacuuuuuuuuuuuuuuuuuuuuuuuuguuuuuuuuuuuuguuuuuuuuuuugaaacaggguuucucuguguagcccuggucauucauaguuuuuaaaggacuuccuugcugccuuagugaggguuucauuacuuugaagagacaccaagaccacaggaacucuuauaaaggaaaacaguuaauuggggcuggcuuacaguuuuagagguuuaguccauuuuccaucauggugggaagcauggcagcaggcaggcagacauggugcuggaggaccaagaguucuacagcuugaucugaaggcagccaggaggagacuggacuccucacuggacagagccugaacauaggagaccucaaagccugcccccacaguccuuuuaucucaaacuuaaguuugauaauuggggcugaucaagcacaugaauccaugggggucauaccuauucaaacaacuacaucccaaggaaguccuugagucagccauuucuccaaaaagaccugguuuccucuaagauguauuuguauuuucuacacugacaaccuugucaacuauaagucaacuuuucuuccuguuuaguuuuugugucuuuaauauauuuuucuuguuuuaaugggaugucuagcacaucuaguacgauuuugaauagaaaggcuacaguggcauuccucaauuguguguuuucaaggaaacaaccuuauuuguuaucugcuuucuacagguuuccgcaaguuaagcaaauuucaaccuauuuuucuauacuaagaguuuuuuuuauuguuuuaaaucaugaaagggugguuuuuuuuuaaucaaauuccuuuuccauuucuuaggauaaucauguuuugucucaauuauauuuauagacuuuucucacacuagagcaauguugcaggguuuguuuguacuuuaagacuuauccaugggugcuggaaagauggcucagugguuucgagcauaauugcucuuccaggagacucagguucaauuccuagcacccacaugguggcucacaaccaccuggaacuccaguuccagggcauccaagccccucuucuggccucucuacagagagcaggcaugcacaugguauguagacaugcaaaacacuuacgaauguaaaauauaaauaaauaaacaaauaaaauuaaagauuuaugcauguaugucugugcaguaugccauguaguggcaacaugggccaaaagagggugcuggguccucugguuuggaguuacagaugggugauagcugucauguaggugcugggaaugaaacccagguccucugcaagagcagcaagcguucugaacagcuaagccaucucuucagcuccccuuuucaaauuuuuuaaaugugaaauuugaaaugugcuuccacagcauauaguuuauguaacauuuuauacuugaaauggguauacacaaauucuagccaagacuuuguaauaaugugucuaucaaauuauuaacagucaccaccaacaaaaaaacuuuugucguaugaauuggugauaagauacuuaaauccaguucuuaaaauguuuuaaagauguuuaacagcuaaaauaaugcaaguuuuuauuuuguuucacugacaaauauauuguuggaauuucuaugauaauaugaguagauuucaaacccauuaucucuuuucuacuaccuauuucaaaauaaugaugaagcucuuauuugcagaacauccaccauuauuagaaccaucacccugcagcuagcuuggacauccuuaaaagggcucaucagaaguaucugauauucaugaagacagaguuucaggguuucugccuggagcuacacccuccaggagccccugcuuggcuuccccugcacccagccccaucccaaccuguuacaacuugggcugugcaugguguuucuuggaaacuggaacacagacuccuccgacugcucuccaggcccuuuguccucaaugagcagaagaccacagaagcuggcuacugaagaggcuguccagauagcagagcaccucacuggccuugcuuagcaccuuugcuacagagcaagcucugagugcucaccaccugcagggacuacagcgagauuugucaggcccccacuucacuaagggccacucucuagugagcccucuggagaaggcuccacuaaaaaaaacguggucaucauagcguuugcacugccucgaguccuaucugagcaccuguagggcugcagacaucaguagcccguuaccuagcucuaauccauauccuaaguagaaaacuguguacuauuuuuuuucucuccuucuggugagaagaguuuuaauuauugauucagucccaucaguaguuguaguacuauuaagaauuuauuuuuccucuugaguacauuuuggauauaguuucuuagguauuggaccauuuugucuguguuuucaaauucacugacaucaaguuccuguuuugaaagucucugcucuaucuauucuguagcuaugucuccuuuuucacugcuaauacugguuauuugugccuucucccuuuucuucuugaucaaucucagcagagguuugucuauuuuauuagucuuuacaaagaaccaacuucuggcucugcugcuccucucgauugugucuuuguucucuauuucuuuaauuucagcucugaucuuuuuugaccuccuuccuuccacauucuuuggauucauucuguugcucuucuucugauuucuucaauuguauguggagcucauucauuuucagucuugccuuuuuguuuuccuuguuuuguuuuccuguuuguuuccuauagcucagacucaccucaagcucacaaugaucuuuucccuuacccucccaaguacagugauuacagaugugaggcgcugaaccuagcuuucagccucucguuuucuaauuuauauauuugaaagcuauaaauuucccacuaauacuacucucaaacaugaccauauacgguaauaauuucauuguucaguuccaagugcuucaguauaucuauuauuauugcuucuuugacucaugaauuauacagagguauguuuuuaaguucccaaauguuugggggauuuuaaguuuguucuuuuauugaauucuauccuauuauguucagaugauguggucuauguaguaacucugaaguuuauugagacuuguucuauugcuugguacacaauugauaauuauuaauguuuccuaugugcucuauaagaauguauguccucugauuauugaauauagaaaucuaugugugucuauuagcaacuaucuuauucaaauuauauuuaucuaaacugauugcuuuuguuaugaucuaccaagaguuuuuauaguuaacucugacagugggguucucuguuuucuucuuauaguuuccuuuuuuaacauaaauuaagaauuguuauauuucuuguaaaaguguaauauccuucucuauuccugaugauagaggaauuaugccagguuaucuuguauuaauguaacagcacaagcuuuucuucuuguuaggguuuggugguauauaauuuucuaucuuuuuacuuuuaagaauuuuuuacaccuuuguguuuuaauuauauuucuugaaaacagcauauggcuggacuuuuuuaaaaaaaaacaaacaaacaaacuaaucuugggcugggcgugguggugcacgcuuauaauccuagcacuugggaggccgaggcagguggaucucugcauuugaggccagcccagucaacauagugaguuccaggccagccaaagcuauacagugagacccugucucagaaaaaaaaaaaaaaag

SEQ ID NO: 9791 - RNA, 5636 nt, Mus musculus
uaggcgcugugggaguggggcaggcgcugugggaggggacgucagagcgagguggugagcagagcuggucgcgugagguguggcggcuccgcuucaagugugacugguggcuacggccuugucugagagccgcagagccaguguugugagugcggucaccauggaccgcccggacgaggggccuccggccaagaccccccgccugagcagcucggaaccccgucagcgcgaccugccgcccccgccacccccaccgcuccagcgacugccccugccuccaccccagcagcguccgagaccccaggaagaaaccgaggcugcacaggugcuggcugacaugaggggggugggccccacgcugcccccaccacugcccuaugucauucuugaggaaggggggauccgcgcguauuucacccugagugcugagagucccggaugggaucacgcaauggagucaggguucggggaggccccuuccacagggaucauggaaacgcucccaucuucagaaaucucugggggaagccuggcaauugacuuucagguugcagagcccagcagccucggagagaaggcccuagaaaccuguagcuuaggagggugggggccccagauguuaguugguccgaagaggaaggaggaggcuaucauaauaguggaagaugaggaugaggaugacaaggagagugugaggaggcggcagcgucggaggaggaggagaaggaagcagaggaaggcgaaggagagccgagagaggagugcccagaggauggagagcauacugcaggcccuggagagcauucaaauggaccuggaggcggugaacaucaaggcaggcaaggccuucuugcgucucaagcgcaaauucauccagaugcgaaggcccuuuuuggagcgcagagaccucaucauccagcauaucccaggcuucugggucaaagcaguauccuucucaucaguaugcaugggccagaagcccaugacugaaggggagauguguggaagagagagaagaggugugggggagggucagagaugaggaugaugaauccccauuagaagauucuagaaggcguggaagagggauggcaagagggcaaaaucgcaucuaaaacuagacugcagaagggaaaaagaguagcauugcaacauuuaaaaagaaaauggaucccagacaauaaaagagggagggguaacggaaaaggcacacagcccauaaacggagcaacagauagagaaaggaggagaggaggggggaguacaggugaugaacugacuaaggagggagggcgcauaagcucuucgggaagcgugcucaaaccacacaaggcuccauaaaccugggucucugcuuagauaccuagaaaucccaaaucugucuaccauccucuccauuagaggggagagaguagaaaugggauggaacccugaagaaucaggagaaagaccacuugguugugaggcucaagugguuaaaugaagggaaagguacaacaggaagaauccaauccacuauuggugacuguugagcucauucccagggaaacacguaugcaacauuugaaaugcacacauuuuaguagaauuuauauagauauaaacacuuggcccaugauuaaaaagugucacaugaucauaggcucucgggagucaggcacaggguaucaaguagauacagauacauaacuuccauaucuagacaugaggcaacugggccuaagcacacagacuucuagaggcauucauccauuauguggacacugagcaucaacaccuauacauguaacauuuaaaugcagguccucgguaaccaaauguaucuguacuuagacuugggcuuuuagcucccagacauacaguauucugugaacauaagcacaagaaucacauggacauggucagagacccuuagcaucuagaccuacagcaaauaugaaccauggcaaggcucccugaugcugagguuuaacauugcauaagcacucaccuacuccucagacaucacucaaacacagaaggaccccccuugcuucagccuguuuugcucugcccucccuggcauugaacaguaaauccuugaccuaaacugcuccacucaucaguuccucaaccaccccagaauuucaaucuugaucaaccaacgugacagagacauuuuccgcuacuugaccaaucuucaggucaggccaaagaagaaagccaaggaaucuggucuuuggaggugagggggugggugggaagggcccugggagggauagauaccacuauuaccccacccugagcagguacaggaccucagacauaucuccaugggcuacaaaaugaagcuguacuuccagacaaacccauacuuuacaaacauggugaucgucaaggaguuccagcgcaaccgcucagguaagugauagucccaggauaaaccuauggccccuauacuaucauuuccccuuccuucuguaucucuuccucuucuaggccgguuggugucucauucuaccccaauacguuggcaccggggccaggaaccccaggccuauaaucgcaggagccaugacaccagagaaagcuucuucaacugguuuuccaaucacagccucccagaagcugacagaauugcugaggugaggccccuccuggcauugccagggaaagccuuucaagacuugucccugggugccugagaaauugugaguggguucuaggacuuaaacuccuugaacuccuuuucacucucccccuccccaccccucaacagaucaucaagaacgaccuguggguuaacccaguacgcuacuauaugagacgagguggcuacagaucaagcagaaagaagcaacacggaaaggaaaggugaugagagaaauggugccugagagguugggggguuguuuuuaaauagggcagagacuaaccuaguguugcacaggacuuauagagacacaggggaccacugagguaauccaaugaauaccuuguuuacaaaugagcaaugauccccagaaguggcaaugggacuuucccccauucuuagaaauccuaguaccuuacucccaauaacauuauacuaaguucuaaacuugcccacaguagagccaagaaucaauaugaaauggugaucauggaagaugcucaugaccauuaugcaauugaagacauucucagugacaucucagaaauugaugagaucacugacaaugagaccauucacgacaucaagaucucugacuucauggagaccaccgacuacuucgagacuacugauaaugaggugaccgaugccaaugagaaccugugcgacagugagaauccugaccacagugaaggcuacaacaccaagaucacugacaacaaagggagcguugccgcaaauccagaugacaacagugaugacccagaggaaaagaauaccuaugacagugaggauuccaacagcgagaaagcugauggugauaacacaacccuacgugacaaccagcagguuacuaauauccaggacagcagugauagugacaauggagaugagggcagugaugaugaagaugaugaugguaaugagggggacaaugagggcagugaugaugaugaugaugacaaugagggcagugaugaugaugacagggacauuagauacuauaagaauggcccugaagucuuugacaaggcucuggauaaccgcaccaaccagaaugacuaugaggaggagguagaacucaucucugaagacucaguugaagaagaggaagagaccagugaggaaggugagauauaggccccucccccuuccuuucucuucugagaacacccagguuucuuuaggcaacugguggugagguaaacacuguguguucucuccggucagaggacagggcaguuaauuuuaccucaaggagugggaaaggagagggagagcuaggggaaggagguaccauuauugucgagccuucuccauggcauggauuagcgacacaauguuuggcaaggcuuccaagauuaucagaggacccuucacucauucauuguugaucaaauguguuaggcaaauaauacauaaauauccucuacacauucuaagaauccugccuuuaaaaccccuauuucacuuugcagagcuccacauuucccagaccucuugaccacaaaacauguucuuuguccaacacuguauacauuugggaaacugcuuaggaaagacugcacauggaagucugagggcuaaugcaauauuuaaauugacucccagguuuaguucugaucuggaagacugggaaaagaacucauuugaaccuggcugugggcagacaaaggagaggugaaccccagggguagguggcagagauaggaaaaccagccacgucugaagguuuaagcaaggcacuaagggugaaagugugcagaagggaggauccacagacacacauuuugggguaggcuggggaaacuaagggaauugucaguccucuuugccucccaucugacaccaucucuuuucuccaaaaauuggaggcagagcugccuagcucuggaguggaguggggauggggaacaagacugaagaaggcagacuacagccuauguuugggucacacuaggugcaaaaaguaauaaguaaaaagccaaggccucacucagaaacagaagcacuuugaggagugugggagcaggagaaaggggaauguaucaguuuugaucugacaaagaugaaugcccugcugucuugccucccucccucccucccucuucuaaccuuggauaugagcacaaucucaauggcacuuuaucuccccuuccucccugucccaaacagaggcacuggugacuagugguccccagcccucaaaagccacagccauuuuguucuguucacuuuucaagggguauccaacuaccuuccccuguguccuccucucuccuucacagccagccagcuaagugaggacagcuaugaagaugagcgaaucuauggggaggaaagaagugaggugaacuccgaagauucugauauucaggaagugcugccggucccaaaagcuugggccagccuggggaagaaagggaaaaucggauaaacaucuugcccucuaggggcucucuauauauaccccuaugcccucucccauuugcccuccucuucagcuagggcugugcggccccauauugcacuucuggggggagacagacuuauuacacggguuuaaaguuuauuuuuaugguuuaguaauugcagaguucuuauuuggaggagggaccacgcuccccuucggcccuccuccacugcaggcuucugugugcugcuaaucuuauuuauugugaugccuuggucagggccccucuagcccccuucucgugagcuuaggcccaagccccucucuccgugcugcguggacauccuaucucuaagcgagaagggccgcugugaccuucgucacaauugcacuguggccucagacucugcuaccccuucuccagaguuacucugcaacuccuuucuucccuucaacagcccugacugcuagcccgccucagugucuuugcaaggcagcuucgccuuugugggauuccugcuccccagaagccccgccccuuuccccgugacccucaacgagccuaauaaaacugagcaaauucaaagugcc

SEQ ID NO: 9792 - RNA, 25168 nt, Mus musculus
uaucaggccagccucucucucccuccaccccucccccucuuucuggcguccauccccuccccaacaccaccucugcuacugccucuggcuguggaccugcaccucuucuccauccucgccaggcccggagagugggguuagccuggaugagagugugccccuaaccuggggcccucccaagccauggcuccuguguucccagggaggaguccaggacccugagcaucugcuagaagcuuggcagaggccccgcugggaccgugucuucugaggacaaaaggcugcggccagcaggcagacuggguggggggugggggggaaccgguagcuaggcaggcagaacaguagcggagccaacacuggcccccucccagaccggcgguggcaugaagaugggggugggaguguguagugggagaagcaccuaccaggacccccaucugcccgcuacuugggcaccccaaagcugugugcugcccaccugguguuccccaacaucuccagcucuaccaagugcaccccucuggcaccugcuucccuugcugccagugauuuagaucaaccaggcuguauccacggcaacagaagcaggagugucacuggcugccagaucagugagggucccacaauguggccugggcugugguuuauccuggaugagacagagugagucuccuuccugaauuccaagacaguccugcuaagagaacccagguaaguagucagcauucuuccauaaaggagcuaggggaggaggggggcugggacuucucugucucuccauauauuucagucucuaucacugucaugcuuccugucucucuguuagucucucugcuucaucacugaguaugacaacacucaaaccccaagacugcuuaucuuuccccaucuucuuuaauccugaaugucccauaagaaagggaaccaccaccuguuucuccacccccaaccccuuacagggucugcuucuaucauuauagucacguuuagacacaagaccauuccuugugugcuagcuguggaagggguaccugggagcucauugagccuuguucucacaaugccugcagcuuccuuuucuccuucuccagguuccuuagguuguuugcagaauugugaucuguaugugugugugucugugugucuguaagagagacagagaaccugggcaccaagcagguggguagauaugacaaggaggcugcuccuagugcagaccaccccucauuccuuccuuuauucuuuucccagucucuaccuacagguaacauaccuuugcucacucacccuggaagaugugucccagcuagugggaggaagcugcuauaggaauagaggaagguaagguggggguagggagcacauucagguccugggcucugagagcgcuugaaccaauccccaugacaauauacaggggacaggaauaacguagugguccccacacugugggcccuggcuucuaucacauggcucucuguuucuguuucagauacccauauuguguuugggaccuccagaucuaugacacaguaagccagaggucccuguaucuggaggugcaggaaaaccugguauauggagaacauggauucuacuagggacacggcuccuaacuacuaguucgcaacuuuaguggaggcaugucacuuguugaaccuugauuuuccccauuugucaaagagacugguaacccuuucuucauggaugugugcagggauuaaauaaauuggugcaugcaaacaauuaucuguguuuauaggauggugcugagcagugucagggucaauauuauugcugauuguucaugauuaguauugcuacagaucaggaaaaggauuagugccuuuucuuuagggucuuagcagagaucuagggaagccagcagaugggaagguggaagguggcaaguagagggaagcagaacagcuuugugcuauuacuucuaauuuguaaagagugauagauagucgggggcagucaucccuacccuacucgggguucuuuccaugcacuuacccuuauuuguguacacacacacacacacacacacacacacacacacacacacacacacaccagacugagaaccagcagaagccuggcuugcagccugcagaauuccuggcccugguaugugucccucuguugaggggaaauuagcaagaguuuggcuuauggucagugguuggcagggacuggagacaaggcugaagcuuuugagauuauagggcuuugagugagcuggggugugguccaugcaguagccagaccuguagcagaguuugcccaucuagacccuggcuugaggagaauaggguuuccuaacugguuucuagguauggauaugugguagaaucccaagggguugggaaucagcagaggagccaaaagagaggagagauugaaaauagauuucuucugaggaacagggagggccugggaccuuuagacaugaguacacuuuccugaagaagcauuugaaguggaaaggagaggaacuagccuguugcccagaggcaucucgaccugaaacuuaucguguguguguguguguguguguguguguguguguguguguguguguguguguguguuugugugugugugugauauauaaaugacugcauuuguagucuguguauacaugucucaucacugcacuguauguguauaucaucauauacacuguagguguauaugaguuuaugugugugugaacagguuauaugauagcauaugggauuaugugggugucugaauagauuugugucuguacuagagggcaugguuuugcaugccugucugggugaacaaauggucauguuugauucugacccaaguauuggcguguuucucugagccuguauuaggccuauugagugaguguguauuugagugagugugugugugucuguguguguuacacauccaauuaaaugaaugccuaguuggaucugauuguguauauuccuguuuuuccaugugugccuuucagugucuguccauccaaaugauuuguuuauaaaaauagauauaugugucccaugcauauaagaaaguaugugugugugaacaugcuacauguguuguaggcgugucucucauauauuugugugagcaggccuauguguaaaagucuguauagauucuucagcauuuuucauuaugucuaugccugcauaugcaugcuugaguguccacugucucuaaacaagccuauguguucauaucuauuuaaagaaauguaaguauaaauagacacacuggaauaagaacuggaauaaguaagagaagaguauaugaaugaaaaauauuuuaugugugcacagacugugguguucacagcaguguguauuauauuagucacaaggcugugugcauaggugaauggguacauuuuuaugaugucuaguuugguguaagugcauuaucugauuaucguaugcaugaguguuacaggauacuugggugcaugcgucucaguauguguuuuauuugaauuuuuagugugacuguguuugaauaugucuugagugacugugcacauauaugcuaauauuuguuaauaccugacugugcguauauucaagugaacauaucuguacauaggcacguguugucaaacacaguuaagguauauuuuuuaauaagcuuguguguaugcccgucugaauacacaaaugugugaaguaccaguuugcacaguuuuuauuugcauuuguauguuuguauuuaucuuuguuuggucuaaagcauauauuauagaaugauguauauaaaucuaugugcaugcuacucuuaguucacaaguacauuuaugugugugugugugcauuuauuuaagaugucuuugcaugucuguaugugauaaguggaucaaauuuuccuauacagaucaacaagugcgcgugcaagaauacaugaguguacuucucuauauaugcauguguugaaauaugcccuuauguucuauuccaauguacauauaaguuacuuuucuuucauuuauguggcuucucagaauggguguguggacauaaccguguauauauacuugacugugauagugugcuuugugaauaucuguguuuccauauuuaauuguauucccauaagaaugaauuaauguauauacaauucuauaagcaugugaauaugcuauguguuuauaugaccaguuguguauauaagucuauauguuagaauaucugcauauguauacuucaucucauuuacaaacauuugcauaucuggauaugaauaugugugagcacaccuauacagauauguauguguguauguaugugugcgugugcgcgcacaugugcgugugugugugugugugugugugugugugugugugugugugugcauacacuucugugguuauguuugaggguauauguguacacauuugugaguucccucuuuuguacccauguuucuuuaucaucucuuuagauacgauacauauauuuuuacauaucucuguagauauguaaaaauacuuuuacauaccuguguccccacuuguguuugugagugaagaaaugcaugucauucaugaguauaucaugugaauauagccuauuuuaaagaguaaauggauauacuugugacuaaguccaaugaaaaugugccuguguguggauaaauaaaaguauuugugcaucugccugucugauaugagauuuggccuugauuuugugcagacugaccucuacacaaacuucuuacucacaugcacccagcuuucaucucguccacaccauaugcaugcacccacucuacacuguagucuccacaugcucaccaaugaccacugggggccgugauaaaacuuugacacaaaaaucuuccuuccuuucucaccacuggcaaaggcacagggcaggagggcaucauaauagugccuaggguuaguaagagcuuugguuggagugugugugugugugugugugugugacaaagugacagacaauaugagaaaguaggaauguacaucuggacauuucacagauagcacccaaauuaugccaucaagcagaaauguagauguuaauaaauauguauaagugaaaguauaucuuagaaaaguaguagguaugggcagggcaugaauauguguguauauguaagagauuauauguauuucuugguaguaugugcaugugagaucauuguguauuuuagggagggaaggauucuuuuaaacacaaagauacacacacacacaucccacccaaauauuuucaacugucacacaaacaaucuguguaugccucuacacaaaccuacuacccaaauacacccaugcuuucuucuccuccacaccauauggauaaacccaacccacacucugcacaguacuucccacacaaaugcuccuuaaacacauucuucauacacaccauccagcuuacaucaguggacuuggugagcgugagagcaugugaauugagauuauacauguuuaugagauguggauguauccugaugguauaugagagaaaguguauggguacauucgggcugugugugagaccaugugugggcgcauuugaaauagaauggauuugaauguagguguguuugaauaguaagcaggucaaagcauggauauacuuagguggcagaguguguguguguguguguguguguguguguguguguggugugagauagaacgagagagagagagacagagauagagacagagagagaaaagacaaagaaacaaacagaaaguauuaaugcacauaguugucugaaucagguuagaaucuagaugauaugugaauguaugugucucugagugcauguauuuggcuuuggaaaccgugaauauaucuagguggugugucuuagugcagugcuuuuagaggguacauguaucacuuuggguguguuuuaauaguguacauuugaaagagaucauagguacaucuaagacagguaugagugcuccaaguuggggugagaauaaguuuaagugaaucuaaaaacuauauguaagagagugggcaugcugaguuggagauuguauaagugugacuuuaauuggauagagugacuguaaguguaagcauauuugaugugcauacauaugggaauggauuauguaaaugggauguguaugaacguguggguguauugguguuggguauaugugugaaaguggauguaucuguguggugcgugugaagagaaagaauguguauauaucuggguuuggggcuugugaaaauguggguauaucuaacuaggauaugugcaguuaucuggauggauagggaagagagaaucuaaguggugugugugaggaaaaaaaauguauguuugugugaguugacugaaucuaccauguaugcaggcauaucuggauagugugguucuauguauuucagcugggaagauauauaacacggauuuauguagcuauuuuauaggugcuguaucuagauguuuugugcauucaauaguguggucauuuaugaguaaaguuugugauuaugaccacauauguauauauuuacuugggcauauauaucucuguuaaaaugucuguaaugugaacuucuccauaacuugguaugagugaccuuuuguacguaagugcauuaguaaaugggagcuggcuuguggaugcacaugcuaggaaaaaaauauauauauauauguauauauaccuacauauauauaauuucuccaugugaauuuagaauuuauuuugggggugaauauauuucuaugugacuaaauugagucugcaaguucucuagagacagucuucggguuuacuguuuauuagcugugugguuuggguaaaucacguaaccucaacaaagccccagucucuugucuguaaaauggaggaaauaaaacuaucuaucuugcaacguuagaauaggaugaguuaauacacuaagaguccuuggaacagugacuagcacauaauaagcccucucaugaggaauuacuuauuacaggucacaacaguauauuaccuguuuuuaucaucuguguauaccuguuacaauuaucccuguccuaaaagcuaacagugugcauuuaucuacaacugcaaaggaggcuuucacgugcauauuugccucauuauauguaccauguguauguccaagaaaaaugagcuuagccucuuuuaauguaagagugucuuuguacaugaaaauuggauaauaguuauaaauaucucauuuuucauauagaaacacagaugugugagaaagaauguguucaaggguaaauggaaggacauugagccuuuuguguauauuugcuaauauacaauucucuagguauaugagcacacacacccauaugugggauaauguagcauaugugagaaugcggguauauacauaugugaauaagauuacguauacacacaugccaguguauuuuuauuugacucucuaacuagguuuacaauugucaguaucuacaugugugcaugugggucucuguucugccuguaaauuuaagaaggcugauguuccuuuauauaugaugaaugcaguggaaacauuugcaugguguggguuugucucuaauacaugugggcauguauuagaaugugugcaucuguguuguucaaugaggguggaaugugugaaucaaugugugugcaucugaagauuuguguuuauauguuucuaagccucagugguuauguggguuugggaugugugagucuggauuguuucaucugcuugauugccucucugugcagcugugagucugaguaaaaugccugcaaguaugccgaugcuauguguaaaugacuggguaccagggcagauuugugagaguggcuuuuuauagaauaguagguuuggagccagugagauggcucagugggcaaaguugccugccauuaaggcagacaaccugaguucaauaacugggacccacauaauagaaaaggaacuccgaaaguuauucuuugacuucugcguguguacauggaguauauaagaauacacauaaauagauauucuuuaagauagaaauuaaauguaguggcuccaauguuuuaguguaagagccaaugugaagcagagaaggucuggaucuguagggcaugagcaagauuuugaaacucuguagaccaggcuggccucgaacucagaaauccaccugccucugacucccaagugcugggauuaaaggcguacgccaucaccgcccaacuaaaugucaauucuuaugccugcaaaagcagaagugugucuaaauguguaagucaugcaguuagacucguguguauguacauuuucaagugcccucugaauggugaaugugucucugccuaugccuauguuaugucuguauguuguauauccuugagugauuugcuauugaauggauaccaaauugcauucacauuuucuuuguguagaagagagagagagagcuaauuguauuuaucagcugguuuaaaucugaauaugagugcagauuugaauguccaugugcccauauacauacauuuguguguguguguguguguguguguguguguguguguguguguguguguguguuaguguuaguguuugcaugcaauaugacuagaugugagugcuuuauggcauuuacacaacucaacauccagagaaagcaaaaucuauauggcacacuagaguaaacuaaagacuauuuagagguacaggaguuugauaaaaagaaauuccuaacauuuucuccauauuauacauuuauaaggaaaaacugcaaaguuuuagaggauuuauuaaguacugaauuuguuuacagcuuucaaauaaagucuuuuugcagauuauuucaugauaaacuagauugcucaaugcauaacaucuucccucccuuucucccucccucccucucucccucccucucuuucucccucccucccucccuuccuuucucucuuuuuaugaaacagggucuugcuggccuagagcucacuguguugcccaggcuggcuucaaacuugcugugcugcuuccuagcaggacguggugggguacaccuuuaaucccagugcuuuugaggcagaggcauguggaucucuguacuugagcucugccuggucuacauaguaaguuccaguauagccagagucaaaaaaaaaaaaaaaagcaaacaaaacuaaauaaaaacuugcuugcuucuuccccgcaaauguguuuacaggcacgccuaggucagaguauauauauauauauauauugaagucuuggccaaccuggagcuagcuauguacaccaggcuggccucaaaaucauagauauccaccugccucacccuccugagugcugggauuaagacaugaugggaauccauagcggucaucagugaccacauugugagccuuuggucaugacuaccauggcuucuuauaguaucauugcccccccccccuuuuuucucauuuuuaucuggauucaguaaaucaauucgguaauuguauuucuuggugaaaacuacaaacaacagcaacaaaauaggaucaaguaauaguguauaguuuuggcacauauaaacuucuacauggccugcugcuuaaucuugagagccauguauaaagcaaccaaggagguggcucagacacauuucgcccuaauuuccuucauaauucacuugaauguacaaaacacagcuauaugauucugccggucagcaaagccuauuucaggaagaaagaaagaaagaaagaaagaaagaaagaaagaaagaaagaaagaaagaaagaaagaaagaaagaaagaaagaaagaaaagaagggagggagggagggaaggaaggaaggaaggaaggaaggaaggaaggaaggaaggaaggaaggaaggaaggaaggaaggaaggaaggaaggaagacuugccauccaagcaugaagacccaaaaucaaauacccagaaccuucucgaagccaaaugcagcagugugcauaucuaaucguguacccacacgagaugggaagugugacacaggagaacuccacagaaguuuuggggccagcuagcauggcauagacaauaacaaacaguaaagauccugucucaaaguggaaagcaaggacugacacucuaaccuccacacauguguaccccaacacacaccauaaacacacacacacacauaaaauucuuguaguaagugcucaugaauuuugaaucuaacagauaauuaucauuuaaaguaucucaaaauuaugaugaaacauuucuucuaaguagacuugacucuauacauauucuaucauucauauugcaacaccaaguagacaucauuccagagccauacuuaaccuccauuuuccuaacuuggaguuuuacuuugaauguauaagccaugucagugcugccugcuuugauuuuugagugccuggaaaugcagggcugggcaugcaccuuagcuggcauggugcucaccuagccugcaugaaauccucaguucugucuccagcagcccauaagccagguguagaaauacauaccuaaaaccccagcacuggggaagugaagacaggugguucagguggucaaggcuauccucauuuacauaguguucaagaaugagcuaggcuauacaacacccugaagccaguugaguaucaacucugcaaaagaaacagacacaaagaaguaauugaagucaggcaugguggugcaugccuuuaauccuagcacuugggaggcagaggcaggcgaauuucuuaguucaaggccagccuggucuacagagugaguuccaggacagccaggacuauacagagaaacccugucucaaaaacaaaaaacaaacaaacaaacaaaaaguaauugaaugcuuuuagcuuauaaugcuuuuaaaaauuaacauuuuuuuuauuuggcaggggcaggggugguucacacaugccacuaagcacauguggaagucacaggacaacuugcaggaguacauuucucucaacuaugugggucccaggaaucaaagucaggucuucaggcuugauaggaagugccuuuaccuuccgaaccaucuuaccaccacuuaugauauguuucuuuauaaaauuccuacacacuuagauuuaaaacagcaaaacauauauauggauuucaaugcuucacacaaaacuaaaagauacauggaaacaguuuugcacuuaguuaaauucaucauuuaguuaguuaguuugucauguauuguagauauuagucuuacaaaguuuugcaggugacucugguauuaccaaaaccagcuugacaucacaacacuagcuuccagucaagucuacauaaggagcuccaggccagucaaagcuacauaauggcucccugucucuaagcaaaacaaaaaccaguagcaucaauccauauaccuaugcaauuuccaauuuucaaaauaugugugaauaaauuugcauauauuaaucucaguuuauuuuuuuacuaauugcauuucucuucuaggucucugauuagugcuguaaaacuaagcauauauggacaauauccauaaaucaguauauagugaacuccuuucuguucaacaguuuuuuaagcuagugccaccucugaccuguaccagugugucuccuaauaguaauuaaaacugucccuuugccuauucucuuuaccucauccaucccaaauacauuguggacaauuucccugcagaaugcuagcagguaaaauuucacuuagcuuuucuuauuaaguuugcaacccugucacuaacugacugagcucuguaugagaauagucuaaucaucguaaaauacuuugguuccuuaauuuauauuuccaagugcuuuacaauauuuacuuuagauguauuuauuuuauguuuuugcugugugugugugugugugugucugugucugugugucugugugucuguguguguuaugugcauaccuggugcacacaaggguaguagagugucagaucucucagaauugcaguuacagaugguugugaaccauaauguaggagagccaaacccagguccuucucaagagcaccaaguguucauaaucucugugucaccuuuccagccgcgugcuuucuuuuuuuaaguucagaguccacuuagugcuaccagaaugagccaucucuucagucucaagugcuuuuuuuaaaaaucugaaccuuagauggugugguggcacauuccuauaaucccaguagucagaaagcugaggcaggaagauuauuaggaguuuaucgucaccuggggcuauguagugaauauggugauuaugaggucaucuguggcuaccuagaccuuguuuuuaagaaaaaaaauccaaaugaacugugacucucucucucucucucucucucucucucucucucuccuuccucucccuuuucccccuuccaucuuccuccuuuccucuuuuccuaucucccucaacaacucccccaggccuuauacaugguaagccagcacucuaccuaccauuaagcugcaugcccaguccuuauaucacguaauugaaggguacaacaaaucuuuguggcuucugaaacugaauuuuucauugcuuuuuuuuuuuuuuugaaacacugagacaaaaucauaaaaucuuagacugaccuuugaugaaucaguucaauuaaaacuauuaucuuaguuuguuuucuauugcugugauaaguaccaugaccaaaaacaacuugggcaggauaggguuuguuucagcugacagcuuacacuacaacaugaagggaaaugaguaagaacucaaggcaagaaccugcaggcagaaacugaagcagaaccaccaaguaacacugcuuacuggcuuguuccucagucagcuuucuuauacaaccuagaaccaguagcccagggaaagcaccacccacaucacccacaucacccacaucaagaaaauguuccccacagacuugccuacaggccaaucuauggaggcauuuuugcaguugagguuccuucuucccaaaugacccuagcuguaucaaguuaacaaaaaacuagccaacacagcuauuguauggccucauuaauuuaucaacaaauauuuuuaccuaaaacuacaaggucuuaaaugugaaauaccaccaagaaucagauugggcuaauuuuuaaauaguggaugcuaauagugaauaaaucaauacauagacugagaaauaauaaaaauauauuaugauguucacagaggaagccucuuuuaaaaacagauagugaaauguuuaugagugaacuaguauaauaauuaugguuuacaaaacugagggccaagagaagugggucgggcuauggacagaagaagacuagccucuggguuuauaauugguauaucugcauauugaguucaccaaaguucaucguggugcuccaucuugcauuuuuauguuugaaaugauaacuaugauaaagaguacuuuuuauaaagaaauaacagucaaggaaauuaacaaaaugauuauauucccuuuaggaauaccaaauacaauacauaaucugaaaucugaaaugcuccacaaucugaauuuuuaaugcaaauacgaugcuauaagugggaaguuucccacccaauaucuagugacaggucacagacaaaauuuagacacacuaaaauaucgcauaaaaucaccguuaugcuguguguaagaacacaaaugaacuuuauguuuggauuuaggucuaauccccaagaugguguacuguaucuacacaaauauuccagaaucugaaaaagcccaguaucuaaugcacuucaacuccugagcauuuuuggauaagagauaagcaaacuguaauccauaacaauccuccacacaccacuccucccccacccuccucuucccuuuccucccccuaugagcauaugcaugcuacacaaaugcgguaccacugagucacacccccgugaccaacuuuucuauuuuuguaggugagaaaaaguaagaacaagaauaaaauuuuaaaaacaaaacaaaacaaaaaagcaagcuaacauacacauagauacaggccaaaccaaaaaacucacuugugauaaauaagugaagguaauaaucaagcugucugggauauuuuaauaagaaccuauugaaaagcaauauacuucuugccacagucuccuguaccuguccuuacucaagcuccccagugugcauguacccuaccagccaaguagcucucuauucauauuuucacauauaccagcagagguuagcugauuucugcacaugagcagauuucuauuauacguguuguuggagauauauacauauaauguguuuaagagaaaguuaauauguuugcacacauuuguccauaggcaaguagcuauuuauaguccagugucugcacauacaagugaauuuuugucugauugcaagugcuuuguuugagagagacugggagccucucuauucuuuuguggguaugguagagcuauuacauguccauuuaucagugagaguuuauauauuagagagauucauuucugugccaggauguacauaucuguauuguugagugugccuaaucuaugugaggggaaguaaguugauuucuugugguaaaggauacucauauaugugagcaauuuuuuaccugcaaauauaucuguagguaucucagggauucuguauauacauaccuaggaaucauguuucaaguguuugugaauuugacaguaugggugauauuuaacaugaaugguaguuuuguaacagaguuuguauaugugaugaugcagauguacuguugugagauuuuugccuaugugggaguauuuaagcaaucagauauaucagcucaguggcuauauaagagucuauagguaaaauaacaguugguuuguuuuguguuugagugugugugugugugugugugugugugugugugguauuagaacucuaagggaaggcaggguugugagccauuacauauguguaugugaaacagugugucagugucucuacacugaagaccaauucucggcccucacuuaaugugccuuuuauguaacaaacuuguuacauaaaauuuguccuuuacuaucuggaaauggaguguguagacuucugcaccugucauuucaaaaggaguccauacuauaccuacauaauguacauauuguauuaacuauaauacaaguaagaaaugauuuauaauaauuuuauuuagauguauaaguguuuggaugugacacuccucaggagauucgagaaaauaauuggacacuuauaauaaguaaauguaguuuagaagaaaaaucaggcucaauguacaggaaaaugauaagcagaggauucauauugagauuuuacaaacuaaugaacuucacugaaaagcaaaauacagucuccucuugauucauaggacagccacauuccuggauaauuccugguaugcuaaaacuagaugaagaaaaaucucauucaaaaagacucuaggcucagcuaauuaauuauaagcucaaaauccuaugacuugcaggucauauguuaguaaugucagaagaccccacauaucacuaagugaugaacucucucucucucccucccucccucccucccucucuccucucuccucucuccucucucucucucucucucucucucucucucucucucucucucucucucucucucucucucucucuccccccuuaaauauuaggucaucuugcacuguuaacaugaggcaacuuucaccccacccacacccacacccacaauuccuguagauuucuaaaauguccucuagggggcaguaacgccuuuguaaagaacaaagcccugguacuaaggcaaauacaacuaccucaucugugccugcucaccucuggugcaaugugugugugcaugugcucacgucucaagcagugugcauguguguguaugcaugcacauauauacuauacuugcuguccgugagacuguguuucagaaagccugugaguguguaggucugugcacaaaggugucuagacacaggcagguauauucugugcacauacauuuauccuuugccucaaaugagccucagcuacagacugugcuuaagagcccccgaccucguuaauacaaccucuucaagcuucccaagcaauaacagggcuuugcuuguuguauuggguguuguuguuguuguuguuguuguuacuguuauuuuuguguuuuuuauuuuguuuuguuuuggcuuugagggagguugguuuuaacuuuuuguuuguuuuguuuuuugaguucuauguguaauccuggcuguccuggaacucacucuguagaccagacuggccucaaacucagaaguucgccugccucuaccucccaaguacugggacuaaaggcgugcgccaccacgcccggcaacugguuuuaacuuuaaaguuuguuuucgcugagacccugagcuacaaauuauuuaccuuucagccuaguauaucuuccucuguacauguuggugugcuuugucucuguguacguauugcucacugccucccaucucuaccuggucuucuauaucaggguuccuuaauuuuuuuuucuacuuaugaccccuuucaccuaagaaauuuuguaugccaccccagguguauaguuauauaaaauaaguauacaaaucaaacauuuacuauuaacaaguuuauuugaaacauucucaggcaugcauauaauuuuacuauucauuaaaggcaaaaguaaauuugcaugcugagauggauuugcuuuuuuacauagauaauuaaaucuuuucugaauauuugguacugacacauauaaggcaucuucaauguuuuuaagaguugauuggagcugggcaugguggcacaugccuuuaaucccagcacucgggaggcagaggcaggugaauuucugaguucgaggccagucuggucuacaaagugaguuccaggacagccagggcuacauagagaaaccaugucucgaaaaacuaaaagaguugauugguauuuugauuuuauaaccgucaaugcugagaaccucacuucacuuagacacagaguacaaaauggcagaaguaugguuaggggcauuucaaauuuugcuggaaauucugucguacuuccaagccaaaauucaucuaaugauuuuuuuuuuaugacaaucaaaccaacaacucaaauggcagauuauuuguuuauuuuuuuauuuuuauuuuauauuuuuuuuauuuauuggcagguguuugagacagggucucucuuuguaagcucuggcugcccuggaacuuucuacguagaccaggcugcccuugaauucacagagauccaucugaaauggcauuuuuuuaaauagaguauucuaauacaauacaauguaauggcauacuauuuugauacuuacaggacaauaggaaaguauuaaagguuuuaauuuucugcacuucagccauuauguuuuauaaaagaaaaacgauuguauguacaacaaaaacacugcaauucguagcauauaguagugucaagucuucacugaggcauuucggguaccauuuguugucauuggguuguauaguggcauguacagugcaaaguuugcguguuguaugcucagaaccauggcuucaguaacauugcaucuauaaugcagcaugagcaacugcugucagaaauguaugggauucaucacacuuuugauucuggauuaaauuuuggucauuacauauccagaaauuuuguaaaauuucuugaaaccuccauauucagugaugcaacuccauagguuaguaacucauucaguuacaaaccaugcuuuaaggagcuguguucuagaugguugguugguugguugguugguuuuuuccugugguuuuccuucuccacccuuucugucuccucucuugcucauucacgguugcucuguuaucuaugucucuuuuaagucacucucccucccucucuuucuccauuuaugucucuuccccuguccuuuuucuauuuuuucugucuuuccuucuccuaugucaccaucugccugccacacaaaugucucucuuugucacuccccguguaucugacuacugcuuacaaucaaucuaucucuaugccuaaucuuugccccuucccuccccuuauggcuaaggcauagugugucugugugugucugugucugugucugugugucuguaugugugugugagcgcucgcacacacacacacacacacacauugccuuuaauuauacauaguggaaggcugucugcaguccuggaaggggugagagauaucaggucuugagagacugaaagagaccuaucuuuauuucucuccaacuccugcccuaacaccuucucuuuuaaguaggccauuggcuaugagauuaauugauacugucaaaaaaaauccugcuuuuaggugacaggccagauuguauugagcuagaaacaaugcaaaggggacaacuuuacuaggagggaguuggcaagaagauauccacuucaagacccaucucccuagccugucccccaguucauauccagcccuaauagcaaucccaagacucuucaguuccaugugggcuggccuaguaaccuucccucugggaaaugcugucaccuugucauguccccacauugccugccugcacacaacaggcacuuuccuacuccuaaaacuguucuuucagcaaauccagggugaauacuuucauggagcccucugcacucaucguucagucuaguucuuuagccaauuagcuuggcaucuuuucagcaggaaccuacuuugugcaugucacugaccuuuuagaggggaggguaccuaccuacccugcccuuguggagauucuguucuaaugggaugaggcaaguaacaaucuaaauuugaagaguauaugauauaauuagaagacagagaugcuggugagaaggaaaggggcauggagauacuaugaccucuuaccuggauuacuaaugaagccucacuaaucucucuacaucuaccguuauggaacaugcccaguguucccagcaacaaguagaaucuuauucaacccugaaccagaaugacaucuuaaucuuuguucaaaagccucccaaguaacucggaaucaaaguccucccuauggccucuaugcuacguccuugccaacucucugacuuacaucaccaccuaacacuugccccuugcucgccccuugcucaauauuccacccacuauggcuuccuugcuccuucccagugugccaugaauagccccaucucagagccuuuguucugacuguuugucucccuggaguucuagucucccaaacagccacaggacuuacauccucaccaauuugcuuagaugaugacuccuuugugaagccuucccuaucugccucaucaacaacuucaguaccuuccucaccucuagcacuuuaaaucaucuuccccuacuuuauaauuauauuuuacaauauugucaucggcugauauaccaacuccaccugucucuucuuguuaccuaaaaugucaauuauacaagaguaggggauccuuuugguuguuguuguuguuguguuggcuuuugguugguuaauuuuuggguuuugguuuguuuugguuuugguuuucgcgacaggguucucuguguagcccuggauguccuggaacucgaucuguaacccagccuggcuucgaacucagggauccaccugccucugccucugccucugccucugccucugccucugccucugccucugccucugccucugccucugccucugccucugccucugccucugccucugccucugccucugccucugccucugccucugccucugccucugccucaagugcuagaauaggaaucuuuuaucugucugauucacaacuguauccccagagcauaaaacagugugugaccuaauguaaagaaauauuuuuucaauggaccaacacaaguauaccuacauuuuuauauucauacaaaaugcuaaguuaacauaaaauuaugccagaggcugcaucacaauccacaguccuacaacauuuggucuucuaugacuucacuucucugaaauauaccauuuaacaagauuagucuucucacagagcaugcuacacacauuccugaccaugaauaagaucugcuaggcaugguggcauagagcuguaauccuugcacaugggagucugagauaggaugaucccaauucaaggcuugcagaggcugaggaaaauguucauagccaaccuggucuacuucccaaaauccuauugcaaaauuaagagguuuuuuuuuaagauuuauuuacuauuauacuuaaguacacuguugcugacuucagucgcaucagaagaaggcgucagaucucauuaccggugguugugagcugccaugugguugcugggauuugaacucagaaccuuuggaggagcagucagugcucuuacccacugagccaucucaccagccugaaauuaagaguuuuaaaaguaaauuuuuaaagaagguuuaggaauguagcucauuggaugggguagguucuugccuaccaggccugagacacuaaauucaaucaccaguacagaaaagaaaaaagaaaagaaaagaaaagaaaaaaggaaagaaguaagcgagggagagaggaaauggagagaaagacagaaagacaucuaaugaguggcugccaauaguuuaauaaaacaaaacaugaaauacaauagaaaugcacgaguauauuacaauuuggacaaguaguauguaaaacguuuaguugagcucuguguuuguauguguaugugacacacauacauaauuguacuggauuauggguagcaauaaaaaaugcuugaauacaaccuuagggcuuguaaaagggaauaagaguuguaccaacaucuacagcccuacagacccacgaauggaggaagaaaggaaucugaggacguugggagacauaaagcacuuuuacccagcaaggaggggaggggcaggaguagcuggggagucgaugggaagggcucauagacacacuaaccugcccucucuguuucuuucucaucuguuucucccuccccucauccugauccaucccuuccacuucaguguuguuuucuauccauuuguauccuuguuuccauuuuucaaucucauuuaccacucugucucugcauuuuucuguuuccuacccucaucucucugucccucugucuguaucucccuccauuguucccauuugcagguguagcucagcaagaaaacugauggaguccgccagggcccaucaaauacugaacuggccaauccccuaggguuggggguagccuuugccccucaguauggccaacaccaccggagagcccgaagaggugagcggcgcacugucucugccaucagcaucggcuuaugugaagcuggugcugcugggacugaucauguguguaagccuggcaggcaaugccaucuugucccugcuggugcucaaggagcgugcccugcacaaggcuccuuacuacuuucugcuggaccugugccuagccgauggcauacgcucugccaucugcuuccccuuuguacuggcuucugugcgccauggcuccucauggaccuucagugcacucagcuguaagauuguggccuuuauggcugugcucuuuugcuuccaugcggccuucaugcuguucugcaucagcgucacccgcuacauggccaucgcccaccaccgcuucuaugccaagcgcaugacacucuggacaugcgcagcugucaucugcauggccuggaccuugucuguggccauggcuuucccaccugucuuugaugugggcaccuacaaguuuauccgagaggaggaccagugcaucuuugagcaucgcuacuucaaagcaaaugacacacugggcuuuaugcuuauguuggcugugcucauggcagccacacaugcugucuauggcaagcugcuacucuucgaguaucgucaccgcaagaugaagccagugcagauggugccagccaucagccaaaacuggacauuccauggcccuggggcuaccggccaggcugcugccaacuggaucgcugguuuuggccgugggcccaugccaccaacucugcuggguauccggcagaaugggcaugcagcuagccggcggcuacugggcauggacgaggucaagggugaaaagcagcugggccgaauguucuacgcgauuacacugcucuuccugcuccucuggucaccauacauuguggccugcuacuggcgaguguuugugaaagccugcgcugugccccaccgcuacuuggccacugcuguuuggaugagcuucgcccaggcugccgucaacccaaucgucugcuuccugcuuaacaaggaccucaagaagugccugaggacucaugccccuugcuggggcacaggaggugccccagcucccagagaacccuacugugucaugugaagcaagcccguaggugauaggcagggggaaagucagaaucaccauacgggggccagcagcaggggaagggugggacccauacagaagccuucucuuucaagcuucaguccaggcucucaaaccauccauaacugaggcaacucgccaacaccucccuaggguuggaaacggggugaggaacuggaaaagaggcauuucuaguuuuguggggauugucccgcagccuccuccacuucaacaaucuccuuuucccaugcccucccugccuucccuucccucuccccucuccuaucuuucuaaaguaaugauucaguaaaugaaaacaaacugaaaaugcaggguuuuuaauaauaacagcugaggaaguaggcucucuugcuuaaauguccccccuuuugacauugucaagaaaugggaaguuucuccuguaaaauagauucccagagaucguaucguccccugggcucccauucacccuccccuuccaaauccuuuagcaagacuuggauguuuaggaaauauuggcuuaagucuucagacaagagggaccaaauggggugcuauauuccuugggagcaaggauguuuaaauugcuaugugcuaugugcaauguuguuuuuggcuaaccuugguccaaagcccaaucuccaaucccucccuaccauguccagacuucacagguguuucuugaggcuguuugagaagccaagagcauacaaagaagagccuccaugaugugcccaggcuagaugaagagcagaaugggggaugggcuccucaaccagaauauaccaaacuuagcuacguucacucaagcuuccuccaggaauauauaacuaacuuuuccuccuaggaauauauauccacuuuaguccccauuagggaugauguggguauaagcugacagggaaagucacccauggggaaauaguugaacucuccagaguaccuagagcccagaccauggggucagagcuaaauucaaccccacaauuaucccuuggguucacaauacuccccccuaaaauaaaauucuuuggagaccuugauaaucaaaaguuauacaaacuucaaggcacuguggaauugaguccauuucugcuugaccucuuuuugucccuuccaagccucacaguccuugagcuccuccuugguugggccccaaacauccuucccagaaguuuuuucuccauccacucuuacagguggauggucccaagccucuuuuccauggacaaaaaccacuuugggcuuacuucaaggccaguucuacagacuggugagccaaguuggaacucuuugccuaagucuggggcagugaucucuccaucuccuuuccuuccuuauaaacuccuguccuaaacuccaccucuaccccaagauaggcccugaacugagguagucuugacccaaaagcaaugaagggggcacucuaggcagaagagauauugaugacccugguuguggaguggcccuggaaaagcaagccagaggagcugagaggcugggaauguguguuugggguggggcuauucucucagugaugaugauagaaaugccuuucugagggcuggggugcaaagaccaaggugggagggcaaauaggguaaacucgggaggguuuuccuccguuuccuuuuucuaacugccuggauucaucauuggauuuuguaaauggaaaaagugaaaugaacaauguuauauuggauguucucucucucucucucucucucucucucucucucucucuguguguguguguguguguguguguguguguguguguguguguccaugucuccuaucuguguaugaucacaugaggagguaugauugaaugagauagugugugucugugugacuuuguguggguaagaaccucugaggaaaacuugccugguacacauaugugagcaaauacauauaugugaagaaauagaguauacacacacacacauacacacaauggagaggagacaaaacuuaguaugugccugcagcaggaaauagagugcuuaggagauggaaccugaaauuuuucauguauguaugugucaagagagucaacucccaucucauaaaguugucuuccuuuggcccagcuucugagcaccagguaaggagagaauacuuuagaaccccaucucuucccaaugucuggagauucaauccucaccccaaauuucaaacaagguauuucuuauauuagaccaccauggaaauaggaacugggaauaggggagggaucaaacaugaaggcaaugggguuaagaaauggcccccugcaauguaauggcuuuuagaggaacugcucagccuaaacugcaaguccuucuuacgguuccacuguauacagcugggacuugguuuagcuuugacuaaauucagaaggaaagauaacauaacgaaaaagcccaagucuggggaucuacccagcuggccuacucccuaagcacucaauuaauuuacuauuuauuuacuuauuucuucaggugcacagaauugagcugacccuauuacucaguucuuggcacacucuaucauugguccaugcaagguccuuuuauuauuuugcuuuguccccuucaucacccauuccugaucccauccuuccaaccccacauaggcaccgcucuucaguacuuaauguguguccuuccaaaccaccguucauguguuuauuuacuuauguguaucuguggaaaauauaugguauugauguguuuuaauuuacauaaacaguauuguacuauaaau

SEQ ID NO: 9793 - RNA, 160429 nt, Mus musculus
cccgagcccaucggcgccucuagagcugggcgggagggaccgugcgugcgaccucacgccugaccagguccaguucgggcagguuucgcuggucucggagagcgcgccuuaaccccuagcggcugagcgcacuagagaaaccccuuuggaccucuagcgcagucagugcgaaaaccccgugugcgcgcccccgggagccggccccucccucuccccugcccaugcugaagaggagcgcgccugcuccgcccccuccccguuccccuccccgcgcccuuuuccgcgcucccuccugguccggcccgcguagcgcuuuccaaguugcaaagcaaguucagcgguggccggcggcuacuguaguggcggcggcggcccagccgccuggaggcuccuagguggugggccgguucgugcuucccggagugcaugggcgugggcauuagcggguggaagggcugaguguggaggggcugagcgccccgcgucauggagggcgccgagccccgugcacggcccgagcgccuggccgaagcugaggcgccggcgaccgacggcguccgccugguggaggugcagcugagcggcggcgccccuuggggcuucaccuugaagggcggccgcgagcauggcgagccucuggucaucaccaagguaaggcuaccccggggucugccccgugacaguccugagauaguccggacccagaaggcuggucgggguuucagggcgcuggaugggacguccgguucgcggccucguuuucugggacgcgucuguugggagucaccugugggugcuggguucuguucagccauaggugugugguuccggcuccauccuagccgcccucgggcggcucccaacauugcugguaguuucaauggcuccuguuccgggucuccuuccccucccccucugggaaagggccuggcaguccccuguaacuccuggccuguccagcgguggaccuacaccugcgaggcugccaugaaaugaagggaaaaaaaauucccaggaaccagggaguggguacagcuuucccaacuuuuguuugcuuguuuagggccccugguugucacccuuuugaucuguaccgguuuucagucugaaacucccuacuagaagcugcugccaggcaguuucacgauucccaggagcucaucaauauuugcugacuuucggcuuccuguccuacauccacgcgcucuggauaucuaccaacacuuaaugaaacuuuuucagagugcuuuuaaaguagaauuugaguucugauaguaagaaaagagaucuuacuuggaauuaacgcgugugaguguguguguagguugcuuuagaauugguauucucuuaaaaugcaaucuauccugauacuuaccaacuaaacauguauaaacuuguauaaauaaacaacaagccaaucucucagguguucugguuaaaagaaacuagggcccuguucucuaagcagaguugagucuuaccaguccuaaggacaaagucuccuuuaaaaugcaaauauuccuggcuccuuagagguguuugaaggugugaaaaugacuuacaaauuuccuuaucuucccacccggauuaaaagcgugaagaauuagguggcuccacuggucuugacuuugaaaaguggugugguguuggcggcauucaaacagcaaaagaccucaaaucgaucaaucaccccucacccuguuacaaaauuagccaccauguaaucuuuuauaucaaaguggauucuuuuuuguuugauugugccauuccagggaauccaagccccagggcauuccacaugcgaggaaaguucuguaccacugagcuuuauaccaaguccgagucugauacacucacuccccuuuuuucuuuucagugcuaggauugaagucggccuuggcaguacuaggcaaguacucuucucucacugagcuaucuacagcccuuauuuuuauuuuuauuuuuauuuuuauuuuuauuuuugagacaauggcucacuaaguuucacuagcuugccuuaaaguugcagccccccccccccagccacccgagugcuaguauuacagggcuguacuaccacagagaaucucaucuguggcucuaaacaaauacuuacugguguuucuugugcauuguguuuugccugcauauauaugucugugugacggugucagauccccuggaacuggaguugcagacaguucugcacugccgcauggaugagugcuaggaauugaaccuggguccucuagaagagcagccaauguuccucugugccuuuuaauaaagguuuucgaggucauuucugauguaguuaaaaauguaucagguacaucucucaguucuuucacgcuucacuuuuuuuuucagcuguuguuuguguuguuuguuucuucuuuuuccuccucugaggcacucuuuugauauuuuauauauauauauauauauacccggcuaaaauuuuaggauuuuuaaaacaguauguguguauauauauauauauauauauauauauauauauauauauauauauauacaugcauauaugugugugugugugucuccucugcaacaaguauucuuaagcacugagccaucucucuaggcccuagcauuugggcuuucacuguauaagaaagguggagguuagccgggcaugguggcacaugccuuuaaucccagcacuugggaggcagaggcaggcggauuucugaguucgaggccagccugguguacagagugacuuccaggacagccagggcuauacagagaagcccugucucgaaaaaccaaccaaccaaccaaacaaacaaacaaaacaaaaacgaaaguuggagguuauuuuaaauggaaagauuugcuagagggauuuuugugcucuuuuauaucagauaguccuggcucgcucucagcuuuuuagaaauggaaguaggugcuggucaaacucagccaugcuaagcugaacuacugagcuauauucucaccuaugcauaauuuucacauuucauuauaacugaaaauuuauagguuuguugcuuaggaugaaugggacucagaacaacuugggguuuuuguauuuccauguacacauagacauucauguacuguugcuccugugugcacaugcauggacuuuuaccacauguucuauuguguagaauuaacaguauuucaucuacuugucaguucuuuacuauuaagaauauuaguacauaggcccagcaaggugacucaacucccuuuuaaaggcacuaagccugaugaccugaguuugguuucuggaagccacaugaacaccaugguacacauacaguaaaaguaaaaacaaaaccauuaucagugcuguuugcuuacagcaugaaaucugguaauuauuugccauauuauuuaaaaaugacaaagggcucgggagagagauagcucagugguuaagaacauuggugguuuuuccagaggacucacaugcaauuucaagcacucacauggugacuuacgacuucgguaacuccaguccuagaggaucugacaccuucuggccuccacaaacaguggagcagauauacauucagacaaacauuuauacaugugaaauucaaucucaaaaaaggaugaaggaaacauuuuuguuuacagccaauuaaaguuagaaauagacugcucuguaguuacuaguggaaaauugucaccuggaauuuaaucuaaauuuuuacuuuucuaguagcuauugaaauguuauuguauugaagcauauuaaauauguuuuucugauaguccuuuuuccauuuaaaaaaaucuaugcaauaguuaauguuggauccuugguauaccacaagagcuuucuguuuuucuguuaauuagaacuauauuauuuuuauauuuauauuauauauucguuauuuuaauucuguuuauuaauaauuuucuguuuagcugauacugauuugggaguagcuugaucuaauuuaagaggacacauucuuuugauaauaaugugacuaucauuugaagaucuuaugagcacauaucuuagaacugggaagggcuggagauguguguagcuauacaagaugcagaguaugaucuucaacaucacaggacaaaacaaaacuagaagagaugguaaaaaccaggcugauuuaguccugguuuuuaacugaagaauucuuauuggcccauuuuguggauugacagcuaugaccaagugaggguaaaaugguggacucugaggucacagacauggcaaguucugcauaggaccuugaaagucagacucugauugugaggaucugucuugcuuccuguccagcagauacuaucugcuugugacugaacucccuugcuguguuauuuauacugaguaacucgaugccaucuguagggugacaguuuuuccaucuuggcaccauugauauucuguuguggggucuuuucuaugcacuguaguccauuuagcugcuucuuuggcuucuaccuacugaaggccauuggcacaugucuccagguaugacagucugaauguuuccagacauugccacaugcccccaaucuacaguuauaaaucauuuauuaggcuccuagugugucacuuuuucuuuuaaagacuggauuuuuauuuuuuauuuuuuaaaauaguggccuuuuggugguguguuugaaggcacuuggcguuuccaguguuuucauguaggucuguuuuucuuuuugagaugagcucuuggcuuugagaaaaggcuuuauuuacacaguaaaaugcaaacaaggacuugcuucaucugcauuuuuguaguuggagaaaggaaacagagcagagacuccccagaacugugugcuucaugggcaaucaaaauagauguuggagaaggucugaguuuucucaggagccgguuugaaguuaaaggauguuaacuuucccugaaaaaaaaguaagagccuuuguagaauuucagauacaggccugaaacucaacaagaccucugcugaaggauagcguuaggagucauaacuucugaguauauuuauaacauugcagcuugaauuuuuucuaccauuagcaaacaaacaagcaaaacguguguguguguaugugucuccuucacuaaaaaaaaaaaaugaaaacacauuaaacuucauuuuuucauucugauauuguaggaaaaacaggaacaacuugcaguuucuaaggugucaugacuugguaauacucuuugagaguauucauguguucagaaauucucagggcacuggaauaucacacaguuaauuuucuauuuaguugguggugauuuguaagugaggugagccauuggguuguuguuguucccccugcccccacccccaccccugccuuuuucuccccuaaauuauggaaacagggcuuugcaagugcucuaccacugagugacauuccuaggcaagucuugcugguguuacuuguuuccucuuucaauuuagccacugagaauuucagugggggagaagagcaagcucauuucuaugaugucaccuacuggagaguugcaucugccagcuggguaucaggaggcccccugcaaccucaggaauguuuaucacggaagaaggaaugaagcacuggcuauucaucuuuuauuaaagcccuccuuccccccuuaagaaugccagaaauugcuaagaacacauucaucagggccugggcuagcuugaccuuccuggcaagcuccuuugaaaaccuaguuuucaaauugucuuugggaaauacaacauucuugaugugcguguuuguguaugugcacuacagugguauaggauacuuggaaguguuuuauggaccaggacaagcaguuggugauggguaugugugugaggucuacuguguaacaauaauaccuuagcgauugagaaaggaguuuagaggcuguguggaguuaaggucaugguggccugagaccagagacguuaaaacaguagcccaaugguugucccuuguacccuuuuguguuguugauuuuuuuuuguuuguuuguuuuguuuguuuuuuugagacaggguuucuuuguauagcucugacuguucuggaacucacuuuguagaccaggauggccucgaacucagaaauccgccugccucugccucccaagugcugggaucaaaggagugcgccaccacacccggcuuugcagguucuuuuuuuaaguuuuauuuuuauuuuauuuacauaaguguuuugccugcauguaagugcacagaauacaguguccacagaggccagaagauagauuggaucgagaauuacagaagguugugagcuaccauguggguacugggaacugaaccugaauucucugcaagagcagcuggggcucacuugagucaucuuuccagaccucauuauugagaggcuccauagagcccaggugggccucaaacuugguauacagagaaggaugacuuaaacuucuuguccucuuggcuccagcuaaaucuuuuacaguucuaugccuccacagcuaugggguacggugcuagggauuuugagagacaaugagguacucuaccauaugagucccaucccuacccccuacauuugauuuugauuugaucaccaagcuggccuggaaaucugugucaaauuacuugagucugagugcugagauuaugagugugcuacuaugcuuaagggguuuuuguuuuuuguuuuuguuuguuuuuuguuuugguggugcugguggcggugggguugcuggcuguagauccagagcuuuuuaaaggcaugaaguucuaguugaaguuuugaaagugggacucauugaauuuagcaguggaaagauaaaugugaacuucugucuggaucuugguucacuucugugugccacacaguucacagcaggccaaacuacuacucuguuaguguuugagagagcuugggucaccuccccacccccaccuccucacacuagggugcuaagguucuauaaguccucagaaugguaaaacccugucucuaugcaguggcagucacagcaggauuugcaguuauuaggaugaguguaauucuaaagauauauuugucgugaaaauucagagucugguuaaaaacacuagguaaguuuucuuuccugugcugaaaggccuuuucacuugggagacuugccuugccaacuggcuuucaaauauaucuuuauuaccccuuccagcuugcaaauuaacuuggccuuguggaauucuaauccuuguuccuucagagauguuuuaggcacaggggguggggagccaggcacaaugucuaaagauguaguccaaggucuuauagcuggaggcuuucagcuucaaaucacggaggauucucucuaugggaggcacuagaguaugugacucacaccuauaaauccagaggcuuccaccauuacaaaaaacuauaaaccugagcuaugccccacacuucuguauugugcugaauucggucuuccuggcugagguaggaguauugcuuaacauguccuaacauuuaucucuugggaaaauaauaaagguagaaagcuaguuugccuaagagcuacauguugaauaauaaauaguaguuuucacuuggacauaaugagauagucuuuuguuuuuucuguuuuuuuuuuacuuguguauuucauaguucuuuacuuaggaggacuuuuuaaaaugcauuuuggaauuauuuccuugcagaaguuguuuugugucagcaugcaaauaggcuuggauuuauggcccagcucuuagaagcaaaggaggaaaaguccuggggucuguuuucuuugcaugccaggcaaggaggaaacauucaacaagauaauuucaggguauaaaggcugaaugggcuuuuuauucaggccaucuuuuacuuucagacacuagaaagguguggggccaaggccuuauaggagaaauuguacaguauuuggaagauuaggcucuuuugauauaugugugcugagaauuuuaacccacaggaggauucugaaagaguucuauuaggacuuuaaaacauacagcuggaugaggagugaggggaauugguggucccugaagauaagacucagcuuucuuuuuuugguuugguuuuuugagacaggguuucucuguguagcccuggcuguccuggaagucacucuguagacuaggcuggucucgaacucagaaauccaccugucucugccucccaagugcugggaucaaaggcgugcaccaccacgcccggcagcuuucuuuuuauacugaaaaauauuuuucauauaguauauuuugauuauguuuccccccccccaaucuccaacuccucccaguuccuucccaccccucuacccacccaccuuuauguuuucucucuuaaacaaacaaaaauaaaacauaaaaccagacauacaaaccaaaacacaaccagaaaucaaaauaaacaagcaaaauacaaauaaggcaaauaagauucccaucccagauuuguuuuuauguuuauggaaauagcucuuugguauuaaaguuuauuuuuuucauuuuuuuuguuuguuuuuuauuuuugguuuuucgagacaggguuucucuguguagcccuggcuguccuggaacucacucuguagaccaggcuggccugguacucagaaauccaccugccucugccuccucccaagugcuggaauuaaaggcgugcacaugugccacaacugccuggcucagaugguuguucuuauguacucugaauuacccaggugcugaagguaggccuuuuguauacuaggcaagggcuuuaguauagguuuuccaugaccaccagugagguacaguaccaacucuugaaacucuuucauuuauuucuuauccuuaaacaguccauuuauagaugucacucuaguuuuuguugcuuuuccuuugcacuauagacuaggauuuagucuugccucugcaaagacuccucugcuaaucuuucaucucccaacuccuugggcauauuuauugucuuuucuuccauucccagugaguccauaauuuuggcuacaagaauauuuuuucaacauggacauuauugauauuuggggcuaaauuauucuuuaucaugagaucauuugugcaagguaggaugucaucuuaggcuaauccccccucagugacagcuggugacagccaaacagacccccagauauugguagauguuuuuugugugcuggcuaguuuuuugucaacuugacacaaauuagggucaucugggaagaggugacccguguugugaaaaugcuuauauccgaaugacauagaggcaagccugugguauauuauucugauugguugguuauuugugggggagggccuagcccacuguagguaaugccaccccagggcagguaaucccagggcuugugugagaaagugggcugagccagcagugggaagcaagccagcacuccuccauggccucugccuuaauucauacaagcuccagguuccugcccugaccccucuuccuacagcacuaauaccuauaagaugaaauaaguccuuuccuccccaagucuccuuugcucauuuuguuuaucaauaacagaaaccaaacuagaacacccugaggacuagguuaacaauuuucagugcuuauauuauuuuauuuauuuauuuauuuauuuauuuuuuacuuuguggugguagaaauagaacccagagccucauauauucuagguuaacaucucucucacugagcuauaucuucaauugcaaagauuuuuaaagcuugcuuucuauauuuacuuuuaguauuuugugugauugaugaucaacuuagugcuguauccuaugcaaguguucccccacugaguuacacccuaguccuauaauuuggauggcaaaugaugucacuguuuggccuaugggaaggagacuacaggcacauugugauuauuuuucaucuauaagauugcacuugggcugguagugguggugcacucugguaggauuugcugaaggaggcagagguaggaagaucagaaguuugaggccagcccaggcuacacauuuuacaaaaaaaaaaaaaaaaaaaaaaaaagccgggcauuggcgcacaccuuuaauccuagcacuugggaggcagaggcaggcggauuucugaguucgaggccagccuggucuacaaagugaguuccaggauagccagaguuacacagagaaacccugucuugaaaaaccaaaaaaaaaaaaaaaauugcacuugggaggcagaggcagguggaucuuugaguuugaagccagccuggucuacagagggaguuccaggacagccagggcuguuacacagagacacucugucucagagagaagugggguagggaggggcagagagagacagagagagagacagagagagagacagagagagagacagaguuuuauuucauugcuuaauuucuucugcaguuguuacuuacuguaaauucucagugguggcacaucucuucuuauauuuuuauacacaccaaaguagcuuuucuucacuuugcaauauugggguuaucuugccacucugguggucacaguucuccguuuucugcagugcaauauuauagaaauaaggucagacauuucugguuuaugaucuguuagacuuucucuauuuuuucucucuuauuuuucauuuacuugugauuuugaucuugggagauuuuguuuaaccuuaucuuccaaucuucuuuuuuuuucuccaaauuccaaauuuuguuucagaguuguucuuuuuguugacaccauauggauuuuuuuucauuucuuuucuuucuuuuuuuuuuuuuugauuaauucuuuugucuaauaauacugaggcgguuuucaaaacuaucaacuuuccauaaggauuuuguuucuggagucggcuuuuauuaguugucugguuuucucucuucccugacagaaguuucugguggucuuuggacaucuccuggcauuaaagaacagauuguuugaauuacauauacugugcauaugcaugaguaacccagugagacuguuuuuuuucugggaaaucuuggaaguccaaaccucagguuguuucuuuugagaguggucauauccuuaucauauaguaacuuuugcacauauuuuuguguagaguggacugcaagguggaaggcuaacaauagaagagacccuucccuugcucagcugagugaacaagacagaagaguagucguguccuguacucuagccauagugguuccagcuugaaggaagccaagccauccacuaguaauaaguugucaaugccugcugguguucacagcuaguucuuucacuugguccuuagccuuuuuaacucucuaucccacaguuuguuaaacuuagaaucauuucugcuuuauuguauuacuguaggggauuaaaugaaucagcauguaaagcgaguucuagaauucauucucuuccuccucuccccucaauccagauucauuauaaaacugagaaauuauuuuguuuuuguguguguguguguggucugucuuuuuguuuuuuaauguauaugaguacacuguagcugucuucagacacaucaguagagggcauuggaucccauuacagaugguugugaaccaccaugugguugcugggaauugaacucaggaucuuuggaagagcagucagugcucuuaagcacugagccauuucuccagccccugagaauuuauuuuuuaaaaaacuguuuauguauacuucuuaguuagggguuccauugcugugaagagauaccaugaccaaggcaacucuuuuuuuuuuauuuuguuuuucauuuauuauuuucuuuauauaaauuucaaaugcuaucccaaaaguucccuauacccacccgccccugcccugcuccccuacccacccacucccacuucuuggcccugguguuccccuguacuggggcauauaaaguuugcaagaccaaugggccucucuuuucagugauggccgacuaggccaucuucugcuacucuuauaaaggcaacucuuauaaaggacaaaauuuaauuggggcuggcuuacagguucuuuuugagguucaguucauuaucauugcaggaaguacaucagccuccacacaugguugcuggaggagcugagaguucuauaucuucauccaaaggaagccaggagcagacucucuucaggcagcuaggaggagggucucaaagcccaaccgcagagacacacuucuuccaacaaggccacaccuccuaauagugccacucccugggccaaccauauuuauaccaccacaguaucaaaguacuuuuuuauuauagacagaauuugagcuggauuuugcauaguauagaaauuuaauauguaccaaggugauuuuuuaaaaauuuauuuauuauuauacauaagugcacuguagcugucuucagacccaucacaauaguaugucagagcucauuaugggugguugcuaggauuugaauucaggaccuuuggaagaacagucagugcucuuacccacugagccaucucgccagcccccaaagugauuuuuauacuacuuauuaguauagguuucauagauaaugcauuuaaguuaaagauagaucuaauuugaggauguuccucagugguugagugcuuaccugguguggcccuggguuugauacaaagcugcaaauuauagauacaugacuaaaugaaaguaaaagcuacauccaauauuaguuucagucuguuguuuucauuuuauguagccccagaaaugaauauuuucuucuaucucuccaaaacuuacaauuuuaaaguaauacuuauuguaauacaaaugaauaauaacacauuuugcuaauuuuauaauaacauaaauguucuuucagaucaacaggaguugucacaggugauuuuuuuuuuaaggugagugaaacuagugagaaggauaaacacuaaacaugcuugugacaucaggcuacaucuuacuucacuccuuuauugauuuguaauagaaaaucauucaaggaguugaauucacagguguggugugagugugcuuuguggaaaacuccauguagcugcuucccaugcaugcauguauggcugugugaccauccuaccucagugaaguccaaagagaaguaaugucugccauuuuuuuuuuuuuaaagauuuauuuauugauuauauguaaguacacuguagcugucuucagacacucuagaagagggagucagaucuuguuggggaugguugugagccaccaugugguugcugggauuuugaacucuggaccuucggaagagcagucgggugcucuuacccacugagccaucucgccagcccccugugucugccauuuuauaaccaacccccaaagucccgcucugccugguugggauaaagauaaaguuucagaacagggcuuuaucaacauagguccuugaaugacuaaugagguuguuucccaggaucugucauucacagaguauuacuacuguaugagcagcaugaucauucacuuuaucuauacugccauuacaugaaacaaaccugcauugcgauuugguuccuggauugcuuauuaagucagacuguucuaacaaaugaaauccuggcacuaaucaaaaguuuuucuuuaaacaaauaugcucaagggacaaaauauauaaugcuugaaaccuguguaggaggacauauuuuacuuuguuggaacaaucacaguggcuguccaguuagcacacggcuuauuccuuacauacucauuauguaaugugagacuuccacaccuguggcuucuucaacucuauccuuuccuuuuagucaguaauuuaaauuuuaccuagucuugccuuuccuccaugucuguagaugcuuacuugggaauucuguagaggaagagcagaaagcugugcgaaugcuuaguguagauaauuagcccucagguaggacugggugauguaaugauguuggaguuuguaccuuggcagugcuguccuuuucuuaaccacauggcuuuaagugcagaacuuguugcagggaaggcuacuuguuaaguggucaugaauggagcugccuucaucagauuagcuaauuauaauccugaauggcagacuuuuucuucccuugaggaauaaaagcagcacauagacacauaugaguuggaucagcagugugauaccuggggaagaugugaggaaaugcuagguaaguagcagaaaguccuuccugcauuugugaaguagguaaagguaguucuuugucuacagauccaaauuccuguaucuggugaaauuuuaucuguaugugaauuguguauauguuuguaaauuugcgaacaacuugauauuuaucaguguuaguuuuacauauguuuguaaaguugugugcaugguggcaugaugguacuuuaauauugucugggguuguaguucauugauagagcacuugcuucauaugagccaagucuuggguuugauccauaacacacacagacacagaaaauacauugauuaguagcuuaaacauaauaugauccuuguagaaguauaauuauauuuauuaauuuuucucuacucaggaauucugugcugaaaacaguguaagacuuaaugauuaaaugcuugaagauaauuaucuuaagaaucacauugucaaacugggugugguagcacagaaaucauaacuuucagcccuuagaaaguggaggcaggaggaucaggaauucaagguuaacuucugccauuauauaauuaguuucaggguauauaaaggcauaccucaaaaaggaaaacaagcacacacaaaaaauaauuauacugccaaaucuuuggaaucagaagacagaucaaaagaaguuuaauuuguucacguugaacuguuaagaaaugacuuuugggcuuagagagauggcuuaguuuuuuucagagcacugaguuugguucugagccaaaugggaaucauuuaucuuuucuagucuccuggauuucuaaucuuggcuauagguuuauuacuaaaucuagaaaucaucuuugauaauucucucauuaaacuucuauaaccaguugaucgugaacauauacuugucacauaaucuuccuggugagauguuaaauaucuauuuauuuacucagguggaagggcauagacacaaaacagaaaggauuccaucuaagugccuccugaugaaccagugaguuuguugguauuuuccugcuuuagcuguuucugaagucaccaucuggugggugugggugugauuggaaagaggugugguccaggauaaggaagaucauggagcagcaggacccaacaaauauaaagcuagagaggcugauuaugagguacacuugagcacagagaacuaagguuuuguccuggauaaagaggagcauuguuguauuuaaacaguuuccacuucuuucugaccuuguagcuuugaaagcauucugaucuugaguuguaggaauuucucuuaauauagugguucucagccuuccuaaugcugugacccuuuaauacaguucuucauguuuggugacccccagccauacauuuuucuuguuguuguuguugcugcuucauaacuguaauuuugcuccugcugaugaaucauaauauaaaugacugauaugugaccccaaagagguugugacacuuguaugccugauguccauggaggccagaagagggcuuggagccauguaggugcugggaaucaaacccaggucuucugaagagcagccagugauucuuaaccccugagcuaucucuagacugaccccuuuuaauuuuguuuuuuuuuuucuaacaugguaaauuaguuacuuuuaagauugcuacugcaaccugacacaaacaacauaaggaaggaauuauuuugguuuagaucaaggauucaguccaucauggcagcaagguuacgguauagaagcaugauguagcuggucacauuauaccuguagucaaaaagcagagagcaaugaaucuuuguguuucggguacuuucuccuguagauuuaguccaggauccaagcacaugcuacccauguuugaguggauguucccaccucaguuaaccuaaucuagauaacucuuuacaggcaugcucagaggcuuguguccuagguuaauuugaauccugugaguuugacaaucaacaauaaucauaacagaugggaauaugcuauauuuguuucccaggcuggcuuuaaauuccuagguucaagaaaucuuccugcauuagacuuccuaguacuugggacuauaggugucagcuacuguguucagcuaaaauucuuccuuuuaacguguaggcuuaagaguuuguuuuuuuuuuuaauuuacuaaaccucauaguuaucacuuuaaugccagaacauuuuuaucaaccccaaagaaaucuugcaccuccauuagcaguuccuuucuauccucucacuacaucuauagcaucuacuaaguguuuuuauuucucuaacucuguuaggguuugucuaguuuagguauuucauaaaaacagaaccaugcuauguaguccucugugccuaguuucuuuuacaaagcauaauguuuaugaggcucauucauauguaguaugauguaguauguaucaguuaugauccaauacuauuccauuuuauaauggaccauaauuuuuauucauuugcugauggguauuuggguucuuuccacuuugggaguguuaugaaugcugcugcuuugaacauuuauuuacuaacuuugccuaggcauuuucauuuggggaauuuuuuuuucuuguguuucaggcuuguuaacauccucuaggcauggugucugugaggcccuguguauagggaggaacccugugcuucauaaaggaauacaauuggucacuggcucugaggcugcuuacccagaauuuaaacuagcaauuuauaaaaugauggggugaaaugggucagcagguuaaagguacuugcugcucaagcuuugcaaccuaaguucaaaucccuggaauccuagcaaagauggauggagagaacaacucuacaccuacaauauugcaugccccucccauauuacaauuuuucaaaagcuauagaguuguaugggccuuugcuuauccaaacaugaaucguaucucaugauagcucucaggguccucccaaauagauauauuucaguuaccagaauauauuuguacuuuggauugccaugauaguuucuuuauaauccuaugaaguaaauaggacgauuuucuacuuuacuaaggaugacaaauuuguugugaggggagacuguauucucucauagugucaccuucagauggggacaggaaguaguucacaugucuacuguucagaggacaagaauguagacuuuaccuucuuacaagguggccaucuuucuuucgcaagggugugugucaauauccauucuucaguuggccuaguaggagaauguccuuuucaccacuacgaacugauccuggaauccuauugggaaauuaguagucgucuucuuuuuuuuuuuuuuaaagauguauuuauuuauuuauuauauguaaguacacuguagcugucuucagaaaccccagaagagggccucagaucucguuacggaugguugugagccaccaugugguugcugggauuugaacucgggaccuucgaagagcagucggcguucuugaccacugagacaucucgccagaccccaguagucuucuuuuaucccuccucacucuuuccucuuuagaauaaccaacaacucugcugcaaaagaaaaugcaaaccauguuuuuugauaguuucuaguuauguuuucauuccacaguagaagggaacuaccccaauaaauuuguuauuauagaauuaggggucauugaguguauuguaggguuuauaguuuuucugugaauauuucacuuauguguuuguuuuuuugcuuucugugugcugggauuucaguugugugccccaccaagccuaucuuaauuauuuuuccuuuuuuuuuuuuuuuuuuuuuuccugagacaggguuucucuguguagcccuggcuguccugaaacucacucuguagaccaggcuggccucgaauucagccaccacugcucggcuugaauauauuucuuaaugauucauuuuuaauauuuuauacucuuuuacuaugcuuaauucccaaagaauauuuuguauguuuugaaacaacuugguauucaacauuauauauaggaucuucaguuaauguucauuaaugauauuuuuaggguaugaaaggauaugacuuuaaaaguugaaugagccgggcggugguggugcacgccuuuaaucccagcacuugggaggcagaggcaggcagauuucugaguucgaggccagccuggucuacaaagugaguuccaggacagccagggcuauacagagagacccugucucaaaaaaccaaaaaaaaaaaaaaaaaaaaaaaaaagaaagaaaaaaaaguugaaugaauuuuuuauggauuauuugauucucaaaauacucaauauuauuaauaugcuugauguauaaaaugcauuuaaauaauaagaaaauuuaagaagaaaaaaauuuaaaaaaauauuuugaccauuucuuuaaaaaaaaaaaaagccaccucuguccaaguggcauucuuuuacugguaauguuuuacucucuggauguuucuucagacagcaaccaaauuacaauuuauguacaguaaaccgccucucuagaagguguacaagcugguguacuuugacuaucuucaucugggacacuggaacaucacaacuaagccacugagcaugcgcuccuuagaccccgcuccuucaugagguuccugauuugcuuuuugucacaaaaauaaaugaguuuguacuuuagaaaauucugcauaaauauaauuacaaaguauguucuuuauaucuggauuccuucacucaaaugaacaaucauuugagauucguguaaucuauuacaggaaucgauuguuuguucauuugaauacugagucgcaucccacuguguacacaugccacaauuuauuguucagguuguuuccaguuuggacuguuacaguaaaaguugcuaaaaccaaaaaaagaagaaaaaaaaaggcuaugcacaacuaccuggcuuccuucacccauucuuagcuccauaagaaguaccagaagucucaagcuaacaauacaugugcuugggaugguucuaauagccagauaacugucuguaaauuaagaaccaacaaucauuuuauuuaaagguccacagaguaaauauuuugaggguugugugucuauguagccagaaauagcuauagacaauauaaaaaugaaaggaccauguaccaauuaaacuuuauucacaaaaguuggcaguugaggguggagcuguagcgaucucaguaguuaagagcacuugcugcacuuggagaggacucuguuucagcaaccagguagcagcucacaacuguuuguagcucuagcuucacugggauaucuggacccuucuucugggcuucaugggcauguaugugguacacauauagguaggcaauauucuuacccaaaaaaggcaaugggaaggauuugguaugcugauugauauuaagcagugcauuuucagugugguuucagcagcaucaguauccacugagaauuuguuaggauaaaaacuuuuggacgcugcucuggaauuaaugaacucaauauugcaaggcuguugaggauaagccagcuuauucuacuacugacuauuuugaggacuauugccuuaaggaggcaaggucauuuugcaugggaaucaucaccaucaccauuugcauuuuuaaaauauuuuuauuagcauauauuguacauacuugauuucuuuuuuuugggggggggcaguucccgagacaggauuucucuguguagcccuggcuguccuggagcucacucuguagaccagguuggccucgaacucagaaauacgccugccucugccucucaagugcugggauuaaaggcgugcgccaccaccacccggcucacaauauuuuuauauaugcacuuaguguauuuugauuauauuuaucucuccgcaaaaugcucccuuguuucuguuccccugauucucuucucuugccaacuaguccucuuccucccuuuucaugccuugagaaaaaacaucuuuugauggcccauugaauuuaauuaagguugcuuacacaagccuggauacuuuaccaguagcuauaccacuugggggaaaagucucaucuuuaccugcaaccauuaacuggccauagauccuuagguaugaguguguccuuccucuuguauagguaaucauagcugcuuugagcucaagagaggaccauccauaucaugugucaacauucuacucucuggcucuuuucaccucauuuuucaauguucccugagaguuggagggggugauauagauguccuauuuauggcuaagcauucaagagucacuuauuuucagcacauuggucacuuaaaagucugcaguuaguacuucccguugaacaaacaaacaaaauaaauaaauaaauaaauaagaacuuaucuuaccaaagcugauaguaucaguaauguaaggagauaauauaguuguuuuauuuuuuuaaaacucuguguguguguguguguguguguguguguguguguguguguguguguagggguagacaugugaguacagguuccauaggaggccuguggcauuggauucccuugaagcuggacuuaaggaugguuuuaagccaccuagcacuggugcugggaucugaacauggguccucuucaagaauaguaauuugcuuuuaacugcugaaccauuucucuaacccugaacauaauuauucagaauaucauuucaugaguacgacuuguccauuucaucguuagauuuuuuuuuuaaagucuggaucucucuguguagccagauauuuauacgucugagauuaccagugugggccaccaaguccaaaugagacaauuauugacaugugcaagaaaaacaaaacaaaacaaaaaacauguuuucuggaccccagaaagguaaauuuuagcaacugguccagauggucugaugcacaccagaaucagaacugauuucuggagagauggcuaugaaggaaguacugacugucuucuagaggacccaaguuugcuucccagcucucaugugguggcucacaaacuacaacucuagucccuucguaggcacugcacaaaaguaaugcacagacauacauauagauaaaacauccauaaauauuuuuaaaauaauuaauuuagaagcaaacaggaggcauuagggaaccuuuucuaacuacagccuucacuucaguugaggugguuugcaaggaaaauugugaauguggaaaacuggagauguguguugugugguuuucuuuugucucaugaacuuuacccagaguaacuguuccaguaucugcauucacaugccuauacacauggcuuuacuuauccugguaccucaauguauucugaagugcuggagaggcugggauuuugaugugugaaaugaagauggguugaggaaugcuguucaacacgaugacuuggauagggagugccuggaacagauuauugacugcaagagaaaauagaggcaguaggaucaugaguuugaagucaaacuagacuacuuggugagugucaggcuagccugggcuauauaugagacacugucucaaagaaagggggaugcccccauacacagauucaagugcuggccagcauauggaaggaagguccuggguucagucuucacaguggaacaaaaggccucauauauuuuacuuuggauuacaaaacccugagcucuuggaaggccuuuagggaucacaugcauugucaguuauuaggauggcccagcaugcauuucauaguagucauugcuaaaugcuuugugcaugucuguguugguuuggcccuggaucugacccaugacuggacaguccuugggagagagauaggugcucuuuaagaggccucaucaucccaugcugacugaagggaucuggagaagagagucauagcaggcaauaggugagguaggaggagcaacauccuuuuugaaaggcagugagagccauggaaagauuuuuucuuuuguuuuguuauuauuuucuguuggugaucaaaucuaguauacuagucauauacucuacucacaugcucugccacuaacucccaguaccguggacauuuuuaagcaaggauguggaagccagggccacugguaccaggugugugaacagaugcaggggugugcagagaguaucaggaaacuuugagcugcuggggagaaguguccagggauucaaguguuaucccugaggcacuguuaggaacaccugacccuuggauggaggaugcucuguggcuuuaagagucugcucccuucuuuuaauuuccucuguaacccaugccuggaggaggccacggcugaguaugguuggucacuggaggcuuggcuacuagaucugcugcaccaugcacuagacagguagcagcuccugaaagcucuggguguuuugcuagaugcuguacaggucauaccuuuuucuauuucuuggugcacaccuggaacaggugugcuuaggugccucagcugggggcugagccacccuagggcauugucccuccuuagagauucaaucaaacaaguggugugaauuucugugcucaguuccaacagcuaccaagagggauggaaauugagguccuccagacccgggaguguugaagcgaccaggugugugccaauaggccuuuugaaaaaauaaggauuauuauaaaauagcuuucuaggcgacacauuuggcucacuuugauauaaaauuucauuuuacuuucucacauuuuuacuuauuuaccuuauuuuaacuuauuuauuuuugaggcagucuugcuauguagcuuguucuggcuagaacuugagguacucuuguuucccccucccacaugcuaggauuaaauuuccucuguuuaaagaaacacuguaagucauaaauaaaaaucuagcaaacaugggaguuaccuguuaggauagagaucagagucuuuuuuuuuuaauaaguuuuuuuuuaaagauuuauuuauuauuuuauguaaguacacuguagcugucuucacacacaccagagggcaucagaugucauuauggauuguuguaagccaccaugugguugcugggauuugaacucagggccuucagaagagcagucagugcucuuaaccacugagccaucucuccagccccgagaucagagucuuaucugcuuuucuuuuugaaaauaacaugcagacagcuagcuacaacauggagacugaauaccaccauaauuacgauuuuaguaacacaaaaagugacaagauggauaggcaagcugccugucccuaacaauuaagaaauguaucagccagaacuagccaguugaggcaggggcaagcagauauugccagucugggcuggcccagaauuggaacauagugaguucuaggcuagccaaggcuacaaaguauaacuuuuuuuuucuuuuguuuuuuucuugugcugaggauggaagccaggcccuuguauaugauaagcauacuugcuaucacugagcuauauauguagcuauauguagcccugacaaauguuuuaucuggaaaugugugugcugucuuaagggauuauagaagaacaugggcagaauaaaccuguguguuuagcagagagaaaaguaauucagugagucugcuugagggaaaccuuggcuauuaaagccacugcauucaacugucagugcucugaggacccaauucuacuacuaaugcuuuaagcuaauuuguuaugguaauuuacacagcucagugugaauauuaaucaccauggaacagucauucauccgaugaaccaccuaauuuugcaaagaucaguaacuacuuuauuauauauggccauugccaaauuacuugcacuuuggaaugaaagcucauuauuuuaugaccaaauaaguuuucucgauguuuuguucuuaggaauuuccuuuuuacuuuuucauuuugagacagggucucauuuagcucaaguuagccucaaacuuacuugcuuauguaacugaggaugaacugauccuccugcuuucaugucccaguucuuagaauuaugugccaccauaccuaguuuacgugauacugaagauuaagcccaugccaggcaaguacccuaccaacugagcuaccucuauaucccuaaaaggaagcauuugaaauuccaucacaagaaauaaaguucuuacauguguuguuuguuuuacuuucuaguaguguaaacuugagccaugaaaacuuaguuuguagcaguuacuuuucauagggucaggcuagcucuauauugugauuuuauaauuauauuucagauauaaguggagaaauaacguaagguuuuauauuuuauuuuuucaguuuuaggauggaacuaggguauuguacuugcuauccaaagaacucuaccauugauccucaucacuugcuccaacauuaagguuuuuuuuuuuauuuuuuuauuuuuugaaagagucccaugcuggcuuugaaaaacucacuauccuccugccuagugcuggaacuaagaggucagucuugaugccaucugcaauauuuagcuuuuuagaggaauggaauuugcauacguucuaaguuuucucucaucuuuuaaguuuaaacaacaauauaaaaaaguaaaauugcagcaagaacagagccuguauaaaccuagauagaaauccuccauaaauucuccucuuuccuuuucuaucuuauucuuuauugcccuuucuuucccuuccccuucuuuuaacccucacccuccauuccaagaaaucauuuauguggauaaagguaauuucaggaaaccucuuagcuaguuccuagaucuucccuuaaggaacauggaggaaggcaggaaagcagucuggguauuggaauuugguugcauggaccagcaguucggcugugcuucuaugauccuagcacauaagaaucuaccauuuugaacugugcagggucuugguugggcugggcugggcugggcugagccuggcaguguguuuucuccuaucagggguguucaguuacugcucaauacauggaaaauagugagaaaagcuccaagauaaauguucuucaaagucuccuauggagugguacuuagccaucugccucuaggaccccagucuuuccuauagucucaggacugaguaagugaguaaaugaaugaaugagugugcuugugcggggugucucuagggaaggaggagggcaguuugaccuuuuugaaugaaguaucucauuuucacauacaaauaauguaaaagaagcaaagguuuuuccuaagugaaaguucacucugcuuguaauaaauuuggauaagucucccuaagaaaaucauacuacagagguuguaggguaaucugugcuuggaauggcuuuuaagguauccaucuagaaaaucuaaaagaggagccagggagauggcucuacuggaaaagcacaagaaugagugugauccacgguaggagagaaguaacuccgccugcagaauguccuaagacuucuacccagguaacacuuagacucugcaugacauacacacacaaauagauguaaugaccccaccuuuugugaugucauauuuaaaugagugacuuugaaauaaaauaaaaagacucaugaagggguguauuguuucuggggcuggaguccuagcuguauagcuaggcaagcuuucuacuguugcucgugacgguauuuaauaucagcuuccuugccuggguuuccuuacuguucugugacucuuagcagaggcuucuguucauuguguuauauuacuucugccuugaaagagaugggguggaaggggggagggaggcaugcuaaucauccuaugacaaggugaaauuuuaauuguagcaaaaacuguuuuaguucucauaguguugugaaaaucuugugagauuuugucuucauaagcucuacuggggaugagaaaauuaaugagugggaguuuggagacuacauuguaacuucuauccugcuuccuguguuuaccuccaacacugauaagaaggcaacccuguauaguuuaucugucaggaacuugagugucaaagacaaugugccuuaggaaaagggcauuuccuagcuuuuuuuuuuuuuuuugacauucuuuguucaaguuguauuucugguaccaugagagggaugugugagcauguuucagcaaggcagaucaguucagaauggcuucccuuucagucagcacucauucaccauucaccagagucuugaauguuuuagucacuucgaucauuuuuuuuuuuuguuuguguguuguguuugcucacauacacacucuagguagggacuguggaagucaaaaggcaacaucaaauccugguuccugccuucuauuuuguuugaggcaagguuucuuguucagcacagcauaugcacagcaagcugguuggccgugaauuucuggguaguaagcacacugugauucugcuuuuggcuuuacauaggcucuagggaucugaacuccagucuuccugguugcauguagcuauauaaguuaucauuagccuuucuuggucucaagccucuaguaugauuuggaggugguaggacccuuaagaaguggggcuucauuugaaagaaggguagaucaucagggacauauucuugaaggggauagugggacgccaaucacuuguuugucuuugcuuccuaacagccuugcuaaggagcuugcuuuggcaugggcacuguuaccauguggguacuuggaaccaaacguggauccucugaaagaacucuauacuacugagccaucucuccagcucugaguagccuuaauucuugaucgagguuaacagcaaaacacuaagcauuccuugcaaaauaauaauaauaauaaauuuauguccacuuggcuauuggcccauugggggggggcagaauauguuuucuaugacaagagaccauguucucuuugugccuggcauagugguggagugaaacuuugucuggauucuagugacugagaggugauaggaaaggaaaagaacacucucugcugugacugaaacuagugggucuuaaagcauaaagaguuucaaagaaacaggacaaaggagagaacaggucuggaaagugaaagguguugcuaggcugagaggcaaaggaccaugagucugcauuccacuaaaugccuugcaguauugaggcaggcucuaggagaacauccagagacaugcugagucucaggccccaacaaagauuucccuagucucaaacuagggguuaaagacuuagcuugcauucuguugaauucuagguuagacuuuaggaaugucaacuauaaugaguucuguuucuuauaucuagcugauguuggaaacuuacaugccccgauucucuaaaguuuauagcauuuuccaaaauagcaccaacaguuaagaaccaaggguuuaauauaugaaccuacaggaaauaguucauauucaaagcuugacaacauuuacucccuaugaguguguauacaagcauauguauauauguguauuaaagacaaagucuuacuguguugccuaagggcucaaaugacccugaugccucagccuuucaaaaagcuaggacuacagacacaggcugccuugccuggcuucuccuuuuauauuuuagcaucacugguacuuggugauuuaaacagucuuauuucagccugucagccaaucaucuaucaauucaccuacacauaagguuuuagaaaugacagugcgauggccauuuccauuuugaacaaacaaaaauaaaaccauagcaagguacaucauaaagaugaccauagaauuaaaugugagguagaaaucaacacaacaaccuuucauguugauuaaccuuacaaaucuuucugcauaguagaaagucuuccugucucuauguuuauauccagugcaaugaagaacauucucuuuuacuuuugacuccaucucuuuucuugguacuagacaaaucauuguugccucuccuguuggcuuguuuuccuguaauuuccuuguauagugugcucauacuuugccucacugggguagcugccuccagagugcuacaugcuuuacuugagucacaggugauggcuagacuagcucuaaaaucuguuguauucuuuucucuuugcaccuaggguuguccaugaggcagguggcagcacccaccuucaggggaauagagguggagaacugcagguuuuccuuuuguagagagccauguuuggagaugcuggauuagagguuacccagagaggaauaagagaaaggacaaggaagagaugagggaagagaaaacaggagccauccaggaggauggaagaggauaggcagacgagggaccaagugaagaggagaauagaaugaguaguauagcucuccaaugccaagacauaaaaauuacuggauucccuucuaagggaagguuaggacccuagugucccagcucucuugugaccagcucccuugugcccauuucuacaaaugcucugauguugcagccaguuuacuuugagccuuuggggggaguucgagaagggauggggcaagggcugugagauuuuuugagauggagacuaagcagaaagacuuccaaaugccugaaagccaucagugccugaaauccaucagcacacaguuugagcauuaaauuucuuagaaguaugcaaagcgcguccugggacuuuccuuguuagagagcuguucuggggaaagggagaggagcuguuaucaagcagcccugucucugccuggugcugucugauucccuuagcacugacuggauuuguucugaaacuccacccagcaccugcuaucagcagcuuccuccauugggaggugggugggugcugguguuucuagcucagucaaggucaugccuuaauccccacagaggucagcagauuuuucagaggaugaauauguccuuauggagagaagguuuuauuauauuaacuugacagacugcucagugaagggaaaaaugcagcugacaguguuuacuguaaauacagcguuguauuuucauuucuuaacugagugucaggaaauugggcacacaguucugugcuuugugauugcuucuaaagacuagaagucuggaggagaaaggguaugugguacauugcuagucauggguucguguuucccuucuuccagcagucauaauguucuaaggcaacuucauucacuuuguccccugagacuauauuaggaaugcagaguauaauugagaaaaagcauguggcuuacuaaauuuuagcaaauuguuguuaauaaucuugaguugguauagucccaaagacuaugccugguagaagguuucugucuuuuagcauaggcauauacuagcguuuugauuuuagaaaucaggucucuggaagguccccagacaugcccaaggcacugggugaacaagcccacauuguuccccaccaccaucaccaccacucugaugggugcuuucuguuuggaggaaaaacaauauucaccaaguuuagcuggucugguaggaacuggagaucuccauuggcucagguaugaggauagcuuuguuauggagcccagucuggaagccuuguugcagggguggggaugggugaacauucgccauaacuagugcaacuuaugaaggaauuuguccuugaccugcugcaggcuauugaucuggagggacuggaaagggcagccuauagcacaaaugaugccagaagccccuuaccauccccuucaagacucgagguccaaagcagcaugcuugguggcauaguuccugaguuuauucauccaaguaccuguuuuccaaggugacuguaaguuaaacaggaaccauauuucagcaggucucaucuuuaaaccagggaugaaacuucuucugcagcacuguuuccaugguccagugguucucaagcuuccuaaugcugcagcccucuaauacacuuaugcuguaaugaccuccaaccauaacugaaguuuugcuacuauuguaaaucauaaugauuuuuuauuuuugagacauaaugaaacaguuuuggagauagaaguuugccaaauggaccaugagccgcagguuaagaauuacugccauauuugugccuuuuuuggaaucugucuucccucuguagucucagguggcauuucauucuuccucuaacccuugaaauagggucucccuucagucugucucaaccuggaucccagauacuuuguuaagugccuuuucuuuuuuccagaguuuuaugggggcuuauaauuuuuacaauaauaaccucaucuguucuuuguuugugugcauguacuacuaguacuugaacccaaccuaggcccuaagauagauccuuaguccucuuuuugauuuuugacacagaaugucacugaaguugccuaggcuggcucuagacucacuuuguagaucaggcccacaaguuuacuaguuuuaaguuuagugacuuaguaaauucagaguuugugcauccaucacaacacaauuucaggucauuuucauuccgcuccccaaaaugaugcuuuauacauguaaagcacccaauuuuucuccugccuuagcaccagacggcugagagucugcucuucaacucugagccugcuauggacauuuccuguaaguagaaucauauaacauugacuuuuuguguccagcuuuuauguagcacugcacagucaagguucaugcauauugcagaaggccuggcaguucauuuccgccugguccugaguauguaucucugguguggauagaccaccacuuggguggucuccuucaucagcugaugaacauuuucuuugcuucacugaacucugaauuaucugcuccuguuaguaguuuuccaggccccauggguacacacgccugggagauggcccaggcucucugagagugaguaagcucuguagcuugugggagucaggucaugaaagucuuuugaauauaaacuuuaucccuugugaucagggauggcuuucuucuuuauauauguauucuaggaugguugguaaaauuuaauaaaccaaauauuuaaaaaauguguuucauguugccucucucugaccucaggaaguagcucucaauuuuugucauauggagaaaaaucuguaacaucauuaaucugacaacuggcuggauagauaaagccuucugcauauucucugaguuguuucuugggagauaaaacacauuguacgaauauccugccucuuuugcccuccugaugcuguagaaagcggcguagacagaaagaccuaacuucaacagcagcagcaguuuugcuguaguguaguagaggccugugcucugaagcuaaccuucguuuuguauaguucucuuugauagaagaaguagagaagccaauagguaguuaggcacauguuagaccuggucacgugcccugugcuuuaucuguuuucuccaguaggcugcugucugcuguccuuguacacaagcuccucucagcugccugaacaccucauuauuuugucucaacccugagcucagugucugaauaaugaacagcagcucucccaagacauuucaugaaccagucaggacaccuucaaugggacauugcaauugcuucuuccagccuuagauagugaaugcccuugucacugcccuuguauugggccuuuucucauagcagggcucaguuaaaugagcagagaagcuggaauugauugaucucaagcauuacuguagggaauuggaguauugacuauacucaggguuuaaauaugggcagcugguuggaguuggauuagugcuggcauacaggaaagcugcaaauggcauauaaaaggcuuguuguauguauagcuacuagcauguuuuaaucgcagugagccuuggggugcacgaaccuuugauacauagauaaaucauaacaacuaaggguggacuugagguagucugcaggaaagaaucuauguagggaacaacuguacuuagcauuuguuuuccuugaggaauguuuugggugugggaguggcucaauauggcaaccaggcuuuugaguuugauccuuucaagcuuggguuagagugaacuacuaguauacauaccacuguucuccaagcuuccauaggaaguccaguacaggccuguguacuccagcaaggugaaugaaaaaaaaagacaaauguuuuaaaaauauuuuuucaagacaggguuucucugagucacagcccugacuguccuggaauucuuuguagaccaggcuggcuuugaucucacagagaucugucugccucugccuccugccugcugggauuaaagguguaugcccccaugucuggcaaaagacagaaauuuuaaagaagaaaaauuuaaaaucacugcuccauuuuuccucaaccauguuagaaaaacauauuuucuaguucaagaaggcuaccugguucuuuguaacagcaucacgaagucauaaguaagaaaucacccacuaaaauacaguuucuagcuacacuggugauauauacuuguuaucccaucacucuggagguagaauaaggaccaucaugaauucaaggccagccugggugacauagugauuccaagucucuguggguuacaaagugagacccugucucaacacacacagagagaggcagacagacagacagacagacagacaaacacacacacacacacacacacacacacacacacacacacacacacacgacucaccuuauagcuuaugaucugcuaagacuucacuuuuagucuaaugagaagaaaucagaaaccaaaugaaaaccagaugcaugaaaagagucucaucuuuuuccugacugaaauuucaccaggagccuuuugguguagagauacgcaucacagaucaaucuugaguuacacugaguauuaauuauuucugucauuuacuaauuagugucuaagagagcaacagcugauguguguguccuguaagcacaucugaaugggugaugcaguggcuugaagggaugggaacaguuucccauguguuccuuucauggguuuggguggagugcaugcuaggaauuggucauuuucuugucauucacauuuccuaaccagauguggaaucuaaccagaaagaaaaucuuguuuguucaucuggcuugucugaggggcacagagcuuauucccccauucccaagagaccacuggaauugugucccuucugcuugaucauucauccccaacacaaauguguguccugccaugauaaguuaguguacauuucccagaaaguauaaaauauguuuuguuuuguuguuuugucuuagagacagagucucacuaaacaagguggcuucaaacuuacuauguaguucaggcugccauugaacucucuauccuacugccucagccugugcuaggauuacagaccuucuguaccaccacauucuacuugaguuuuaugcaaauguaauccuauagcagaucuucuuuucuugcuggcuccuuucacucaguuauuacuuagacacuugcccuuguuuaaugugugauaguacauugucaggugggcaagcuggauguugguaauguccuuuuuuaaacauuagauuuuuuaaagauuuauguucauuauuuuaaauuaaacaaauuguguggguauauguuucugucugucugucugucugucugucugucugucuguggguaugugaauaugagugcaggugcccaagaggcuggaggcauucuauccccuggaucuggaguuagaggaguuugugagcugccugauguuggugaacuagggcccccuggaggaucagaaagugcuauuaaccacugggcuaucucuucagccccuagaaguuaauuuuaaagagacaguugaaaggaaaucuaagaggaugaucaaagaaaacucccuagguuuauacagauuauuccuuucuuguugaggcaaacaugaugcuucuuuuucuuucuuucuuucuuuuuuuuuaauuuuagaugcuaaagauuaaaccuacagcccuaugcagguuaggcaaguaaugugucacugaguuaugaucccagcuauuuaucacucuaguuggugacaugaaccugggacaguggcaccuaaauguaauagccaacuuuauucagagcagcagauaauuuguacucugaggguuaagaacagagucaccugaguaaaggauacaaucacaaggacaagcugcauguggcaaaacauaugacuaacaacagcugaaguaaccucacuccuauccacuacaccugggaggggcacaaaaacacauuccaagaacaauuccauguuuuugaagaaacagaagucacaggauucuugucuuguuuuuuuggaccuuucucacaagcacucagaauuccccucacaugacuccauuguugaaccuaguuucaacacucagccuuguuuuucccagccucucuuuuauuuucuuugacuccugcauucauuugaaaugucauggaacacugacugcaacuuugacuucauuuuccaaggucacauaagauuucuauucucucugguuggagacaaggucuucugcaguuuagcacccacaggacaagagaauuuuggagccauuaaauggugcaaaguuaggauauauaucucagugguagagugcuugucuauuauaacaaaaguccuggguuccaucccaacacuaccaaagggaaaaagauacuuuaaaagagagguguaacuuagagaauacagggcugcacacuucuuuucaauagacauccuuucuuccauuaagguauuaaccagaccagacccuguuuagcuucuuagauuggguucugucagagugguggccuagacaauaaugaaucauuuguaaggaaggcccuuuuuuauauuacuguuuuuuaaaaguugaaagaauauuuuuauauaugcuaagagcaaggcacuucauuguaagaucauuaaacuaaaaaaauagaguggauucuuuuuuuuuuugggggggugguggugguuuugagacaggguuucuucucuguggagcccuggcuguccuggaagucacuuuguagaccaagcuggccucgaacucagaaauccgccugccucugccucccaagugcugggacuaaaggcgugcgccaccacgcgcggcuuuagaguggauuuuuguuucaaauuccuaugaagguaugacagaaaauacaacuuuuaccucaaaauucagaucccuugcugcugcuuucacuguugcuaagugaaaauagacuuaggacuggagaauuggaucagcacuuaagagcauuuagcugcucuugcagagguuccagguuugauuccugguacccgcauggugacucacaauuauccucagcuacaguuacagggugacucuucugaccuccuugugcaccaggcaugacuaugguauucauacauguaugguauucauacauacauguaggcaaaacacucaguacacauaaaauaaaucuaaaaaaauaaacaauaaacaauccaggaguuuagaguucuaugaaaucuucaauauguuguuguaaggagcuuaugguagaacaguugcuugcaguugcguguaaaaaacuacauguacuacgggaaggagaaggaagaauugagauaguauucuaaaauugccaaauguugguuuuaagguuguugaacaugggugcuguccuugcccuuuagcacucuucuguagccaauauuuaauuuuaagaaacagauaaauguaccaacuugauuugcaaaacaauuuucuccuggagugaaaaacuaaaagcugccuauuccucccuucuucccccccauccuacuccuucacauagucuuguuccuucauggcggggucuugucauauaacucaggcuguucuggaacucaaugugcagccuggguuaguuuuuaacuuagaauuuuucugcuucaagccuccugagcccuagaggauuacagguaugugcuuccauucuggacuuauauuuauuuuuucccccucuccuuuaaaaaaaauuuuuuuuuucugugcgucauuaagauggcucagcuguaaaaggcacucgcuugcugcccagucugacaaauugaguucaguccccuggacccacaugauggacagagcugacuuccugaauuuugucuucugauauucacaucuaugcuauggcaugcauguauguucccuccuuaaauaaauauaauuuuauuuuuaaauaaauuuuaaauaauuaaaaauaaauuguauccuccaugacaaugacaaauaauaaguauggauuuucauaauguauaaaauguauguuauuauauaucuccuuccuuuguuguggcauuguugcacagaacgagagagugugcaugcuagacccauaaguuacacccuaaucuauuuccuuugcuaugguuuauuuaccuuguccauuugggucauguuaugauuugcugcugcugugguuuguuugcuuuuuuuuuuuaaagucagaguuuuacuauauagcuuaggcuggccuguaacucaaggucuuccugccucagcuucuugaguacugaauuauaaguacuugaguacuggaauuauaaacauuaacugccaugccuggcucuacuguacuuugauguucaagcgucacauuguaauuugacaauuuauauaguaaacauaguuaauuaaugacuuuuucaauuaugacuuguuucuuuuuuucguuuuuauuacauuuauuguguguauguguuugugagagagagagagagaaacagaggcagggagcgagggaggggaacaaaaaugaacacacaucuuuaaggagcugguucugcccuuucacuuuguggguacugaggcuuguacucagguugucaggcuuggaggcaaaugccauaaccugcugaaccaucucacgagcccacauuuuaaucucuaaaauaugauaaauugccgggcagugguggugcaagccuuuaauaccagcacuugggaggcagagacaggcggauuccaggccagccuggucuacagagugaauuccagaacagccagggcuacacagagaaacccugucaugaaaagccaaaaaaaauucauaaguuuacagauuguauaauuuuucuuuagcuuauuguccugcuuugugauuaaugugaauuaauuauuuuuccugugcuggggaaggaacuuaggaccuuuguacauggcagacuagaagcuaugguccauuaagccacacauaaagcccauauguguguuuauuugaagggauuccugaaaacucaugggauucauggacuuucuuuaaaaugcaguugcauuuucucugcgucacccucagcagucucaguucugccuauuguccuggccuugagguaguuucugcugcagagaacacagugggccauuucuaaggcuaagucuaaaacaugguacccugccacacacuccaagaagcccugaaccuucucuuccuuguucuugagucuguagccaccaguaccuuugagaaugaguaaaugucuguaacuuucaaaaggauucccacucuuccucuaccaaaaggaaagguugagagccagggagguuuuaaguaguaauuaguuacuugguuuccacaagaaagcuagcaagcagggcuuaagaaugcucuguugcauuccauaaagggggugaggcaggagugggaugcucuggacuguuuccagcucugacuacccuuucuuucuugcuguuuccagaucugccugcccaguaggcagggugaccuauccuagaaggggaaagagcaggaaaaaagaagaaacuguaauuugcuuuuaaaacccuccggggucucuucuauauccuuuccuaaaaaggcuccacccaucagggaaguagguuguagcugcuagcccuggacaggagcacaccauugcuggcccucuggggcuggguuuuccauggcugaggcaaacauaauacagaguugaguucuaaguccccaccgauuuccacuauuguuacuauauuacuauuguauguguauguagcagucaaccaacacauuguuugccaugaguagaaucccaugauuuaauuuacuuuccuuauugcucuuauuuucuuguuuuuuuuuaaaggacauuuuaaugaaacuuuuauuuauguguaugugucugugcaugugaguaugaauacuuggagacuauguauuggaucccuuggagcuggaguuauaggcaguuguaccaaggauauaugggugcuucuagccaaaugcagauucucuucgagaauauacgcuuaacugauaaauucucuguagccuucuaauuuuuuuuuuuuuugagauggcaucuugcuuugcaguucagguugaucccgaacuuuugaacuuguugcucuugcagguaaucuguguugguucccagcauccacaucgcagcuuacaaccacuccagacuucagucccaggagauccaacagccucuuuuaacaaacagccucuuuugauguccuggacaggacauggacaugaugcacauacauacauacauauauacauacauacauacauacauaaaugcaaaacuuucauagauauaaauacaaaagaaaagagauagguccuuuugaauuaauggaaaaauguuacuccugacaaacuuucuucuauaucuuaaagaaugaacaaagcuauguaacuuacuacccagauucaggacucaugcagaaagcucaggguuccauccacagcauugauuccucuacccacccacccaaaccaaaccaaaccaaaccaaaaaaaaaaaccaaaaacaaacaaaacaaaacaaaacaaauauaaagaagaagaaaagaaagagaacaucuguauuaauguucuagaagggucuagagcccuuuacagaugaucuuuagcuucauuuccccaaugauguaacuaucuugaauuuucauauggcuagcucaaaaaacaguuugaauuuauguaucucuuguagauguuuauguuacugaaguuauauuagauauuuuuugagaaacucguuguaugugucuuaaguauuuaagugcuaaauauguuucaggauauacaaaucuuguggggcuguggauguagcucagugguagaguguuugccugguucaauucccaacacagcucaaacaaaacacacacacacacacacacacagagagagagagagagagagagagagagagagagagagagagagagagagagagagagaaaaagguauuaauuuaaaaucuuagaauuacugcaaagaaaggggugauacuuauguucugugcaacuuuucuugauugcuuucauuuuucauuaguccccccccccccccauuuucuaaccuauugggugacugauaacaaaugaagccacacauacuacuagaacuuugacauagucauuguuuguuuguuucuauguguguauacaguacguuguaugcuuggugaccguauaggucagaagaaggugucagauuccccgaacuggaguuacaaauguuuuugaagaaccauauaagguucugggaaccaaauccagguccucugcaaaaucgacaagcaccuagguccugacacaguuauaauucaagguuuuuaaaaagggauuuguuuguugguuuguuuugagacaggaucucuauguagcucagacuggucuguaacucauuauguaguccaggcuaaccucaaacucaccauccuccugucuuugccaggauuauagugaugugcuaccaugucuacuauuucucuaaucuugaaaagggaacuagauuuguuuuauaaacuaguugugaaguaaguugguagccuguuucugugaaagguucuacaaggauccauuaucuccuuuaaacuuggcaauaggauuggggguguggcucaguguuugagaguuugcuugcuuaacaagcaaaaaaguuccaagauuccacccccaguaccacagcaaaagaaguguguaggguaugggaguugaggaaggcuggugggguagcuagguuagaucaucagcaccaaaugaaccuggugcauuacuguaauccuaacacauugaagguaccaggcaagaggcuuaaaaguuaaagguuauccuuagauuauuaguuuaaagcuagucugggcuacaugagacucugucucaaaagaaagggcuaggccaagaguaggccaguguucauugacauuuggcuuaucuaucucccuucuccauaguaacccauuuucuuuugaaagagauguuucaguggugagucuuggcauagccacaggguuaaccuaccucccuuugcaucuuccaguuuagacuucuuucuuccuuccuucccuccauuguauuuuugucaauucaagacagauguauuauuuuuaacauaguguuuuuuaaaaaccaccaauaauaaaaacuuaaaugugauauucucuaggauaaauaaaauuauacuauagguccuaguagguuucauauauagggauaaaacuuauauuauuuagaauaagaauuuauauuuaagaauuccaauuguuuuugguuauaauuucaaaaaauauuuucuuaagauacuuuuuucuaucuucucaaaccuguaugcauaaaaugacaaauuuaauuguugaagaauaaagacaacagaacaucaugaugguuuuauuuuuuaauuuuaaaaaacauuuuaaauuauuuaaaacaacuuuuaaguuuaaauauaguuuugaucauauucuuaaccucccucaaguuuguccaggucuuuuaugccucccuacccacccaacuuuaaguucuuucucaaaaaucaacucaaaaaaguccauauaacaacaaaacacugcaaaucuagaaaaacacgaccgaccccauacccccaaguucauuauuucuuggucaacuauuucugaacaugagaucugcucuggaaugguugauauacccaguaucauuccauuagagaaaacugauuucaccucucccauuagauauaagugauaguucuguuguuaaccuuuacaccaguggcuugguuuucauucauucauuauuaaaaauauacaaaacauaagauaaaaaaaucugucacaucaaaauuggauaagacaaaguaacagaaggagaccguguauaaaugaagaggcccuagggcacaccuauccaggcccugugcuugcugcaucagucugggaguucaugugcaccuugaucauauuguuucagagggccuuguuuucuuggugucuuccaucccgucuugcucuuacacucugucuccuuuguaagguuuccuugagcucugagggggauggauuggauggagacaaggucucucccuuucuguguaaugucuggcugugggucucuauauuuguuucuaucugcugcaggaggaaaguuugucugaugaugguuuaaaaaggcacugaucucugaguauagcagaauaucauuacgagaaaaaagauuccuuucuuucuuucuuucuuuccuuucuuuccuuucuuuccuuucuuuuuccuuucuuuccuuucuuuccuuucuuuccuuucuuuccuuucuuuccuuucuuuccuuucuuuccuuucuuuccuuucuuuccuuucuuuccuuucuuuccuuucuuuccuuucuuuccuuucuuuccuuucuuuccuuucuuuccuuucuuuccuuucuuuccuuucuuuccuuucuuucuuucuuucuuucuuucuuucuuucuuucuuucuuucuuucuuucuuucaccaguacuaauuugguuuuacccuaggucccuagguuaucuagucucagguuguuuguuggucacccuagcauuaucagguauggauucuaucuuaugcacugagcuuuaugucaacuagauauugguugguuacccccacaaucugugugaccauuggucuagcagaucuuacagacagcacacgauuguacauaaagguuuugugguuggcuuaguguuuauguuucucuuuugguagcuugcagaguaccuucuaguacuagaugcuagcacauagaggcaaagauccuguguaggcaucagcucaaauucuccauguuuaaugaguugugaaggugguguugucagcaauggacccuugcugucaguuuguggacagccuauagucuuggcaacagucuggguuguuuggaguuucccauaggaacucuuugaccaacaacucaauuuuagaaguaacccaaaccuggaacuggaaacuuuagugacaagagauacagagccauuugggaccaucuccuccauuacuuggugauuucauuuagauugcuuucauauauguauauauuguaggagauuucuacuauauuuguuugccauauuaccccucaaaugacccuuaauuuuaccugucucuccccauacuucaucccacuaccccuucuuuccuuccuauucccacuugauugucccagugcaaaccccucaccuauccauagauaguggauucuauuuccuauucuauuucucuuuccuagugagaucuaucuguucccucuaguccuuuacucuguaccugugguucuguggagugucacaugauuaucauugacuuaacagcaaauagccacuuauaagugaguacuuaccaugcaugucuuucuggauuaccucacucagaugaucuaucuaucuaucuuuccuucucucuuucucucucuuuucuuuucuuuucuuuucuuuucuuuucuuuucguuucguuucguuucguuucguuucguuuuucgagacaggguuucucuguauagcccuggcuguucuggaacucacuuuguagaccaggcuggccuugaacucagaaauccgccugccucugccucccaagugcucggauuaaaggugugagccaccaugcccggccagaugauguuuucuaguuccaucaauuugccugcaaauuucauggugucaguuuuuaaaaaacagcugaguaguacuuccauguguaaauguaucauauuuucuuuauccauucuuuuauugagggauaucuagguuuccaauuucuggcaauuaugaguagagcagcaaugaacauguuugaacaagugugucugugguaucaugaagcauucauuggguauuugcccaagaguaguguagcuagcucuugagguaguugaauugcuaucuuauugaggaacugccacacuuauuuccauaauggauguaugaguuugcacucacgccaccaauauaguaauguuccacuuacuagauagacauccucaccccuuuuucugucacuuguuuuguugauuuuagccauuuugacauauguaacaugaaucuuaaaguaguuuuaauuuucuuuuuuugauucuuuuuauuagauauauucuuuauuuacauuucaaaugcuauagguggaacaacaauaugaacuaaccaguaccccuagagcucuugucucuagcugcauauguagcagaagauggccuagucggccaucacuggaaagagaggccccuugguauugcaaaguuuuaauuucauuucccugaugacuaaggauguugaaaauuucuuuaagaguuucuuagccauuugaguguccucuguugagaauuaucaguuuagaucuguucccauuuuuaaauugacuuuuuguuucuugauaccuaguuucaugaguuauuuauaugauuuggauacuauguaucaaauauggaguugauaaaucuuuuccuggucuauaggcuguugcuuugaaugguggugucuuuugccuuguagaagcuucucaguuucaagagucuccauuuauuaaguguugaucuuagugcuugugcuaacaguguucugugccaaugaguucaaggcuguaccugcuaguccggcauggcugcauaagggaaagugugacacagcucuugcccuggagcauugccaggcuguugaucccaugaucucccacacugaugguugcuguugccccgaaguugaucagcugucuuacuacucuacuuucaauauuucuuucaggggaaucuacuuuccucccauuacucagagcuaaucacaccauaguaauugaaacagaugcacuuuuuaggaaugaggaauagagauggucaugaggcuguggaggaugaagaacaggcccucuacuuggccuuuagggcuaugggaaaggaucuagacaacauaaccacaagggccauaaaaaccuacauggaugguccuuuguagaaauaguucauugccagacuuggccuugaauguggaaacaugaggagauacauauauccuccgguccaaugacugcugcacuaaguagccagggugaacuuggggacaucaagaauagagaguuaaaguggugucaagaagaaaagguauggauagaaaaaguaggaaauuauauaagauguaggaguaaauaguaucagaggaagagugcaugaggcuauggaauugcuaggauaaggaaaugaagauuagagaauuaacagaugauguagaagcauauaaaaagucaguacucuguuuuucuagcugagugaagaauuggggauaguaaugccuggaaagauauuagagagagcuguuuuaccauuuuacuuacauaaauucaaaacuuuguaaggaaucauuuuaacuuuaguagucuaucauuuuucugcucugaaaauaguuacugaacacugcugucugcuguacuaggaaaccgugggagcugugcccagcuacccaugaagaacaggcugugaaaaccuauaaggaaaugugcucuugcuuuguauuuaguucugcucugaggaaacagagguugggacuauugauccaggacucauagaguuuauguaaaccuaaucuaagaauuuuuugauaauuauuaacaacgauuaaagccuugaucauguagcucugguaaauaagaguggguucaggcucucucugguuauuaagcugaagaacauuuaagcugaagaauaaugaauacugagaaucaucagggaauagagagaguaccugaacuaggagcuuccaucuacuacugacuucaaguuauuauugaaucagcacuguucccauuucccccuuucucaggacccuccucacauugaggcaagacauaggcauauaccucugugccagugaguucaaggcuauaccgcucuuucucuucugucagguucacuauaucugguuuuauguugaggacugugguacauuuggaauugauuuuugugaaaaguugauaaaaaguugauuuggauucuucuacaugcagacaucuaguuagaccagcaccguuguugaagauguugaaguguaugugucuggccucugucaaaaauauaguguccauagguguguggacuuaugucuaguucuucacuucuauucuauuaaucagugugucuaugagccaguaucaucuuauuuucauuauuauagcuuuagaguacagcuugaaguuggggauggugacaccucuagcaguucauuuauuuuucaggauugcuugagcuaucccaggguguuuuuguuguuguuguuuguuucuacaugaaguuuaaaauuguccuuuuaauaucugaagaauugcuuuggaauuuugauggagauugcauugaaucuguagauugcuuuuggcaggauguucgguuuuacugugcugauccuacugauccaugagugugggaaaucuuuccuucuucaaagacuugauuuuguuuuuaaaaaucauacacaccuuucacuugcuugggaagaaauaccccaagguauuuuacuagguauuuuauauuugaggcuguugugaaacacguugcuucccugauuucuugcucagacugucauuugcauauagggggcacugauuuuuuugaguuacucuuguauucagcuacuuugcugaauguguuuaucagguguaggaguucucugguggaauuuuuagggucaguuacauauacuaucauaucaucugcaaauaaagguacuuugacucuuccuuuccaauuuguauccccuugaucuccuuacauuauuuuauuguucuaucuaagacuucaaguaacauauuaaauagguaaggaaagaguggacaaccuugucuuguucugauuucaguggaauugauuugaguuucucuucauuuaaguugauguugucuaugggcuuguuguaaacggcuuuuauuauguacaggcauacuaaaauauauuuuguauguccuuuguuaauuagccuuuuuauuguuuuauuuguaugccauuuguaucccuaaucucuuaugaaggagugaugguuuuguaaaaggccuuuucugcauauaaugagaugaucauuucuuuuuuuuuucuuuuucuuuuugucuuucaguuuguuuauaugguggaguucauuuauuccuuuaugaauguugaaucaucccugcaucuuugggaugaagccuacuugauuaagguggaugaucuuuuuugauuuguuuguggguuccaguuugcaagcauuuuugcauguucauacaugaaauuggucuguaauucucuuuguugugucuuuaugcgguuuuguuaucaggguaacuuguaaaaugaauugggcaauguuccuucuguuucuguuuuauagaauaaauugagguauaugggcauuagcuuuucuuugaaagugugguagaauucuuuacaaacaucuggcccugggcuauuuauuuauuuuggcugggagacuuuaaugacuacuucuauuucacuaguggauauauaggccuguucaaauugcuuaugugauauaaauuuaacucugguuagugguguauaucaagaaaauuauuuauuuuuagauuguccaauuugauagaguacagguuuuuaaaguguguccuuacgauuuucuggauuuccuuggucucucuuguuaugcacccccccccaauuuguuucuaauuucauuagucucacucaaccuuuuaauuugucaaucuuacugauuuucucaaagaaucaacucuguuucccugauuuuuuuguauugcucuuguuuguuucuauuuuauugauuuuuagcccugaauuugaugauuucaugccaucuacuccuuuugaguaugguuacucuuucuguuuuagaguuuuuaaguguucuaaguugcuaguaugagaucucuccauuuuuuauugauauauauauauauauauauauauauauauauauauauauuuauuuauuuuuguccuuggcccccucuuggucagccaucccacaguuccucauugcauucuucuaccaucuccaagaggauguccccacccaccaggccucucaacuccuuggggccucauguaucucaaggguuaaguguaucuucucccacugaggccagaccaggcagucuucuguauauguguccagggccucagaccagcucacgguuacugccugguugguggcucaguaccugggagaucucagggguccagguuaguugagauugcuggucuuccuuuggggucgcucuccuccucagcuccuuccagccuuuccauugguuggauguaaguguuuugucuaucuuagucagcugcuuguuguugggucucugaggacagcuaugcuaugcuaggcuccuguguguaaacacaacauagcaucagugauagugucaggccuuggggccucccccugagcuggaucucaauuuaggcuagucaguggaccuccuuucucucagucucuuuuccauuuuugucccugcaggauguuguuucccuauuuucuuucucaaccuguuuauccuuuguauagaggaaggcuuuugauuugaguuaauuuuauauccagccacuuugcugaaguuguuuaucagcuguagaaguucccugguagaaguuuugggguugauuauugucuuagucaggguuucuauuccugcacaaacaucaugaccaagaagcaguuggggaggaaaggguuuauucagcuuacacuuccauacugcuguuuaucaccaaggaagucaggacuggaacucaaggaggucagagagcgggagcugaugcagaagccauggagggauguucuuuacuggcuugcuuccccuggcuugcuucaccugcucucuuauagaaccaagacuaccagcccagggauggucccacccacaaggggccuuucccccuugaucacuaauugagaaaauucuuacagcuggaucucauggaggcauuuccccaacugaaguuccuuucucugugauaacuccagcugugucaaguugacacaaaacuagccaguacaauuauguauauuaucaucaacaaauagugaugccuugacuucuucuuugcuaauuuguauccccuugaucucuuagaguaggcagccuugucuuaacccugauguuagugagaucgcuucaaauauuucuccauuuaauuugauauuggcugcuggcuugcuguauauugcuuuuacuguguuuagguaugggccuugaguuccugaucuuucuaauacuuuuuuuuuggcggggggcuuuuuuggggaacuuuuaaaaaauuggauauuuacuuuauuugcauuucaaauguucuccccuuucccccuuccucccagaaacacccuauuacauccucccucccccuucuucuaugaggguguuccuccauccacccacacacuccuacuuccccacucuagauuccccuacacuguagcaucuaucuagucuucauaggaccaaggaucucuucuccuauugaugccugacaaggccauccucuguuacauaugcagauggagccauguguacuccuugguugguggcuuagucccugggagcucugggggaucugguugguugauauuguuguucuuucuaugggguugcaaaccccuucaacuccuucaguccuuucucuaacuccucuuuuggggacaaaaugcucagugcaaugguuggcugugaacaucagaaucuguaaggcucuggcagggccucucaggagacagcuauaucagguuccuuuuggcaagcuauucuuagcauccacaauagugucagaauuuggugacuguaucuggguugaauccccaggugggccagucucuggauggccuuuccuucagucucugcucuacacuuugucuccauauuugcucccgugagucccuuucuaagaaggacugaaacacccacacuuuggucuuccaucuucuugagcuucaugugguuugugaauuguaucuugggucuuccuagcuuuugggcuaauauccacuuaucagugagugcauaccauguguguucuuuugugguugaauuaccucacccaggauauuuucuagguccaacuauuugccuaagaauuucauaaauucauuguuuuuaauagcugaguaguacuccauugugcaaauguaccauauuuucgguauccauucuucuguugaaggacaucuggguucuuuccagcuccugacuauuauaaauaagguugcuaugaacauaguggagcauguguccuuauuacaaguuggagcaucuucuggguauaugcccaggagugguauagcuggguccucagguaguacuauguccaauuuucugagaaaucgccagacugauuuccagagugguuguacaagcuugcaaucccaccagcaauggaggaguguuccucuuucucuauauccucaccagcaucugcugucaccugaauuuuugaucuuagccauucugacuaguaugagguggaaucucaggguugauuugauuugcauuucccugaugacuaaggauguugaacauuucuuuaggugcuucucaggcauuugguauuccucaguugaaaauucuuuguuuagcucuguaccccauuuuuaauaggguuauuugguucucuggagucuuaacuucuugaguucuuuguauauauuggauauuagcccccuaucagauguaggauugguaaagaucuuuucucagucuguugguugucguuuuguccuaauaagaguguccuuugccuuaccgaaacuuugcaauuuuaugagguuccauuuguugauucucgaucuuagcgcauaagccauugcuguucuucuguucaggaacuuuucccuuguguccguguguuugagacuguccucaccuucucuucuauucguuucaguguuucugguuuuauguggagguccauagagaaaccagaaggcuccugucccagguugcuccuugguuccuguguccugugaucugagguuucaagggaggucccucugagcaguaguggugguuuuaccugcacuuacaggcuuguuggcccuccugggaugcuaccucucucccagugcuauuuggguauggagcccuguugcagaggaucaguuuaccuacucuuuuuuuuucuuuuuuaaagauuuauuauuuauuauauguaaguacacuguagcugucuucagacacuccagaagagggagucagaucucguuacagaugguugugaggcaccaugugguugcugggauuugaacuccggaccuucggaagagcagucgggugcucuuacccacugagccaucucaccagccccaguuuaccuacucuugacuuaacuuuggugaaugguaucugcuagaaaagcauccauuuuaucuagauuuucuaguuuuauaguauauaggcuuuuguauuaggaucugauguuucugugaauuuccucaguuucuuuuguuaugucucccuuuucauuucugauuuuauuaauuugaauacugucucugugccccuuaguuuggcuagggguuuauauaucuuguugauuuucacaaagaaccagcuuuugguuuuguugauucuuuguauaauucucuuuguauuuguuugauuuuggcccugaguuugacuauuucuacugucuacuccucuuggguguguuugcuucuuuuuguuccagggcuuucaggugugcugcuaaguuguuaguguaggauuucuccaauuucuuuaugagggcacuuagugcuaugaguuuuccucuuaacacugcuuucauuguaucccauaaauuuggguauucuguuucauaauauucauugaauaccaggaugucuuuaauuucuuucuuuauuucuuuccugaccaaguuaucauugaaaagagaauuguuuaguuuccauggguaugugggcauucuguuuuuaguuuuuuuguuuuuuguuuuuuguuuuuuugaauugaagucuagccuuuaguccauggugaucugauaugaugcaugggauuauuucagucuucuuguaucuguugaggcuugauuugugacuguuuauauggucaauuucggagaagguaccaugagaugcagagaggaagguauauuugaugaaauauucuguauauaucuguuuaguccauuugguucauagccucaauuaguuucucugugucucuguuuaguuucuguuucaaugaccuguuacuugguaagaguggaguauugaagucuccuaguauuauuguguguuucaauguauguuuugagcuuuaauaaaguuuguuuuaugaauguuggugcccuuccauuuggggcauagauguuuagaauugagacuuuuucuugguagauuuuuccuuuugugaauaugaaguguccuuccccaucuuuuuuucauaacuuuuaguugaaagucuauuuuauugacuauuagaguagaauuccagcuugugucucgggacuauuugccuggaagacuuuuucccagccuuuuacucugcaguacugucuguuauugucauugagguguguugcuuauaugcagcaaaaugccugauccugguuguauaucuagucuguaggucuucuuauugggcagaugauauugauagauauuaaagacaaaugauucuuaguuucuguuauguuugauguuucaagugguggcauuauguauaugugauucuguucuuuugguuuucuuguaagaugauuaauuucuuguuuuuucuuugguguagauacccuccuuguguuggaguuuuccuucuagaauccuuuguagggcuaguuugguagauauuguuuagguuugguuuuguccuggaauauuuugguuucuccaucgaugaugaucuagaguuuuucagaguauaguagccuaggcugacauuuguguuuucuuagggccugcauggcaucugcccaggcucuucuggauuuuugggucucuguugagaagucugguauaauucugauaggucugcauuuguauguuauuuggcuuuuuuuuuccuucuaagacagugcuguuaaacucugauauuaguagagucugacuuuuuuugaaaagugaauuuuuuggggggaggggggauguucucaguuggcacuuacaguaucaaguagaugaaacccugaaaggcuaguuuggauaaugggaagcugguauuuagacagagacuagucagggcuggcuccugggaugauucguuccucagccauucuuacaguuacuuuucaccuggaauguaucuguguggcaacagugcuuugucaggagaacauacaggcaccuagcaaguuaacacugcauacucuaaaaaugcugcaguuuccccuauaagauuccauuguguucuuuucacuucugccuacugacagacaccacuucuagcuucaauuugaacagauaaaaaguucaaaacauuuuuaggucauaaaauuguuaaucaauuaucaagcauucagguacauuuaacugcugaggauuuuccgugagugauugaagucuguuuuacuccuucagcuucuaguuuucaguugacaaguuugccauauuugaaagaaggcuucuguucuuuuaaugaguuacagccugagggcugggguguagcucaguaguagcaugcauacuucacaugugugagggccuugguucuauugcccagcaucaucacuuccucaaaaaauaguauuguccagaagaaagggcuugcucauuaaaagcaaccucuugugaagcugacugagauauauuggaaugcaaagcauggcuaguaucuggcugagcaauuaaaaaacuuuggagcagguuagugcccaugaaaagguuuaugaagguugucagaaaaaaacaaaaacaaaaacagaaccuucagguaaccucccagcaggacaucagcuaaugcuauaaauggaacuaauuuuuucccuaugcuuugcuuuaagaacauacauuccaagacugggauauagugcaguggccuuccuugucaguccugguguggcuggccuagaaugugcuuauuggcugucuuagcaugugcuuacuucuggaguugaaucuagucccugcaguugauucucagcacuacagcaaaaugaaugaaucuaucaaugaaaaagacucaucuauucuucuuuguaguuugauugaauaguagguacaauguauugcuuucugauucccagucaccuaugggaaguuucuguuuggguacugccuagcuccuugccaauucuguguagcacgugaggcuucauucauucuuauugccaucauuuugaaggcuugccuuaagaugggugugcagcuuuuucucuuguuauguaucauccuccucaucaccugccacauuuuauaucugugaagacaaucccaugaauuccaguuuuaagggugguugaauuugauccacaguaaagacaacaguuguaguucuaaacccuuaaaagucaaaggaggucuuuauagcacuagugaaagcuuccuacauggaaggcaaguagucuacacugagccucaucccugcacaauugagucuaguuguuucacaauauauaauauacuguugaaauucuggaagccagacacccuaaaucaaggauguuagcaggccacacccuuuuuggaugcuccagccaagguccuuucugccucuuucagcuucuuguagcccuaggcauccuuuaguuuguggcuguuuuacucuaaucuuuaccuccgucaugcaucuaccaugcauuuaugucugaguuuaccucuuauagcaauuuaagaugaguucauccuaacuaauuacaucuguaaugaugugucuaaauaaggccaccaucacauguucugggggagagacuuugauguacuuccaucccguucucuuuuucuucuacagcauaccucuuucagugacauauaaacuuacauggcagaaauaauacauuuuaauuuuucuugagaaaaugcuugcaacaugaacauagaugucaaugaguuuuuauagaauggaaucucuguaaucaccuauaucaaguaauagaagacuuggucucuuaacccuuugcccuauccuaccuacaccuuucaaggaagcccuguuggaauauucugucucaauguucuucuaguacggcugggguauuuuagauuuuaaucugauacuuugcugacauguaagcacagggauguguugguuccucuuuaugccuugcucugcaaaccugugccuaucauaaauuaaacugagucuuaauucauuuacaggcuggcugauaaauaacucaggcuuuaacuaauuaggaggaaguaggauguaaguuaggccauguacacuaacauucaaugauaagggugucgugcugugaaccagaaucagcacuuugacuuuguaaccugcauggcuuccugggaacucuauuuuuuguuaagcauauuguuacagaacaaauugcauuuugaguaugaauaauuagauugaagcuagaaauucugucauauguucuuuuuuuaucaaaugaaucuacaguaaggccauuuauauucucaaugugaaaaggucacucuaucugucauugucaccuuggauucugauagaccuuugcuuaugcuucuguuguggcuguguggguggcaggagaggacugcagcucuuagccagccccaucuccaugucacacaguuugagacuugaguuuagaugggaaagucucuggccuacugguaggaguuuuauucuucugcauuuucuucuguuuaaaagccacaaauucuuuucuguucuugugaaagucccauacacaugguaacuaugacaguaagucacuuaucuuuaugauccuuauuuuauuuuccuguagaauugagagaaaaauucuugcccggcuaucaucuuucagggugugugaguguguguuguuuuguuucugaaacaguugucuuacuguguagcccaugcuggccuugaauuuauaaucuucuugccucagccuccugaguagcaccgacuacugugcugauaugagcuaacacacugggcugaaaaaaaaucuguagucuauaaugaaaaaaaucuguauuccuuuuugaagauggacaaauuccucaaauguuuccauauuaacuuuagcagaugaauguauugcuuuauguaauaauuugucccugaaagggcugaaugagaacagaacaggacacaaaauaagucagauuacaaaagaaaaugaaaaugaaccagaaauggcuuugaggcuucaguuuuguuaugucaagaauuuuaagcccagcuagaacaaaugauggcuccauucuuagguguguguuggggggggcacucacagagcccagaaagagaggauauuggguccucaggagcugaaguuacagguaauugugagccacuugcaguagguacugggaaucaaacucagggcuucugcaagaucaauaagcacuguuaacugcccagccaucucucuagccccaguuuuccuuuuauauccacucgaacuguggaugaacuuagaaggaauaaacauaucauuaaggaauuaagauuuucccguaggagaguugacugcugagcaagucagcauagggugucucauuuuuguuuagucuugucuugguuaguguggcauaaauuuuaagcaccuugcuguguuuuaagugacagaagaguuacaacuuagauaauaggauauuuuuguuugauuguaguaccauuucugccuggauaaauaauacuaaugagaugagaacuauguugguuuucuugaaacagacagacaaacaauaucaaaaauugccuucauguauuuacauugcucuuuuuaaaaaaauuuauuuauuuauuuauuuauuuauuuauuuauuuauuauauguaaguacacuguagcugucuucaaacacuccagaagagggggucagaucucguuacggaugguugugagccaccaugugguugcugggauuugaacuccggaccuucggaggagcagucgggugcucuuacccacugagccaucucaccagcuacauugcucuuaaagaaauugaauuccauacacauuaauccuuauauauuuuuuuaaguucauugacuccauguucuacuagauguaaccaccauaagucacaaaaaauuuagagaaaaaaaauuguguuaaacauauagacuuuuccuucuuguuauuaguccuuaaauaucauaguguaacaacuauguacauggcacuugcauuguauuggauauuauugaugauccagagauggguuaaaguauaugauaggccaugaauagauuguaugugugcacuguuccauaguauauaagggacaugauaauccucagaccuugguauccacaggggauacuagaaacacuacccccuccaucagauaacaaagacaacuguacauuucuuuguuaucaggaaauucagacauuagacaaaaauagaaauguaauaaugccauuauaggagguagauguaggguaaauuuaaucuauucuuacucuuauuauuuauuuauuuauugguggugcugaggagacccuacagccucauccauguuuagcacacuuaacccaauaugucuuacucugaaaccagcaaggguuuucuuugcuuuuuuuuccucagcaacaauaauaaauuuuacuauuucauaguucuaauuauaaaaguaagcaauguuuuuaaccacauaaaacuauucucauagguguuguguuuugaaaggaaaaagaaaagccaaaaauuuaacccaggcucagugauucaugccuuaaaucucagcucguagguggauucaagagaaucagaaguucaaagacaaccucagcuacauagugaguuccaggucgacuuggacugauuagacccccaucuccaauaaauaaaaauaaaauaaacaaguauauaagcugggcauguugcacguuuuuuuuaauuuuauuuauuuauuauauguaaguacacuguagcugucuucagacacuccagaagagggagucagaucuuguuacagaugguugugagccaccaugugguugcugggauuugaacuccggaccuucggaagagcagucgggugcucuuacccacugagccaucucaccagccccgcacauuuuuaauaucaguauuucagaggcaaaggugagaggauugggaguuugaggccugccugggcuacagagugguagugugucccccaacaaacaaacaaacaaacaauauaucaauaaguaaauagagcuagaaaccaucugaaacaucagacuuuucuaggaagaguuauucuaacuaccucauuuuaggcucuuuagguagauagcugggauccuggaccagaaaauuuucuggagucucagaguccugaaguuuugucuauacccauagccauaccacaccucggccuauagcccucaaguuuuccuuguugccaaguagcuucugcauccacagguauccugucuuaguucaaggacagagcaaagagauggccccagauaucucugcccuuauauugcucugcagcuuccagcaguuuucuucucuucucucugcauagugcacauucuucccucugcagaggauucagacacuggaaagcauggggcugggaauuaucacagagaguucaguauuacugaugagggagggagagggacgacuuccaaaagacacaaucaaggaucacagggaaggaacuuggacaugagucaagcuacagggaaaggucaacuauggagaguccugaaccuuugaaugguaaauccaggacaaagaaaacaaggaaagugaaauuugccuuucaaauaacaaaccauuuauuagggacuugaacaccuugagguacuggguaugugcauggaugauuaaaaaccccauggguauuuauaucugagaauaaguuuugaauuaaaugagccagccauggacaugaauuuaugguucuuuaauauuuuuuaaauccuguauuacugggauuuaaaaauaacacaaggcuucuagcagugaacaguaacccuagcuaucaaccccuuuuaaaauagcgccucccaauguacucuguacugcucucaaauucaugaucuuuccuuagccucccaaguacagaauggcagaugucuaucaucauacccagcaacauaauucuauuuuugcagggugagauggaauagaggaaucaauucuuuugaaaagcaauguaaacauuugaaacagucuacccuguaaaaucaagauugauagcuggagacaccugcucuucccuaaaguuauuucucuguggcccuggaucgugucuguggcuucugaacauaggaucaugccauugcuccgagguuguuuuguacuuccagcgcugcccccccccuccuguguucacccuuucaacccuauaaacacuugcaugucaaagacagagcuuuuuuuuaaaaauguuugcuuuugaaaaggaucaccaaaauguuuucccaauaaaagauagucuuugugaauagcaagagcaucauauuguguucaagagaaaggaagacugggggugguggugccugaguucacuucaagggaagucacuguagcucaguucccccucccucuuuccuucuuacgugcacagccacagugcauucaauuguuuaagagcaauacauccuuugaacuagcccuaggaugggaaugcccauuaaaaauaaacagcuauguguccugagcaucuggaacucuauguucuaacacucagcaguuccguuuccugucucuugauuguguaucuguucuuccagauugcuuuugugcuuugaaaacugcagauuucaguaguccuaguaaucucuauggaagcaagcauuuaaaugaccugacuccucuguacccagauaucugugagaacugcuuaguaacacauaagcauuguugcuagauggguggaaagccuguuuggaaagcuaaauauuuggaaaccuucuugcacagccaccgugguaugguguguuugguagugguggugguggugggugucuauccuaccccuucccccccucgcauuguuauaagaugaauaguaggguauagucaggaacuuucuuuaucuuugcugagucuuuuccucuuuuucauccuuuccagaaaugaugucuguuguguggucaggacaucuguacaagaaaggagaaagaaauauauauuaaauuuggucuuuguccuuagaaaaaugcuaguuguauuagagcucuuuugucacuguaacagaccaucugauaaacauaacucaguggaguaaauacuuauucuggcuccuaguuucagagguuacaguagauggucaucuggcuccucgguugcuucuguaucucugguaaggcugaacauuauggcgaaagggugugguggaacagaacuauucaucucacaauagccaggaagcagagaauggggcauaggaucagggacaugauauaucccaucuaggucauaaccuacuuucuccaacuacaccucacuucccaguaaugauaaucuuaugaacucacuaauggcuuauuuuaugauuaggucagagcccucacaaccuaguuacuucucaauugcuccaccaggaacaaccaggccuccaguacauaaggucuggaguuuucuaggcugaaugugaaugggccagaguaauguacauuucaguaaugagugugaccgcaagacgaaugaugaauagaauaucaaagcuuuauuugcauggaagugguagaacaauguuaaauaugauggccuaccuggccucuccaagcucuuaggcauucugcuacagaccagaaggaggcugauuugugugacgcagguugcucccugcuuccugcaaugguacauaggaagugacuuggcuuugguuuucuguucaacaugagccauucuagauaucuccaauauaucauuuaacauagugguucuccacugggagggauggugucucucaggaggcaugugacaaugucuggagagaugauagcaguagcuagcaggugaaaguugagaagcauaguacauccauucugcccaaagcaaagaaugaccuggcaucaaauguuaucagugcugcugagaaguuugcuuuagguaagggauucuguuuggcuauccaauuuuuuuuucaccccgaauuuuuacuaaccagauauuugaguaaaauagccacuguugaguucuuacacucaauauugguguaagcauucuucugagcgucuuugauaaauauaaugguaugauucggaucuuaaaggcccccugaugucccuguauuuaaaguugcugaugugugguacuguuaggagauguuaaaaccucuaggaagugguaccuaguaauuagaagaugggccauugagaacacacccuuuaaggaaauguugauaccccaggcucugccucauucaugucuugacugcuuugaggugaacagauguguuuuauuuaccaggugcuccugcugcccgguuuacugcuuugucagcagccuuucaagugauucuccuaggcauuugucauaguuuugaaaagcugauuaucacacaucuauauacauagcuccaguuaucugcuauucacuugugcauuaugcaucaggccuuugagcugcauauguaaaaaugguugcaugugcuuuuguuccuguagauaucaugauccuaguacgauucugaaguugggcguuuccccacguugcugucggugcacaacugaggaccugaggacaggaaccuuuuucuuucuuagucagggagcagaagcaccaaggguucuguggcaaggguauuuuaaaagcauuagaaacuucugagagagggagaagggucacaggcaaauagagggccuuauacugguuaucccuuaacuaaguugaacugcugaugguuagcacagcccuugcuugucaaggugaagaagauguagagcagcggagugugaaaagagguuggagcccccuucugggcccuucugcgucuaucaucucgugugacugugacaugaccucuuccaucuguugcaccaccucugccuuggcagcuuccucuuuugaccugaugaauagagauccuugaaaaccguuuuccugacccaugcacagucucuuccuucagagggccagcuggugagauguguuuucuguuacccacuugauuguaaguacaggauauuuagaccaugauauuuuaaagagagauuuguauuagccuaacaaguuaccuaccccccucccccucuaucgucuuucuauauagggcuucagacuugcuauguaguuuguaucucagcuggccucuaacucuccauccuccugccucaaacauuuugaguguugggauuacacgugauuucugacauauacaacaaaaucaguggcuaugugucauaugugcauagaagguucuuuaguuuucuuacaucacuaaguauggaacucagguccuugugagggcuaaauaagugauccaccauuuagccauccccagccccagccccagcucccagcuccagcuauuagguagccuuuaauucacaggggaacugugacuugguuucuacauaauucacuuaggcuaaaauuuuaaaagucaccccacuuagaaauucgguaauguuauaccagcuguauagaaaacuuauuguuuagacaauacaaauguacaggauaagaaaccuuucuaaauaggaagcauucuaccuaacuuuggagaggucucccuuuccacuaagcuucugauguucuuauguuauuaccaggaucuguagaaguugccacugaaccugagagugggauuguuuguacuucauuucagucccccccacccccuuuucuuuuucuucuuccucccucuucagaccacucuuuuugguuauugagauaaggucucauauagcccaagaugaccugaaacucacaagcugaggauuauuuugaacugcuugccauucuccuuccuccaucucccaaguguuggguugcaggcauacucuacaaagcccagcucccagucccaauccaccauaaauagauuauaauaauaauaguaauuugugaauaaauuuguauaauacuuggaguuuguagcauguuucaaacaucucaguuauauccuauaguugaccuaggguguuuucaucuuuuggaggcagggucuuguaucccauacuuauauaggaugaccuugaacugauucuucugccuucaucuccuaaaugcuuggauuuuacaggcacuugccaccacaccagacuuuaaucucauucugacaugaacagaguguaacaacagugcucugugaguauacuuaguauuaugaguuugcaacauaucuccauuuuuaucuuaccuuuuaucuuccugcuugucuuuccugguuguacugaguguuuucuuuuuguccauucuccuuucucuuccuucucucucuuuuccuuuccccuuuucuucucauuucccaauucccuuaacuuucuucuccuuuucuguccuuucuucucccuuuuacuuauuugagguacgaucuguguagcucaaguuagucuugaauagaauaauauaguugagggugaccuuggacucuggauccuuuugccucuuaccucuccaguucugggguuguggguauuugccacuaugccuuguuguccugguaguuuuuuuuuuuuuuuuuuuugcuugcuuuuauuguuuuuuuuuuuuauuaauauuuggucucacugaagcccagacuggcuuggaagcccagacuggcuuggagcucccaguucuccuuaauaagccucccaaguagcugagauuacagcagugcaucggcaaacccaguuuaagauaaucagguuuuggaaaaccaaagugagauuaaagaaaaaugagugacuuuuuuuuaccaaauccuguacaaacaagucuuaagucccauuuccugccucaauguuuuguaaacccucuuugacacaaaccuuuuucuaccuugccaccugguuuucucuuccucugugccaucagggcuguguaucugguaaugcauuuaccucagaacuuuuaucaauuagguuuggguaacaaaccauacagaaauuagaauaaagauugcuuaguacaaaucagaauuuggugaauuggcuguguuauauucugucuugucucuuuauaaaaacaaauuagagcaguugccauagaaaccagaggucuugcaaagcaagacugauuuuuuuuuuuuuuuugguuuuucaagacaagguuucucuguguagcucuggcuguccugggacucacucgguagaccaggcuggccuugaacucagaaauccgccugccucagcaagacugauuuacucuaugccuguggcucuugauuuaaaaaaaaaaaaauucuccugcucaugcaccuauagucacaguuucucaggaugcugaggcaagagauugcuugaaugugguaguuuggugcuaguuuugacacuauaauguggacucaucacuuaaauacuguauagaaucauuaacuagcauuaggcuauuguuuuuguuuuucuuucuuuuuuuuuucuuuuuuggaccuggcauuaagaaggcagaaucuccaggguauguacaaaaagagaaaucugucuucccuuccucagcaccccaaaagcuugguggugguggugguagagaaagagggggguggaaugagaaugagacuguguguauguuugacgccugacugucuucucuagauagggaagacagucagggccacaggcccagaggcaaucaguaaaaugucguccugugcuguucuugaagcucacuaggaaacuggcuaggaugcccugaaacucacuagaaagccauuugaaaguuguugcuaaaacucacugggaaacugcugaaggggugcuaaugaaaccaagaaagacacuuuugaaacuauugucacuagguguaccacaggacugccaugucccacagggcuggcagagaggaaagcacgugagauaaggaagggaaaccagucuucucuuggugucccuccagugcccucugcugacuguacugaaaaggugcuaguugugacuuuagagauguucccgguguaggguauuguuuccgagcuuguguuuuacugucauugagaugugagucuuggcuuuggagagucaaaucagggugguucuagguucuuccuuuuucugacacugcuuaggcccuauagauaagcuuuuuucccccuuuuguuuuagguuuaaaguugugaguuaggacauuggauugcuaacugguggugcuuugcaguacugaaaauaugcuguuuuaaaauccuuuguuuuuauagaaauagaacuuucucuagaaauuuuuucugaguuuauuuuuucugucccugggugucuuuuaggaagacuguaucuggcacuauuuagaguacagucuuguccugauagagauuugacauuguccugauagagauuugccaggcuuuuaccucaucuggggaagaggucacccaucaucaugaaaacugugaguccuugcuguagaauguaaauggcucucugguucccagucuauccuaccuggcugcugagccugccucucugucuugcaaaacuuugaaccaaugccugguucucacagucaggagagcagucagcuccuuuuuguucacuaauaucuaucugcucagccucuggaucucuugggagacugaggccccauagguacuucuguuuuccauuuucgugucuacaugacccugcccuugcaucagaacuugucaccaauucauuaccuuccuuuaaaacauuucauuuaccugucuuugucaccccauccaggccacauuugccucucugugucuuagggccaaguauaaccugagccucauuucagggaugaauggaaggauuauuagaccucuauauuauuuuucccugaagucccaccuuaguggccuuucccaaccuguuaaauaccccacccccggccugagucaagcuuccuuucugaaggaacugagagcaaacagaaugaguaauggauuuaagaagauggggagguuauuauccuccuguguaacaaaaggcauggccugcucaugcacuuuaggcuauucauuggaagggaaaauauucuggaaauaauuacagcugauaaccugcaggugugacucacauuuugacgugugaucuuagacucauaaaacagcaaaguugcucuucccuauuucauucugaugacuggacauguggguauauuccacuucuccaagcucagaauuugacuucaacgugaauggugagcuaggucuucuuccuucuaucaccagaguccugcuuaccuuaguugucuuuacacuauaaaaauaacuucugucaagagcacugaaaaggcuucaggguggguauucaucacggcugcagugguccccaaacuuguaauucuccuacuucagccucacgccccccccccccccccgcaaugccaggauuucaggugccuaccaccaugucuggcuuuugcuguucuauucuuuuuguugaagacauuuauuuuuauuuucacuacaagguuaauauccugaaguaguuguuuucaucauaaguuuacacuugacuucucugcccucccuuacccaccuccacuaccugaagaacagugcccacguucugcuucaaggucaaguucucagucuucucaccuucugccaggauccucccacacuccuguguauucuuuacacuguuuccccugacucaucccucuggcaugccuccauuuccugccugcauguuucuucaugucaagaccuccauggaauguccucccuaaugcugcuguauuccuuucaagcccuacacauuuuguuuguggagcuuuuacaucagcacuuugaaccugaagugaauauggcccuucauauuuccauuauaccaaauuacaauguuucauccacagugcaccugguuaccuauagaauuuauauucuuuugucuucgcaaggcuucauuuuuuaauuacaguaaaaaaucuauaguuuugcauugguaguuaaauacacacucuggccuuuccuuacaaacacaggacuacaguauaaaaaguaucauguggcaauucuguuuucuauuuuuauuuguuugcuuguagcucgggcuggccacagacucauaaucuuuucucuuaaacucuugaguucugggaucacagauguguaccacccaugccugagucacucuuuuuuuaaauguuuuauuuauuuuuauuggauauuuaauuuauuuacauuucaaauguuaucuccuuuccuguuuuuuuccuucuaaaaaccacuaucccauccucccucucccugcuucuaugagggugcucccccacccaaccacccauucccgcaucccugccaugacauuccucuacacuguggcaucgagccuucccaggaccaagaaccucuccucccauugaugucugacaaggccauccucugcugcauauguggcuggagccauggggucccuccauguaaucuuugguugugguuuaguuccugggagcucuggguuuaugccagagccugacaaauacagaggugguugcuuauagccaaccauuggacuggcucauuauuccuugaaaauuggugccaaauuuaaguugguugucuaguacaagcaugaauaauuaaguccaacuugagauagcauauggguuuaguauagaauggaaauucauaaaacauuuucuuuuaaaaaauuauauaucauuuucuuauacuggucuggaaaaagaugucauucuguuuuguacaaagugaguagcaguauucacauagcagggccaagcaacugaaccugauuuaugaggcaugaugaaauacuguguguuagauguugucaaggaucauuucacugcuacaaaacaaagcagaaaauacacaacaggauggacuccugguccuuugaggccaaggaauuuauccaaauuugguggagggaaugguugauuugucuguugagcacauacauguaggacuauuucagcuaccaauagaaaaccuuagaagggguuuuguauaucauuaaauauagcacauaagcuugauucaggauugauuccagccuucuagaaccagauccuuuagggccagggagggaauuguuuuuuuuuuuuaaucacuaugcagggcacauuuaucuuucacaugaacgaccacucuuccaguuacccaacugaaguacaacauagugaaugaaaaauggggacaugauggcuccaagguaugguggagaagguuuauugucuaaagaacugccagaggaauauggaagaguccagacugaacauugccagcagacuaaacaggacuaugagaggagagaggaagagaagagaagagagaggaggaggccaagagaggauuuccucucuuggacccaagaaagucugugggaagcaagaggauucauagcugaaaugguuaggcuuuauaggaaaagagaaacuggggacaagaaagugaaagcucagggcuuggggagguuuagaguagugggcaggguuugccagccagggcaacuuuguaacuggugcuuguaaaguugagagauucugggauaauccaguggccaguauccacuuugauauguuaaauagacagcucaguuagccauuuguucaagguuucuuugagaccuaacgcauaagacagguuccagggacaaaaauaggcucuaguugcucacuggguauucccuaucaugguucuuuugucgucuucccaaguggguccuuaguaaacaaugcgcuaagacaaacuugacucuccuggauaaaaggagcagcauuuccuggguuuggacuauggacuuguacccuacaggugguauucugacuagauucugugaaggguuagaagacaaaauacugaaaugaaaaugggagccacauaacuccauuugaaacuaccaauuaagauccugaagauauaaucagagugacagguguuggagacgugagauacagaagaccugcacgagaagggaacauuuuuuuuuuuuuuggaguagugcacuugcuugccuuuauuucuuggccuugcccuaaggagccacaauuuucacagcuucacauuuggguuucuucauccccaaggaauugcaugagcuugaugggcuuaagcuauugucuaaguuuccuucuuuaaagagaucucccagaucaaagaggggagacguuguaagguuaagguccaccaugaugaccucuuaaagaagacccucuagauacuugaugacacccuaaaggcuguuaucaugagcuauaauaaagacagucucuugugagagucuaaaggacucuauugucuuaucugauuugugauccuuacugauguuguagaagggauguuuaggcaccaucgguggugguggaacaucauaggagcaccuucagaucuuuaccugugccccucaaugcuuggcagcaguuucuauuuaggccagucagacccccauacucauugagugcuagggcuucucuauuggcagcuguucagaggaucagauugcuuuuuuuuuuuuuucugcacugaggugaaacagaugucaaauucauagucagcuuuucccaaugcuugcccacacaguugguacugaagcuguucucuagguccuaggcacaaucaccauccuggaacaguaucagauuguaggcuacaguggcagcaggcuagagcuacagcaccagguuuuuguuuuuugauuacauuccuccuucauauauaaauaucucuugucaagggagcaauagaaaggaaaauaccaugcugucucccaaaugcaaacauguuuucccuggaaaauauagauggggcauacuugaaaaaggaaaauggguguucuguuaguaaauaaacaccuuuguagacaagaaaugauagguggcaggcaucagccuuccuugagaagguagaaggguucagaugagaucacuuugauagaaugucccagaacuuaucaaauaagcauuugugggaacaggacaaaaaacugacucuugaaacccaaucaccauagcugacucagacacacauaauacaucauuuugaggaaauacuccaccaaaaacugucuuggccaggcauaguggcauacuuaauaauucugacuucuaggguagugugggauacuuuaugagacccagucucagaaaaacugggacuggagauauuuaggaucuauuaugaagugcuuguuuuauaugcauaaagccuugggcucaaguccuagcacaauaacccuguuaccacagcuuuccuauuuuuaaaauuauuuuuauuuuuuuacagucuagucauuaccuacuucccaguccacccucccacaguuccucauccccuuccuccucuucccugucuucaagaggaugccccccaccaggccuccccuaaauauuuucuuaauguuaguacaauuaaaaguuugggggucaaggauguauuuuaaaguuucgucccuaucaguuuuauacuggaccaaagucauuuucuuccuuucauauauuggagaguauacaacauuuuauugugugaaaauauaucuaauauaaaauugagcauuuuuaagcauguugagauguagauucaguggcacuagguaaauuuuccauuguuguacagccaucaccaguguccauguguugacagcauuccauccugucauacugaaacuuuggccccauuaagugcuaacuauccauuucuccuuccauuuuccagccccuugggaccaccauucuguuucugucucuauaguuuuggguacuuagguaccucauauaaauggaguuauauauuuuuuaaucuaguguaugucauacagcauaaugucaaaauucauccuuauuguaacauaagacaaagcauccuuuuuggccccaugaggauagugagauggaaccucagaucuuaugcaugcccugaagguacccuaacacugagcuacaucucaaagggcuggauaauauuccuuuguacauguauacauuuuacuuauguauuuaacaauggccauguggguuguuccuagaaagcauaauuauuuaauaguaaggcccaaauuaguuucuguuucucagcccaccaaccagggacccagacuccuaccaaacuuaaggauaugguugagauucuaccagcuggcuucaggggaguaauaccaucuacaguguuguauuuuugcgauuugaguugucuuuucuucuaccacuauuagcaguccgggucguucuaauuugaucuugguguucauucuuccuccuuuuccuccauggucuguauuauaucuaaguugacuccauugguacccuccaagcucaccuccaagcuuuacauauuuccugcuucuguucacuccacauguaggaugccuuuccucgacuccuacccucagacagcuaccugucuacaugcucuucaccugggugcuccugggucuuuuacaugagacuugucaaaaccucauuuuuuuccagaugucucgugcuauaugugcagucuugagacaauuauaaauuaugucuguuaugauauugggaugaaauugucuagacuuguugggugcauuggcaaauaucuuuaucucaaacucuugagaggcagaggcaggugguggauuucugugagugugaggccaggcuugucuauacagcaaguuccaggccagucagggcuacacagugagauccugucucagaaaauauugucuugaguuuugaagugaguuauuauuagauggacuacuuccuguuuuugcuaggagugguuccuugaacccagggccucauacaugaagacaagugcuuucccacagaauuauauccccagcccaaauuuuuauuuguuaauucauuaauuaauuuauucagacacccccccccccccgugugucucucugugucugugugugugacacaucuguggaacucuggagagcuuucaagagucaauucuccccuucccaugaaugaauguugguucucucuuuuuaccauguggggucuggagagcaaaaucuguucaucaggcuuaccagcaagcaccuuaucugcugaacuaucuuguugcucccaacuccuuuuguugcuguuguuguucuuuguuaguugguuuuuguuugcuuguuuguuuguuugggagcacgggcugauaaguuacugccuaagccuccugaguaguugagacucaggcuuguaccuucaugauaagcuaggaguaaaauuuuaauuuuuaugugcaauacugaccuacagugacuaaauugccuuuuuuagcauaaaacuucaguucuccuagggacuugguagagauuuuuuaaaaaaauauguagcuguguuuauuuguaugugaaacagggucucacuuuguagcucaggauggccuaaaacuuauagcaaucucuugucuuagucucuugagugcuguuauaaaagguguguaccaccacagaauaugagacaaaggcauccugaguuugagaccaaccugggauauauggugagaccuugucucaaaacaaacaagucagcuaacagauugcauauugagcaauauuugauugccacugggguucuuugcugcuuguuuauuugcagggguuuuggggaagcagggguauaauacgcaaaguagaaaauauauuugucuuuguggaccuaagagucaauggugcuuuguggcauuaucuaaaugugugguuguguucugauaaauuuuuauuaaaaacuaaggacacuaaagaccccuggcuggauuuuguuuggccaacaacuauuuguuagccuaccaguuaugcagaaguuaaguguauguauggauuugugauuaauugcuggccuaacaaggguuuagucucuauuaagugguauaaguaauagaucagauaaauuggcuaaggaaggguucagugaucacuguuuuguuuuuaagguaggagauguagaagauaauaucaagcuuuguguaugugugccuuuuuuccaaugcugaggauggaacauuuccuuauauguuuacacagccuguucuuuauggguaccugagcacagcucuuccaguuuucugguacagcagauagcagucuuuaguaacugcuuccauauaagaauaaaaaaaugacaaacuacuaaaauuaaaauaauuccuuacaaaguuuugaauuucuguaaguagaacagcucuuucuaauaccuuuccaggcauuguuaucuucaauucuucaguuagaaaaacagaguacuaacuuuuaauaugcuucuacaucaucuguuaauucucuaaucuucauuuccuuauccuagcaauuccauagccccaugcauucuccuucuaauacuauuuauucuuaaaucauauauaauuuccuacauuuaaaaaaauuccaauuuuuuauuagguauuuucuucauuuauauuucaaaugcuaucccgaaagucccuauacccucccccuacccuacuuuuucuauccauaccuuuucuuccugagacuacucuaacucucuauccuuggugucuccaaguucacccuugcuaaucaaugcaucagucauuaaaccagauguguauaugguuccucaugauuccaaaaucaaggccaagucuggcaacgaaccauuuccaaaaaggaccauauaggcuuuuauggcuccugugguuauauugucuagacccuaaaggccaaguggacaucuauuccucaucuucuacagccuccauuccucauuccugaaaacggcaucuguuucaauuacuauggcauuauuagcucugaguaaugggggaaaguagauucccagaaagaaagauugaaaguagaguaguaaagacaguagaucaaccucggggcaacagcaaccaucaauguggagaucaugggaucaacugccuggcaaugcuccaggggcaggaacuguguuacaccuucccuuaugcagccaugccggacccaguacuagagaauuuauuagaaagcuggauguugugguggcagugcagaccugaaaucccagcuacuccggaagcugacucaggaggaucauagguucaaggcuaccaccugggcuauauaaugagaccguucucagugaaugaaugacugaugaaugaauaguccuggggacauagcucaguagggcuggguucauuuucccauauuagaaggaagaaaggaagaaaagcaaagaagaucauuaggaauacuaguaucagacugcuuaaugugcaugagauuucucuugggaucaagguaaugcucugaaauuugauggugacuauggaaugcugaaugaacugaaaguuguacagauguaugacuuuuaugagugguuaugugaaauuugaauuauaucacaagugcuacuaaaacaaggugcaggauuaauguaugaaaauaauuaccaaacaguaaaaaugauccagaauuauuguuuggauguaggaauuccagaauaugaaucugguuuugguuauaugaauuucugagucuuuccauucauuuuucagugaacuuguguggggacugacagggaugagggaugcuauauaagcggcauuguauuaguguaacccuggucauucagugggaauaaacucagcuuguuugccccaaacuuucuggaucauuuuacugcuggguuauccuaaagcugugaccugcuuuaagccugcacauacuaaauuccaaucugcauuagaggaucuugcuauggcucaggaauguucacagaacccccuucucuguuacagauugaagaaggaagcaaagcugcagcaguggacaagcuacuugcuggagaugagauaguggccauuaaugaugugagucucucaggguucagacaagaagcaauuugccuggugaaaggcucccacaagacccugaagcuuguggucaaaagguaagaugugugucgcuucuuuauuaaccaagacaaacagagagacauagaaugaagccuauguggcuuguuuauauguuagagauuuuuauaugugugugagcuuaaaauuacacuuuuuccucguuaguuucugaagacuguucuaagauuccccuuuugaauaucagaaccugcacauguuuaagaccuuucuagaaaaugccauuguguuuguuuauaaucuaggccacauccucuuacaugcuuuaaauaaucucuaaacuuuuaaguugccaugacaaaaguacuugacaguaacaaccucaaggagaaaagauuacuuuugggcucaugauuucaagagauuucugcccaucacaguagagaaggacuggguuuaauagugguagaaguauuuugcagacuccuugucuuagucacgguuucuauuccuggacaaaacaucaugaccaagaagcaaguuggggaggaaaggguuuauucagcuuacacuuccaugcugcuguucaucaccaagggaagucaggacuggaacucaagcaggucaggaagcaggagcugaugcagaggccauggagggauguucuuuacugucuugcuuccccuggcuugcucagccugcucucuuauagaaccaagacuaccagcccagagauggcaccacccacaaggggacacacuaauugagaaaaugccuugcagcuggaucucguggaggcauuuccucaacugaagcuccuuucucugugauaacuccagcugugucaaguugacacaaaacuagccaguacacuccuucuucgcaguuuugcugaccaagaagcagaagagaugaacuggaacuagaguugagcucaaacugucaagggcuugcccucaguaaccuucuuccaguagccagaccccaccucccuaaggcucuacugucuucaaaacacaagcuguugggggcagucugcucccaauaagggaauauauuguugccuauuguucauagaaggugaagggcagguaguuuugauuacuuuuguuuguuuguucauuuguuuuuuaagaaaaaguuucuuuguguagcccugacuguccuggaacucacucuguagaccaggcuagugucgaacucacagaaguccccaaugccucugcuccccagguguggggacuaaagacgggugccaucacugcccccaccccccagccuguuuaacucuuaagcaugaaagacaagagugggugugucacaaaugcaaguaacagauacuagguucauaguauugugccucaguuugggggacaaacugcauguuccuauaaagauuggggguuggcacuuagauggugcuaagaaaaugaaauuagggacuuaauacuuuuuuuuuuuuuuuuccgagauaggguuucucuguauagccuuggcuguucuggaacucacucuguagaccaggcuggccucgaacucagaaauccaccugccucugccucccaagugcugggaucaaaggcgugcgcaaccacgcccggcgggacuugauacuuuuauguacaggauaaaaacaguaccccuugguaccaugagaaaacuuuuauuuuauuguuuucagagauuucaggcaugugccucugagacuuguugcaugucuguuuuuauagaaucaguggaguuguugauuuaauuaaaaaguuaaauugauauugaugcauccaguauaugugaagcagaagcagguggaucacugugaguuugaacauauaaaaggcuuugaacuuauaaauauguauacaugugcuugucucaaaaguuaaguaaacauuuacuucagauuuuaucacacacugaaaaacauacuucuacagagcaacaguucucccuuucccuccccgcaaccccccuuguuuuuuagcuacaagcagaauccaggguagaggcucagagacgaguaaggaggggcuggggagguaguucaguggguaaaacacacaggugugaggacuggcguucaaauccccagcacuugaaaagcagagacaggagccuuggagcaagcggccuauuagauuagccaaaucagugaacucuguguucaaccagaggaacauuucucucccucaggauauaaaguaaauagggaucuaguaagauacaagauaacaaauuacaagauaaaaaauuuaauuuuuacauacuaugugugcaguccaaugcaugggagcccuuguacaaggcaauaaauaaauaaauaaauaaggaaagaaaaguguuaucaacccuuauuucuaagugggauaugcuuaugucaugagaugcaauuagucuuuugaaugccuuuuguuuauguuuuggcagugcuagagaucagacccagguacuguuaugugcuaagcaggugcucuaccauugaacuacagcacuuccaguccuaaacaccccuuuaaucagaccuuguagcucagaagauaucauuucagaagguggaauaugagguaucauuaguguauaauuccuugguuaccucaugaccccucagaaggaaguugucuuauuuaggaaugcuauugcuauguugauacaccaugaccgaagcaacuugaggaggacaggguuuauuugccuuaaacuuccauauuacuguucaucauugaaggaagucagaccaagacaggagccaaugcagaggccauggaggaaugcagcuuacuagcuugcucuuucuuccuauaagaaagcucagccugcuuuuuaaauagaagccaggaccaccagcccaggaguggcaccacccaaaauggguugggcucuccccuguaagucacuaauuaagaaaaugccuuauagcugggucuuaggcauuuuuacaguugagguccccucauuacagauaacucuaguuuguggcagguugacauaaaacuauccaguacagaaguccuuuguugucaugagaugcaauuagucuuagucaagugauggucaugggaggaugcuaauccuagagguaagacuaggagugacacauugccucugggaauuguuacugccucuuaaaccucauucuuugguugugaggggcuagaacucccacucuuugacuaacuugacuuuugaauagggaagauacaaauuucaaaucccuucaacugggcauaugaauucuuagcauaggauuuuguuuucuuuugaaacagagucucacuguauagucuuggcuagccuugaacuuguagacccucaaaaagaucaccuaccucuaccuuuaacaugcuggaauugaagguaccaccacaccaaauguagcaguggaaaauuuuuuuccaucagaagguaguauguacagaaacauggaacagguuucauaaguucacuucuuuuuagugucaaaucugguguuauaagaguguguguguguguccauggguuuagugggagaaaaauaguuuuauuguuuacuuugcauuucuauaauuauaagguaaagugggcauugcuacauauauuucuuuuucuuuuuuguuuguuuguuuguuuguuuguuuuuugagacaggguuucucuguauagcucuggcuguccuggaacucacuuuguagaccagguuggccucaaacucagaaauucgccugccucugccucccaagugcugggcuuaaaggcugcuacauauauuucuuaaugugcuugauauaauuguuuugagucuugaauuauauaucuaaaaaggauaucaauagauaaacuaaagccuauuuaaaauaugucagugccaccuaggaagcaaagagaggagaccauagagcuuuuacuggcugguauagccaaaaagauguguaaacauuucaggaagaagaauuaaacuuugcuccugaaggcuugauggaagccauuauggagaacuccuuuuuuguauucuacaugcuguuuccuuuaaauacggaguauagacaauuaugugcuuuaaguaaauaaaagugaauaguuuaaguaggaagauuuuaaaaacaaagcaguuuauucaaauuuaucugaaacauuuuaacaauauacuuaguguuuuaaauuuuuguaaauauuuuuguaugaauuguaaguaauaaggguagguauuauucaaauuugacaugguucuguuuagagaugugaagacauuucccaagcugguaaauuaguuaauauuaggacuuuuguguguuucuuagugcauggugaauaauuauuguuaaucuuaaagauaaacauaguaaagccaugcaacacuccagaauaacaggcuucauuucaaauaaaccaguuguuuuaaaaaauucagcauguauucauucacuuuuuucuccaugcuccugacaaccacucaaucugcuuucuguaccguguauuaguuagcauuuacuaguauuuuguauuuuauauugaguuccaagguggaacaguccuucucagaaaaacuucaagaccugggguggccccauaguaaacaugugcucagcaccuaaggcccagguugauucugagcacacaaagaagagucuagcucacaaaaaaucacucugaaagugacucauagcuuguagcuguuaacauuugaauuguugucccugcauagacuccgcuccccuuaaugacagcugcucccugcuuuuauuuccuguguuucuuuuaucuuaguuugugagguaaccaggggaacagccaacuggaaugagauuucaauagggcaguuugacaaagcagugguaucuuguuucacaaggccccagcaaucuuguccucuuugagaagcaguguccugacuuuaaugccugaagggacauggugauaucuguauucccagugaagauucuuccacagacaaaagagagugguuacuuuucgcaggguuagcuggggaagaaaaaaacuucaacuaucaucuccagaaagagcacauguucuucaugauguccagguggcauucggggcucuugagcaguagggugggggacucuauaagagccagaucuguggggcugugacaaguugagucagcaugccuaccuuguucuuugguuuccaagguguuugauguuucagugugucccuuugcagugcuauguaguuuuuaguauauauuuguuugucucuauagaguugucaccugcuuuguccuccucagugcacaguucugcaccuggugauuucauggauaagggcuggcauggaucugggcucuaagguuuucacggaaggcuacagacuuuuuguuggggaccaguguugcgguaaaucuucaacccaaauaugccccaacaaugaaaacacgacucaguuauuaugaauccaugcugugugccuagauugggcagcucuacuacuacauuaucuuucacaucaaugagaccccuuagaacuugcaguuucuccaggccauguguuucugcucugcuuuucuucuuccuccuccucugcguccucucccucuuccauuuucuccuccuucucucucuucaccuucugcuccaccuucccuuuaucugcccaaucaucagcucucguuuauuauacaaauuaaggaugggaagcagguuuacaggaaaucaccugagugcugacucuuuccuuguuugcaaccccuccccgaagaacggaauuaacauuaaacauaauuagccccagggcaacccacaauuuagcaguguugguuuggccacucaguuggauuaaaaacagaaggaggcagagacacaaggacuuagagaguucagccuggucuagaaugaguuuaacgacacuuuggguaguuuuugagaugcugucucaaaauaauaaccauaaagaaagucugggggauacagcucaguaauuggaauacuuaacuagcauauguaccaaaacacaucaaaauguacacaugaacccuagggaaaauuucuuuuaaauauuaugccauaaauuauuuuuauaaggcugaucuauuuucaaucuuuuuuuucuuuacgaugaaguauaacugccuuauuuuaaaucuuacucugguaguuccuuguaauccuguccuagauuacgugccauuuuguuggggacaagccaggguaggguugauucauguuacuugugucuuugcugguagccauaaaccgucuugugaaucuaauuauaucuccuaagcuuucacucaguagcagcuuaacaacaaagaggaggcuuuucuuuccuggaagcugcaaggguuaggcagccugcaucagaugguuacacauuuuucagaaagcagacuucaaaagcuggggaguagacuugcuugcugggagcaaguuucuugcagcaaauaucauucucuaauguugcagaguuucauugccaucaacuucagacuaguacuuuauugugcucuccucugcccuggccucugccauggcuuugagagcguagcuggaguuccucggugcuaauuauuagcacagacguuccugugaguagcaacuuucagugagugguauggcaggagugaucguuuugagacagcaacagauccuuugucuccuucuauuuccucuccucuccucuuuucuccuuuccagugagccuuuccuugguggaauucucccagaauagggacucuuggggugugggguuucuauggguaucaagugaaagccauacuuuacaguagcuugcucuucuuugcuaauggcuuaggguauuauuucuauucugugagcuuuugggggcaugcuacugugcuucuuuacuuguggaagcagagauguugaacuuuauagccugauugguuugcccuucuuucaguauuuucuuuaugaaagucaagaaaagaaauaaaaccacauaguucauaagaguuuuaucuugaauuuggacauagauguagcuuaagaaauuuaaucagaugagucucugaaacauuucauuuucuaggucaaaguuaagacuuuuguuuuuccuucuuucuucauugugaaaaauaaagaacuagaucuuuaugaagguuguaugcauacuguaacuaagacaugcaaaugauguuuauaaaguucaauuuggcagaaguauugucuaaugaguccuaaugaguaaaagagacaauacuuugaaaccauugauggcuuuuaguuuucauuaguuauacaauuuuuguuaauuuuuugguaauacauuuuccuuguauauuauuaucacuauacuuugccuuuuguuuuccucuggugcugaggacugaacccagggccucgcugaugcuagguaagcauuuuauuauugaguuccauuccaaucacauugaugguuuuuaauauauuaagagacacauauuuacuauaucaaaagagacauuaagagaaacuguuauuuuuguuuauuucaaguuucuaaaggaacuugguuuuguuuguuuguuuuuuuuguuuuguuuuuuguuuuuuuguuuuuuguuuuuuuuuuugagacaggguuucuuuguguagcccuggcuguccuggaacucacuuuguagaccaggcuggccuugaacucagaaauccgccugccucugccucccaagugcugggauugaaggugugcgccaccaacacacgguaggaacuuguuucuuuuuguuuaguuuuugagacaaaguuucacuaggcccagguuggccucaaacaugagaucuuucuacuucagguuucaaaaucugggauuacagugugugccauggcacucaucucagaggaacuauaaauuguauaauuagcuuuauauguuacagauuaucucauuuugagaucuaaggaauuaaguuguaaauuguagcauuaacaaugcagcuuauauuugugguucuauaccauagauucauauucuauaccuauauucugcucucaauuuauauucuuuuuaaaauuauuauuagauauuuucuuucuauacauuucaaauuucaaaugcuaucccaaaaguucccuauacccuccccccgcccugcuccccuacccacccacucccgcuuuuuggcccuggcauuccccuauacuggggcauauaaacuaugcaauaugaaggggccucucuuccuagugauggccaacuaggccaucuucugcuacauaugcagcuacagacacgagcucuggggguacugguuaguucauauuguuguugaccuauaggguugcagacccuucagcuccuugggugcauucgcuagcuucuccauugggggcccuguguuccauccuauagcugacugugagcauccacuucuguauuugccaggcacuggcauagccucauaagagacagcuauaccagggucccuucagcaaaaucuuuauggcauaugcaauagugucuggguuugguggcugauuaugggauagauccccgggugggauagucucuggaugguccauccuuucgucuuagcuucaaacuuugucucuguaacuccuuucauggguauuuuguucccuauucuaaggaggaaugaaguauccacccauuagucuucucucuucuugauuuucuuguguuuuacauauuuuauguucgguguucuauguuucugggcuaauauccacuuaucagugagugcauaucuaaugacuucuuuugugauuggauuaccucccucacgaugaugcccuccagguccauccauuuggcuaggaauuucauaaauucauuguuuuuaauagcugaguaguacuccauuguguaaauguaccacauuuuuuuuauccauuccucuguugaggggcaucuagguucuuuccagcuucuggcuauuauaaauaaggcugcuaugaacauaguggagcauguacccuucuuaccaguuggggcaucuucuggauauaugcccaggagagguauugcgggauccuccgguaguacuauguccaauuuucugaggaaccgccagacggauuuccagagugguuguacaagccugcaaucccaccaacaauggaggaguguuccucuuuuuccacauccuugccagcaucugcuaucaccugaauuuuugaucuuagccauuuuggcuggugugagguggaaucucaggguuguuuugauuugcauuucccugaugauuaaggauguugaacauuuuuucaggugcuucucugccauucgguauuccucagaugagaauucuuuguucagcucugagccccauuuuuuaaugggguuauuugauuuucuggaguccaccuucuugaguucuuuauauauguuggauauuaguccccuaucugauuuaggauagguaaagauccuuucccaaucuguugguggccuuuuugucuuauugacgguguccuuugccuugcagaagcucgguuucuguuaguaagauccuuuccuuugccuuuccccaucugguaaucucuggaguuaguuguuauaguugucucugguuggaucuuguuccuccugugauucuguuagcuucuaucagccgaccugggagucucucucucuccugagucucaguggucagggaacucucugaagguaagcucuccucuugcagggaaggugcacagauaucuggcauucagaccucccuccuggcugaagaaaaaggccugaaacagggccugucccagaagauguguugucucugcagucugcaugcuuacgugcacagacuggucuccgagggacucaggauacaagauggcucucucagcugcucugguggccagagcccuccagggcagacaccucuccucugcugaggaaggugcccggaugucuggagccugaaacggggucuguccuagaagcugugucgcuuuuaccugucccagaagcuguguagcuucuacaguccacuuguucauccuucgcagucugugaccugaccugugcagacuggucucugagggauccgggacccaugauggcucccugaccugcucugaaagaguccuccuggauggacaccucucuucugguggggaaggugcccggaugucuggagcuugaaauggggucucuccuagaagcugugucgcuucuguaguccgcacugucaccucugcagacuaguuucucaacuuauauucuuuuuaaaaugauuacuagugaugagaucuaccuaacauaagauacuuuacuuuaggaagaaagauuucccuauauacaguugaauuguaaagagaaguaugcucaugagauuagggaguauucucccuugauauaugggagaagugccaggaccugcagcccagcaggcaccagggauucugguaaguucucaaugguuuugccugggcaggaggcccauguucugguuauguccaucauguugcucaccuuuguuauuacuuguagaagaccugugacucucagaggugucuguccuacccuuggcuauguuuugaggaugcccuguuuaucagggcugacuacuugaccuaggaaaauauacuuuugguuucucaccaaagggcagggagagguuauaucgguagaacuauagauggcugcccaguagaucacagagagugaauaaaugucauuuuuucuuacacuugucucaucaaguuugcuaguacuaaucucuugauugucuuuugggaaggaaacaaacacacuucuuaccauauaaaaccucuguuuucuaaaaaaaaguuucacuuugcauuuuguuuguuuugcaucaucugcuucauuuaugcaaggaaaguguucauguuaugagaacugccuagugugucucccuccuacucucuugauauuugcucuucccccagugcuuaaauauuuuccugucuuugccacucaagauacuuguauaacccaacccuuacaaaaaacucuuuagaauagauuccagugaagugaauuuuauauagccuuuucauuguaguuaaauucaaaacuuuuuaauuuaaugaaguuguauuguuaaugcuuuuauuagugugauuaugaaaugucugacuaacucaguuguggcacaugccuguaauuccaguucucagaggcaagaagagcaagaguuccaggcuagcauagagugcauaaggugacacuuugaaaaauacaaacuaacuaaacuaacuaaauaaauaacuuaggcccuuuugccuaugagacuucuaguauucuuucagguagaauaguuguuaucaugguuuggauaaagggauggcaaguaucuggccuccauuauggaaaauggcuguauuacuuuguugguauauauuugcuugucuguagcuguagugaaaugacagaaacacaaugacaacaaaauccauaaaaacaaaguauacaguuguuucuugagcaucuucucuagcuucaguuucuaagcacaaucaaauauaaauguucaucuauugucauuauuacuauuuucaguuucuagaacugaguggaauugggggcuuccugaauacuaggcaagcacucuacuccugagccacaucucaggucuucagguuuauaaaaguuaaggauaggggcuggagagauagcucagugguuaagagcacugacugcucuuccagagguccugaguucaauucccugcaaccacaugguggcucacaaccauccguaaugagaucuggcgcccucuucuggagugucugaaggcagcuacaguguacuuacauauaauaauaauaauaauaauaauaauaauaauaauaauaauaauaauaauagcuaaggauagagaggguguuuuuguaguuuggugcuuuuccaaagaaaaggaccauccauccucauugaucugauguauaauaaaacagguggcaauuuccccacagcuacuuagcacuuauggauguagagugaccaaauaugugagauauuauuuaauaguucuccaacuauggaaaacauuggaaagaguguaaaucaacagauuuacuuugaaaaugccaucuaauuaauuuuuuuucauuuuaagacagggucucaggugucccacauuggcuauaaagucaguauguacagccuaaggaugaccuuguacuccuaguccuccugccucuauuuaaguguugcgauugcacauuugugccaccagaacuuguugacaaguguuauuuaaucagaauagcauuugacuauucacauucauccugcagcaguuggcuguuuccuccaccuccagacagagucuuguuuuauuguccaggcugcccguaaccaugcuguccuccugccuuaaccucucaggugcaucaauuauagguguauaccaccauaaacaguaugccuacuauucuuuguagucaacagacuuagugauagauuucaugaaagucauuuauuuuuauuuuauaauagaguucuuaucccaaggccaagguucaauucaacauuuuuuugcuacaugaugaugcuaauaucagucucuuagguugccuuucuauguguuauguaucuuuuguauauaucauaucuauuucuugguccuuuuuuagaaccuucugaauucucaacguuuuaucuguggauacugaacauuaccagaagcucuaaaaaggagauuucuguuuugagacagaauggaugaacgugcucuuauuuuuuauuuuauuuuuauuuuuuggauauuuucuuuauuuacauuuuaaauguuuuccccuuuccaggucucuucuucagaagcccccuauaucauccccccucccgcuuccucuaugaggguacucccccccaccccacugcagucuuccagcccuggcauuacaguacacuggggcaucaaacaaccucaggcccaagggccucuccucccacugauguccaacaaggucauccucugccacauaugcagccagagccaugagucucuccauguguauucuuugguuggugguccaguccccaggagcuccugggggucgcgccuauugacacgguugcuccauccauggggcugcaaacccccucagcuccuucaguaccuucuccaaccccuccauuggggaccccgagcucugguagggaacacccaccacuguauuugucgugcucuggcagagccccucaggagacagccauaucaggcuucugucagcaagcacuuucuggcauccacaguaguauccagguuugguuacuguauaugggauggauccccagguggggcauuaucuggauggccuucccuucagucucugccccacacuuugucucuguauauccucucauggguauuuuguucacccuucuaugaagcacucaaugaagcauucacauuuuggucuuccuucuugggcuucauguggucugugaauugaaucuuggguauuuugaacuuuggggcuaauauccacuuaucagugaguguauaccauguguguucuuuugugacugaguuaccucacucaggaugauauuuucaaguuccauccauuugccuaagaauuucaugaagucauuguuuuuaauagcugaguaguacuccauuguguaaauguaccacauuuucuguauccauuccucuguugaggaacaucuggguucuuuccagcuucuggcuauuauaaauaaggcugcuaugaacauaguggagcauguguccuucuuaccaguuggggcaucuucuggauauaugcccaggagagguauugcuggauccuccgguaguacuauguccaauuuucugaggaaccgccagacugauuuccagagugguuguacaagccugcaaucccaucaacaauggaggaguguuccucuuucuccacauccucgccagcaucugcuguacccugaauuuuugaucuuagccauucugacuggugugagauggaaucucaggguuguuuugauuugcauuucucugaugauuaaggaugcugagcauuucuuuagaugcuucucagucauucaaguuucuucaguugagaauucuguuuugcucuguaccccauuuuuuaaaaggguuauuugguucucuggagucuaaauucuugaguucuauauauauauauauauuggauauuaguccucuuucauaugugagauugguaaagaucuuuucccaaucuguugguugcuguuuugucuuauugacaguguccuuugcuuuauagaagcuuugcgauuuuacgagguuccauuuguugauucuugaucuuacagcacaagccauugguguucuguucaggaacuuuuccccugugcccauguguuugagacauguccccacuuucucuucuauuagauucagugcaucugguuuuauguggagguccuugauccacuuggacuugagcuuuguacaaggagauaagaauggaucaauuuucauucuucuaaauguugaacgccaguugaaucagcaccauuuguugaaaaugcugucuuuuuucuacuggaugguuuuagcuccuuugucaaagaucaagugaccauagguguguggguucauuucugggucuucaauucuauuccauugaucuaccugccugucucuguaccaauaccaugcaguuuuuaucacuauugcucuguaauacggcuugaugucagggauggugauucuuccagaaguucuuuuauuguugagaauaguuuucccuacccuggguuuuuuguuuuucccaaugaauuugagaauuguucuuuccaacucuaugaggaauugaguuggaauuuugauggggauugcauugaaucuguagauugcuuucagcaggauagccauuuucacuauauuaauccugccaauccaugagcaugggagaucuuuccaucuucugagaucuucaauuucuuucuucagaaacuugaaguucuugucauacagauccuugacuuauauuguuugugauuguugugaaggaugucauuucccuaauuuuuuuguuuuuguuuuugguuuuuguuuuuguuuuuggagacaggguuucucuguauagcccuggcuguccuggaacucacucuguagaccaggcuggccuggaacucagaaauccaccugccucugucucccuagugcugggaucgaaggugugcgccaccacugcccagcuuccuaauuucuuucucagccuguuuauccuuuguguagaggaaggcuacugauuuguuugcgcuaaauuuauauucggccacuuugcugaaguuguuuaucagauguaggaguucucuggugaaguauaggaucauaucaucugcaaauagugauauuuugacuucuuccuuuccaauuuguaucccuuugaccuccuuuuguucucuaauuucucuagcuauaacuucaaguacuauguugaauagauauggagagagggugcuuucuauuguuugugaagaauuaggaguaugugcaauugcaaaaggccagcucaauucuacucuucuccuaccuugggcuuuccagaagcauccugcucaguugugcuguaagacuugucccuuugggaucuuuuuacagccacccccagcccuggcccccugaccagaagguuucccacuggcucgucucuagucacugagacuaccacgguauuuucagugcauuuuccuuuugcccuuugcagggauuuuccaaccucuaccuccuuuucucuuugcugacaggaacuagguaagauuccuuuuguaaagguccuggauugggguggggguggggguggggcaccguuucccuaagacuccuucccucuaaccuuggaggacccaucauacauccauccucauggguuucuugggaaaugaucuccauaaucagcuguagcucagacaugcugauucuguggcuacuuuuuuuuuuuuuuugaagaaaggggucuugcucuguagaaaaggcucaccucaaacuugugggaauccuucugccuucacuaccucaggacuaggaucauagaugugaaucacuauaccuuauuuugugucuuuguucuuauauauaagacucauucgcccugcuguuacuccuuagggcuauuuauaguaguuacauuaauggcugcacauuugaaugucuuuuguuucuuagccaacauuaucuguucauugaagugaggccagggaguuguacuggaguccuuuuaaaugcugcuugauguguuaggcagcugaaauaucauguguuauugaucgcaagugguuuggguauggaguggagaggauaaagagcuagccuuucuuuucuuuccaguacuaguaaaagguugugacaaaagauaagaaaaaugauaguuuauuugggucugcuucaaaaguggguauggugugaguuuauucugugacauucuuucagcagugggaagagugacacuagaagcagcuuccuugcucuggccagggcugagauaagagacuguacuggcugggaaaagagcaacugugaagcuuucauccuuugacugcaucuguuauugcugaagauuggccuuugauggcuucuaucauuuucaucugcugaguguaucaagacauuuguaucuuuccugaauucuucuaauguauaaaagcaggggcucucacucuggucccaaaggaccagaucuuaucaggcaccaugcucucauucacagcaugacaucucugcagcacugccuaggaaagaauguacuguucuguuaacuucccacagugccguuaaacagucaacauuucuuucuuuuccuuucuucuauuuauuguuuuguauagcuuguagcugccuuugucucaccuauguucccauaaguagccccaguaaacucacuggugcacuaagcuggacuuggguagaauuauuuuugguuugucaucaguguccuggggugaauagauauuugcucauguauucccagaaaccgucaaucacaaacacgcuuucucuugcuuuuccacugccacucuaggauucacagcuguguuccaucucaggugcacuugguaugacugacuuagguugguauuuucaucuaacagcuggcucagcaauugaaguacagcuccacggcuuugucuucaggacagacagcauuuucccucuugaaguuaccacucacuaauuagagcaucuguggcccauguuuuaugagcccauucaguugagagcaucccggaaagcagaacuuacuggaaugauguuaaccacuuggcugguguguugcuugcaaguuaagugaccauauauuauaaaagauauguuagagcauuuuugaugauaacauuguugaaucuacuaaaaaguaguuaggucugagaguacaggcauguaaccccaccacucaggaaaaucuagaauuuguagccagccugggauacauggcaaguuccaagacccagucugggauacacaguauggcccuuucucaaaaaaauagaaaaauaaaaagauaaggcguugcuccuaagaaccuuucuaaacagauucacuuuccccuuauccuuucuuuucuacuaccucuggaggguggugggcuaaaagggagguuaaaguguuuaagaaccaccauuaacaauagguuuugaaaaaauuaaguuacaagguagaaacugacucagagagagagagagagagagagaguuauuuuagaggcuuaauaagaaaaggaaggaagugcacaggugagagccaguguccacucugcaugaagguacuucuuaacuuguuugaaaaacuggaaguguggguaaauugccaggauccagcuaaauuccaucucccuuacccuggaccuucugaaagcauccugccuucugugagucuugccaggggugggauguguuggcuuuguauaucucuccaaaggcugugggcucucccacugcugcuuuugaagucacugaggcccaaguauuucuagcacauuucuacguugcccauuuaaugaaguaaggccuuuguaaacuuugcgucuuaugucauagaugcucuaaaacaccaagcauccuucuuccuucacucucaauauguggaaacagccuccuaaccuccuuggucacuuucaagguaagggaauguucugagcuauuuccucaggcauccaggaauuugaacagccacuuacuccuuaccacuugcagaacuaauuggggcaggaccaccagacacagcuuguauuuggggaggagguacagccucacuaucuucuaaauaguuacaaaaauaacccaauucacauaugauuguuuauuuuuugaggagagugaaggauucuguauuuccugugaauaaagaaaaauucauuaaaauacucaugcuaauaauuaaaagaauauaacagaagcugggaauucugguguucaaucacaauuuugauuguagguugcacagcaaauuccaguuuaucccaggcuaugagagacuguccuccucccccuccucauuuuuuuuuaucacucuaugccaguuuuuguacugguaagauaaaacccauucuuucaaaagaaauguauccaguauugggcuggggacuugguuuaguguguaauacacuugccauacaagcaugaacaccuguguuugguucuccaggaucuauguaaacccagaugcaauagcacauccuuauaauacaagugcuccuacagcaaaaugguagguugagacuggagaauuccuagaagcucacgggccagcuagcauaucauauggggagacaauuaaaagacccugucucaaacaagaaggcaaguaagcucugauauccaagguugucucugaacuauacacauauauugacugcagcaugugugccugcauguauauacacaaaccuguacucacaugccaacacauaggugcaugcacacacacaaagaccguuuccaaguuggacaugaauuuuuuuuuaaugaaguaaaaucaguuuguuuuguacauuuaaggcaguugauuucaggaaaaguuacuagaguaucaacaguaauaucuuucuuguucuuugcaugaccuagacucugggaacaaacucguuacuauuaggcacuucaggcuguuuguuucuucugcuguggcauacacuggguuauaucuguguccuauacccauauuacuagagacgacugguuuuaaguccaugcaugggggggaaacaggagagccuaauuucuaaguggauuucaaacguucuuaucaccugagaauggguagaacuagugggggccaguagguggcaucagagaacacaccaucucuucagaauugugaaugacaagccaacuagccucuagaugcuaucuguuucuuauuaauacaaccccagcuguuucucagcaucugaaaugcuaacaagccugauguccuugauucuaaaauguggucaugguguacuaguaaauuuagaggauauggaagcaaucacucgcacuuuaggaaauguuacugucccugguaggcauuggaaccuucagugauugcauauaggaguauaacucuuuucucuauaucuucguuuguuuauuuuuuaaaaacagccccaguaaacauaggaaccuuaagucuccuugacacgcccacuauucuaguaaucuucaguuacccuucuuacucuuugucuucauugguuuauuuaagagucccaguaagaucucagcugccgacuauauaucgaaaucgaugcaucuaucugugcauuggcuuuuaaauaucaauaguguauuaucaguguguguguguuugcauguaugauguguaugugaacuguguaguuguggaggccgaaggaaaaccuugagacaucaguguucuuccaucuuaauguggcuucuggggauggaacucagggucucaggcuuguguggcaagugccuuuuuccaguugagccacauugcuagcccuguguauuuucuuuuuaagaaccuucagaggcugacgagauggcucagugguuaagagcacugacuguucuuccaaagguucugaguucaaaucccagcaaccacauggugucucacaaccacccauaaugaaaucugauguccuugucuagugugucugaagacagauacaguguaccuauuuauaauaauaaauaaaucuuuuaaaaaaagaaagaaaaauaauaaccuuugggauuuuucauggccucacagaacauagugcauuauuuguacacacuuuucaaagauauauuucugucuuacuuuucuuagucuaguccaucugccuuggagaacuucuagcuaccuugcacacaaacauccuccuagaugugguggagagcccucuuccauaguaucaggcucugguccuuuuaugcuaacuaauggcucuuacuaggcuuucuucagaggaaacauucuaaaacagccaggaagaaguuacaggcuucccacaaccaugcucaaauucccuagaauguuauuucuucccauucugcuaccuuuauuaaaucaaaaaguggggucuaauacagugaacucaggcuugcugagaacuuacuauguagcccacgcuagguuccuacuuauaccaguccuccugccucagcuuccugagcgcugguuuguaggcaagaguucauacaccugacuccauuuuguugcuugcugguuacccuaaucaggcucacacuaaaggggaaggagcacaacuaaugggaagguagcagagaugguacagccacuuuaaaucuauuacacauuuuguuuaaaaaaagcuacuauuuuagaauuugcuuacuaauaguaguuguccuagacauugcuuucccauggccucagcuaguaucucaaggcauucuaguauggaggugcaaauaguguuaucauaguugaggcauuuucuuuccuuagccauauuuuuccuucccucugcccucauguucugucaaucuaguuccuuuuucuuaccaguuaacugaaaagagagaugaaaaaaagcuacagauacuauaccauaggaaaacccugcagaauaaaguguacgugguuagagccuuacuucugaagguuuugagaaauucuaugagguacauuccugauuuuguaauucuuuacaucugaggugugauaguuauuaucuucuuucucuaguaccuguaaaaugaacaugaagucaacauuuuuuggcgcuuugcauacuuauuaagacuauuggucuugcaaacucuauaugccucaguacaggggaaugccagggccaagaagugggguuugggggacuuuugggguagcaucggaaauguaaaugaagaaaauaccuaauuuuaaaaaauaauaaaauuaaaaaaaaagacuauacaagucauuagaagguuuguguuauagugauuuuugguuuuaucuuagaaaguauucuuuauuauauaacacucuucaauauuuuugccugugggaaaaaaugucuagucuguuauuuaccuaaagcuguucugugugaucuuuugacacccuugacuggcucaaaaacugucuuuaauuggagcuuugagagguaaggguagcuucaugcagugacuuuggaguugaagggacuuggguuggaucuccauguuugugauauucugcugcagguauuuuuguuguucuuuuggggguacuggggaucagucccaaggccucauacauaaucugucuuuaaaaaacacagagaacaguaacaacaaaacaaaauaagagcuggagaugcagcucaguugguagaauguuugccuaguauauagaaaagucuugaguucuaucaccaacacugcauaaaacugggcguagaggugcuccugagaauucaggggggagaggcaggaggaucagaaguucaaggcuagcccuggguauauuagacauuguuucaaaaaugcuuauaacauuucuaacugacaacaaccuuauccauuuauggaggaauaaauuaaaaagacuaagggugguuuuagagccuaugauucccacucuguaucauggcaguuuggucauuagcagccaucugaaguaaugugcaugcccauauauaguagaaagcagcuguaagccauguguuuuggguggcagcagauaccauuaguucccuuuguuggguccugcuguuguccuggacaggaagaagugugugaagucccuuucuuuguauucuuuuccaggaaaagugauccaaguuggaggccccacuccuggcacgcuaccaaguacuuugauguccacccugagccagcagccucacuguuucugaacaccagcgguuccccuuccuggaagagccagcaccaggcuagguagguacucuuucccggagaccaaacaccauguaaguaugacauucugugaguacucagaaauucccuuaaguuuugggauuugacuucagaacagucaaggcuacugauccucaauuaggguuugaacugaauauuucacugagcacagaaacaucugauaauagaaaacaaacaaacaaauaaauaaauaaauaaauaaauaaagugguaagacaaagaacgaacaagcuuuucucucucucuuguguuucuugaggaagcuucaguuuuuauucuuguggaauccuuugagacugucaagugugauaucacggaguuggauucugaaucuagcaggugggguucccguuauaacucugucuucucagccaucaucuucuuucaaagauauuuugauggauuggcaagcaggugauguuuauggggaggguuuacuaugucuacaucuagucuucaguacucuacaaauguuauugauuagaugucucacguauucugauggaaggaugacaguaaugauggcugguaugguuuuggcauguguuuauugugcaugaguauaucaucauggcuguaugaauuguuuuuccccuguaugcauuugugccuguguauggcuguguguguguggcuaaauguauuugugcacguaugcaucuguguuauguauguauguauauauguauauaugcacaugcaguccaguaugcauauauaauauacaaguaugaguguacaaguauaauuuauauauauguuuauauacacauguggauaucuauguguguuuggaaauaauauuaguuucuuauacauuucuauuacauuuuguuauauauuaguuuuacuuuuuuaaaaaaaacuuuaguuuuaaucuuuuuuuuuaaagauuuauuuuauuuauaugagcacaccguagcuguuuccaggcacaccagaagagggcaucagaucagaugguugugagccaccaugugguuggugggauuugaacucaggaccuuuggaagaacagucagugcucuuaaccacugaaccaucucuccagcccugcacccccccuuuaaagauuuauuuauuuauuuauuuauuuauuuauuuauuuauuauaucugagaacacuguagcugucuucagacaccccagaagagggcaucagauuucauuauggaugauuguaagccaccaugugguugcugggauuugaaugcaggaccuucagaagagcagucagugcucuuaacugcugagccaucuuuccaguccuaguuuuacuuuuugaggcagggucucauacggaucagacuggacacaaacuaugcaguuuagacuagccuuggacuugaucuuccugucucuuuaacucccaaguacuaggauuauaggcaugagcuaucacauuguuuccaaauuuucucuuaauuuuuaaaaauuauuuauuuacuuuuagaaaacauuuuauuuuuaucacuuucuaacaaugugucucugugugugagagugugauuuugguauauaagugugguaccugcagaagcuugaagguuuuagaaccuuggagguaaagauacagacauuuguaaaaguuccucuguaagaguaguaagugucuuaagugccaacccacuucucuagccagcccucugauuauauuuucuagcauacaaaauaauaguaugcuuuauggcauuuuaguacacauauaguuuuguacuuugcucauauugaguuuuaguuacuacccauuuuuuccaucccaguagcccuuucuccgccccaccccuacacuuucauucugcauaggagaaaacauguaccucccacuccuccucaucuuucuaacuugcucauccuccuuauuucugagaugaggucucacuauauauguucugguuagucuuguaauugcuaaauagacuugacugucgaacuacaggccaucuuccugccuaagccuuucagguacuaggaucacagguguccaccaccacaucuaguucccuucucuccauccccaaauagggauggaacccagagcuguuugcauacuaggcacauguucuaccaauguuauauccucagcucagcaacucuucuucuucuaaccaucucagauuucauugaggcuguuaguuaacgccucucugauaacagauugcagaguaagcacuuaugugacgugaaggaaguacuucucaaaugcauaauauuuacagcaacaagacuggauaguauuuauuuugaaaaaccacagauucuaaacugagcaaaaaaagggugaaaauguguuucauauuuccucauuggagugccuugaacguaauagaaucuuccacuuaccagcuuaaccagucaccccauuagagaagcaucuaugcuagccacaucuauguauaaacugggcuuugugcuauuuguaucuggaugaauuuaugguaaugaauaaucuggaacauauucuauucauuaaggauucagucuguccuuaaagaaaaugcuaucaaagccaagugguuaucugucacccucaggcgacuuagccaggucugucuccuaucuuuacccugcuugccauuuucucucuuauccuuacucuccccuaacauaauauagccacacuuuucuuucuugaagcauggaaagucaagcuuuaaggaaaacauuuagcauccuguaaguaguuuugccaguaagagacuuacagucauauaugcacagugacuguucuguggaauaauuacuuacucagccaauuacuuacucuguuuuagacacaguacugacuaagaaugugugguuugagugugcaugugcagccaaaaugagacugaaaaguuuaaauccuucaucuggacagagaagcacaugauucugcugcuaaagccuauugcuucuugucucagucagaauuuacgaaugaacuguugauaauuaaauauuugagaauggaaauuuccugaaauuucucuuguaauucuaaagcaucucauuugaugcuuccuuaagaugaacugugugcacuacagccuguguuauaaggagcuauuuucccuggcucuguuaguguucaacuuggcuauuguaacacaagauguagaaagaagagcauggcuguguugcuauaaaacuuuauacauugaaauuugaacuuuauauaauuaucuuauguaagucaagagaaauauuccuguuuucuuuuccuucagcuauucaaaaauauauaaauggguucaugcauagucccuacuuucuccucuagcagauuuaggguauuagggcuuauuguugagguucuugguccauuuagaauugaguuuuauguaggguaagaaauaagacucuaguuucauucuucuagcuauccagcaguacucuuuggugaagauacaaucuuuucuccauuagauuuguuggccuuuuuucucacuaauuagguggcuguuguaguaugaguagauauguggguccuugguccuauuccauugauaaaugugucugcuuuuauaucaguauugugguguguuuugguuacuauaucucuguuccacaaguugaaagcugggauagugaugaccucaacauuuuuguuguucaagauuauuuuaacuauccuggguguuuguauuuuccugugaaacuuaagauuguuuuuucaauuucugugaagaauuguguuggaauuuguguggggguuuguaaauugcuguuggcagacugaccauuuucaguauucauccuaccaauccgugagcauaggcagccaucgcaucuucugaugcccuuuucaauuucauucugcauugucuuaaaguucuuaugguacaagucuuccaguucuuagauuuauuuuaaggguuuuuauuuuuuuuaauuagauacuuucuuuauuuacauuucaaauguuacccccuuuccugguuuccccucagaaaacccacuauucccuccaaccucccccuacucacgaacccacccacucucuuuuccugguccuggcauucaacuacacugggucauugagccuucacaggaccaagggucucuccucccauugaugaccuacaaggccauccucugcuacauaugaggcuggagccaugggucccuccauguguacucuuugguugguggcuuagucccuggaagcucuggggauauugguugguucauauuguuguuccuccuaugggacugcaaacuccuucagcuccuuggguccuuucucuagcuccuccauuggggucccagugcucaguccaauggcgggcugagagcacccaccccuguauuugucagguacuggcagagcuucucaggagauagcuauaucaggcuccugucagcaagcacuuguugacauccacaauagugucuggguuuggggacaguauaugggauggaucuccaggaggugcagucucuggauguccuuuccuucagucucugcgccacacuuugacuccaugcuuccuccugaggguauuuuguucuccauucuaagaagcacugaagcauccucauuuuggucuuccuucuucuugagcuuuguguggucugugaauuguaucuuggguacuccaagcuucuaggcuaauaucuacuuaucagugagugcauaccauguguguuauuuugugauuggguuaccacacucaggaugauauuuucuaguuccaucuauuugccuaagaauuucauaaauucauuauuuuuaacaguacuccauuguguaaaugugccacauuuucuguauccauuccucuguugagggacaucuggguucuuuccagcuucuggcuauuauaaauaaggcugcuaugaacauaguggagcauguguccuuauuacaugauggagcaucuucuguguauaugcccaggagugguauugcgggauccucagguaguacuaugcccaauuuuuugaggaaccaccaagcugguuuccagagugguuguaccagcuugcaauccuaccagcaauggaggaguguuccucuuuuucagacauccuuggcagcaucagccauucugacuggugugaggucacggcaguuuugauuugcauuucacugcugacuaaggauguugaacauuucuuuaggugcuucucagccauuugauauuccucaguugagaauucuuuguuuagcucuguacucuauuuuuaaaagaguuauuugguucucuuuucuauuuuuaaaagaguuauuugguucucugaagucuaaauucuugcauuuuuuuuuauauuggauauuagccgccuaucagauuuaggauugguaaagaucuuuucccaaucuguugguugcuguuuuguccuauugacaauguccuuugccuuauagaagcuuagcaauuuuaugagguccuauuggucaauucuugaucuuacaguacaagccauugguguucuguucaggaacuuuuccccugugcccauguguuugagacauuuucccacuuucucuucuauuagguucagugcaucugguuuuauguggagguccuugauccaauuggacuugaacuuuguacaaggagauaagaauggaucaauuugcauucuucuacagguugaccaccaguugugccagcaccauuuguugaaaaugcugucuuuuuucuacuggauuguuuuagcucccuugucaaagaucaagugaccauagguguguggauucauuucugggucuucaauucuauuccauugaucuaccugccugucacuguaccaguaccaugcaguuuuuaucacuauugcucuguaauacggcuugaugucagggauggugauucuuccagaaguucuuuuauuguugugaauaguuuuuccuauccuggguuuuucguuauuccaaaugaaucugagaauugcucuuucuaacucuaugaggaauugaguuggaauuuugacggggauugcauugaaucuguagauugcuuuuggcaggauagccauuuuuacuauauuaauccugccaauccaugagcaugggagaucuuuccaucuccugagaucuucucuuucuuucuucagagacuugaaguucuugucauacagaucuguuacuugcuuagagucacaccaaggaauuuuauauuauuugugacuauugugaagggugguguuucccuaauuuuuuuucagccuguuuauccuuuguguagaggaagaccacugauuuguuugauuuaauuuuauauccagccacuuugcugaaguuguuuaucaccuguagaguugucuggugauuuuggggucacuuaaguaacuaucuuaucaucugcaaauacuuauauuuugacuucuuccuuuccaacuuguaucccuuuggccuccucuuguugucuaaaugcuuuggcuaggauuucgaguacuacauugaauaguuagggagacagugugcagccuugucuagucccugauuuuagugggauugcuucaaguuucacuccauuuaguuugauguuaacuccggguuugcuguagauugcuuuuacuauguuuagguauuggccuugaauuccugaucuuucuaagacuuuuaucaugaagggguguuggauuuugucaaaugcuuucucagcaucuaacaagaugaucaugugauuuuuuucccuuugaguuuguuuauauaauguauuacauugauggauuuccguauauugaaucaaaccugcgucccugggaugcagccuacuugaucaugauggaugcucauuuugauguguucuugugaggauuuuauugaguauuuuugcauugguauucaaagggaaauuggucugaaguucucuuucuuuguugguucuuuugugguuuagguaucagagaaauuguggcuucauagaaugaauuggcuaguguuccuucugccucuauuuucuggaauaguuugaagaguauuuguauuaggucuucuuugaaggucugauagaacucugcacgaaacccaucagauccugugcuuuuauuguuugggagacuauuaaugaguguuucuauuucuuuaggguaaugagacuguuuagaucauuaaucugauccugauuuaacuuugguaccugguauuugucuagaaaauuguccauuucauccagguuuuccaguuuuguugaguauaaacuuuuuguaguacgaucugaugauuuuuuuuuuauuuccucaguuucuuuuguuaugucuccauuuucauuucugcuuuugugaauuagaauacugucucugugccuucugguuagucuggcuaaagguuuaucuaucguguugguuuucucaaagaaccagcuccugguuugguugauucuuuguauaguucuuuuuguuuccacuugauugauuucagcccugaguuuaauuauuuccugcugucuacuccucuuggguguauuugcuucuuuuuguucuagagcuuucagaugugcugucaagcugcuaguauaagcucucuccauuuucuuuugggggcacucagagcuauaaguuuuccucuuagcacugcuuucauugugucccguaaguuugggcauguuguaucuucauuuucauuaaacucuaaaaagucuuuauuucuuccuugaccagguuaucauuagguugagcauuguucagcuuccaaguguauguauguauuccauuguuuuuauugguauugaagaccagccuuaguccauggugaucugauaggaugcauaggauuauuucacucgucuuguaucuguugaagccuguucgaugacugacuauauggccaguuuuggaaaagguaccgugagguguugugaagaagguacauucuuuuguuuuaggauaaaauguucuguagauauuuguuaaaucauuugguuuauaacuucucuuaccuucacugugucccuguuuaguuucuguuuccaugauuuguccaaugaugagagugggguguugaagucucccacuauuauugugugaggugcaaugugugcuuugagcuuuacuaaaguuucuuuaaugaauguggcugcccuugcauuuggagcauguucagaauugagaguugaucuugguagguuugaccuuugauguguauaaaaggaggauuccuugucauugagguccaauguguaguuugagcuuugguaaaauuucuuuuaugaaugugggugcccuugcauuaggagcauagauguuugaaauugagaguucaucuugguagauuuuuccuuuuacaguaugaagugccccaccuugucuuuuuugauaacuuugcguuggaaguugauuuuguucgauauuagaauggcuacuccagcuuguuuauuggaccauuugcuuggagaauuguuuuccagcauuuuacaccaagguagugucucuuugucacugaggugcauuuccuguaugcaacaaaaugcuggguccaguuuauguauucaguguguuagucuaugucuuuuuauuggggaguugaguccauugauauuaagagauauuaagggaaagugauuguugcuuccugauauuuuugcuguuagaaguaggauuauguuuaugugacuaucuucuuuuugguuuguuaaaagaagauuauuuuauucuuuuucuaggguauaguuuccguccuuguguuggaguuuucuauuuauuauccuuuguagggcuggauuuguggaaagauauuguguaaauuugguuuugucauggaauauuuugguuuuuccauguaugguaauugagaguuuuguuggguagaguagccuuggcggacauuuguguucucuuagagucuguaugacaucugcccaggaucuucuggcuuucauagucucuagcgagaagucuguuauaauucugauaauucuaccuucauauguuacuugaccuuuuucccugacugcuuuuaauauucuuucuuuguuuuguguauucgguguuuugauuauuauguuacaggagaaauuucuuuacugguccauuuuauuugguguucuaucggcuucuuguauguucaugggcaucucuuucuuuagguuagcgaaguuuucauguauaguuuuguugacgagaguuaugggccuuuugaguuaggaaucuucacucucuucuauaccuauuauccuuagguuuggucuucuccuuguguccuggauuuccuggaugguuugccuuaggaucuuuuugcauuuuuuuuuacuguugugucaauguuuucuaugguaucuucugcaccugagauucucucuucuaucucuuguauucuguuggugaugcuugcaucuaugacuccugauuucuuuccuagguuuucuaucuccagaguuaucucccuuugugauuucuuuauuguuucuacuucuauuuuuagauuaugaaugguuuuguucaauuccuucaccuguuugguuguauuuuccuguaauucuuuaagggauuuuuguguuuccacuuuaaggguuccuaccuguuuaccuguguucuucuguauuucuuuaagggaguuauucauguccuucuuaaaguccucuaucaucaucaugauagaguaugauuuuaagucagaaucuuguuuuuuccgguguauugguguauccaggauuugcuuuugugggagaccuguuuuuugaugaugccaaguauccaugguuucugucgguaugguucuugcgcuugccuuucgccaucuguuuaucucugauguuagguguucuugcuuucucuggcuggaguuugucccuccugugggccuuuaugccuguaucagcauuccuaggagaccagcucucucccggcugaacuuguguauggagggcuguggaacagcccuagcucugagugcagauggugaccugaaggauccugucccagucgcuccacuguuccugugcaaugugugcuccuugcugguccugccuuggacaguuauuggagagaaaguggcuaucuaaccucugagcccuggagugaaaguacuccugggagauaagcucucuccuugcuguggaacagcccaagcucagggugcagauggugacuugaaggauguuacccagcccagcugcuccacaguucccgggcccugugagcuccuggcgggccccugcuccagacaguuauuggagagaaagucgagaucucaccucuugguccaggaguaagagcacuccugggagaacagcucucuucuggcaagaccuguacacagcgggcuguggaacagcuucagcuccccauuuaagguuuuuuuguuuguuuguuuguuuuguuuuguuuugcuuuguuuugaauacuguuauaaauggaauuauuucuccaauuucuuaguacauguuagcuguuuguauaugggaaggcuauugauuuuuauauguuaauuuuauauuuugauacuuaguaaagcacauaucaacuauaggaguuuuuguggagucuuuagggucuuuauguauaaagucaucugcacauaagguuacuuugacuucuuccuuucuuauuuguaucccuuauaucuccuucuagcuaaggcuuuaagugcuagacuggacagaguagggcaaaguagaugcccugucuuauuccugaguuuuucucuguuugggaagauguuggcuaugggcuugccuuuauuauauauccccuguguucccagacucuccaagacuuuugucaagaaugaauguugaauuuugucaaagaucucugcaucuaaugagagagagagaugucauguggucucuauuuuugagucggucuauguaguggauuauguuuaauaaauuaugcauguugaaccaucccugcaucuuugggaugaaggugacauggucaugguagauaaucuuuuuauuguuagguuuuuuuuuuaauuugguuuguaaguauuuuuauugaacuuuuccaucauguuccugcagaaauaauuuucuucuuuuguugagucuuuguccaguuuuaguaucaggguaauacuggcuucauaaaaauaauuugagaauaucuuugcuauggaacaauuugaggaauauugauguuucuucuuugaaguuuugauagaauucuguacugaauccuucuagcccuggauuuuuaaguuagauuuugugguuguuuuuguuuuucaagauagggucucacuacacagucccggcuguccugaaacuugcucaugagacuaggcuggccucaaccucacauccuccuaccucugccacauguugagauuaaagguaugugcuaucaugcccagcuaaguuggaagaguuuuaauugugucaacauuaucagguguuauuucuguuuaaauuauuucaugagauggcucaguggguaaaagugccugcagugcaaggugacuugagcucaauuccuagaauccagagaaaggcagaaggaaagaaacaaguccauaaacauuguucucugacauucuacacaugugccaugacacaugcuugcaugcacacacaucauguauauaugcacacauaauaaaaaauaacuguaagaaccauucuuaguuuaugagcugucauuuuccagucucugcucuuaaccaaugaaggaccguggaaauguuauuucaggcacugccugcaucacugugggcauuaguuuaagaaaaugugguagcauugaaaaggauuuuuaaaagucacucaguaguuugacagccuuuuuagugugcccucagaaaugcccucuucucccaguucccagucaguuacuguuaaguguccuccuccucagaagaggaccagcuguacucacaaugcuauuaucuucagaccuugcucuuugcaaaccuuucuuugugcuuuuucuccuuguaguucuuccucucaugauuuaucuggcucaugggagcauacaagccuacagcgcacuucugaccacuucagcuccaugggcagcauagacagccucgaccacagcucccaacucuacccaucuggacaccucucaucugccaaguccaauagcagcauugaccaccugggaggccacagcaagcgagacucagcuuacggcuccuuuuccacaugcuccagcaccccugaccacaccuugcccaaggcugaugccucuuccacugagaacauucucuauaaaguuggccuuugggaggccuccagaccaggcagcagccgacaaagccagucuacaggugauccucagggacugcaggacaggccaucauguuucauaccuaggguuccugguaacaguaguaaaaguccaaggccggaggauaauguugaacccaaaauagccacucaugggagauccaauuuugggccugugugguauguuccugacaagaaaaaagccccuucucccccaccucuuggacuuccuuugcgcagugauagcuuuucuguggcagccaggggccaugaaaaagcccggggcccuccauucucagacuuggccaguaugcagcacuuuaucacccugccccaugugcaaccccggggggaccauagaauggaaacuacagaucgucaguggaagcucacacaccuaagcaguggaaaagaaauaggaaauguggguuaccagucagaaggccaccuggauugccguuggcuaugcucugaugauagagcagguaggcccucagggccuccgggcaggcuccaguucuccgaugugcacuuucugaagucuuaccacgggagccagcaccaacagcagugcagugacgagagcccaagggcccccucaucaccaagggaacugcuucauauaacuccugguggcggucugcaagagccuccugaaccaucucaggaugacaacccuacucaggugagguggccugguucugcucaccagaagcuagaugacagagggcggagccacuauuuuccugggucccucaggcagccuguacaggggagugcccagguugugauaccccgaggugacuauuggcauucagauacaacuccuguggaccuugaauauccucucuuacgcccaguaggacagaggaccuaccuacagcagcaugaggagacuccggccucucaugaaaaagagggguaucaccagcuaaaugcagggauugaaggcugcugcucuggaauccaagagccuccuagagccagccgcacugugagaacuggucugcaguguccuagcaaugacuucaaauuaguggauggagagagugggagaauuucucgucagaggacacccaugcugcauucucugacccaagaugguacauggagacccgggaacagcaaggauuguggaaaugauaagccaccacuguuugaugcccagguggguaaacccacacggaggagugaccguuuugccacaacacugaggaaugagauccaaaugcguagagcaaagcugcagaagagcaaaaguacagugacacuagcuggagacagugaagcugaagauugugcuggagacuggagagcugaugugggggcugucccagaagguuccuuccccagcaccuauaaagagcaccugaaggaggcccagacacguguucugaaggccaccucuuuccaacgccgagauuuagaucccaccccagcagaucaguauucaggaccaucagaacacaggacuuuugaccacagugccucaucuucuuuaucuucuuucccuggggagccagacucugccccacgcuucugugagacaggucuggccaaggcacccucuucuggaguugguguaccccacguucuucgaauuggaggccggaaacgguucacagcagagcagaaacuaaaguccuauucugagccagagaaaauaaaugaaguggggcucucaggggaccaccguccucauccuacugucaggacaccugaggauacaguggguacauuugcugacagguggaaguuuuuugaggaaacaagcaaaucucuucuccagaaggcaggccauaggcaaguucacugugggcucccuagagagaaggcugagaggccacagacagggcaccaugaaugugagaguacagagcccugguuccagaagaggucacuggccaccuccugcggagagauccucagugauagaaaaguagaaaaggccucagagaaauugaacccacccagaaggcuuggaaccuucgcagaauaucaagcaucuuggaaggaacagaagaaaccucuggaagccaggaguucuggacgauaccauucagcagaugauauucuggaugcuggucuagaucagcagcagaggccacaguacauucaugagcggucucguucaucaccguccacagaucacuacucacagguaugcaguguauaauaagccacuacuuagcuugcacugagcaccacuuuaagauucuuagggcauauacaacauauaugauggcucacuaagaugcgagaguaucauuucuaguuugaaagaugaggggaugaaauggcauccagcacuaucauuuuaagugccauauuugugcagaaacaucucuuuauuuccagcucucucuucccuaacuuauacuucaucaucuuuguaccuaauuaguuuguaucuagucucauguucagcaaauaacucuaggugcugggagacuauaggaagcagucacuuuaucuagugacaugaaaaugggugauuuguguaaacauauacuagccauuucuuuaaagauuuuauuuucauguauauguaugcuuguaugccacaugugugcuagugucauggauaucagauggauuccuuagagcuggaguuacaggaaauuuuaagcugccuaaugugggugcuaagaacugaacuccaguccucuccaagagcagcaaggauucugcugaaccauuuuucuagcaaaccccacccaucuacuuuuaaauauugauaugggguggggugggguuaaaaauaauaaaauugaugucauuuacuaucuaguauuuauuguauuuauacccgccacucaguuccuaggguugaaauuuauacuuucuagacaaucagucuacuauggaucuauaaccacaguugucuuuuuccuuuacuuuucuuuuugagacaggaucauuuugcaguucagacaaaucuugaacuugugguccucuuuucucagccuuuugaguacuuaagauuauagaauuuugcucugguaaaaugcauuuagugaugcauuaaucuaauccacuguuucuccccucauaguacugggaguagaaccuagggcuucaugauuauuaggcuauaucaucuuacuugaacuaugcccacauaccaggcccucuugcacuguuuuaaguuugauguuugaguuaacuuugggcuuuuuagaaaacuauauauucuuaucaguauuuuaguguucaaagucagucacuucuccugugcuucucuucuuccucuguuucucucuguguuuuuucuauguaucugaccuguggggagaaauguaacaauauaguauuaacagucucauuuucuuauaaaaggaggaguaguaacuuucuuagaagauacccaucauguuguacaugaaaggauaguugucuguuggcuuuggcauuugguacugaaacuccaugcagagcuagggaaagcuuguuucugcuguuucuagaacucugauuuauccacaguucaguaugaucuccgagaacucugugccuucucaguuaggauuaggagcccagcccccacaaguccuagacugugagguuucacaguaaugacuugugaccagcugucuuuuauuguguuucuuuuagccaauugugucacaugguaacagcucucacauaggaguucuguuuccugcuuagaaccgaaguggaugcagggguccuaggucaguggucucaauaaggugccuugcagaaaugaacagccauguccugugaccaggucucaagucugaaacaacgggucuaaccacaggcauugugagacaggcacacaaagugaacccacaaaugaaggguuucauaauaacagcugucuuaggcaugcaggcaguuugaugacuccgugucuuacaguguuguucuucacaggaagugccuguugaaccaaacaggcaggcagaggacucuggugaccacaaagaagcaauucucuguacacuacaagcugaggagggaugcucugcuccaagguagguaaaugguggauuugggauugcugaaaguuguuuuaagggugaacaacuuuauggaaggugaaugcuagguuaacagaauaagucuggguuuugcuaauugaguaugauuuccaucacugagaucuuaaaguuuggaggagagaaaaccuguggguucugcagcccugcccagagaagcagggcaguaauagccuuuaguguucuaaaaauggcuguuguaauuuucuuuagugaagugcuuuauggggacaaaauaaauguccaguuuaaaauccuugaacaaaguacuuaacugaagggauacuuuuacugucuggcacacagcuguguuuguaggccauggucucagaauugucacaaaggauuuuggccaaguuuucuaaauugggcuuauuuaaugaguuaaccugagcuuuaaaauagaagucaauugacucuccagagagaggcaagauccauguuguuacaguguggccugaaacaaucaauuccagauuguuggaguggauagcuauugagcucugcguaggauaaauuugauuagauguguacacauugugaucuugcccuuucuguggaaggggcgaaagugaagaguguauauuugcagauguaauauaacccuguguuacaagggcugguggaaggauggaaaucagcaugcaccacaaucuucuugagugauaguuuuucuaaugccuuguacauccuauguggcugaugugauaugcaaaugaaacacugacuucaaagcucaagguuccauugcagaaauaaccaauuuacaugaaugcucucaagagcuuuauguuggggucuuauuucacauguuucccacuaacuguuguuagcccuauucaaaagugucacauguuuaugugacucugaggugaccagauugauacucugugugccucccucagaaaugccugccauuacuuaacagucugcacagcuaaaccgaugcacccauggguaagaaaggcugcugaauaauccgccuacagaauuuagcagugucugaggaggacaauuagagcuuuauuccuggauucugagucagucacgugcugagcaccagcugugcaggguaguggggugcagcacacggcuauguauagagaaugucaccauggacagcuauaaugugcauguggugugugugcacaugugauuauguaugucaguggcacugucagagcuuacagggauacgaggaagggaggaggggcccucugcuuuauuuaucauggcugugccucucagcugacugcuuaacuacucugaagaaauuaguuccaguagcaaucugcuuuugaguuacaaacuuagccguuuucagaauugcgaucucgugaucucuuucucccucucccucucucccucucucucccucucucucucucccucccuccuccccucccuuccucccucccucccucuccuucccuaucucccucuuccaccucuguuuguguguguguguguguguaagaguggcaagccaaugaaauguaauaggaauguuaaaaauucauuuucaguuuuuuccagagauuauuuauacauuucuggagggucagcaagaaauaauaugcuugagacauuaaagaauaauaaaaauaagggucuuacagaggugacucauuggaaccagguucagauccuagcacccauauggcagcucacaacugucuucugaugcccucauauagaaacacacgcaggcaaaauaucaaugaacuuaaaaaaaagaauaauaaaaguaaaaguuuauaaugcagagauguaaagauaccuagugucccugcacagguuuaaauaaacauaaacaugucucuauaagaaauucauuauugaucugcuaguugaugcuuggaaauaagugguuuuguuguguuuuguuuagacaacacaaaaacguugaaauagacauuuucuguuuacugguuauucauccaaaucaaguagaaauaauuuuuuuaauuuaaaauuuucuuaauuuuugagauacaaugucacuucacacccagaaacucccugcauaguguagcacauguugucaucaccaaauucaugcugaucuuccuaucuuagaacuugcugggguuucagggaugagguauuacaugcagcuaguaacaucuuuuuuguacauguguauaagauccuguaggacauuacuguauagcaaggaaaaaaauuacaaguauuuauagcuaaacagaaaguacauaauuguacauguuuuuggugguugggggagcugcccauucagcauaugccuguaaucccagcacucaggcugaggauggagcucauaaguucaagaucaacuauaggcuguagagcaagaccuucucuaguauaaacaaacagacaaacaaaaaguuacaugaaacaucagaaaucaguggagguuaaggggaaaacaaagcacuggguagccgggaaggccgaucacaaaaugguagauccaguggcauuuuucuccccuacaucacacucggucuugagcagcccaccucacuuguucugacugucuucccuguucuggggauauuuuccuagugauuuucacugcucucagggauuucagacugaauauucaagcuuauuacaaccagcagggucuguuucuugcaaaugcauucaaucacugacuugggagucacuuaaauguucaguaugugacuucuaaaggccuaucuaucguuaaaaaaagaaaaauauguucucacaggggcuagugagaugguucaccuaguaaaggacccugccaccaagccuguggacuugaguuccauccuuggaauacauauagugaaaggagcaaccagcuccucuguuguccucugauugucuuucauguagacuccaucuacuugcuauguccucauuuguuuacauugugggucucucuguuccuaaucucuaguucuuacaaggacaccaaacagauuaguuuugagccacccuagcgaccucauuucuccuuaaucaccacuuuaaaugucuuguuugcuuacauaguuauacucugagauacugaagauauaggacuucaacacauuaauuugggagaggucucaauucaguuccuuacaguaggagagaugccccugcuuuuuccauacaccuuuaugcuagugaguucuguucuucugcaagcuuucucacacucacacgugaagggaaagcacuuacaauggagaguaauaaaggagcuucugucuuauauguggcuaauggggcagcaagaugguagucggggccuucggaacccuguauacugcagccuuauuggauagcucccaacucuguucugucauucugcuuucagaguucggcuuuguaagacauuuuucuucuuaacaucagguuaagaacaugauggcuccuuccuuuucuguccuuuccucgaccagaaccccuuuucucaguccuuugguagaaaauuuuguuugaccagguguaauuggcuuucuggaauuccuaaaaugcuuaaauucuacccuuucuauuuuuccauuucaugccacggcuuucuaaauuagccagucauuaguagacacuaagguuaaacccagccaauaaggaacaggcaacccgacucccguaccuuagggagaaaagacugaaaccaucuaggugaugugugcugcugcuauuccacuagcuuuauccuggggcagagcauacccuuuuugcaaaaagcaauugccauacugaguuacuuucauuuuguucauguauuacuuuuuguaacauaaaaauuaguuuuuccuuauacccucaaaguagaugcccauuauauugugaacaaugaugucuucugccgauugggauaguggggagagaaugaugucaugaauauauuuucaccccauuguccuguucucuggacucucccuccucauuucugauaggcaauuuggaagaacaggauuuuaauuuuucacuguuugucagacauaguuucuauauagauuaggugccaaauaaaugguuggugaaugaauacacuggugaauugauagaugggugagggaacagacagauaaaccaguccuuggguagauggauacagagaaggguagguagauggaugaaugguuggacgccugaauagaugaauaggcagauagauaggaugaaugaguugauuauggauggauaugucguuaugaauauagucuagggcucuucaauuagauucauuuucccugccagucaaagacguaaaaugcaagaacaaucgugagcaugacagguagcaacaaacgaacacaaacagaaucagcaguugaaaggcauuuauuuauuggggaugagaaaacauguuuaugcaacagacgcacagagaaaaaugacccuuucuaaagcccgggggaggagaggaaucaggaagcuaaaaauccagucuguucacaaaagagcuggggauuuuuaaagucucugaagaguuuuccugaaugauuuaagguuugaaaacaggauaguuaauuggcccaauuguuauguagaauguccugaugcugcugugaacuuguugaaucaguccaucagcagccacccuacuggaaggaagaaagcccacaaggucuugaaggucaggcuuuugacucagguuuggagggugaggaggaaaccagacaucuuagaagcucaccaguuuuaggaaguagccagggcaucucucugauggccuaccaaagaguuugucuaacucauuaucccucaguuagguaaaugguuguuuggauugauaaaugagggguuguugaaggcauggguaggggauacuaaacagugaaugagcagacagaaggaagaauaggugaguagaugaguagauggcuugcuguucaaucuuccuugaguccuugaucagcauuccaugguaguacaugcucuguauugaaauuuuacuaaauauuacuaacguuuaguuaaauauuaguaagugaaaugggcuuuacuaucugcacuuguuccagaguuaagacauaagcaucucagaagaaaucauuaaacugacuuguuuucuacaaucauauuuuaaccucuauaagaaaauuaacauacuacauuuggguuuugcuccuuacauaugagcuucuccuggaaugugcuacaaaauugggcugagaugagaucugggggugaccaccacagcugauuugucauugacuucaagauuguauuuuauugggaugggggagaaggaaagaacuuacuccuauagaggaacaaaacugaauucaugcgagggaaaauucuuuagagacauuuugcuguaauauaaaaugcauuaaccaacaaagcaaacucacuuuauguuguuugcucuugagagagaacuugguguguagaaauuaugugaagaccaauuuccucuuuagaaaaccagcuucugccaaguggauuuuggaaguaacagagauugauuaugggagagcucuacccuguguucauggcucuagggcagauguuuauugucucuggcccucaauuagcugucuggcaauugcagccugccuuuucuaaaggacugugcuagguaauuaugcauccagugcuggaugggucaggcuaaaaaggugaaacuuaagcuuggauguagagggauaggggaggguggacagggaugaggaagcagagcuuccauuucauaagaccaggcagaauucugaacugaagcacucuuucuguauaugcaaacauaagaccaucaucccaaaaaugaaaaacaguaacugccagaaaaagacagaggcauaagacuaguugguugguugguugguugguugguugguugguugguuuuucggucccuccauguagcccuggcuguccuggagcuuacucuguagaccaggcuggacucaaauucauagagaaccaccugagauuaaagaugugugccaccacacagggacagacuuuguuuucaugucuauuauuaguuucucuuaucauuguugggacaaaauacuugaaaaaguagcuuaagggaggguguauuuugguucauaguuggaggguauuauucucaaugguaggaaacucaugacagcaggagugugaggcagcuucaauuugcauccuuaaucaggaaucaggagaaaugaaugcugcugcuuagcuuacuuucuccuuuuauucugcccaugggaugguauugcccauacauaggguggaucuucucaccucaauuaacccaagcuagaaaugcccuuguagacauuuaguuuucagaguacuaaaaaguagguucuagaagcaggcagccucuuaugaguauaggcaagaaagcuugacugacuuuucccuuugcuacuuucucuguauguuagcucuuguauauuagaacuauggaacuauaacgcuccuuaggaaagcaaaggccuguugagguuaagcuaucuaauaagcagcuacaggaauuggaacucuuuuuuuuuucuuuuuuuuuuuaaacagaguuucuguagaccaggcuggccucaaacugagaaauccaccugccucugccucccaaguucuaggauuaaaggcaugugccaccacugcccagcuauuaguuuucuguugcuguaauacaacaucaugaccaacagaaacuuagaaaagaaagaguuagcuuuggcuuauggucagagagagagaaagagagagagagagagagagagaccgagaccugaaugucuggaaacguaugguuuuauggcagggccauggagcugacugaccacaucuuuaucuaaauaaggacaacagagugaggaggaggagggagaauaggaugugggaguaaaagcugcacauuguacaucaucaaggcccacccuaggugguuucuucuuccagcaagggacuaccuucuaaaguaaccaucacuucucccaaaugccacuaacuagggaucaaguauucaaauauggagggcauuuugcaaggaauuggaacucuugacuuuccuuaacacauguaggcuuggaagguacauacaugggggcggggcauccuggauguuauuauuuguuuguaagcuuaccuuaaaucccaguuucuuaagcugugggucauaaccucagguuguguuaccuaacugaaugugagucacaagacuuugauaagaauaaaagauuucuaaauauauaaggaccaaaaccauauuaaaagucaaauggguaagaaaucugaaauguuuauagcaguguugacccaugguguauguaucucaugacugugcugcagccuugguucugaacacacagcaggguauacuuuucauugcacauucugucacagugugcauugccagcaggcuuugcuugaaauaccuugacuccaauuugaaagugcuacauguuauauauuugggaaggaaaacaaaggacaaagagagaugauauaugaauagggaccacgguagccugagaagugucucugucagcuuuucucaaguacaacccucagugcuuuuguuuuguuuuuguuuugcuacauugagauaaagucuugcuauguaguccaucuggcuuggaauucaccauguaauccuagcuagcuaugagcuuauagucuuccugccucaaccauccaaauaguggaaucccagguacacacaucauucuaucuaguagaaaaugagcccuuuuagccugcugggccuauuacucuccauauuaagcugacauagauuuugcaguuuguuugcauacaaacuugccaaauuguucagugguuauagacuagcauacaaacagaaaauaaaacagguuuuaaauauucuuucagauuauuuaauuacaauuaacacuaaaagguagcuuuacagugaugcuaguuuaagaauauuacuucuguucauuuaucuuauccaucaaaucugucuuccuacauagacacagcuaaugugaauugaugcugugauguuuaucuaauacuaauaauucaaucagcuauaaauggggagaaagaaggagagagagagaaagagaaauagagagagagaaugaaugaauaugaaugaaugaaugaauaaauaaauaaauauuucugaagugcagcccucaccuaagucuuaaucccguaggauggaccagggcuaccuugaagacugguuaggaaguaucaaagguggguaagccuggaagagauuggaaaggaaggauaucagauacacacacacacacacaaugaggacacauuucagagucccugaauccuauaaugaauaaagcuggaacauuugaagcaacaaaauaaaauagugauagauaucagccaacauuuagaauaaauucaugguguuuacaaaacugaaugaguaaauuaauacaugggcaguagacaagucuaucaugcagacaaaaugugaguauacucuacucucaugauuuugaucuaaaguaucucccagaguugcuacacuaaaaggcuugguagcaagcugauggcuuuugagaaguaacuagauauugagagcuuuaagcaagugaguugaguacugggggaugguagaaucuuuuggagcugggugugauugguggaagcgugucaccugagucuauccuuggcuaucuuauccucagucucccuccuccuuucugcuuccugaaugcuauacagugauagcaccauuuuuacuagaggugcugugauauuuugaccuuacuucauguaauuggccacugugauaccuugccucacucaggcucaaagcaaagcaauggaaucaggguaaucuuugauugaaucuuuaaaaccuugaaccaaaauaaagccuuuauccuuuaaguuaauuuugucagauauuuuguuacagaggggaaaguuuaguaugucuauccucaaggagguggagcauaacucugggccuucaguaaucuaauaacauucuacagaaguaugcagacugaagaguauggagaaagcuuacaaauuaaccacauguuuggauugauaccauagaaauaagacauguuagcaguauguacccuuuguauggugauaacaaaugauaauucaccucuguagucuuuacccagaaacucauagacauaaucuaauuauaaaaggagggaaaaucaaaugaauaacauguuacaggugccugaaaaauccuuagaaguauaacaaauaccaaaacaaagggaagucuaauuauuuaucuccuacuccauucaggacgauggagcaaaauaucuuagacuagaagaucaaagcuucucaccuuauaccaucaagaagcagaaagggaaaggguggacuuaggauaagauagugucuucaagggcacacaccccagugugucuagucacagccaaaagguucuacuaccgaguauuucuauuguuguuugagguguggucucacuauguaguccuggauggcuuggaucucauucuguagaccgggcuggccucacucagaaagauccuccugccucugccuccuggcugucaggauuaaaaccauguaguaccaugcagacaccacuagguauuucaaaccauucuggaggcugaagcccaagguuaaggcauaagcagauuuggugccuugugagaucucauuuucuggccuaaagauaaacauuuuuucucuguguucacacauaaagacacuagucugacuauugagauagacacuugcaugaacuuuuauuccccaagugcucuaccucauaguucuuaagagguuaaagucacuugguugguugguugguuuuuaagaaaggauuugacuauagcuuagauuaucuaugaauuuacaaucuuccugccucaaccuccucugugugacauuguuccuugagagaugugaacaaaugucacucaucccagauagggaucugaugacaaaccaaaguacagauagugccaaaguccagcuuggugaacaagugaguuuuaaugggguuauuuacaggaacaggaaggucucaaagacagcugcaucaccaaagcccaucgcaacaugggaugucaacuuauaacaacuuauaaaagcuggagaucuggagcacacuauacaguuuacagacagcaaguuggaaagugucauuuucagguagcuuaguuuuuaagucuuuuccaggcagcucaguaugucugagagucuucuaggcagcucaacuacucucugcuucuuccagucuugucugagucuucucagcagccuuuaauguuuuuauacucuugagaagaaaagagcccagugaauguagucaguuccagggacuucuugaagcuauugaguuugguuuuucacauccuguuuuaacaagcuucccuauaggauagagucacuuccucuuagaacaugcuauuguuucaccccccuuuuuguauucugcaucuuaaagaguuucccucuaguggaauguccuuaccuaguaaauugcuacacaacaccuucaucccgaauucugggauuauaagaacauaucuccaugucugcauaguuauguuuuuaacauacacauuugaggggagggagaaacuuucaggguuauaguaucaucacaaaguuacuauauacaauguggugccugccugggauccugguccaggaaaggaacaauaaauaauacauaauaauuaguaaaauauaaaauaaucuauaaaauauaauaauaugauuauuaauacauuaauguugaggugcuucauuaguaaguguaucagucucaauguaccaauauugguugauuaacuaggguaaauauauaucagacuguuuuccaucaguacaacaaaaugacugacguggucaacuuauaaagaaaaaagguuguuuuagcuuaugguuucagagguuuccaccuaaggcugguuacauugcuuuuaggccuaugaugaagcagcacaucauggaagaaagacgugaugggggaaaauccauuuaauucaugguagcagagaagcagagugggaggaagagggaacugauguacuacagucuccuuuaaguauauaauccuagugaccuaauuuccuuucucuugucccuauuaccuaaagauucuuccauuucauaguaguggcccucacgggaccaagccuuuaaaacacuaucucuaugagagauacuuaaauacuuuaaaacauuaucucuaugagagauacuuaagauucgaaugauaguauacuauaucauacaaaucugaagcuuaauaauagagaacacuuggucuauuauauggaaacuuguuucuuuuaaguuuucuguaauuuuuuuuuuucauuugaaaaugaaauguuuuuguuagggauauacccaguugauagaauacuugaucaacacuuuaacauguacaacaagccucuugggagaggaaggcaaggauggggaugucagggaggugacaucacuguauaugaggacauauaaaaaauacuauguggacaugaaaaacacuggaaagagugugagcuuugcaaucaaaaauacaggagcaaaucuucacuauguuuguaucaggucauccagauuuaguaaccucuuguaacccuuucucuuaaauuuaagcauuuagugggauccaaguuaguauaccacagagacacccacacaucauuguccacugaagcacuguucacaauagccaaguuauuaaguuggccugaguaucccauaaacacaauaguaaagaaaaauguaggcuggagaguauauguauuuuauuuggucacaaacuaaaaaaugaaaugucauuugcagggaauuagaugaaacuggagaucauuguguuuaguacaauaagcuagaucaggaaaaacguuuuuuuuuuccucauguggaagcuagauuaaauacauauacacguauauguauaugacaugaaaguaguagaaagguuaguauuugugaagauuaaggauaagaagggggcuaaggaagauaauauaagauaauaauuauauauaauauaugugugauauauuauauauaauuaauauaauauauaagauaauaaugagcaaacugugauuuaaauguaugaaaauguaaaagugaaacccauaaugcuguaaaagugaauauauacuaauaaaaacguaaaugcuuaauggauauaaugauaauagauuagcagugugcuauauuggaggcugcauaauaacauguuacuugguaaaaugcgcaggagacugaaauaauuacuguguauugagaagagcuuuauggaaacaagcuggaaagcaaaagcccuguuggcuaagcccaggacucagauguugagggcugucuaggugggaaggagcuaugaagaaaauuugugagggggcaauuucuguuuaggaccaugccacugagguuggggguuuguggucagaguggagguggggcccggagccuuuaaaugcaagucauugugaugugaugaauugagugagucgggucagucugguugcuuugucuucuugccccagugcccuugcacacagaaaaaguucuaaaacacuuuguuugucaguugauggauuacauuccuaaugaguguguaaucagcguaagaauauccaucgacauaaaauaggcuauugaguaucuucuuuaacuucauuguaguuguagaguuggacuauguaugccugugauagcauugaucagaguuuuuaaguagaauucaugaaugacauucuugcaguggguucuucuauauuuuccacuuuaagaaaauauaaaaagaaaggacacccauucuccaugccuauuagggguuuuaaaaguagaagccucuuacagcuuagucaugggaagugcugguaauauucccugagaccagauauacuggguuuuggaguugacagaaccuucauaaacuuguacaucauaaggcagcaggcucugauauuccagcuguugccagcaugccuucgugacuccacaaugcuguaggcagcaggauucugcgguggcagaggcgggcuuugggucccugaagcacuuagcugccuuugcaggcugaaugagccacagucuacagcagcaaucagggaugcagguaagagacucuagugcuccuucucagggcaucuuauccccgaggggaacuguuuuaaaaaucacuugugcuauuugugaggaggguguaguucccaaugccucuuuuguucuacagucuuaaagggcagguuguuugucaguucacaauggcgugggucugaucuagcaagaucugcaaacauucucauuguuuauuguucugucuaaagaugaaaaaucaugcaaaucaggguucagauucuagauggagcacucugcaagcgugcacacaugugacagggggcacauuuguccaugcugcaugcauguuuaagggcacaggcaguuuuuucagccuggguuuuuuaaagcuggauaaaaagcacguuggaacugaaagcugucgucccuaacuggugggacugguagcccuugcuguguggaaaaauagcucugugugaguucugcacauggaugacccaagaacgcaggcaggagggaucugugaagacuugucugcguugccguuucuuuuucaguagccauaagaugcaggcauucucacuccugagacacugaguguggacacugaaagaaauggugaguuagccacauccaaacugggggguggugggguuguaaaaccaggugugcaugcuuggucaugcaaaugauccauguguacauucacagagcuugcuaacugcagugaaaaaacucuauaaggagaaaauggaaucucuguggcuuuuaauauuuuaguucuuauaauuuauuguuuugaucaugauaauguucuuucuuuaaauguguuaguguacaugugcuugcauuuuucauucuuccucuuucauugugauuaaaaaugcagguuauuguuuugggccauguugcuaaaugaugaauugccuuugcugcaggcaaggaagcuuuuugcauguguagaaggaaugccauuuucacagggaaacugcugcauagcugucucuguacacacauacauacacuaucugagucuguauucacugacucaugggaguaggugucaucuugaauugcacauuuaggcauugguugugccagugcagaggcaaaaaaaaaaaaaaaaaaaaaaaaggaggaggaggaaaggcaaauuaaggaaagguuuuccagaaucugguagcacuauaacuaaauagcuugcugucuaccagcuacauuuuuuaaaugauuggaaaauaauuuucaagcauaaaauacuggaacaaauuugaaugguuggcauauuuucugguugaaguagauauaaguauuuuugaugauuuuugucauuuugugguagaaaaagggacuagucaauauauuuuauauauaguaggaaaauauuuuauguguaaauauacgugcacaugcucacacauauacacacccacaugugccucugucuuaaggagaaaguuuacaggggcauucuuauucauuaacgcauacacaaaggucuuuuuucuacauuauggaaauaaucacaagugugugucaacuagauggguuacagaaggcuucugcuacccagcugcagugacaaaugacauaguaaaagccuguuaacugcugcaugcuuugcauagacuggccacucccccaaagucugacuuuggaugcuggagguuggggaagguaauaauuuauaugcccuuuuagaauguauuuauaugguucuuacuauuuuagaucucuguuggggggggggagacggagggaaggaaggaaggaagauagauguaucaugguuggggaaccauaggaaaaaaacuggcauuuuaugucuaccuugagcuauccaucuuucccuuucuuggacauuagagguuuuaccuggcuucuuucugcuagagcaaguuaacagucagaucacugauagaauuguagacauuucuggaugucuaaagagauucagaaucuauuuaauuacuuacccuuuuuacccccgccccuuuaaaauaaauguuuagauagggugggaagauaguucaaauuaauauaaaaaauuaaagagagaaaauuaaaaucauccuuaaucuccuuacccagugauuccacuguagaacaugaaagugugugugcuuugaagucuuguuuuagcacgaauauauauuuuauauacccagucauucuccacaugguauaugcagacugccuuuaaaaauacaaaaagauuuuauauguauuaugcaugguauucuaagauaugaaaaaucugucuuacaguauagauauuuaaagcugcuucuggccauucacaauuauaaauaauacuuuaguagacauauuguacugagagagucauacccuuccauguggguugucuuaaggcaugauagauacauauuuaggagauaccaccuuguggaucuaugaaguguauccuugcuauuuaugccucacucaccagccaucuaggaaguucuguuuuucucacaauuuuaccaauauuaagcauuaauuuggaauuguggauuauuuuuuuccaauuuuuuaauuagguauuuuuuccuuuacauuucaaaugauaucccgaaagucccccauacccuccccugaccccacuccccuacccaccuacucccacuucuuggcccugguguuccccuguaccugggcauauaaaguuagcaagaccaagggaccucucuuccuaaugauggccgacuaggccauuuucugcuacauaugcagcuagagacaugagcucuggggguacugguuaguucauauuguuguuccaccuauaagcagaccccuugagcuccuuggguacuuucucuagcuccuccauugggggcccuguguuccauccaauagcugacugugaguauccacuucuguguuugccaggcaccagcauagccucacaagagacagcuauaucagaguccuuuaagcaaaaucuugcuggcauaugcaauggugucugcguuuggagucugauuaugggauggauccccaagugcagcagucuuuagaugguccauccuuuaaucugucucugcaacuccuuucauggguguuuuguucccaauucuaagaaggggcgaaguguccacacuuuggucuucauucuucuugaguuucaugugcuuuccaaauuguaucuuauguauucuaaguuucugggcuaauauccacuuaucagugaguacauaucaugugaguucuuuugugauuggguuaccucacucaggaugauacccuccagauccauccauuugccuaggaauuucauaauuucauauuuuuaauagcuggguaguacuccauuauguaaauguaccacauuuucuguauccauucuucuuuuuuuuguuuuuuuuuuuguuuuucaauaauuuuauuuuuuucuaauuuuguaauuuuaauuucccauagcaccuuggcaauguugaaaacaauacaaauacaaagaugcucguuuuaacaguuuaugcaugaauaugugucacacaauuuggggggggcaguccauucuucuuuugaggggcaucuggguucuuuccagcuucuggcuauaauaaauaaggccgcuaagaacauuguggagcauguguucuuauuaccaguugggacaucuucuggauauaugcccaggagagguauugugggauccuuggguaguacuauguccaauuuucugaggaaccgccagacugcuuuccagagugguuguacaagcuugcaaucccaccaacaauggaggaguauaucucuuucuucacauccucgccaguaucuucugucaccugaauuuuugaucuuagccauucugacuggugugaggugugaucucaggguuguuuugauuugcauuucccugaugauuaagaauguugaauguuguuucaggugcuucucagccauucgguauuccucaggugagaauucuuuguuuagcucugagccccauuuuuugaugggguuauuugauuuucuguaguccaccuucuugaggucuuuauauauaauauauuagauauuagaccccuaucuaauuuaggauugguaaagauccuuucccaaucuguugguggucuuuuugucuuauugacagugucuuuugccuuacaaaagcuuugcaauuuuauguggucccauuuguggauucucgaucuuacagcacaagccacuuuuguucuauucaggaauuuuuccccugugcccauaucuucaagguuuuucccccacuuucucuucuguaaguuucagugucucugguuuuauguggaguuccuugauccacuuagacuugaccuuaguauaaggaaauaagaauggaucaauucucauucuucuaaaugauacugcaaguugugcuagcaccauugguugaaaaugcugucuuuuuuccacuggaugguuuuagcucccuugucaaagaucaagugaccauagguguguggguucauuucugggucuucaauucuauuccauuggucuaccugucugucgcuauaccaguaccaugcaugcaguuuuuaucacaauugcucuguaguacagcuuaaugucaggcauggugauuccuccgaguuuauuuaucauugagaagaguuuuugcuauccuagguuuuuuguuauuccagaugaauuugcaauuugcccuuucuauuuccuugaagaauugaguugggauuuugauggggguugcauugaauuuguauauugcuuuuggcaagauagcaauuuuuacuauauugauccugccaauccaugagcaugggagaucccaauccaugagcaugggagaucuuuccaucuucugagaucuucuuucauuucuuucuucagagacuugagguucuuaucauauagaucuuuaacuuccuuagagucacaccaagauauuuuauauuauuugugacuauugugaagaguguuguuucccuaauuucuuucucagccuguuuauccuuuguguagagaaaggccauugacuuguuugaguuaauuuuauauccagcuacuucauugaagcuguuuaucaggcuugggaguucucugguggaauuuuuagggucacuuauauauacuaucacaacaucugcaaauagugauauuuuaacuucuuccuuuccaauuuguauccccuugaccuccuuuuguuguugaauugcucuggcuaggacuucaaauacuauguuaaauagguagagagaaaguagggagccuugucuagucccugauuuuagugggauugcuuccagcuucucaccauuuacuuugauguuggcuacugguuugcuguagauuucuuuuauuauguuuagguaugggccuugaauuccugaucuuuccaagacuuuuaucaugaaugguuguuggauuuugucaaaugcuuucucagcauguaacaagaugaucaugugguuuuuuucuuugaguuuguuuauauagugaauuacguugauggauuucuguauauuaaaucaucccugcaucccugggaugaagccuacuuggucaggauggaugauuguuuugauguguucuucgauucgguuagcgagaauuuuauugaguauuuuugcaucaauacucaagggaaauuggucugaaguucucuaucuuuguuggguuuuuaugugguuuagguaucagaguaauuguggcuucauaggaugaauuggguagaguaccuucuguuucuauuuuguggaauaguuugugaagaguuggaauuuggucuucuuugaaggucugauagaacucugcacuaaacccaucugguccugggcuuuuuuugguugggagacuauuaaugacugcuuguauuucuuuaggggauauaggacuguuuagaucauuaaccugauccugauucaacuuugguaccugguaucugucuagaaauuuguccauuucauccugauuuuccauuuuuguugaguauagccuuuuguagaaggaucugaugguguuuuggauuucuuuaggaccuguuguuaugucucccuuuucauuucugauuuuguuaauuaggaugcugucccugugcccucuagugagucuggcuaaagguuuaucuaucuuauugauuuucucaaagaaccaacuccucauuugguugauucuuugaauaguucuuuuuguuuccacuugguugauuucgccccugaguuugauuguucccugcagucuacuccucuugggugaauuugcuuccuuuuuuucuagagcuuuuagguguguugucaagcugcuagugugugcucucucuaguuucuuuuuggaggcacucaaagcuaugaguuuuccucuuagaaaugcuuuuauugugucccauagguuuggguauguuguggcuucauuuucauuaaacucuaaaacgucuuuaauuucuuucuuuauuucuuccuugaccaagguaucauugagaagaguguuguucaguuuccaggugaauguuggcuuucuauuauuuauguuguuauugaagaucagccuuauuucauugugaucugauagguugcaugggauaauuucaauauuuuuguaucuguugaggccuguuuugugaucaauuauauagucaguuuuggcgaagguaccaugaggugcugagaagguauauccuuuuguuuuaggauaaaauguucuguacauaucuguuaaauccauuuguucuaacuucuguuuguuucacugugucccuauucaguuuuuguuugcaggaucuguccauucaugaaagugggguguugaagucucccacuauuauugugugaggugcaaugugugcuuugagcuuacuaaauuuucuuuaaugaauguugcugcccuugcauuuggagcauagauguucagaauugagaguuccucuuggaagguuuuaccuuugaugugcaugaagugucccucgcuguuuuugauaacuuuguguuagaaguugauuuucuucgacauuagaauggcuacuccagcuuguuucuucagaccguuugcuuggaacauuguuuuccagccuuucacucugagguagugucugucuuuuuccaugagauggguuuccuguaagaagcaaaauguugggucuuguuuguguagccagucuguuagucuaugucuuuuuauuggggaauugaguccauugauauuaagagauauuaaggaaaaguaauuguugcuuccuauuauuuuuguuguuagaguuggcauucuguucuugugccugucuucuuuuagguuuguugaaggauuacuuucuuccuuuuucuagggcguaguuuccguccuuguauugguuuuuuucuguuauucuuugaagggcuggauucauggaaagauauugugugaauuugcuuuugucauggaguacuuugguuucuccaucuaugguaauugaaaguuuggcuggguauauuagcuugggcugacauuuguguucucuuagugucuguauaacaucuguccaggaucuucuggcuuucauagucucuggugaaaagucugauguaauucuaauaggcuugccuuuauauguuacuugaccuuuuucccuuacugcuuuuaauauuccaucuguauuuagugcguuuguuguucugauuauaauguguugggaggaauuucuuuucugguccagucuauuuggaguuuuguagguuucuuguauauuuaauggcaucucuuucuuuagguuugggaaauuuuuuucuauaaugcuguugaagauauuugcuagcccuuuaaguuuuaaaucuucauucucaucuacuccuauuauccguagguuuggucuucucauuguguccuggauuuccuggauguuuugacuuagguucuuuuugcauuuuguauuuucuuugauuguuguguguauguucccuauggaaucuucugcaccugagauucucucuucuaucuccuguauucuguugcugauucucguaucuaugguuccugauuucuuuccuaggguuucuaucuccagaguuguaccccuuuggguuuucuuuauuguuucuacuuccauuuuuagauccuggaugguuuuguucaauuccaucaccuguuugguccaucaccuauuugaaaguguuuuccuguaacucucuaaggcauuuuuguguuuccucuuuaaaggcuuuuagcuguuuaccuguguuuuccuguauuuccuucuuaauguccuccaucaucaucaucauaaucaucaucauaagaagugacucuagauccaugucuugcauuucuggugugaugguguauccaggacuugcuaugguuggagaguuugguucugaugaugcccaguaaccuugguuuuuguuguuucuguucuuaugcuugccuccugccaucugauuauuucaaguauuugcuguccucugauuggagccuguccuuccuauaaucccaguugauucaggacuccucagaguccagcuuucucugugauccuuugcuugugggcuccugugaaccugagauuaugggugugccagaguucuuggcagugaaguuccucugagacccuggaauacuggugugaccaagcuccuuuuauccugggauccuguugucaaagguccugggcguuuuacagugccugggguguguugucuucuuugaggaguguggagcugucuggucaguguuccuaagauggcauggagaguccucuagggaccauggggauguccuccaauuccgcgcccaaggugaccaagugaugguguugaccggaagggacuugugccccuggucagaccgguuuucugcuucccuaaugcugucucagguccugccugcgcgauuggauuggaacagaaguugcauuccacacacaagugguccuaagaucucguggagaguccucuagggacuguggggguguccgucgacucccugcccaagguuacccgguacugacgcugaccggaagggcaauucugugguuuauuaaguaacccauuuuuaacauguauuucuuaggggcuugagaaaggcaauguucuuucauauauuuacugauuuuuuuuuauucauuacuguucacauuccuauuaaaagugguccuuccuuaaucaucgucauguagguuacaaugcauuuguguaguauggugcauacuuuucacacauuuacaguugguuuggguuaaauuauuucuaauccuaaccucuuguuauugaauccucuuguuauggcccacauuuggcuacucugaauuaccaguucuguguuuuagcagccaccagcuuuuagcaacuauguguuuuuguugccaggguuuaguuaccaauugcauggcauuacaugcaaccgucuacaguucugucaauucugaaaugguuuucaaugcuuugcaaagaagaaagaguggcuaaggaugauguguuauguuguauuguaagagaaauggagaacucagaagacagauguaaauccuagcuuaaaacaaguuguugcuucugguagggcuugcugacuguuuguaggagauuggagugcucaagaauuagaggacagugccauguccuauguacucagcuauguucuuagucugcaaaguauuuggaaauugaauuggcuauuaugaggacuuuagaaauguuugugauccuaacauuuguaguuguuaagguagaaggacucugaguucaaugccagagugagcuacauauuaagaugcugucucaaacaaagaaaugaaaauuggaagagugauucaagcuugaucugaauauuaugaucuucacucauuaccuccauaguugauucuggucuguuugcgucacauaguuacccaauauaccgcaaauaagcuaacuggauccuugcuccaggcaugcuccugauucuugaauauuaaauuaagauaaacaauauauuacauguaggaugaagucacuagauauauacuccucuuucugacucaaaugguaggucuccaacugauuuugcuauaaccuaugaccauauuucuacuaguaaaucucucaguaaauuguauugugugcagucuuggauuuuuucagccuuuuuuuuucuuuuuccuaaaauauauguaaaugaauguuuugccugacuguaugcaugcaugcaugcuuguauuuuuauauauguauguguuagauucccuagaacucugguuacagauguuugugaaccaccauguagaggcuggaaaucaaaucuagguccugugcaagagcaacaaguacucuucaucacugagccaucuuuccagccccugucuguuuuucucccauaggucucacaguauuuuggggcagguuuucacaggaccaaauucuuucagagcaguauauucugaaaaaacucaguuuauauaccauguaacacaccaguaauuuaauacccauauuuuuucuuaaugaaagugacaugccaagccaaggauuaaaauuuguaguuugcuaaucccuguuauacauaacaaggcauaugcuaaauuuuuaaaaucacaaguggccugaccuagcauugccaagccuuuagucucagcuacuugggaagcucaggcaggaaaaucuaaauccauguccagguugggcaauuuaugugaaaauaaaaaguauaagguuggaaauguagcucagugguagagugguuguuuuauaggcccgaggccucaguuuuugcaguucccaguauugucaaaggugaaauaacaguaacaacagaguguauauaagugcucauuuuaauaaacauugugaaggauauaaggagaauguuaaggcuagugauauaccccaauugguugguaaagccuagcauccaguaagcccuagguucaaucccaguacuacauaaacugggcauuauggugcacaccugaauuccaccauucaggagauagaagcaggagaaucagaaguccagggcugucuuuggcuauauaguuagcucaagaucagcuugagacacaugagauccuaccucaagagaaguagggagggaggggacagguggagagaaggaugaagagagagaaagaauauguauaugagaaugccaggaaaggagacagaagaguuuauguaguggaggguguaaugagguuuuaaaaacaaaguuuccuggccucuuuaaaugugaggcaauguugcuacaccuaaguggagcuccacagauuucauuucaaagagauauccuggcccagggcucagaaaguuguucugacucuuggaauauggguagauucccccuagaccuagugccagggaacuuucagugucaccauuuuuauagauaaugauuauuuuuuuuggaagggacauuccgagccaagaauaaaaaugccuggaauauagcuuuugauacccacauacauguaauagguagaaaagugggagagaaggaauuugggaagggaaguuuugcaaaacagauucuuaauguuuucuucacauccaaauugcuuggaaggcugguuuugaaauagauuuagaggcaugucauccuucacuauucaacccucugccagggccuucugacuaacuuuaagaagagcccaguuucuugcuacaucaaaucuugggaccacguaugaagggauggagccacagaaaugagaaaggccuugccacagauucucagaauaaauguuguaagagcauacauagaucccugggauaguugagcagcaguuagagaguauacucucucaaguucaggccacugugcuuguguacauguauuugugugcuuguagaguccagaagucuguaucaguagcuuucuugaucauucuccaccuuauuuuuugagacagucucuuaacuuaaaacucaucaauauaauucaucuggcaggccaauugagcuucaggacauccucuugucuccaauaccugccccagcauuaggguuacuauacacacauaccacuauacccagcuuuuacauagaugcuggugauccaaacucaaguccucaugcuugcacagcagacauuuccccagcccacucccccauuuaaaaauuacugaauacuauuaaaaagucagugccuguuaauuuggguuugcaucaucuuugagugaaauuucucuuuaaauaugucuucuccccuauccacuuaaccacaaaugauuuauccuuuuuuccaauucaacuucacuauuacuuggcaucugcgucucuguaagcuaaaaugaagucccaaggaaacugcaaaccuuuuuuauccaucugugaagacauugaagaaauaaaacucaucugguuuucuaaauugcuuuucccacauggcaugaaaaacacagggcggcauagagagaaaagcuuuagcuaggaggaauuauaguaaacacaugaccaaugucaggaugcuucugggcuuguguucuccccaaaguacauccagcaacacacaagacuuugacaacuggguaugguaguguauauuugcuaucucaacuacucaaguucaagcaggcuuucaugggccauguggaaaguuugagcucaaucuuggcugcauagugagaccuugucuuaaguacaucuucccuagauccccaaagaaaaacacaggaagcuguucaauaaaaagauccauauguuuuaacaaaacuugcagaaauaguucucuuccuuagcaucauaagcauaauaugucuguuacuuuagcaacuacagguuaaucauucacaaaccuaaaaucugaaauucucuugagucagaaacggugccuacauauugccacaaaaagacaaauuucuacauuugaccucacauuauacucugaugaguugcagccaaaaugcagguacacuaaaaauaauauauuaaaauuaucuuucggggcuggagagauggcucagugguuaagaacacugacugcucuucugaagguccugaguucaaaucccagcaaccacauggugggcucacaaccaucuguaaugagaucugaugcccucuucuggugcaucugaagacagcuacaguguacuuagauauaauaauaaauaaaucuuuaaaaauuaucuuucauauauauauaugcauauauauauaugaaacauguaaaauguaaauguguaucuauaaauauaaguacauggcauaaguuagaauuacugcauucgugcuuauaauuaaguuccauauaauuagguucauucacacacacacacacacacacacauauauauauauguauguauauauauaauauguauauauacaugaaaauaguccaaaaagucuuuuaauuccaaauucaaauacuucuucccccaaacauuugaaauaauagauacucaaccauguuguuuccaucccuggaaauuggacagucagaggauaaucagacagucccucuucuacagcugcuuaugcuuuaggacgucugaugauuaauuggcauuucuaaccaguaucauuauucuuaaauguucaugcucuuuaaauguuucugaugaacucugugccuuuguugauuggucaguugguuaacugauugccucuuuggugcucuagugacauaucucacugucucauuucccacuucauucgacaguuaugagaugcuguguugauggaagagcuuccugcuuguacuuggacaaggaauuuaugugacugcuaagaaguaucaggaaugugggaagggugguuagaaauaccaagagcucaccaugaggucucauguaccagacuuauauauggaaugacuuggguguccuaucucuuagcugucugacuucuauacacagaucuagcugauauaucccucuguagggcagauuaguuaucuaugauugauaaugaauaagucuacucuuucucaaaucacuuuucucuauaccaacaaccagaggagaugccacauucaaacuguaaaugugaaacuaaagagaacaugggacuuaagugauguugacauuuccccuuccuggaaacgcagcuguuuccaaggcagagauucuggguuccagucuaguuguucuaugaguuaauugggcacuucacaaaccaacugggcagcuagcucucaagugugauucucaggccacagugcagaacugcuccuauucauugauugcucucucucucucucccucucccucucccucucucucucucucucucucucucucucucucucucucuguguguguguguguagguagguagaggguguguguuuauaauagaaguauaugccacaucacauaugugaaggucagaagacaaccuuagauaguaguccucaccuccuuguuguaagcaggaacucuuauuguuucacuguugcacauaccagguaacuggcauacaaacuuagaaauucuccuguucucggccucccaccucaacauggaagcaauggaauuauugguucucagcacuuacacugcaauugccuuagucacugagccaccucuucagcguauauugcuauucucgacaauauauaaauaugcguaaggcauguuagcauuuugcaucaugcuuuaaugaaaggaggaaauaucucagugucauaguuauuuuucuauuguuguaccaaaacaccaugaccaaggcaaccuauuaaaggagguauuuaauuaugguuucaggggguuagaguccaugauagugaaacauaagcauggcagcaggaacaucucaaaacucacaucuucaucugcaauuaggaagcagagagagaacacacugggaauggcacuugucuuuugaaaccucaaagcuugcccccagugacacaccuucuucaacaaggucauaucuccuaaggccugggggggcauucuuauucaaacuaccacacucaguguuaucaucuauugaaaguuuguucugucauagcccagaguucuauugguagccuugauguuuauaaaucacugaguggcuggcuuggccucuugggggaaugcccuuccuaauucagaaggcgaggcuguucugccugaguuuuuuauauucugccuagguugugugauuugugucuuagcaguuguauggugauuuugucauggaguacaauggacagaccaucuguuguugaaugugucuuagaugcauggcucagaggaauuccacccaaauccucccauuaugcugugggaucucugugccucgaugcuuacagcuucccagcuaugguuugaaucugacaugccuccuauagacucaugguuugaauuguucaaucacugcucauagcacaauuuugaugguuguggagccuagcugguagaaauagggaugaagguuauuccugccccuuauccuuauucuggccugcuuucucugcuuccuguuccacuaagauaugaaaaggcuccaucauauguucccacugucgucgaacuacuucaccaugucaucuucagcuaugaugaagugcacagguggcuugcuucugugcuuucucgcagaaguucccucuuccuccaccaccugcuccuuccuacuauaaccacaaagcuuccucccccuuucuggccgcuccugagagaacuugaggagccacagguaccagcuugaguaagauggaugacagccucccucgccucugugacacugagguuagcauucuucccugauaacuggcugggcacuuccaggugcagcuggugccuguccuuggaaaaaggagauuagggucccacauuugaaucauggaagagaggugaucagaagccacagacaguuguggccggucauaaaacuaguccccauaaagacacuccuuaggucggaaguaucccccucucagccucaauuccacccuaccaagugguaucguguuugaauuaugacuugccucauccaccuccccuaccaaguauucaaagaaucucuaacuaugcuguauauaagcaucaagccuuccaagcuugugguuguacuccuguccuacgcugugggaaggucugugaucugagucugacuugaaaagacgauugcaucggacucugcaguuuuuaaacucuccuggguuuccugcagaaucguggcauaauaauggacugaaaugccuccgaaaccaggaguccaaagaaagcuuucuuucuauguuuuauuggguauuuuauuacaguaacaagaaaagugaguaauguacaccuaugugacacaguauagccugugaugaccaugaaucugaaaggauauaaagcauccucagguuuguuuacugguuagauaacaccaggcugguuauaccauggauuaugauuugaaguaucugccagcaaaaucccuaggauacaugagacucauauuuuacuaaggccucauacgcuaugccauugauagagcaauaacugaccaugaauccgaguccuguuccugucauugacaacaaaauccaaaaauggauggaaaagacucuauaguguuugcuuauuaacacaucuaaaagaauuggacaauuuccccaucauccucuauaaaggugauauaaacuccauuagcaaacaguggugaauuaauuagugacgauagagcaguaaaacaaauguuuaucuagauuguccauacauaaaguuauuucaccaaagacuuagcuguuugcaucuugaaaaaguaccuaccaccccucuguguauauaacauucuucacauugacuaaaagugagugauagcaacaaguguacuuauauauauaauugguugccuuuuagacacugaagaaaacagguuauaggucuccacacacaggagcacaggcugaguagaaaugaacuguaaggucacuuuagagucccaugcuagggugggacaugaagauuguaauaggguuggcauguaguaagaagacagguaugcccaagaucugacuacagggagcagagaacacaaacugagagcauggaacccagaucccucagcugcuguagugagcagauagagucuggaaguaaaacagccauuccucauaugcagaaacuucccauugaggucugagguugcuugucuccagagcaggaucugauaugucaauuuaaauaauaguggaguuaacaagauuucuagaauuuuugucuguuuucucccauugguguugugaccaugcuauaccagaacagacacaucuguaccuuucuauggugccaccacaaaguaugucaucaguuuuauuagcaggaauuugccaaguaucuuaaucagcauuacgagugucugugggaaugaguauauuaugaugagcucuguugaagguuugcugugagucaagcuguagaauucacaggcuuggguggaguuuagcugcaaaaaugaggagugagacugugaaggccauagaaguaggccuagacagaagaauauaugcacaaauggagggcagauccagacagacaaacaaguagagugacaugggauauauguacaugacauagccacuuauacacagccacacauauacauguauaacauacaacacaguaaggaugcauagcacagcacacauacacaucugccauacauacaccacuggcacacauguacauuuacauaucugcacagaugacauauauagcauauacaguuuacaucuauuuauaaauaugccuauauucaaacauaucacagauauaccauacuagacucuguguguauuauauaucucuuagauaccauuaaaaacauagauuugaauuugguuuugacagaacuccaaauugcuacauuuuaguccuuuuuuauuguauauauuugugaccugguuuaauagauucuuacuaacugcgacaguucaaauuaguuggugauucuauaauguugauucugaaagcuugagcuggaaaaggaccaagagaaaaagaggacaguugugagugacuaaugugagugacuaauaaugcauacauuuuagcaacaaauuggaguucauuugauucugguuauauaauacagugacuauuuauccaauaauacuaaguacuaggaucuuuugacugggagcauggcuacuacauuucaggaacugcaggguaagcaguucauguauauuccaacuuuuuugaaaugacacaggugacgggaaucaaaaugaccuuuaccuaaagcccugguuuaucucccaguucccacacagcucaaucuacaugugcauaguucuuguccuuuguuuucucuuuauauaaauuuggauggugcuaugagcaaggcagagacauacugagaauuucuuuuucccugaauuuggccagaaauguaaucaauucauuuuccauauauauauuauauauaaugaaugaugguguguguauacugauucaggugaaaguucagaaagaacuaagcuuuauggcuaggaguggcacuaauaggaguuuugcaacaaaaacagcuguuaaacuagguauuguucccuaaacuauccacuaugcugcuuaagauacuuuggugaaacuucaaacuagaagcuucugugaacgucuguauacuacaaauagaaaauggcacuucuuugagucuuguuuuuuugcucugguaaguuuaguaguuuuguugaaguuuguuuucuaaacagucuuuaaucuccugagcaauaacacaagugugccuggccuccuaaauggcucaugagaaccuaagugguuuguuuuucuuggugauaucagggaaauugggguccccuuauaauaaaagaauuaagaauggacucaaacauaagcuugaggacaauuucauuagaguuuaaaagaaccccaggguaggcaagcuguaaacuuaagcagcuuugcagaagggagagaguggaggagagaaagaagaagcaacacugauugaguuaagccaguauagagguucaaccauaugguggggaacagagcuuuauagaaagaaugaaaagaggggugggauguagcuuaguugguuucugccuaaaaagaaugaaaaagucaaaaguauuagggaaaguauauuuaggcauuggccagcauugaaaagaaaagacaaacagcaaaagaaaaaguuaaaccuuucuaagucaggccgacgcuuguagggacuacacuggggagcaggaauucagggaagcaaaaguacauuaucuaauuaaaaagcuauucuuucuaucauuuuuagcaggauuugaagaugaacccacccucuugagggaugguuccuuagcuaggucaauaaccugucuaggaauguuaaaucucugcacaggccagagauuucauccucucuaccagaggaaauaauuuccucugagccuuuauugcugcuaugucauuaggauaucaguuucuagcuccauugcuaguggaguuuaacuacuucuauuugcagggauacagggcagcagagaggcauugguucugcucuauucuggaacauguuaacccaggaagggaccuuccccucccaucuccccaggacacaacaggguuauccacaagacagggcacugacaugauagcccugcagaucccaccuguaacacugauauuauauaucaugugcagguuguaacaagugcagaaccucaaguacucuagguaugaaacagggauggguuccucuucucaaugacuaggauauauccucucaaugcuacuuauauaugugcugugcuugucugagucaguagcaaaguuuucuugguaguaugcucuaccccuacccccacucccaccaaccaaccucugagucaaacuuagggcuuugacacguuaggcgagcauucaaccacugagcuauauacucuaucccucaaaaaucaacugauuguucuugaaacaacucacuuuguagccuaggcuugcuuuuaacuaggugcauuccuuucacuuuggccucccaaauacagggauuauaugaaacaccaugcccagcccagaagucaaucuuagauugagaauugcucuuuuccuuaaaucagagguucguuuuucuccuugggcuuuguuugguguaguauguuggcagaggcacuacacucugaguuguuuuaaguuugcugguaguuaaugcauaggcuuuaauaauggcauagacaauuauacauccacaccagcuucuaucugugugucaugggcaggccuauguguauaugugcauguucaugugauaugauaguauaagggaaaacucuguaacucauagcugcuuccaauaagcaguugucuuucucauuuugcaugucuaauuuuaagguuuuuaugauugaauugauucuuggcacaucuuagaaaggcccuguguauaugagcauuucccauaagucauguaaaaauauuacaacuugaaguaaauagucccaaauauauguggaucugacaauuuucacaaaaacaugauuuuucuuuuuaagagaggguauuuauuuuagguauuuauuuuauuuuaggggguuauuaaagaaauguaguugauauauauacguguguguguguauguguguguguguguguguguguguguguaccagguuuguguauaugugucauuaaugccucauauauuccuuauauaacauguuucacauauagccuaacauuuaacauauguuacagaucacaaguggcagugagcacagguguuaaaaaaauauguaguccuuaaagugauccaagagaaaagauccuaauuggaauuuuugccuaauuuuuauuccaucaucuucuagacaagcugaugcccuguguuaggaaguuagucugagaacacugcaggagcuacugaaacaacucaaaggccaaucccauauugccugaauugucccacuccaagaaagacccagagcucccuccuguggagcucuaaucuaaucuguggagccuggacuaaucugggacucuaccucgagaguauacauacucagaggaguacacacuggugacucgggaccccaaguccaggauucccccuucacccccugccugcucagaaacacacuuuguggcuaaugagcaugacccuguacccuaaagaggccuugauugccuaaucuugagcccaggaaguacuagggccuagacaguacaucuucaccuguggcuuuacuuguggcuguccacaaguccuuaccaacaucauuuacugaguccguggauguauauaugugauuugacugucccucucucacagcuccucugugcucagcagugcccagccgcaagacagccagcaugugaaugaagacacaacuuucccucaaccagaaacccagcucucuuccaagugucaacaccuacagacgucagccauggaaacuucucgcuccccuucgccucaguuugccccacagaagcugacagauaaaccuccccugcuuauccaugaagacaacucagcaagguauugucuuaugacagcaugcucuguauauaucccaugcaggcuucgaguguuuguugcuggagcauugcugcagcuucaagcacugggguaaaacucagucacggaaaauuguguggaggaugaacacagcucaaucgaccaguugugauuuagugacaucaggauccccuuugaacuuaaugcauuucauuugccuuacacucugauacaugccaacuaugcauguuuugccaaugaucaaaaucagguuuagccuaaguauaagaucuuuaaguaaaguugaguaauguccaguauuuucauagucuuuaaaauacuccuucacaagcugggugugguggugcacgccuuuaaucccagcacuugggaggcagaggcaggcagauuucugaguucaaggccagccuggucuacaaagugaguuccaggacagccaggacuauacagagaaacccugucucaaaaaaacaaaacaaaacaaaaaauacuccuucacucuuuuaguuuuuauuugcuuuuugagacaggcucuugauguauagucuagguuggucuugaacccacuauguagccuaggcugucuauguaacuugaccuuucuuugaacuccuuauccuauugccucuaaccuccaaagugcuaagauggccaaggacucaaggagcuauauccuuagcuucucagccuaaccccuuuaaacucuggaauaacccagauaaaaggccgagugccauggguuaccucuuuucaaguuauuggucagugaggucucauagacccuaaccauaauagguuauugucauugcucucaguuaccuuccagaacuucaugccuauugccuauuguagaagacaccacauacuugagucguaaaacauggagaaaagaaguugguaacgacauuaaagcuuuauucccacuagcuaagcauuucauaguauaagaagguguuauggaugauacuaggggaguaauuaauagccuuacccagcuuugaacucugggaacuauaauaaugaacugacaagauaugccuacucaugcaauagugacagaaauuuuaaggaagguuuuaagacuuguuucacaaaacagaacuuaaugucuccuacuguuaacagugcauagacuguaagagagaacugcuaucauucugcuauguggauuuagcauuaaacccucccuuaaguguuuguaucucuuaacccucaucagaaaaguuucuuuuguaauagauagcaauuaacacagugaucuacaacuuuuaaacaugcagaaaauaugaaacuucuaaguuuucaacccuaaaugcaacaucaguguuacacguccucuucccaaaguucauugaucauuguggaagaguagcagagguaguaaaugacuguagugaaacugauuuccagacaggacagggcaguugugcacgugagcucacagugccuuugacugcaugcacaagaucaagccauacaaaucccagcauaaauggaagcacaaagucccauccccuaucuaagaagcuguuggcaaucaguagcuacugggagagggagagucaguuuucuuucaagauguggccccugaaaggcuccccaugcuccaauagauaguccugcacuuaugcacauacuaacagcacuaagugaacucagugguuuuaaaagacaaaacaaaacauaaaagugagaaggaauaguggaggaaugugggguggauuugaugaaaacauaaguagguaugaaauuaucaaacaauaaagauuaaguuuagaaaggacaucaguuauguuguuuuugcaucucucucuuaguuagguuccuacugcuaugcuauauaccaugaccaauagcaacuuggggaugaaagggucacuuuccucucacaauuuacaguucacccaccauuaaaggaaguaugagcagaaacugaagcaagagaccuuggagggagaaccacuacuauuggcuugcuccccacaguguacucagcaugcuuuauuauacaacccagggccuccugccaaagugggaggggccccccacaucaaucauuaaucaugaaaaugauuuagacuuaggccaaucugauggaggcauuuuccaguugagguucccucuucccagaggacucuagcuugugugauguuaacaaaaauaccaaccagcacagucuccagugacuguguuaaauccacaguuuuaugugugugccucagcuguguuagucauuuuucaauugguagcacuguuagggaucuggagagaaaagcucuagucugguaguuucuacuuuaauagaaccccacaggcuaaguagcuuagaaacaacagacauggcuugcuccuuccuguuucuagagacuagaagaccaaggucaagaagguguggcagauucagaaaagugcuucauagaugacaccuucuugugugcucacaugguagaggaggcaggaaguucucuacuguucuuuaauaaagacacucauacuauucaugaggcucaauuuucaggacaucuggaggaaagacugacagaucuguaugagcuuggucuaaauagugagagccuaucucaaaaaaaaaucaaccuaagaauuuggguacauauacuugguuuuuuuuucauaccaguaggaaaugcaauaagaugacgugugugguagacaaacuguauaccauuuucucaugccagucagcucaggguacucuagcuucucaagucacuagagcuacagugagcacaaugggcuucauggugaaacagugugugagucuaggaaauggcuuuuugucccagugaauacuggcuggugcacccucucccucucccucucccuccccccuucuuugacuucguuugcuauuuaugacagacuggccggaaauucagcaauccuccugccucagcuucccuagugcuaggauuacaggcaugaguuacuaugccuagcuagaaacuuauaguuuuuaaacuauguuugcccugggugagucacugagacuaauacagaacaaguaaguucucaguauacugcaugguaucccucacaggguggcuuuaggugucaguaugugggagacacauggaacacauggcaaagccccagaguggaacccauggguagaggugcucagcaauaauucuaaacacagcaacucugaauauguauucuagggagaaggaggaacacccagguaccugcugauaugcaacagccuacuuuuaaguuuguggugauucuguccacugaugauuuuuccuacaaagggcgaauuaauaaaugguacuugaugcauuuguauugcccucagaauaaaaacaagaaaucaaagaguauuuuauagccauagcucaugcgauagagcauuugucuucccaaugcaagcccuuugggaauucaaugccuauuuucauaagaaaacaaaaaugaguguuaaacaguucuuaugucauucaggaucucuuugucuuuguccaggugugugacagaguuugaguuggacugcuaggcauccagagaccgugaggggucagaugaggacacuuuccauccucugcuaucuuucuauuuggcugguugacagugggucuuuguguugggaucccugugugggucguggguggaaaucuguacaugucaagauuucagaggacagcccuuaucuuugcagaaucgagcgggugauggacaacaacaccacugugaagauggugcccauaaaaauugugcacucagaaagccagcccgagaaggagagucgucagagucucgcgugcccagcugagcugcccccacugcccagugggcuggagagggaccagaucaagacacugaguacaucagagcaaugcuacucccgcuucuguguguacacacgacaggagguggaagcuccucauagagcccgcccuccagagccccggccacccagcacgccugcaccuccugucagagauagcuguuccuccccucccucacucaacuaugggaaggccaaggagaaaaccauggaugacuugaagucugaagaauuagccagggagauugugggaaaggacaagucuuuggcugacauccuggaccccagugugaagaucaaaacuaccauggaucugauggagggaauuuuucccaaagaugaguaccuccuagaggaagcucagcagcggagaaagcugcuccccaaaguccccuuacccagagucacagaggacaaguaaguagauggcacacaccauagcugcuuguuucucagucccuaucucauaggcuuagaagugaaagaagggacucaggggguguaucuauaaucaugauugcuucugcggacaggugaugguuuuccuugggguccucaaccuuagcacuguuugguaagguuuaaaauuaccauaccuggaucuagcagaggcaagaugaugcccacugcagcaaauguccuuagcuuacagcuaaauccuuuccaguuuugucuaucacucuggagaauggggcacuccugccaucuaguggaaagacaguagguacuacuaaagaucuuauagugugugaaauagcccaucuacuaauaugaagcuaacuguccaccccauuaccugucuuauguccaucaucuaaucucuguauuuaauaugcauaugaugugccuguccauccauuuguuuuugaaguagggucccucuaagaagcuugggcucccuuaaacuugauccugcuaccucagcuuccugaaugcuagauuuauaggaucuaccaccauaccuaccuaucucccucccacacacuucuugguaauguugaaauagaaccuagguccucuuauauacuagguaaauuugucaucacuaaguuacaagucacacccauuuuauuuuguuuugagacaaguuaacuggacuggcuuugaacucaaaaaaucuuccugccuuagauuccuaacagcugauguugcacguaugugcuaccacacuuggcuauuuaucuuagguuggucucuacagcuaucauguaaucuuuccauauauuuaaucuguaucucuuuuugucugccugccuuucaccuacuuuugaagcacauuacaaagucugccucuaguugaacagcauuuucucucauuagagauguuucuguguguuuaaguuucaguuaccuaggggcugaggaugcaacucagagguaaaguauuuaccuagaaugcgcacggccuugaauguaauacaaaucacugaugggauaagaaaaacaguuuugcuuccacagaaggcaugugaccaugugacagugucuaaagacauuuuucuuugcuauaucugggggcauggaguugguaucuaguauguagaacccagagguuguuuucaagauucagcagagcauaggauagcccaacacaugcauaagcaugcgcgcgcgugcacgcgcgcgcgcacacacacacacacacauguuuuuaaaaauuaagacccuauagccuggauuggggauauagcuagguaugagaguacuugcccaauauggcaagguccacaguuucuaaauuacuacuaaaaaacaauggcagaaaugaauaacagucugugaaucuuauauuaguagaaaaaguuuuuuuauuuuguuuuugaaaacauuuugggcuuagucuucuuuucucauuucccugguucuuguccuucucuccgugccauuuguuacaaccuagguacuaaguucaaagagugggcaugugucacagcugauuaaaauuuuggccucuucacccaggaaacaggacccagguaugccagggguuguguccuuggccaccaauucuaccuauuacagcacaucagcccccaaagcagagcuucuuaucaagaugaaggaccugcaggagccugaagaguauucagcaggugacuuggaucaugaccuuucuguuaagaagguaagaaagagaaguacaagucugaugccaguucaguagcuccaacucacagcuauuaagguagcugagggaagagaaucauuuaaggccagaaguucuggaccagccugggagaaauugcaagaucugccuuuauacaaacaaaauuccuugccuucugagcauggugacuaaugccuauaaucccagcacugagaaggcugaggcaggagagugagucagacaguugaugcugcgggguaaguucaaagccagccugggcuucacagugagauccuucuucaaaaacuaaaguaacccuucccucaaaauuauaugcugggccauugaaagguacuaggaccacucaccucagcagauaccuuccacagcaucucugagggcauuugugcuugcuuuucauggaaggcauuggcaugaauaagcuguucaugcuuaauuguauucuaagccuucuacaaaacccuuguaggcagacuagagaaaggagcucucuguaaggguccccguguucucaggaauuauguaaggccaccaccaacaauaccaccaccaccaacaacaaaaagaugucuaacauaggcuugguaaaccuuacuguucugccuacuuuuggaaauagguuuuuugaaacauagccacauccauuuguuuaaauauugacugucacugaccauguaacaaccuacaaggaguaaaauagcuccucucuagccccucaugggaaaaguuugccagcccuuguuauucuacaucagguauuggacaguuggaacagggugagugaauagagagagagagaacugccugauuguagagacccagaucagugccagagcucaagccccauaagugagugcugugugagggaaaagugaagcaggcguagaugcccuaugggaagagcuugguggucuuggggagaagcagcagaagguaaggcuucagcuuugggaacuaagaaagaagguuggagauuaauucaggaucaccuuauguggcacccaugacagucacugcaaggacaguguuaucucuacugcuaccaaccugguaauuugaaagauagcauagauugaucuuaauuaccuuagaaauguuagggagggaauaccaugaacuauuuauacauuaaaaacaucauuucaguggauucugggaauuaaauauggagauggguguuuggucucacaagagacuuugaauuauauuauuauguauuuuauucuaguugcauguucguauuuuaaaaaacaacaucuucaauuuuuguccucauagaacaagucauagaauuugaagcauuuuaauuuaggccacacuguacauacacuuuccuuacaguuaggccuuguuauuucauauuguagugcauuuagaagugcauacccuggccaaggacauagcccauugggagaaugcuuacccagcuuguauuaggcccuggguucuuucucuaacacucuacccuacaaaguauaucuaaauauuuuaaaauuaagguaugguagcacauaucuauaauccuagcauucagaaggaagagggaagaggguuagcacaaguucagggucagucugagauacauagccagcuuguacaccauccagaacuacauagcaaguccauuucagaaaugucaucccagccgcggggggggggggggggggggggagggggggggugcacgccuuuaaucccagcacuugggaggcagaggcagguggauuucugaguucaaggccagccuggccuacaaaguaaguuccaggacagccagggcuauacagagaaauccugucugguaaaacaaacaaacaaacaaaagcaagaaaaaaugccacccccaaaaacaauuuaaaagugaucucaccccccuuugucuguauagugucuguauuugcucugagaggcaccaggagcuaggauacugugucauuagaagcaacuacuuugggucucagggaaucaaaguuugaacauuuuuuauuuuauuuacuuuuuuuuggacauagacucauguuauauagcucagacugaccuauaacuuguuauggaauccaggcuggccucuaacuuguccuccugcuucagucuccuggguucugagauuucauaccugcaacaacacacucagccagacuuacauuuuuagauaguaaagauuaauuuggcgguuuauccaccccauuuuugggaugaaaguacucuacccauaaauugcaucccaaucuuccuuuuaauuaaaacaaaaaagugugugugcaugaggggugggguucuuugugugugcuauacacauuuguauuuguuauauuuacuuuaguuuuugagagagaaucuugcuacauagccuugucuggccugguacuucauauguagcccaggcuggucuuacagccuuccuuccucagccacuucaguguuagacaggcaugaacaacuauauccaacuccacauuuuauuuuacuuuugcucuuugaaaaucaaugcuugauggcuagagagauggcucuuggguagaaugcuuacuauggaagcaugaauauuggaguucagaacacacauaaauauauaaugaaugugucacucugccuguaaucccagugcuuaggagacaaagacagcgacucuacagagcaagcuggcuagcuaaaauagccaauucaucaauucaucauugucuaguuucaagugagaggcccugcuucaauauaccaugacaaucaagagcgacacucaugucaaccucuggcuuucacacacauacauguacaucauauacacauacagugaagucaggguacacccaucauccuagcauugagguugaagcaagaggaccauagauuguaggccacuccggacuauacagaaagacuaucucaacaacaguaacaauaaaacaccagaaacaaaauuagugcuuuaagguuagggauauagcucagugacagaguacauaccuaacauguaagagguccugaguuucauuccuaagacuacacacaaaaauaaaaauaauaauaaauaaaacuuauucuuuucuuuuuuucuaguguaauuuuuuaaaauaaauuuuaaaguaagaugauucaguauggcauguguauccauguggaucauuauacuuuucuuuuuucuuuauuagauauuuucuucauuuacauuucaaaugcuaucuucaaaguccccuauacccucccccgcccugcuccccaacccacccacccccgcuuccuggcccuggcguuccccuguacugggacacauaaagucaucagacuggcaacaagcacccuuaucugcugacuuaccucuuuggcucauauaaacaaggaagcuuauauuuaaccaggaggucuucucaugguuuuacaaaaccccccauuauuugaugaugcaaagacuaacacacccaaucuggcugaauucugccuaggcuguauguaauuugucuacacuuugggcaacagcuuggggucauccuaacaaauaucuccaugccucucugugcccuacagcaagagcucauugacaguaucagccgcaagcugcaggugcuccgggaagcacgugagagccugcuggaagacauccaagccaacaaugcucuuggggaugagguggaagccauugugaaagaugucugcaagcccaaugaguuugacaaguuccggauguucauuggagaccuggacaaaguggugaaccuccugcugucacugucaggacgccuggcccguguggaaaaugcccuuaauaauuuagaugacaauccuucuccuggagaucggguacaugcaaacacaucugucugggaaaugggaaguguugagaauccuucagaguggcuguccuuaagaugcuaagaaagucagcucuuagaagcaucguauuaucugugcauggccuguguacucucuagagcauggugcccugauacaucugggguccauucucuugguuuccuuucaaaugacagaacaagauaaguagaugcagggagucaggggcauuauaagcauguaccaccauguguauccucaguuuucuuguacucaaaagaagagaagugucuuccuuucugguuuuauuucauagauuguauuuuagucaaagucuacauucuuugcauaguauggaaaagaaggcacagacagagacaggaaacugagaaggagccuacgaguagcuuuugggagggguaaggaaggaagaacuguagagaagcuagccacaguuacauguagacuacauccuagucauuccuaugggcaucccauguggcuucaagauuuccaagucuccaaacccugcagggccucucagugguuagccagccucuacuuuaguccugccucgacugaacuuucugucucccuuccccuuaauagcagucacuguuggagaaacagagaguccuaacucagcagcacgaggaugccaaggagcuuaaagagaaccuggaccgccgugagcgcauuguguucgacauccuggcuaccuaccucagcgaggagaaccuggcugacuaugagcacuucgugaagaugaagucagcucucaucauugagcagcgagagcuggaagauaaaauccaccugggugaagagcagcucaaguguuuguuugacagccuacagccugagagaagcaaaugagaggcacauuccuacagaagguggacaccaagcccuggagauuaaugccugagacuauaagagugaacccaagccuauuugcccaucucuggagagacauacucuggagccacgaggcuaguaaaaaagcaauaauguccugcuaguaugugaugauuuauuuaugauuuucauuucuguugguuugcugaacauaguuucauaucacaugugauuucacagaaugccaggcuuugcuaaacaacaaggguucucuagcccuccuuugcagcaguggcaccaauguuccucccucguguagaugccaaauacaguccuacagugcaugagaggaaagacccuugugauuuagccagacacgggcugcuguguguucuguccuuguucauuuaacaaugugagcauuccucauucugucauggugacauucucugacucaguaaaaaucagugaugauauuuauucauguguggaaaacaugaacaguuuccuaguaguuaaagacuaacuauaaaaugaacaaucuacauauuggauccauucauuccaagauuaaaauuaucacauaacuugugugcauguuuugaaauacccuaaacagauaucuaguauccuucuugucacaucuuaaauacuuucuagccaagugauuuuaauuggauaaaagugugucuacuaauaauguuauugcuugcuuuuuauuuccugagaccaauggaauauuuugaaguuuccuucccuggaacacuaauuuguguauaugaucuuuaaugauaaucagugguuuaucucuuuuuaugucuguuaccaugggccacaugccacaugccacauaccuuaagacuuaagacuccaucuaguggucagagguccuguggagugacuagugcuuacauuugaaacagaguuuuguccuuaacaguucaaauggcaagaugacaaauagaguguuauucaugaaagcuacacugucauucuguugguuuccaguugacaggacagauugggaaaagacauuuuuaaaucaugugucugacuuguugcucauuuuguuuuuguuauuauuuguuuguuuuagaagagucuaacccagauuggcuucaaacucccuauguaguccaaugaccuugaacuccugauccuccugccuccacauccugaguucuggguuuagcagcauaucccacuucaugacuucauacaucuaucugauaaaggauuuguauaaagaacuuccaacauccaauaguaggaauuguuugaaaaaaaaaaagugggcaaaagacuugacuagacccuucaccaaagaggauauauguauggcagauaaacacaugggaaauguucagcuaccaauggcguguauaacuugcuuauguuaaauguguguagauuugguguuguucaaaagguguuucuguaacuaagugcaugguaagugaugagcaagucucuuggugacuugguauuuaggcaucacuagucuuuguucuaccaagggauuauuuaauucguauguuccccugagacugcagcauauacgaagauuucccucucuuagcaguagccacaccuuuuccaaaauacacaugcacauuuacauccauguguaugugcacguguucacacucccacacacaguugucuuaaaggaccagaauccaugcuucuugagccagaggaacagacguugacagcagaagcucuggugaagaugauacaguguccuccauacagcugagucaagauuggcgagauuuuauaugcagaccauggaugacaugguugacauccuaucacugucagucagaagaaaaucuuugcaaaaguguugauuccuguuaaaugaaacuauucuaccuuuugaaguuccugaucugccacugcagccucuuucuccuuccacuuggucauccuuugcugugaaugugggucaugucagaaaacacgauauuggcucuccacaaacuauccaagguguugcagacuauuuuguuuuuaauuuacaccaagcuauuuaccugugguucuuuaaucccaaauacaguguugugaacauuuuaaugauauguguguaacaugugaguaauggaauuuuguuugucuguaaccugcuuuuucauguugcuucaagcuugucuguuaugggaaacaauauguagugcucuagcaugcuuguaaugaaacacauaacaauuaugaccuucuuauccauccccugcuugccuguuccaugucugauuagcagggacccaagaauuccagagaguccauguacauaugucuaugacuugugauauuacugcauaagaaacaaucuggugcuaaugguugguccuuggcaugcauaggcaugggcaugggcacagcuauggaacucucuguaaauauacugaccuugcuuguggucagcuuuuguggcuuuacccugaacucugcccuggcaaauaugcacauucaugcuugaugcuuaccacuuaucaacagauccucuugcuugacuuuaacaaaauaaauagugucucuucagaugaaaguagaaugucuuuauuuccuacuguauagcuuuguaaaaagaauaaaaauaccagugcugggcauguagcccauggggaaggguuugaacaugguguucugacuucaaauaguagcauuucuccuccagaaaauagccuaagccaggcacuguggggaacaccugcaauccugguccuuagaguggugcacagcuggacccacagcacaguuuuuccuucuauauacgggugccaaacacauccuuaaaggggcauaguagauaaaauucuugugauuuagcuugauucaggcugcuauguauuuuguccuuucuaagucaacagugugacuucuuaucacacaugucauaauugugugacccaacaaaaaucagugguaauaauguuuagaaauauaaaugguuuccuuguaguuaaaaacaaacuaaaauaaacagcauacauguugaguguacucaaucaaaaauuaaaaucuuaaaugca

SEQ ID NO: 9794 - RNA, 1413 nt, Mus musculus
cauucuguuuacuaugcuuuuauuuauacuauuugcacagugagcauauuuacaaauguguuccauuacaagacaucagacacaagggaaagacagaacaaaucuguaaucuucuuccacucacacuuuacugguuauuccaaacuuucaaagaacagccucucagugguacuuucuauccaucacacaacaugacacaaagacuucauuuaauaagguuagcacagcuguuaauaucaaaugccaacgacagaaaaaaauaacauaaacuuuuccucaaguauauauuuaaacauauugugauucuuagucaacaguguuauaaaaugaauacaagauaacaauaucuauagcaaacacuacuuugcaguuuaacaauuagcacuggucacaaauaccaaauacagugcccuccccacccuccacaaccuuuugaauucaggacccugccuaucuacuccauggagcagauacuuuggauucucuuuuccacuccuaaggguuugccuaggaucucucuauggagcagaauaaccccuagcacccgaauugagaauagccucaaccucugcaucaucaucugaaucccagucauaguuacauggccagucuuuggagcaucgguuccgaacucuugccacaaaaugcaugacuuucagcuugcuagauuccacgugugcucgagggccccagaagaacucauacuccacuggacugcugcggggcacuggcuuauaaaucagauacccucugcgcacaaacucuucuguaacgaccuucuucggaucuccaaagaugcugugcugccucccaggcugcaucccuaacuuccccagcacuuuccacaccagggccuccuuugcgcuguugcccaugaugaagaugagggcuaauauggacauuaggagacuuuucuuggugcccugaaaauugcuccggguaaccggcuuuugcacuagggcagugcucgaagcuucugaagggguacuggaggccuucuccagggugcuugugucuuccuccgggccgcucagguauucuucgggugugcucggggcuacagaagccgccaucggggucucugaagccucugaggccuggcucuugcgauuguugcgauucucuucagcugccuuugcguuccggcggcgccgacucuuccguccccgaggcauggcuccugcaaagcgaugaaagccugcagcacuuggagaaggcuauuggcagcgucggagaaaaguggcuaucuuacucagggacggccgcugaaccgcaaacgccagcggagccuuuguggcaaggaaccagucgcuuucagccacaaagcccuuucccaggcaagcugacuugcgcaaggagucgccgcccgcacucccuguagcgccaagcgcgcaagaaaccagagcagcauug

SEQ ID NO: 9795 - RNA, 1413 nt, Mus musculus
caaugcugcucugguuucuugcgcgcuuggcgcuacagggagugcgggcggcgacuccuugcgcaagucagcuugccugggaaagggcuuuguggcugaaagcgacugguuccuugccacaaaggcuccgcuggcguuugcgguucagcggccgucccugaguaagauagccacuuuucuccgacgcugccaauagccuucuccaagugcugcaggcuuucaucgcuuugcaggagccaugccucggggacggaagagucggcgccgccggaacgcaaaggcagcugaagagaaucgcaacaaucgcaagagccaggccucagaggcuucagagaccccgauggcggcuucuguagccccgagcacacccgaagaauaccugagcggcccggaggaagacacaagcacccuggagaaggccuccaguaccccuucagaagcuucgagcacugcccuagugcaaaagccgguuacccggagcaauuuucagggcaccaagaaaagucuccuaauguccauauuagcccucaucuucaucaugggcaacagcgcaaaggaggcccugguguggaaagugcuggggaaguuagggaugcagccugggaggcagcacagcaucuuuggagauccgaagaaggucguuacagaagaguuugugcgcagaggguaucugauuuauaagccagugccccgcagcaguccaguggaguaugaguucuucuggggcccucgagcacacguggaaucuagcaagcugaaagucaugcauuuuguggcaagaguucggaaccgaugcuccaaagacuggccauguaacuaugacugggauucagaugaugaugcagagguugaggcuauucucaauucgggugcuagggguuauucugcuccauagagagauccuaggcaaacccuuaggaguggaaaagagaauccaaaguaucugcuccauggaguagauaggcaggguccugaauucaaaagguuguggaggguggggagggcacuguauuugguauuugugaccagugcuaauuguuaaacugcaaaguaguguuugcuauagauauuguuaucuuguauucauuuuauaacacuguugacuaagaaucacaauauguuuaaauauauacuugaggaaaaguuuauguuauuuuuuucugucguuggcauuugauauuaacagcugugcuaaccuuauuaaaugaagucuuugugucauguugugugauggauagaaaguaccacugagaggcuguucuuugaaaguuuggaauaaccaguaaagugugaguggaagaagauuacagauuuguucugucuuucccuugugucugaugucuuguaauggaacacauuuguaaauaugcucacugugcaaauaguauaaauaaaagcauaguaaacagaaug

SEQ ID NO: 9796 - RNA, 35289 nt, Mus musculus
ucucccgcacaggaacuuccgcuagccgaaaggaaaaggagcgggcugcauuuugagucccacaaugguaguuaagacagcuagggggcgggggguugcagggauuuguccugcgcgcaagagaaugucggucuucuuuaggcaggugcacacauuauccuauugguucauagcuuuuggcaagcagugggcccuuccagucucaccaaaggcgggcugagaggggugggguggggugggggaggggugcggcggggcacaggcuugcaagaggucagcugaccccagcccuccuuggcugccuuggcuuacacagcauauucacucucccgccuggguuuucagaaggcguuuauguguggcuaauuaauucgugggcccaucagggacccgaagaauagacuuaaugaccaaagcggugggugaggggaggcagcagugcgcaggagacgcagagccuguacccugcuacguguucgccuggucaauuaagcgggggcagugagaagaucaggcuuagauuugcgcagccucacggaggccagaguacuuccuggcaggccacagaggaagcaauuagaauaagaagcagcuggaugaaagugagcuguugccauggggacugagagacagaaaggcauuugaagggagaccacaggcaggcuucagacaaugggugggaauggggagcagagagaugguauggugcgguuggauccuggauuucuaggccggccagccagcuuaccugccucgacucgcuccccucggugcacacucugaacuuuguccacuccuucucucugcucagguuccucugccugaaaugccuccccuccauccuccacucucuaaguaccaccugcuucucccaggcagcuuccucgcucgcucaaguucauuucggccugccccaaagaguaaugagucaguuccuacucccccaagggaggccccauagccaggcaugcugcuuuucuugugucauuugaagcgugaacuugcucagauccuucaccucucugagccuggcuuucccccuugaaaguggauguaacucaagcacuggcuucagaguugugcgaauucaacgaaaagccuuuacugccuaguaagcacagauuugccucuaagugcguugcaagcagcagcagcaggugagaguggcauuuaagaaaugcgccuugagggaauaugugguggaaagauuuuacauguguuccguuuuugaaaaaaugguuuggugugagugugugugugugugugugugugugugugugugugcgcgcgcgccccgugugcuugugcccugugugcuguauacacgagggguuagcagagggcgugggacccccugggacugaguuagaggugcuugagaucugcucgcuaugggugcuggcaaccuaacucgauuccucuggaagagcagcaaguguucucuuaacugcugagccauugcucccgccccucauaugugcucucaguucuuggaagguaaauggauauuuucugcuuguuucacuggaagggaugaagcauguguuugacagugucucagcugggaauccuacugggaaauuaacccuguggggcucauagacuuuggcagcucccagcuuuuugguagaguuuguggaccaggauauggccuuaucuagcgaaugaacucuguggugggugaugcgugucacuggcaacagcauugccagcacaacuugacccagugaggcucagacaccugugcgcggguagaaaggagaugccugcuggagagaaacagucauugaaaucagaacugggaacaagaguuuggggcugguguguaucuguuccaagccuuugaugaguuuauugaacaucccaguccucugauuuguucuauacagaaaaagcugaucucucuggcuuggucuguccagcuugcuuccuaucucugugaaaguuaaugcuaaauacuacuauauuuucagucuuucuuuucauucuugagauuauaauugcagcaauucucccuuccuuguccucccuccaaaccgucccauaaacccucccauacuguccuuccaauucaggcuucuuuuuuuuccccacuaaugguuauucccugaauauauguauauacauauagguauauauuccuaaauauaacguguucagucugugcaaugccauuuggauguauggcuugggagcugaucauuuagcacuggacaagcaguuggugugcucuccccuuggaaagaguauuucugcucccagauguccuuaaccacuugcaguucuuuguguaggguugagaccucauguacauucucuguguucauugguuucauccuugcucaucguucacacugucaugucggagagacuugauggguauggcuucugacauuccuaggagacagacucuuacagcuaacucucugauccgauggcucuuuacagucuuucugccaccucuuccacggugaucccugagccuuuagagaagguuuccuggacuuaaagauuugucauauuugugauuauauacuguaauauauaguuauaauuaaaauauacaauaauuuguuuccguuuugaugcuauuuaugagaauguaauuaccaacguucacuuuuuuuuuuuuuacugaaguuucuuuuuuuaaggaaaauguacuaguacuuccuacuugguaaauuaauuugggguguauuugaugcuguucucccuugugccacaccaauggauugaggaguaggugccauucccugucauugucgucuucaccuaaaugaaccauuauuucacuccaaggacagugcaacccuccaugacuccauagauagagcagauaacuaauauacagccuaagaccucaacacccaucuaguuuuuccaaagaaguuagugggaacaagguuuaggcucuaggcuauuuuugcuaagccagaaacagagaggagaggggcguggagaggccuggauccuauaguguuuccuagcuaucagagaaagacaauuacauauaagcuuagaagucgugacauccaaagagaaaucucuugagcucaguuccagauucuacauaugagauuaaaauccuugauauguuguugaaccacugcuaucuaugaaauccuggggacuaugcuuuucaggcaauucuuuucagaagggacuaaauuaguuauuauagaguaguccagaaucaaauacuacugacaacagcagcucugggucagaaauuuuauuuauguaaagagucauaguuauauaauagcuuuuauguguuaggcauugauagaaacucauuagaguuuggagaguuaguucacagucuguuagugaaaaacaaagacuuaaaugcuuaaugauuuuuuuuuuaagcuuaguguagaagauguuggcucugauuagcaggacuauggaugaggucucuaggcaugaauuaggagaucagauuaauuuaguguaaucaggaaggguauaucugaauaaguaagucaauauugggcugaaaccuuaaugcugacuagaaagguuacaugcaaacagaugucugagaagcugaaagccaaaaugaacagacucauagcaguuucugcgauugggaauuauucucucugugggccaaauuuuaguuccuuuaacagugugacaugaagauauugaggaauuuuaguuuauaauauuaucaugcauacuguauagucacaccaugacuuauuauacuauuuccccacugcuuaaacauauuugcucauuuuuaaaagcaguauuccauauacauuuguauacuugucuguauauuuguauuucucgucacagaguuagugguuugaauguuuuuuuuuugcauauaaaucaugauguaaauauccaggcuuauuuccacgaauaguuguguccuuucuuaguaagcaucaccagcagugaauggaguguaucauuuucaccacaucugugucuucccaaagcacuguuagauguauaauucauuagcagucugauggguaaacuaacacaucuuauuguaauuguuauaugugauuagcauaaaauaaaguacacauacuaaaaauuguacaauuugauacauuuuaauguauguguguaacuguugguagauuuaauauaauuguuguauuguuuuagaauauuuuauuacauuuauuugggggugggugcacacaugcagcauauuaguggaggccaaagaacaacccuuaagagugguuucuuuucccuucacuauguagggcauggggauugauuucuggcuaucaggcuuggaggcaaguaucugcacuuaaccugcugagccaucucacaagcccaaucguuauauuauuuaucaucaaauuccuucaugccccuuuauaauugucucccccuuuuuccaucuuuccuccauccuaggcacauuuauaaacuuucuaucaccauauauuauauuucauuccuugccauuuauguaaguaaauucaaaguucuuuucuagauuuuauuuauuuuuuuaucaaauggucuugaauuaccauacaaacuaauggggucaauaguuucauuggcaaaauauaugccauuauauuuuguucuucuuugugucuucugaaucuuuuauuuuauuuuuuaauuuuugagauuauaguauaauuacaacacuuccucccucuaaacccuuccauguaccccuucccucuuccauuacccacuccuccccucccucuugcucucccuuucuaaaauacuucuuccuccuuucaugucauauauuauccucucuugguccauacucaucccucccuuuaggcaucuuccaucucauaaucccuuuucuauuuucauuaacauauauguguucauauauauucauauuuagguuuugauauaugacagaaaacaaaaaauauuuugucugauuuuguuuaacuuaguucauuggaacuggaacucuaguuccaaucauuuccuuaaaaauauuuauuuuucuuuauggaugaguaaaauuccuuuguguguguguagcaaauuuccuuuaucugcuccuugccugguacauaucuaggcugguuccaaaucuuggcuauugugagcagagcaccaauauaagugggcaugcaagcaucucugugcccuuaaggucaguacccaggagugguacaacugacugauauguaguucuauuuugauuuucuuuugagaaaacgggcaugcaagcaucucugugcccuuaaggucaguacccaggagugguacaacugacugauauguaguauuuugauuuucuuuugagaaaacggcauauugauuuguaaacuauccacacuacuucaugcuccuaccacgguuucuucaauuuuuaccauauccucauuauauguauuucuuccuuuggucaauaaauaaugauuuauaaaaacaaagacaaaaacaaaacaagauauauucuuguugcauaguccugguuuugaaaagguaauuucuauugcccagucuccaaacugcugagauuaaaagcaugaacuaccauacccagguugguaauugcagggcagggaguauuggggaauaaaaggaaugggagaaaacccgcaucuugccagaguucuggugcucugggcgagcagacgcagaaggacugccgcaugcuuuccauguggccccgggugggugucugauugugugaagucacagaccccagcucagcgggugguggacaaggagcaguccuagguagcagguucucagccuugggcaucccagacacuguuggacaccucggaagagcugaaaacagaauggggaccccggggguagcucugucagcccuggggccgaagagaggagaggaagguggauagggggccgcuggaugguccccacgcggggcgagagucccugguccagucuguggcuggagcacaggauggccuucuggcuagagguuagaccaggcuuguuagaggaaagccuaucccauugcucaagcacggcgggccuugaugagcagagacagucuaugguuuuagagcuuuauuguagaauggcagggagaaagagagaagauagaaagagggagagaggccagccauggccacguggagagggguggggagggagagagaaggaggacuagaaaguaagaaaggugagagcuuaaagggagugaggaggggccaagcagccccucuuauagugggcugggcuaucagguaacugugaggaggagcauaccuggcuauagucagguuaacuguggggguggagucuagccagaaugccaaaagauugggacauugugugacugauagucacacaccucucaugugggggcgggggguggggugguaauuuagacagaagccagggguccaggagacaugauugaacaauuuccaucccauguagauggaaaucaccacccauugguuccccccgggguucaagaccuaugcucaacuggagaccccacagauaaucagucuuuuucucccuuguuucaaugauuucauucaacauuauuuucuuuuguuuucccugaaugacacaucaguauacagauacaguacucauuguuuaauuggucacccauggaugaacauuuuaacaauuuguaguuugggucuauaacaaaaaccagauggcaaggacaugcuuuuacuuuuaaauaaacagaaaauauggagcuggagagguggcucagagguuaaagcacugauugcucuuccagagggccugaguucaauuuccaguaaccauauagugguucuuuaccauacauaaugaggccaggcaugcacgcaggcagaacacuauauacauaauaaauaaaucuaaaaaauauaucuuaaaaaucaggaaaucuuuuucuuuuuaaguuauuaauuuuauuaguacauuuuguucuuuggcaauuacaauuauauuuugucuuauuuauuaucacuaauguguguuguguauaugauuugugugagaacacucacaccauggugugcauguggaggccacagucaauuuuguagucaguucuuuccuuccaccuuuauguggauucuaggacucaagucagaguuucacaacaacuguuuuuaaccacugagccauuuugcugacccuuuuuaaauuaaaauuuuagguuaauauucaguauaauagguucauacauaccugucuuuauccacuucccucuccuaauguuuuccucccaauccugcuguuucccccuggcugauucccuuucuucccuccugauagcccucccccaaccccuaccccauuccugcucuuaagucauauauauucuucaucuuuguaagccuucuuuuccuccuuccucauccuucccuuaagauaucuucuuccagucaaauguggugguacacgucuauaaucccaguacuugggagacaaagucaggaagauugcaaguuugaggcuagccugagcuucaaaaacaaaagaaaggcucacucaugagauacuuuaguagagaaaggucuugcuuccaagccugguaaucagggacucauaugguggaaggagggaauauaccccagcagguuguccucugagauccacacauuucacacaugcacuaacacagacacgcgcgcgcgcgcgcgcacacacacacacacacacacacacacacaccaaaauaaauguaaaauuuagaaagucagaaaaacaaccaaaagaacccaaacaaaacaaaaagaucuuuuuucccuucucaggauccguucuccuacuccuguugcugaucaguuucuucuucccaacuaauccuccucguguguguguguguguguguguguguguguguguguguguguccgucccacugagguuaauuaagauugcucauauaauauggguagguuauuuacugucgcauggguaauuuacuaguggcuaaaucacugaagaaacuuauucucccucccuuagcaaccauuaacugccaguagcuccucagccagaggugggggccucacaaacccuugaccagcugugauagaauguugaagagcuccaccuuguguaaguaaugauagcuauuguguacgugauugcaaaaacaacaguguauccagaaaacugcgguuccuagcacuccuguccauccuccagcuuuucccuccuucccaccuugucuuccaccauguuuccuggguucuggaaacaguuauauagauuucccuuucaagggugagcugugcucaacuuauuuucacccuuugucuuguuacgagucuaugcauucaccaucacagacugcagaaagaaguuucuuggccugaggccaagagcagcacuaaucuauagggauaaagauaaagauuuagaagguaguuugacuccacauccauuuagcaaaugaacaguaauauaggggccugugaccuccacagccaugagcuuuuaaccaguuacaucagcuaugaguuccuucuagggaagcagaucucaaauccaaauagaaaauggccaaacagucauuuuuaacuucuauguuuuuauagucaaguugauauauuuuaguauuaaaucuaugauuuuuaacacacauauagacuuauguuacuaccuucauaguaaagauauagagcagcuacagcaucucagaauauuuccuuauacaauucuuucugggucuuaccaucuccccaccccugauaaauaauacccacuaaaaauucagaguuccauccuuuauaaaaugucuuguauauguauauguuuaaauauauguauauauauauauauauauauauauauauauauauauggaaauacaaaguacuagaacuuucuaacuuagcaaaagacucaauauuuagcuuuacugguguauaaauuaagacuuuuuaaacuauauauacuugaauuggugagauggcucaguggugaggcaugugcuuuacaagccugacauccugaguugaagucccagaacccaccaaagguaggaaagaaaggcuccucaaggcuguccucuaauccccacaaguccaucauggcaugaugcgcauguauauguauaugcauauguacacacacacaaacacacacacaaacacacacguacacuaaaaagguuagaugucuccagggccuggaggaauugaucuagaagccucuuuacugaggacuaguccuccagcugccaagggagaaaagcaaucauaguuuuaccucacugugaaggcuauaaaccacaacaaugacaaaugugauguucccacuagugaaauaguggcacuuaugucuuggagguaacuaagagcugucuaguugaauuuaagggccacuuaauaagagggaauucaugcugcguacuguaaacauagccaaauacccauggcuagagaggucaauagaaccuagaguggaaccuauuucugccacuuacacaaaccaauauaauuuguaaauauuuucuaaauacuuauccuuauuucuacagaggagcagagcucuuccucaucaaagaagcuucucuucacaguacacagagauuauuacaaaggucuacaccuggucaaaauacagagcacaacagaucauggaguacccaaccccaacugauauauuuacaacucagucucuaugccugaggcucgaggaaauuguggaagaggaaguguagaaagaucauaugggacugagaaucgggauaucuguugugagauuguauccucuggacaugacaaggaagguacacccaggaaauuucaacaaugugguugccuaaccaagaccagcauagugacaauaccaguugacaugccagcuuagaugaggcagaucucacaagaccccacaccuaaaugaagaguuagaggcaaucaggagcuucugagaaagggauuguuuuuucccagggauuagcccccaugauggguuagccaaaugaucagcccauagcagucacaaaagcaacacuagauggagucaacaggcguguguaucugcauaaugauaauaaagaagagauuauuaauuuaagaaguaaaaaaggaggagugaugaaaauaauguaaugccauacuaauguaugauauuuucaaaacaaagauuuagauaaaaauaucaugagucuauaugugugcaauuuguguauguguucaugugugcgaauguauacauguauacaugugccauggcacauuugugcagaguagagaacagacagccuuauguauuuuuccuuaccuucaaccuugcuugagacaucuuuuggggcuuugccacuguguguaccaggcuaacaaccccuggaacuugucaggcaucuccugucuuugccucccaucugggauuacagaugcaugcuaccacacuuggcuuuaccugggucccaggguuucaaacucagauccucacacuugcacagccaguacuuugcuaagggagccaucuccccagccguugguuuauuauugcuaaaugauaguccauuaucuggcuuauuguauauuugagaaaaaaauacucaauaaaauaaaaccacauaaugaaauuuagcaaaaaccauacaaaacuauucugauaacacccaauuauuuuuugcaaaccugacacuucauuucuuucuaaaugguauuuauuauagucaucacuuucuaauaugaugucaauguccacuggauauaaaaugauaugugucuugucugugucauccaauaugguuuagauuaaacaaccauauuuagcugaccucuacuuauaugcaacucaaugaugcacaugauauaguaauuguguuggugcuacggcucaacagauaggagcacuugcuuccaagucugauggacugaguuuugucccuagggcccacagaguggaaggagaggguugacugccucuugauguccacugaguuacacacacacacacacacacacacacacacacgaaaugggaguauaaauguaagacaccaugguaauggucauaaucuagcaaauggaacuuucugcacaaagaucacuguugacaagggacguccaagucaaacauuuucaauguuuaaaugaaagaggcugaagcuugguuccaauuuucucuacaagcuugaaugaacacuaacacugaccuguugcuagguauugugcagcacuaauggccaucacauggacaacgcuaaacagguucuugcuuuuuagaacuucacaguguggacacagguagagaucucaaugauauccuuuauuuuuauguuuaaguuaauuuucaauuuagcaugcaacauaauggguuucauugggccuuuuguuucuuuuuuaaaagaaucauuuauuuauuuuauguauaugagugcacuguagcugucuucagacacaccagaagagggcaucaaaccccuuuuuagaugcuugugagcuacaaugugguuccugggaauugaacucuggaccucugaaagagcagucaaugcucgaaguugcugagccaucucuccaacccucauuuggcccuuuucauauuuguauaucauuauucuuuguucuaauuugucccuaucuccaucuucccaaucuaucucccugcccuacuucuuuuaaaaccauuuuuauuaacucuuugagaauuucauccaauguauuuuggccauacucccuccccacuccuccucagaacucuucauagguccaucuguaccucccuauuccacaacuuuauguucucuuucuaaaaacaauaacccacugaguccaguuugugcuucauauauacucauggguaggagacaucugccaaaugugguuaacuugcacccuuaaaaauaaugacuccucucuguagaagcugccaccugucaauagcucuucaguuaaggguuggaccucuagagcacacugcucgcccaccugccaugcugggauguugacugacugaccugauuuuguucaggcagccacaacugcugugucccauccuguccagaaaacaggguuucacuccaguccucccuggccucugccucuuagcaucuuucugccacuuuuuuccucagugguugcccacccugcccagaucugagcuccuagcagggaggcaauguagaugucucuuuuguggcucugcaguacaccaguauaccgacauuuauuuucugcacuuuggccaguuauaagcuucuauguuagccacugucaacugcauaaauaaauuucucugaugcugucugagaguuucaccaaccuauggguauagagauaugaauuucaacuugcccuacuuuuccuggaccacuucccuuaaaugcccccuuuugcuuucuugucauaugcauuucauuauccucuccuuuucucuucuaucuuauccuuuaagcuauuuuccuccuaugccacaguccccuuuuuaguucguucucucucucucuuaaaucuggguuucacauaugagagaaaaaaauguuccuuauugauaaucaucuacacaccagguuuuuugcaccuguaacuucccuaagacuuugaaauguagcuguugaaaucuuauucuuucagauaaggaaaggaagaaaaagauuuuuaaaaccaaguggugauagggcuggagagaugccucagcuguuaagagcacugacugcucuaccaaaggaucuggguucgauucucagcacucacaugguggcucacaacuguguuuaacuccagcuccagaagaccugauccuuucauccaggcagacaugcagacaaaacacuaaaugcacauaaaauaaaaaugaauguguuacuuaaacaaacaaaaccaaaguaaagugacaagguagcaaagucaggguucccaucuaggcugugacagaaaaacgaaugggacaaaacagccccagcucuuuccagucuuuccugguaacauuucaccuaugugguguaagugucacuuacugugggauaguuaaugaucuuccuuagccuucagagcaucacuaaauaucacuccauuuuguuucugucccugguccuggagccaccugucuuuucauucugccaaaaccaucaucaguuuuuacugcacuuaauguguuugcauguuuaucuaccugcuugacaauaagauaagagcucauauccagccugagagaugucagucuagcuauuuacucagcagaaccucaaacauaccgcucaguaaagacgugauuggauuauucaugaugagaugugcucuuuaccugaaaaguaauaguggcucuuauuugguccuuuaugauaauaugcaauauauuauuaaagguagacuacuaacaucacuucuuagucuuauuuugacccccaggaggaggaugcauuagucagaguaaauauggcuugaugcugugugcuuuuuuuguuuguuuguuuguuuguuuguuuguuuccaagacagcauuucucuguguagcccuggcuguccugcacucacucuguagaccaggcuggccuugaacucauagauauucaccugccucugccuccugaaugaugggacuaaagacaugcacugccacaccuggcuugcugugcgcuccuuacacauacacacaguccuaaggauguucccuaccaggaggauuuuucuaaacaucucuccuucaaguggaaaacuauuuuccuuacaauccaugugacuaguaaauuuagcccuacugaaaacuacacuugagagacaaagagagaaacuaguugugaugggcugucugacaaugugcuacagaugauguauaucauuuauguucauaugucacugggcaaaagaugcccccaauauuccuccucgaaaugaaaggaauuugguuauguugcuuggcugugugaccaggauagaacuaguuguccaugagccuacuugucggcgccuuaaguaacuuuuucuguuucaucuguacacuuggauuagauccuucaggucugaauuccuucuaagccuucauauugcucuguacuucccaauaagaagagggacuucacugaguauaguacugaaggauccucaggcaggcagugagugaugcugauauauucaaggccacuacaagugagcucugucaauauagggaaggcacgaguuucucuugguuucuuucuguuugagcacuuuuuauauuuguuuguuuguuuguuuuuugcaacaugugacuaaguaauuuuuacuucaaacuugauuauaaggaaguucauaauagaaagcauuuguguguuuauuguuguguuugauucacgucugguuguacccuagaaaucccacucuggagaaccccaugaaaugcauugaaguugucaauccuuuaccuaguaauucaauuauagcagcaucugaaaacuugauucuccaggguuaauuuuuaacguucucacaggcuuuaaaguucacacauucuugcuaucucaauguuuccacuuuucauauuugcauucaauuggcuucucuucaacagagucccugcacucacacaguggucuguacuaauaggcuauauucuuucaaaacuuucuuuuuuaaauuaaugagcaagaacuaugauuuuauagcuuuauauaaucauuauggggucugggaaaugagaguuauuaugaaauacuucacaguugauugauuuuguauuauaauacugguaggaaaauuauccuaucccacuuugagcucauacaggaagcaucuuccuaaguaacauaugugugagcuguauauagcaagugcuguucaaacucuuaugacuuugcggcuagauaaccauuuaaugguucauuuccauucuagguagcccauuucuuacuuuuucuuauuuaaggaauaucuuccaacauuuggguaauuuuuuaaagccacuaucaagguaucuguuguauaugcucuaucugcauuacacauacaugccaaaagggugggggggggggcgcgagaucacauuauagauggugagccaccaugugaaugcuggaaauugaacucaggaccuuuggaagaacagccagugcucuuaaccaccaagccaucucuccagcccgcacacguuuuuuuaaaauucauuuuuaauuagaauauuauauaacccucuaugcuuugagauucccucucaaacucauggccuuuuuuucuuucauuaucauuauguauucauuaguaaauauauaagugcaaccugcugaguacauuuaguauuacuugcuuguguaugauguuagggcugaccacuugguacucgguaaccaacaauucugauucauaugugaaacuacccugcuggguccagaaaacacuauuuucugguagugaucgacacuuccgccucuuacaauggagacccacaacuggucaaagugcagagaauaacagacuacagagugcucaggccuaaaugggacaccuauauuauacuuuucuucccagaguuuggaugauuguguaagacagggugaagagauucuaggagccagagaaagaaagaaaggaagggacagaaggagggaggaagguaggaaagcuuuuuuaaccugcaauuaaaacauuuauauccuauuuuuaaaauguuuacauuacuacuuaaaauauuuuuguuuuuaauccuccacaaguauuucauuuaccuuaagguuaauuauauuuacaauuuauaagauaaucauuuucaagagaaauguuaguccauuuauaccuuaaaauuugcauuaucugaaagugcauauaugucacacuguuagauauaucuucaauccacagucacauuagugaggucacaauaguaaaaacuuauuuaacucuuggauagaacuguaaauguaacaggaaguauacuuuuuggcaggggucuauuggauaguuuucuaacucaaugucauucuuagaaaucuuacuuuauuccaaagcuugcuguguaaaauuaucacaaugugauguuaaagugauguuuguucaucaccauguuaucucaguuggggcaguuauugggagcauuugcaaaugauacaaaauaugguguuauaguuuagugguaaggaauacagucucagacuauaccuuuagaucuuuguuuauacuacucuaggcuuauaaauucacuuauuauuaauaaauuuugcacaauuauuuaugcuuuucuacuuacaagauuuuguggucuguaagcaucauagauuuauuuuuuccuuucuaaauuuaaucccacucccuauuuuucuuaucugauugaucugccuaguacuuccauuacaauguuagcaucauggaccuuuuuuuguuccuaguguuaagguaaaugauauuaguuuuucaauucugaguaugaugcuguauuucuacugacagauuuaucauacagaguuugaguucucuaaaugguuugauaaaguucagccaggaagauaugugcaugccuggaauuccagcaccugagcagcagaggaucuugaauuccauacuagccugggcuacauagagaaggccugucugaaaaauaaaauuugaacauuuuaacagugaagaaaaaugauuccugguuuguguuucugaaugcuaacucaaucuccucauuauagguauacuuagaugcuacaugucuucuuuuuaaaacucaauucauuccuagaaauuuauucauuuaaaugaguaauguuaguaaaaacauugucugaaauugagggaguauguggugaaucauaauaacgauucuccuuuaaucaauguuauuucuguaauaccaguaauaauauccuaaauuuuuauuuuaguacauuuauuaacucuuguuaauuuucuccaucuuuaaagaaauaaacuuggcauuuauuguaaugucuuacuauuauccauuuuaucuaacuccgcucuaauguuuacuauuuucuucuucaugcuagcuuugguuuuaguuagauuuuaucuuuaggauuucuugaggugcaguacuagguuauuuugaaaacauucugguauauaauauauuauauuauaauauuauaauauauuuuaauaugauauaauguaauauauuauauaagccauauauaauauauauuaaauauacuauauauuuuccacuaacauugccccacugcaucucaggagguuuaauauguuguguuuucauuuucauucaucucuaagugcccuaguuaauuuucuaacaguaugaugagacauuauaucuaaggcaacauacagaaaaguuuauuuggagcuuauaguuucagcagguuaguugaguccaugaccaucauggcaguaaacaaacaaacaaaaauacaggaaggcaugguacuggagcaguagcugaggguuuacauauuaauccacaaaugggagacagggagaccuaacugggaauggcaugagcuuuugaaacuuaaaaguguaugccccagugacucaccucuuccaacaaggccacaccuccugauccuuuccaaacaauuccaacaacuaaggaucaaguauuaaaaauaugugagcuuaugggggucauucucauucagacuagcacagaaguaauuuuucauuuuuauugugauuuccauuuuugauuucuugacuauuuaagaguuuguuugaguuccacauauuggcaaaguuucuagcuuucuucccaugaugaguauccaacuuuauaaaagauaccaugugcauuucuaaucuuucuaaacuuauugagauuuauuuagugaccuagaaguuuaucccagagaauguuacauaccuaugaaguguaguuauuuauaauuuugcucaaguccucugucauauuuaaaucauaaguacuuacugcauuucugucuuuuuucucuuguguccugucaguuacugcuuagaauuucagggauguuuuguuugaugaauauagauuugugauuguuauaccaucuugaugaauuaaucacuuuuuagcauaugaaaucuucuguuuccuguaaauuacuuuaacuuaaauuuuauuuucucugauguuaguauggugauccaacucuuuuugugugugucuuuuuuuaaguuuauauuuauuauuuauuauauguauuuguguaugucugugugugugcucauguauaugcagaugcccagggaggugaguagaguucauuggcuccagugaagcuagaguuauagacaauagugaggugcacaauguagaugcacaauguagacaaacuccaugccuuagaaagaauaguuagugcucuuaaguccugagccaucucuccuacccaaaacccaaaguggcuucuuaauuuaaaaaaauuaaaaauuauaugugugcguguuccuuuggauugaaaucagauugucaggcuuaauagcuggugccuuuauaugauaagacaccuugauggcuccuguguguaaauauauuuuuucauaauuccuguuauaaaugcuuuccuugguguuuauguuuuauccuugugccacuuugagccccuuuucauuucuuuuguguacauuauucaguuacucucuuugugguuaucauaauuacuccaaccuugcuuaaauaacacauaacccuauuccuauauaguguugcuucauuaacuguuacacauaugugugugauuaugauuugccuucuuugcaugguuuauuugacauaauauuuucuguuuucauccauguucucacaaaagaugaaauuccauccuuuuauucuggaauacuaucccauuguuuauguauacuacauuuuaugauccauucauuauucuuuauuauuugauaggcacuuaaguuuugggcuaaaguaggcugccauaaauuuaggagugcggauguauauuucacuuuauuuuauuuuucaucaaauuucuucucuuaugauuuugcacauguacacaaugcauauauugcuuacuaacuaacugaccacuuucuuuccccacuuccuuuucaacucucaaccauucaucuucuccacaaaucucucucacaauuucucacaauucaagaaucucucucucucucucucucucucucucucucucucucucucucucuuuucuugcugagauuaaucagagcugucuuugugaccauggguuuucgcuauccaucggaacucaauaaacucaguaguggguacauuuauuaguuacuuuuauuuugaugugagaagacacugugacaaaaagugaguuaugggagaaagaguucaguuuuguuuauggucccagagggauaaggauccaggagggcacaucaucagaagcagaaagcugagagaucacaucucaaccagaagcaugaagcagagagagugaacugugagcaggacaaggcuuucauuucucaaagcccaucaaccugcccccucccccccccagcccugugacauccuccagcaaggccacauauccaaaaccuccccacaaauaaugucaccauggaacacacagaguucaaaugucuuagccuaugggagacauuucucauucaaacuaccacagaacacaaguaaagauaauuauuuccccaucccagaaacuauuacuagccaauaguucagagauaaagggagggccccaugaacacuugcaucuuauuugacuaauuguugauagugcuugcccagugcaggaaaucaauguugugaaucaauggcugcaaugagucuagagaaaggagcuuuguagcaucuucuggaaaugagauuuuuuugaagaccuuuggaaauuuuacauguggguuacauguaaucuuauaacauccacuacauaggacuggaaagauguuccuauaacaauuucugaaauguucagguuaaucaugcagacaucuuguaaucuagccccucacaaaaggaaugaaauccaguccagaucagacaaaagcauuuuaguucagcaaucaacauuuaggaagcuuuaagacaugugaugaugauuaguuuggauaaaauuucugaaacaugaagagaauagucaaugaauuuuaaagacuaaauuaauguuguuuauagagaacuuauaaauaaaaaccaacucacaaucuauacaugucagugaacuucuguauagugagaauugucauugugaaguuauggaguuucaguaacaauuacacuuucacuacuaguuacauuuuaugcacuuaucuaccugccacaaagaaaccaugacagaguuaaaacuguauauacaauuaacuuuauauccuguuucacaacucagguuuuucuuuaccugcaaacugucuguacuuaccaccuaauauuuauccucucuuaaucuccuuucuacauacauaaacauuguacccacauguacauuuguuuaugugcacaugaacacacacacauacacacauauacacauuguaggcuaggauucccauauaaggaagacuaugcaggcuuuguuauuuugaaauuguaugaccuugcucaauauuauauauuuagaguccauuccuuucccugcaaacuuuauauuuaauuuuucucuauagcugacuauuccauuauauauauauauauauauauauauauauauauauauauauauauaugccauguuuucauuauuuauucaucugcugaugaacaauuacauugguuccauuucuuugcuauagugaauaaagcagcaauaaacauaaaggugaaaguaucgugcccaggagugcaauaucugggucauaugguaauucucuuuuaauuuuaggggggccuccaaacucauuccauaacaccuuugucaauuggaacugccaccagcagugaauaauggguuuauuggguuuuaaaaacaguuucuccagcauuuucuuggucagauuuaucuuuuaaaugauuaucuccaauuuauuuaaauuuuuccauuauuuuuauuucuuuuucuuuauuauccuuacauguauacuuccauauaaacugccaaucaacaaacaagcuaaugaguugaauacacaguuuuuuaaaaucccacaaauggccaauauuugaaaguguucaguaucccuagccaucagggaaauguaaauuaaaacuacuuuccaauaccaccucaccccagucaaaaaccuaauuaaagucccaagugguuagaaaggagauauagagagcauuauauaaauacagccuugggcuggagagauggcucugcagguaacaacacgggcuguucuuccagaggaccgaggcucaguucccagcauccacaucauggcucacaaauaucuguaagaccaguucuucuuuuagccuucacagguacuaggcauguacagggcacacagaauacauguaggcaaacacccagaacacauaaaaugaagaaauaaaaauguauaaacacagccagcuguguccaucaaaugcuguuuguauguauauauauuuuaggguggaccaugugguauugaauaaccaguuaggagcucauuucuagggaaaccagauucuuucucccccagaagacauaauuuuuuuguaacuuuucaugaaggccuuguaauauuucccccauccaugcuggcaugucaacuaacagugucacugucuggguuuuauuuaaacagacauaaaauaauaggauuccuauguuuuauuucuucaaauacacuuauuauuuaccccuccuccuucuacuccaucuauauugcccucucuuuuuccacccccaauuaaagccuaccccaccuccauuucccccuuuauagcaacagucucuuauuauuucccucucuagacccacuucuuucccugacuccuuggucccuuaaccuuauaggccaaugaacaagaaccacaaugcauuuuggucuccuacaggaaaaauucagaggcucaugugaagacaaaauggugacacccugcuucugcuucacgcgcugacaugugcauuucuagagauugugcaugagagugagccaggaaauuaggagauccgagcaaggagccuuguaucacccccacccccacccccagcccaagagguggcaauuucuguguagaccacaucuagucaggcccaccagcugccaaguacaaacuccuauggauguuuauagcaaagagggcaugagcagcuggugucugucagggacagcacuaugcuugccuuuuaguugcuagggaggggggggggaagggagagagagagggagggagagagggugggggagaaguaaguacucagugcaugguugaaaggacuguuugcucuagggccuucguuccgcuccuguggcuuucccauuuccugagggggcuacaaaagucccauccauagggaaaaauaccaauaauauaaguuaauggaaagucaagcuuccaaacacgguuugcugagguggugaugagcaucaaccuacccacaggaugcauucaaaucuccuuuuugcaugcuuuguuauuugacucgauaggaacuugggaggcauucuuuuaauuagauauuuucuucauuuauauaucaaaugcuauccccaaagccccuuauacccucccccugcccugcuccccaacccacccacucccacuuccuggcccuggcauuccccuguacuggggcauaugaucuuugcaauaccaagggccucuccuccuauugauguccgauuaggccauccucugcuacauaugcagcuagagacacagcucugggguguacugguuaguucauauuguugauccuccuauaggguugcagaccccuuuagcuccuuggguacuuucuuuaacaaaguaaauguacuguauauguaagugaaaacuguuaaauauguacuuaguuuguucuacuuaaauuaguuaaugaaaaagagaaaaaauaaauguggugacucaaaagucacacucucugauaguguucccugcucccucggacucuuacuucccuacauccacaaaaugcucuuauguauauuccuuaucauuaaguuuugauucaucuagugguuuuggauguaccuguuuauguaguuuuaguagcauuguguuguuuuauauacacagagcauagccuaucauaagauuuuauuaauggaagucauguaaaaucuuccugcccuuugcauuacuuaauucuccuugauuauaaagucaucaucacaauauuuccucuaaacacauuuagaagacaucagcuggcacuguaauucuuguuucaaucauuaaauauaacagagguaauucgagaaggguucuaugggguuaaucauauuucuguuuguugugcuuauaguuacuuuccuuuuuuuuuaaaaaaaggauguuccuuugucuccuguuuuaucacuucuuuuguguguaugaaacuuguuaucaugccuuuuuaaaaaaaugugcaucugccugucugucagucuccucucucucucucucucucucucucucucucucucucucucucucucuguguguguguguguguauguguguguguguguguguguguguguguguguguguguacacguguuccauggcacauaagugguggucagagaacaauuuccaggagucaauucuuucuguccauuauguggcuaccggggauugaacuugggucuucaggcuugauggcaagcaccucuccucacugagccaugcugcagaccuuuggacauucuuuuaggguagaggcauuagugaauaauuaauuuaauaauaacaacaauaacaacaacaacaacaacaauaauaauuuucuuaguuuucuuucuucuaaugcuucccuuaauaucugaaaaaugcuugugucagauaugaguuucugaguuugccuuugaacauaauaccauaauuuuuuuccugacuucuuuguauucaguugaaaauagcugcugucacugaaucagcuuuucuguuuaagugguguuuugugugcuuaagauauuuuugucugguuuucagauauuugacuaugaguguaauucuuuggguuuauuuuuauauuggauuguaauugaguacaggggcuuaugaccccucucaaauuugaggaauuaucagccauugcuuuucagagccccauucuuugucuauuuccaugguccuauaguuuucugaagauuuuuuuuuaauuucagucauguuaccucuguuguucagaugaauaucuauucauuuaucuccaguuucaagaaaucguuuuccucucuccauucugcucuuacaguguguuauucuacuuguaauuucaguuucugguuugcaacuugccuuugcuggagagaauggagccacuguuuuucagugauauuuuucuuaagaaaagcaauuacuauuuaaaagaauuauguuacccuuuccuuuuccagguuccuuggcaagaguaagcaaauguuuagaugacucuauuaucuucauaaguugacuuuuaugaguuguuacuuuuucuaggacccaggcuuggauauauuacacaaaaaagauaccuauagaauuaacaacuauguuauucccuaugauuuaagagcaucugcucuucuucuuuucuguaccuuucauaguauuauuugcuuugcacacacuaucuggggauuuguuauaguuauauauaaauagcaagaauauaaauauaugucuuuauauuacuuucucaaaaaucaaaguuagguaauuuuuaugcuuagaauuuugggggaaaaguaucaagucuaugguaauagaaacacuguggaauauaaaaacuguuaagaacuuaaaauugaaaggcuaaagcuguguguagauuaucugcuggguaaaaaaagucauuuacauucaccaucaucaacuuuaggucuuuccccauguucuucucaccuucauaauaacagggcugccaccucuuuuauagugucaaacaagcagggagaagucaguccuucaucuaauuaauaaggcaagccuuccucauuugcagaacacaugccauaugcuauucuuguauagauugggauccucauuuuuaccucucucucucucucucucucucucucucucucucucucucucucucucacacacacacacacacacacacacacacacacacacacagacagauaccuaacaaguaagccuucccucuucaaagcuauuuggcuuccuucaauaccacaaaauauggcuaaccuagcuugugauuuuuauaguaagugcuaaauggaauauaucggaauagaauuagcuauaucagaacuggauuuuuccacacaaaaaaguguaaaguacugauagaguuuugccaagauuucauaggaguacauaaaaaagaaguuuuacuuggggaaagaggaaagacuggaagacuagcagcuaaaaagacuuaagaaagaagaaguguauccaaguuagcaucuauugugaaauucuaguggaguaagcucgcuaauacuuugaaauuuuuaguaaaauucaaauagcccacacaauuugcaagugauuuuucaaucauuuuauuucaaccauuuuaucaaagauuuauuuauuuauuuauuuauuuauuuauuguaaaugagugcacugucuucauguacaccagaagagaacaucagauccuguuacagauggcuguaagcaccacguaguugcugggaauugaacucagaaugucuagaagaacaaccagugcucuuaacagcugagcucucuccagccccuuauucaaucuuguucuuauaauauauauauuuuuauauuuagcauuuccccaaaaguauaauaaauaaguauauuuagcuuuccuccacaagacagucuccacagugaaugucacagccaguaaauuggaggcaacagugcaaacuauggagagaaaauggagcaagaaaauugaaacguuuaaaaacaacuaaacagaaauaccuuaaacaaagaagguagccaaccaaaaggcaucauuaacaaauaagaccauaaagaagaauguauuucagggauggaggaaauaaguauaaggacucuggcucucccagugucagagaauacuacgagacuaggccucugguuucuucaggaccagugaacucugagagaccaggccucuggcuccaguagaaucagagagaaaaggaugaccaggccucuggcuuuugcaagcccagagagaaccugaguuucaugucucugacuucugugggaccagaaagcauuaagugaccaagccucuuacuucuacaagacucagagcaucauauguccagauaucugacuucuuugggaccagaaagcaccuugcaacaagguuuccaucucagugagcucagagcucaaugcagaaucuaagcuuugcccucuuccuugugccuaggguuuccuaagggacuggggcuauaguuccaguaaucagugugaaugugaguuucugacuucugagauuccaguggucauuucaggauccagagucuauauaacucaaugcucgugacuccacucauagcccccugauacuagacagaccuuagugggccugagguguaguauuuucuccacagcaagcucacagauuccugugaacagccaaagggcagcccuauucuuuguccuauuguuacacuggcaagacaggauaaccucagugacuccauuggacauuccacagcaaauuucaccaguuucaguagcugaacuucaggcagauauaccucuaggacaaaucccagaaaacaaaguauccaaauaggcuuggacaagguaaagauuaaacugaaaaaacaaacucacuauaacaggcacaaaauacagcaaggaauauaacacaaccaccaauuacgaccuaauaccaaccaacccugcucuguuaggaaauccaaaguuucagagguagcaaaaguaucugagaaagauuucagucuuauauuuaaauagaauucaucaucauguagaagauccaaacaaacagaugcaugaauuauggaaauccacccaaggccuccacaagacagucugcacagugaaugucacagucaguaaauuggaggcaacagcgcaaauuauggagagaaaaugcagcaagacaauugaaacauuuaaaaacaaccaaacagaaauacuugaaacaaagaagguagccaaucaaauggcaucauuaacaaauaagaccauaaagaagaauguauuucaaggauggaggaaauuuuugagauaauacauagagaccuauacaaagggaaaaguaaggagugugagcaaugcgucuaagaagccuggaauacauucaagagguuaaauaugaaaacuaaugguauagaagaaagaacagagguaaaaucaaaugcaauagacagccaacauauacaauuauagcagaacauuuuucaaacuuaaagaauaaaggagacacccaaagacaaggaauauagcgagcugcaaacaaacgugaucagagaagaaacuccuuaggacagaucacagacaaaaugcuuuuagaaauuuagauccccuugauccucucagccacuauuccuggugagaauccaggguccccuucagcaauuucucccagcccaucuccagucuucuauaaccccuccaccaaccacagaacuccaccagggaucccauagccaccacacuuggcugggacugagaugagcuaucuguguucuccuuccccuccuccauucuggucucucuaggguaucccuauuccaguugcuacugcaugucucaaccuaucucgauuccuuugggacuccagccauagcuggcauacaccuacuucugugucugcugcccuucauggaacuggacccugaguccuauuuaagagaccucuaggguuaucucccuuccccugccuguuaguuuaccacacucccaacucaccacaucugucugaaacugcuuagaaguaugaaaccugaaacccagaguuucagccacaagucuaaaaaccaaccaucauucugcuaauccacaacacaucagauugugguaauagcaauugaagaaccaaacaaccauucaacaaauguaaaaagaaaaaaauacaaauguuauaacucuagauacucagaucccauugcaaagacaaaaaaugaacaaucaagacaauaugccugcuccauaaaucagcaccccauuguaacaugcccugagaacaccaauuuagugaaagcaagaaauaaguacuucaaaauagcaaguauggauauguucaaggaccuuaaaggaaauauaaauaaaugccaaaaugaagaccauuaaaacacaguugaaugaaauaaugaagaaaauucaagauaugaaaguagaauuuaacaaagaaauagaaucacuaaagagacucaaacugaaauaaaacucaaaaugaaaaacucagguagucaaacaaaaggcucagagauaagguuucccaaacaguuugaaugaaguaaaagagagauucacaucuugaagauuagguagaagaaaaaauaacccagucaaaauaaauguuaaaccuaaaaugaauccaugcacaaaauauccagaaaauaugcaacccuaagaaaauaucaaacuuacaaauaauagguauggaggaagaagaaacccaagacaaagguacagaaaagaauuuuuaaaauuauuuuauuuauuuacauuucaaauauuguacaccuucucuguacccacuccaggaaccacccccacucccaccccuccuccuccccuuugccucuaagagggugcucccccacucacucccaguucaucucuccagcaucccucuuugcugaggcaucaagccuccacaggacccagagucuccccucccacugauaccagauaaggucauccucugcuaaauauguagcaggagccauggacccacccauguguacuuuuuugguuugugguuuagucccugggagcuuuggggguccaauuaauugauguuguuguucuuccuauaggguugcaaucccguucagcuccuucaguccuucccccaacuccuccauuugggguccgcaggcucagugcaaugguuggcugugagcauccgccucugucuuacgugcuggcagaaccucucagaggacaggcauaccaggcuccugucugcaagcacuucuugguaucagcaauagugucaggguuuggugucugcuggugagaugaauccccagguggggcagucucuggauggccuuuccuucuucagucucugcuccacucuuugucccugcauuuccuuuagacaagagcaauucuggguuaauauuuuugagauugguggguggucccaucccuccacugggggccauguuuauauacuggaggaaaucucuucagguugucucucccugcuguuggauauuucagaaaaguuccucaaucuaaagaaaauuaugucuaucgagauauaaggggcuuaagaauggcuuagauagauguucuauaagcucuaugagaccaucacagauacaacaaguccagacuauuacaccuaacaacacuaucaaucacauuaggaguaaaaaaaaaauuucaugguaaaaacaaauuuaagucuucugcugaauucucucaaaccagcaccacuuaaaugugaauaucagacauuuaacacagcagguuucugaaaugaccauagaucuagggccuaagagggagaguggcuagccugguccuuggauccucuuccuccccuggaaaccuacuuccaucucuugaaaccagagauaaaagagagauaaauuacagcugucaacauuuuucuuuaugucugguaucccaucuaagucaaaugaaaggaaauagaacaguuugcaggagagguggaaacaauuugacaggaguauguguauacaaaaaauuuguuucauuugaaauucucuaagcuugguacauuuuaagauguuucaguuguucagguuugucucuuggagcagaaaccacauaagauauaauucuuucugguaugaaauggauuacaugaggcaugaaauacaaaaaaaaaaaauuguugcuuucaaauguuuccuuaaggaagauugaaucugcuaugaacauuaguuucacauagacugaaauaaaccucuaagguuugaucaaccuaaagugugacauacaaaagcaaaagugucagccauugaacaaggguuuaauuucuuucauagcugggauguaguaugcagcugugggugaguaagcacgauuuaaaagcuguugugaacacaagccaacaaguaaaguugaaccacugacuacagccaaguguuaucccacuaguguucccucugggcagagguugccuaguuauaaauuauguagaauccaacacauagaaagacauuuaaccucuacuuaggucauaacuuccucaugugauugguauaaauggauacauagcugccugugacagccuuauuuggaaauuugagauuucaaaagauuguuguucugccaguucgaagguucuuggaacugaguuggugaguuaguaugcaaguaucccuucucccucucugcugucauuuguaauguuugggagaauccuugggauugaaguucugauuacaaauuauuuaacuuggaaguuuguuuuuucauugcaaacccauauaugucaucuugguaccaagaccagggaucacacuccuauuggaagucauacuuacauuuucuuacaaauuaauuaaugaaauauuaacauaauuauauaauagucaaaaaagauauaaauaaaacccauggaaaggcagggaaaagagaaauaaagauaauacaaguuaaaaauauucauauuaaagugauaacauauccccaauuguaauuaaauuaaauagaaaugaaaaauauacuaccgauaagagacaucaugauauuugagaaugaauagcaauuaauuauacaaaagaauucuaucuauagaauggauaacaauauacauuuuaaaaugugaauaaaaaacauaggggcuagugagaugaauuuaauuccuaagacccccaugauauaaagagaaccaugauauaaucuucacacacacacacacacacacacacacaacacacauaugcacacaccuuagcacugaaaaccaagagcacugguagcaaacacaacucuuccgauugacacagucacagagaagaacugugcucucaaaaacuuuagagacuauuccagaaccuuuaagcauaccugguguucaucacuuagcugauaaaauuugguacauuagagcuaaguggauuuggaugggguuuuggacaguaaauugauaauguaguggagagagcacucugagggcuuuaaaugagagugcuuuauaauuuccauuuucuauggaugugaauuuaugaagcuaagcugccccacaaagcuuccagucucugauuauucaggaagauacuaauauagguuuuccugggcagauuuucacaaauguaaauuaaagcuugaaucaguugaucugaaaauuauccaggaaugugugacuaaaucaggacagccauuucaaaguaguuucauugucuuagcagaagaagaauaagugaaagaaaugcuucgcgugaggauucaaagcaugccuguuuggaagauggagaggacccugcacagaaaucggaaagaagucccagaauuaaggaccuucggccaacagcuagagaagaaaaacuccaguccuacuauaugaugggcaauauuccagcugaguuuacgcuuugcucuguguuagugggcuaguaugaucgucaauccucuuugucaacuauuucggauuaaaaagcugcuaggacauuagugaggcaugcauuuggaugugccugugaaggggcuccuggagagaauuaacuaaagcgaaacaguauaccuugaaggugugagucaccaugggagugggcugggggagucuggccugaauuaaaacagggaaaggagaaaggcaaccgaggaccagcacuucuuuucugugucuuuccuuuuucuagacgagauaagcccaugaagagauguaaaaucccaaccacaaaacccuuucugccagauauuuuuucacaguauugagaaaacuaacauacccuuuugaccuaccauuugugaauccugucugauaucagaguggguuggacagucuugaguaguacuuugguccucuugaaaagaaaaacauaauucucaauuuaaaggaauaagagauaguuuauucuggaaccaaauaugaaccuggaaacaaagauucauuuuaccacaaauaccacauuccaauaugguagcaguuucaugauuuuuuuuuuaugguaacagaacaaaguuguaccucaaauacacuuaaaauauauacuuaaauacacuaacauauccaauagacagguuacaguuuguuauaggccucaguggauuucuggugacauucuuaggguuuuguauagcuggagcuagugguuugcucagaguauauuugaaccuuuugauagucagaaagguauuaggucagacauggaguggguaaugaauagcuuucauagaagcgaauaugaacccaaaauaauuugguucuggucugcaacauuuuuaacucuucauaaucaugaagguuggucguuuauagaaucucuagcagguuuaauucuuuguuucuuguuuuguuguuauguuuuguuaucuguuugcugugcuauguuguguuuuucugggaacuugaguucagucccuaguacuggcacauacucaaggguuacaugcacacacugaugugcuuucuuuccuccaagugccugauauuauuguacugaaucccugcaugaguuuggagguaugcagccagcuguauccuagccugugacugagaaaggcuaaaacucaguagcaaaccuacuuccauggcucuaacugaaacaaagguuuucuaguuugucuuuagggucauagauagaugucucuccuaguaagcuccugcaugagcaguccugcucucaaaccacagucaagauauuuaauucuacgucaagauuuguggcaguacugaggucagaagggcagccugugcugguuacugauuaauguggcucccucugggucccuaugugggccagugugucaaacaacaauggagagagguuaggaggagauuaacaccucuuuacaucucuuaugauaccaacguuagaaugucugccccaugggcuaacacaaguauaucuccuagcuuggacuuuaaauagacagaauuuucugagaccaugauugagagggacuugggaugauucgaaaccauuucagaucugcugcguuauuuagauuacugugcguauuaguuacuuuucuaguguugugaugaaacaccacaaccgaggcaucuucuagaagaaaggaguuugggggcuucuaguuagagaggcuuagagucugugauacagaccugaggcagcaggcugcaggcauaguagcuagcacagaagcuaugcuuucacaacccuaaucccaauuaagaagcagagauagagcaccaggaaugcuaugaggcuuuaaacuagugguucucaaccugugaaucaugacccaaaggagauugcauaucagauaauuacauuaugcuuuauaacaguaguaaaauuggucaugaaaucauuuuaugauugagguuggaggagauugccauaacauucaaaccaccacacuaccacagcaagcauguuccagugacagauaguugaaauccccagaagccucuuauagaugcaagguagucuacaaaucaguggaacuggagcccagguuugggccauuuuggaucugcuguagguugaaagaccuuuccuggaaaugaacauggguaugucccuuuuuuguacuuugugcaaacaaaacugaucuuaaauuauagaucagcaagcuagauauuaauuaaaagguaauuccaaaauuuauggccaccacugaacgcauugguacugccuccugaaacagcaauaugcgagacuucuccaaggcuccuuagcaguuaguguuaguagucagaccaaaguaaggcauuuaugagcuuaggucuaggaacacauucucuaagucugccaucuaagucaagguaacaugucuaaaagauuauuuucacucuugcuguucacuguuuuaaaccacccagucauaagaacauucacagcacacauuuacaaagaacauaugguaagccauaaaucaaucucaaugcguuaaaaacaacuuccaucauaaaccaugcuaucucuuaacaaugaaaucaaacugagauuaaaaaagaaaaaugacagaaaaagaggcuggaguuauuaucuaaauucauauaaagcuugccuuauaauacaugaaauuugagguucaauccuuaguaccacaaaagaaaagaaaaaaauuacaugaaaauauuuagccacuuauacauugaacaguacucuuccaaauaacccacugauaaaaagaaguaucaaggaaauauauauauauauauauauauauaucuuuuaaaaauuagacccuuaagucaauauuuaggagaacagaauaaauacaaaucaagaaggagauccaugguaaagaauugaucagaaacugauagaacugaaaauagaaaaugaaagaauaucaaaggaguaaaagacugauaagaucuuuuagaaagaucagugauauggauaaaugucuaacaaggcuugcgggagcuaaaaggacugggaaaggggaggaauugaaggaagucaaguaggaaggagaaagagagagagacuaggaauuugaggaagaguggaaugagggcuuaugggaaagguuaaagggaggaauggaaagggauaaauuauauaauuauauuauaaucucuaaaaauaaaaugagaaagaggggaauggggcacccauugcuaauaguagccuuggagcuauuggcaagugauagcugcuagaagagauucaguuuucccuaagggugucccacauuccaguggaaagucacacguccaagaguauuugggcagcacagauuucuuuugacaggacaaaagacaugaugagugggugagaaugguggaaugaaccuuggaaaagaugaaggagggaggaugaauaugaccaaaacacauuguaugaaacucucgaggaacucauaauguuuuuaaagaggcaguugcuuauagacaugcccacaagccaagccaauguagguaauccaucauugagacucucuuccaaggugucauugggauaaugaaagcuaaugauuacaaaaccccacuaauguggaaaaaaauaacauuauccucagauauuugacaauauagaaugcaccccgugaguucauucauauacucaguaccucuguuaugaagauguuugcuaauuuauauuugugaugaguugagauaaugugacuccaauuaggacauuaaauaaaaggcuuuucagcuguuuggauuuu

SEQ ID NO: 9797 - RNA, 14078 nt, Mus musculus
agguagaaaauuuuauuaauuccagacuguuuugucaacauuuucaaaguaacuaugaugcagaaaugacauuuacaauuacuuuuggaaaugacuuugcugaauuaugcagccuuugcaauuaaacauaaacaguuuuguaucugcuguaauaagccauuaaaaaguaaggucucccuuguugugaucauauuaaauuagcugcuuuuguaugguacacauauuauacucucauugaaugcuuggcaacuaaacacauacuuaacauacuaaguauugguauacauuuaaaaaugaauuaagacaaaagacaaaaacuaucuuuacauuucaugaacuuagugucuacaaaaaaaguaaauuuuaaaauuagaaagccgaaggcugaaacauuuguuauguugguauuuuguuugugcuuuuuagcaaugcacaaauuaugucuauuaguuaacauguaagcacaacuuaaaagcaguuugguuaccuuucuuacaguggcuccugacccuuguguagcugucuuccuagaaugcaucaaacaccugguuaaugcuauucacacugucccccguauaauguuucuucucagcuuaugugcucagcaaauuccuauuuguucuucaaaucuagcucaaaaggcacuucauuuuuaaugcuuuccuguuuccaggaaggaugucucaccauuuccauggcaacuucgcaccucuguuuuaucacagauaaauaucgaugccuuacaaauauguguuugcuuucuaucuuuuaacaccuaagaugaaccuuacaguuccucaaauaacguuuggugaaaaacacaaaugagcaccaaugcauugucaucaaaaagcuuaguguuaauacacaaucaauguaaggacuuucaauauucaaacaaauaacagcugccugcauuugucauugcuggaauuggauagcaauagaacaaagcucuuaagucuaggacuagaaagaaaagugaggcucugaugaauacaaugggucacuucaaaagaagaugcaaaagaugaaugguagaggggcguauuugagucuccauacuuuaaacaucaaacuuaguucacuuuauacacauauaccuucacauggcauaugaagguugcccauauccuggguuuauuucauauucguccuuuauauuucaaguuugcuccaauagauguaacauacucuucuauccuuagauugcuugccaugguuccuaagacuuucugucucuguucaaaguguagaagaauugcagcuguuguauaacuuuccaucauucuacaucuggauuuaaucucugccuccccuguagucaccucugacuacuuaacgguagcuaaagacaggcuuggcgccaaacaggauuacggaugagugaaaguuaauucagcacgguaagcagggcaguguuccagaaagugagcaguugucuuucaaaaaugaaagaggaggcuggggagauggcucagcaguuaaagugccugccaugcaagcaagaggaccugcauucagauccccaaaaccaaacugggugggcaugaggaccugccuacaaucucagccuuggaaugcaugcacagacaggggauccugagagcaagcuggcuagugagacucacaguaucuaugagcucuggguuucacugaaagacccugccucgaagaaugagguggaagagcaauggagggaaaaaucuuaaugucaacuugagccuccacacacaugugcacauguaugcccacauacauacaagcaugcauacacacacuuacacauaccacacauauauaagaaaagaagaaaacauuaaagaugaaagaggaggucuaucagcucugguuggcgcaugcucuguuugaugcucucccuucgagcauaggccaagacacggguguccuccugaaagaaucgguuucccucaucagugagcuuccaaaggaaagagcgagguuuuccaucuggcucaucuucaaggucgacuggcaccuuuucaaagcaggucagggagcagagguuguggcgaaugguguuuuuccagcccucuggugcuguccgaaaauaagggaaauguugucgaguaaaauuguagaucuguugcacauugaggccacaggaagggcugcuuuuuaaugcuagagcaacuagauggcuguaguugaguggagggcguggccaggacuccuucucccggugggggccauggcacacuguguguuucuuggaguauuucuuggaggauguacauuccuguuccuuagucuccucuucuaugaaaucaggggcaguggaguaaaugagcagcuuuuguugcugaugaugcucaguguggagaacagacagggauuguaccauucucugggucccuaaguagucagacucgccagucugugggaauggugcacuuggcagaauuuuaugaaugguauuuggagccuccuugcuguugauggggcacacaauguugggauucacccacauccacaagcuggguucagcgggaggaccaucaucaucaaaauuggauuucuucuucugaggcagugcaggugguuuugucaguuggauuuuauauuuggcgagacucugcucagcgaaagagcacugauccaugguacaaggcaggaaaaauucauuccccaugucccaauccagcaucccagggacuuggccauggagacuguaccagaagucccgauuuuuuaccuuuacauccaucuuuaccgaagugauggaugaagguaaacuuccaaauagauaaaagucucuggaaauuugccaagcuauugcugaggcacuauuuaaugcaaaaugucuccucuccagugcaaucuaucaguaggccugcuggaaaagcugacacgaggacacugauacuucacuggucagagaagccacagcuuucugguacacagcucaaaagaguaacuaagacgaucauuuuauuaggaaaaacugcuuucaaauuuuuccaagucuuuucuuacuguugcucacaaaugauguuuugauagcucugcaagauaacaugguacauagcauuaacccaaagucacagaugugggaauugacauuuauagagucauuggaaccauauaccuaaauaaguaaaggauagcuagauuuacugccuugccguagccuuucacaauccccauggccugcugauuucauucaauauauuuggguauugaaggcacaaacccgacucauagaaaauaacuguaccugcaagaaggcuccccuuguuggauucauacuugugccauuuucaacccuuuucugagaaucagguggccucuacuucuccagcuuaucuucuuagacuauggcuucuaagccauacucuaaagaccacgccaucaaagguuugcuaaaucaugugagaacuuaccuuucauguagguucacauuaaggaaauuugcaagaaguauaaacagggaguugccauuuggccagucuccaaaaacaucuauaaauaauaugauuucacuaaaaccauuauauagggccauagggccauaucacaaagguuccaacaaaugcucaugggaguuacuaaagggcauggauuccuaugcgcucccauuuucuuguauuaauuuucaaaaaauauuguucauacaagcuucuagaaugacuucuuauuguaccacuauaauaguuaauaauaguaugagcagucaauauuuauugaugcucuaaguaugcuacaugguuuaacucuaugccaaaaauuacucuaugaaauagcaaucauucucuacuuauguaguaaaaaauucuaaaaagaaaucacacagcuagauaauggugaagcuacuuucaaagcuaugcagagaaugugccuuuauucacuauaguaauuuguacuguuucuauaucacaauacagaauccaaaucauaauuauuauuuagcaccauugcuucauaauucauauaucagaaauacaaaccugcuaggauuuucacuauauaccugccuaucuucuuccuauguuccuuugaucaagaccugcuuagaaugaccuauaccagaguaccuugguuuagcuaguaucuacucaucuuuuuacauuuaaauuuuagugugugugugugugugugugugugugugagagagagagagagagagagagagagagagagagagagagagagagagagaugggaguugggcaugcaugccauggugugccugcagaggucagaggacaacuuuguggaguugauucucucuuuccaccucuauauacauuccaaggacauaucucaagucaugaaguuugaacagaaaacaccuuccuucacugauuguuuugcuggacuccuacucaucuuuuaagacugaagaaaugcugcuuucaccuccacagaaauggaucucuuucacagugggguaccagccgggagaaagcauuggauagaaccugaaauauuuagauugugccaauuccagacguccuggcaacauuugagcuuucagcagcccauuauucccuaaaggcaggcuguacuguuacagaauguuucucucaucuuuagagaauggagcucaauuguguuuuuaauaaaaccaguucaccacuguguauucaugugcaugcaugcacagguauguauaccugucuguguguguguguguguguguguguaugaaugaaguucagagaaaaaucgacaggaauuaguuccugcccucuggaacucaggucaucggcaccaaguguuuuuuaucuauugagccaucucacuagccugccuuugcugggauuacaggugugagccaccacaccccacuccuuuaauauucaaaagcaucccugugcccugauauugcuuuccauuuaaaggacugguaaaggagauaacugauaaguuuuagguccugaaaaaacauccaaguaaaucucuauguuauuacaaagcuccugaauuguuuaaaaaauaucagagguagcauuuaaagauaagaaaaccaccuucaaagggcuuccauuacuaaauuuuaacuuuugaccacacacauugucaugaauugaaacuauuuuagucaguaaaagacuguguaaaugauuuccaaaacucauggaaagaacaaugcuucaggguacucaagguuuguuacuuuuauauagcaaaauccaugaauauuuaauuuaaauauaugcaaauguacauauauacuuguuuuuaucuguggccaagcaggaaagaauaaaggaaaaguaaugaguuaauaaugaauuguuuaaaaaaaaaacaagaacccuaucagcggcuguuauguaugauuacauagacuguguuaaguucaagggugcccaagaacagaacaugaaaaucuguccacuuuugguuuucaagaccagguaccccaguucugggacugugucaaucugcaggaggugccucuuuauaauucauacacaagagucauuuauucaucaaguaucacaaaucacauacuuguagaaagggacucuuguuucuaauucaugcauagacuaguacccacauaacuaugaacuuguaagaaugacaaacacugauugguacacauaauaaucagguagaaaaaaauccaauagaugaaaacauuuuuuucaagaagagaauaaucaaaauaucuaauccauuauuuauaaauguaugcaaauuaaaaugaaaugcacauaaugaauaugaaaauuugaauaaugcuagaagacuaggaauaguaagaggucaggauaaugggaaucacuaaauauucauauguuaaagaaugcuucaguuuuuauaaaaccaaguaacaaagaagcagcucuaagugauaacaaaugaaacgcugcuauuaaaaggcccccaaccuaccacacucaguucaauaucaauaaguccccaaaguuaguuuuauucuuuuaccuuggcaaguccugggugucuuuucuagauaguugaauaaaaaccugaaaagacaaaaauaaaacaaauaucacauuaaacaaaggaggaaaaguccaagggcaagaauaaagagaaguaaacuaauuccacuguuuguacuuuauaauaggcuuaaaacuaaggcuagggaauaguuuuaguuguuggauuuguguacacuuaauaugcuauacaaauggcuugacuuguaucccaaaaagccacauuaaauuuguaauuacaguuuacagcuuuuagggaauccaauucaucaaauagauagccaauguuuagaaggccagaaaaaguaguuuacaaauaguuuagacaucuggguuaugagcuaucugaauuuaauaaaguugaucaguaaacaaaacacaaauaguaacgaguugcccucaauguacaaaaaccacuggacaccaauaaauaaauaaauaaauaaauaaaccaaaaaacauuuacaaacaguuauucuuucuguuaguuucucuuucuagcaauaugacuaaaguucacuuuccuagaugcuuucucucuaucuauauaccacaacugacuggguuugggacugacaagauggcucaguggcacuugccuacaaauuugaugaccugagucugaacccugagauucccaugauagaaggagagaacugacuccacaaaguugcccuaacaaccuccacacaaaugugugcugaggcacucugaacaccaccaccuccauaaacacagaauaaauaaauauacaagcaaacagcugcaagaaaaucacaacagaauuaaauuuugaacacauuauagguauguuugaagcuaugcauguagcaaacuacaguaggcauugagaauaaaauuauugucauuuuacucuccaacuuauuucugccaugccauacuguuuccucauucauaaugcauaagaaacuuaccccauuuaaucauugauagcaaaugaaauaauauuguuuauucaacaaaugauguuaauuagcuauaccaauacauaauuuuaauguuugacauaugaaguuccauaaauauaagaucuuauuuaugcuuuuuggaagcgaaauauggguuuuuaaauuuuuuuaaaaauucuauuugugugugugugugugugugugcauguaugugcacauguguguggugccugugaaaagacagugauggagucucugggacugucauugcagguaguugguugugagccacucuacauggauccugggaaccaaaccuguguucacugaaagagaagcaaguguuuuuaaccacugggccaucuacccagccugaaaccuagauuucgaaugaugaauguuucauacauaagucauauuggaaaagaaggagaacuuacuuuuacaacuauaugaagaaauuuugacauucuuuuguuguuguuguuuuguuuuauuuuuucgagacaggguuucucuguguagcccuggcuguccuggaacucacuuuguagaccaggcuagucucgaacucagaaaucugccugacucugccucccaagcaccagguuuaaaggcgugcgccaccacugcccggcaaaucuugacauucuuaagaacuuacuuuaaucuuuaauuuugaaggcucuuugaacgcugcaaugugaguucaaaagucucagaaaaaaaauuucuuuuuuuuuucauuccaauacuucaaaaguccugaaaugauggagagacacacuaacuuauuugcaauagcuuuucauuuauaagacacgcugagggcuaauaacuccuuugucucuuacugcuuguuuuccuggguaagcaaagaagacucuauggaacaaaaccaauauuaggucaaauaaaaggcuugucuagacagcuaacaccaggggcaaauuucacauagccagugcaaaaaggcauauaacauuagguacuaaauaacuuguaaaaauagagagaguacauagagugucaggguuuggucuaguacauauuucacaccaugucaucuaccuuguuauucucaagaggacaauucacagcagcauacauaugauaaauguauacauauaaagcagccaauccaauuuggcagagugaugucucauauuuugguaaagcuccuccuauugccuccaaacuuauaaggaauagugagucaaacuacacaagaaagagauacaucauacuagacaauaaaucccacucuaagaaaacaaacaaacaaacaaacaaacucaugauaccagaaacuuugcaaaacugaugaauaaaacugaagguauugacuugcugaccuuuugaauaccaagaaggaauuagaaaugcagauuguggccguaacccagcauccccauccuggcaucuaguguacugaaaacuggagugccagcaaggagcaagcaaaaaauauuuuaggaaaaaaauggaauauguguuagaugcuggucucuguaacagagcacaugugcaaaagaacuuggaaaaagauuuauuuuggccccaacaaccuccaaaauaaaucuuugugccugaguaaugaacucugggaauacuucuggagguauacccuauccuaccaauucucuuuucuuuucuucuuccucuucuucuuccucuuccucuuccucuucuuuguuuuucugggguuuuuuugggggggguuguuguuguuguuguuuucaagacaggguuucucuguauagcccuggcuguccuggaacucauuuuguagaccaggcuggccucgaacucagaaauccaccugccucugccuccugagugcugggauuaaaggcgugcgccaccacacccggcccaauucucuuuucaaaacagcauuuucagugauuaaaaaaaaucauuugcauucuugauguggaaauggguagggucuggccaauuucucagauucccucaagacaucuuucuuauugccacgauguaaaauacuugaguucauuuaaauggcccugagcuuuaaagcagucaccauuuccuuggcuccaacucuacacaggcuucucuuuucuaggaaauaaguuuuucaagucuuuccaaagcccagaugcugaaaugcuguaaaauuucccaugccauauuaguccauugccuuuuaacccagucuuccacaaagucuuaggauauagauaaaaugcagaucaaugcuuugucagauugaaugccccccagucuaguucucaaucaggacuaguugcuauuugaagccucauaaacaguuuucaccuucugggaaccacuucuguuaccuguuauacuccgcuuauacugcuuuauaucuucucuaccccauaucaccaacuuauaaaaguuccucucaaaacugauuccaaaaagaggaaucucaggaaggagagaagggggguuagggguagugggggcuugacugucugacaaaaacagagagugagagcccaagccuggagcccacugcuuuacuccuaauccccaccuuauuccagucucauuucuaguccauaagauggcaugauaccguccauguucagagaaggucuuuguccccuuacucaauccuuucuggaaguucuuuucauagacaguucacaguugaguacuucacuaaucuuuuagaugcuucugaauccaaugaaguuaacaaucaauauuuaauaaucacaggggcauaaacuaaugagugaagguauguaaggauagaaaaucaaguuuuacuuaaaauuagcuugaaaacucaaaucuuaaaauauucaaaaguuauuaauaagagaaccuaacaacuauaccaugaauacauuccccaaaccaugcuauaaagccaucuacuuaggauauucaaauaauuggauguaugaaaauauauacaaagaaaggaacauacagacaaaugagaaggaaugugagaaaugacucagggagauggcaaagggguaaggugccugaugcagagucugaugacccauguucaguccccaggacccacaagauugauaguguuaucuucucccccgccacacacaagccuuuugccccuauugcccuagcauaacuuauagacagaacucuauuauagaucaaagcauuuauagcuggaauuaguguuuacuuuucuccuuugguagacuucagaguaccuuccucuuccaaagaugcugaaacacaggggagaaaguucuauguaggcaccagcuuggcuucucuacguuuaacacauagguguuguuuuuaguaauggggccuugcugucauuuuauggaagguaagcuauagucuuagcaagcuucacuggugacaugagauauccagcggaacucugucucccccauuauuuggcgauuucauuuagauuacccucauguacauauacauuauaggaagcuucuacuguauuagguucccauacuaucccucaaauggcccuuaauuucaguuguuucuucccauauucccaccuuuaucuaccuuuccacuucccucugugcuugauucucccaucccaguacaucccuauccauccauaacuauucuauuucccuuuccuaaagggauauuaucccuauagucccuugauaccuuacuugaacccuuuguagcucuacagauuguaguuagguuuucugggucugagaugccucacucaggaugauuuuccccccuaguuccacccauuuacuuguuaguugcaugaugucguuuuuuaaauggcugaguaauauucauuggguaaauguaccacaucuauccauucuucuauugagggacaucuaaguuguuuccaauuucugccuauuaugaacagagcaguaaagaacuuugaugaacaaaugucucuguaguaggaugaagucucuuuuggguauaugcucaagagugggcuagcuggauuuugagguacaucaacuccuaccuuccugaggaacugucacccugauuuccauagugacuguacauguuugcacucccaccagcaauggauacguuuucuuccccuuauuccaugagcugucacuuguuuuguugaucuuagccauucugacagguguaagauggaaccucauagcuuugaucugcauuucccugauugcuaaggcuguugaaaauuccuuucaguguuucucagcaacuugaauuuuaucuuuugagacuucuguuuagaucuguagacccauuuuguuuguuuucuugaaaugcauuuuuuauuuaacuucuuuauauacuuuagauauuggcucucuaucaaauguguaguuaguaaagauucuuucccauucuguauaaguaccgcgcgcuaaccgauagcgccacuggagccccucuuucccauucuguaggcuggcgcuuugucugaaugauggugucuuuugcugugcaaaggcuuuucaguuucacaaggguccauuuauuaauuguugaucuuagugccugcgcugaugguguucuguuaaggaaauugucuccugugccaaugaguucaaggcuauuccccacuuucucuucuaucagguucaguguaucugguuuauauugaggucugugagccauuuggaguugaguuuuuuacagugugcuaagcauggaucuauuuggauucuucuaaguacaguuacccaguuuaccagaaccauuuguuaaagaugcugucuuuuuuccccacuguguguuucuggcuuuuuuuuuuuaauaaaaaaaaucagguguccaaaggugugucuucaauucaguuccauugaucaaugugucuauuuuuucccaauaccaugcuguuuuuauuacuauaguucuguaguacaacuugaaaucagggguagugauacagccaguaguuguuuuauuguuuaggauuguuuuagcuauccugaguuuuuuuuuguuuuguuuuguuuuguuuugcauuuccauauguaccugaagaucguucuuucaaggucugcgaauaauugaguuggaauuuugauggugauugcauugaaacuguagauuacuuuuaguaaguuggccauuuuuauuguauuaauccgacugauccauaagcauggaagaucuuuccauuuucugauaucuuuucaauuucuuucuucaaagacuugaaguucucaucauacuagucuuucacuugcuuaguuagaguuacaccaaaauguuguauauuuucugaggcuauugugaaaagcgauguuuuccugauuucuuucucagucccuuugucauuuguauauaggagggcaucugauuucugcgaguuuuguauucagguacuuuccuuaaaguguuacaauaggaguuuccugauugagucuuaagggucacuuagguauacugucacaucaucagcaaguaaagacacuuugacuucuuuuccaacuugcauccccuugaucucuuuuaguugucuuacugcucuaagacgucugacuuuuagagacuccauugagaagccgaguguaauucuaacagcucugccuuuauauguuacuuggucuuuuucccccuagcagcuuuuaauagccuuuaucauguacauuuagucuucugaguagaggggggcuuucuuuucuaguccaguguauuugggguuuuguaugcuucuuguaaagcauauaggcauuucuuccuuuaggcuaggaaaaauuuucuuauauuaucuuguugauaacauuugcugugacuuucaucaggaugcuccuccucccucuaguccuauuauucugagauuugguguuguagugucccagauuuccugaauuugugccaggaguuugugauauuuaauauuuucuuuggucaauauaucuauucuuuuuucuauccugucuucaaugccugggauucacucuuucauuucuuguauucuguuggcaaagcuucuuucucagguuccuaaauucaagguccucaauuuuuaauuuccagauuucucaguuuggguuuucuuuauugacucuuuuuuccucauuugggucuugagguguuguuuuagucauuucuuuucgcugcucgguuuucauagauuuuuagaggggauuuauucauuucgucuuuaaagaccucuaucauauucauaaaggcuguuuuaaugucuuuuuccugagcuucagcuauguuggaauauucagagccugcuguggcaggguagcugggcucuaguggagacacacuguccuggcuguuauugagugugugugugugugugugugugugugugugugugugugugugugugugucuguuuucuaggucuaggccccuggaauugggaacaucuuaauucuagaugcugauaucuggucuugucuuucugguucuuaaaaaacugcugugccuguguaggaaauucuccuguggucuugauagauuuggccacuggagcuuccaauuaaaaucuguuucuggguauugggagcugacauguagaaauggagaugggcuagaggaggugaggggggguccacaggagggaggaaaucaggguguacuaccaguaucugcuuaguccccugggacugggggcagagagugaggagaggucacagccgaaggucugcuacagaucuggggaugaaacuggggguuggacuuggaggaauggagggagagguggaggucuggagucagcuuauuuguuucccuggucugaguagccauugaauuccuagggagugccugcagguguugggggcugggacaaaagaaugaauggguggagagguuaggagggcaagaccuggugauccacuggugauggggcagagggggaagggaggcugcagcagguguucugcuacagagcugaggaugugaccaggggguuggauuuggaggaacagggcuagaggugaaguuagccuaccugcuuccuuggccagaguagugggagcauucccagggagugccagcuggagucagacgcugggauaaagcaaugacuggggagagagaauaggaagcgaagaucagugggauccauuggagauggaggcagagggggaagggaagcugcagcagguggucugcugcagaguuggggaugagacugaaggauuggauuucgaggagcagagagagaggugaagaucugcagucagccuaccugcuugccuggcaggaaugaauggccuuuggguucccagggagugccugcuggaguuggggucug

SEQ ID NO: 9798 - RNA, 31998 nt, Mus musculus
cagguucccacgugauccuggccugcaguagcgugguugcggugagguucuugcgcuccugaagggcgggcgcggaaguaagagcauccucaggcggaccgugacuggcagcgaggucgggaggagccaccaggcagugaccgcuuugcuucugcagcuccgcuccgcucauuccguuaucucagccuuugcagucuguacagaagcugaccaaguuaccuuugggucuugagaccuuggcgagugaggcccaaacucgggaccaacuccucauccaccuugcccucccucuccuccaucucuuccuuugcacgcaccgaaucgaaucgcuugcuccuuugggcuggccugcucggcugugccuggagacuaaguucgggucgguaaagguaacugugggaaaagcggccccccaguggacaaaggcggaggcagggauagaucaggccccgcgggcccugggugcugagcguaggcaggugagccagaagaacgguacugcggauuuagaaggcacugugaaggacuuguugcacgauggaagaaucugacuccgagaaaaagacagagaaagagaaugugggcccaaaaguggagccuccucuaggggagccggaaggaucgcuuggguggguaaaggggauuauguugcaccugggagggagggcaugcuaauuguaaagaguauugugagaugcaacaaccucuaaccugcagugaugaauugcuuuaauuuaccaauaugguugauugauaucaugcccuugaugacggaaaacagaauagaaacacccuuugccuggaugugggauuccugguuuaugcguagucuucuaauugagacaguucugaguuguuuucuguuuucuauaaagguuauuugauguuaucaccuuguugaugauaaaaaaggaaaggacagacauuugcugaccaaugacguauagugcgauaugccuauuugagaacugcguuauauguacuuugugccuuuaaugaaugaaauacagcuuggaaggacgauugaagguccaaagaugcuucuagauuugaaaaauacggagaugaauuuaaaaaaaauaguauucagauuaugacaauauuguuugauuuauaaaaguacccagaguguugcuucagcuuuaugacaaaauaucaaaucuugaauuuaaaugguuucuauuccuaaauaugccauccuaggaagcgucucccgagcugaugaaggaaacagggagcauaaacccagcuuuauaauuuaggaaaaugaagacuucugaaaagaggucucauccauacuuagcugcuuuaaagaauauucgucugcaucuuucaguuuacuuguguguccccccccccaccccccgcccccggcaauuagaucacgaaaacaccaucuuuugguuuauaucuacaggugggcaaugccaaaugcagccaugaagaaaaagguaagauguguuagcuacaucaguaacaugaagaaaaagguaagaagcugcaguucagggaaucuggcuuuuucuggauuguggcaagaaucuauggggucuuugagacacucauccccuuauuuacugucagauuuacuuugucuaaaauuaaucucauggagucaagccagauacaaauauuacacagcccucugugugugcacugauucuuuaacccaaaucaaauguuacgugcaauuuuuuuuucuagcuggaauuggauguucuuugcuuugcuuugcacuuuuauugggacuuagacaauaucccuaagacuguagcucaggagcaauauuucuugaccuuuuugggauuuaguaucacuugugaaguacugguaauaaccuucauagggauauuaggaaguuuacaugaauaaacucccuguacaccacaaacauaauuauccucaccauguaagguuaaaaaagcucccauauuuuuagccugacuuuaucuaaaauuuaauucugggccucaaguuugcuaggaggauuuuuuuuuuuugaugaaugucugaaguugcugucaacaaggaugccuaaaaaaaugccagaaauuucuacauaauuaggaggggaaaaguagaagcuuaaggaacugugaaaagagaaagggggcgaacugccauuugcuuuaaugguucugcaaugcacaugcguugaaggaucagccuuuaccuucagaaauagauacaguuauugcuuaauuaauguuuaguuaaucuaguuaauuguuuaguuaauuuguuuugcaaagggcaaggaaaauguucauauaaauuuuagacuaaauaaacaauuaaauuuucuuagguaaaccuggauaucuaaauuguugaauugagccaaugcauauccaguauguuuucacuaaagcuucuuauauuuguaaucagacauuuugauauguuaggauuggagguagaaucugugucucuuucauuugaaaaggaaaguuaacagaacuguaucucauaaacacugugcuuagaaaggacugugaaagucauuuaacucugacuccuuguagugcaagauaauuuggcuuuaacagguguuuuuucuugugucaaauccuuacacaagaaagacaucuguaaagucuugcucucuaccagauaguuguccuugccuuuuuuccucuaauggcuuguucauuucuuuauuuuuuauuuuuuauuuuuauuuuuauuuugguuuuuucgagacaagguuucucuguauagcccuggcuguccuggaacucacucuguagaccaggcuggccucgaacgcagaaaucugccuuccucugccucccaaguguugggauuaaaggcguguggcaccauucuuuugaugagugcauuucaagcuuuuguucccuguuaggcacuggagauaagaaaguacacaaaggauacaaagacucucccucuguccuucaaauguuuccagucuugugagagaguuguugaaaggaaggacuacagagcuuuauggucugcaaugauauaguaguaccacugaggggcaggcaugauaccucucagccuaaaccaaugcuucucaaccuuccuaaugcugugacccuuccucauguuguggugacuccccaaccacaacauuauuuucguugcuacuucauaacugcaauuuucuacugugacaaaucauaauauaaauaucuguguuuuuugaugaucugaagugacccuugugaaaggguuuuuugacucccgaaagggguugcaaccaacagguugaggaaugcuggccuaaggcauuuaggucaaagaaacuuuauggggauuuacuggggauugaacccagguuucacuuauauuagguaagugcccuaguacugagcuacugagcuacauccccagcuccagagaaaauucccgugaugauuguugaaccaaguguugauggauaaguugagacuuaguagaaagaagaauaaaggaugguagagaauauaggaugaauccagacacagagucagggcucccuaaauggcuggaagcaaagagacuguaaaccauucaguuaaauaugaauggaugcuaaaaguuugaggcuaggagaaucaaaagguaaagacagaaguagauaagcuuaaucaagagugguucuuauguguaauuuaaagaggcagaaaccugaaauaaaaauuauagaaauaugcagaagggaugaaaucaugggcugaaguggaaaacagccugaccuugaacagagcaguaggaagaacuuuuuaguuauacuauaugaaaucugcuuguuggagauacacacacacacacacacacacacacacacacacacacuuaccacgcuuguauugcuaagugauguguaacucauagcagguaauugcuugacuuuugagauguccucaacgauuggcugaggaauggcuuaauuacggauauccauacuggucauugguacuugcacaucuguaaaaugccagcuauagaagaggaauggcucccuuuacacuagauuugcuccagcuuugcuaacguuuucccuuacuuuguccuuagguccuguugauggguaaaaguggaucugguaagaccagcaugaggucuauuaucuuugcaaauuauauugccagagacacacgucgucuuggugcaacaaguaagauguuucauccuauuguaaagugaggugacuuggcuguuaauaaucugcauaacacacuugauugcagcagcuugagaaugcacagguugaugaauuugcuuuggagcaugcuuuccuuuuucagaauguauggccuaauucugauuauuauugcucacuauccuggggagcugcuuuccuuucuagguugcuugcaaaguggaauguucucagcuaacuuccuguguauccugcaguuucuuaggcaaagauaggaacccucugccugcuuauuuuguggggagaaugcuuguuuauaacuuuucauacaaagggggaaaaucauagaucuuaacuagacuauauugaaaccuaagaugguuuuaauacaggaguuaguuguugucuuuauuaaaagguaaacuuggagauuguaaggagagguauaccuguucuacacucuguucuuuuucuuuauauaccuaggucuucuccuucaggaaucuacucugaguugggaaauaucuuacugaccuuuauggcuagaauguuaguauagucuuucuugccuacaagggcuaucagagcagugaaauggaagauccugggagugcccuacucugaugcagauugucauuucguucugaagcaucgaagcauuucugaauucugccuuuguucuuggcuucagggugagggcaggcauugcucucccuagccuucagauuacaaucuggguuucuagcauguucaguacuuuuagcaacaaguuaggacuguucaggugcccuaaucugguuucaagaacauuauguuccagacucugggauacgaaggaggaggaggaacauuauugcuauuugggggcuuggagcguaguguagacuucauaacuagagcagcuuuggugagcagaaaacuauuuccuaaacaaaguaccaagucuuucuuuauucuuucuauuaugguucucuucuguucuuuacaaauaucugcaaacacucaauaucuuaauuuaucuuacucauccucugcuucccaaauuuuguuauccuuaccuuaaacaucucugguuccucaugugacauacuuuugaaauguuuuuaaggacuuccucuucuuauaagacuugaaugcagauguggucuaaucagggcagggugggccuacuacaucucugaaucugggcauuacuuugucauuagaauggcaaaauccuaccuucuuguuuuggagcaaccuucauuuuacugaauaauaauuaaagccacaacucuucuuugcauauauuuuauugaagcauacacaucguuguuuuuuguacaguuuauauuuugaguguaauaaugaauccuuauauuagaugguucauguuucuuuuuuaaaauccaagccauuggguugcaguuuucuuguacauaauacaaaggauuuuagcuacuuauucucucauuugauauguuagcuguccuucauaguuauauacaguucuauauuugauaaguaucuaaguaauugucaaaaauauugaucaaggggcuggugagauggcucaguggguaagagcacccgacugcucuucugaagguccggaguucaaaucccagcaaccacaugauggcucacaaccaucuguaacaagaucugacucccucuucuggagugucugaagacagcuacaguguacuuacauauaauaaauaaauaaauaaaucuuaaaaaaaaaguuggucaagauaguuuccuaucuugucauacuuguagcugauaucuagccucuagaaacuguaauuguccaaauguuuuucuuucuuguaccuugauuggauauauucaauuuuuuccucuucuagacuaaauguauagggcuagugucuguguggucucaguaaagaugcuuauuaaacuacuguaacuuuuaugcccucuuucauuuacucuaauuuucaauuaucuuuauagacaaugaaaguauaacuuaaaaauuaaucacauucagccugaaagugucaguauugaaaucacaguuugugcucuucuuuuuauuaugacaaagccugucuacauuacacaacucaucaauuccuggaagaccuuuucuucauacuuuaaauucgauucgcuuuguugaaacaucuuuucuugguaccacugauaccccuguuucuaauuuaccggcagaguugguuuauuacccugaauccaaugaauagucucacagcaagaauuucagaauuacugaaacugcuguaaauacuuuugacauaauccagcagcaucauuaugagcauagugguguaaauuauauaaucauauucacuaaaauaggccauuuauugaacaagugcauaucuggaaguauuucuugucaaauaaugucagagggauaggguuccugccccuaaagauguaguaaguugacugguaagacuugguuaguauuuccugaauuccaucaaagauagcaaaaaauauaaugaaaaauauuggucucaauguuuuagcauaucauuaaugaguuugucacuaaugaagacaggucuguguuuguugcuaaauguguggacuaguacauuacuuuguauucguuaucccuuuugaugcagucaguuacugauuuucuuuaaagguaguaaaaaagaauacuacuuuuaaaauauuguuugccuuuaauguguuaauguuuuccugguuugucauucccgaaaaaagucaaguuuuauuuuguuaaauuuaaagccgccugaacuuugaaauuuuaaguacagaaaugaugauauuauuaauuuacuagguaaauguuaaaaaugugcuuguuuuggaaugguaaauuggucacuaaauugauuaugaaauauuuuagccucaaacacuguugacaacuccaaaauuuccuaucuccucaaaauucuguucucuuggcuuuuuauuuaaugcuuuauuacucuugauuuucuuccuuugcauuuaaucaucccucccugcuuuaaaaaaaugaguuuuucuguauaauguuuucuucuuucugccccauaagugaauaugauuccccaaaguucuguuuuucuuuauucuuuucaguugcucuaaugauaacagagcaggaaaguuauaggagaaccagaggggggcauaccuugaacauaaaauuuagcagggaagcaggaaaugucuuauaagccaagaaaaguugucaaccuaugagagauuuuuuuaaacaaagaaauagcauggucaaaguuacauuuuuaauucaaacuaauacuugugaaagcuucaaauguuauuuaaguauaaaacauucauuuuuauucauugucaagccaacuuucuagagacaaccaccacuaauaauucugggguuauuauucuggccuucuucguaguguacacaaucauggacguguaagucuuuuuaaaagaaugguagaaaauucagcaauuuggagacaucacuguaucuguaaugcggauacagguuggaacgaugcaaggguagaagaaacagguuccacuuauaagccagaggacuuguuuuaacuagacuuccacauugcugguggcuggaucucagaauuuucaagauuuuggaacugugagaaggaaauuucuaucguauuaagaacaacuuuuaagggauggcaggggcuuuauuuggacuggggucguuaguggugguggcuauggcgcaaagcuacagagcugggggggaugcuuaagcagcagagucaacaggacuuucuggggaccuuggagagaauugugaggggaaagaagaaugaaaggaggagagguuuuauauuaggcagcugguuaaauucaccgagauggagaacacugaaaaaggaacagauuugcugggaugaaaggagagaugagcuacauuggauauauugagcugggauauuuacaguacagacauacaguauaugagucagaaaaauaguagagaaauuugcacuaguguugccuaguuaguaucuacaugguaaguguaauauuaugacagguauauugcuuuggggaagacuauuuugagucccuaagaacccuaacauuuaugggacagaaagaagauuaggaacccaugagggagaaacuuccaaagauuucguaacugugaugccagagaccaagagaagaaaauuaauuuucaggaaaagagaguagucaacagugucaugcugcagaaaguaagacaaggacucaaaaguccacuggauuuggcaauggggccaucagucacuugaagagaacuguuucuguaauaugggaauagaaaccagauuucuaucccauaugccccauaucuaaaagucacugaauccugucgcuucuuuuguuauugucuuucccuuucucaguagcacuucuuuccauuuuuuuuuuaguacuagaccguauacauagucuucaaauuaauagcaguuugagcaccuacucucucguagacucuguuggaaauacaaagacauguaagauaugauuccuuuuccaaggagggggaagugaagggggaaaaggaaguaguuugaguaucuacugugugccaggcacuguguguauauagcucuuugaauccucacaacaauccugugaggucaauacugucuguguucuuuuuucacauaaguagaagcuaauucuaaaagcuuucuugacuugccuaagaucauucagagacagaacuguuauauaaacuaaagucuguauggguuccuuucucaugaugguuuguaucuauacauuaugagaagauaaaauuguagaaaaguagauagcaguucguuuagguaacaacuuggagauagacacaggaaauauuacuaugugauugaauuaacaaucacauaaaugauguagaauaaaauugcuagauacugagaaauauuccugauaaacucuuccauuauucuuucuugagguuuuuuagugccuggcagagaguaguugcuuaauaaauauuuaaauuaguuccaagggagagauaaugguaggugggauuuuugucagggaaagagggcuuuuggaggaggugggaauuagucuggguuuuaggauuaacucugaaaggaagaagggggcuuugcagcaaaugacagaaaaggcaauggauacugggagggaacaaaacaccagaggucgcaaacagauagccuguguacuggaugaggccuguggaugcauuuuuuuuuggccuguccauuguuuuagaaaaauuggaaauaguaaucuccuguaaacguuuucauaauaaccuagaauucaggcuacuauuuuaagauguuaaagaucuaguagaccugagccaauaacuuugcauggaaaugaacaagaguugaguaacucucaccuccgugaggccaugguagauguuuauucucagauuuagcaagcuuuuaaugguacagguuugcucacauggccugauuuagcaaguuugcgaccccugagaggaaaauguguuggggacuggggagguaguaggguuggggaauuaugaauaaaaacauacugggcugaagugagaggauuuguuaaugcaauuacuggguagauauaaagguagauuuuuaagccaaaguaugaaggaccuugaguguucccccauuaaacauggaggaaccauugagaguguuuugaacggggagugauauguucaaaguaguguuaagaagaugaaccuugugguagguugauguaaagucaguaagacuuuauaguauaggcaugaggagauaagggccuuccuugauguuaagcgauggauuauaaaauaaagacugaaauuaagagauacuacaaaggacucaaagugaauugaauaugucaggagagucagaaagaaaaaucaccagacacauucacugaagaggaagucaguacaggaguuaauuuuguuauguucuauguuuguuuuauguuugcuuucugucuguuuuguuuggaaguuggcguaagaauguggguuugggaauauuuguuaaaugguguaugucacugucuugcguguuaaauuuuaacauuaauauuauaauuggagauuguuucugcuuuggauacuaaacuacugaaauuuaaaaauuacuuacacaagagccaauuccuuagcauaggguaguauagguacccaccuugccacuaaaccacaugacuaagcuaaaaaaaaucaccuucuuguuauggcuuugagcauuucacuccacuuugguccuucuaaacaccauggguuaguguuuugcuuaucuuuaaugucauguucuuuacuacaaauacuagacuuguaacauuuaucuuccaguugauguagaacauucucauguucgauuucugggaaaccugguuuugaaccugugggauugugguggguaaguacuaugugccuacuuauuugugaagcugauggcaauaaugaugucaucuaguauaaucagcauggcaaauacacauagaaaacuaucauuugcauagaugcacuggcuaaaacauauuucagaauugucagcugauuaauaaagauuuguguuuuguacaacuuagaaaauaccuucuacauaaaacacauuuaaguagcucuaauauaagcuccaccugaauauguauacuauaggauagaucauaaauuagauuucuuuuucagguugacuggcacuaguauugcauucuuagauauuauuuaguauacuagacugugcugaaucuaaaauaguaauucuagguagccuugucacuguagauuggauucugaacauguacuuaccuauuguugguuuauaaccagggcaaucauaaaauuugcacuuauugugccucuguguugaagcaacaguauguaaugcagagugauuaagagcacaaauucuuugucuaggguauauuauucaaacccucugugcugugacuucaccuguacaauagagcaaaguaaccaacccauagauugguuaugcuaauuaaguuaaaaugcacaaaauauacauuauagugucuuacaaaauaguuguugccaggcggugguggcacacaccuuuaauccuagcacuugggaggcagagacaggaggauuucugaguucgaggccagucuggucuacagagugaguuccaggacagccagggcuauacagagaaacccugucucggaaaaaaaaaaaaauagauguuguugucugguaaguauaucccaguuccacacauacaaaagaugcucagugagugguuuugaaaaaaauaauaaauaacuaagugguauuaagaaaauaauuuguucuugauagcagcuggguuaacauuuuggcuaaaaaucuucccuuguuguaauugcuuccaauucucuagucuaugucaacagauuuacccaaguuccuuguuguuagauacuauaauaugaaauucaauuuuguagaucaaguaucuauacuuuggggaaaauaugauucuuccaagguuacauagcuguauuuagcaagaugcagaauuagaaauuuguaaauaccacuccauaugcaccacuaaaugacacuacucuuuuauugcugucuaacuguugagaucuuuugggaagugacagccaaccuaggagcaaaggguagcauucugcugaaaagucaucacugaagucauauuuucauaaauguacacuauuugacuaguguuauucagcaaauguacacuaagaaugugccauccugcaaaccauagauaacacagagccugcuuaaaauaaauuggcauuggagugcuucacccuuuagcuauuuacuuagaauguaacuugauacugcccacccacugagccucugcacugcagggguuccuaggguugccucugcuuuccaacauuucugacuggagcuggaguccuggggaagagcaaggguggcagagaguaggaaauugaguugaccugcauaauaggauggagugcagagugacaagcccucauugguuguccuuuguuaacauuaucaacauaugaaaggucaggcagagaaaggguuccguuugguuugguuugguuugguuugguucaguuuagcuugguguuuuugcccugcauaggggagagaaagguguuuuuaugaacugaucagauacuugucuuucuucaaagaaaaguugagguaaugucaucuugcaaaguugaguuguuuauucaaaauaaauuccuuuucugauuauaaaagaaagagaaaaagaaugagcuauccugggcuggagagagauggcucagcuguuaagagcacugacugcucuuccagagguccugaguucaauucccagcaaccacaugguggcucacaaccaucuguaaugaaaucugauguccccuucuggugugucugaagacagcuacaguguacucauauaaaauaaaugaauaaaugaauaaaucuuuaaaaaaaugugccauccuucuuuuaaaagcugugagacaguggaagauaauaucaggggugauucuuaucugguuguauagaaaauugaacgcuauuaaucaagaacucauaaguauagcaucuugccugugcuaaguguugcaaaugagagggauguggugguagagaaccuacagugagugagcuggcccaagauagagguaguuucuaugaagauguguggacuggauugaaauauaaggaaauaagcuggaguuauagaugaagaggucaacaaguagcaugaaagagugaucaauauguguaaaagacucaugaguuaaaccguuaaccuaaagaaugaacagaagguaaguguguuuauaaccaaaggagaggccagacaugauaaguaugcagagguagguggaucuuuguugguuguaggcuaaccagggcuauggagucucaagaacaacaguaauaacaauaacaaauauaagaaaggaggauuuuacaugauugcagguuaugaccaugaaguagaguaaggggaagcucaccacauuuggcuguuauuuccucuuugaauuaaaguuuaagaucauguuucaccugaucaagcaacaaaaguucaagcaggagugacugcacagaagauucguuuacuaucuagacuuuuuuuccuaccagacaagauaccuucauggaaaauuauuucacuagccagcgugacaacaucuuccgaaauguggagguucugauuuaugucuuugauguggagagccgugaacuugaaaaggacaugcacuacuaucagucaugccuugaggcuauucugcagaauucuccagaagccaaaaucuuuugcuugguacacaaaauggauuugguacaggaagaucagcgagacuugguaagaaauggaaaaagugcuguaccaaaugguuagcgugcacuguagacuuccuuuauaaacagugaaggucaguuuguaccauucuguauuuuagaacgagauaagccucugaccaugugcuuucacuaaguaaccuuuaucggguuaaaaaguaguuaguugccccuguuguauugucauagcugaaagacccaccaggaguaagaugaggagagguugcugcugucacugaauuaauuuaggaacgugauaugcaccaguucaagggccuaccccauugugucaagcacuguucacaaggccucacaaucgcaguggcauaaauaacuuaguaugcaugaggauaacucaaaaaugacuaaggauaauagaguaggaaauaucaaccuuuauuuccucaauaaaaacauaaaauuaaccaccuauaaccaaaaacgucccagagagaacuugggggcucaguauagaagaggcuuagaaaaauaggcaacuucuuaucuagcuaugagauucugggucugguaagacauauucuaccuucaauuuguucaguaaaaaauaagagcauuagauauuaauguuuaagauuaaaaaagaaaauccuucucuauguuauagagaauuaaagaaagggguuuuagauuauacuaguuguauagaauuuaguuucuuaccuggcugucccgguacucucuuuguagaccaggccggccuagaacucauagagaucugccucccaagugcugggauuagaggcaugagccacuacugcccagcccuuggcuuggagccuuaaggaaagccuuauacuaaaggauuuuuuuggugauagcauuugucagaaaaacauguuccauaacacauaugaugugucagaucccauggagcuggaauuacaugugugcugaacaacaacaaaugagcuccuuuugaauguuuuaaucacuuucaauuuccuuuacuguuuuuuaaauguucauauacauauccucgauuauacauuaauauguauguuugaguuuuccagagaaacagacccagucagauguguuuguguauagaaagacaaagacacauuucauuuaaggaauuagcucacuugauucuggaagccacaucuagaaguaguuugaaauuuagagagcugggaagaugggcuagagaccugaaaagaaguauauacauaaaggagaggaaaaaaauaaaguauccuuauuuucagaugauguguuucuuuacauaaagacccuaaaaacuccaccagaaaacuaaagcuauaaauucauucagcaaaguagugggauacaaaguuaacagaaauaaaucaguagccuucuuauacacaacaggaaacgcggauuccuauaucaauagaugaguugguauguaaguacauuuggucuuguaguuguaauugcagucagaaacuucuuaaguaugugguaccccacuuucuaauagccaugucuucuauagaaacugaauagguaaccugaauggaauugugucggcguccuuccuauacuugaaccaaccuucucuuucauucaagagguucucuggauuuacgaaaugguacaaaucuggauggauaccaguugaacagccaugauauuuuaugauucaugcuaggcuuuugaucauuugaccuaaauuacuucauuuauguagaugaaauaagaauguaguagauaucccaucuaguucauuuauaggggcacuaugaucaacuagccaaaacuauagguuucugugaguugguacuuaaguuuacccuucuugucuuugaugguaaaaugucuucacauugcccauuauucuagcacccacuuccccuuuauuaggcuucccaauuaagugguagcaauuaccacuguaaguuuuggcuuauagaagaaagugaucagagagcuggaggagguuagggguccucuuacacaucuguuucucauuggcuuuguguucccaguauugaugaaugaauagauuguagacuaaaaaccuugagcauugucaucucccuaagcguuuagauuccuuccuauguaguaguagaucgaugcagcucugacauuuuuuuaaaaggacuuuuauguaugagugcucuaucugcuuguacaccugcuugccagaagagggcagcagaucccguuacagaugguugugagccaccaugcaguugcugggauugaacucaaggacucuggaagagcagugcacuuaacugcugagucaucucuccagcuucacagcuauggcauuuuaaccucaguuaguacagguuauguuuucauucaugucucagcuaggaacuaaacaaacagagugccuucuuaacccuucaccuacaaauccucugcuuauugcauccacaucaauaaaauuguccugagccauuaauaucuauucucauaguuaucccuguauuuuggucuacauuagaaaaaucauauaguucuuuuagaggcuguauauuucaccuuuagaagucuucugauucuugaaucuguauagugcuaggagcaaagggcugugguagaaaugaaucaagucucuucaagcuaccuccauggaggccacuuuaguuucuuuuuuuuaaggaaaagcuguauuauucuuagauaaaaauguaguggcugcuucuaugggcaaagaauugagcauuuaggcacucccaauuuccucaagcuuuuacucgaugagaccaguuccauucuccagaaucauguucccgccagugucaugcuuucuaagcagguaccacauggagaugggcauucaauuugcacuguaauuuuugugcucaugagaugagaguccaaguuuacuuugcagcaguaucaagccuguggcuguaggaaguaaagguaucuuucugggcaaauauaggaacuucaggucaucuguauuaucacucaucuggauacucaaaucugagcucauccuuaucauuguccauuuuauacagcaaaauuaggaucagcuaccaaauccauucuacacauuuugacaaaaauagccacauagaugcuugccagaacauuguaugauucaggaucugaauuccacaucacccccaggcucucuugaguguucucauuacuucuugaaauugcaucuuuaacucuaaucagaaucaaaaucacuucagaaaacucaucacaagauucuacucuaacucuuaagaaucuuucuuuuuccucuucugaguacauugcccaagccuuugguauaggaguuuagguuaaagacaucucauugggggcugaguguggcaaaguuucucauucuggguaccauguccagcaguugugggucauugugcgaguuaccauauacugcaagaagcuucucucauuuauagguauagcaauguuuuaacuuccagguuuuggguuuuuuuuuuuguuuguuugguuuguuuuguuuuuuuuuuuuuuuaaagagagacagagaaugaacacauggagacagauggaggcuggcaaguaugaaaauuggaugggaagccaacauacuacagaacuauaaaacuucaauuuuguacaagaaauaaaaagacaaucuagacaugucuagagaguguuucacagcagauuuuccaguuuuauggcucucacaaucuuucugcccccucuucugcaguguuuccugagccauagaugcaggagcuaugacaggaguccauugggacugggcuccccaagauauguugcauccaguugggguuuccugugauagucuccauuugcuguaaagagcagcuucuuugaugagggguacuaguuagacuuaucuguagauguaaggauaagcuucagaauauagcacgaaacuaugcugggcuagcagagcagcaauaguagauucucuuuuaagauccaugacgucacuacuagucccuggaaguugacuagguuuuuaauacuaggcaugauuucccucuuguugggcccuuaaaaguccaauuagacaguaauuggcuuccuagugcaaaguggucagcaauuaagccaaauauauacaaacagcaaaaaugaacauagcagguugcauuuauauauuugugcguguguauauguaugcauauaacaauaauaacuaaaggaaaauacuaucaauuuaaaaaggaagggggacaaggaaggaguuggaaggaggggacuugggaggggcgggugugaggaaaguaacgugauuauauuuuaauuuaagauguaauuuaaaaauuaaaaaauaauuagcccucauuguguguacauacauacuagcaaucucccuacccagggaaacauaucugaguauccauauuuuauauagauauuuucucuguauauguggggauggauacauagaaacaaauccuagcuggcuagagcuuaguugaucauguggauuauaaauguguuguaaauuaaauacacuaaucauauauauguccacguauauaugaguaauauauguuauuaaaaccuacgucuauaauacuggagaacuaaauguauuuugaguuguacaauuuuaauauagguauugucauauuaaaauuaccuagauuuggugauuggauuauauauuuuaagaucuguaugauacauuuuauuuucuaacauagugcucucuaugaauauuuaguaaaaguuggauaagucugaagaaaucuaauagucauuaauacauuuauagccuuguuugagaaauaauaauacucaaagguugcuaugaagacaaaguaagagguucuugucaaaauaugauaagauacuuaaaucucagaaauuucagugagagaguggagcuguuguaugcucaugagguuguuggauuuuuuaauucagauauuuaaagaacgagaagaggacuuaaggcguuuaucgcguccgcuagaauguucuuguuuccgaacaucuaucugggaugaaacucuguauaagguguguaugucccuaagucucuacucuaagagcacgaguaaaaguuagaaagauauuaacaaaacuaaaauauuuuaaacuacuuccuagccaucuagauuuguugcacuaaaaagaaaauaauaaccuguaacacuuuguucgaagaacaucaaacuuaacagcaaaagauuuugguuugaaucuuagauugagucgacauugucaccaugucacacuggauuugccuuggggauaugauuaaucuucugcuacacuuuguugucauagcaaaaacuguuauuuaacauccaccauccauuuugacccaugguggucucagugauuauuguaguuacaucuaauguucagguccuucuacaugcuaaugggauaaacuaaucugccuaaauucagacagucagagaagaaaaauguuuaguugagaaaugggagaagugaaucuuaaugagaugugauauggauauuguauguuguaaguucagcuuuccugucauuggagaugauaugguuagcauccaacccucauuguuagcauugcuggaaugaucaccacacuauuugcagccuagggguuguucuuucaguaguucugaggaugaaguuaccuuagugguacaaaggcucccgcuucuuccauuucucaugcuuaccaguggcuuaaaguuugacuccuuuugucucuucauguggucagacauuuccuucagucugcuucugguauucauugacaagugugacucuagguggcaaaggcugcuucucugucacugguagguagagcuucaguaucaauucaucugacaaguaucaacaaccagaaacacagaacccucacuugcaaggaggaaaaccacuggacuuuuaaaaauagcaguugauuuuuuuaaucuaauuuacuuccucccucaauauuauguugacccaggcucacucuaauaacaacaauuugagauagcuauguaggaaguacuguucuagguaacugugggcggaauuucucucaaagccuuauucccauagaacagguaaccgggaauaaggauggacaugacacacugauaagaaccagcugcggugugaaggauggcaauacauaacacgaccaaagacaauuggcuaaucacaacacugcugugagugacagugucucugcugugguuagcuuuggugccuucuccaagguaaauucagcagugacauuaacaccaaccugggaacuuggaacagagacauggcacuacuacuacuaucucugacaucauugcugcauagaccugacuuaaaguuguguauuauguuuuauucaacaagcauucguugucucucuauuggauguugucacauacacaaauggcuccaguaagguuccugaugucuuauaggagacauaagaacaaaguacaccuaacaagagaaauugggagugagaauaaaggacagaggaauacaagcaccuuaagagaauacuaggagagugaaacuaauuucaucugcauguauuagucauccuccuggaugaagucaacuucaggcagucacaugauaagccuuuuaaaauucaguaccaggaaauuuuucacaggucaccaaacguuugaaaauuacaaucccaguuguuucuuuuauaaugacauacuauaucuuugaagggaggagcuacacuugucauuauggcucugauauuuucagaaaauggacucuuggauguaaguuaaauauagcauuauuucaucuuuuuaaagcuguucacaauguuggacuucaauauuuguuggaugucuggauuagaagaguuuuaucauaauagaucauacuuugcaacuuuuucccuaaagcuacaggaugucauuaaauuacuguuuacucauggaaagaaguuucuccagcauuuuuuaaguguuugaacucuagaaauucaacucaaggaugcagaucaaguauuaggcuacuuuucuucuuucaucuuuguuagauuuaacgucuguauuuuuuuuuaacucaguuaucaaugguuuuuccugucagugucuuguaggguacuuacucauuuccaaggccuggaacuggcuaccuguaaguaacagucaguugugcuuccguccucuuaggcaugguccagcauuguuuaucagcugauucccaauguucagcaacuggaaaugaaccugcggaauuuugcugaaauuauugaggcugaugaaguucuucuguuugaaagagcuaccuuucugguaaggacuuucugcucuacagcuauaucucagucugccuucuugaagucaaagaacaccauguuauuacuuuuaggaagaacuaacccccuuuuacaucagcauguauauuccuauuuauaaagccacagugguguggaaaaauuccuuugguaaauaacguuucaguaauuaguaaaauuuagauuuuucagguaugccuuguuagaaaguucagauuaguucuaguaauaacuauuauaauaaauggcccuuauuacccaccaaacuauauuaagaaaugcauggcauuuuucuuuuaagacaaaaaacacuaguaguuuuaauuuucuaauaaauugaauuuagcaauguuaacagaguuugcuguacagcugugagugauguaauguauaauacguacauguauuuuaaagaauuaauuuuauauguaugugucuauguuucugucuguuugccugugagggaguugccacuuguguguugggugcucauggagaccagaagaaaguguuccaauuucuuggagcuggaauuacagucaguuauuagcugccuggcauggguacugguaaucaaacuuguguccucuggaacaccaggaaucacuugugaucacugagccaucacuccugcccaauguauaaauuuaaaaauaauauuaauagugucugggcaguaguggcacacacccuugucagacagaggcagcggauuucugaguuucaggccagccuguucuauagagugcauuccaggacagcuacacagagaaacacugucuugaaaacccaccaccaccaccaccaccaccaccaaaacagcaauacaagcuaauuuguaagaacacauuacauaaauaacaggcucauuuaauguaaugcucaaagcagcuuccaguaaagaauuaauuuucugaacuuuaccagugcuuagcuuaguucaagcaaaugucuuacuccaucugggcuuguuuccucuucuccaaaacaaaaguaauaaugcuuauaucauugguuuauugauggaauuggagauggagugcucagugguuaagagcagauugcucucucaaccaccuguaaugggaucugaugcccucuucuaacaugucugaagacagcuacucauauaaacaaacaaacaaacaaacaaacaaacaaaucuuuacaguggaacaggguaaugguaagcauccagcacaaaccuugacacguaauuaacaauggaggauagagaauaugcguguaguuucuuccuuugugaaaacacacucuuccugguagaugguggagcucaggcugaguccuaacuggaggacuucuuucugucagcccacugguacaaccuacuuccuuggaauuacuacucaaccuacuuuuuucuggcuaauguucauaccaauaaggaaguaaacugcuauguuuguuuauauauauauauaucacaacagaacccuguuucagaacuauucccuugccauaccuaccacacaugguccuacagugacagcccaaugcagacucuacuccuaacagaaagcuuuuguuucucuuuucaaaaaaaaaaguuuauguguuauugaugguuuguacuaagggagauaaacuaaggcaagguagaucugcucacucauugguauaagaguuguauuucaaauacuuaacaucauaucaggauuucuuugugaauuuucuucuagcaaguaauauggauuuucuucugcuagaaaugaacaacuuauauucagccuuuagaguacuugugguuuuuuauuaaaauugggaucaucuaguaaaagguuuuaaauaugauuucaacagcuaguuuguuaaucuucuuuaaaauguuugguacugcucaagagcaguucgauauuuuuauuucguuccauuuuauuuauacuauuuuaaguuaaagacugucuuaucagacugucguaugagagagucugauaagguaaaaaaauuaacgauuaagguaauuaagaaaaacagcaaaugauuuaggauaagguuaugugcuagugaagucuuaaccugaaaaugcauuuaaaugugucuaaccuacuaagcacaauaggguagcaaugcuaauucucugaaaaugacccgcucuuuauuuuuguaauccaggaauuuaccuuuguaaaauggaacucaggguccacuauugcuguucagcuacacaagaaaguauuguacaguauauuccaaacuugggaaaauucaaaauaugguuuauacugaauguacauugcuuacuagcaugaccaaaggcuucacacgugucagcuuuauuuuuauuuauuuauuuguuuguuuguuugcuuauuauuuauuuauuuugagacauguguguagcccugguuaucuuggaacucacucuguaagaccaaguuggccucuaacucaaagauccuccugcuuuugccucccacaugcugggauuacaggugugcaccaccacugcccggauccagaugucuguuuuaauuaguaacagugauaugaguauuuucauaaauucacauuacauuaucccuuuucacaggugauuucucauuaucaguguaaagaacagcgagaugcccaccgauuugagaaaaucagcaacauuauuaagcaauucaagcugagcuguagguaagagacuauacaugcgaacuguagguaagagacuauacaugcgaacuguuaguuucuggauaguaguuaucauuuuugagguuuaaggaaacugcacguuuauguuuacaauaguuuguuuaaucaaaugaaaaguugaggucuaagggagccuacaagugugugaaauguccuccauuguccuuuuaauagaagcaugacagguguauauuuugaauaugaaaaauaauugagcaagaaugucaugggaacuucagagaguaaguuacuaaauucaggaauuuaaaaaaaaaaaaaagaauccaaauccauggauuaugugaaccaagcugauacagaagcauauaaaaaaauaugcaagucgaguaucccuuagagauguuugauaccauuugggaaauaaaaauagaauauugaagaaggcuuugaaaaggaagggggaacuuaugaccuggugaagaaaagccuggauuuuuuaaaaaagggaaacacuguugcuaacaccaacauccaaguagaacugcucgaauuguuggcugaggcugggcgggguggcagacauaaaaagcaaauaagcugaguugagauaggaaaagcuaccuuuaguagaaacagugagcaauuagaugggaauauacacauugcuuccacugggaucaagggcacuaauaacaacaggaagaagcuguccccaccugagcaugcaugccauaggaagagugaucuggagacaggcuuuggagacacaaccaggaacuugguacaccaugaguauugagacucuuggggauaccaggauagaaauccaacaagggaguaggaauccagaaccccagagugacuaaccugaagaaugaauggaaagcacugcuccccccccccccccacccagcacugcuugcauaagcaacacugcggcaacacaaaagaauugcugaaccuggcaugcuguuguggauggacagaaguauuugggggcaagguguauaggucauagaagccacaucccaacaggggcagaaaacacaagaaagcaucacaaaagagaaaaugagccacuguguauaucugcucacaaucccuccauacuggaaaccaaagaugguaagauaccugaaaugccacaaaaagccuuccaaauccuacauuuaagaaaucccaauauucaagcagaggacucaaauaaucaaucagacaagagaaguaaggaaaucaaacaaaacaaucuaucaguacaaugggaagaaucagcacacaaaauagcgcagaaacaagaauauuaaaaauagagaacaagagccgggcguggugucgcacaccuauaaucccagcacucgggaggcagaggcaggcagauuucugaguucaaggccagccugcucuacagaguaaguuccagaacagccaggacuauacagagaaacccugucucaaaaaaccaaaauaaaauaaaauagagaacaaaaugcauucagguaaauguaaaaauuagcauaaccaaaacauggauauguucaagagcccagaccuaagaauaagaaaagagcaaauauaaacauuacaagaucagauuggagagaugucuuagugguuaagguaccuauuguucuuguagaagaccugaguugguuacucguacccacauggugguucacaaccuucuguaacuucaguuccagaagauaugauucccucuucugaacaugugcuuacacugugcacagacauacauccaagcaaaaccuacauacauauaaaauaaaucuuaaguuuuaaaauuguaaaggcauuagcugaauguucagugaaauuauaacagaaaaagucugaaaucuagggaaagaaauggauagccaaacucaagagacacuugcaacugcaaguagccaugaccaaagaagaccuuuuccaugacagaucagccaaaaauauuaagcgaaggaacauaauuaaaagccgugaggagaaaucaggauaggauaaaaaugcccuuuuuaaauuaaaauuuauuuauuuauuuuauguauaugagugaucuaucuacauguacacugcaugccagaaaacagcaucagaucacauuauagaugguuguaagccaccaggugguugcuggaaauugaacucaggaccuuuagaaaagcagccaguauuaaccacugagccaucucuccaggccucacauaaaaucucuuaucuuaaaagcuggaaaaacauggcaugauagauuucaggcucugaaaccaaacaacugacaaccaaaaguggcuauauccaggaaagcuaucuuuuaaaguuacuggagaaauaacacacacacacacacacacacacacagagagagagagagagagagagagagagagagagagagagagagagagagagagagagagagagaaaugagaauaccauacacaguaaaaagauaguuucaaucauaaggucacaggaagacuaaauuccaugaggaaaagaugcagauaggagagcugagaaggagcccaucacaucuaaacaauaaaauagucccaguaggaaauaauaaacguuaaagguaaugcccucacuuccucacuuaacugcuacauacaauaaacucacccuacuggcaaacaaaucuauaaacauauagccaaagaguagaagaauacucaagcaaauguaaggagaaaacaagcaggcgcagccauucugauucuugauggaguaugcuucaaauggaaauuagucagaggagauaaauuagaacacuauauaaaaaacguaucaggcauuuauaacaauuguaaauguauauguacaaaguguuacuaugccuaauuucauaaaacaaauauacagggguaugaaaauucaguuagauccuaauacugaugcuauuaauauucaucuuuagguaggucauccaaagugaaaauuaccaaauaaaugucagaccuauaccauaucaccaauugaauaauuuuuucagauagcugcagcauauuccaucugucauccauggaauacacauuauuuuuagcaguccaugaaucuuugaaucgguucauaauaugggcuaccaaauaagccuugacaaaugaaauaaaauaauucuuuguauuuugucagauaauagugggaccaaaacuaaaaggacaaacaacaaaaacacaaagaaauuguagauaauguauguuuucuggauaauaaacuaaacuaaaauagacuaaaacacugaguaauagacuaaaccgaagaggaaguuuaaaagucccucaagucaaaugagaaugcuugugcaacuuaccauaaucucuguguauagcugaagcaguucuaagagaaaacuguauaaacuaugaguguuuacauuagcaguuaaacacaucucaaauagcaguuauguaccuuggggucucagaaaaacaagaacuggaagguuuccagucagccauccucuuucucuucaaggaggcaguccaguggcagacacuaacaugcagaucuucaugaagagccugacaggcaagaccauuagucuugagguugagcacagugacaccaucgagaaugucaaggccaagauccaagacuaggaaggcaucucacaugacuagcagaggcugauaauuugcuagcuagaaacuggaggauggucgcacccuauccaacuacaacauccagagucuaccuugcaccugguacugugccuacgugguggcaucaucgagccaucccuuuagcagcuugcuuggaaguaaaaucgugacaagaugaucugcugcaagugcuaaucacaucugcaccuuugugcagucaacuguugcaagaaguguggccauaccaacuucugacccaagaagaaggucaaauaaagcuggggcuguaccuggcccaggaccaaauaaaauccucuuccauugacuuggaaaaaaggaaaaagaaaaagaaaaaaaaacagaauaacaagaacuagucaaaccuaaaagcaguagagggcaagaaauaauaagaaucagggcagaaguuaauaaaacgcaaagacuaagggcaaaauauguuccccuaaaggcuaaacaugauugauaaaccaauagcuaaacuaaagagaagaaaaagaaaacauuaaaucaauagaaucagaaauauaaauggggaugcuccagcagaaucuaauaaaauccaggguauucuuagggaacacauugaauaauucuauuaaaaaauaaaacccuugaaaaucuggaagacauggguauuuuccuaagcauuuauaaccuaccuaaccugucccaugagauauaaagggaaagauuaauucuaugaaaccagaugaggaugcacuaaaaauuacccuagaccaguuuuccugaugaacauggaugcaaaaauugucaacaaaauaugugaaaacuaaauuguagaacacuacuauuauaugccaugaccaaguugcuuccaucucauucauccaagguugguucagcauaggcuaauaaguauaacauaguacauaaaugaacacagggauagaacucacacaauuauauaucaagugcaggaaaggccuuugauaaaguuuagcaaccucucaugauaaaagccucaaaaaauucagaauaaaaauaauguaucucaacaucauaaaggcuauguaugucaaaccuauaaccaucguucuaccaaauggggaaaaauggaaagcauucccuuuaaagucaggaauuauaaagggguaccguaccacuccuuccauuuuauucaguauaaugaucaaagccagagacacaacacugagagacacucacacacacacacacacagagagagagagagagagagagagagagagagagagagaaaggaaagaaagaaaagggcuauaggaaagaagaguuaucucuauuugcaaacaacuauucaacugaauaauuguuuaauuaacacuuucaacaaaguaacaggauccuaaauccacauccaaaaaucaguagucauuauauaaacuaaguagguuguauuuuuauauuuagaaacacacacacauaaguagcagggaauacaugggagaguuuggaggaaggaaagggaagagggaaaugguguaauuauaaucucaaaaaauuaaaaaaaaaaguaguccuagccaggcacacgccuuuaaucccagcacuggggaggcagaggcagguggauuucugaguuagaggccagccuggucuacaaagugaguuccagaacagcuagggcuauacaguacagagaaacccugucucgaaaaaccaaaaaaaaaaaguaguucuuccauacaucaauaauaaacuuacugagaaagaaaucaggaaagaagucacauucacaguugcuucaaaacaaaguaaccaacaaauuaauuaauuaauuaaugaaaaaauaaaguaaucuaaauuaaacuggacaaagaaagugaaagaccucuaaaaugaaaacuuuaaaagcacagaaggaagacugaagaagacacuaguagauggaaagaccuuucaugcucauagauuugccauauuaauauuguaacguaguaauauaccauaauguaacauaauaauauaccacugaaagcaauacaaagauucauugccguacacagcagaauucuaacuacaguuuucacagaacuauaaaagccaagccuagaauucauauggaaucacacaauacugaguagucaaagcagucucaaagcagacugaugagcacucgagcuaucacaguaccugaccucaaguuguacggcacauccauaagacaaaauucugauacaaacuaaagcagauaaguugauugauagcaacauuucucugccugggugggucagauaugucauauauccugcauaucagauauuuauauuacaagucauaacaguaaaaaauauacagguacacgguagcaucaaagguaauauggggguccccauaugugagaaacuguauccacugaucuacagagauacuugcauauccaugauauugcugaucuauuaucaggauuuucauaauauauccagccuucgugcuuaucaagagauuuaaagcuaaagaaaacugugcauauacaguacggauuauuauucaucauaaggaaaaggaaaaauucccgggcggugguggcgcacgccuuuaaucccagcacucaggaggcagaggcaggcggauuucugaguucgaggccagccuggucuacagccagggcuauacagagaaacccuguuucgaccaaaaaaaaaaaaagaaaagaaaagaaaaaggaaaaggaaaauaaauggaaguggaaauucuauguuaagugaaauaagcuacucaaacaaauaacauguuuucaggcuggagugaugguucagugguuaagagcacugauuguucuuccaaauguccugaguucaauucccagcaaccacauggugguucacaaccaucugaugcccucuucuggugugucugaagacagcuacaguguacucauaaauaaaauaagucuuaaaacaacauguuuucuuuuauaugagaaaucuucauguaaauuugggucuuucugugcaggucauaaauauaacaaaugggaccauuagagaguaggaagauaucuuuaaguuugauuagggggaagaaaggugaauaugaugcacuauuuuggggauaaaggaacucacagcagugaggguucugagagaaugagggaaaguaagaacaaaguguguuugugauugugugaugagaaaugccauaaugaaaacccacuaccuuauaugcuaauuauaagaacuauuagaaaaucuuugguagcacuuuuuaauaugugucuagauuuaggccccuuuucacuugugcgccuauauuagugacuaucuaaacauguuaaguuuaucaguacaguuuccauagaaauuuaaaacguggugaauuaagauacagugcuauaaaaauguuuaauauaagcaacuucuuuuagucuuuuuuucuuuaaccaccauuuuucuuucucccauagcaagcuggcugccucuuuccagaguauggaagugaggaacucuaacuuugcugcuuucauugacauauucacauccaacacuuacgucauggucgugaugucugauccauccauucguaaguucaaacuuggcugacacaguuucaaaguuauagaguuuuuaagcaaaugccguagagcuagaacuuuacuagauauuuuuaaguuauuuuauaguggagguaguugcacaauaacacgaagauacuuaaucucacugaauuguacacuuaaacaugacaagcaugguaagcaucauauacacuauacauaaauaaugcauaauauacauaguauauacgaauaauguauaauauauacauauauggcuauaguuaaagaaauuaguaauaggaggaggaggaggaggaauguugaauaauuuuaauagguggauauuuuggagcuuaaaaauaauuuuucuuggguauuguguuuuuucuucaugagaauuuaagaaagcagaucacuaaauugaggaauuuuaaagaaaugggaacccagauccgugaacuuuuaaaagaccucuaaguuauuaaaaacugaaucauuuuguggaucaccacuuauucuacagccgcauauuucuguuauguguauuaaggggcaguauuuguuauuuccauaucuuggaagccauaucugcuacagccauuagacuaaagguucuuaccgugucugcaaaauaucccccauguauuuaaauuauuucucuucuccugguuuuauauuagguuaauauuuaaagguaacauaaauuauugagguuuauucuauuagucucaaaccaaaagauugugaaguuuuauguuuaggauauguacaaaucugcuuuacaaauauaaauccuugauagcuugaggcuuucugcuccuaugcucugacacacacugaaggauuuggaucuuuuaauugauuugcuuuuacuagacagacauaccuuugacugccuuucuuacucuguugggugucuccccacccuacccucagcuucugcagcuacucugaucaacauccgcaaugccagaaaacacuuugaaaagcuggagagaguggauggaccaaaacagugucuucucaugcgcuaaacauugcugaauauuguuucacacaaaaauugaaacacuguuucuuaauuuuauuguuguauucauauauguaggauuugaaauauugugaugcccaccacgucuguauuucuucucuacuccccagucuuaacguuuaucuuugaaugcuauuuauucaaauagcgugaggaguuagaagaugaggugucuaugauguugauguaauguauacguaggcgauauauguaaguguucugauaacaugacucuaaugguguuuaaguguucugauaaccugcuuuuaauaguuguguaugccaaagucuuucccagcaccucuuguauucauuaucaaauauauacauguaaguuugaaguauuacuguuuucucagcaugaauuaaaaauauucuguaacucagccaggcaagguagcucaugccugugaucccagcauuugggaaacagaggcaagaggauugcugcaaguuuaaggccagccugucuacauagggagguccaggccagggauguauaucaagaucuuguuucaaaaaauuauauauauauauauauauauauauauauauauauauauauauauaccuuaacuucacuucaauguaaauaaacuucugcuguuagggau

SEQ ID NO: 9799 - RNA, 161180 nt, Mus musculus
caguggaugggguggagccgcuggguggggucugggacaggcagcugggagaaaccaaaagggaaaaaaagaaaaccauugccccugaaauccuuaacgcugggcgagggacgcucgugcgaaugaggggagaggaggguuuuagaucuuaccaccacucccgccaccggcuaacucccuuauacccuucugucucgccuuaagaucaguaauaucuaguguaccggcaucucccuaagucuuccugggcucgguucguggcgcgaggcagcgaagaccccgugcgugcgcugccccuggcaggggcugcaaggaaaggaugccuucggaggcgcagaaccccaaaguaagucccuuucauuuuguccagccagcaccucgcuuucggcugcccucccggggucucggagggggcggggacauggccgcaguucugcugguggcucacucuaggaggaaagaaggguggggcaggguggaguagggcggaggagagggguggaggguggugcucuggugcccagaguggccacgcggccagcucgugcacacugaagcguguuguguguuuacagccucuauuuccacuccugauguuaaggcuucacuaucauccuucugacauucuuucuuuuugucauacuccagcaucccuaucagguugcucaaaaccucuagcuucaagcugggagggcuccaucuugccuggcuucuuaaagggacagugcacaauuuuaccuaagggacuuggaguggaaauucaguuuaaagaaugucagugucuuaccuuguuguaacacugucuguuuauuggaaggaauuuaugugcagaggacagcuccucccucucccagguuauccuucaaacuugguucuaacauccaguggauuuuuagaaggugcaguguggguauucaugccaauaugcacauuaguuacccacagagucaguggguucaguaguuuuaucugaaggauagcauuuccauucagacacaacaugacuguguagaugacuucgagcuaauuaaucaauucuaccaauauuuauuuaaugccaacuucauugccuguggcaggcagaucaugcagcuggacauuguguguaagaucucaaggcccugcagaauguugcuauggacuccuuuuuuuagcugauugguggccaagaucuccucccuggauagggggaggaauguggaauuugauuccaacauaugccaaccaucucuaacauauacucuccuaguucacauguauuuucacaugugugcugggaauccauauacucaaaggaacugggagcucagguuggaaaacauguagcaagucaaauggcuugugaagugggugugguggugugugccaggcagaggcagaggcagaggcagagaggcagagaggcagagaggcagagaggcagagaggcagagaggcagagaggcagagaggcagagaggcagagaggcagagaggcagagaggcagagaggcagagaggcagagaggcagagaggcagagaggcagagaggcagagaggcagaggcagagaggcagagagagagaggcagagaggcagagagagagaggcagagaggcagagaggcagaggcagagaggcagagagagagaggcagagaggcagaggcagagaggcagaggcagagaggcagagaggcagagaggcagaggcagaggcagagaggcagagagagaggcagagaggcagaggcagagaggcagaggcagagaggcagaggcagagaggcagaggcagaggcagagaggcagaggcagagaggcagagagagaggcagaggcagagaggcagaggcagagaggcagaggcagagaggcagaggcagaggcagagaggcagaggcagagaggcagaggggcagaggggcagagaggcagaggcagguagaucucugaguucaaggccauucuguucuggucuagauagugagcuccaggacagccagagcuagagaaugaaacugugucuugaaaagaaaaagccuuuggaaaagcacaggacagaauguuuccguaggaaagcugaggccauccugaaugcucugauuuucgccuuggugucuuaccugcuacauuguguugguaaggagagccucauuagcuccuucccauuagauaaagaaagaguugguauagcaaccauucauuagaaauggcuucuauggaccagugacaucuuuuacaugcuucucuuuuguuucugcuuagggaggguggcaggguuguggauggagcuuuauaguccacagaccaaagagaugaaauuguugucgagguuugagggcuaucauuuccccaugaaaugcucugugugagugauggaaugacccaguucccaucagucggcaguuagcugugucuaguauuaaauguaaaguccagagucgcuuucuuuaauauucuggguuucagugcaucuccaguacgaguucucauccagggauggugccuguuguagguuccuugacaacguuuuaaagcaaagcagaguccucuauucagugucuucuugguagaucaucuaaacuugaaaacagucuuauuccagacagccuauauuauugaguuugggaaggaauuaagauaaaaagacucaacauuuuuuccuaugaccuucugaaaacaaagaaaagcacacauuuaacagaaacacuccuaguugauuuugacuguuugggaguguagucuuguuauugagucaaaagccacuugugcaugccaugccccccuugaauggaggguggggaaggaacuauguguugauuccacaaccaguauucugccuuugguauucugugucacuuauuaggggcuguuauguuucucuucuaacacuugcucaucucuugguguucguggcugguucgauuaccuuuguggggaauuucuaguuguauaucugggaacuaggaaacucuuagcugucagacuguuguugaaaugugcuuauugccuuuauaggaugaggaaagcuuuacgaaccuucuaagaaguacucaaggaaagaguagaauuuuucuccaagggauuuaagcagcuuucccacagcacuuugaauuauuugugucauucugcuuccuagaauuuucauuuaggacaaggaaaagugguuucaugagagauaauuacagaaaccaaacaaaaacuuucaagaggggcucucugucucugcucagucuguguuugucucuugcucuaacccccucucccccucuccccuucucccucccucucuaccucuguccccuuuuccuucccucucccucccuuucccuuugccucugccucugcuucucucugcccucuauuucuguaauucuauagcacuaguuccaacccucaaauuaccucuuggaaugccuagacuuucuuauacuagaaaaauuuggacagcuuugguuaaauccuguucugguucuuacucaguccucaagaauaggaagcugcaaaugagaaaauugcagcacaaaauuauauagugucaugcuagucauuuacucauuuaacaaauguaugcuaagaaucuuuucuggaccauugcaccaucuuggagauagugagaggugcucuugaaggggauagacaguaaagauguguguuuaaugaagcucugaaguaguagcaggauagugugacauguuagggagagcuaauuaauauagaauauuuaaggaaagccucuuugauaugauaaagaacaauauaucucaugaaauaagggagauagucacaaggauauuugagaaggcuguucuacuuguaauauauuccaggaagagcuggaggcacguaauugccagccaugaaagcacauaccugguaucccaggacuuuggaagccgaaggagagcaauuucauugcuagcuugagguacauaguaagguugucuaagaaaggaaggaagaggagagagaggagcaucaucgcugacgugaggucauggagaucaagggaauuaaauauuuuggcuuuuauucugaagggguuaggaugcauuuuuuccuguucuuuaauacugcaauuuccuuuguuuuuaauugcaauaguauuacaucacuucuucugcccucuuccagggcaucucuucuucccuucugccucucccagguacuuuuuuuuuaaccacucuauaaauagauagugucuuuuccucugauuauuucuguuagacuuaauauguaugcaaauauguauguagacaaauaugcaaauauaauuggcugaguacauuuuuguugcuuguauguaaaggauacauuuuuuuaugaaaacuaucaacaaucauuucaaauucuacuucacuaaagaguguugaauuguucaucuugacaaagcugagguagauugucauuuuggcugcaauguuccuuguagaaaaucuuaggaaagcuuuugcugaguuguucaugccaucuaggacauaauuuuauuguggcuguuauaaacauaauuaucugaagaugauuucauacacauaugaaaauacuuaaacacaaacggcucuagugcauuuuaacaaaaaaaaucaccauaaaauuuauuagcgcuaggaaaauucuuagcuuuaauuacagaagugucacagauuuuauagugcuauuuaucauaaaaauaugaaguauuugcuuggaaaucuuuuuaaacguucaguacugcccagcacauuauuucucuuaaguuaguucaauuuguuuuucuucaaguucuccaaguagaagcuuccaauuuugauuuauccuuagccuggggaauucagaaagagaagaaugagaagggaauuaaaagugagagaaaaagacccagaguccacagggagaaauguaacaagaguuuuagcauauccauuuuauaauuugaaaguuccauaacuuuuagaccuugaaaauccuccuucucauugcagauccuuauuagggggaaguuagguguguauguuggaugcaucuucucuagauaauucucaauuggacauauaagagacucacuucggaaauauauuaagaaaauuaugauaccuuggccuaucugcaaagauucagauuaaguuacuucagcaguuaccuaaaaagaaaaaaaaaagauuuuuaaaaauagucuucaggugauuguaauguggaagcaaggcuugcccagcacuguuuuagaucugagguuauuccagugugauagccagaucagaagcaaucucaucaccugaaaaccuucuaagaacggcaaauuucacuggacagugguggcgcacgccuuuaaucccagcacuugggaggcagaggcagguggauuucugaguuugaggccagccuggucuacagagugaguuccaggacagccagggcuacacagagaaacccuaucucgaaaaacaaaacaaaaacaaacaaacaaaaaagacugucaaauuauuucagccagguguaguggcauaagccucugaucuagcacucgggaggcagaggcaggcaggcaaaucucugugaguucgaggccagccuggucuacuaugugaguuccaggacagccagggcuacacacaguaacacugucuuaaaaaaaaaauaaaagucaaauuucaggccccgacuuagaugaauugguucagaaacucuuagggaaacagacuugaacaagcccuucugguugcucacugcuuuagaauuuagagguucgcuccaguuccaacauauaauagccugcuuucaguaagagaaguucccuauguuuuugugugaaagguuggaacgaugugcccguuagcaucccaugucaucccucaguguuuguauuacauuuaucaucuguccaccuuuuuuuguuauguuauuuguuuuuuguuuuuuacgagacaggguuucucugugcaauccuggguguccuggaacucacuuuguagaucaggcuugccucgcgaacucagaaauccaccugccuccucccaagugcugggauaaaaggcgugugccaccacugcccggcucacuuuuuuuuuuuuuuuuuagggugcacuguuauuuaaucaucauaguaaccuuguaagauagacgcuauuauuaucucuaguucacagauaagacacaggaaaguaaaauacuaaagaucacauugcuauuuaguggaagguauauuuucucuuuugaauccuaugggauuguguuuuaucaccgaguguccuguucuguccucuuuaccuuuucuuuucuucuuccucucaucugaccaugccuacacgauauccuaccaugcaccagauucucuaguaagcacuuuauaugcauuaaugcauacucugaucacagcaaucccucgaagcaggugccauuauuauuccuccaauuauuuuuauaauuggagcacaggaaaaccaagcaacuugccuaagcuuccagagcuuggaaguggcggacagacaucugucacacaguguccaaagucuguacacucuugucucacacugcuuuaucuucugugguaguuugagaaauaugugugucccaggggcuuggguauuuggacaccuggcccccaguugguaggacugaugggugguuguggauccuuugggagauggaagcuuguuagaggaagcauaucaccggaagcaggcgcugaguguuuauagucucacccuacuuucuguucgcucuuucugcuuaguguugugguuuaagaugugaauuugagcucaugacucugaccaccaugauugccacuugcugccauaucuccguacucuuacccuucugaaaccauaucccaaauaaauccauucuucuauuggcugccuugcacauggcauuuugacauagcaacaggaaaguaacugauauauuuuucuagcauauacuuucuuucucagucucaagcaaucuuucuuuguuaacauauagacuaaaacccacuuuuucuuuacuuucaguugaaauccuuacugaaacugcucuuaccaguugcuacaggcucuauccugccuagugcuccaguuuaggucuuuaacccaauucacucuuaacauucaggguugcagacuagccuuuuuuuuagaaccucuacuucuuugacuuucaugucaguauuauuucuuggauugccacuugccugauuguucuuugcauucucuucucuuguugcucuguaauccuuaaauguuucuacugcuacuuguaugaugauguuugucugcauggcaagucuccauuuucaaacggaauguuucuucugagcccuagcugguucaucuguuaacuggacagacauuucagcaucuuacauguggugugucuaacaccuuuucuauauuaucaaaccuuccauuuccauuuuuguccuucgaucaacaaugaccuaacagcaucaguuacuacucucuuuuccuuuaccuucaaauuauuucuaauuuuuuaucauaucaaauauggcuuauuaaaacagguccuuugcuguuguucugucugcaauaucuguguucucuauuauggguugaguauacucaaacacguguuggagcccuaacuuuuucaguaccuuagaaugugaguguauuuggagaugguuuuauuuacauaggugauagaguuauaaugaggucaacaugauagagccuaauuuagugacuugaaacauuauaagaugagaaauuuggacacaaaacucccccaguggugcuaagugaaacuauaagacaguaaaagagaagccuauaccuaagcccucccucauagcccucagaagaaauccuuuccucccucuuugauuucagauuguuugucugugggacuauagaacagugcauuucuacuguuaaaguacugugggaugcuuuuuaaugguauuccugauaaauuaauauagauuucacucuguucuacaaauuaggcaauuucugugauuuuuaaaccuuuccuguucaauguucagaaucuuagagaugcccuaucauaggauugaauucaugccucuuaauaggucacuuccauucugucugcacccuguuauguauauagcaugugauuuuucccccuuguuacaagaguccuguuaaacuuauuaauauugcuuggauauuccauguguuuucaaaaauuccauuccuuauuuggcagucccuuuaucuugaaugucuuuuaugggcuaggauagcaccucugugguggagugcuuacccagcaugaccauaguccuguguuccuaugaugauguguuucuccaaugaaauaagccaguucaaaccaaaucaagaguacaaaggcaggcuuauugaaaggcagcucucaggcaaguucacugaucucaagcguagaagucaagggagucacaugccugggcuaaagcaaggggugguuuuuauaagucuugggcauagggugauggaugauguguaaacuaggagcugggauuguacccauguaugauaaaaaaaaaagcugagccccugggugggcauuggugugucaguugcaggaaacaugaagagaugcugucuuagcugaagugcuccuugcacaugggcgggguuaggggaggaagagugaacaggguuucuuagcuugugcaggguuuccaaccaaauaguuccauuccuagcacugcaaacauuuaaaaaguccccucuuccacaacguuuucuacuucaucccacccuuucaucucaguuuucucuuuuuuggcaaacuccuugguagauagcgauaugcauuucaaguucuaugaagucucccaguacguugaaguagaaauaggacuugaauggccagguugaagggaaagggguauuccaaucaggaacaacagaaccguauaaacaaggcugaaguaagcauaacugucauauggguugaaggaggcuggaggacaauuagagaaggagugagcuuaggaaauuccuuccauuggugaagcaaaaccagcugcuggaggaaaaggccacagguuuuuuuccucuauaguauuucaggaaaauagcugcgcuucaaagagugauguuaaugcugaauugagccuaauccugacacuuaagucacccauauuuuaucacauggaaaucuggacuucuucuuuguaaaauuuaaaucuauuuauuuuaauuuaaauuauauaugaagacauaaaauuauauauauguacggguaucaaguauuagauuaaacacauauauuauuuaccauuuaaaaaaagaucaauauguuuccccccucaaauaguuauuauuuuauggugacucuauucaaaauccuuucuacuagaguuuagaaauaaccagugcauuguguauagucacuuuaaugaguaaagauauauccaaaguacuuacuuuuacuugauuaaaacuuuguaaucacuaauaagccauguuccauccuuucuuccuucuuaucuacccugggcuugggaaccaauauugaaugcucauauagcauuaacccuuuuagauuuuacaugugugaccauacaguacuugaugugccuggcuuaguucauuuaaucuaacauccucuagacuccucucauguuagcaauuuggauagcgucuuuugaaaaguguuaauuuaaauccauuauuaauaaagcuuuuggcugagaaguggcgcaugccuuuaaucccaguacuugggaggcagaggcaggugaauuucugaguucgaggccagccuggucuacaaagugcguuccagaacagccagggcuacacagagaaaccuuguuuugaaaaaaaaaaaaaaaaaaaccuaaaccaaaccaaaccaaaccaaaccaaaccaaaaaauccuuuuguuuguuuuugagacaggaucuuauuauucuggaacucagucuguagaccaggcugggccucucaauucacagagauccaccugccucugccucccaagugcuggaacuaaaggcauacuccauuacacccagcuucauuauuaauaaaauaaagccuuuaauuuuuaauuauuauuuauuuuuaguuauugaggauuuuuuuuugagauggggccucuuuguguggcccugguuggccuggaacucacuacguaguccauccuggccucagaaacauagagauccacuugccccagccuuaagaguccugggaggaaaugugugugccaccauaccucugugcuguugaguuuuuagccucuacaugauaauuguucacuaaauacaauacuuacaaauaucuuuccaguucccuggauugccuucuauuguuuacuuuacugugcagacaauuuuuaguuugaugcaaaaucacauucuuuucuuuccuuuucucuucccaugcuuuuggguaccuguccaaaauuccuugcuuauuucaaugucuugaaguggguuuuuguuguuguuguuuuggguuuuuuuuguuuuuguuuuuuuuuuuuguuuuguuuuuccuaauaguuucaguuugggcucuuccauuuaauucuuuaaucaauuuugaguugaucucuguaacagcauguauauucaguuuuccuagcaucguuucuagaaagacugccauuucuucaacucauucucuuagaaugucugccagaagucuauugccuguaccucugggcuuacuuuuaugcucucuuauuuuguuccauuagucucuauaucuauuuuuagaccaguuuaaacaauuggaauguguuugugcuuuuauucagauuacuacagcuuuauaguauauuuugaagccagguagugcaauaccuauuuuucuuuuucuauaagauagcuuugaguauuuaggagauuuuuuguuuauacacaaauuuuaugauuuuuuucuguccaugaaaagaaugucauuggcauccuaaugggguuugcauugaaugugugugugugugugccuugcuuuacagccagugugcauauuuuaaugcuuauucuuuugauugugauaucuuuacauauuuugaauuuuucauauuccuuugcuaauuuucauuguuagucuucaccucuuugguuaaccuuuuucaugguauuuggaaaugagaguguggaaaacuggaucuuuuaguagcaugcagacucucacuguguguguguguguguguguguguguguugugcgugcauguaugauugaagguaacauauuaaagcugggucaugguaucuuugguuuaauuaaaucuacucauaggggcucgagagauggcuaaacaguuaagaguguuggcuguucuucuaggaggauaccuugguucaauuccuaugauacacauggcaacccacaacugucuguaacucuaguuucaggggaucugacacacucacacagacauacaugcaggcaaaacaucaaugaacauaaaauaguaauaaauuuuaaaauaucugucauauggauuaaccauuucuacuuauaaugcagaugauaaugaaagaaacauuuaguccuuuaucucauucaaucauucauucagucagucaaucauucauucaguguauaccagaacccuguguaggcagcucuuugcuacagcuugggaacacaaaacuuuaagacuccaguuuucaucagaucuccucagcuaggaaacaaacaauccuuuauaauuuauugauuauuuacuuuaugcuggugaccaugcuaagcccuuugcauacuugucaauuaaguuuguaacaagguuaugcccaucuuuuagauaaggauggugaagguuagagagaaaccaggcuaucucucagucucugacaaaauuguccugcuuggucucuuauuaacucugacaguauguucuaaucuucugucuccucaauucucuggcucauucagucuucaccuauguuuagcuuguccuuucccuucaaccugucucuguaaaacugucccuguaaaacugccucuuucucucccucucucucugcucugcucccuuaaguagcuucccuuuccucucuucuuuugagaguugggcauuuccuauucugucagaucuuucuuugauucaccaguuugucugccccucaauuagacaucacuuucaaacaugggugcuuccuucuacaaacuaacuauauaccuucauuguuugguauuaaagguguuuacuaaggacuaagcuaaaccgcaacuagaagcagguuuguuauuuuuuuuuguaaauaacauaaucuuggaauucacagugugaucaaauauucugcaacaacucaagauggauuucuaacuuuggaucacacugccauuuuaaugaaaugugaggaaauaguaagauagaauacuucuugacagaucacaauucaaagaccuauguaccacuaucagugugcacaugucugugguuuuaaacuauguuuucucaaaauuagaauucauugucaguguauacgagauagaguucacguuggguggugguagagacagaagcagguggaucuccaagaucagggccagccuggucuacagagagaguuuucaggacagccagggauacucuaagaaaccaugucucaaacaacaaacaaacaaacaaacaaacaaacaaacauaauaagugauagaauacacauagaccuuuucuuacaauauaucucaucucucuggcuccaauggugauagucaccaaaacaugagcaggagcuuacacuuuaaacauuuaauuuacuaauugaaguuaauagcuuuugguuaauaaugugaguagaucuuuuguuguuguuauuuuaagacacggucuuacuauguaucuuuggcuguccugggacucauuauauagaccaagcuggccuggaacuuaccaagauucaugugucccuugccccaaguacugcucacuggaucuuaagaauggacugaguuuaugacauugaaaguuguggagugguagcacuccucucugccucuuggcccacuucaagacugaauugcucuaucacacccacaugccacuauggacugaucccucugaaaucacaggagccaagauaaaucuuccccacuagguaguggugguaaugacauuuuaacuaacucaagucaacugaaauauuuauuuaaaccaaggaaaaaucagauuacaugaaaagaauggaaaguugauaggaauccaagguuucuagugaauauuagauaucucucccuugguguauucauugucgucccuucucuuagaaggucuuagcaugucaagggcaagagguagcuucuuugucugcugaguuccuguuacaguuguuaugguucauucacauagaaagccacaggaucucaucauucaauuccaaacucccagcacucuguuauuccuggcuucacuuagcuaaggccgucuauauggaucccucccggcuauauggaucccuccugaggccucacaccuuugcuaaccagugaggacuuuacaggggaucauuuucccagucuuuguuauuuuguuauagcaauagaaagcagaugaaaauaagucugcaguauauaacauucaaugaaugagugaugcaugguuguauuuuuuacucuuucucuuguuuuuuuuauuuuuauuauuuuuuuuauuuaccaacuuguugaugaaaccacguguuccuucauuuauccuucauuuucucuggauuugcucaaagucaaugucaugcuuguaaugcaaauugaguacagagcucgggcuagagccuggggaagcgugccuuucucaugucugaguggugcugaagcuccggacuagaucacccacuauguaguaggggcagaaaaaagauaacauaacacaccaucaacugccuuuucuuuaaaggucaagugauagcuauuuaaauauguuaaacgacuuuaucaaggucacagagcugguuaaaagacagaauccagacuuuagacgauuucucaugcugucuuuuauauucuccgcuuauaaucguuucuggaaacaguuccuugauuuugaauugcuuuuuauagcucaacuaagccuaugaaaguacagcagaggagccuuauggugucuugguugaacacaauuuuguuuuguugaauuauuacuguauuuaccuucaaguuuccuuguaaauagauuuaagucaaauuuugaacaugugggaugacugcuuuaugaaagcuuuuuauaacuuagaagccaacuuauuauauuauucauacaguuuuuauugguccaaaaggagaagugagacugacucaaauauuuagagauagcauucauaguuguuaaugagggagagguaaaaacuguuuaaaaugugcucucguuuaaagcaugcccacuguaccuaaauggcguggagauccccuugacccagugcauagaggggacaauggacaauuuacucguuagcugaagaggaaaacccacagauuuuuacagauacgucguucaaacuauuucuuuccuggcccuuccacucagaauaccuacaaguuggugaauuuacuugagauaauuugauagccccucgacgugacacuugagaaccugcaaacuccucuucagcaucacuggaaucuaccacuugaguucuucccuuucagcugugcuguggugcaugugagcauguuuaugaugcccagugagugguaccuuuaauauccuucaagcuuucucuuguuuuuaaaagugcauuuggggcgcuuguguuaaauguguccuuuuugacucggccagggaauguaaaauauaauauucaugauuggguagguuuaaccucgagaaucuaauuuugaauuuuaaccucugcugaucagaaacagcacauucauggagugggaaaaauauuccagcaaaacagccucuuguugaguagucaagggucagagcagcacaagcuucugaaugcccaguauuguuuuuuuuucuccccucuguguaaauguuauuuuguugaaucuacuuaauaccaaccuaugaaauuccauuucccguguuaugaaauaaguaaauguagaaauagugaaguuaacuaaaucucccugucucuaggucccacaaguuguaccuuaagugauaugucaugccauuuuuacucaccaaaguuagcaaagugacagauucugaugcuguggaccucuuuuuuaauauguauucaccgguuauuuccuuauuuccuuccuacugccuuacagugaguggaaauucgaucauaccccuauaggaaccucuggacuucccauaccuuuagacuuaguuaucucagaauaucuuggucugccuucagugucuacagcauaagagaaauccagagaauacuugcucacugaaguaaugaauaaauacguguaugaauaaauccaguuugggggagucaucuacauaauuuguaacaucuugauagguuguauauuguuuuacacauuuguugucaucgauauguaaguuaguuaugugugucugcagacugauaaauauaugcauucaaaauuuguuauccugauauauaaagacucacaaagaagccaggcgugguggcgcacaccuuuaaucccagcacucuggaggcagaggcaggcagauuucugaguucgaggccagccuggucuacaaagugaguuccaggacagccagggcuauagagagaaacccuguuucaaaacaaaacaaaacaaaaaaacaaaaacaaaaagacucacaaagauauaucacauaaaugaauauaucugcuauuguaaaaccacaaauacuaucuuaagguccauucaugcuaccaaacuuggccuccuaaccuuguaaugaaauacacauucuuucaugucucuuauacaugaacauucaguaugguucaaaauuucugugcauaaaugagcuguuugugauuacagugcagguagaaccugaggagaauaucgaugaccacagaguagguggcuuaaaacagaaauucauucucauaauucuguaacguagaagccuggcaucaacaugcugguaaggccagggaccuacacagaccucuaggcuaaaaucuuuccuggacauuuucaacuucuuacaccccuauguauuccuuggcuugugacaggauaaccgaugauaaccgaugucucuguguuuucauuuguguguauguuucucucucuccacauggcaucuucuucuuguaaggacauaaucauauugaaccaaggucugcuuuaaucaccucaucuugauuuuaucugcaaagccauuauuuccaaggaagcucacauuggcaaggacugaugucgacauaucaagaacauauuuugagggcuacaagggcauguucucuggcucuccggaaugcauguccuucauauaggaaaauauucucaaccuaucccugucuucucaaaagucuuaacccaguucaagcaucaguucuaagucuaaaaugucaacuaaauaaaaucaguacaaaaguccuaaguuucaucugucauucauuucaauaagauaugguugauugagagccccuccccccccaaccccggggcaaaauucuuuugcauuugcagacuuguaaaaccuagaggaaaaacuaagaaagccaggauggggccaaaagaggcauugucauuucaaaauacuucaaacuaaaagaauaaaaguggucuuggggucaaagcaggucaaggaauauuguauuagaggucuuagaauaauccugugguuuguuuuucuguccccuuggcuucguagauuugcuguucuagccaaugggacagugacccuccaagcccucuccuacuucuggaaauucuguguuugggccaggccucuguagccacacccugccccuucacuucccucuuucauuucugcucuucucuguuccuuuaaaucaagauuaauaaugguucuccuggcauggaauuuucauaaaccuguugaauauguaaucuacacaguuagagcuucaagauagccuuugggagaacacaacucaaccugaaacaauuggaucgcuguaaagauauauaauauaugugcaguauaaagaugguggugaucaguaaauacuagucuaacuugccauuucuuguucaugcuaagacauuuuaccuggauauugcauuuacacucuucuaccuaacacaucuacugccaguccugacauucuuagucuccuuugcuucuuuaauauuacccaucugaagacuguccaacuaguauauuauuauauauuacauauguauuauguauauauuuauuuauacuaaagaguauccugcuauuacguauuuacuuagcuuauuguuuguuucucacuauugacuaccucuucacgaaggcuguauauucuguuuguuaguguucaaugguauuuucucuagaacuugaagugguacauagccuacugugaacauuuuaguauuuguuuaugcaaucagugcacacagagaaagaaggucuuucuggaacauaaaugugaugguagguauuuucauucauuuuuauuuugugugugaguguuugcuugcauguauguauauguguccagugcaugcccggaagucagaagagaauguacuagauccuuggaacuagaguuccagaugguuaugagcugccacgugggugcuagaaacugaacccuagucaucuggaagagcagcaagggcucuuaaucacugagccaugcuggagggguuuuauaacagcaaauaaacaagggaagaccaagugaaagcauguauaaaaaccagcuccuucuguuugucuaaugggaccaaguggcaucagccucuccuauuaugucaguguuggugguuccauucaauucaugguuguauuguaguguuucuaauuaagaaacucugccuuuuccucugugagcuaaguaagaacuuggugcagaaagaggguggcauuucacugguuuuggaaagaggcauggauauuggccagagaaaacagugaggggaugauaaaugugagaguguggguguaaaccaagaaaagcaauggcaaacuguagcaucacuauaaauaccccccacaguguacuacacuaucuuaaucaacagcaacagcagcagcaauugcaccaucuguugcauuuacuacaugccaggcacugugccaggcaguaggguaagaaugaauauggcuuaauaugucccgugaagauauuuaugguccacucgggugggugaggcccauaaggaaauaguuacagcaggcagugcugcaugccccacuuaaagggaacagacagacgaugcucuaagaaugcagguuuaagaugaaugaucugugugacaaugguuggaaaaauacuucagugacauuuaaaggcuugaguugagcuuugaggaugaaguuuuugucaaggaagcauucgagacaaggauuuuuuuuuuuuuuuuuuuuuugugaggacaagaacuguucugaagucuaccugucugcguccaauuuccaggaggucuagaaccaugccugccuguuuuaauaccacauucuuagugcugaaugcaugguugaccacauaagagagaguuguggacacaguguaacaccucugaauugggaacuuuggauggaacacagucugaauaagugagcaguuagaaaugcagguugauuguaggaaauaguuugcauagaauucucuuauggaugauugucuuuuacaaguccugugagucugaggaaacagaggaccagagagggcauccaggagcucagcgaagaccaucuuuguaaacgcauagcaucugucaucugccuaugcuuccccaugcucguguuuaccaagaugcucgcuugccauuugcucuccuacaugcuuaauuucuugaaauucuguaacugagcauguaggaaagcacauagaaguggguuauaauuugacaaauuucuaggcaguugcauggauuuucaucacuuuaguuuguauauauuuucaagugacuuauaugaauaugaauauaagucacuugaaaauauauaugaaugaaugcaaaacagguggguauacaggaguaaccagacaaaagugcaaaaguguccuuauuuucaaagagcuuucuaguagugagagacuuuuaugaaucucucccccuuuccuccuucccucccaccucaaucuuuuucucugucccuccccucccuccguccccccucccuccaccuuauaauuaaaaucaugaauguucuugcaucagcccuucauagucugugaaaaauaacuugaaagcaguggugaauuuacauaucugccacagugaacaagaguauacauaucugccacauaucuuuuacauaucugccacagugaacaagaguauacccuauuuauauaucuuagguucuuaauacuuguugagcugaauuagguugaaaugguuauguuuauagaagaguuauaaaaguauagugacacuugguaccauguggucauacucccauugaccuuucaucucacuucuuuauaaguuuuuuucuuaauuuauugauguaguguguguuugucagaguggucaacuuguagaaguuggucccuuccucccaucauauagauucuggaacuugaaugcagguugucaggguuggcagcaagugccuuuacccacugagcccucucuuucuuauuuucagagguucaucaucauguauucuauagagguaguucaagauuaucugucauagauaugaauuuccaaaguuccuagggaguggaacaaaauugcaauaaccauugccaagucaauuaaagcaauaccuuuuggcuuuauuuugugugaaaaaaagagauugugacagguuuaugggaauacacauguaaagcucuaaagaaaagaaaggaaauuauaacuaugacauuuuuguuuuauuuccuggcucauaaaggaaacuuuaagaaguuccugucuggguagcucaugaaggugguguguggugguguucuauacaccuugagagugguuuaaagugaugaaagcuaucccucaauccccagccauuccgaugugauuggucugggauagagugugggaacuguggcuguguuaagccacuccagugauuuuugcccugcagcugaaguugagagucacggcuguacagucauguuucuguaaggaccucaaaugcauuauuagguuauagucuguccaucugauacaguaaaauaauagucugcucacuucugucaagggcaugcaaucucuguaccagugugaaaagcacucuuaaauaacaaaauuacugccacagcucaaaggaauucauuucucuaggaaauauugacagugauuauguuaauuuuguauuguugcuguagcaauucgcuacaagccuagugauucaaaacagcaugguuuauuuuaucacuguucucaaaguuagaaggcuuuuagcuuccuuuuuuuuuuuuuuuuuuuuuuuuugagacaggguuucucaguauagcccuggcuguccuggaacucacuuuguagaccaggcuggccucgaacucagaaaucugccugccucugccucccaagugcugggauuaaagacucgugccaccacacccagcuggcuuuuagcuucuaaaggcuucauguucuucagcugaaaagcuaccuuacuccucuucucucuccuauuccugccuugcaauuauaaguccuuuugauuacauugggcccaguggaauaauauuauagacuagccuaaucucaaauuuccuaagcgcaucucuaaaguuccuuuguacacuaacacaauaccuucacaaagaaauuguaggacagcgcuugugaugaauguguuaauguuaacucaguuaacuuaggagucaggugcaguuguuauccacagaagugacguguucaaaaucacguaacaagugaauggugaaguuagauuucaagcccagaugcuuuugaguuuaguguucuaaccacaguguguugacuacuuucccuaguaucccugacuuuaagagcuuagccguucagcaaaaucuugcuggcauaugcaagauuuugcugaaaggacccugauauagcuguuucgagagaggcuaugccagugccuggcaaauacagaaguggaugcucacagucagcuauuggauggaacacagggacccccaauggaggagcuagagaaaguacccaagcagcuaaaggggucugcaacccuauagguggaacaacaauaugaacuaaccaguaccccccagaacucgugucucuagcugcauauguagcagaagauggccuagucggccaucauugggaagagaggacccuugguauugcaaacuuuauaugccccaguauaggggaaugccagggccaagaagugggaguggguggguaggggagcaggguugggggagggauagggaacuuucaggauagcauuugaaauguaaauauagaaaauaucuaauuuaaaaaaaguuaaaaaaaugagccuagcuguucauucaaaagacaagaugguuguuugaguacauaccaagugucagauaccuagauguaucaguaaacaagccaaggcuucugauaucaguggguucauauucuugaggaggcuacacaaauguaaugacaaaacaaaguuagugagaagugcugcaaggcaaacagaagcaauugagaguguacaaaucauagagguggcugugccacagaguuauuauauacaaaggggccagagaauucuguacaugauucgcugaaggaucagucuugaguaccauauuccugaacuccugcuauuuuccaugucuaguggaucccaaagaggauagaaacuccauaggaagaccaacaaagucaacuaaccuggagccuugggccucucagagucugaauuaccaaggagcauacacagcuggaccuaggccuccccacacauauguagcagauauguagcuuggucuucaugugggucccaaacaacuggaguguaggcuauuccaaaagcugguggcuguaccugggauauguuuuucuaccugggcauuuuuuuuuuuuuuuuugguuuuuucgagacaggguuucucuguguagcccuggcuguccuggaacucacuuuguagaccaggcuggccucgaacucagaaauccgccugccucugccucccgagugcugggauuaaaagcgugcgccaccacgcuaccugggcauuuugaaaaucacaaucaugaaagauuaaaauacugaauauugaaaugcugaaaacagaaacucccaaagugaugauucacaugcacucuaaaaaagcuacgagacagcauaaagcugaauucuggggaauuagccauguacuacagcaauaaaaaaauaugcauuguuuagguccauuggcauucacuguagcugauaaucucugggaaccugucuuugcccgaagaagccagagaaguaagugaguggcuugacaaugguugaggaugugguagauuaagaugaugcacagcacuguugcuguuccauuaucaaugcuguuuucaaaugcgugcucuguguagaaguaccugugugacagguuucuguaaauucacaaccauacagucauaacaccaaauaugggacaaagagagaacacauagaauuuuaaaaagagaaccuucauguacaaaaugucuaucaauugcuagacauacaaagagcgacauauucauagaauggaauaauauucaguaauaaaugagauuaaucuuaaaacauuauguuaaagaagcaaugaguaaauuauauauuacauguguauguauauaggauguccagagauguuaaguuuugcgagauagaacacauuuaacuagcucuguggguggaauugggaaucaauuccaaaucaauugcaaauucaaugaauugacgaugaauacagaaaaaaacccugagcaauaaguuacuuuuucuuuucuggaacucaggauugcacugaaauauuaucucuucgucagccugugucaguuuucagaguggaacuuauacuugcucuggaacucugcuugucuugucucuggauucagucugcugucucaauucuuccauaauuucccaagcaccauauuuuccuagcccuccucucuccuccuuaauuaaugcaaacauauuuuacucauuuauuuaccaacuguuagacauuuauuacaauuauugguuggcuauuguaaauaccacugugaaacugaguauauaagcuuuuccaugagauccugucuuugauucuuggagauacauguugaaaacuggcaugacuagaugaugcgauaguacuauuuuuauuauuuauacguuugaauguuuucaugcaauauuuugauuguauuuucuauuucuccaacuccucccagauccuccccuuuccuacucucccacuucauauucugucucccuauuaaaaaaaauaaacuaaaucaaaacaacaacaaaaaaaaacaaggcacauguacaacacgcggacucuguucuguuggccuucugcuccugagugagacccauugguuguucccuuauaagaagccaagugacagaaauugagguagaugauuggaagaguaagccauuguugccgcaucaaggaagaagguucaugcuuaugagucccacuacguuaugggaagaaaaucuucaggcuguucuaaucucuguuuggcaucagaauggaagguuggguuagggguguuuguguaauauugguuuuuguugguguuguuguuuugguccuguuagcccaaauuccauauuuuccauaucccuguuaaguaugcuuuccacuuuguacaugcauggagauaauucuucaacuaauugaaaucauuucauggacuagagagaacauacauaaucugacuaaaaauuccucugaauuugucaagaaauauuuuguaaaaacaaaaaagucaccuauuacuauaauaaaaaggauuuaugcauugaaugaauaggguguaggauagauaagaauccugacauuuguguaauuuaugauuaagugcacugagaacaaaacaugguuucagguuucacuggcugaaaaccauuuguguauuguuuauuucucugauggauauucaagauauuguucguuuauaagugauaccauaauuaacauaaaaccuggauaaauacuuuccaaaagguauucugaauaguauccccuccacauacccuccaucugugucaggugcugaaauaaauauaauggaccuagucuauaguggagcaaaacagauaauaaggaagauaaauuuacuacugaagagucaccuuaguguaaacugugaaauguguuacaaaggaaaauaacaaaguguagugaagugggcagacuaaagggaggccuugucaacuugcucaaaggaggacuuuauggaaguagcauuugagugagaucugaaagacaaaagaaaaccugcaagguaagaguugagaggaagaugcgagcuacuauaggaaaacucugcccaaggcauugaggacagaaugagcuaccuauuggaggauuucagugcuguagagacacaaagugugguaggaaagggaccgagaagacuaggaagacaggaauauagggcuauagaauuuguaaugaaaucuuuacuauagauauuucagauuauaaguauuucuuuuguuuuauucucaucucacugucucaaaggauuuuucccuuauauaagcaucacacauaauuuugaauaugccuaugaccuuuuauuuuuaugguaggauaaauguaaucuguauuuaagugugucugaaagguauacuuuaauauauguuuaaauauaguuuuaauacaacuauauacauggauacucacauuuaaacuucauaaauuuuuuaaguuccaaaaauuauucuuuugaacuuuuuuuuuagcucuuaguugacacaggaaaaagucaggaauagaaucuacugcaaaaauuacagaacuuuuaguacuucauaacuaaaacuguaccuuuugggcagcaugucccuguuuuucuaaagccugcaguuuuuugcaucuccauuguccacacaaaaacauagcucucaccucacuuggaauaagacauaguuuuuucagguugaccaguacacuaacaguuuacugaaguuuuuguaauaacaacaaagaaagucacaaaugaagguuuuuuuuuaaaauuaaagauaaggugggaauauccaguagguagguuacaucaaagugagugucugcucuaggcccagauucucgcugguccccuuaguaaccuugggguugaugaaaacuaagugucuguuuuuacauuucaaaaaaggauuugacugauagucacaaggcaauugggucaaacaccagaaguaggcaauaaauggcuauuaaggggcuaaagauagcucaagauaauuuggcuccagaccugaagcauuaaccucuccagagucacagaaguucuucuacucaacuggucuuuucuauuuucacauaggacuuggcuuuucccccugagaacuuaaguucauacugcuguuuuguguucaucuuuauagacucuacauaugagaucauguaauguuuguaccugauccuuuucacuuaguacaaugucugcuagggucauuccuucuuuuuuuuuaaguagauaauauuccauguuguuuguaucuguguuugugcaccugccaugacuuucuauggugacugauacuuggauuguucuguaugaaucaaaugaauaauacuauaacaggcacagggguguauauaacuccuuuaggauccucagcucaguuucugaggaugucuaagcaggagugggguggcuggcuggcaugguaguucuauuuuuauucuuuugagacagcuccaaacuauuucuuauaagggcuagaccaauuaaaauuuauaucagcagugaauacuaguuccuaccccacccgcaccccuguucuuacaaaaauaaaccuuccaucuuuuaguuacuagcuauuugaagaagagugagguucuggguauguugguucaugcuuggagaaaugcaacuucauagccaucaaaaugguccucauagaaaggccugccaggucuauagagcaagacauuaucucaaaaaaccuaaaugaauuaaaagaaauagugugagguuaugugucaauuguagcuuugaguuguauuugccuagugagcgguuagugguguugacccuuuggucgugucuccacuuuguagaaugaguuugggggugcuccuuuuguuacucuuguuuuggggguguuuuaggaaguauugcuuguaggucuauuuugaaagugauuguuuuaggguggcuucuuugcaucugcuccugacuuguaagguuucuguuaauaaggauguugaucuaaugauccuauucuuaaauauaacucaguguuuuucuauuguucuuuuuggaaauuucucuuugucuuguauuuuugacguaugucaggagcgaagguauugucuauuuagaccaugcuuauuuaauauccugugggccuccaguucguauguauucacaucuuccucgagguuagggaaguugucugcuguuauuucuuuguacaguuuuuccccaccuuuuacuugauccucuccugcaauaccucagaauguguacauuuguugcuuucauaacauccuacaucuuaaggcugucuuauuucuuccuuuuguuuuuuuaauaacuucuauugaauuuguucuuugacaaaguauauucugguuauugccaucaccuuuacugucguguguccccccuccucuccacuucuggccuuucuccuaguccuuuccccacauucuuuugguuugucugauugguauuucaauauacugaccagcuuuagcuucaguuauuacuuccucuaccugauacagucuauuguuguagcuuuaaacucgaucuuuucaugauccuccugcuuccacauccuucagcaaggacuacuaucagucugugccaccacaacuggcuaaacuguaucuuuuauuugacuuauugagcuccuuauaaugauauuugugugaauaucuuauuccuuugcugaauaucuuauaugauucuuuuuuucaauucaauuuuauguuuuguuuuaucggauucuuauuugucuagcagaaugucuucauauuucguacagacuggacucaaaucaucugucauccaggcugccuuccaacuguugauccucuuuauaucauccuccuaaauucugggauuacaaauguaagccaccacuauuggcuuccuuuaaguuccccccuuuuuuugguauuaauuccuaucuacugcaaaaagcagcuucucuugagggcugaguaaugcacugaucucugggucuacauuaagagucauuuuguugcuuuggcuccuuuaaauuucuuaccauguaucaucucucaucggguucuguuuauauuucuugugcuucuguguugaaaucugcauaucgggugaaucaauuauuccuaucucuuuuguggaggaggcuuuguaguaaauugcuuuucucuaaagauguauaucgaggugucaguuugguauguguguuacuagguguauuucgacucaaaacaaaaaggucuguuugggcucauacuuuuacagauuucaauucauuauguaagaaucacuucuauucuccugaaguaauuguuguuucugaggcuuacugccucaaucuguuaaccuaggucuaguccuaguggcuuccagccucuguacaaucuuaucuaggccuagaauguuuucagccucugacauguacugcuaaauaugcucaccauuucuaguuguuucugaaccuugccuggcuguuucaauuagcuguucuggcucaaacuccucuccaaguggacugauucagucuggcuuuucucucucagccaucuccugaauuguucugcuuggacucauacuaauuuuggcaauaaguucuacucuucuggcuccuucugucuucaucucugucuagcuuguucucuuugcaaccugucccgguaaaacugucccaguaaaacugccucaccuuuuuucugcacugcuccuuaaguacuuuuccuuucuucucucuucuugagagaguugggcauauacuaucuugucaaaucauuuucucauucgucacuuugucugccacucaauuagacaucacuuucaaaccugggugccuccuuguacaaacuaacuuuaccuucgcacacucaggaauacuauaaaagcacuaaagucaaaggcaugauauauaugcauagaacuugaugaagacccauguaggcccuguguaugcugccucagucucugaguucauaugagcuuugcucauguugauauagagggccuuguucuccugguguccuccauucccucuggcucuuauacucuuucuaucuccucuuuuaugggguuccuugagcucugaggggagacauuugauugagauaucccauuuacagcuauguuuuccaaggucugucugucuucugucucugucucucucuccccauaaucuggcugccagucucuaaauguguucuuauaugcuguaggaggaagcuucccuaaugauggcugaaauagguugaucuauuaguauagcagaauaucauuaggaggcauuucaucacuacuuuucuuuuguucuuucaagaccaguaguauuugguuuuacccuaggucuuugggcucuucucugguucuuggucacccaaguaguaucggguauggguuauggguucuauuuuaugcacugggcuuuaagucaaaucagcuauugguugguacaaacucaugccaccauugcccuaguauaucuugcaggcaggacaccauuauagaucaaaggguuugucgcuggcuugguguucaugugucuccuuugguagugugcagaguacuuuccuguaacaaaaauacuugaaaguaggggugaaggcucuauauaggcacugacauuuccaugugaagauauggucuucagcaauggggccuugcugacugugaaaagcaaccuauagucugggcaacagucuggcuuguuuggagauuccuaucugaccucuuuggccaacaacucaauuaaauggaaccuaaucuuagucuuggaagcuuccuuuggugaaaagagauggcucauugggacucucucuuccauuauuuggcaauuucaucuagaucauauauucauauacuuuaggaaguuuuuacuauaucagauuuccauacaaucuuccaaaugccccuuaauuuuagcuuucuuuccccauauuuccucugucacuacccucuuuccacuccuucuccacuugauuuugccuuuccaacccccaccuaugcuuccauaacuauucuauuuacuuuuucuaagagauugauguguucccucuaguuccuuacucuagacuugugcucugugauucuaugauuguagcuugguuaucauugacuucacagguaauauccacacgucaguaaauaugaacuacauuugucuuucucugucuggguuaccucacucaugaugauuuuauuuuuuguuucauucauuuguuccacgagcuuugccugcaaacuuaaugaugucauuuaaaaagagcugaguacuauuccacuuuuuaaguauaccaucuuuucuuuaucuauucuucuguugagaggcauuuagguuguuucuaguuucugauuguuauaaauagagcagcaaugaacauguuuacaauaucacugugguaggaugaaacauccuuaugcccaagagugguauagcuggaucuugagguaggucaacugccaucaucuugaggaacugccacacugguuuccauaaugguuguaccaaguuuguacucucacuagcaguggauguuuguuccucuuacugcacaucuuuucaaaauuagcugucacuuguuuugcugaucuuagccauucugauagauauaagaugaaaucucaaaguagucuuugauuugcauuucccugguaacuaaggauguugaauguuuauuuaaguguuucucagucauuugaguuucuucuauucauaguuuucuguuuaaauuugugcccuguuuuaauuagguuauuuguuuucuuaauaucuaauuucuugaguucuuuauauauuuuauauauuagccuuuuauugaauguggaguugguuaaaaucuuguaccauuuuggaggcugcugcuuuguccaauugauaaugucuuuugccuuauagaagcuuuucaguuucaugagaucccgucuaauucuuggugccagcacuaagagcauuauguucagaaagucuucuccugugucaaugaguucaaggcuguucccuauuuucucuuuuaucagauucaguauaucugguuucauguugaggucuuugauccauuuggaguugaguuuuuagcagagugauauguaagggucuauuugcauucuuauacaugcauauaguuugacuagcauuguugaaaaugcugucucuuuucuaguguguuuucugaccuuuucuucuucuuuuuuuaaaauccaagacuagguaucuauaaguguguggauuuauaucuaggcccucaacuuaauuccauugaucacugggucuguuuuuaugccaauaaaacagacuauauuauuaccauagcucuauaguacaacuugaaaucacaaaaggugauauuucacuaaggguuguagauuuauuuaaauugcguaucugaucugcaguuagccugcuguagagugucugcuagaacuggggacugggauaaagcaaugaguggcugaaacaugguuuggagggaagaucuguaugauccacuggagauaauuguagggacaaaagcuguuuaugagacugggaugucagauuugaaggagcagaaggagaggugaugauuuauagucagccuaccuguuuccuuggcuguagagguguguguguuuagaguuguguauucuagaguaaggagcuggauuaaagaaaugaguuggggaagggagguuaguagggucacaugugggauguaauagagaugggaggcuccagcaggucuguugcagaguuggggaugagacugggggauuggaucuggaggagcagauggagacauaaagaucugcagccaguuuaccugcuugccuggcagaguggacugugcuuucccagggaguggcugcuagaguuggggucugcaacaaagcaagaguugggggugaggaguaagaaguaggauagaugugagauucacuggagaugggggggggguuggaagggaggcugugcaagugguuugcugcagugcuaaggauaagacuggggaauuggauuugaagaacagaagggaaggggaaggucuggcauuagccuaacugcuucccugaccagaguggccuaugggcuuccagggagucaacauucuuauuuuaauuuuaauaaauugguaucuuuaugauaauuucauauuuguauaucauguaauuugugcauauauacuuccuguuguccucuuaauucuuaauugucuuucuguuuuugacucaaaugucauuucuuaaugaaacugcuuccuauacccagaauagaugagcuuucucugugguuaagacucauugaucuuuguacaucauacuucuaguguagauaauauugaaaacaaucaauuuauguuguuuuaauaacuaacuucuucccugggcaguggugcugcaugccuuuaaucccagcacuugggaggcagaggcagguggauuucugaguucgaggccagccuagucuacugaaugaguuccaggacagccaaagcuacacagccaaacccugucuuggaaaaaaaaaaaaacuaacuucuuucacuagaauauauuccacaggaacagggauuauuuauaauuuuuaaaaauaaaaaauuaugauuaaaaacguuuuauauauacuucuuacuccaauaauauugguugauuaauugaguuggaauccugaaacaucugagauuuuuuuuuucauuuuauugugugugaguguguguguguauuuauauguaugcccaugguuauuucaaaucagcuuuaauuauuuuuucaacuuacugagucaggggcucuuaaaccaaguucuuauugauucuagucuuccuggcuuguuuaggagaucguguaauugugugucucuaccuguuuguuuguuuguuuguuuguuuuucgagacaggguuucucuguauagcucuggcuguacuggaacucacuuuguagaccaggcuggccucgaacucagaaauccaccugccucugccuccugagugcugugauuaaaggcgugugccacuacgcccagcugugucucuaccuuuuaagcuggaauuauaggcaggcuaccaugcccaccuggcuacuccaucaguucugugaauucaaacuccagguuuuaagcuuuggcaagcaagcucuuuuuaaaaauuaauuaucuuauuuaaauuucaauuccaaauguuucccccucucuguccccuguuccuaaguuccucaucuuugccuccgagagggugcucuucccccucauuccccuucccuggggcaucaucucuacaacauuaggugcauccucucccauugagaccagccagacacaucaauccucuccuauauauguucugggggccauggacuagcccauguaugcucccuguuuaguggcacagucucugggagcuccuagugguccagguuaguugauucuguuguucuucccauguucaauccuugcccuaauuccuccauaggggucucccaacuucaauccaauagguggauguaaguaucugcaucugucucagucugcuacugguaaggccucucagaagacagucaugcuaaucuguaaacacaucauagcaucaguaauagugucaggguuuugugcccccuccccaagagauggaucccaaguugaaccaggcacuggucagccuuuccuuuaguuuuuacuccauuuuuuugucacugcauuucuuuuagacagaaacaauucuaggucaaaaauguugaugguggguugguaacuccaucucucuacccuuucuaucuacaggagauggucuuuucaaguuccuuccccccacuguugggcauuuuggcuaaggucacccccacugaguccuaggagucucuuagauuccaggucucugauacuuucuagauguuccuccuacccccaccccagaagcugcauauuuccauucauuggcccuuugggcuucucuccuguuuccuuacacccccccauacaugauccugcuccucuuucugcuuccccuuccuugucccacccaggucccucccucccucugucuuaggugauuauuuuguucccuuucuuagugggauuaaagcaucucaccugggucuccuuucuuguuaaacuucuuacagucuauggguuguaucauggaaauucuguaccuuuuuggcuaauauccacuuaucagugaguaugucguugggcaaguucuuaaccauguggccauauccauggcuuagcaccugaguuuugauaagaaauagaaauguaaguacuugcuuaaugguauagagggaaaggcucucuugguaaagugcuuguuauacuaacauguguuuggauucccuguacucacaaaaauucccugaaaucccagaacuugagagauagaaagaggaggcuaucuggagcuuacuagccugccaguuuagucaaaucacugaacccagcuuaauugagauccugucaaaaacugagguugaggaauaguuaagagagacacccaguguugaccuguaacuuacaccuggcaugcaugauuggccuaauuaacgaaaauuucuuuccugagaucuguuacuccuauauaauugcuguaauagaauuugugucuuugucuuagcauaucagacaaagagaaugguaacuacaaagucccugauacgaagggaagucuagauucucaguguuucgaaaguggacugauaaacugaaauacagcagcuaaaggggaaugugauucaaaaugagauggaaaggguaaacugaauggaaacagaaaccauuguuuguuuuaagccuucccaaaccagccaaucaguucuucccucugugcucucuucccugauccuuucagccuuugaaaacaguguagauggcauuucaggagcauagaaaucucuggugagaauccuuuuagagaagcucccuuaugcauaaagggaaggaucuuccucuguuuuguaauagaacaagaacauauaugagauaacuaaacaauaagaugacuguauauggauuacacagacacacaugcacaugguguaagguaaucuguuaucauuacaaagcauuagacagaagaauaaaaaaccauauucuuuaaacaaagacuuuaaaaauuauuuauuuauuuuuauuuuauguauauuggugauuugacugcauguaugccugugagagggugucagauccccugguaugggaguuacagacaguugugaguugccauaugggugcugggaauugaaccuagguccacuggaagagcagcuguuguucuuaaccacugagccaucucaccagcccacuaccuuucuaauuagauauugaugguuugcauuucuagcucguuuuuuuuuuuuuuuuuugguuuuuuucgagacaggguuucucuguguaguccuggcuguccuggaacucgcucuguagaccaggcuggcuucgaacucagaaauccgccugccucugccucccaagugcugggauuaaaggugugcgccaccacgcccggcucuagcucauuuuaaguacaguccuuuuuauuucucuuuuuggugaauaauuucaacaauuugugaaacccauugauauaauuucuuucuguuauuugcuuaucaagcaguucacccccuuauaauuugucuuuccuuuuacuucucuuuauucuaucuagucuuaaaauaauuaucugugacagaagaacaaaaaaaaaucucuauagaauggaagguggggaagaaucuuuucuguuuauacaaauuuucagauuauacaguugauaagcuucccuacucagguuuuaucuuauucugaauaucacaacauguccuauuugcuaccuuauuauuauuaguuuuguauuucuugguggauaggggaggccuuauccuuucuauuccuuugaaccaugugugaacaagauggccuccauuucuuuuaauagugaaaaggaaaggaaaccaucuagauugaaaagaacaaaaggagggaugagguaauuuauagaugauucuaucaaagaauguagguccaagucauacuuaguaauuuggggggaguuuaauauuguaacuacuuacagaguuccaaggaagggauagggaaaucauuggaaaggauauuaucauuuucuauguaugauaauagcaagugauauuauuauucuuugaacugauauggcguacauagagaacaaugccuggaaaacucagaauuaauauuuaggucuauuaguagccacuggacagagugaugaucuuugaauagauguagaaaucagucugcagccaucuuuauucuuccuccuucaggacuccugaugguauuucugauuugguaaacaccgacaaaagcuacagaaacggagcccauuuaugauacauaugcuagugagcuuccagagucucacucagcccagaguggagagaguuggggagaugaucugcagggcaaaauagaaaauauugacagucaugacucucuguauagaaagcaauuugugaaguaguauuguuaugaacaaaucaccugcaugugcccuuaaagauuuuuuuaggaagguauauauguuggucuacacguacauuuauucacaauguuaaugaguuuggcaucacuauggcauacccgacagaaacaauauaauggaggaaaagauaaauuagauucaugguuucagaggguucagguuacugcaaaggaggcuugguggcaggaacaguucagugcauggucacuggagugugugguagauaacaucaugugauggcaagagcaggaagcagagaggccaggguuagaaauauuacugggugacuacuuuuaccagcaaggcucucccuaacguuuccaaagacacuuccagcauuaccugaagacaaggagcaaguauucagccauaauccuuaggggaagauuuuggauccaaacuauagcaacuacuuuguuucgaagucaaguuaaugaucucaacagaagcugcuccaaugaagacuucccuugguuuuuauuccccauauacuugccuuccccucaaccucccacccugguauuaugagguacucaugguuggauauauuuaaagaaagugcuuuaagcucaccauugugaaggucaagggcaucacugguaucuguguggcagugaugaauacuuaagauaaugggauaccaaugacaguaauguaugcgaacagagugggaagcaucacacagaaagacagaaagccaaucaaggaggaagaaacauguuuuuuuuccucuuuuuuucuuuuuugaaucgcucgucagaacuauuucaggucuauaagagcaacuuucguuuaagagcuguguaugucuccaacugacggaaucaacuuuugcuaggcccuccaccauaaaaguccuaugagcucuuaacaucaccaugguagaaauaaagacacaaugcucugggaacauguuaauaccauguauaaaucauauaaacuuuuuuauuuuguuuuuuauuagguauuuauuuaauuuacauuuccaaugcuaucccaaaagucccccaccggcucccccacccacccacucccacuucuuggccuuggcguucuccuuuacugaggcauauaaaguuugcacgaccaaugguccucucuuuccacugauggccgacuaggccaucuucugauacauaugcagcuagagacacgagcuccgggggauacuaguuaguucauauuguuguuccaccuauaggguugcagaucucuuuagcuccuuggguacuuucucuagcuccuccauugggggcccugugauccauccaauagcugacugugagcauccacuucuguguuugcuaggcccuggcauagucucacaagagacagcucuaucuggguccuuuuagcaaaaucuugcuaguguaugcaauggugucaguguuuggaggcugauuaugggauggauccccggaugugacagucucuagaugguccaucauuucgucucagcugguucuuguccauucuuguuuacuuguuugauuuuuuuagacagggucuuguucuggcuuucaggguagccuagaacucauuguguagcccacauugaccuaaacuuguggcauaaaccuucuuuucucucuucuugagcccugggcuuacaggcacugguaacuagaaaguaguucuggauauaggcauucagcaguggggauaauacaaguauuucagugaaagaaaaaaauacaaagaaguagaaugugcaaauguagaauuauuucagaaauauuugucagacugacaucuaugcugcacaaggugaagccauuagguggguuugguguaugcauuacuuacuuugcucuuuucuguggccauguucuugacaagaaauaguuuaaggaaagaaggacguuacauacagcucaggggaaugcagucccccgugucagggaaagcucagaagcagcaggagcaggaggcaggcugaucauuacuacaucagcagucuggaagccuggcuguaaaaccuccaccuccaccuccacccugcuacagugacucacuuuuuccagcaaggcuccaccuccaaaaggcuccacaaccuuccaaaacagcaccacuacaaacauacagagggcauuucgcauuuaaccuauauccauaguccauuugcugcuuuuaauacaucuguauauauggguucaccuauagaucauauaguugagcaugcagaaucauaggcauauaaaugaaaguaucuuucacaugcuaaucuucauguuuucucuauacacacugaggcuucugcaauguacccauauucauacguaaaaaucuaagucuuuccucuguuuacaguuguucagcuaugcuauaguuuauucauuuuccugccauagguaauaguuuccaaauuuaccacugcaguuagagcacucaagguuucaaaaaugugugcuaaucaauuuuaaauauucaaauuaaaacaaaagugagauaucgucucacauccacugaaauagccuuuagggacacaacuuugauaccaaauguuaaugauacagagaaaggguaucuugauauccuagugguggaagaguaaauuaggauagccaucauggaaacaguauucgaauuccuuaaagaauuuaauauagauccacauauuaugcuagauaaguaugagauaguuaaaguucaugggaaaguacuucucacacauuugcugaauggaucaguuaaacuuccugcaaucacugcuaacguuuuagaaguaaaggauuaguaauuuggaguuguucugaaaacuaccaacuuaucuuguauaauaauuuaauuuuaaaaguaucgauuucuggugcuacacacaguaauucuuagcuaacucgaccacaggccugagagaacaugccaucuauuugcuauuuuagaugaaaaauaacaggaaaggaaaacugucacauuaaauacuguaucuauauauucgcauaaguguuuuacauuaauuaagcccuuaugaaauagauaauaauaauaauaauaauauuauuauuauuauuauuauuauuaucacuuuuuaggugggaaaugaaggcauaaagcaagucauggucuugugcauacuggcugaagucuacauuuuaaccacuuuacucaaggggaacuucuacaccauugguuaguguuagacuagguucucgucuagaucuugggucuuucuguuguaugaggauauauuuugccugucaaaucucuucuaccacguuaguuacuuuacauuaugaguuuauuuucauauuuguuacacaaauguacauucaaaugaaauauccuagggauguauuauaaaagaaagcuuuucaucauggaauccuacaaagaguuuauuagcucuuugggauuagcucauuugggucauuauaggaguugcuauagcucuuuuaccauuugcuuuaaaauugagaaugggccuccuauucuggaguauacaacagugcauagucuagaaauuuauuuaauguuuucagucucaaugucuugacugaaagaaauagcagcaagacucauaaaaauaaauuuuucauucguugucauuauuuuccuauagcacagaagcaaauagagcuaggaguugggaccuaccaagcuuggagacauauucacuuuggugaacuugcccuacagaugguguaauggagguaaaaguagauuucaaagcauaauugcaguaagcucagaauagagccuucuuccuugcccuguuugaagcuacuggcuggcaaugaaagcauucauucucuggaggaagcaaaagacacaguaagccuuuuagagaaaaagaaggauguguauguguguaguguaaggaaggagaauagggacaaguaguguaggguauaucagugggucgcagggugacauuagucagaguguugggcuagugucacgauuacuuucaaaugaaaaaugagcacguuguuccacagugcucaugggaaauguugguaaugauaaugcuugugguguauuuuugcuaguggacuguugaauguuuagagguauuagugaauauuaguauuauaacuguuuagguuuuuauagguacuggaucuuuauagccugggucaaaauaggacucaccacauaggguaaguuggccucaaauuugccagccucuugccucagcuuaccaagugcugagaugacaguuguaugccauuguaaucaguauuacuuugagagccaugaguggaauggcuguuugcccuggaguuagauauugaaccuuuaauauccuuuauuuaauucucucucaaguucaagguaaaagaaagaggauuuauguauuuauuuguuuauuuaauguggaugacuaugcauguuagcuauaaaacuuggauucuaagcugggcagugguggcgcaugccuuuaaucccagcacuugggaggcagagacagguggauuucugaguuugaggccagccuggucuacauagugaguuucaggacagccagggcuauacagagaaacccugucuugaaaaaccaaaaccaaaccaaaaccaaaaccaaaaccaaaaccaaaaccaaaaccaaaaccaaaaccaaaaccaaaaacaaaacuuggauccuuuggaagagcaaacaguaaucuuaaccgcugagccaucucugcagccacagauagaguuuuuuuuucuuuuaacaacaaaaguaagugaaacuaguguucauuuugagugaaagaauagaauucuacuuacauugcugcuuugcuccuuucucugcuauuaucauccuguccuaaauagauuuugaaccauuuauuuauuauauuuguuauauuauauuauauuauauuauauuauauuauauuauauuauauauuuuuuauacuuuuuaauuuuaguuuccauguuaguaacuacaaguaaaaaugagcugcuuagaggagacaaugaaaccagucugacauagccaucagucacugugauguuaaaggcuuugaguugccucugcuuguuguaugaauguguaccucacaucaaaagcuguauuagacagccuucuacagaguagcauaagcagcagaauauuuauguauauaauauguaguguauauuacaguuguuaaaauuuauuagauugccuugcaaugucuuugcuuguuagucccauagcugucugcgcucgggaggaaaauagcuuuagcucuaagucuuggaaguuccuuggcaagcuguuggagaucaguucacacuggaaggcugaagcugugcucugagagcagcaggagauggcaguagagguuguagacucaagcauucaugaagaggaucugucaggaagacagcaauuuuucucuccggcuuuucacugagaaguaaugucaacuuucaggauggcccuuaccuacacaggcagccuugccucaaaugcccucauagagucucuugguggauucuaaauagucuuaaauugacaagaaagaccaacaaucacaaaaggaaaaugcaacaaguaauuacucuguauuaugaugaaauuggcaccaaauuuagucauuugauauucgugggagcuuauauauugucuaacucuccaggaauaaaaguauauggaacuguuuauauaaauauuuaaacacauaugugauauauguuacuuuauuaucucuuucuaucuauguagagagagaaaacugaaccauacacaaugacaaguuuuaauauauuuucacugaaaauacuauuuuuuauguaauauauucugaucaugauuucuucuucccaaauucuuugaagauccucccuacuuccucacccauccaacuccaugcccuuuuaucugccccccucuuuagaaaacagacaaagaaacaaacaagccauaaugaagaaaaaagaaaaaacacacagacacauaguuacuugugcaugugcacgggugcacacauacauacaaaccauaaaaacauaaaauugaaaacuauaauauacaagcaaaagacaaguaagauuuaaaacaaggcccagucaaagcaauauuagacaaaguuucuacgagaauaucacugaguuauuuucuuguuggccaucuacugcugggcauguggcugucccuaaguaugcuuaauauacguaugagauuccauuggggagaaguaauuuuuccuugcaaaaggaugucaauuaguuuugcuggcuguaguaaucuaaguuggucaauauucuacauucucauggcuuuuaugguuucuguugaguuucccucuugcagcaaugaauguuguucuuuuguucucucuaguuaauauuuuaauugucacaugggaugggaacauucuuuucuggucuuguuuugaaguucuaaaggcuccugagucuagguuaucaucuccguuauauuagggauuuuguagggccccguuuaauugaauauuuuuaugccuuuuuucugauauucuauuuguaugauuuguaaauuuucucuuauaaugguauccgacagaacauacauguucuguucacauuuuguuuuaucauaucaugucaguaucugaaugucuuuuuguuguuguuguuguuguuuugguuuaucgagacaggguuucucuguauagcccuggcuguccugaaacucacucuguagaccaggcuggccuggaacucagaaauucgccugcaucugccucccaagugcugggguuaaaggcgugcaccaccaccgccccgcuagcaucugaaugucuuaauucaucugucuuauccuccguuucugcuagucuguagucugucuugcuugaaccaaucugcuguuaagucuuucugcugauuuuuuuuuacuagacuuacugaguuuugcauuuuuaaauuuuaaguugcauuuguuuuaguauuuuauugcuauugaaucuuuugcugauuuucuuuuuuuuauuuuuuauuugguauuuucuuuauauacauuucaaaugcuaucccgaaauuucccuauacccucccucugcccugcuccccuacccauccacucccaccucuuggcccuggcauuccccuguacugaggcauauaaaguuuguaauaccaaggguccucucuucccaaugauggccaacuaggccaucuucugcuauauaugcaacuagagacacgagcucuggggguacugguuaguucauauuguuguucuaccuauagaguugcagaccccuucagcuccuugggugcuuucucuagcuucucuauugggggcccuguguuccaucuuguagaugacugugagcauccacuucaguauuugccaggcacuggcauagccucauacgagacagcuauaacagggucccuucagcaaaaucuuucuggcauaugcaauagugucuggguuugguggcugauuacgggauggauccccgggugggguagucucuggauaguccauccuuucgucuuuuugcugauuuucuuuucuucuucuuuuuuuuuuucggggggguucgagacaggauuucucuguauagcccuggggcuguucuggaacucacuuuguagcccaggcuggccucgaacucagaaauccgccugccucugccuccugagagcuuggauuaaaggccugugccaccaugcccagcuuugcugauuuucugaagucaguuguuuauuuguauucuauuagaauuuuuuaagaauuuauuuguauccucauuuuuaucaaaccuuccuaaucguucuuuuuuuaguuuuuuuaauuagauauuuucuucauuuacaauuucaaaugcuaucccaaaaguccacuauccugccccacacccccacccugcuccccaacccacccacucccacuuccuggcucuggcauuccccuguccugggguauauaaucuucuaaagaccaagggccucucccuagucguuguuuuaaagucuuugagauuucauugaauuuacuguauuugggagccauuaauguggaauugguauuuuucaggggugugugucauacaguuuugggugcuuuuuuuuugucuuuguuacauuacugcauuggaauguacacaucugugauuguucuuugcuuggaguucuaaauuagcuuuauucuuccauuugaaguauuuauaauauuugaguggugggauuauuuugacuugauccuuuuagaaauuggacauucaguccauaugcucaagguaucugguguauuacuccuagagaguagaauaacuacagcaaaaccguuuuugcugaguaggcccaccaugcaaaucuacuggccaauacacaguaguuagugcuccuuuuaacuucaaaagcgagagaaauggaaauaguuaaggguagcauauuacuaagguaaagacugaagggccagcaaggugggacagugaaugaagugcuuggauaaccugaguuuaaucucuggaaugcauauaaagguggaagaagagaacugacuccauaaaaauguccucugaccuucuuguguccucuauaguaugugcugcaaaccaccacauauauuauauacaccaauaauagacuacuaguaguaaugauuuuaaaaauauuaggagcuaaagagaaguagacaagaugaggauaagaauuaauauaacaaccgggcggugguggcacauaccuuuaaucccagcacucgggaggcagaggcaggcggauuucugaguucgaggccagccuggucuacagagugagcuccaggacagccagggcuauacagagaaacccugucucgaaaaacaaaaaaacaacccccccaaaacaaaacaaaacaaaacaaaaagaauauaacagcugugaaaaaacuaagguaggggaagucuaggguacuguuaaggccuguggauuuuagggaguuuuggagcucuggaaugcuguagucaagaaguaaugacaagaagaaagguaggugugguaguuugaaugacaauagccccauuggcuccuagggaguggugcuacuaguagguguggccuuauugaaguaggugugguuuuauuggaguaugugugaguaggggugggcuuggggguuucagaagcccaacccaggccucuucucucugucugucugucugucugucuuugucuuucugucucugucucuuuuccuccuccguccccccaccugcagauccagauguagaacucuugggguccuucucgagcacccugucugccuaugugccgccaugaugauaauggaccagacuaaacaucugaacuuguaaggaaguucugaugaaauguuuuucuuuauuagaguuccugugcucauggugucucuucacagcaauagaaaccugaagacaguagagaagagauaaggaagaaaagaggaaugagaaggaaagaaucaguagaguagaacaguagaucuggcucaguagacuggguugagaaauacagagcacagugauaaaaccuaacuaguaagauaaagacuaaaacaggacccuuaugagaaugaaaguaacaaauaaaaauauuuuaaaugauaaaauauuaacaugaaaaauugggcaaaguauaguaaaguacauuaaauuacagugaucacauuaguugguaguguuuggugggaugcauuuugaauaucccucccacaugauguuucaugcagcaaauugcacugaugagggugguguaauuuauaauugcaauucaagcuuaugagaucauauuuggguuauuuauugccccaguagcauugagauaguuagccguuggauugaguuuuugguccagguaugcuccguugagcuguguaguucccagcuugauacucugucuggaucugugcuguguuagggaaacgagcauggaaaccuuagcugaccucuguacagucuaagcagggagucuccaaaggucuuguaauauuucacuuuggccagaaugguuuucugugguuucuucccauggaaguguguagggcccucgauuucacuuacaucaugaaucuugauggagccuuaugguacccacugaucuugggcaaucucuuuucugugcuucaaauucuucagcuuccaggccuuacugauaguuauguguucauucuuuguccauucagcuguguuucuucaggaccaguguguuugaggggagauacuucccuggggcuccuaugacaucagugaagcuccuuagugcugauuuucagccacucauacugguuuccccaagaucucucagcagacaguuuuaagaaaaugaauuuacagaaaaaaaugaucauauauguguacuccacuacaguuuuuuuuuacugucauuuacauccugcauuacuguggaguauuuguuuuaagcacagaaccaauauaaugauaucaguauugaucuagcauuaauagcugaaguacuuguauagauuugugagaauugguaaacauauaguguuucauauucaccauucuaguaucuucuagaauagauccauacccuaaaaaauucuguuuuucucucuuuauuuucucccauucuucuucaaccuaugauaacauuaaucauuuuacuguguacugugaaaguaccaggaaaaaugguauugccuaucagaaaguccauguaauauguaauauguauauauauauauacacauauauauaugcacauauguguguuguauauacaucuuaggaugaacagacgguagagcuaugaggaaaauggagagagaaagggguguaugucauauauguacagauucaauuugcaaguuguaggaaucuguaaaccuguauuuaggaaggacucucuuauaaccauguauaugauaacaguaauagacuugauugccauuucauuagcugccuuagagaaagaauguaacauuugcuuuucaaauccuuuuggccuuucuguuuuauuuuuaggauggccuaaagucuuuaaggcagcagggaaggaggucagugguagacugaggaaggagggaguagggauggucugaggaugacggauguagguuuuagguggucuggguaauccccugguauucccaaagcaagcaaagcaagcccccuuuguaguuagacaguugcuuagaggucuucauggaauggagacccaggaagcuuauagagucuucugguaugugugcagcaggaaugcuucuaagacuuggggcugccacagccuguagucuccuucuaccucaaauucacugcagucacagccuuugaccuuggaugguuucuccacugagacagugaucucaucuggagcaaaggguguuuuuaccagccccaggcaauccugaauguccaaugcguuuuccucuuccuccuuuacugucaacuuaaacuggaauuuauugugucuuggcccuccagcagugguugcuaagggcucuguuaaaugguacuauaguacuuacuagucuuaguugucuuauaauaugucuaagauauuugggcaucugggugggugaggucuucccacaucucccauugcauguguaccauguucuugugaaaguccccuaagacuucuccaugcugguaacgugcuuguuucaacaggccuggucucuucuuaaucucucugcuggaugaauuuugcuauaauguggucaguucacugguuuuacagcuccaguagcuggugggguugcugaggucuguaguguaccagagucuguaggauggggauguggucuacauaacugcccagcaagaaaagccuggucauuuucuuagucuccaccauggucuuuaagucacucaggaaagucauguacuuuaacaugucuaugaccacugccauaucagcagauguucaucucauguaggcccugcuguugguacuuacuuagguuaugguugauaucacaguuuuuuuucccacagcaauuugaagcccacagugagcuggugguuucccagcacugauuugucacagggaggaucuugcucuucguauuuuucaucuuuauuuuuaaaauuuuuuuuaugauuuuugugguauuuugccugcaugucugucugugcacuaccacuaugugugugcuuggugccugcagaggguggaggagggccucaugguugugagccacuguguagaagcugggaauugaacccagguucucuggaagaguagccagugcucuuaacugcugagcugucucuccugccaucuucauguuuuaaaggaaggcaguuaaacagcuucucaccaagcuucagugauuugggagggggcucuaacagccuuuguuuguuauguguuuucauaauuucugaaaacugauccugcuuugauucuguauucuuauggaaugaaaagaaauaaauaauucuguauucuuacagaaugaaaagaaaugcaccauuagcauuaauaauauacagcuguguaugaugguuaaucuuguaugcaguggaaaaauuuguaccaaauuauguaacugugaccaaaucuuggcagacaguccauuuuauauacaauuccaucccuggagaugguccccuauuuuuucucuuggagauuguaccucuauuaaacugauacuugauauuuuauaauuuuuuauuucagagagagcacuaagaacauguaggcaugaacugugauguucucugagcaaauugcucacugucaauuuuuaagguuauuggguuaucuugauugacagucauuugcuguauuguuauuuauuuauuuauuuauuuauuuauuuauuuauuugcacaaugagugccauucuagaauucuacaugcacuaaauaaaagggauuuuaagguagaaugauauuuuucuuuaauuuugagaauuucaugcauauuuaugagaaaauaugaucauauucucccucauuucuucccgacaacuuccccguauuauaaaccacuagggcuaguuaguauugcccauauguauauggaugugggucuacccaguggagcauggcaaaccuacuaggggccacauccuaacaaaagaaggagucucucucccucagcaacuguccacugccaguagccccucccuaugcauggggccuggggagccucuacuacauuuguucaggaaguuugccugguuugaucuuguauggccuugggucgguaaucgcagcugcuaugacagccaagacaacguauccugucacccucccuuauccucuggugcuugcauucuuucugcuucugcuucugagauguucccugaggcuucuuguguuaggguuaauuagauggcuggcuuaggacugggcauucagucucuuaguaauuggaaucugcauguuuuaaacaucaggugauguuuaaaaggauauccccuuuauuuagagaagacaauaauauucagaccagaaauacugugaauggggcaguggugguggugcacuccuuuuaucccagcaaaggcagguggaucucugaguucaaggccacccugggcuauagagaaaguucuaggauagccagggcuauacagagaaacccugucucaaaaacgaaaagaaaaaaaaaaaacucuuacccucccuaucaaaaucccccaaaacaaaccaaacaaacaaguagggccaaaacuaugguaguagacaccaaaagaagauuuaaacaagauacggugguggcaacagugugaguagcugauuagucgugggccagguggaagugaaggugacuccuacguuuuugccuuggacaguggaguagagaccagugcaagguaccaaguaaaaaacaacucuucacauaugguuauaguaucugagugcagacaucuuguugcacaguauguaugcuucuggaauguuuagcuagauggcuccuucccacuaaaucagucaccauuccaagaacacagaguacuuugcuauaucacaguacccuuauaaauuuugugcugaauacauccuuucuggacucagaguauguagguuagucugguuugccacuauuuuauuguaguaaagaaaaugaggcccggcgugguggugcacgccuuuaaucccagcacuugggaggcagaggcaggcggauuucugaguucuaggccagccuggucuacagagugaguuccaggacagccagggcuacacagagaaacccagucucaaaaaaaacuaagaaaaaaaagagaaagacagugagaguacagaaauuacacaugcacugcuguauugaauuuccuaaacugaacaugcaucuauaaaccacaucagacaaaacagaaaaugacuugccugucaaaaguccucacuauccucuauuagcugcuguaucccaaaggaaaccacuaugcagauuuuuagcaucauauaugaauacugucuguuuauauacaucaucuaaauggaaccauaugguauguacuaauuuauauuuagcuuauuuuuucucagcuuuauaugauuuauugacgcuguuguauucagcagugguuugcuuuuuuuuuuacauugguuuauaauauugcaugguauuuauuuucauauuaucauaaauuuccauuacacaucugugccauaauuuaguuauuauuguacauuucauggauaugugagcuaugugcaguuuugguuauuaaugaugcuguaugauuuuauauuuuaauagauaauuuuuuguugcaagcacauuuauuucucuuggguauauauaacagaauugaauuguguuacagguuacucauguguuuagucagugcugccacacacaucucucauguggcuuuauucauucuccuuuuucccuaugugaaaagcuguuucucucauuuccauuuuuggcaguuaagaggcagagauugcagaauuugguuucauguucacaaauacaaaguuuggaaaucuuaccuuuuuuugguuuuuuugagacaggguuucucuguguagcucuggcuguccuggaacucacucuguagaccaggcuggccuugaacucagaaauccgccugccucugccucccgagugcugggauuaaaagcguguaccaccacgcccggcuggaaauauuacuuaauagaugagugauuguacugaccaguuuuguguuuacaugacacaagcuagagucauuagagaggaaggagccuuaguugagaaaaugccuccaugagauacagcuguaaggcuuagugaucaauggggaagggcccagcccauuguggguggugccaucucugggcuggugguccuggguucuauaagaaagcuaacugagcaagccauaggaagcaaagacaguaagcagcaccccaccacggucuccuacuuucaggugccugccuuguuugauuuccuguccugacuuccuucaaugaugaauaacauuguggaaguuuaagccaaauaaacccuuucuucuccaacuugguuuuuggccaugguguuuuuuguccaacauaauaaaugcaccugaacuuaugaucacuccaccuuggcacugccuuugaccaagugaauacuguguacauguucaggguaguccucaguguacacuuuggagccuuauucaggacauuaagaauuggguuauugaggucccauacaucuauccagaagaauauggagacaaauaaugccaaauaauggagccuaguaaaacuucaaagcaggaguagucauuagaauaaauccaaauaauaaaacacaugaauuuaagauguugcagcuugauugucaucagugaaagugcuguagcaaggaccuauauagaacgucuaucauauauauguguguguguguguguguguguguguguauauacauauauacacauacacacacacaacacuggacuaaaaauucgugcuagauguuuuuaguauacugggaauuagccugaggcuugcaaaaauccaugggacauuuauuaagagaaacgucuuuugguaagagcagugaguuuauaauuauaauuugucucauucccauuucuccucuccagcugcuuucagugaaagcagaaaucuggcagccacuagcaagggaagaauagacuugucaguucucuaaagucccauuuccagaaaauugucauuauuuaacuuuuguggcagcccuuuggaaugccucaugugcgaaugugucuuuuauuggucugacugagaucuucuucauguuuacuacucuauacucagggaaauuugucaggagaaccagagaaagauuuaucacggauacccaagguaauauauucaguauucaauuaaagaauacuuuaacaaaaauacuuagcaagacaauuuggggagagugaugucuacaggaauacugaugagcaugcaauacauacaguccauuuacacaacaaaagacgagguagggaauugagauuuauaagaauaaaguauuuguaaauuagugacuguauuuaaaaaccaauaaaagaaacaaaggaauuaaaaugguacguugcaagguauuuaauagaaaugaagucaguaauagaagaacaaaaagacacacaguguuagaaauuacaugauuccccucuuaaaaggguuuugacaaaaaacaguuguaacuuaacacaacgaaggcuauauacuacagaucucccuauguacuaguaacagacaugcugagaaagauaucagaaaaaucauccuacuuauaauugccuaaagcaaauauauauagcaaaaaaaaaaaaaaagaaccccagcucuugaucagaagugaaagaccucuacaacagaacauuuaaaaccuuugggauagcauuugaaauguaauugaagaaaauaccuaauuaaaaaaaauacuucuguucugaaaaaaaaaaaagaaauugaauuagacaauagaacaaugguucucaaccuuccuaaugcuguuucuccuguuguggugacccucccugccaccauaaaauuauuuuguugcuauuucaucacuguaauguugcuacuguuaugaauuguaauguaaaugucugauaugcaggcuaucuaauaugugacccccaaagguugugacccacagguugagaacugcugcauuagaagaugaaaaauguauuagaauauaucaauacugugaaaauggcaguacugccaauggucaucuacaaauucaaagcacucugucauaauucaaauaguagucuuuauagaaauaaggauggaccaucuagagacugccauauccggggauccaucccauaaucagcuuccaaacgcugacacuauugcacacacuagcaagauuuugcugaaaggacccagauauagcugucucuugugcuacuaugccggggccuagcaaacgcagaaguggaugcucacagucagcuauuggauggaucacagggcccccaauggaggagcuagagaaaguacccaaggagcuaaagagaucugcaacccuauagguagaacaauauuaugaacuaaccaguacccuggagcucuugacucuagcugcauauguaucaaaagauggccuagucggccaucacuggaaagagaggcccauuggacuuguaaacuuuauauaccccaguacaggggaaugccagggccaaaaaguaggaguggguggguaggggagugguggggaggguacgggggacuuuugggauagcauuggaaauguaaaugaggaaaauaccuaauaaaaauauuuaaaaaaaagaaagaaagaaaacagucuuagccgggcgugguggcacacacuuuuaaucccagcacuugggaagcagaggcagguguauuucugaguuugaggccagccuggucuacaaagugaguuccaggacagccaggacuauacagugaaauucugucucaaaaaacgaaaaacaaaaacaaaacaaaacaaacaaaacaaaaauaaaagucuuaaaauucacaugggggcuggggagauggcucaguggguaagagcacugacugcuccugugaagguccugaguucaaaucccagcaaccacaugguggcucacaaccacccauaaugagaucugaagacagcuacaguguauuuagauauaauaauaaauaaaucuuugggccugagugagcagggcugaccagagugugcagagguccuaaauucaauacccaacaaccacaugaaggcucacaaccauauguacagcuacaauguacucguauacauaaaaugaauaaaucuuuaaaaaagauucacauggaagacaaagggacccauaacaauaaauuauaauucuuggaauaucaugauaccuuauuucaaguugcauuauaaaaaugagauacuaaaacuggcaaggugcuagcaaaaaaccagacauuaucaaucaggccuaaugagcucuucauucauguuuuccuuauaugucuuugacacaguuuugaaauauauauuacuaugaucugcaaguauuaugcaguguaauguauuccuuauauuuuaaucaucuuuaauuaaauauaacuacauaauuuccccuacuguuacaugucuauaagugaauaaguauauaaauauauaaaugcaaccugcugaguaugguuaguguugcuuguguguguguguguguguguguguguguguguauacauacauacauauauaugcauauauguauauauauauguguguguguaucauuguuguggcucauugcucauauuaauuacuuuuccucccuuggcaucucccaucacucauucucugggaggaaguuauugggucagauccauguagauugcuucgugucagguguccaaagaguaugguaucuucagcaauauggauucaccuucaacuucugggagacaagcgaugguaguagcaauagucuauauuauuuuaggagucucuuugacucccuuguccaacaacuugaaaggagguuuuccaugccuggcaacugggauuuuguuagucuauagcuccugagguugccucucgaaauggugcaacugcauuaaacuaacuaacucucucucucucucucucucucucuccauauaauuauauugauuaaauguaauuacaggugaauuuaaucugacuuguuaaggcauuuucaaacaucuguaguguuauuuauucuuccuagcuuuccuucuguauuaaucuuccacuccguccccagcuaaaacuucccucuguguuuccucauguccuccagcagauugcuuauauccugcuaucccccucccuugccuguccccacagucucuuuuuacuuuccugguuuaugugguuauucuagguuauauauacccucaacugaggauuuagaacuaggaaccacagaugagagaaaauguggcguuugucuuucucagucugaguuaaccucauucaauauaauauuuucuaguucuguagauuuacuugaaacuuucaugaugucauuuuucuucucuguuauguauacauaccauauuuucauuauauguucaucuguugaaggacauucauuuccugacuguuguaaauagagcagcagugaacaugagcaacucucuguggaggaagauguuuaguccacaugccauagagugguauaacuuggccauguggggcauuuauuucuagcuuucugaggauucuccauacugauuuccagagugguugcauuaguuugcauuuccaacaauaaugauaaggguuccuuuuucuccacacccuugacugcauuuauuuucaguuauuuuguuaguuugagccauucuggccuggguaagcuaaaaucucaaagauauuuuugguuucauuucccuaauugcuaaggaugaugaaaacaucuugugaauuuuuuuucaccauuuuauuuuacugaacucuccauuuuggucuaaagcuguggugguuugaauaugccugguggugguuugaauauguuuggccuagggagugggacuauuuggagguguggccuuguuggaguaggugagcuuuaagauccucgaccuagcugccuggaugcugccauguuucccaucaugaugauaauggacugaacuucugaaccuguaagccagccccaauuaaauguuguccuuauaaaaguugccuugguuauggugucuguucacccuaagacagaagcccaauuuuuaaucuuuuuguuucuuuuaucuuuaucuuuuuuuuuuuuuuuuuuuuuuuuugguuuuucgagacaggguuucucuguguagcccuggcuguccuggaacucacucuguagaccaggcuggccucgaacucagaaauccgccugccucugccucccaagugcuaggauuaaaggcaugcgccaccacgcccggcuuaucuuuaucuuuuugaguucuuuacauuuucuuguuauuaaucuuuucucugauguauagcuggcaacgauucuuucuugcucuguaggauucuucuaaacuagugcuuguuuccuuuauguuucaugagucccacuugucaauuguuggccuuaauucuuggacaaauagaauccuauuuaggaagucauuuucuauuagaaacugguggugaaagaaucagcuguauauccauccauccccgaccucugcagaaggaagaaguuuucuucuagcaguuucaauauuuugagucucauuuuuaaaauuuuucuuuaguucuaauaaauuuuaaauaucacccuugauccauucuuugauucauucaucauucauuaacacacuguuguuuaaugcucaugaguauggauacaugcuggauauuuuuugccacugggcaguggugccacaugcuuuuaauuucagugccugagaggcagagacagauggaucucucuaaguucaagaccacccuagucuacagcaguaguuucaggacagauagggauacacaaagaaauccuggucagauaggaugcauggagauauuugaaguuuuaaauuuuguuaagguuuguuuuguauucaggaugugcuauauuuuagagaaucuuucauugguugcuaaaugcacuguacauuguuugguauuuaaauagaaucucugaagcuaaguuaggucaauuuguuguaucaugucauuuauuucugauauuucuuuguuguuauguuuugguuuuguucuguggccugucucuuagagaaaguagaguauugaagucaccacuauuuuuuagauuaauaguugucuuuaauuccacuaauaaacacuuuaugaaauuggaaacacaagucuugggugcauauuuguuuagaauuauguugaacucuugguaauuuuuucccuccauuauaaugaaauaccccuuuuucuucugauuaauuuuagcuugagaucuauuuugucaaauaauaggagagugauauuugcuugcuuccuggucccauuugcauugaaauggugccuaucacuaaaacuacgaugaauuucuuguugacaacaaaaagauggauuuuuguuucugaaucuguucagcuaauuuguagcuuuugauaggagaguugacaccauuaauauuuaaaguuguuauugaaugauauauguugguuguagucauuuuugcucauuguauuuauagccauauuuucugauucagugauuacagcuuuguuuccuucuauaguauauuggcugugcucauuccuguccuuacuccaaaauauugcuuccaguauucuguuagggguauucugugugauaugaauucuuuuagccuguuuauagaauggaaauuuuuucuuuuuccuuuaaguuaugcucgguauaguagucuagaaugucaucuuuagucuguuuuguuuguuuuguuuuuugagacagggucucuuuuuuguuguuguuguuguuuucgagacaggguuucucuguguagcccuggcuguccuggaacucacucuguagaccaggcuggccuugaacucagaaauucgccugccucugccucccaagugcugggaucaaaggugugccaccaugcccggcagggucucuuucuauauauagcucuggcugucuuguaacuugcuauucugaagagucaaguuaaccaauagugacuaucaguaaucaaugacuauaaucuuuaucucuuuucuguaguuaauccuuacagccauguaaucucuggguuugagggaacaugugaaaaguuuaaugaguaugagaagauucauauguaugacauuuauauuuacaucuuuuuuuugagacaggguuucucugugcagcccuggcuguccuggaacucacucuguaaaccaggcuggccucaagcucagaaaucugcuugccucugacucccaagugcugggauuaaaggccugcaccaccacugcccggcuauauucacaucuuaacuuuuguguacuuaauuuugcucucugcagcaauuucuuguguguguauacauauguauugaaugugccaacaauauuucauaguaugaaaaaugaucauuaaaaauaauucaucugugugcuaacuuaagucaucuugugucaccagugauguacauguuagacuuugguaauacuuaugacacagcgauuuauauucuuuacuuaauauaaaaaucauuuauuuuuugucuauuuuguuuuaaguaguguuagugcuaggcauguaguguccagaaaucaucucccuuauggagcuuguguaaugugagugaaggaaaaaaacauuuauaacauaguuuucauacauguuuagauaaaauuuuacacacacacacacaucagggcaguagguuuaaaaguaaugacaaugugaguuugaggccagccuggucuacagagugaguuccaggacagccagagcuauacagagaaacccugucucaaaaaacaaacaaacaaacaaacaaacaaacaaacaaaaguaaugacaauggagugugaucccuuagcuaugauggcuaugcaaaacugagaugaggcuauucuaagaaaaaagaacagacaaguagaaaugaaagaagauauaugacagagacccaacagacccaaguaccuggaacauagugaaggaaggaggaaauaauuuugaggagauaguggguuggacaggauuagccuuuuaaagcaaaacucaccauuacucucacuucaguaacgaccaaggagauaacauaaaguguacccauucuuuuuaucuuuucuucuuuccauauguauaucuaauguguguaugcacaaagauauauguagagaggucagagauuggugccaagaaucuuccucuauuguucuuuuacuuuagucuuugagguagacauuaaagaugccuagacuuugcagcugacucuaauuauucuagcaguuuugauucccagcaccugaauggcauugcagaacugucuauaacuccaguuccaggaaaucgggugcccucuucuuaacucugugggcaccaagccaccaagcacuuggacacgugcacacaugcagacaaaacacuugugcauauaaaacaaaugaaucuuucuggagggaaaggaaggagcaguagauuuaggggagaggagagguaggugugggcagagugcagggaggggaaacuaauuaggguguauuguaugagaggagugcaaaaguaaaccaaaaguuuguuuaaaucaaaauuuguaugaauauguauuuugcauaugcauguuuuuauauguguguauuuuauaggccauaaaacaagaauaaggaucauaugaggggggaaaaggugaaaauaggguacugggauccauguaauaggacagaaggaggaggagacuaagcaaagaacauagacuagcuaggggaugugagugaggagugcaggggaggacgggaaggaagaaggaugaaugagaacaaaauaugaaaacacaugcccaugggaaugaagaucacaggguaaauccuaacacgaaccuaagaaaaccuagcucuguagucuuaaucuaggcacagaacuagacgauauuguuaauuauuaaaaguugcaagagaggacugccaaguuauuuauaaagguaaacguaucagaauccuaucagacuacucagcagaaagccuaagagccaagaaagcauggcgugcauuucaagccugagagcauauaauugcuaauugugauuacuguguccagcagauaggacccuuucaaaugaauagagaagcaaagucuuuccacgauaagcacaaacuagagcaauuuaugagcacuaacgcagcauuucaaaagauaacuggaaaaaaagucauacggacaaaacagaaaguuuacaaccagggaaguaacaaugaucaacaaaauauuugaaagcugaauuuagcaacccauuaaaaacaucacauaccaucauuaacauauuuucacuccagguugcaaggauaguucaaaauguggguaucaauaaacauagucuaacauauaaccauggacuauacaaagcccauauuauuuucauacuugcagaaaaugaauuugagaaaauucaauaucccuucaugauaaaugccugaaaauguaagaaaaaaaaagucauucccaauguaguguaaugugacuaucugcugcaaaccuauagcagacaccaugaucaacaggauaaagacagaccguuucuuccagaauccugaacaaaauguauccacucucaucacuuguacugaguagugcuuggaacuuuaaccagaacaacgaggcaaggaaaaugacagaaaaggaagaauccaaaugagccccuuuugcaaaugacacgcuucucauuuuaaugcccuaaggaauauccacggaaucucguagacuccauaaucacauucaacaaaugugaauuugauuggguuguuugucuuauugauguuucuugaaaucuauuuuuuuuuggacacagggucuuucuauguaacucuagcugucacagaaguauguauguagacuagacuggccuccaacucacaaaggauccaccuacuucugccuuccaagugcuggaauuaaaguuucuugaauccuuuguauauucuagacacuaauccuuuguuguguguaaagcuggcaaaacauuucucuuauucuauaggcugccucuuaacuuguggcaauuuccuuugcuacuguacagaagccuuuuaaugucaugagaucgcauuuguugauuauucucauuauuucccgagugaucaaaauccucuucagaaaguccuuaccugcacccauuucuugaaaucugcuauacuuuugccucuggcaguuucagaguuuagggucuuagggucuuauagaaaguuccucaguucacuuggaauugcuauuuuguggaggaugagagauaagguucuauguggagauacccacuucccagcacuucuuguugaugauggcauauuuccaccaauguguauguuugacaucuuugucaaaaaaacugguggcaguaguagccugacuuuuuauuugagucccuuaugcuguuuaauugccuugcaccuuuuuuuuugugacaguaccaugcuguuuuucuuaaaaugaaccugcaguauaacuugaaaucauggauggugguaucuccaaugguguuuuuaauguucaggauuguuuuggcugucugaaguccuuugugcuucugcaucaauuuuuauaauuuucccuccguuucuaugacgaauuucacugaauuuuuauuagaguugcaucaaaucuguagauugcuuuugguagggugucccuuuucagaauuuugaauuucguaguccaggaaugugggaggucuuccugguuuuguuuuguuauguuauguuuugcuuuugaugcauuucucaauuucuuucuuuggucuuuuaaaguuuucauuggagaggucuuucacuuccuugguuaguuuuacucuggaguauuuuguuugcagauagaaguuucccugauuuucuucucauuauguuuguuauugguauauaggaaggauacugauuuuuaugacaguuuugcauccugccacauugcuggaaguguuuauuaaaucuaagaguuuucuguuggagucuuuauugucucuuauacauaaggucaugccaucugcaaacaaggauaccccuuuuuuacuuucuuuuuuucuuuuuuugauuuuucgagacaggguuucucuguguaguccuggcuauccuggaacucacuuuguagaccaggcuggccuugaacucagaaguucgccugccucugccucccaagugcuggaauuaaaggcaugugccaccaugcccggcacccguuauuuuucuuuccuacuugggaguucuuuaauuuacuucuguugucuuacugcgcuggcuaagacuuagagugauagaguaaauacggguacagaaaguggaacccuuuucuuguucccuauuuuaguaugaauuauuugaguuuucccauuuaguauaaucuuaacuauaaguuuguuacuuacaccauuuugcauauauauguccccuccuccuccuccuccuccuccuccuccuccuccuccuccuccuccuccuccuccucuucuucuucuucuucuuuuaguuuuuuugacacaggguuucucuguguagcccuggcuguccuggaacucacucuguagaccaggcuagccucaaacucagaaaucugccugccucucccucccaaaugcugggauuaaagacauguaccaccacugccaggcuucaccucuaauuuugaucuuuccuuucuuugguuagcuaagaauuucucaaucuuguuucuuuuuugaaacaaucaacuauuuauuucauugauuucuuauacugauuuucuuuuauuuuuuuucauuucauuuauuucugcccugauguuggauugcuuuucaucuaauguuuggaguuugucuguucuucuuuucccagaggcuaagcguaucauuauguuguuugagaucuauccaauuucuuaauguagguacuuagagguacaaacgucccuaugcuuccauuguaucccaugcauuuuaauaugcuguguuuucauuuuuauuugauuccaagaacuuucauuuucuucuugacuccuucuaggaccaagucauugugugcuauuucauugccacguuucuguauguccaaggauuucuuuugcuacugauuuguagucacauuaugaucagcuagaaugcaacaaaugaucacgauuuuccaguguguuuguugacacuuguguugugcccuaauagacagucuuauuuuagagaaaguuucacuaacugcugagaaaauacauauccauccugugguguuuguauggaauguucuguagaugucucaaguccguuugauucaggacaccaauuaauuugcauauuucucauuuacuuuuuguugaaaagacaucucaguuggugagaguggcauauugaaguuacuacuguugugcugugaccuuacaucuuauaaaauuuuuuaugaaauugagugcaucuguauucacgguauauguuuagauuaaacacuguuaagugacuuuaucuuuucucacuaguuuuguuuuaauguauguuuugccggauauuaguggagugaugccugcuuguuuucuaguuccuuuucccuggaacaccucuucccauccuuuuauccuaagguaguuucgaucuuuuguggugagaugcauguuuggggggggggucagcaaauagauguuuucuuguuuuuauguagucugcuuuucugcaucuuuugacugaggaauugagaccauuaauauuaagaauuauuguugagaacuguauucucaacaauaauuccugggauuuguuuuguugauucuguuguguucuugccccucuuccuuucaugcuuaacuguucuuccagcaugguuuauucuuuccuguggccucagugauguuuuucucuucuguuugaagaaucccuucagauaucuuuuguacagcugggcuagcaguuauacauucuuucagucuauuuuuaucaugcagaguuuuuauuuuuccuucaauugugacagacagcuuugcugauuuuugaauauaguagacucaguuagcacaugucuuuuaaaguuucaguugaauaauccacugcaauuugaaaaucccuuuauaugugaguuguuguuucucuuguacuacuuccaauauaguguauuucuucuguauuauauuuaauacuuuaauaauaccuggacaaguggagguucuuuccucaucuugcuuguuugguacuccagaugcuuucuguaucugaauucacaucucuuguccuaacuuugggacauuuuuaguaugaucauuuucuuuuuauugaucuuuuuauuuuuuucacauuuuuauuaauuuuuugagaaauuuauacauuguauuuuuuaaaaauuuauuuauuauauguaaguacacuguagcggucuucagacaacccagaagagggcaucagaucucauuacggaugguugugagccaucauguguuugcugggauuugaacucacgaccuucagaagagcaguugaagcucuuaaccucugagccaucucuccagccccuacauuguacuuucauauguguucauuccccuuccuccucaacuucuuucagauucauacccucuucugucugucucugucucucucugucucugucucugucucucugucucucucucucucucucucucucucugauuuuugagacaggguuucucuguguagcccugacuguccuggaacucacucuguagaccaggcuggccuugaacucagaaauccaccugccuuugccucccaagugcugggaauaaaggcaugcgccaccacaccuggcuguucauacccacuucaaccuacccaacuuugucuugcuuuaaaaauaaaccuaucaaguucacuuuguccuguauguauggcuucccacugaaguauguucuauccacaagaggcuguguucuuaaagaaacuugacucuccuucuccuggcaauuauuaacugacaagggauccucagugagguuugagaauucauguucuccucccauuuccaugcugggauuuugucugugugaucuuucauaggucuguguaugcugucauaacuaccaugaguucauaugugcaguugcuugucuguggcccaaaaaauacuguuuucuuguagucauccaccuguagcucuuauauucuuucugccuccucuuugaaaaugaucuacuagacuugggaggagggccuauaauaaagaugccccauuuggugcuaagcauucucuuauuucucuacaccaugacucguugugaauaucuguuacucacaucugcuacaagaaaaagcuuuugaaaugaauguugaaaaaaauucaucugucuauggauauaauaauguuaaaucauuaggaguugguuuaauacugugcccauugagcagaauaugguaguaguuucuccuccuagagcuuaugaccugaccacugcuccuuggcccuguuaauagugccaaauauggguuucauuuuuuggagugggacuuaaacaccaacagaaaguaguugguuacuucuaugauguuugugccacuagugcaccagugagcaugcuuugccaggacagaaaugauuguuguucagaggauucacagcacgguauaagauugguuauuacuuuucaacucugacaacauguauagcucuuuucaguacugugaaaguuagccuguagagaagaaucuucuauugaauguuagcuugacuucuuucuguucuaugauucaaauacauggucucuucagcaaucaggucuuaacauugacaagagccugugauguuuaaggguccaugggacaucacuguugaugauuccaaaagaaggaacacauccuuggcacuggggauuuuauuuguuugccuguguuaucuaguaggggcauuguuacccuguugcaguguaacuucauuucgacuccuuuuaugguagguucucauaugccuuuuucagaauauucuuagaauuuaacuaucucuuccuuauuucuuccucuaccuuucucucauaucaaccacccuauuuaauauuucuuguucuauuauuuucuggauggccacccguguguuuuuuuuaaauauuuauuuauuauuuauauguaacuacacuguagcugucuucagacacaccaguagagggugucagaugucauuacagaugguuguaagccaccaugugguugcugggauuugaacucaggaccuucggaagaacagucagugcucuuaaccgcugagccaucucuccagcccguggccacccauguuugcugaauauauguuuaggauugugauauccuauugguggaguuuucucuuacugauauggaugugaggaaagcugaagacuucuucagugcugguuggagggaaaacugguacagccacauggaaauugaugugggaguucuuccaaaaucuagaaauaaaucuaccacauaauccaguucuaucacucuugggcacauuccccaaggacucugcagcuuacuauagagauaccuuuucauccauguucauugaugcucuauucauaaugucaagaauggaagcagccuagauuuccauuaacugaugaaaaauaauaaaaacaugguaugcuugcacagugaaauauuacucugcuauuaagaaaaaaauacacaguugugaaauucaaaggucauugguggaacuagaaaaaguaaucgugagugacauagcccagacccagaaagacaaauggcacaugguuucucuuauuuauggauguuagcuuugcuaugaguguuucauuuggaauacccauaggagucagaaagucaguaaggaaguguggggauagcuuucgagggaaaauauauagaacuaggugguauaaagaauuaaaaggauauaauggaauagagaguauuaauuagaauugggaugagagggcaaauauaagagagaauauauggaucgaguagagauaucuaacauuaaagaccauucaaaaaagucauauggaaaccuacuacuauagaagcguccuaaagacaaauguuguuuuccccauauguaaaauuuaggguuaaaaugacauggaaauaaaaaagagggguaugaguuaaaagaagcaaggaaagaggaaacaugguuaucaggugccaaaaacguaucgaaggucauuaaaguauguuguauacaugcaugcaaaugucuuaaugaaaccugucuuagugaacuguuccagugcugugaauaggcaccaugaccaagguaacuuuuaggagaaagcguauaacugggggcuugcuuacaguuucagaggcuuaguccgugaucuucgugguaggguaugugguaguauguaggcaggcauggugcuagagcaguagcugagagcuuacauucugaucagcaggcaggaggcaaagcagagagcaagacagggacaucccuagacuuuugaaacuuaaaagcccaucccccacaccuucucugaccaggggacaccuaccuccuaaccccuccagaacaguccaccaacugggaaacaaacauucaaguauauaugggggccauucuuccccauuacuuuuacaaguaauauaugcugugaaaaaaaaauuaaagguucuauucccugagagcuguucauuaguucucaagucucaaaaugauuaaacauguugaguacauaugaguuuaugcauacugggggcaucuagauaacucagcaggaacacgugguaguauacagcuugugucuaagcacauauauguagagacaccugacagagacaggcaugaggauauagagcaagugaggaauucugagaggaaagcauguucuuuuguaguacuguaccugugagaaaaaaaaaaagguuugagaacugaugaaugaguauccucguaucuucucagggaagagcugauucagauaacuuccucuucagugaacuugcuuuucugcccauaaucaauauuauaccuagagguucagagauuucaaguucuauccaggucagguagcuuauaacuguaauccuagcuaugugggaggguagagcaggaggaggauugcagcuugaaggcuaccugugguuauggagugaguuccaggaucucacaagcaacacagggagaccuugccucaaaauaauagaaguguuggggauauggcucagugauuaagaguacuuaacuagcaugcucaaauuacuagguuuggccuuaaguauugugggguggugugaugauuugaauaucuuuggcccagggaguggcacuauuagaaggugugucccuguugggaguagguguggcccuguuagaauaggugugucauugugggugugggcuuuaagacccucacccuaucugcugggaaguaaguacucugcuaucagccuucagaugaagaacuuucuuagcucugccugcacaugccugccuagaugccaccaugcuuccugccuucgugauuauggacugaaccucagaaccuguaagccagcucuaauugaaugcuguccuuuauaagaguugccuuggucauggugucugcuuacagcaguaaaacccugacugagacaggugggaaagagaaauugaaguuacugaaaaaucucuguguguuaguauagaagugggcauggaccuuuguuaaagaucagugguuaagagcauugcugaauggauacucuuucagagugaccugagccugauuuccagcaccgacaugguggcuaacagacuguaguuccuggggauuggauguccuuuuaugccuccauguauguacaugguacaugaauauauauauacaaaccagacacuuagauacauauaaaauaaaaauaaaauuugaaaguuuuuauguagcauguuuuuuuuauuuauuuauuuauuuauuuauuuauuuauuuauguauuauauguaaguacacuguagcugucuucagacacuccagaagagagcaucagauuuuguuauggaugguugugagccaccaugugguugcugggauuugaacugcagucagcacucuuaaccgcugagccaucucaccagcccuuauguagcauguuuaaagcuuuaugguugguuuaaaugucagcuugccacaaauugcuuucaacugacuagggagccuuauugccuugauugauuaggaugacccuccuggauauuagguagcaccuacugguaggaguccagauaaaaaggguaauguagaaggcagaucauuuccuccuguuguuugcuuggaccuuccccuggcuaguuaauuccccuguugcugcugcggcugauuccuugacagauaggugaaccagcaaguccaagcuuuuguugaccaggguccagggucuccacaggaaucuucugggcuucuaugcacccggucuuguggacugaauaguguagauauagccaguggggacugagaaggggagauauccuaucagugggauguggacuuuuaucccucaacuuuaagggauaguguuauaaaaaucuauauuuucuaguuccaucuauuugcaugcagauuucauggguuggggagcugcgauuggcauguaaggugaauaaauaaauuaauggaaaaagaccguuuauauuuuaguguauaaugugauguucuaauaugcauaucucucuauauaaauguaauucuucaaguugagcuaauuaacauaauacacauaacauaguuaccauuuaauauguacguguaugcugaaaaacauuuaugauguacugucuuaggggaauuacaugugaauaguacauuauuauuagaaaauauuuaugaugccaccguuaguuugccagaacuuaagagaggcaaauuuuggcuaaguaucugguuugugccauagcccauggauauuuuguaagaauuuuauuuuguuugggggguccuuuuauaggaaaaucuacuuagcuaaaauccugauuucuagugagcugugugauuuugugaugauaaugaugacuagagaaggcuccaaguuuaauccagaggaaauaagcauuuggcacucaagucccagaaugccuucugcuuugcucaugauuucgcucaaauacacuugaauuaaaggacugcacugggauugaauuuauacuggaguagaauguugguguagaguguucaagacuuuuaaaauguucugguuuuaaaauacuuaacaguucagaaacauaaugcauuagaauuuucaucugcuuuuucuucagguggaauaauaugccuuaauaaauuuaguaaauuccuggauuuuuuuauuugagacaggguuucucucuguaucccuugcuuuucuggacuuacucuguagaccaggcuggaggggaacucagagauccacccagaacucugcuccugagugcuggguuuaaaggcaugcaccaccuuucugauccuuucugaucaccuguauucccucauguaucaaauuuuuguguaggauccaaagacauuaauauauaaauguuuucagauaaauauagcucucacccucgucaauaaaacuucuuuuugcgacagaguugcuuauagaaaacuaccaccaggcaaagagaacagcuaguguagggugugcaauccagcuacaccacuaccuacaauacaacuccugcaccugaggcuagggaacacuacagaagagggcugggagagcuagaggauaaggaaggaacucugcuaugaauuuguauauuauaaaagggacagucacgcuucacuuaugauaccucaacgauaauauggcuaccuaaacaagaucagucuugugcuuuuguagccaaauacugguuaaauacuguuuuuugguuuugguuuguuguuauucuguauuguuugguuuuuguuauaaagaacuaaguuuaauuguaauagcccuggaggcugggugguuaaagaugaaggugccagcagauguugguaucuuauaaggacuuacuucuggguucauggaaagcuauguucucuuugcauucugacauaagaaaauggacaagagaucccacugugguguuuuucaguaagggaacuaauuucauuuaugaggcuuccacuuuuguagccuuaccacauucacagacaucccucuaaauacuaucacuuugaagauuaggaguucaauauaugaauugaggagagaaagaugcaauauucaguauauaacaacuuuugcuuugguuuuuguuuuugagacagggucucucuauguagcccugccuguccuggaacuuacucuauagaccaggcuggccucagacuaagagauauucccaccucccuguccaaagugcugggaucaaagaugugcaucaccacuauuuggcuacaacuucuugccuuaaagaaguuacuuccccuuucacagaacaguuuaccuaccugauaggucuauuguguguuuaaaaguuaguaauauaugagaaccacuuaauauaguaccuggcaccuacugcucuauguaaauagcugucauugucaugauguacuauuaugugccauaggaagccagcuccugaauucuguuacuccaucaguggcuuggaaagucagauacaucuugagaacucugaaauaguaaguaguaucuucuuuuuuaaauuuuauucucaaaauacauuucuuuuacuuauuuuuguuaguucucugaaauuuguauacaauguauuucagucauauugaccucauccccaauuucccucagauccacacuucccuuugcuaugugcccaauuuuguggauuugcacccaucaacucuaauuucuaauguccauauauucauggguguguggucucuaacugaauuguggucaaccuagcaggggcaauauucuugaagaaaucugacucugcuucuccuaauggcuaucaguugccucaacuaggggugggacuucaugucucucuucccucuccagucugagauuuaggcuggcuugugcuuacauggggcuuauguauacugugccaaucacugugaauucauauguacagcugcucuguugcauucggaaaacagcuugauaucuccauguucugugacugugucuuuucagcaguaguguguuauucucaaauauauuaauauagugccuggcuuuguauaaaaacuucaaagaacuaauaaaaacaaguaaaauaaauguauuuuaagaaucauuuagaaaucaguuauaaagguuauauauguacgugagaccuacaguaacugaacugagcccaugcuauuuauugugaaggaguuuuuaauguaccuugguuuuguuuuguuuuuacuguauauguauuuauuuguuguguguauuucuaucucagauuugauuucuguauaguaaauguggugcucagagguucauagauggauggaguaagagaaagauuuagaaauucuuaaaugagaagaaauuccaaaguguagauguagaguaacuugaccaugcuucauuguuguaggacacaggguaguuuucuuuagucuuuaagggcuauugucaucagagcccuaggaucaaaauguauuugcgauaguuugaagaguuuuuuuguaugaaggaaagaggaaaucagagaccaguuuacuucccacagagccuucuucccucuagccagaguccuucaccaaaaggguuucuguuguugaagggcgaagagggggaggauuguaggccaccugagaaagccugguuaccucauucaacaucuuaccuuggcucugugugauguagugucuacauaauuuucauccauauuuuucaaccauaccaauauuaucaguaguauugacgacaucuuuuuaaguggucagaugguguucuguaucaaaugcaaauaagcucaucuuugaaaacuucacauuuaaugaacugguaaucuacaaucuaagggaaacaauauacuuucaaugcaaauacagcuuugugguuuuuaguuuuccuaucucuacuuuauuuucagccucccuucuucuuaagagagagcacauuccugggucacuacaggacccggcacugcauacggcauuucuguguccugauguuuagauguaggccugagaggagaaaauacuuccccaguuuauguagccuuuaccuagucucuccauuuucaaugucacccuguuguaugauauguguuaguagugccagaaaaauacccuuguucaucccugccugccuguaccuacuaucuacaucuagcuguccaugccguuuuaguaaagucagaccaaaagaaucuccucuaccgcuuuccccuuggaggccaggauauguuaaguuauagagagcauguuuccaagugaggguuagugugugaccuuucucauguuuucucaaggauccucacuggguucugaguagugugagcauagcuccagcugcacuggaggaaagccuuccauuuagcccacucauguguaagguuucuugcuccagucugugaaaaggaaaaaauccaggagcaugaaaggggaaaggaagaaaagaguggaauggaagaggagacaaaaggaagggaaguuucccaaaaaaggaaaagcaaaugucuuagggagaggguggaacugucuugucugggaugucucuugguggcuagcugagucuuucaguacucacguggcuauaauucucucacuuugcccugagcauuugguucuccuaacuuaaaccuuccuucuccaaggacagagcagcagaauugugauggaccuuguuacacauuucugccuaaguuagcuuuucagaggcaguuuaguaggaggauuauuagagaagagccacaugccucguguuggcauauuuuagaguucacuacagaccugcuguuccaguauccugcugauagcuuuuaauagugcaaaaguacguacauaauuuugaggugcauuuagaagacaucaaaaagcaggcagugcuuaguaaaugugguuuuauuaggugaagaaaaugaccuguguaauaccuugaaguaucauuucuaaugagcacugcgugggaacuaggagacauauuuuuagagguguggucuuguguuuuguuuguuuugacaguguuuacucuaaccugggcuggccucacacucacuuuguacauuuuauacaaggcuggccuugaacugcugguccuccuccuauaucuaaaguccugagauugguccuauacuaccuccacucugcccaguuuacuccacccaauuuacuccgcccaguuuacgagaaguaucgggacgugugcuuuuauuaugcaaucuuuguacuuaggcaauauucaauagacaguuauaucuugaguaaaaaguugauaauuuuuauuacuguuaagauugucagcuaaaguguugauaaugucacaaagguuuauggcugucuggcaggaaauuaauacuauugguuauauacuguacucugugauaugggcuaugggccagaugaggggaaaaaacccucaguuaugguucaccaaucuuuugaaaagguagggcucauauacaaaaagggggggacacaaaauaugaaaagguuauucauggaaguaaacauacuaaaugaaaaaguuggcaauuaaaggauugaaaucugaguuuaaaaucugguucuacuauuuaguagcugcauucuuugggccaagugaauucauaauaaugauuaguaagauuuaugaugugcuauuggauuccauuugcuagcauuuuguugaaaauuauagugucuuuguucaaugugaauauuauuguauagcuuuuguuguuguuaugucucuaucugguuuugguaucuagguaaggcuagcuucagauuaauuugaaauggauuaaauaucuaaacauaugagcuaaaaauaugaaagaaaccuuugagaacauuuauauuuguguagucaauaguguuuugguuuuuguuuuuacauaacccccaaaggaaacaauagcuagaacagacaaguaauaucuaccaagcuaggggggaaaaccugccuagcaaaggaaauaauugaaugagaagaaccuauagaauaaaaauauuugauauuuguccauaugauaaauauuaaugcuauccaguauaaaggucuuggaaaagcuaguaagaauacccaauaauuaaaauuuaaaagggcaaaauaggcuagagagauggcucaguuauuaagugcacugccuacuauuucaguggauucaucuuugauucccagcacccauauggugguucacaacaaucuaacuccaguuccaugggaucuagcugcagggggcaccagacaugcauauggugcacagacauucauuuaggcaaaacaccuaugaacauaaaguuguuuuuuuuuuuuugcuguaaauagaagcuuauuugguaagcuagacuuaccuauugguggaagacuaagauuuagaauguaggaagaaauuaugcuggucuagcaaagugguuguaaauggacaaagucuuugaauagguccuccucaaaagaagagauacaauggccaugaggcauguggaaacaugucacaaugacaucauuagucaucgggaaaguaaaaaucaauaauaagauuaaaaauaaaauaaaaagcaaauuaugguaagaguauggaagaaagaauucugaugcaguguugauaggaauguaaaugacuauaaccauguggaagaucaguauggaaguuucuaaaaaaacccaaaaaaguaaauauacaaaaugaauaaaguagcccucuucuagguauacacacaaaggaauugaaaucaacuuaacagagagauaauucaguacccaugucuauauaaagaaaauaugguguguguguguguguguguguguguguguguguguguguguguaaugggcauuauucauccuuaaagaaaaaugaaauacuacuuaacgguacauuuugaaagucauuuuucagucccucauuucauuuguuuuccuguauuccccuuccuucuuuacuuguuuuucuuugguggcuaucauucuucccaucuaccugaauccucaucuucuaacucagaagccacauauauuugauaagugaauaagucuaugggaaccaagaagcuauguaugaguguaccugcuucccugacgucucagugucuuaagaggcaucuugcuuuuuuuuuuuuuuuaacauguacuguuuuuauuucuuaagcuuucuugucaaguguauguggcagagaaccaguacaaucacauuaauuuacaaaaagagucacaaaucaugguuagucaugaccuaaaauuggugauaacuagaaacaaccucugacuucuuuaaugcuauaaucccucuauaacugucacacuaaagcaaggaauuugggaagaggccaguacugagacuaauagaagaaauuuugcuaaguugacgaugguaggccaggcuugaaaucacagcugaggcaggggaucaccaggaguuugaagccaaacugagcuauauaauggcauugaggauagucugggcuacggugugaaacccuuugucaaaaacaaauuggccagcaagaugguuuaggagaugaaggcacuugcuaccuaggcugaugccccacauuuaaucccuaaaacucaccugguggaaggcaagagcugacgccuauaaauuguucccugacuuauacacacacugauccccacacauguaccuucccccaugcacuccuacacacacacacacacacacacacacacacacacacacacugcaguaaacaaaaagcaaacagaacagaacauuugucuaaaggaaggggauggcaaagaggcuugucauuaguaauagaguaugaagucucacucauauuuuccaaagguaagaaucccuacuauuuguucauugagaugucuaauaugccuaaggugucuuuuuacauauuaggagaauaaauauauguuggauaaguuagcugaggcuauacaaccuaaguccaggcaacuccagugccuucucuuaaccacuagacuguacuagcuuucuaccggaagaauauaaauuauucaucaacuuuaugucauaugauacauagugcuuuucacaccugccuccauaagucguagaaugcuguggugucuacagggagaggucagacuuuucuucaucaccagcaagguauuucccuggagcaaucacagcauaaaaaacgccccugugggcucaguuuagccagauucauggacaguggagucauucugacugaggaaaggugacaagaucaggguuuguacauuuuuuuuuuuuagucuuggcuguuacugaauacagagaaaaugauucuuuuguuugauuuaacugcaguguuuaguggcuaguuauucucacuggccccuuuagagucagagaacucuguuaaugaagaucaaaucagcggaaguucaauuguguaguuuguuauagguagaaauacacuacagcaucucuuuagaagccucuuuuuuguuuuuguuuuguuuaauauauucuuucauauauuacauuccuaccauagguuuuucuuccucccucuaacacucaccccuccaucuccccuaccuguucccucccuacccacuucuccauuucccuucagaaaagggcaggggucccagggauaucaaccaagcauggacuaucaaguugcaauaagguuaggaaccuccccacauauuaaggcuggacaaggcaaccaaauaggaggacaaaggucccaaaagcagacaaaaguaucagaaacugccccaacuccuuccauuaagagccccacaagaacaccacgcuacacaacuuuaacagagaugcagaggaccuagguuagacccaaucagacugccugauugucuguucagucuccaugagccccugugaucccugcuuaguugaaucuguggaccauguucuccuggugucauuaauuucuaugguuccucaauuguuccucuccauuuucagguuuuccaaagcucuugauaauauuuguguuucgugguaugcacucauugauaagugacuauuagcccaaaaguuuggaauacccaacauuucaauucacagaccauaugaagcccaagaaggaagaccaauguguggaugcgucaguacuucucagaagggggaacaaagugcucacuggaggaaauacagagacaaaguguggaacaaagacugaaggaaaggccauccagagacugucccaccuggggggucuaucccauauacagccaccaaacccagauacuuuuguggaugccaggaagugcuugcugacaggagcaugguauagcuguuuccugagaggcucugccagagccugacaaauauagaggcagauacucgcagccaaccaugaaacugagcaugggggucccagauguuggagaagggacugaaggagcugaggggguuugcagccccacggagggagcaacagugucaacuggccagaccccccccccccggagcuccagaggauuggaccaccaaccaaagaguacacauagagggacccauggcucuggcugcauauguggcagaggauggccuuguuggacaucagugggaggagaggcccuugagccugagggugcuagaugccccaguguaggggaaugccagggagggaagaugggagugggugggugggggagcaccaucacagaaacagguggaggggggaugggauagggaguuucugaaggggagaccuggaaaggggaaaacaauugaaauguaaaugaagaaaauagccaauaauaaagauggaaagaagaaauguuuguguaucgaucucuacaucaguuaacaucagauacaggagccucugauggcaguuggguuaugcacuggccuacgaauuuagcaggauaucauuaggaaucaucucauuuuuugacgguuuguuuguuuguuuuucgagacaggguuucucuguauagcccugacuguccuggaacucacuuuguagaccagguuggccucgaacucagaaaucugccugccucugccucccgagugcugggauuaaaggcgugugccaccacgcccggcuauuuuuugaccuuuauuuuuaauaugaaguggguuuuaguuuagcagucaagugagcagacuacugcugaaagaucucugacaucacagucggcuaagcacagcuccuuucaugccuccauaugcuaguauggaaggauaugaugguaacuuuuucuuuugauuuuuuuugagguagggucgcacuguguagcccuggcuguccuggaaccaucucuguagaccaggcuggccucgaacuucuagagauuuaccugucucucccaagugcugggauuaaaaguauaagccgcuaccuaccacccagcugauaauaacuuuuuuuuuguuuugcccacaauuauaagaaguauaaaguaugagaggcaaugcauuuuaaauuagaacgugagagccagcaacaucuugcucauucacgaaucacuauaguguagagaucucaugcaaaucuuucucauuucccugaaaaaaauccucacuaauaucuuucauaaacuauuagccaucuuugugugugugugggggggucugcacaccuuuucaucucauaauugucugaguacuggaauaaaauaucucaacugacagugacaaguaaagaggauaguucuguguauugcaggcuacauguaacaggccucuccauguauguugcuaggagucaacccuaagggucuugcacuugcuaagcagguagucugucacagagcugcugcucuagucuguaaggauuuuaacagcaguaauggauuuuguuaacuuuguaaugcaugauacuccaagagauauuuuauauauuuuaugugugugaacagaugcagagacuaaaauauguauauguauagguauauguauauauguauauacacacauauaacacacauauauacacacacaugugcaaacaaacuucuguuuguaggaaauaaaugagaacuguuuguguuuacucauucauuuaacuuguucuguguuuagcuuggcugaagcacagaauucaagaugccaugcuuagcaccaaccuacuccucuuagacuucuccuuaccaguaaacugcaguguauucuuguacacccucacaucagagcaaucacagucaucuuuguguaagacauagaucaacaaacgagauuaucccuauacauaauacaacaaguccuaaaucaaauccccucucaccaccagcuuuacuagcugguccaaugggucauuuucccaccccuacagaauuauaguggucucuuaacuagccgcaacucuucugccguugugacucuauuacaccugaaugguagcauauugcuuuuccucacaaauuuguuuuccugucugacuccaacugaaagucaauaugcuugccaugguaugcaacagucuucagguuugcucccuucugauaccaucuucuaccuuuagcccauucacucacucuauucaacucacuggaacuucagaccuggcauucuuuaugcgugaauccuuuucuaacagccauaugcauucauuuuuccuguguuugccaccgcggaggggucuguuuaagagccaaguaaugucucaagcauuccucaucagacauucuuacuuucuuuggcauaguauuuuccauuuucuuugauuacaaugaaaccuauagggaauuuuauuauuugcaauuaugcugguucugaaaaaggugaauauaagacaaaucaugaacuuucucuugaagaguucaaaaacuaagaugaagaguuauuggcaauguuauugcauuguguauauacauuaaaaccucacaguauagauuauaaacaugcacaguuuuggcauuuauacccuauucaauuuggggacaaguaauuacuucauaaaaccuugagaaaguaaaccauaaagucuuccacauaaaacuguguuuguacucugggggagaaagaugaugccucaaaagaaaucauauaagaauacaggggcugcagaugauccuguggguuagaguguuuccugugcaacaguaaagaucugaguucaaauucuaaccauccacaugaaaagccaaccucagugcuuugugggagcagagacaagaggagcuugcuggcugccagauuuaguaagagacuaggucuuggggaaauaaggcaguauuagcuaagaaaacccagcaucuuccucaggccccacauacauaauacacuaauuuaaaaaaguaauuauaagucuuaaugccaguuuugcauaugcugugggguuuuuaaagagggagcuugaugauauaagccauggaaggcuuuaugagcagggaaauaugugaccuacaguuggaaccaaaucuucagugauuaacaggagagaaagaugguguguggagugguauauugacaagauguuccacguugagaagagagcaaauagaauaccauugaaauguaaaaggauaaguuugaaaguugagagacauuccugggacuauauaauaugcagcacacauggugggaagaaggaauucuuuugcucacuuucuucaaggguaaaauuaucuuccuugugcugcaucauauuaaagugaauacuaagugaguggagcugccucaggcuucaguauagguaaaaucuuuguucauauuccuauguaauuagggaugaugauacauugaugcaaucaugucucuuuggacaccuauagcuggcucucuggacaagacauuacugagagaaaaguauccacauuuuaaguauuuuaaaauagugcugcaauugcauccagggcuucacccaugcuuuauaaggacucaagcacugagcuugaccuccagagcauguuuaaauuuuuuuuuuuguuuuuguuuuuugguuuuuucauuuauuuauuuuacacuccagauuuuauuuuuauuccuuccuuuuaaaucguaauagauugucuguaucaguuaacauaugcuucaacugcacauauaccuguuuuuucauacuugucuaaaacaucucauuagagcaacauuugcguuucuuaauaacacauugcauaucuuuuuuucuuuucuuuucuuuuucuuuuucuuuugggggggggggauuucgagacaggguuucucucuauagcccuggcuguccuggaacucacucuguagaccaggcuggccucgaagucagaaauccaccugucucugucucccaagugcugggauuaaaggcgugugccaccaugcccaguuuuuuauuucuuuucuaauugaaauuuuuauugauucuuugugaauuucacaucauguaccucaaucccaccuauguccccacccccucugucccuccaaccuccccuccaaaaccaaaaaacaaacaaacaaaagucuugccuuggaagcuguggugugucacacaguguacccucuaggccauacagcuuuacuugcaaauggucauugcaaugagucauuggucuguucgagaccucuggcuucugccucauagucaacacuggaucauccgugggacucuucucagauauccuguugugcccuguuauguggagaucccacagcuuuggaugugcgugacaggcccgaccccuucauguguuacagcaguucauaggugggugggauagauguuggggagcuggaccaacucagagcuuuauuaugguuuguaagauggaauuuguaaguagccagugguugguuaccugucugagagcucuuugauuuguucuaauguaguauccuuaguuauaauauuucucuuccuccuccuccuccucuuccucuuccuccuuuguguaauguggccaugacaugaggugcuuauuuauuuauuuauuuauaucccaacuguugcuuuauguucuagucccuccucuucuacucugagagggucccccccacacaccuugguaccucuaacuuuggcauaucaagucuuuuccagauuaggugcaucuuuucccacugaggcugagcuacaugucugcuacauaaguucuagggacuuuguuccagcccguguauguucuuugguuggugggucagacugaaagcuaccaaggguucagguuauuugacucuauauuagucuuucuaugcaguuccuauccacuuucauaagaguccucaagcuccauccacuggcugugggugucugcaucugacuuaaccaacuacuggguggagccucucagaggacagccaugauagucuccugucagcaaguacaacagauuaucauuaauagugucugggguuggugcuugcccaugggaugggucucuaguuggacugguuauugguugaccauuccccuagucucggcucccucccccaugccuauauuuuuguagacagaauaaauuuuggguugaaaguuuuguggguggguuguggcuacuuuuguuauaugaaaaauguuccauaaaugcuguuuuuuuuauuuucauucaaugcuagaaguuuucaaucuccccacuuauuucaauaacauuuaaaagcauaauauuucauuuccauguuuuuguacuuuuuguagugucucuugauguugauuuuuuuauuuuauuccauugugcuagaauaagauaccagaaaucauuucaaacuuuucuauuuuuaagacuugcuugauguccuaaacugucaaaguucuauaggcugcguagaacaguguauauuacacagcuauuggauggaauauucuaaagcaguaauuuaauccacuuaaguauauuguaauuuaauucuauuuuauuuacuuuuguuuugauggucugauuauuagaugaguuauugagacuuauagcuauuguguauuugcaaaucagucugauuauauccaguaguacaaguuugagaaaaguugaguuugauguauauauauuugcaauaauuguguauauauauauauauauauauauauauauauauauauauauauacauauauauauacacacacacacacacauauacauauauaucgguuuuucgagacaggguuucuuuguguagcccuagcuguccuggaacucacucuguagaccaggcuggccucgaaaucagaaaucugccugccucugccucccgaguacugggauuaaaggcgugugccaccacaccuggggcaauaaauauauuuucuugauggauuauucuuuuuauuaauaugugcugaacuucauuaucuuuuuugacaaaguuuggcuuguagucuauuuuguuagauaugaagauggcuagcccaauuugcuugcugcuucucuguguuuaauauaccauuucugucuuccuuuccuuucuauaguguccuucuuugccugggaggugauauuuuaguuugguuucuguugcuuuuguaaaaaccaugaucacaagugacuuggagugaagaguacuaauuguaacuuccauaucccuaucacaguaguccaugaagggaauucaggaccggaauucaagacaagugccuggaggcaagaacugaaacagaauuccuggaggagugucuggcuugcucccccuugcuuccuuagccugcuuucuuaugcaggaccaucugcgcagggugguugggcccaucuacaucaaucauuacuuaagaaaauguuuaacagacuugucuacaggccaaauugauggaggucuuuucacauuuggggguucucucuucccagauggcucucacuugugucaacuuguccaggaacuaaccaggacaguuaaguuugaaguagaggauacacaguuagaucugguuuuaaaauucaaacaucuaguuauaguuuguuaauuuguggaguugagguauuuauguuuagaguuauuacugagagaaacgugaaaguuuccacacaucugauucuuguuuuguuuuguuuuguuuuuuguuuguuuucacacuucugauucuuuuccuuguugguccuauuuguuguuuugcuccuuuuagcuauaagccuuugucugugccaucucauugaaaauguuugugggcaagccagucacugaugaccuccaaguuaauauagcaaaagauaaccuuagucauuccaauggugugaaaucauuuuccuucucugacguccaggcucuuaucauugucuuuuguuuuuguuuuuguuuuuguuuuuguuuuuccuuaaccucugaucucaucugucggucuccuuugcuaaauugcacauuuuaacuguaaacuuuucgguccuaugaagcuuaaucuuuauauuucuucuacacauauuccccuuuaaugaaaucuaaucccaugacuucacacaaucgugcaugccaugcagaugauucuucaguuuuauacacugcacuaaaaucacaucuauaagaaucauaauuuuuuuuaucuaccagcuacuugauucuuguuuucccucaucaucaggcauguacgaccuguagucuuguccuuuuaaccugguaauuccauccuuuuauuugcugaggacaaaaaccucaaguauuuucuuucuuucacuuucugcuuguuucagcaguuaaagaaauguguuuauggggggugaggaagcacaagcauauuauagacacacagagaaaaugacccucuguaaagcagagggaggacuugggaagcugaaaaauccagucuccuucugagggcugcgauuuugaagucucugaagaguuuuccuccucugauuuaggguugacuaguuugaaaaaaaagauaggauggucgauuagcccacaacuguugcguaacauguccagauccagaccgggacuuguugagccaguccgucagcaggggcuugcuggugggagaccuaagccuguaaagccuuuguuuuaagcugccagacuuuugucucaaaucaggagacggaggaagaaguuggccauguuggaaauuugccaacuuuauuaccuagcuauugcccuucucccuaucugucugccuaccagagagucuguguaaccccuagucucucauucccucgcuucuagcuaucagccuaacugcucucagggaguugacugcucuuaacugcuucuuucuaccaagaguagaugggagggagggcagcagucagaguggcucaaagagugguugaucuaaggggccaugauaaacuuacccacuggugaugauccagaauguaagauagccagccaugugguaugaguccaugucuuugaagguugcuguacagggggguggcauauguaacauagagaaagugggacugccauuaacagcauagaaaaauagcugggaaguucugcccuuaauugaggaagagaauaggcaagaaaaccauguagcaggcuuugucacagggaucugcaugguugaugauuucucugcuaaaacuguaagguuugagguauauaccacggaggaggcuguuugucugguucaagaguucacggagccuuuccucagccgguuuaaguucagaagucagcuguggaguuuauucuacuguuaccuaacagggaauguuaagagacaauuuuuuuuauuauuauuauuuuguuuuucgagacaggguuucucuauauagcccuggcuguccuggaacucacucuguagaccaggcuggccucgagcucaggaaugugucugccucugccucccgagugcugggauuaaaggcaugugccaccaggcucggcaagagacaaacuuuauauauauauauauaauauuauauauaauuauauauauauaaauauauauauuauuagguauuuuucucauuuacauuuccaaugcuaucccaaaagucccccauauccucccccccacuccucuacccacccacucccacuuuuuggcccuggugucccccuguacugaggcaaauaaaguuugcagguccaaugggccucucuuuccagugauggcugacuaggccaucuuuugauacauaugcagcuagagucaagagcucuggggguacugguuaguucauaauguuauuccaccuauaggguugcagaccccuuuagcuccuugaguacuuucucuagccccuccauugggggcccugugacccauccaauagcugacugugagcauccacuucuguguuugcuaggccccggccuagucucacaagagacagcuauaucaggguccuuucagcaaaaucuugcuaguguaugcaauggugucaguguuuggaggcugauuaugggauggaucucuggauaugguagucucuagaugguccauccuuuugaagagacaaacuuuuaauguggaaaguuacucaacgucaugguuaacauagguuugguucacuaaggugaggcauaauuguguaucuggcugcacuguguaccagaaccuuugucagcaagagaugccucugcucuugugccaacuguaacauccaggguagggauacaguauggaaugaaauuuuuuuuuuuacuucaacugcuaguugaagaucuggaccuaaggggucaacuguacuugggaagagccucauauuacagcugugagaagugaucuuuuagaaagaaauaguguugugaggaagagauuaauuagugggaaauaguuguccaaauaacaucucacaugguuaaauacagugucuaaggaaacauaccgauugcuuuaauccuggguacccuuuccuaacaggugauuaagagcauauagguggccaaaauuaaucuccuccuccuccuccuccuccuccuccuccucuuccuccuccuccuccuucuucuucugugaauguuuuuuuuacuucaagugcuaguugaagaucuggaccuaaggggucaacuguacuugggaagagccucucugacuccucuauccucucauuuaagccaucugugugagaaaucaaaggcaucgaccauuguuuaauuugaaaguguggaggaaauuuuuuccucucuguugacucacccccacccccucuuuguagacuagacacuggauagugucugaucaaugagguccccucuaaacaagggaacaggugacuuuucacaguuacaagccacuuugagagauauccaggacuuaauuguuauugaaggcauggggauaaagucaugugacauuuggucuuuuuuaaaaaugugacauggugcacgccuuuaauccuagcacuugggaggcagaggcaggcggaucucugaguucgaggccagccuggucuacagagugaguuccaggacagccagagauacacagagaaacccagucucggaaagaacaaacaaacaaacaaacaaaaaaugugacauuagcaaagauggcagccaagucacaacaguuuaauuguggacuuuuauacccuuuucuuucaagcgacacuuuaguuagguaaauguggauauacaaguaggcaauccuauggucucagcaaguaggccuccaaaagcacauuaaaaaggaaggacuuccacagucucaucucagaaaagcuaccaccagugugagauccaccagugugaacuuguagagggagagggaagguuagcuagcuggucuuugccauuuugcugauucuucuuuucuacccuuuuuaacccccaguuucaccccuaaucacuagauaggaaggaagaauagaggggagaaaggucugugaauguaauuucuuucuguuucuucuuugaacacgacuacuagcaaaccacgaccacuacucugucccccaagugaccaacaucuaccaacccugucucucauguaccuucugaaaagcuuccagaauuccagaugucacacaacuguagaaauuuaucugcagcuggcaaaacuaugccucugcuagagcaagaggcaacucauagucagcugcugcaggcagucuaaagcaggcccauaucccacaccugggauuaaaaugaaagcacauucuuacaauauuuuccguguuuuuuuuuuuuuuuaagaaaccaaaauuccagaauucucacuauagggaagaaauuuaaccaccauccaauuucaguucaaaacaguagucugucucugucucugucucugucucugucucugucugucucucucucucaguguuguggagggaaggauaggagauacagacacuuaggaaugucaaaaggucuguuugucuuuaaguagagaggaacuuuccaaauuucccuaauaaugucuucuuccagcacacagaucagauccaggucucucucugacaagaaugaagcuacauugcucuggagccagggcuuaggcuaggaguguagcuuuaguaucuuuucacaggucucugaucaccaguuuaacuggcuuccuaggauacacaaacauuagaguuagaaggucugagggcccaaucauugauagaaaaaaagaaaagaaaauugccagucucuucccaggguggagaaagggugcaggcagcuuaaggggcauacauaccuucuuacccuuucaagguuugcccaauuuauuacucacuuuuaugaguuggugguccucaaaagaaaacuugggaugaaguccccaaagugauacuguuaagggagcuuugauuuaguuuguuuucccucugccuguuaaagacuuaaaaggcaagaagaacagguagcagacagaaucaggguugaaaaaaggcauuuguuuagggcaaggaagcacauguaugcaguagagucuacacagaacagaagggggacuugagaaggggacccaaauuaacagagucagaaacugugaugguuuguauauccuuggaccagggaguggcaccaucugaagguguggccuuguuggaauaggugugaccugguuggaauuggugugccacuguggguguggguauaagauccucacccuaguugccuggaagucagucuuccaguagcagccuuuggaugaagacguagaacucucagcucuaccugcgccaugccugccuggauacugccaugcucccaccuugaugauaauggacugaaccucugaaucugaaagccagcccaaauuaaauguuguuuuauuaagacuugccuuggucauggugucuguucacagcaguaaaacccuaacuaagacagaaguugguacugggagugggguauugcugugaugggccugaccaugcuuuuauuugaaaaauguggauuuugggacuuuagauuuggaaagcaguggaaugcuuuaaauggggcuuaaugggucauccuaguagguauauggaagacuuuguugcugggaguaauuugaacuguguugaccuggcccaagagauuucaaaggagaagaauuucaguauguagcauaaagacuguuuugugguauuuuggugaagaaugugguuacuuuuugcccuugucugaaaagucugccugaggcuaaggugaagagacuuggauuaauugcauuaauugcauugacaaaggaaguuucaaaaaagcccagcagagacuuuguucucugguuaagucucacaaagagaaguuugaacaagcauagcaagcuuaaaaggccaaauauaaaauauauggucccaguauuaaaggcauaagaggaagugaaauggagcaaaauccuguguuuuaggagauaacagauuaagggagugggaauuuggggcaagauccuacccagcuaaauuaaauccagguauagugguacacaccuuuaaucucaggagaccggcaugcugaucucugcauucaaggucaaucuacagagcaagauccagguuagccaaguuuaggcagugaaggauuuggaaaacagaaagccagugacaauguaauagcacaagcaggucauguuguaguuccugcaagcagcagaacucggcagcuucagcuacguggcucuggcucuagaguuaagaauugaaggaauuacugggacaguugaugcugguuagcuggagcuaaggaauuagcagugauuaagaagagaccagcaucacugaggugaaaucuucuggaaauuguuuucugggagcacaaagaagcuguguuccagagauacccaagguuguaccucaugcugcggcuggauuugguaauguguaagagucacucaggugguacugcugugaaggaaugaagggaucauggagagaagcugaggcuuagcacugugagaggccagggaaggccauuggagaaggugaagccucagcuguaguugauggcccaggacugaaggggucaugcaaaggauuugaggcuuggcacccugaagagagccuaugaaaggcuauuggugaagccuaguuggaauggaacaccccaguguauuggagaugucaguaccaugggaugauuaccaagaacagcagcaguaguggaguggaucaaccugagcuuagagugcuacagagggcagagcuggaaaagugaugcaagcccuuaggaggaguccaaaagaucaaguggaaucccagacacugaaacaagaagcuguaacguugaaauugccuuggagacucaaagauguuaaagaugccagagccaugggauacaugcugaggaaagcugcuaacagggaguggaaccagcccaggagaaagcaguuuguugcaaucaacaaagaugaaaaaaaggaguggagaucugaagaccgcuuugacaucagccauggagaugcagaguuugaaguuugcccagcugguuuccgccuugcuuuggggauuacaguuaauuaaguugaaugaaucucagaagaguccuugaacuuuggacuuuuaacauuguuucgacugcuauagacuaugaggacuuugaaaguuggacuaaauacauuuugcguuaugcuauguuuaaguauggcccccauagacucauguuuuugaaaaagucuauggggaccagggaguggaaugugaugguuuguauauccuuggaccagggaguggccccaucugaagguguggccuuguuggaauaggugugaccugguuggaaugggugugucacuguggguauaagauccucacccuaguugccuggaagucagucuuccaguagcagccuuuggaugaagacguagaacucucagcucuacuugcgccaugccugccuggauacugccaugcuccuaccuugaugauaauggacugaaccucugaaucugaaagccagccccaauuaaauguuguuuuauuaagacuugccuuggucuguucacagcaguaaaacccuaacuaagacagaagucaacaaggaaacauuacaacacacaucaaagaauucagaaaaauaugaaggcguuuugaugaucucguacaggaccuggguucaguuccuagcaccuacauccauaacuccacucccaauggaucugacacuuucuucugacuuucaaggguaccuggcacacaugugguauacacaaauacaugcaggcaaagugcucauauacauaaaauaguuuuaaaaaccugcauauaaaaauaguaauaucauacugaaauggaaaaccuaaccauuucuucuaaaaucagaaacaugaccaaaguuucauuuuuacuuccauucaauuauaguacuugaaauuuuagacaaagaaaucaucaauuauacaucucaauaaaacagacucuuaaaacucucagaauuggggacucgagcaauggcuaagaucauugguuguucuuucagaggaccuggguucaaucccuagaacccacaugguggcuuacagauguugguucacuccaguuccaugguucugauaccaucuuauacccuuugaggauacuaugugcacauguuaaacauacaugugugcaaacaaaacacucauauacaaaauauaaaaaggguuuuuaaaacuugaaaaaaaacuuagaacuaacaauuuaugagaaaauucuguaugcauaguuaauaugccaaacuauauaacaaaucaggaaaacuaucucucauauauauauauauauauauauauauauauauauauauauauauaauuagcuaaggaaguaagaagaccucuacaauagcaauuauaaucuacugagaaaaaaagcaugagauuaaaaacagaaagacuuugcauguuugugauauuauacuauguuuucuagauuacuuauauuuuuuucugccuccucuccuuugauauuucccaagacuugacacugagagaagggagcugauaacaauguccuauuuaucgcagagcacucauacucaaucauucucuaaauuuugaucagacuuuagguucuaccuugacuucugugcacugugaaaugaaacuucucugacucagguugagaacagcccccgucucuggguauaaaugaauggcuccauauucaugaacacauaggaagcacuaaaugaacuuaauggguuauuaauuuaaaacagaagaggauaggaaguuggaagguaggauuuuuuuaagcuaugagaauacaacauaagaucuauucccaaauaauuggaugagguuuagauaaggagaagaaagggagggcagaagaggaaguaggagaaauauaaucaacaauaagaacauuugaaagggccauauggaaaccuacuaaggaauuuaguuggaauauucuacucagagaauaaugcuucuccuacaagcuauagguugccaagcagaauaaucucagugcaaggucugggacacaucccaucaaguuguuugucagucuaagagaccuccaaaauaauaaaagcuauugccauugguguugguugcccaccagaacuuaaugaugagaccccuguugcugaagaacacugcacacuucagucacaagaauuggagaaaucgaacuugauuaccuggaagcuuccacccuguuggcuaauuuuaauaguauuggaauguaccagucaaaguacagagauuacauaucuguauagugcucaggaauaaauaggacaacuucuggacaugauagaaccacugcucucaugaacucacagcagcuguuugcccaagaucaaaccagucaauauucuagagugaaugggggagggcucacaagucccagcccuaccuaaagagcuguugacagccaguggcuucugaggaaggggcagucaguuuucuuuaaggguguggccccuguaaaguugacuguaauccaguggguagccccacacccuugagaccauggacagcacaaauuauacuuuguauuguauaaagagaggacacauaguuuggguggggacauaaggagguggaucugggaggaguuagacgagggaaguuaauaugaucaaaaguacaauguaugaaaguuucaaauaauuaauaaaaacauucuuuuuaaaaggggaggcaugaaguuggaaggagguauggaggguauggguggaguugguggggugggguaggagguaacuauaauagaaauauauuguaagcauguaugaaauucucaaagaauaaauuaaaaauauaauuuucuuuaaggacauaucuacucucagcacauuuuaaguauacaguaggacguuguauaggggguaugguuauacuagcuauccagaccuguuuguuuguuuguuuguuugagacaggguuucucuguguagccuuggcuguccuggaacucacucuguagaccaggcuguccuggaacgcagaaauccaccugccucugccucccaagugcugggauuaaaggugugugccaccaccgcccggcucagcuauccagaacuuaacuggcauaucugaaauacuuauuuuucaacuaauuuuuaaauguaaaaaaauguucauaucauauuauguaaaguuugauauauguuuguguuauauaauguuuaaaucaggcuaaugauauuuauuuuaaagcauggcaguuuucucuagguguaagcuuaaaaccccuuuucuuggccucauuaucuacaaccacuucacuguagcuuuuugcucccaucuaauuuaugacucacuauccguugucagccaccuucuauuccugagcucuaagcucccugaguucuuauaacuaucauucuauacuucugcaguaaguuccacauaugagugaaguauuacuucgaaguauuauaucugucacauauuuugcuuaucaccagaauagcuauuuccacccaucuugcuacaaguuauaaauuccauucuuuucuaaaaucauauugcauuuauggaccacaauuucuuugcccauucaucaacuguuguuuccauuagguuauuuugacuucuuggcuauucuguguagugcuguaaugaacaaggaguguagacccccugaggcauaugaucguuguauuuuaauuuggggagaaauaucaacacuguuucccauaauggguguacucauuuacauucccaccaacaguguucauaaguucccuugcaacaacauccuuaucaacauuuguuauauuuagacuuuguauguguauacuuguauguaugcauaugcuuucauguaugugaacaccagaguucaacaccagaugcuguuuuuuagaguauuuuuuaaauuuaauuuuauuugugauucauuuuuuacaccuccauauuccauucccugccccuccccauccaccaucggagugcuccacuucccacaccuccuccccacccuacuccaucuccaugugaaugcccuuacccccaccccaccugaccucuaaccucccuggggccuccagucucuugaggguuaggugcuucaucucugaaugaacacagaccuggaaguccucuacuauauguauguugggggccucauaucagcucgugugugcugucuguuuggugguccaguguuugagagaucucaggaguccagauuaauuaagauugcugguccuccuacaggaucgcccuucuccucagcuucuuucagccuucccuaauucaacaacaggggucagcugcuucuguccauugguugggugcaaauaucugcaucugacucuuucagcugcuuguugggucuuuuggagagcagccaucauagauccuuuuugugagcacuucauagccucaguaauagugccaggccuugggaccuccccuugagcuggaucucaguuugguccugucaauggaucuccuuuuccucagguucuucuccauuuuuguuccugcaguucuuucagauaggaacaauuaugggucagaguuuuugacugugagauggcaaccccaucccucacuugauguccugucuuugugcuggaggugggcuauauaaguucccucucccuacuguugggcauuucaucuaaggucccucccuuugaguccugggagucucucaccucccaggucucuggugcauuccuggggugggguggggggguccuauuuccugagguugccuguuuccauucuuucugcuggcccucagggcuuuaguucuuuucccucacccaauaacagaucagguuccccucuacccaccacugucccccuuaaccuguccacauucccuccuaagucccucccucccucccucccucccucccucccucccucccucccucccucccucccuccuucccuccuucccucccucccucccucccuccuucccucccucccucccuccuucccucccucccucccuccuucccucccaacuugugauugcuuucuucucucucccaagugguacugaggcauccuccauugggcacuucagcauguugagccuuuugaauucuguggacuguaucuuguguguucuguaugggauuuuucuuuuucuucuucuucuuuuucuuuuggcuaauauuuacuuauuagugaauacauaccacgcauguccuuuugggucugaguuaccucacucaggaugugaguucuauccauuugccugcaaaacucagaauguccucauucuuaauagcugaguaguacuccauuauguaaaugaaccacauuuucuguauucauucuucuguugugggacaucuagguuguuuccaguuucuggcuaucacagauaaggcuucuaugaacauaguggagcaugggccccuguggcaugcaugauguggcaccagaugcuguuuuugacugcacuccaccuugauuuuuugagauaggacgucucaccaacccuggaguugauugauuuagccagacugucuggccacaaaccuuucgagauccaucugucucuguccccacucuucauuuaguacugggauuguaauagugcuucauugcaccuggauuuuccauggguacaauagaucuuaguucggguuaucauguuugcauagcaaguacuuuagggacugagacauguuucuagcucuuccuaugucuucuugauaaaaguuuuucuuacuagagugcagugaugugcuauaacgguuuuacauuaauuaauuaguuaauuaauuguauuugugugaggguauacagaacaugugugccacaacauacaugcggagguuagaggacauuugugacacucaguucucucuuuacagcaugugggugcuaaggaucaaauugguccucaggcuuauggcaagagccuuuacccccaugaaccauuucaacccgugccuuggaacugugauuacuuaaggauuaauuauauuggugauauuuaugucuuauuuucagaaauuucugauguugagguuuucucauuuaaauucccagcaacuucccuuauuggauaugugcauggcaaguauuuuaucccaugcuggaguugacuccacuguuugcuggggauguguagauuaccuuccagucauucuacugggucacauuggccucuguguaugaugucagcucuuuugauugauacagcuuugcaguauauuuugaaaucagguagcauaguuccuccuccucuggucauuuuauucaaaauagcuuugucuguuuggagauauuugagguuaaaugugaaauuuagaaugucuuuuagcuuuaagaaauaugcuaauugggauuuugaugggcauugcauugaauuauacauugcuugcaauaugauauuuaucaauauuguuucuuccacucuauaacaacagaauaucuucaguguuuuggggagguauuuauuuucuucauccacauuuuauaauuucauuguaguuuuuuuuauugcuuaaguuaaauuuauuccuagguaguauauucuuucaguuauugguucauuuuauagaauuuccuuuuguaguauaaaauacuauugcuguuuguauauuagauucacauucuccacuucugguauauuguuuuaagacauuguuucauuccuuauuauuguguuguuugggugcuucauguggcguggcauauggauggaggucaggggacagcuuugugaaguugguucuccccuucuacucucauugcuguauuuguguggcaagggucuuuaccugauaagccuuugugcuggaugucuguauuacauuuucuccuuaaggcuuagagauuuauguagaaggggagguagaaguauuguaaaagccacagguagugcaggauucugaggaaaugguauauucuacacacagcaguacugauacacaaugaacucacagagccuguaauagcauguacaagacauucacagauuuacagauucaagccagacaaaaucucagcacagagaaaggguaagugagcacaaaggcccauccuaaccaagaagcuauuuccaauuacuaccugcugggaaaaggaaaauucaguuucucuguuggagugauacuggauauaccagcaacacuccauccaggucaggcuucaugcucaguaguaguugaccaauacaaaagcgauuccaugguguguguguguguguguguguguguguuuguuuuauuuuauuguuuaguguuuucugucuuuuuggguuuuguuuuguuuugagagaaagaaugugaaguuuggugcuguggaagaucuaggaggacuuggggaaaggaaaaggauaggaucaaauacguuagaugagaaauuuaauaaaaauguaaaaaaaauuagacuauaauauuuguuguauucuugucugauuugguagcaagcuaauauuagccuugcagaauauguuuggaagaaugucuuuuauuuaagggauauaucuuuaggaaauuuuaugcuauuucuuccauaaauguuugauagaacuuauuaaugacacucuuugguccucagcuuuucuggaguaggaaaccuuuuauuacuuacuacuagccuguucauguuuucuaaguuucccuaauauagcuuuggcaauguuucuguuuuggugaauuuuuccauuucuaaguuauugaaguuuggacauauaguaguuugugauaaucucuaaugagauauuuuugcaccccuguugucaguuguaaucucuuacuuugauucuucuuguuuccauuucaagguuuauugaguuauuuuuuuuuccuuaagcagcucuguguuucuuugaacuuaacaacaacauggguuuaguucuuucagcuaaccuucucuucaaaaaacaaaaacaaaaccaaaaucaugcuguuucuaaaauuuuuucugcuuccaucguuuuuucaaaagauaguuauuuucauacacuugugaaauuuaaacucuuuugaugucuuucguuucuagauuucccguuuuguaaucugaaaaauaguugguaugauuuuccuuugugaaaauccuuguugguauauaaucugucacagagcauguucuaugugcugaugaggaaaacauuuauuucccugugauugaaugggcuccuccuccuccuccucuucuucucuuucaagacaagaucuugcuauguauucuaggcuaggcuugaacccauacagccugcauggccucaaacucaugguguuuuugccucagccuuccaagcucgcugauccuugcuuuagaauuucuuuaaauguuuauuaucuccauuuaaugaaggguaaauuuauuuuuuaaagauuucauuuauuauugccaugagggcuacauaucauggcuuauauauggaaagucagaaggcaacuucauggagucaguucuuuucuuccaacuuuuguggguuuugaacucagguugccagguuugcuugucaaguguccuuaccugcugagccaucucagcagccccaagugugcaauguaacucuuuuucuucauugauuuuaugucugaaugcuuuuccuguuuaugagccuggcuguuaaaguccuugacuacuauauauuagagucugucucuucacuuagguuuauuaauacuuguuuuauacuuuuauuucuuuauacuuugauauuauauauuguuuauagcuguuauuuguucuuuuuaaauugacaucucuaucauuauguugauuuuucuuuaaacuauauuugauuucaaauucuauuuugucucugaauaguugucuacucauaauuucucuugguucauucacacugaauaucuaaucucauccccuuucucuggaucuauuuauauucuuuuguuugguugguuuuugguuuuuguuguuguuguuuuggguuuuuuuuguuuguuugguugguuuuuguuuuucgagucaggguuucucuguguagcccuggguguccuggaacucacucuguagaccacugcucgaccuaucuguauucuuaaauguaaaauugaaugaagugaauuuguuguuguuguuguuuuuuuuuuuuuuuucgagacaggguuucucuguauagcccuugcuguccugaaacucucuuuguagaucugguguuuuucuuuuugagacaggguuucucccuguaacaguccuggcugaccuggaacuuacucuguagaccaggcuggccuugaacucacagagacccuccugucucugcuucccaagugcuaggauuauaggcaugugccucaugcccaaugaagaaaaaaaugccuuaagagagaguaugggcuucuucuuuuuuuuuuuuuuucucuguguagcucuggcuguccuggaacucacucuguagaccaggcuggucucaaacucagaaauccgccugccucugccuccugaguguugggauuaaaggcaugcgucaccaugagccuggcugagugugggcuucuuaagacaagguuuuauuuaaccaucuugaugcuagcuauauacacaacuuuaguaaguuuugaaguuacaucgcucaaauuaauuaaaagauuaagugaaagcauuuugguaugccugcauagcacuuuuccuuaguaaauaacaugguuugugagcuguuguacuauacaagcuuaaacacaaauaagauaaaaauaaacaucaaaauggauuuaaaguaucauuauuauguacagaucccagagagaucgggacaugguuugacuguaaauaaggucgagugugguauaguucagauuuucuugacucucagccagcaggguugaagagcuucuuucuucucccuugccuccuugaguuucacugccauucugcuuuacuccagugucucccucugaggcuuuaccuaauauuaagagucggcaauggucaauauuccauuuuucaaguuucuuacuucugaacagggacaaagacaguaccugccuguccaagguuuuuaagucucacugucugaucugagggagacauuaagaguuggaguuuggagcucugaggauuacugucuuaaaccuuuacuugaugauuaaaugacuuguccuguaauauguuuugaaucuuuguuauuuuuuauuauacaauuuuuacuuugugguuacuaggaguuucaaaaggaccuuuuaauaguaagaaguuaauucccauggcgcuuacucuaauaguuugcugcauguauucuugguccucuugcugugucuuggaggaguacuuucugcagauuguguucacaugccaccuuguuccaucaucucuaauuuauagcauggaucaugucugaaacuuuccuguuaaguagauuccuugagaggaagucuuuauugauguuucauacuuagcucugcuauacuacauggcuaaaaaugguaauuuaugcauggcuguuuucaccaugguaguaaaauaugugcugcacauuugggaaugguaacuagcugaaaaauuugcacuuguuuauuuuguaucuuggucgcauacuuaaggacaaugaaccacaucuugguagugauuucauauguaguaugcauuuuacaccagaucuuuccuugaauuucaacaguauguguuaagaaucccuuguuuauauuuuuauuaucagauucuaaauugaagguaauuuuuucagguucuauaugaucaaaaucgcacaauccaguacucugccaugcuauucucaauugcuccuuuaaagauugaagacccaugagugagaguagauaauguugugaaagaggauucauuuacuaagaccugcaauagucuacugacauuugcuucuggaaauuuagugaacuuucugaacagaugaaaauaugccuuuggguaauaaaccaacauuggaaaugaacaaauauuauuauaggcagaauguugaaaaaaggaaacaaacuaagagggucaauacagagacuaacaagaaaugagguacacacuuaagagagaaaaaaaauauauagauagauagaugaaaaaaagagggguaaaugguggcuagccccaagauucaaggucccuggugacaucuaaggucacuugcuguagguguguguguguguguguguguguguagggggcgugucacagugaagcuauaauuggaagaauuccagcaccuaauugagucagcaauggaacugugaagcagccauuucagcagcagacauaaucagagguagaaucauugaacucaaaacagcaaggaaaaaccugugcuagugucuguauagcggugagucaagauaaccuguuccuaguggcaaguguagaagaacaugaagguugaaguaaguucauuuagaacuguauaaauaucugagguauccgaugaaguauucaagcucugcucuuccaacagugcgagcuagugaagaguuuggguuagagugacugguagcggcuguauacgaaguuguaaggaaaaauauuacucuuauaauuuuaaaauguuuggugguaaaacuccuaaguaaauuggcuauuucuuagaggcaaagcuaccaguauacauaaaaccagugucuccucucagucuuucuucuguguuagaagcacauccccauuuuaucugaagaacagguaaagaacaagagaacccucuauagcuuagugauauaaagaguuaaaaguugaccuaacguguuuaucagagcacauaauugcuauuuugcuccaauaggaacaaguccuaggaaaguugaaauaccaauaagaaguuucuuuaauuguacugugaauguuaguaagguuaacuauucagaaauuaauuggucauccuguuccaguccguagcaccgugaaaaggguuugaaguuuugguuuggcuuucacccggaugcaguagaauguaagguuaaccugaauaggcagguuagggccugagauaaguguauuaguguauuaggucuuugcagugguuaaaggaaucugaacuguuuauugaaagucacagaauaguuuuaaaugagcugucaaaaacaguguccauaaauguagcacauuuuaaauugucacacaaaacacuaaaauacuucauuuguguaugugaguauacucaccuaucuguguauggauaaaugugcccaggcuugcucagaggccagaagagacuguuggaaaccuuggaucuggugauacagcuguuuucaugcuaguaagaugcucaauuuguuauguaggcaaugaaaucgaaacuguuucucuagccuucaaaaugacagauuuaacaagcacauacaauagaguauuacuuuguaaagauaaaagaacaaugcuggucuauagccagccaugugcuguggccucuccucacucuuugcccacauucccaggggacuaagcagaucuuuggggaacacccugauuuccucccaccuauggaccccaucagccccucuccuaucccauccucaucccuaagugugaguuucuaauaccuacaaacacauuuuaccuggaaccuccaggccacaccuaucaggauuccaaaagaauuuccuaccaggcaacacauaauccucacacucuucuaagaaccagacagggcaaucaacaccaaggaauaauacacccaccuuauaaagacaaaaacauguaucagcaccuagaauuauaaucuucuugaaccuagaugccagcuuaaaacuauaaugaaagccaggcgugguggcacaugccuuuaauccuagcacuugggaagcaggggcaggcggauuucugaguuggaggccaaccuggucuauaaagugaguuccaggacagccagggcuauacagagaaacccuuucucgacaaacaaacaaacuauaaucaauuacaguuaggacaauauaucuccacuauagcccagcaacucuaucacagcaggcccugaauaauccaacauggcuaaaguacaagaaaaagaccccaaaacagccuguagaaagaugauagagguccuuaaagaggacaugaauagauggaugaauaugaaugaauuucuuaaagaaaucuaugaacacauaaacaguggacagaaaugaauaaaaccauucaagaccuagaagugagucaauuaaaaauaaaaauaaaacuaagccaaacugggggaucuagaaauggaaaauuuaggaacaugagcaggaaccuuagaggcaagccucgccaacagaauauaggagauagaagaugauacaaucucaggcuuugaagauacgacagaagauggauauaucagacagagaaaguguuaaaucucacaguuccugacacaaaacacccaggauauccaggaaacuaugaaaagacuaaaccuaagaacaguaggaauagaaagagaaacacaggucaaggacauagaaaauauuuuaaagaaaaucuagaagaaaauuucccuacccuaaagaaggagaugccuauuaaaguacaggaagcauacagaauaccaaauagacagggucagaaaauucagcacauaauaaucaaaauacaaaauguacagaacaaagaaagauuauuaaaagcugaaagagaaaaagaccaagaaacauacaaagacaaacuuguuaaaaauuauaauugacuucucaauggagacucuaaaagccagaagggccuagauaguugugcugcagacucuuaaaagagcacagauaccagcccaggcuacuaugccaggccaaauuuuuaaucaucauagauggaaaaaauaagauacuucaugcuaaagucaaauuuuaucaauaucuauaaauccagcccuauaaaagguacuagaaagaaaacucuaaccuaaggagguuaacuacaccuaugaaaauacaggaaauaaucucauaucagcaaaacuaaaagaagggaaacaugcauaccaucaccagaaccaccaccaccacuaacaacaaaauaacaggaaucaguagucauugguaacugguuucucucaauaucaguggcuucaauucaccaauaaaaaagacacagacuuacagaguagauggaaaaaaauaggauucauucuuuuacugcauccaagaaguacacuuuaacauuaagaauagacauaagcucaagguaaaggguuggaaaaagacauuccaacaaauuguuggaauuaagaagcaagcuauuguuucuuaaaaugguauagccauuuuaauaugacuucaaaccaaaauuaaucagaagcgcuagagaaggacaauacaaauucaucaaagggaaaauccaccaagaaaacaaugcaaaugcaagggcaaaaauguuuaaaagaacacuauuaccauuuaaaucacauaggacuuccacacgcugauagugggagguagcaugcacaggaccuucaagggucugcaguagguccuuuguguagcuauuauaguuuccaguuuaguguuuucaugggauuccuauguaugugaaugaguacaucucugauucuugugcccucucuuggacucuuuucuuucugauuccaguguguuaaaauuuuguuuuauuuuacaagccuguuuguuuucuaaugagagacagaaagggagugaaucuggaugggagggaagguggggaggaacugggaggaguauagagagggaaaucugcaaucaggauauauuauaugagaaaaaaaucuauuuuuaauaaaagguuuuuuaaaaaaauaaguaagccaugaggaacaagucaguaaacaaauauuuuucccucugcuucugcuucaauucuugccuccagcuuccugcccugccuuccuucaugauagaguguuacuagaaaguaguaaacuguaauccuuccaccccaaugcuagagggauuuccauggagaaauaauaacaaaaucauuauguuuacuggcacagaaacagauauguaaaccgauggaagaaaagugaagacccaaacaugaguacauauaacuucagccacugaauauuugaccaagaaaauaaccugggaaagagaaagcauguucaauaaaugguucugggagaauugccugaccauauacaaaugaauaaaaguagaccuguaucuaucaucuuucauaaaaacuaacacaaaauaggucaaagaccuaaacuugaaaccugaaacagugcuagaaggaaauguaggcaauaucuauccccccuucucucucccccccucucuguguauguguguguguguguguguguguguguguguguguguguguguaggcuaggacauuuucaauaagacuuauuugcccaacagucaagauaaacaaacauuugacaagugaugcagugauaagacuaaaauguuucugcacaguuaaagaauuagucaaguagagaggaagcccacagaaugggaaagaaucuuugucagcuaugcaucugacauagcauuaaucuccagaauauauaaagaauuaaaaaaaaaaccaaaauuucagaaaacaaacaaacuuacuaaaaacccaaaugaugccgggcgugguggcccaagccuuuaguccuagcacuccgggaggcagaggcagguggauuucugaguucaaggacagccugguuuacaaagugaguuccaggacugccagggcuauacagagaaacccugucuccaaaaacaaaaaaaaaaaacaaaaaacaaaacaaaaccccaaaugaccuauucaaaaaauugggacugggaccugagaagaaagaaaaauggcuaagaaauacuuccaaaauauacaugguccccagauauguaucauaccaccauaugaauaggaauggcuccuauggaucaaauauuugaaccuuggucuuuagagacagauuuaaaaauguggcauuuuuagaaugggugugaccuuguuggaggaauugugucucagaagccgguuggcuuugggguuuccaaagcccaagccaggcccuguggcucucuuucuuccugcuauugcugucccccagaggaaaaagggaagucccuauugcugaaaacaccauccacuuaagacauagagcccagaagcuccuaaacuggaacagacacaaaagccugcucuuugaggauuagccuuuguaguauuagaaaguaccauuugguauuuuaaaggagggaagcagcuagcaauccuaccuaguuauaauaccuaugaagcacaauaaggagcaucaggauauaauaguccuaaggguguaguaguggcauucaaaccaguggcaguaaccaacaaaagggagauugugucugguacuggaaaccuagaaaaugacccaggacaagugaagucauguaucuuggaagagaaccuccaacuaccacuuuacuaaacuagcacaaucccuagaugcauauuaauauauauguauuaauaugcaaauauuauacauauuuguccuuuuauccucaguuacuuuuuuauuguuaugcuaagauaccaugacugaggcaaccuauugaagaaagcauuuaguaauacccuuucaguuuuggagggugagucuaugacacuuaugguggggagcauggcaucagauagacaggcauguuguagcaguagcugagaucuuacaucuaauucacaauccacuuauuaggcagaaagagcuaacugauaauagcaugggcuuuuaaaacgucaaagcccauucccagugacacacuuccuccaggucacacuuuuuauuccuucccaaauacuggggacuaagcauucaaauauaaaaggcuaaaggaggcauucauauucaaacuaugacauucuacucccuggccccauaggcuuauggacuuauaaugcaaaaugcagguagaacuuaaaaaggucccguagucuuucacagucucaacauaguuuaaaaguccaaauucagaaguuucaaggugaucucuuaguuguaacccccuaggaaauuaaaaaaaaaauugaauacuuccaacauagaauauacauuacuauuccaaaagguagagaugaggggauagugaggaaggagaggacaaacacauaguuaaaaacacagcaaggcaaacuccaaaucuugaaguucuuaagucugauaucgcacacuucucucuuuuggacugcuuccauucuguguaugcaguuugccuuugcguauaucccaggacucuggcaucuccuaacauccugcaguuucuaauacaauucuugcuucacuucccagagcuucccacaguggccucccuggacucagaggaagauucccaaaccuuucaugaaccagguggcugauguucccaaguucugcugccggcugggcauggccucuggccccuuucuugaacuacauuugcacaaacuuuuguuuguuacucuguaggaacagauaauuacccaggccuuuuguuuuuacuaguugcaggauuagcugggugaggucaugcccuuaaggguaucucucccuuuauucaguuuuaucuguuucagcacaaacacuggcuuuggcauuauauuuccaaguguucuuuuucucuuuaaauuuguauuucuuuuuggaaacaugcauaaggauggaaggucuucagcuagugcuccagugcccugccuaccccguaugcucagauauuugaaugcuuagucuccaguugugcccuuguugaaggagguuugucaugguuggugggcuuugagguuugucauucauaguuagcuuucugccucuugcuaguggaucagauguaaguccuuagcuacuccuccacgucaugccuacucuauguugcuaugcauccaaccaugaugguuauggacucuuaagucucuugaaacugcaaguucggcccaaaacucuucuucuaugaguuacuuuggucauggugucugcacagcaauagaaaaauaaaccaagacaagcauaguuucaccccucgaucaaggaaacuucucuauacacaagaugaagaccauuugcagaaaacaaugcaaccaauuaaaacgcagaguuguggagcucagucccaauugauacaacuauaauuuaacucucacaucuaaggcgcagggauuauuguagaagauggggcaggaggauuuugagaggggagcgggguguuugcuaugagauugugucuucuccauauuucagaauuuacacccauagugucucaccaacaugacuauuuaaacauuggaacgaggacaacaauagacacauuacaguggauggauaaaagcccauucuacacaaugaacugcaggcaacuagggaaugcugagagugagagaaauagucuuucucaaagaagagcacaccaguugguuauccaauaucaaacugucagcccugaaaauauacagauaaguauagauugagcagguuguccuuacguauuuaggaauacucacauacacaaauacacacacauacaaacauguacacacacacaggugcauauacauauguaacaacaauuaaugaaaaaggagaccuugaaguugaaauaaagcaaggaagauacauaagaaagggaaaggagaaaugauauauuauaaucucaaaagguaaaaggaauaauuuuuuuaaauugugaaauucauaaaaaauauauaauuacuuuuaaauuaccuaacuauagacccccacauuugaauuuaaacgaugaauucuuccauggugcaauuugguaauagggcauaagucugacuuugauauauuuuguaagugcaaggccuugaccaaguuauuuuucaggcucacccuaugauaggcuaggauagaagacaguggccuuaaacuuacaugguuggugaucaguuaucacagcugugcuaguaggaagggucaauuuaucaaauguucuaugcagacaaacacaauggucucuaaaucccagguaucggucagcaacuaaaacccgguuguuacuaauggggccagauuuaguuuauagcauccauaauaaaacuaacccuguaauggccuuuuauucuagguauuuugacagacaggauacacuuguggugccugccugggauaaagaggaaauucaguaccagugcaggcaaguuagagagacuugucucaaaaugaaaaacaaaaccaaaaacaaacaaauagagcacgaaagguacaaacaugaaaacaaaaauaugacaaggcuggagauaaggcucagucaguaccucauucuugccuagcgugcauagcuucacaggcuuaauucccaguaacacacacaaaauagcaugccauaaugaacaagaaccaucaacaggaggcuagacucuagggauacucugaugagaugagaaccaguaguagagauggccacugauguccuuccucugccuaaugucuuuuccuuccauuucuccccauucuuuuuauuuuauuuuauuuauuauuauuauuauuuauuucuccccauuccugccucucuccucuaccaccuaacuaaaaauuguggaaagguugagacugagucaauauugagaggcauuagggaugaagugcacauguaaucuaucaaguacuugguuaaaaaaaaacagggacaacuuucaggaugaugacauggcuuaaauaagaugaacaguuugcuuaguguaacauucaguucuuguuagccacugcuucuucauuauuaauuuuauuacuauuauccuguuguguccuucagagcuauuuuuguguuuaguuauuuaucaguaggucuuggaguaaaauaggaaucucaguguuguagugggaaguaaauggaguauauagucuauuguguccuacuaugguagccauuauuuuuagccgcuuccauggaaagaauguuuuacaauuaaugauagaaauaauuccuugcuauggguagcagcaaaaaguaguugcuguguauaugguaagagugucuagaagucauagaagucagcauaguaacagaaugcauguucccauggacccaugguauuccaagugugcucucugaaauagaaacagcaguuuuuccuggaaaccuagaaaugaaaauuuggggguccuuccaguaaccuacuauaucagaaugagauuaggacuccacaaucuggauuuuacgaagacauucagaugagucucuaaacugaagugugagguccaugaucuggagguuuaagaacugucauaaaccuuaguucugugugagacacuuauuuuucacagagauguuauuuacauagcuuuuuaucuaaccuaauuaguucauguuucaugcacaaauuuauauaauacccugcucuuuuuuaaauaaucaauuuuguuuuuuuuaaaacaaaguauaauauaaaaacuaccauuaaacugaugugaguucaugucagcuuugcucacauugaguuaaauggccuccugguguccuccauccccucuggcucuuacacucuuucugccucuccuuuguggguucccugaccacugaggggaaggauuugauggagacaucucauuuagagcuuuguguuccaagaucucugucucucugccucuuuguguguguuuguauguguauguguguguuugcagguacccucagaggccagaugugucagaucgccccugagcuagagguacaggugguugguuaccugcuguggauucuggaaaccaaacucagguccuauguaagaacaguacaugcucuuaagcacagagucaucucuguaugaaguugcaguucagagaguccucuggaaaaaaaucugauuuuuuuuuuguuucucuuuuuaauguucugauuuguaucuuugguaaaaaaauaauuuaaguuaaauuauaucuucuuauuguacauaauaagccauaaugauuguuuuaugcaaaaaagugcacacuuuucuggcauccuaaaaagggagcaguaacacuggaauuggggggauuagguuuuaagaaaucuguacauucaaaacguucuguaguaaaugccuuugucaccaugaaaaaguacaucuuuauuuuauuuuauuuuauuuuauguacaagaauuaccccccccccccaauucuaucauuucagcauagcacaaucaaggacagauauggguuuggaaaauggacuguuauuuggaaaaacuuauauaaacucagaaguuucuuaauugaugucaaaggucuauuuuugaggacccuaugguauguccugauuucuuugaaucuaaauacaguaaauuuauccaggugggcaauugguacaugccuagaauccuaacacuggggaggaugaaguagagaguugaaagcuagccuggaguaugcauacugucagaacaacuggauugguaauucugauacgugaucugcacaaauuuuaccucccucugucucaguuucuacucuguagaggcaaugguguuuacaggguuacugcagggauuguuuuacuauuuguaaacuguuuugaacagugauaggcauauagcaagcacccaguuugaauuguacuauuuacuacuauagaacuuuugacugauuucuuccucaaguucuuuuucuaguucucauuuuggaaaaagaaagcuucuacaagugacccuauucccaucaaaacaucauccaaauaucagagagguuaaagauaaauaugggucaaauuaaaguuauuaaagauaaauaauggcauauauacugggaacaauaaugaguuugagaucagaccacaucucacaaagagacccucuuuuaaaacaaaauagauaagcauaacauuuuuuuuuuuuuugguuuuucgagacaggguuucucuguauagcccuggcuguccuggaccucacuuuguagaccaggcuggccucgaacucagaaaucugccugccucugccucccgagugcugggauuaaaggcgugugccaccacgcccggccugcauaacauuuuuaaaaaaaaaaaaucaaugauuuaguuaccuacucagugaaauuaacaaauauuuauugagcaauuacuuuuugcccaagaacuaaauuacauccaugaguaaaucugaccuacauucuaccuucuuacaaugaggucuugugggagaagcaggcauagaagaaauagaucaucacagaaaugcauaguauauacaauuagaaauuaugauuauuguugcuaaggaaaauugauuugccaaacaugugaguguggaagaacauucugccaagauuugugaacuuuggcucacaaagcagugucuuuaucagguggcaaaugcugguugaagagaugccauuauggagaaaaccauugguuauuucugcaggccuuucuuguagcacauacuuagcaacaauuagguuuugucuugagacagauucuuugagaaauuucugacuuggauuguucaaucauaacugcacuucaagauggcaaauguugucaggaaaaccaauuagagguuaaaaauuuauaucugcuuguucuauguauacguacagugaaaacauuaaagucacuacaacaauaauguauguccaacucauauuuucuauuuuccaauucuaaaaguaauucaugaucauuauaaaaaauuaguuuaaauaaaguagauaaaauuucagauaauucuguaaguaguucuuuuuaaugcuacauguuauuucuguuacaaaaaaugugugugugaacaaauuuaaugacaccguacuuuugugucuuacuguucaacucaauauuacauaauauuuuauguagccauggcuguauuguauugauaaaguuaauuuacuuucauuuuccucucucccuuccuuuccuucuuuuuagcaguucuggggggauuggacccaggacuuggcuucucaaaauuaagcaagccuauucucacuggaguauauuacuauucguauuuuuacuuugagacaggaccuugcuuagcagccaagacuggacuccaauuuguguucuuuuugccucucagguaucuaugauuaugggcaugugccacucugcauagcuaauaagcauaaauucugaugucuguauauuauauccuuuaugcugcuauaauaguaucacuuauuggcuacauuuacaauaagaguguaugucucaauguucugaaacccaguacauauaagaucaaggaucuuguaguaucauauaaggacuguuuuuugcuuucaagaugguacuuuguugcugcccuuccagaagugugaguauuuucuucacauuggcagcggaaauggaaagagggcaaggggcaaagccucucccuuaugcccuuguauaagaguacucauagcuuucucaaggccccucccucuuaauaccaucaccuugggaauuaagguugaaauauaugaacuuggagagacugcacacaaaaucugacuaguaguguauuuguuauaauugcauucugcaauuuagcuacuuaauaucuuauuguugagcugaaucucuucccauucuauuuaaguguaaagugaccuuccuuuguccuuauuuccguuuuuccguuaauagacuuacgucuugcacuuaauuaccuaguaaacuaauaugcuaaagcaucuugguuucugugagauggcuuuguugauuugggagucuauaauuugucauaacuagcugagauagcagagagcaaagaguguggaaaugauguuacagaaguagauugagccacaaggaaugagaaagagaagaaggugaggcauuucaaugaccauaaauggaaaaaguagucuugacuguauuucuccagaguugagucucaggaccaauaagguguaauugaguccaaugcagauacagcuugugagucccuuguccaagugcuuggaaauagaaguguuuuagguugcaggguuuuuucccucagaucuuggaauaguuauaaauugauuauauaaguaauauuuccugggauauagguuucaugcuuaaacauaaaacauauuuuuguuucauaccuauagaaauaaagggugauuuauauauaauauugaaugaaaauguacuuuuugcauuuauauucauucaaggcauggguaugugugugcaugugugcacauauguggaaguaggagaacccauuguguagaguccguuuugucuuuucaucauguaugugaauucugggucucaaacucaguucaucagauuggucagucaacauaccucacuagccuaguguaacuguauuuuaaguacaauacuaugagagcagauaagagauauuucuacuuguacuaucuaaggacucaaaaaauguaucagaauucggagccuuuuagaguucuggguuaggguuccucaacuuguaauagcaaaauguacucuguaccaaguacauguauugauauaucguuauaauaacuucuugguguccuuuuguccucuuggcagcauauauauguauauauauguauauauauauacauauauauauauauauacauauauauacauacauauacauauauauauauauauauauauauauauauauaugcauuucucauuuuacaaacaaugaaaccaaggcccagguagcuuuuauaaguugucugaugccaugcagcuacuaagugauaauagcagcauuaacaugcaagacaccuagcucuuauuuuuauuuauuacacuguuucagcuuucacuggguauuugccacgguauaggcgcuacacucaaaaauggaaaacuugaagaaagugaccuaugaccacuaaacuccugcuaucaaggagcuaaucgucaaaggaguaugauugcaccaaaaagaucaguuuaauaagaugaagugagcccuaugagagagguaugcaucaugauguaagagccagaagaaagccuuuuaguacaaaguggggguucaagaaauaagggcagguggcuuucccuaaguuccacauugaaaaugccgcgcccuauuacccagucugccauggcucuaggagaaacagacaaguuugauuuuuauuuguagagcaggguauuaaaauccuccucuaaaucaagaugucucuccaauaagugaauuguuggacuggaagaguuagcuucacacuguuuugcugaagaucaauuaugucugaguuacuuucaggagcuacgacaguaucuguagcaucguuuacuuauuagucuuuaaaugaacuuacuuuaauaaaaauaaauuucuaugaaaacagcauaacugaaaauggaaaaccaguuuuauuuucuguaaauagaagguaaccaucaaaauaaacacacaguaugggaaaguauuuaucugugugccacccaaaaugaugcuuuauggcaguauuggcauacauaccacacagugaaaaauagcaaaauaacaucaucaggccucaacauucuguaacuggggugaguaacucuugugaggauuugugucucccacauuuuauuuucagcaucacugugcauauuuccuuuacuuggccacacagcucugaccauuucaguuguguguuucacccauguaaacagguguauccccguggcauacuaauuagacucaaaccauuuaucucaucguaggcagugaauugcugcugcuaaucugcuugccauacucauuuacauucauugcuguacugacuugagagaguaaugcccugucgucccucccugucaggcugcuuuaacuguaucugucuuauugacuugagggaucuacuacaauucaaggcucuuuggugaaacagaacuaaagaacuauaggauaaagcuucaguacuuuuaguagccuguguuaagaaagauucuaagaacucaccauagguguaaccccaaucagguguuccauuuuacuuucuaaaguagcaauagacuuaccucgggguacagauuaauuucuuguuugggauacaauggcaagcaggccauauccuuugauagggauaugauaacugcuuauugugacuuuggggaccuaguacuccuggauuagcucagugauuaagggauuccuaucccauuuaaggauaauaauuuguagguaauuucauauguuuauauguuuaauaugaaagcaagaauccaaaucuuauacugacucuggaaaauacauucuagggaaaaggccaaggauauuaccccuuuccugcaggugaggcugaggcucccaguuuuucugguuugacuugguugcugacuauaaaggaaggcucuuccuucuuccaacuuaugggugugguaacuucuguagucugaguaguaugaaaauccaugggagcccaacacacaggagccuaacauagcaccgcaccaccacuacuagcaccacagcuaaucaagcuuuuuacucauaaaguuaguagccuaaggcacaacuaaauuuauagcaguuuguaggccugcuagagcuugcaugggaugguauuauccuuagaggauuuuaaauucuggccauagguucugggcuuacuggacauucuuaaggugaauuuaaaccucuggaugucuuagagcaaacuauuugguuucuguuuuuguacaucagugugcuuauguauauaaggguaguaaauacaaagacuauggguuguugcuucaacuucugcagccagaaaggagacucaaaguucagagguuccauuguuaagaagacuaccacuaguuaaccuuugagagcuucuuucaugccaaggacugugcuuuguaggccuuaaucucaccggagcugagguaggauuuuuagggacugauugcugauaagacuauggagauaguaagagaaaaacacuuugguuccguccauucugggaaagaagcccugaaguuuaacaucgauagucacggcaacagccuccucgguguguuauuuaaucuuuucugacaguucugggaaguaaggacuaacagaaucucuguaaaagaaacccauauggaaacuggugcuuugagauguggagagcuuuugcucagugucuuggagcuuauaaaccaagcuucuuuuuccaggucuucucuucuuagcuaaauagauaucccucuuccaaaguccuuugccaccaguaaucuuaguuguuacucucugauacucaggaggaacucaaggcugguucaacauuagcagagaggcaaaagaucucccuuuaacugagcuugcaggggacuguacccccuggggaacuacaaagggaaaacaaaaagaagggaguggagacacucuuguauuguuuugggugauagucuuguugucucaggagcaauaauaacuagaggaggcaaauuuuucuguuuauuucccuccuuggccccaggcugcucuauccuuuuggcccccuccuuuuccuccccuguccuguccccauccuuaucucucuucucuucucuucucuucucuucucuucucuucucuucucuucucuucucuucucuucucuucucuucucuucucuucucuucucuucucuucucuucucuuccgagagacaggguuucucuguguagcccuggccguccuggaacucacucuguagaccaggcuggccucgaacucaaaaauccaccugacucugucucccaagugcugggauuaauggcgugcgcugccgcaccaccaccaggcacucaucacucucuuuucccccuucuccuuagcuacaggucuuaaaguauuuuaaauuuguuguuguuuuuucugcugggagcaguaggggugguggugaugaaggccucuuccugaggcuuuuccucugcuucucccccuugcccuccuucugggcuccacccccauaguuuguuagcuggccuucucaagaaggaagggaagcaggagaaugagaaggaagaagggcacuacagagagcaacaucuugugagacccaggugucugcaggcuucuuggcuauaguccuuaaguccaguauguaauuuaacccucuuccuuauacauguacaggagagcucaagaugcccaguuccccuuuugcuucaggugaaaagggagaaguugaagauacugcggguugcuauuugauuuauuucuuaagccccuuaagagaaggggagcccguggugcuuccuaaaacgaagaacccuaguuaauucuugauguuugcucucucacaacauuccaucugacacaaaggguacaccuagccuagauaaaaguguauuguugcucaguguguuucaucgacuaaauggauggaaaaagggacaggaaagauacuugaguguauguauccaagguuuaauaauuuacuuuguuuuuucccaaaaucagaauuugcccauccaguacaguuuucuauacaaaugcaguugaggcagacaaaaucugggauguaaaauaaauuaggucuccagaaaaacuuuuagcgagaguauaaauuguuuggcuaucuucagguggauugacacaucuucuugaaccugcauagauuaaacaaagaauuuaccaugacaaaaggguacgcccagcuuagauaaagaguucuaguggcuauuaauggcaguauuacagaagucuacccaucuuuguuuuucacaucacaaaaguguauuugucuugaacauaaacaguuuuacauccuugaaucuaaaacuuucugucauuacugaagauagccuugggcuagugaaauauccuuuucuuaaaagcaauauuuauuagauuuuauauauuaagaacauaaggauacaagguauaaugugacccuuuuuaaaaacgaauauauagaguuguacauuauguggcucccucuuaauaagucuuaccuuguaauugcagcagguguguacgcagugguagaaauaugguauagagagauagugaggcauuuguaaaaaccccuauaacaggggcauucuuuuacguagcaaguauacauaucugcuguuuaaucuuugucccuugauuucuauguaugaaaacgauagcgcugguaccuaccuauaccacugucagaacgauucagugaggcucagaacagaguucagcacuuaguuacugcucuguaacgaugaaugauaauaauacucagcaucuacauugcagaccuacugacaccugauaccuaaccaggacuuuauaguuuaauaaugagaagcaguuauaacaacacauagguaccuggaggugcugaagcaaauggucaguucuuccaaacguaaugaaauuaggagagggggugaccuuuacuugguccuuuuaaaaaggugaacagaguuuaggccacgucaacaaaaaagguaaggugucucguggccuagagauuaauugagaaaauccuggucuuaucagaaauuuggaguccaguagagcagcaaaaccccugcugcuugagauaaagguaggguccagaucaucacaacagguuaaaggacuugaacauuugcauaguuggugaacuacuaguagagaacugacuggggagggaaggaaaaggagauuuuuaaaacauaucugagcagaaauagcaauuaagcaaauggacaaacaugcugggcacauacugagcugugacccucagguuuguuguuugguuuuuuuuuuuuuacucuuuuucuuuugaggcugggugugacauugcauuccuguaaacucagaaccaaggaggcugaggcaggugaguggugaguuugaggacagucuaagcugcauuagccugagcucuaucauaagauuaccuccuauuucaaacaaacaaaaaaacaacaagaagaaacauaagcuggggauccaacugagugauagaaugcuugcuuagaauacacuaggccccgaauucaaucuacauuacucccugaugggacauaaaaauauagugcuaccugcugucuaggguuguuaugaggaauaaaggaaaauugaggacuauaaugguaccuggccuagugaacugcccauaugaggugcugaagacauggaaccuauuauuucuuuugcuuggcugcuccuucuguuccuccgcuuuguuucuccucucucucucucucucucucucucucucucucagaauugugguagggaagaggcacuggaaggaggcugugguugucugugacuuccuggguuuccauuaaaaugaacuagagacagacuuuaaggcaaggacaaggaaaugcuggaaagaugguggcuucuauucuacggacccaguucuucggggauguuagccaaugcuuagcugagaggcggucucaggggguugagaacucuauucuuagagagcugggagacucagaaagccuuccuguugccaauccgugaucauuucaucuuuaccuaguuuccucucaccuccuauugcuagaaaauucacccagcucuucuuuccucuuaagcuucaucccuaaaaagacacugugaccccucugucuuugcuagugucacauguugccauggagaacugggaggguuaaaaaaauccauuuacuguuaccaucuuacuggcacuccccauucugcuucccuuucucccuagaaaucucuuacucccaaucaccacacccuucccaaccucccuuggagugcuuaagucuggguggauaguugaccaaguagugugccugaaaaccccugcuggggacuaaggaugcaccgaaaaggcuuucagucauaccugcagcugcaggaggccaacugagacggccgccaggggcgagacuggcuccuggcuccuagggcccgccccacccccuccucugucccuccgccucuucugccccacccaucucuacccccuccuacuccacuccccucuagcggccacuugucccuuuuaaggaacuccacccuagguggaguccucauagucgcaccucucuucugggccuagucugacacagaaagagcuauguacuccaucugcucagauugccuggggagagcaccaggcuuugacccgcgggugcgguauaccaguggggcggccagguaccaccgagaagucucucaggcgcgguccugcgggagugccucccacucgcguuggagucccugcccugggccgguguuuuccuauauguuucgaccaaucguuggcgucuuuuccuccuuucuuuuuaggaaggcgccgggugugcagcacuaaccgcugcgaggaggggauccucuggcgcugucuccuugugggucuucacugacucccccucucucucucucaacuuugcguucaagucgugaucuaagguuugggugcuuugcugggaccccgcccgugcucucuaggcgaggguuugaggaguucugagguggguggagaaugggcuuggccggaacugaaucgguugagguaaaaggggaacgcaggagcuucagcgcuggccacuucgccccggagaagccgcuguauuuuuagcacagggaaggcugcagugggaggauucuuuuuaggaagucggcuccaccgccccgauucggggcuuggaugcuugaaagcuuuguuucccuuguucugaggguggcccagcugggucuaaaucgacucccucccuuuuucguuuucccuauccuuuuccagccuggagaaaacagggaggugggggaccaaggaagagaaggcuaaagcguguuaccaggcgcgcugucagacaugggcgggugcaaggggaacagcugccuugagaucagcucuggaguaugagucucugagaggacugcgugagcuccggacacuucaggagucggcagcggcuggaggcauaggcgguaagugacuugggaaaggaccacucuuucagucuucagucaggguucuaauccccgcaccccgcgugccaaccgcacacacccacuuggcuuuggguuuuagcagugaagugggaugggggagacgaguaagcggaaggggguaagaacauuauguggaaucaaauucaacucaauggaaaaagacuucccuuaaggaucgcggagacuaagaggaaggguacuucagggggggcuuguggaagaauugaaaagggacacgaauggauagguaugucuaguucagucuguccugucuaggugcucucaacccuccuuaagugguacgguuuguuuuaacccuguacaugcaaagucucugugcgagagaagaggauuuggaggagcacugaacccacuuacgucacccccucccuucccccaagcaguagcagguaccuagagaugcuucuaaaacgagggaggaggggaagggaagaguuaaguugggagccugcccucuagguacugauagcagaucccuucuguggaggagcugcuuaggacaugccccucuuuaagggggggggucguccccuugguugggggaggaagccaaagcauagcccugucuaggcucuuaaggauguggccaagggguuagcuccuguagguggaagaucagccagaauugcugugacuacuggagcaaagggacuugcuuagccacaaagugaagcuuuuuguacuuuuuuugacccuaagaauuuuguagaaacuaaaccaugucguaacagguggccaggggaacaguaccuuauuuucucuauauuguaauugcgggaaaaauuuauaaaguacuuguaugucauuuagcauaauagugauggagaaaagagaaaaagagacucaucucuagacuuggauuuaaccugaagaugguuugugauaauaaaaagaucuacuuugaaacccuucuaccagcaugaacuaguuauaugaccaugcaccgugcuuuucuccucugagggaugcauauuaaaauucuuauucagaagguauauaugauacaggcugcuccaacucgccguucuucauguuuucuuacucugggguuuucucuggcucacugcugauagacuucguacuucauuguccuuaaagcacauuucagaugaaggggaaagaaggccugugcaguuugaaucgcuugcucaaagacaggcuagaauauaugccuuauuuguuugugauuuaacauuguucucccuggcugcaagagaaaaggccacuaaucugucuaucuucugauucuuugguugguuuaaccacgaugauguaaccagcaagaccuuugaacagcaaaccaguggcucacaagugacuucguccucuucuucaaagucuggggggaacccuuaugagagagaccauccuuggaaacuguuggugagacaggcuaggcacagugccuuuagguuagcuuagaggacagauaggcaaaggaugcaggaaggguggaaauccaacuucaaauguguaagugauaaauauaacuacccagccuguccucaagaccaaauugcauaaaagcucugcgcucauagaaagaacccucuugcuuucagagcauacaggauaaaaaaaaauuggugggaaaaaauguucagggcagccacccucauuuuuguaguguguguauuucagagaugaggcucuuagugguuccugcugguugcuuuuuuguuuuguuuuguuuuguuuuguuuuugaaauuuccaggguaugaagccuagcuauuauuagucuucagggugccuguuucucaugugaaggaggugggucuugacgacucauccguuucgacucugccaggggcuuauuaauguuuguuacauuuagauguuuucuuuauucucauauuuuauuauuauuauuuacguguuuuuuuguacgcauauaaaguaaaugcugcaugugugaagaagcuagaauuauggguaauugugagcugcccaacauggaugcugggaauagaaccuggguccucuggaagagcaaaaagugcucuuaaccuguagcuaucacuccagcccugugcauuuauuuauauguuugccuuaguuuggagucaguuguacuuuaugggcucacuuaaauuguugaaugaaggaaaaaugccuucuuaauacagaauucauuuagcaaaauggcauacuggauguuagguacugaggggaaaaggugucuccccacgcccucccccccaguagacauugaaaccaggagcugguguauuauuggaguuuuuaaaaauggcaacaggguguaguagaacuggccuugaacucucucaauucuccucucucaaccuccugagugcuccaguuaucaucagcaugaacuguuauaacuacugagaaguuuuaaagcuugcuuucuguuugaauucuuuucuuuauccuccaaccagauuuguauucuuauuuaaguccugcugaugucccuguccuccacagaucuuccuuaucuccucagcuauuaucagauugucuucauauguucuauaagacaaauaaacugucuuauaauaugcuuguuuuuauguguguccugauaaguauuuauagcauuccauccaucucucauuccuaccuaaaaugcguuacuaugaaaacuuuauuuucuuuugcaucuguaaauauuaguuugaagaacuacaugauuguuccugaauuuucuaggaccuugaucauugccugcugcauuuuggcuuaguuguguuuauaacuaagcccccaguccccuuugagacucagagcuaguugaugacgcuccauaccauugcggcuucauaccacuuaccuuucccuuacauccuuuccuuugcaaacacuugguacauauuuugugagaugaugaucuaaggucuuacuccuuguuuaguuuuucagugcagcccuugcuguccuggaacuugcuuuauagacccgggcugguuucagaacucacagauuugacugccucugagucuggaguccugggcuuaaaagcauucgcuaccacugguccuguauaaggucuuacucuaacuaaacugcuuuuugguaagugaaaagaaacugaucaguguaguugaccuaauugaucagcuguucaguuuucuuuuuagcuuacauauggauaucauuuguuucaauuuuauaaguagaaguuagauuucugaucuguuuaugaaccauaauuuaacuuuauccccuagccucguuccuaauuucaaaaaugauaugguacauuauaguuauaaauaauauauugaaaugaaggauuuuacugguuuugcaauuuugaguguguuguuuacuuuuuuuuuuuaacagcaaguauuaacagguuucuuuuuuuuuuuaagauuuauuuauuuauuauauguaaguacacugcagcugucuucagacacuccagaagagggagucagaucucguuacggaugguugugagccaccaugugguugcugggauuugaacuccugaccuucggaagagcagucgggugcucuuacccacugagccaucucaccagcccguguuguuuacuuuuuaacgucauuguguaucugaaggggaaaaauguaaauuauuggucuggaaguuaguuauaaaucucuagaacgugcuacaugcucuguaucauauacuaaaaauguuaacuguguauuuagauuuuuuaaaguacaauguggauuuuuuuuuuggcugugcuaggaaugaaauuuaagggucuuguauaugccagaaguauuuugccgaugaacuacaucccuagccuaugagaguuugaagguacaaucguguaacucuaguacuugcuaagauauuucaaacaugccuucugauagggguagcggcaugccauuaaucccaaaacuccaccagaggcacaggcaggcagaucuuugaguucuaggauaaucaguucuccacagaaaaacccugucucaaaaacaaacaacaaaaccacucacauuuugacauuuuguuuuaaccaccagcuuaccauuucugaaauagaaccuauuuuuuuuuuaccacuagacuuaccauggcucauucaacacuuuuccccuuuucauuuccuuguuucuacaacuugccauuaugauaaccuuggcgaaguuacuuaaacuaugcaugugaguguucucugugaaccagagaugguaguacaaacuacuuccguggcauugaggaacauaauugcuuuaaucuuaugaaaacacuuucagaauuuaugaaaguauaguaagcagugaaaaaaaauguaguuuuaguuguguuucucauaucuuaugaacaauauacagccuuaucugucuuucauuauucucaaaauugccacaaccuuaauuuaggccagaggcuuaaauaauuaccuuauauaccaguuacaacucacauaaauguuuuauuuuuccuaaaaauuuuaaaugcucauugaacagauuauuuauuuuauuuuauuuuauuuuuuuuuaauuuuuuuuuuuaagauuuauuuauuauuauauguaaguacacuguagcugucuucagacacaccagaagagggagucagauuuucuuacggaugguugugagccaccaugugguugcugggauuugaacucuggaccuucggaagagcagucgggugcucuuacccacugagccaucucaccagcccuuauuuuauuuucuuaauggacguauuuuaaauugguaauguuccguaugguccaagaccugauguauaaacaaaaggcuauauggugaaaauucuuccucuuguucauggccauuuguuacuucuucuuccucaccagaggcaacuaaaauuacuaguuuuuaugauucuuuguggagauauuugagguauagcaaauaauuaauacacauguauauauuauucaacauuuuuauucuuuuuuauuuuuuaaucugaaguccuuuuuaaaauuuuuuguuuuuauacauuuuaauuaaaauauaaucauaucagcuuuuuugccuuucuguacaugcuuauuugccuuuuuaacccauuaauuuuuuaaaauuuauuuuugagaguguaauugaauuauaucucuuccuuuuuacacacaaauacuaacacauccugcaguauuguucuacuguuuguucuuccuacuuaaaaaucuacuugggagauacuuccccauagguucacaacaaugccucguuauucuuuucgacuguauagguuuuaacuagaucguuaaggcuuuauugagccaguuuucuauugaucaacauuuaggauauuugaaauuucuguagugugucuaauaggaaugaaaacucuuauguaguauauauaaggcuguuauaaugaaaucucacuaacugggugcuuuaaacaacagaaguucugguuuuuuaguugcaggggcuagaauuuagggaucagggucucagcauagccauauauauguacugcgauggcugcuuuccuaccucacauugcuguauucuuggcugucuauuuuguguaagugaagagauggagaagccuccuguguuucuucuuacgggauuucucuuuugugauuagcgugcuaccuagaugaccucauuuacuuugaauuauuuccauaaaggccauauaucuauaaacaagucaccucaggagugacagcuuccacauacaaauugggggcaggggggcaucaacccacuuugucuaaucucaugauccuaaaaauuggccaguugccaacauuuuaaaguuggauuucauuuaaagucuagauuccauuuucuccaauaauuauuagaugaaagaauaugguaagguuuuauacaauauugcagaucguggcgcacgccuuuaaucccagcacuugggaggcagaggcaggcagauuucugaguucgaggccagccuggucuacaaagugaguuccaggacagccagggcuauacagagaaacccugucuagaaaacccaaccccccccucaaaaaaaaucaaaaccccacaauauuacagaucaaugagucuuugcagcuguggcguuucauucuuuuucucaacuggaacuuaacugcugugugccaguugcauucacugcacauuuugucuuaugauucauaccacaauuagugggcaccuuuacccucuuuaucaauaaccgagcuuauugugagguacgaaaguaccucuauuaucguuuucaacuuuaccaaacuauuccagagugcagggcuguaucuuuuucaucuaaaaaaauuauuuuugagaauuuuauacagguuuauaguagaauaugaucauauccaccucucauuuuccuacuuccaauuugccuccaucuguuacccacucaacuucauuuuuuccuuuuccuuuuuaaaaaaccaacucucuaaggcuaaggaacggcuacuacccauuugugcaugcauguggagccaucuacuggagggagcaugugcaaccuacugauggccacacccacaaagaaugcucagccucagcaacuguagcuucugacaggccgagccuugugggcuucuccauucacacuggacguucuagcaggucaugagugggauaacuagaucauguuuagaagaaaguauucaaauauguucggguacaucaaaccuggacucagaucccagcccgacgaccauuucuaucuuacauggcuuuagcauugcuugaucucucugacugacccuguacuccuuuguguguauacggcaucaacaguaguacguguuuuauucuuguauaaaagaaaauggggccuagagccaccaugagaaagaggagaggacaaaauggacgaaaccccucgaggcuaugcuacuggccaccuacaugacuggaacuuguugaagugacacugcagaacuucaaccucugggauuguuaagaugaacugauaaaaaaauaaugauaggugucgugcuaguaacugguuuggauuuuuacaaggcgacuauacuuuuguaccuuuugugauuuuuauuuuuuucuucugacggaaguacacagauuaaaggaguaauccuuaaaacuuaccuggagauuuuuauaauugcuuugugcaaauuccaugugucauuaugauauaucuucuugacaaccauaugugggguagguuaaacucacauaucuguauuuuguacagaagaagauccagguguauagaaagggucaacgagucucccaaagucacauucauugucucuucauuucuuuucacaaugcuucacuacuugaaauguaggaagcuaccauauguuagcaaucucauuuuccacacuaacauucacccaugauauauaucgucagcuucacuauuugucagaagagagaacggaaugauaucuacucaagauucucuugaacaauuagguuguuaucuuaaaauuaauauccuuuuaugaaacauuuuucuuuuuuaaaaagaagguaucauuagauuugggguaucauaaaguaauaaaguauauuguaauuggacucaaaggacaaaaguucuauuaauucaguccuccuaaacucugugagcucaggccuccaaguucauuaucugugcaauguaauggaaauuauaugaaguuguuccuuuaccuauuguaauguuauauaggugcauaugugauucuuuccauuguccaaaugcucuauccuccuaaggaacuagguucuuauuaagccugccagugucagugaucaguggucacagugcaccuggucucauuauguuguccugacugacccagacuuuuuuguguagaccaggcuagccucaaacucauagagauccaguucccuaaagccugcaccaccaugccuggcccaguugaggcauucucaaaugucagauagccucuguaugcccuucgacuaaaaaaauuguaauagacagggcaaguaagacuugacuggcuuuuuaaauuuaccauuagaacuuuuaaaggugggcauggccuuuaaauuuugaagaugaaguucuguguaugccucuaccugcauuccacucugcuaaaugggagggguacagagaggagcaugacuagggaauagggaaaaucugugcuagguguugguaaauaaacacuuguauacuuauuuacuuaagaaauccuacaauaaucuaugugcugguuauuguuacaaggaguucagaaaccagaaacucuugccccauuuuuuuuuuuuuuuuacuauuacagaauuuugagcugguaaugguggcacuuguuaauaauccaaacacuucagaagcuaaggcagggggugguguuaugaguucugggauaaccugggcuacagcacacugagagccuguccaaaacaagaugcaguaugaagagggugguuugaauauuugcagccaagauacagcaacacaaaacagaaaaaaaaaaagaauuuaaaaucaauuauuuuaucuauugaaagucaagaacugaagaaaccauuccuaguugaaaaagccguaauucucaaggacacuucuuuacaaaauuaaaggaagaauuuagagaauuuugacaguugaaaccaauuguuuccaguuucauuugaaaauucagaggcuauacuaggcaaaauacuaccaguuuagacucugguugagucaagcauauauauauauauauauauauauauauauauguauauguauauguauauguauauguauauguauauguauauguauauguauauguauauauauauaggcacaaagaaaacgcagcagagaguauugauuuuagaguuagaugcucaugagucacauuguauaacuggaaaaaguguuuuucuuuguccaacucaacuuguccaucuagaauuauaggauuuuacauuaucauuugcagagcccuacugcuucuauagagccucccagggauagggccauggaggaaaauacauacuaaggaauaagaacaguuagggccagaugaaagagaacuuugacaucuaccugaauuuaagcgcuuaccccugcaugucuucuaaggcccgagaacauugucugaaauuaugguagauauucaacaaauuuuugaauguuuaucaggguaguuacaaaaaacgcaaggagucaggugugguauuuaccugcacuuggguggguaaggcaggaggauugcuuguguuugagaccaggcugugguacaggcaaguuccaggcaguguaaaacauuaucuugaucucacagaaagaaagggggaguaaagaagggaggggggcuuuuuuugaaauuaagaacaagaauugggaaaauguacggaaccaugagaaaaaauugaagagguuauguaugaaacacacaaguggcgucguuaacaugaagugagacguguuacaaggaauagcuguuuccaauuccuaaguugggaaaggaggugaguugggaaaggaggugagauggcaggggaaaaaaaaaaucccuguucggucagacaauucucuuauaauccagaggggggcgcucaauagcuagaagagcuugauuguugccaggaaaaccuguaggagugucacaaaguuuauuuccuuugcagucauacuguccuugacaaaucguuauucuagugaggacaaauuacaagucaucuacugucuggucuucgguuccuaaggguuaaaaccaggcaggguagaggaagcauaaaugaaaucugaaguccgacuaguuaguuuguagguaaacuguagauuuggguuuguaucccuaaccucuuuucgucucugcugaaauugaacugugauaaacaaaaccuguugcagaggaaaacauagguacuuuuuaugaggugauucaaaauauuugaaugaagcuacuagugccaucucuuuguaagaggggcagcuauuuauagaggaaggugaaaacugauuuuaacuaugcuuagcuuauagauuuaagauguguagacaaaaguggucuguugguuggcuuuguacauauacugcucuggucgauauccauacagcacuuuaaaaguccuuagcaaaaaacaagaacuggaccagaaauggaaagguuuuaaaaccauagaacuauuuugauaauuaccauaauuggacaggucagaguggcuggauucacuuagaugaaggaagggaaggacuuauauauaggaaguaggcaacuagagucugagacaaaugaugaucuuuucuaugaguagaucaacucagaauguuuuaaugacuuucuaguauaaaguuugucugaaaagcuguucauagaggacauaagguaaaacgaaguguacaugucauacucuaugccuauauuggguucaauauuuuaaaaacuauuuuccccuuguaucuuuucuagauauggauaaauucauagacaacauggauguccgaauuaaaucagaaagugguucgaugcagguauucaaacaggugagcuuuguguguuggauauccaucucuuagacauuagagaacugaagcuccauuuucaaaugacauggauaggaaaugagaagggauaaaggaagguagauuuucccagaaugauuugaaugucugguugugaguuccaacuaaggggucugccuaaccuugaagaaacagcuucauaauguuccuacagucuuuagugaagagccaucaccauuuauuuagcacugucccauauuuuugguauggugaaaauugugugcuuuguuuuauuuaauguuguugguagccuugcugaacagcguauuagguucucucuaaggaaacauccucuugacccuauuuccuuguuaauuguuuuccuggagaacccuggcuaguacacuacuuuuggugaguggugaguagugugugguguggugugugugugugugugugucuguguguguguauguauauauggguuauagacuugugccaccacguuuguuuuuauaugugguggcacaagucuauaaucccuacaauaagcagauugagccaggaaaauggguauuucuagcccacccugggcuacuaaggagauccuguccaaaacaaaauagacagaccgacaaaacagaaggaacaaagcaauuccaacuuucaaugugaaaacuggucuugguguccuaguuugcuucuucugugcugugauaaacagcaugaccaaaaaagcuacuuucggaggaaaggguuuauuuguuuauaguucacaaucaaagaagaucaagggaggaauuugaaggcaggaauccgaggccacugagaaaacacuacuugcuucuuuucccuugcuuugcuuauaacccaggccucaccuggccccucccaaaucaaucauuaagaaaugcucccacuaacugcucacagggcagucugguggggagaauuucucaguuggaauuucaucuucccagguaugucugugaggcuuagucuuuguuuuaugaaggucuuuaauuauugauugaagccucugcacuuuaugugacuggcuaauuccaacagugauguaaaguacuugcuuuauugagggguaaaaagaagcugguugugguaucccacgccuuaacagucaggagguagcagcaaucagaucucuaugaguucaaggccagccuagaccacauaucaagcaccauagugagacccugucucaaaaaaaaaaauugaaaacaucuagaaaaacguuuaaccagccaccugacacuauaguccugcuaaauugucacagaauauuaacuuaucacuagucucauuguucacguuuuacagaaaagaaaacugguuuuaaaugaugugaacaaguguuuguuuuugagauaggcucuuacuauuccauagaccaggcugggcuggaacuugcuguauaacuuugggcucauagcaaacccucaaacucauagcaaaccuccugccagacucuugaguucugggauuauaggcauuguaugaugccuguuuguucaggguugaguuauaaggcaucauauaaguaagccccagauacugucagaauuaccuugaaaaaucugucaaaauugcauguauauugaauauccaaauuuuuuuauauuguacucaccugauucuuuuggccuuaguagcaugcccauaauugacggauuuuuguuccuuaauuuaggagucauauaugccguguauguguguguguguguuauagacaugugcacauauguaccuuuuuguuuucuugagaucaauccucaguauauaacucuuguuggcuugguacucaguauguagaccagccuggccuugaauuuaggguaaacuuccugcuucuuccuaucaaguuuuggaauuacagguguauaucauaaugcccagcuaaugacuccuauuuuuaaucagugaaugauuggucuauggcauauaauuggaucuaaguuacguaugcauuuggaugagacuccuuguaauguuuuaaugauguuaaacugaauuuaauaccuuguuuaccuuuguauuugcugccaucuagaagcuauuaguacaucacaaacuugcuaguuguugcaaauuaucacuggagcuuggucauaguaauacagaauaauacuaaaagaaagcuuucuaacuuaggacauacauacugcugucuauuuuuuugauuucuguagucauaccuaauaaauggagcacuuggcugucauauucuuuuauuucuaauucugguuguuuucuugaaguggaaucucuuguuugaaacuugugucuuauugugucaugcauguuccuucccauauauguccuuugacugauaacauuuuaccuaucucucucucucucucucucucucucucucucucucucucucucacacacacacacacacacacacaccacauuuuacuuugaaaguaagcugcaucaagaaacuuugccccuuaauagcuggguaucaccugcaaauaaucacacuauccucuaaaacucuguaagaauugccacauccccaaaugaacaauauuuucauaaugauaucuuguauguauguaugcauacauacauacacacauacacacacaaacauuucagagauacuuucaauggcauauuuucuuaaacuucuuuuugucuaccaggacuguaacuaaguaagucuguccaauccuuaccauauuugggagcccagauuucaauucuauaucuucuauagaauuuucccugacagucuaaugcccaaaaauacuuaguacacucauacuccuggaauacuaauuuauuucuaucagucauucauguagucucacuccugguuuuguauugucaguggcagcauggaaauaucucauaucuuauuaacaaugcuuuccaucuccuaaacuucacauuuacuaucuucaguuguuauuaugucacauauaauuaacauuucucuugcuuuucuacuucuuuuuuaagauuuacuuuucuaauugaauguaaaugugugucuuuaugugacuaugugcauuugagugcaggugcccuuggaggccagaagcauuucauccccuuggagcugaaguaguuucagguaguugugagcuggccagauggcuaauaagauaacagagaucuauucuugaagaauccuagaaacagacaucucaaagaauguuguuccacuguccuggacuaucaaaauguacauguuagagaauaaguuccuucucuuuucacacaucugguagguguaggcauuccuuggcauguggcccuaucacucugcuaucugauuguguguucacaucaucuuauuuuguagucucuauaaagauacugaccacuaaaucccaccauuuagguauuccagaaugguugcuuuaagaucuauaauucugucuagugguggcacacaccuuuaauaaucccagcacuccagaguuagaggcagguggaucucuguaacaucaaggccagccugguacacagagugaguuccaggauagccagggcuacagagagacccugucuuaaaaaaauccauaauucuauaugcaaagauccuuuuccaaaauuggugauauucauugauucugggcacuaagauaugagcaaaucauuuuugggugaccauucuucagcuugguauaauguuacuuuucuaauacauaauacaagaauguaguuguuaaaauaauuuugaucauguaucauuuaaagcaaucauacacaaaaagaaauuauuugcuccuuuuuucuuuacuuucaguuucaagcuagauacuaauauuuccaugcugcauacaaagcaaauaccuagauuucaucuaugcauauauacauaugcauauuuuuauauucugugguuuugucuguuuucaugcucugggaaaggcucuuauaggucuaggcuagucuggaacugaauaucuuccagcuuuagccccuugaauucugggauuacagguguaugcauuucugaucuuguuuuuuuuucccccugugugcuuuuguuaguauucuagucucuuaaaauugucacauucauuaguguguauaaagaggaauuguccaauagcgcuuuauuuccuaauaccauugagaugauggggauguaagauucaaaauuccucuagguuuagauuaaauuuagccuuuuaauaauauucaucuccauccauuuuucucuuaauacugaaacacaucauggcauuauugaagaaggauuggaauuucggaggguaaaacugguuuuucgaccaaaauaauugaaugugcauaauauauguguacgcacacacaagugcacccaggcaugaaaaugauuagucuaaacccagagcaaagcuagaagagaccuguggacaaaaacagcuuuuaucuuucucuuggggaggagccuggguuuuaucuuguuaccaugacaacacuccuuccucuccuuucuacuuacugugcugccugcaguauuuuguucuuucauuuucuuucuugucuugccuuccugcuuuaaagccccacaucagagcuauuucaacuaacaguugguaacaguuugguuucccucacuugauuuuccuuacucuccugaagccaaggcugucuucaucagauguucaagagcuaauauuuaugaaagugaccacuuuuucugucuggauuucuuuguagaauugccuuuuuccaugaucucugguaauuugucaguaacgaacuuaagaaaaaugcagacucaaauacugguuuuuguuuguuuguuuguuuguuuguuuuuuauaaauggauuaggauccugggcauuuaaggaggacgauaggaaguaaaauaucuuuuacaccauucccaaguuucuggacuggccacacauagccagaaauacuggcaagcuguagcuacaagcguuaacaagacaacuggggaaaggcagcagccauucucucuuuggagagugguuaauuauugacuagaggacacucaaaaccugaaacuggaccacaggguugaagaaggaaaagcguauguuaacacagaaaaaucucauagagcuuuacauuaauuuuccugugggcuuucaaaucuguagucauuguauucagugaagaauagaauguggcacccauccuuagucauccuagugagucaccaaaauucuagggcuguaaacccaacuaggacaugcuauguagaacaagaaaauaacucagguagugcaugggguuuuuguuguuguuguuguuguuguuucuuuuuuuuuuaaauuauagugacuguuuuauacagaauauaggauaaauaguacugcauaucagguuucuuuuuuuaaaaaauauuuuuuauuacauauuuuccucaauuacauuuccaaugcuaucccaaaagucccccauacccccccccccacuucccuacccacccauucccauuuuuuuuggcccuggcguuccccuguaauggggcauauacaguuugcguguccaaugggccucucuuuccagugauggccgacuaggccaucuuuugauacauaugcagcuagagucaagagcuccgggguacugguuaguucauaauguuguuccaccuauaggguugcagaucccuuuagcuccuuggcuacuuucucuagcuccuccauugggagcccugugauccauccaacagcugacugugagcauccacuucuguguuuccuaggccccggcauagucucacaagagacagcuacaucuggguccuuucgauaaaaucuugcuaguguaugcaauggugucaguguuuggaagcugauuaugggguggauccauggauauggcagucucuagaugguccauccuuucgucucagcuccaaacuuugucucuguaacuccuuccauggguguuuuguucccaauucuaaggaggggcauaguguccacacuucagucuucauucuucuugaguuucauguguuuagcaaauuauaucuuauaucuuggguauccuagguuuugggcuaauauccacuuaucagugaguacauauugugugaguuucuuugugaauguguuaccucacucagaaugaugcccuccagguccauccauuuggcuaggaauuucauaaauucauucuuuuuaauagcugaguaguacuccauuguguagauguaccacauuuucuguauccauuccucuguugaggggcaucuggguucuuuccagcuucuggcuauuauaaauaagacugcuaugaacauaguggagcauguguccuucuuaccaguuggggcaucuucuggauaaaugcccaagagagguauugcuggauccuccgguaguacuauguccaauuuucugaggaacugccagacugauuuccagagugguuguacaagccugcaaucccaccaacaauggaggacuguuccuuuuucuccacauccuugccagcaucugcugucaccugaauuuuugaucuuagccauucugacuggugugagguagaaucucaggguuguuuugauuugcauuucccugaugauuaaggauguugaacauuuuuucaggugcuucucugccauucgguauuccucaggugagaauucuuuguucaguucugagccccauuuuuuaaugggguuauuugauuuucugaaguccaccuucuugaguucuuuauauauguuggauauuagucccgcauaucaggauucuuacuuaaauuauuuugaucauauuuaaaagauaaucaucaggccgugcaaacaaaaguauugcuuauacuagugaauaaauauggguugauuaucuuuuuuuucucauauuuuuaaauguaccuuacaucccaauuguaucuucuugcccucuguccuuuccucccagccccucccuuucccuugcccuucucccucaccuuuucuccuuagaaaagggcaggccucccauguacaucaaccagccuuggcauaucaaguugcaguaagauuagguggaucuucuccucuugugcauaggcaaggcagcuccguuaagggaaagggauccaaaggcaggcgauguagucagagacagccccuacucuuacuuuaggagucccacaagaaguccuaacugcacaacaguuggaaugaagguaagaagaaccuugacagcuacucucuaguacauucuccuaagaagcuugcuuggagaagcauuaacacccaggaaauacuugcuauaggcuggauucauuuccgcauaacaagcacacaugaaaucaauauguccagaaggaaaacgugaugauauucucugaggaagcuacuaaaacacuaaggucuaaauaaccaccuaacauuuauuucaaagccauggagcaagagagagcggugauuuaagcaccauugcggacaauuugggugggauauugacaaaucacaaagcaggcuugguguauaaacgcacaaugcaagauggauuguuugaacagggccuguaacauucucucucaucagagcaaugaguauguauuuguuucuauugcuucuuuguuucaguuuccauuauggauauucuugaauaguguuuucagcaaagagaguuaccguagaucagcacaagcucuccugcugauaguguuaucguaggcaacacucuuuguccuagcaauggccuuggcgaaagggaauuuacauauaguuucuguuuuauauuuaagacucagaauuuuggcuuccuuagaauucuaggccuaaagcauaggcucuagaaaacccauuacaauuuuuaacuagguacuuccuuguugugucuauuuauacaucaguaccaaugaucuuauuaaagaaacugucauguggagggcugaggagaugccucagugguucauuguguauaauguuuuugcagaggaugccgaguucgguuccuccuauaucaagcagcucacagccaugugcaacuccagguccagggaauucaaucucauugcgcuucuccauauucauucuuucauccuuucauaagcaucuaauguaauccauaacucaugugugcauuauuauguguggauuaaugcccuuuugugaaagggggucaguaaaguccuguuagcaggagcagguggaguugaaauggcgaugacgccaccaggaacugcuuuacuagggcuaaggagauggcucugugguuaagagcacuuggugcucaugcaaaggacuuagcuucaguucccagcaccuggccuccauugacaccuagaauuaaaugcacauacuuauagcuguauacauaauuaaagaugaaaguaaaucuuuuuaaaaagaauaaaagagagaaaauauuacaucuuacaacaacacaugcuucuaugauaacugcaguaucauugaaagccuugguaggaaaaaaaaaucaaacaaaccaaaaaccaaaaaacacccuauggaaaugggugcuaacagauucuuuugauucuacuuuuucaaccagugaaugaagcuagucagucggaggcaaguaggaauguaggaaaaaugguagcuuaaauugauuggggagguccagagggcaguaaagccauguuuaguaaaacaguuaauuuuuuaaaaagugugugugugugugugugcucacaggggccagaagaggacauuggauccccugaacuggaguuacagggaguugugagucaccugaugugggugcugcgaacugaagcuaaguccucugcaugagcaccucugcucuuaaccacagagccaucuccuuagcuucccugccuccuccaguccccacccccguacacccccuccccugcuucccguaaagcaguucuugauggcuucauugcuuucaucuucagcugacugcauaccugcuccugcuaaggauuuugcugaucccccuuucacaagagggcauuaauccacacagauuauccauggcauuagauaguuguaaacugguggaagaaagcaucuggaggagcacaauggaaaaaaaugaacacaaggcccaaguugacacaggggcuugcaagucaggaaaacauugucucagcaagcaagagagaaaagcagauggucguuugguuaaguuuuggagguugaguauagauucauuuucugucccuagaaugcucuugccuggggguggucuguaaaugaagucacagcaagaggucacuaucucuccauauuccugaccuuuugcagaauucaggccuuuauuuuuuuauuaguuaaacauaauaguuacugcuauaguaguuucgucauaccucauguuuagcaaaaacucuuuaauaccaccauacaguagugacacuucuccgaaugucuuaccaacacgguucuguuugugucuuuuuguaguguccucacuccucauucacugcugacuugucacucacuggacagaaaaaucuguccaugucccucuacucuuccauaacccagacuuuuuugaaccccuuuuugcuuuauuuacaaauauauaacugaagacuagcucaguuuuauguaaaguaggcauuuugaacaucucuugcucuuuaaaauuuccauaacucaaauaucguauugucagagacugaaggcuugcucuguuaucagcugaaguggcauaaccaucucaagggccguuuucaugauuuauguuucuuggcuauuguauacacaguacacagcauccuugacaucugauuagauacaguuuuuacaaauauuuuaauuagguugggacuuuauauguugauauuauauauucaauaaccauugauuaguauuuuuaaaugucuuuuaacuggugaauuuaaaacaaaguccauacauauuauuauggugccauguaauauuuggauaucuguauacauugacuaaugugcuuaaauuccuuaaacauuuaucauuuuaucaugacauuuuccaaaaucuuuuccuuuguuuuuuaaauuuauauuuauuuauauguauguauguauguauauauauauauauauauauauauauauauauaugucuguauuuauaugaauacaugcgcaugcagcguguuggaggcagaaaacaauguugagugucccuuacauugaaauuauaggugccugugagcugccauguaggugcugagaacugaaagcaagucuucugcaagagcaguaaacauucuuaauggcugaaccgucucucuagcccaguguuguauguagccacacaguagcuaugagauagcauucuaggguucugugcuuuauuaaacaagauugguuccuuuuggacauuauuugcccuuccuucuuccuuccauuuuccccaagcucagguagucuuuucugcucccaauauguacggauugagcuuuuauaagauuccacacaugagucugaucaugguaugcuuaucuuucugugccuccauuauuuuauuuaaaauaaagaucuccaauuucaucuauguugaaguaaugacaagauuguauuccuuuugggaaugaauacuauccaucauuuuaucaauugcuagagagauuucauccauaucuuggcuauuaugaauagaacugcacugaauauggggaugcaaaucucugccucuuucuuugugccucucucucuaucuuugugcaugugugggggaguguguguguguguguguguguguguguguguguguguugagaccaagucuuacuguauaucccaggcuggcucaaacucaagaucuuugaccucucuuuggccuuucccuccucagccuuccaauugauggaauuacagccaugcauguauuuuuuaaaaauauuccauaauuuagaauuuugcauguaaagucaaccauuccccuguaucacauugccugugcauuguacccacuaauauaccauugcaaauagaaguguuccucuuaccucuuuucucuccuugagaaagccuauuaacucugacucaucuaaaaugucaccuucuccuuaaagccuuccucuagcuagaacaaagcaccuacccccucccccgccccagcaaacccuucuccuguuggaaauggaaccugugacugauuugacuaggcaagugauguaccacugugccacacccacuuccucuuuuguuucucugaagcuucuuguucguaugucaaaucacuuauuuuggcaugauuuauaagcuacucauauuaucucagcauuacaguucguauguacuucuuagcugugucuuauucauaaaugcugucaguggacuuagcacaaugcaauugcaggaagauuguguaaaaucuuccuuccuuccuuccuuccuuccuuucuuccuuccuuuuuuguuugaagagcuauuuucuaaaugaauauccuuuuauuggauuuuucaaguuaaaauugaauuucauuuuagaucuuugauugugaaaaauuaugaaaaggauuuuuaucaauugugugaugcuguaauaccaguucuuaacaauggugcuuaauaacauucucuuuccuuuuuuauucuuuagugcauuacuguuucauuucuuucagcaucauguaucuuucccaugaagaguggagcuuucuuucuuucauuguucccaugucucuuuagacuaccaacgguggcugucuccuuuuguaauuguguuuuaggucacuggcccuguuccgaccagagauccuucugcgagagcagacagaaggaauaugacuucuccaucauuccuggcugccagcccaauggagaacccagcucuguuuaaugauaucaagaucgagcccccagaagagcuccuggagagugauuucaacaugccccagguggaaccuguugaucucuccuuucacaaaccgaaggcuccgcuccagccugcuagcaugcugcaagcuccaauccguccucccaagccaccgacugcaccucaagccauuauggugccuacuucagcugacacagucacuucggcagccauuccuacuguucucacuccgggcucuauccuggccucgucucaggggaccgguggccagccgauuuuacaugugauccacaccauccccucagucaguuugccaaauaagaugaguggacuaaagacaaucccacuggugguccagucuuugccuauggucuauaccagucugccuacagaugggagcccugcagccauuacugucccacucauuggaggagacggcaaaagugcuggaucggguaagcaagcaguuuaccacuucuucaacucacgaaccuucugagaucuucccuuccuuagugagccuaucuugucucuuuucaccguuugcaauuuugagggacacuauuccaaagggaaacuguccuaaucauuuuuuaaaaguguuuuaaaaauaauuucuauauaaugcuuaagacuauauaaugaacucugugucuuggcacauaucuguagucucagauuacacggcugggcagagugauugugaaucccaggcuagcuuuagguuacauaaggagacccugucacggaagaacauauaauugaucuccuuuagaccauguuucucaaacaggaaugcauauucuugagcgaaauagucuguauuuuccuagcaucuucauauacuauuaucuaauggaaaaucauuuaaagcauuauauucaaaauacugcugauuuaaagcaaaaugcaaaaucugaacacugaguuaaauuacaaacuaaagaacaaaaauguugacacucacuaagacacugucuuccccugugacuuucuagauuauugugcuggguuuuuuuuuuuccugugcuauugguagaaaacucaaccuuccuaucauuaccauacuuagguaugcuuagcucugguuauuuagacacuuucuguggucucugucuaagagucucugcaguauagucacauuuccugugcaggccauuaguugacaccuauauaaccuuccuuuuaagguuugauugcuuuuaagauuuuauuugacuucaagaaugugaaggacuuuuccuaaccgaguuagauguucuccagaauccuguguuaggaugugccugugcacucuccagagacacccaccacagggaucuauauauuuacauuuuguagucuucugguugaauugagcaucucacacauacuaaacaaguacuguacuacugcacucugcccccagccuucuuuugauguaaacaaacaaacaaacaaacaaacaaaaacauuguccucaacagcacaguuuccuuuauauaauuauguuuauuuuaguuuauaaucagaaaugaucaaaggaagucucuugcuucugacaugauuugaaauaguuaucgucaccaaaggguguuauuacagucagguuuuuagggcuguaaauguugggauaauccuaggacuucucucaagccacggaacuagucauagacuucagugccuccaggauauagugaagcugucuuuucuguagacucuuucccaggagucugaggccuagagguggauggaucacacuuagauuguguccuagggaaauccacuagaaggacagcugcccaccuuucaaagccaccucugucccuuccuaugcuaaacaagguugagaagggacugccuuucucuucuuucuuuuugaaugauuuuucuauuuuacguccacuucucuauauggggcaaaccgggaaucccgauaauaaucauagagaucuguacauucuggucuacaguaguagcaccccuuucuuuguuuucagucaaaguugaccccgccuccaugugcccacuggaguuuccaagugauagugaugagagugcaauugaaaguggcucuucagccuuacagagucuccagggauuucaucaugagugaguacuuaaaguguguguguguguguguguguguguguguguguguguauacacgcccauguguguguacacaugcaugccaauuauauguguguacagguauccauguaugaagguagaauuaacaggacacaauaguaagaguuuaaggaaaauuaaaaaaaaaaaacaagcugcuuuuucccaagaacuauacaaguguguguacaugugaauguuugcacauguucauagaguuacauucaaauuguauauaucaugaauucuagccaugaauaaaaagguucuaauuucuuauaaauuguaguuuuguaguguuuuucucuuuaaguuuaaaguagccuggucuucuaaucauaaaaugguuugggagcaauuagcuugcauugagcaaaacauguuguauggaaaauguguuuuguuaagcacaagaauggcacuuguugaagugaaauguucacacuguuugacaaggaaauauuaccaccuccgguccuuucucaggaagcugcauuuccucagcaaaauagccugguucaaagaauggcuuccaggguuucaacuauuucuucuccaggggagcuagcauuagaauuugcauaaaugauaagaugguaugaaauagcaccacuguaauugguccugugucucuuucuuugcuuaggccagcgacaaugguccacaugcagggagaagagucucuugacuuaaagagaagacggauucaucagugugacuuugcaggaugcagcaaaguguacaccaaaagcucucaccugaaagcucaccgcagaauccauacaggucugcccugcccccugccuccugcccugcccccugccuccugccccugccccugccccugccacuauuccaacuccaguacauacuugcauacauagauacauagugaugagccuagggagagagagaaaagcuacaaggaggaggagaucacuuaugggguuugcccuuuugcguuguucuuacccgaaaaccacuuucauaaaaauaaacaaacaaaaaaacuagcaaaacaaaaggccggguacguuccaagcaaguaugcuacugugccuaguuuuucauugcuagguauuaaacccaaggcaucaugcaugccauccuaugcaaguacucuaccaacugagcuacaucacuagucccauagauuuuugcuuugucugcccucaaacuugcuauguagcugaggcugaccuugaauuuuugaugcuuuugucuccaccuccaauuuuuuguuguuguuuaaguaauucccaugcuguuuguuauggacuaguucacuuuuccacccacaguaucuuaagaaaucauuuuucuccauauucuuuucaguacuuugugauugaucaauugguuguuuauuuauuuauuuguuuguuuauucauuuguuuauuuguugauuaucgcccuucugaccaggcugggguugaaucucaauauagguuucuucugugauggguaaaagcuaaccauuuuuucauguauuuaccggaguauuuguauuucuucuuuucaauaguguauguucacauuaucuucccauuuagagagugaauuacccauuuccuguuaacuuuucugauuucuuugucuauuuuggcuguugaucaucuaucucaccuaccuuccuuuuuuuuuaauuagauauuuucuuuauuuacauuucaaaugcuaucccgaaaguucccuccccccuccccccagcccugcuccccuacccauccacucccuaugaaugacuagcaaagguuuuucuuucauucuguaggcuguuaauaucuuuuguugacuguguccuuuauucuacagaugcauuuuaauuuguuaucauaccaugggucaagucuugauuuuauuuccugaucuauuagagucauugugaggagauucuugcucaugccuacaucuugaaguauuucacauacuuugcucaaauaguuucaguaugaugggucugacacuaauuucagucccacuuugaguuguguguuguuuagugaaugcuaaggauauauuuuuaauguuuugcauguggauauaaccaguuuccccagcacaauuucaggaugagcuuucucaaguauauuuauauuagccauucucgucauuggaacuaaauauugaaguaagacaacuuuaaggggaaaagauuuauuaugguuccugauuucagagguuuuagucuauggccaccugccugccuccguugcuuuuggugaagcagagcaucaugguagaagaaaguggcucaccucauggugguguacaagaaagagauacagaguuuuaagagcaugaauguauuaacuguugaucaugacccucauaaugcagucauuccuagcauuaccagcuagggacauaacuuuuguaccaaaacauaacgguauggguuguuuguuuguuuugcuuuagucaaagauuagcuggcuauagaugugugguuaauuucuagauucuuuauucuauucuguugguaugugugucugauuuuauaccaguacuauguuuguuuuauuuuguuacuaaugcucuguaguauguuuugaaaugaaauauuauagugccuucuauuguaguaaaucuccaaccccaauaagccugaauaaagaaugcacaacucaguuacaauauuuauaaacuguaggccuagauugggcagauuuacuacuauaguacucuauuccccagcuaugagauuccuugcuaccuguggcuucuccaggccacgugguucugcuccaucuuccuucuaccucuuauuccucucucuuuccuccaucuccucauuucucuccuucuuccuuucuuccauuacucucuaaaacccccagaucuaccuuucucuuccacugcgcaaucacaggcucuagacuuuauuugaccagucaaaaugagcacaagguucccaugaaaucaccugaguccaugauccacuccucaucugggcagcuccucuugaggaagcagaauuagcaucaauauaucaauagcaccagggcaauucacaacaaccuucaacauuauacauuuccucaggauugauuuuuuaaaagacuuauuuauuuuauuuauaugaguacacuguagcugucuucagacacacaccagaagagggcaucagaucccauuacagaugguugugagccaccaugugguugcggggaauugaacucaggaccucuggaagagcagccagugcucuuaacugcugagccaucucuccagccccuuaggauuguuuugacuauuucggucuuaugcuuuaauauaaauuucaagauuuucuuucuauuuuuuuuaagaaugugauagguguuacauuaauaaguagagauugcuuucagaaaugugaucauuuuauaauacuuauuugaccuguccaagaaacugggaggucuguccauguuggaauagcuacggguuuuguuuguuuguuuguuuuuguuuuucaguguuuuauaauuugcauuuuuagucuuccaucguuuggucuucugucuccuuggcuagauuuauuucaggauaaucuucggcauuugugauuggaguucauuacuuuaaaaaugacacuuaucaauuuauauuguguguuggguaggugcuugugccacagguauuuguauggaggucagaggacaaacugcaggaguugguucucucuuuccaccauauggauuuucaagugccaggcuugguagcaagcaccuuuaccaacugaaccuucucagccuaucuuucuuuguuucuucuuucuuauuuuucuuaccuuauugccaugcauaaaauuucaguauuguauuuaaaaagaguguggcuuguauacauuuuguuuuaguuauuuauuuuuuacaagaagcucuuuuagucucuccucauucagaauuaugcugauuauacgcuuacuguguccuuugucagguugagaugugauccuccuguuccuaauuucuuccaggcuuauaucugaguccuguuccacauuuaucaagauuauccugggauauuuaucuuugauccuauuuauguacuguguuacauuauucauuuguguacauugacccauccugacacaccaagaaugaaaacaaguuaaccauggcuuauuauuuuuauaugcuguuuaauucaguuugaaauacuuuguuggggauuuuugugucuauguucaucaaagcuguuggccuguagcuuguuuguuugcuuuuuuuuuuuuuucugauguguccucaucggguuuugguguauaucuagauaacacugaccucaguuugaacacaagcuucuuuaaccacaguaagauggaacacagggucccccaauggaggagcuagagaaagcacccaaggagcugaaggggucugcaacccuauaggcgggacaacaauaugaacuaaccaguacccccagagcucgugucucuagcugcuuauguagcagaagauggccuagucggccaucacuggaaagagaggccccuuggucuuacaaacuuuauaugccccaguacaggggaaugccagggccaaaaagugggaguggguggguaggggagcaggguggagggaggguauagggaaauuucgggauagcauuugaaauguauauaaagaaaauaucuaauaaaaaaaauuccaccagagaacucuuaaaccuggggggaaagaaaaaagaaaaaaagaaaaagaaauagacuucuucagggugcagugagcucagagugccacaugauggcagcaguuuaacaagccaauuauucauuuggguguagugaaaauaggaauuccuaggagaaauccuugaacaauuauaauaaauucuacacauagugaaacuguugugaaguguggagaugggcuacuaccauaucgaauaaaaguaaaacaaaauuauauucccuauauucuccuuuuuaagugucaauacucauguguaacugucuagacuuuucccuuuuguuuggugagagagauagacaagguaguccuaccuagucuagaacucauuauguagaccaagcuggcuuugaacucagagaucacucuguuucuuccuuaugggucugggauuaaagguguguaccacuacacuuagguuaucuuuagucuuaaaauauccaggugugugucagucuucuuacaggcuaauguaaaaauuucugaauauugaaaugaucaguaacuaacauuuuuaaucaaccaaauaguuuccugguacuacuccaaaccugugaagucagccuggaccccauucuguuguccaauuaucuaacagguauacaguuaauuagugaacacuugagaggguuaguagguguuagcaguaaguuaaaagaaacuaagaaaaucugauuggcacgagacauuaaaacugcaaagcuguaaaugccuuggaaguuuuauaauggggaaaggagggguagaagaacaaagacugauagacauuuuucuccauuuauuuauuuauuuauuuauucauucauucauucauuuuacaucccuauugcugcccccuaguucccccucauagaguccuucccccaccccuccccuucuccucugagaggguggggcccccuagguaucccuccccacccugacacaucaagucucugcagggcuaggugcaucccucucccacugaggccagauaaggcagcccaguuggcaaaggauuccagagauaggcaacagcuuuagggauagccucugcaccaguuguugggggacccacaugaagacugaacuguacaucugcuacauaacgugcuaggggccucaguccagcccauguaugcucuuugguuggugauucagucucugggagcccccaagguuccagguuaguugauucuguuggucuccuguggcauuccuguucccuucauuuccuucaauucuucccccaacucuuccauaagagucccccagcuccaguguuuggcugaggcucucugcaucuguuucagucagcuucuggguggagccucucagaggauaguugugcuaggcuucugucugcaagcauaacagaguaucauuaauagugucagggauuggugcuugcccauggaauggaucccauguugggcugauuauuggucggccauuucuugaggcucugcuccaucuuucucccugcauuucuuuuaaacgggacaggacuacagagugaaucucaaaauagccagggcugcacaguggaaccuugucuagaaaaaagccgaagaaaaaauuagauuuauuuauuuucauuuuauguauauggguguuuugcccauguguaugucuauacaccaugucacauggcaucaacagagcccagaagaaggcaucagauccccugcaacuggaguuacagauaguagugagccacaucugggugcugggaauugagccuaggucuucuguaagaguagccagugcucugaacaacugugccaucucucuaaccccaauuaauuaacuuuugcaacagaagcucacuuagaaaccuaguuuagccucaaauucuugacccuccuacguaaguuucuuuaguacguguuguguguguguguauuuguauguauauauaacacacacacacacacacacacacacacacacacacugugcugugguaguucuucuuauacuaauccccucuuuuccuuuccuuagcaugcaggucucaugauacaauccagcuauaaccugaagucuccaagcauggagcuaucuaaaauacuugggcuuaacaacucucccguuccuuuuuauguauacauuucugaccuuacacagaagcaagcuuuugcugagugcucuuuccacugagucaccuguucuuauuguagaugacuuuguuucagauuguucauuaggaaguaucagaugagagaacagaguuauaauaggguggaaagugucagcaaccuggaucucuguuacaguuugcauguagaauuccgcguaugggcucauguguuugaaaucuugcucuccagcuaguugugcuguuucagggagguuacggaaauucuugcaguuggagguugacuguaggaggugaaucucugggacuaggcuuauagcccaugcauacuuucuauccucuuucugcuucuugaucuauagagaugugagucaagcuccugacuuaauggagccucucaucaccuugucuacuuugccauaauggacuauauucauuccucaaacugugagccaaaauaaguccuuuuuucccuaaugugucuuuccaggcauuugguuccagaaaugggaaauguaaugaauauuguucagauuguacuguuuacuaacaaucuagguuuccuuuuguuugagguuuuuuccuacuccuuuuugagacaaugccuuacuauaguugcauagccuggaacucacuauguagacuagccugaccuuaaacuugcacuguuccucccgccucuggccacuacugucucccuuuuaaaaugcuuugaacaaccuuuugagauauuuuuaccuugauuuaguaguguugagaaauugacuuggccaggggaaagcgauuacuuaauauacgguuagcgugguaaagguagaauucgagcagaauucaauaacucuuugagagccuguguucuucacuguguucuacacugucuucagccuaacuucagaacuucaagcagcaguauguagaggcguuuuaaaaguuuuuuaccacaaaaacaaaacaaacaaacaaaaacaauaugugaaauaauacauaugcuaguuaacuguauuuaaccagucccauaguguguacaaaucaugaaacuagaagacgugcaauaugauguucauuugucaaacuaauuaauuuaaaaggugaauaacacguacuucuucaaggcgacugucuuacuuuaauacauuuaauaauguauuucugcuguuuuucugauuaccuucaauaucaucauguuuuuccugcaggagagaagccuuacaagugcaccugggauggcuguuccuggaaauuugcucgcucggaugagcuuacucgccauuuccguaagcacacgggcaucaagccauuccggugcacagacugcaaccgcaguuuuucucgaucugaccacuugucccuccaccgccggcgucaugacaccaugugaauaucacaggccacagcaggcacgcugcaauggccuccugagugugugcugaaguuguaacuacguuugccucuuugacuacaacuugcccccaugauugggguccgaacagccuacugagccagguuaaugagacuggaaaacaaguuagcuggucucccaugcggcucuucauauuccacuuucaccucuucacuguccagacuucaguuuuugcaaccucuuccuggguugaauucagugcggcgcccauggcugcccucccugaucccucaugcuacauuauagacauuuuuccuacaauaacaaacaaaacaggaaucaaacucaaggcugugaacaaacauccgcugcucuccccuccccccugguuucucuuguuuucuaaagauuuuauucacauguguguauauauauauacacauauauguguauguauauauauauauauauauauacuguaaccaguacuuaauaucacuuagcaauguccuaaaaugaggguuuuuuuucaaaguuguagcuacaaggggcauaacaguagaguugguugaucaaauuuacauagaauugagucugaaauacagagucucaugcuaaccgugaagguuuuguagauccaguuuuacuuguucuuaacaguuugguuuacaggcagugccagcccuccuuuugaaguucaucaagagcaaugaagggauuccuugaccuccuuuuccuccucaugcuccuuuagaauaaaagguuuuauggcacaauuccauucuuuuuagguuaaguuuggacaaauauucaaagcacagaaagauagaucaguagggagaaguauucuaggaaaauacgugggcagugacaggcaagagcagaccugggagcacccugugaacaauuacuuggauaagguguuagaacugcuguuaaucccaagccucguucagagggcagccuguugaaacaucacuuucgaugggcuccacuguacuguugauucuuuuguuuacauaaggcaaccauucagcguauuaccugaugagaaauugcacacugagcacguuauagagaggugagggguugcacuaaaggaauuuuguuuacuucaugccauuuugggcauuuguucuucucuuucuaaugggauggaagagguuuucuuucugacacugacauauagaaagcauuuuuuuggauguuuuacaacuucuauuaauacccaagccauuuauuuuauuuagauauaacaacaagaugcuuaauauacauuugguugcccaaucagacuguucauaauauucucuggggcauaaaaccuucuguuccuggcccuggaccucauaucuaccucuucguggcauauuuccucuccuggggaaaaaggagaggggcuuuguauuaguaggauuggacacagccucucgccuaaagguuuucuucauaugaaaccuuuauuucuuggcagauauucaaaauguucuggcuugaacaauuuagguuacuaccuccuguggcuguacuuucuaacuaaagccuagaauucuaccauccagaagggguccugucuacuucuacccaucccucacguuuuacagaugaggcaaauacgggucagauucuuucuccagauaauuccuugaggccuuacagaccuguauacaccgucucccagggaucacacuaguaaaccaaauuaaagaaaaagaaguuaugugauugguugcaauauuuguccaauuuuauguuacacuucagaaaacuuuaaauucauguauauuuggugacaaaguaaguagggugugcuuauggucaugaccacuuaacaccaggcacacaguguuucaagucacauuuuuugauaauucuagauuuguuuuaauuuaccuuguuucaaguuucaaugucuuugcagagcauaaauucuccauaaguuaaggccuacuuguacuuuucaacguggcauguagguuuuacuguuacugcuuugguaagggaucuguccugacucuggguguacaaguuccaggcuguauacuaauuacuaagcacuaaucaauaucuagggcuagucuacuaauggggaccacaauguaaaacagauugaaaaauguauauuccuaccauauaugggcuuaagcuuauaauugaguaguugguacaauacuauagaacagaguccaaaggguuauguacuucuguuccacuuuggauccuaaauuuguuuuccagagauuggaauuggcaugugccccuuagacuucaggauauugagacauauguuuauuaaugagcacuaugaaauuauaguacucauaagggugaucagcugaggaucccagauacugauguuccuagcaucucugagccuuuauucaaguauguuucugcagagucuuaauagacuuugcaaaugcuuuguccauugucuuuagccaagaaccaauucuaaccauauucucuuugcucuuuuuguucccaaauggcaaaaaucuuuccaguuacaagcauagucuuuacaaaugugucaugauuaagagaacuucgcagaguaaaugaacucaaacaguacagugcagaauuacugcaccaaaagcacauacguuugcuacauagugggauauaaaggaaaccauuccacuucucuugguuaacaucugagguuuaacuaaguguaaugggcuuacaacagccaaagacuguuaggaugacauuugccuaggauauggaaauugugucuggauggauaauauucaggaguuuauuguagugaaguuucucccucuguagacaucuggcagcugaacauaauuguugguaauugccauuguaaaguguaagaaauguaaacugguuugauggauuaguggaguucauuauguacaaacccacgaauguuuguaaagagaauuucuuuuuaaauaaacuuuacauguuggaacucuuuuuuugagauuuucaggaaaaugugaagguagaacagaguuccugcugacucuacauuauauauuuguuugguauacuuguuacaauuagugaaauuauaccgauacauuaauauuaacuacaaucaaugcuuucgucagacuaccuuggcuuuuaucugcuguucuuuuuuucuguuuuaauaccgccuucaaaauacaacauuguauuaauaauaacagcuccuuauucuccucguugugauagcuucuuggaguucuuuguucucaaggaccuuggaguauguuuuucaguugggguguauuuuauauucuucucaugaaaauuuucucauuaaaaaaaaaaaaaacgaggucaaugaaagcuaggcaugguggcaaacacuuuccuuuuaaucccagcacuugggaggcaaaggcaaguggaucucuggucuacagagugaguuccaggacagccagggcuacacagaggaaaacccugucucagaaaacuaaacuaaacuaaacuaaacuaaacuaaacuaaacccuaccuuaaugaacccaauggauuuggguccaaacaaccacacaagugaguuacuauuuucauaacaucaucuuucuaugacuuaucauucuucauauuauccuuagucacaugacuaagauagugucugagauuucuccccuauacccuuuuuccuaucaucauacugcagucuuuggagggaacuuacugugcucagcccacauauacagaaauggugaguuagguacuauguccuugagagcaaguguucaaauauuuuggaauuuuucugcauugggagcuuugccuccucucuuauuuauuuacuuauauguuuauuuuugucaacauggacucauugauauuuauuuuauagauuaucuuauaauucaaugcaacuuuuauuuuguugcucaaauuguaacuuuaacuguuaggagcuuuuuuuugaauugaucaugaagucuuguuugcauacccccauuauuguuuuuuguuuucaguaagugaguaauuuuugguguugcaagauguuccagacacaucuugcuuuuguuuuauggaggacaauucuauaaucaggcauuuugucaauaaguuguaaucccuuuuacugaagaauuauaaccaagguguagguacuauauauguuugcuacuuugcagauauuucuucaaguucucagucacuagaacaaagaaauacaugcauauauuaaguuuuauauauacaaaugcuuguaaacacuuccauauauaaucaucuuuaugaugauuuauauaaguuuauaucauugucuucaguccuuaguuaucugcauaucuuuccauucuaucuggaagaacaauagcucaucuucugccauuuauuauuuuuuaaaauccauauuaauacuaaugaaauacauauuaacagugucuuauguguuauccuguaguauacccaugagaaaagucaacuagaaccuggugcuuauguacacgauaguaacauuuuuagaacuucaacucuuugaaacaaaaugaucuacaagauucuugaauuagagauaaucuguauucucaauucuauccuaguccccaaaugcuuucucauacaugaaacaaaccaucagugauugaccuagccuugaauaagccaagggagcauguugauccucuguaguauguuaauuccuauagaagggaucaaagagaaagcagcugcaugggucuaauuugaagaaacacuuagcacuguccuuuucucuacugaaaauggaucucugacaacugggcaguacccugauuugccucucuucuguauuuuccccaguuuuuaggcaagucacaucaccucucugugccucuauuaacccaucucgaaauggggauccacauaucuaccucacaggaguguugugaggcuucuuauuguuuuaaaaaaaguguaaucucuaaacgaguaagaaaguauuauaaucauuacuaugaugauaauuagaguacccuauauguauccuauggaaaaggagauuagccucauuguuaguaaacagcuaaaauuaagucaauaaaagaucaaugaagcguggccacuggaagcaagauuauuuauucuguuacccucacuuucccuauauccucuaaguauaggacuaucaaguguuuccagacucgaaacauacgaggacccaaaacaguaggaggcaaaguagauugucauuuucaaauuguguuucuucucccuuucuuacucugguuggacugcauuacauagaacuuugucagaagcacaaagacaauuucucaaaggguuucagucuuugaucaguucuguuccaucaauuaagauuucucuuucugcguguacuguacauugaacagucaagguaggaggggaguggguggguugguuggguugggcauggacugggagagaagggaaauuacagauguguuuuccaaacaccuguuaucacuuuccauuucuuuuuuuucuggugguggguguggggcaagggaagagauacuauuuuguuaacaaauucuccuucccuuccaguagauguuuccuagggucaguacaaauagcuguguuggaccuuacuuuuauaacuauguuguauacaguguuguuuucauuguauuuucgaauaaagggggaagaaagucccuagugcuggccaucccuguuuuugacaggaggucacaacaggagagcagcagcagaagcugacucugugguggggaaaggagccugcaaugaagggauuuauuggauuuuugucauucuuuaaagaaauuauaaagcaguauauuacacauuagucucuaugacucuucuguuugagccuccucauuuuagugcuuuagagcagcaccuauuuucacuccauuuuauacuuguuccuguugaaguaugguguugagcaaucucucauagacaagucugugguguaccuauagagaauugccucaguaagcguggcuacccagagguuacucugacguagcucaguggggcgcucccauuguagcuuccaggccaggcugugugcuugaguacuaagcagucauguucugucugauuacuguacuuuuuuaauaauaaaaauauuuuaaaccagaaac

SEQ ID NO: 9800 - RNA, 3432 nt, Mus musculus
gggggcggggcggggcggggcggggcgggagcgcgggcgccgcagcugcaggagucgcugggagugcgcgcgggcagaucacaaggcggcggcagcggagacggccugcaggaccugcucucucagcccucagccgaggccuacgccgagccgagugcgcagccgacgaccgggaggagccgcagccuucaacucugagguacugugauccgcgcugcccgccgggccgccccaguccgcugcugcggcaccuccuucccucgcgcccucuucgcucgccagcgccuucccugugagccugcgucaccgcggccgccauggcugagaacggcgagagcagcggccccccgcgccccucccgcggcccugcggcggccccaggcgcggccagcccgccggccgagcccaaaaucaucaaagucacugugaagacccccaaagagaaggaggaguucgcggugcccgagaacagcaccgugcagcaguucaaggaagcgauuuccaaacgcuucaaaucgcagaccgaucagcucgugcugauuuucgccggaaagauccugaaagaucaagauaccuugaugcagcauggcauccaugauggacugacuguucaccugguuaucaaaagccagaaccguccgcagggccaggccaccacgcagcccagcacgacugcgggaacgagcacgacgaccacgaccaccaccacggcggcggcgccggcggcgacgacaucaucggcucccaggaguagcuccacaccuaccaccacgaauagcagcuccuuugggcugggaagccuuuccagccuuaguaaccugggcuugaacucgcccaacuucaccgagcuucagaaccagaugcagcagcagcuccuggccagcccugagaugaugauccagaucauggaaaaucccuuuguucagagcaugcuuucgaauccugaucugaugaggcagcucaucauggccaauccacagaugcaacaauugauccagagaaacccagaaaucagccaccuacugaacaacccagauauaaugaggcagacgcuggaaaucgccaggaauccugccaugaugcaagagaugaugcgaaaucaagaccuggcucucaguaaucucgaaagcaucccagguggcuacaaugcucugcggcgcauguacacugacauucaagaaccuaugcugaaugccgcacaggagcaguuugggggcaacccguuugccacgguggggagcaguuccaccucaggggaagguacucagcccucccgcacggagaaucgugauccgcugcccaauccuugggcaccaccgccaacaacccagacggcugcgaccaccaccaccaccacgaccacaagcaguggcaguggcucuggcagcagcuccagcagcaccaccgccgggaacaccauggcugcagcuaauuacguggcuagcaucuucagcaccccaggaaugcagagccugcugcagcagauaacugagaauccccagcugauucagaauaugcugucugcgcccuacaugcggagcaugaugcagucgcugagccagaauccagauauggcggcccagaugaugcugaguagcccgcuguucacuucgaauccucagcugcaggagcagaugcguccacagcucccgaauuuccugcagcagaugcagaauccagaaaccaucgcggccaugucaaacccgagagcgaugcaagcgcuaaugcagauccagcaggggcuacagacucuagccacugaagcaccuggccucauucccagcuucgcuccagguguggggaugggagugcugggaaccgccauaaccccugugggcccagucacucccauagggcccaucggcccuauaguuccuuucacccccauaggccccaucgggccuauaggacccacuggcccugcaagcucccccggcuccaccggcacuggcaucccgccugcaaccacuguguccagcucugcaccuacugaaaccauaaguccaaccucggaaucuggacccaaccagcaguucauucaacaaauggugcaggcucucacuggaggaagcccuccacagccgccgaauccugaagugagauuucagcagcaacuggaacagcucaacgccaugggguucuuaaaccgcgaagcaaacuugcaggcccuaauagcaacaggaggcgacaucaacgcggccauugagaggcugcugggcucucagccauccuaauuacguuucuguaccuugaaaaaaaauguaucuuauuuuugauaauggcucuuaaaucuuuaaacacacaaaauugugcuuuacuuuuauuuugauucuuuuaaaucugucuaccuauaaaucuaauaggaugcauuuuaagguggagucccucccucccucccucccucccucccugcuccuccuccccccacccucucccuucccuuccagccugcccucuccccucuuuguuuccuucauuccuuucuuuucuucuuuugauuuccuuccuucucugauuugaauggugggaaucaauacuguuucacucaaagguguugcaugcaaacacuucucuuuauucugcauuuauugugauuuuuggaaacagguaucagccuucacaguugggugaacaaguuuuguccuacagauguccaguuuauuugcauuuuaaacauuagccuaugauaguaauuuaauguagaaugaagauauuaaaaaaacagaagcaaauuauuugaagcucucuaauuugugguaaaauauugcuuauugugacuuuggcauguauuuuugcuagcaaaugcuguaagauuuauaccauucauugaucguuuuugcuauuuguacacaguacaguaagcacaauuggaauuguacaucuagaaguauuacuguagaaucucugagcagaauauguguaaccaaaauaagaaagaauauaagaaauauuccugaagcuagguaugucucacaauuuuguagaaucuuacagcauauuugauaaauuucucagugaaaauguuggcuaggcaaguucaguuaaaauauaguagaaauguuuauccugguuucucuaaguauacauuaaauuguacagaaaccuuacaguguaacauugugucaacaguugcagauugauuguauaugaccuuaaucuuugugcagccugaaggaucaguguagugacuccaggaaagugcuuuuuaucuaagaguuccucagcuucucccaugaagagaccuucauaugcauuuugauuuguaauuggaaauguaacuuuuacuggaagugucaugugauguuugcauuacuuuuaacugcuauguauaaaggaaaguguaucuuuuggcucuaucaguuauuucucuugugcacagggaaaaaugcauuaaaaugacuaaaaaaauaaaaaaauaauaaaaaauggaga

SEQ ID NO: 9801 - RNA, 3432 nt, Mus musculus
ucuccauuuuuuauuauuuuuuuauuuuuuuagucauuuuaaugcauuuuucccugugcacaagagaaauaacugauagagccaaaagauacacuuuccuuuauacauagcaguuaaaaguaaugcaaacaucacaugacacuuccaguaaaaguuacauuuccaauuacaaaucaaaaugcauaugaaggucucuucaugggagaagcugaggaacucuuagauaaaaagcacuuuccuggagucacuacacugauccuucaggcugcacaaagauuaaggucauauacaaucaaucugcaacuguugacacaauguuacacuguaagguuucuguacaauuuaauguauacuuagagaaaccaggauaaacauuucuacuauauuuuaacugaacuugccuagccaacauuuucacugagaaauuuaucaaauaugcuguaagauucuacaaaauugugagacauaccuagcuucaggaauauuucuuauauucuuucuuauuuugguuacacauauucugcucagagauucuacaguaauacuucuagauguacaauuccaauugugcuuacuguacuguguacaaauagcaaaaacgaucaaugaaugguauaaaucuuacagcauuugcuagcaaaaauacaugccaaagucacaauaagcaauauuuuaccacaaauuagagagcuucaaauaauuugcuucuguuuuuuuaauaucuucauucuacauuaaauuacuaucauaggcuaauguuuaaaaugcaaauaaacuggacaucuguaggacaaaacuuguucacccaacugugaaggcugauaccuguuuccaaaaaucacaauaaaugcagaauaaagagaaguguuugcaugcaacaccuuugagugaaacaguauugauucccaccauucaaaucagagaaggaaggaaaucaaaagaagaaaagaaaggaaugaaggaaacaaagaggggagagggcaggcuggaagggaagggagaggguggggggaggaggagcagggagggagggagggagggagggagggacuccaccuuaaaaugcauccuauuagauuuauagguagacagauuuaaaagaaucaaaauaaaaguaaagcacaauuuuguguguuuaaagauuuaagagccauuaucaaaaauaagauacauuuuuuuucaagguacagaaacguaauuaggauggcugagagcccagcagccucucaauggccgcguugaugucgccuccuguugcuauuagggccugcaaguuugcuucgcgguuuaagaaccccauggcguugagcuguuccaguugcugcugaaaucucacuucaggauucggcggcuguggagggcuuccuccagugagagccugcaccauuuguugaaugaacugcugguuggguccagauuccgagguuggacuuaugguuucaguaggugcagagcuggacacagugguugcaggcgggaugccagugccgguggagccgggggagcuugcagggccaguggguccuauaggcccgauggggccuaugggggugaaaggaacuauagggccgaugggcccuaugggagugacugggcccacagggguuauggcgguucccagcacucccauccccacaccuggagcgaagcugggaaugaggccaggugcuucaguggcuagagucuguagccccugcuggaucugcauuagcgcuugcaucgcucucggguuugacauggccgcgaugguuucuggauucugcaucugcugcaggaaauucgggagcuguggacgcaucugcuccugcagcugaggauucgaagugaacagcgggcuacucagcaucaucugggccgccauaucuggauucuggcucagcgacugcaucaugcuccgcauguagggcgcagacagcauauucugaaucagcuggggauucucaguuaucugcugcagcaggcucugcauuccuggggugcugaagaugcuagccacguaauuagcugcagccaugguguucccggcgguggugcugcuggagcugcugccagagccacugccacugcuuguggucguggugguggugguggucgcagccgucuggguuguuggcgguggugcccaaggauugggcagcggaucacgauucuccgugcgggagggcugaguaccuuccccugagguggaacugcuccccaccguggcaaacggguugcccccaaacugcuccugugcggcauucagcauagguucuugaaugucaguguacaugcgccgcagagcauuguagccaccugggaugcuuucgagauuacugagagccaggucuugauuucgcaucaucucuugcaucauggcaggauuccuggcgauuuccagcgucugccucauuauaucuggguuguucaguagguggcugauuucuggguuucucuggaucaauuguugcaucuguggauuggccaugaugagcugccucaucagaucaggauucgaaagcaugcucugaacaaagggauuuuccaugaucuggaucaucaucucagggcuggccaggagcugcugcugcaucugguucugaagcucggugaaguugggcgaguucaagcccagguuacuaaggcuggaaaggcuucccagcccaaaggagcugcuauucguggugguagguguggagcuacuccugggagccgaugaugucgucgccgccggcgccgccgccguggugguggucguggucgucgugcucguucccgcagucgugcugggcugcgugguggccuggcccugcggacgguucuggcuuuugauaaccaggugaacagucaguccaucauggaugccaugcugcaucaagguaucuugaucuuucaggaucuuuccggcgaaaaucagcacgagcugaucggucugcgauuugaagcguuuggaaaucgcuuccuugaacugcugcacggugcuguucucgggcaccgcgaacuccuccuucucuuugggggucuucacagugacuuugaugauuuugggcucggccggcgggcuggccgcgccuggggccgccgcagggccgcgggaggggcgcggggggccgcugcucucgccguucucagccauggcggccgcggugacgcaggcucacagggaaggcgcuggcgagcgaagagggcgcgagggaaggaggugccgcagcagcggacuggggcggcccggcgggcagcgcggaucacaguaccucagaguugaaggcugcggcuccucccggucgucggcugcgcacucggcucggcguaggccucggcugagggcugagagagcagguccugcaggccgucuccgcugccgccgccuugugaucugcccgcgcgcacucccagcgacuccugcagcugcggcgcccgcgcucccgccccgccccgccccgccccgccccc

SEQ ID NO: 9802 - RNA, 843 nt, Mus musculus
cagucccuggcgagcuccgcuauggcucagguggccaagaaaguccacgggucuagagcugcggcagcagcagcagccgccgcugccaaagccaaaagaucgaagccuaagaccgccgccaaaagauucaagcuuaauaagaagcgaaacccuagaucuaagcuucccaagagaucucaucguuccuuaauucguucucuuuuucagucucguuccugugguugcugucguuguugcugugguuuuugcuguuaucguucucguccuucucguagcagaauuacauuuaaggugagagaucccaagcuaagcucauucccucccuucuucagucauucuuuccccuaagacuuucucaggccuacaauaaacuucccaucuaccucuaccccuuuacaugaauccucauccacguucuaucuuuuccccaaaccagugcccuuaugacuguaguucuuucagauuacgaagaagggggaacaaucacuuagaaggagaauuaggagacgaaucaagagugcuacugaacuucgauugaugcggagccaacuggagcugaucgaaccggaaccgacuauggcuuuggagccaagugagauuacaguggcauuguucucucaugagaaugccaaugugucugagccggaggaaguuccaccaugcauugacagugaccagguuccgaauggagacuuggccagcuccuagacccugaacagguccaaagacccaugaaacaucagugaacgggucugggagcugagcugugguccugucaaggccacuuuucaccacaaacuaauuuguaugauggugaaaauaauaagaugugaaaauaugugu

SEQ ID NO: 9803 - RNA, 2031 nt, Mus musculus
caggaagcuacgcuaggaaaagagggaggagacugcaguggcagcagcgacugcuggaagcucuuaaguggcccagguacugccgccucugacacucgggaauaaggugagagaaagcccagagcggggacuuccuggaugcucccuucuuuugccccgcggcuuuccuagacaggcgcuuggccuuagacuccuggcucugcucucacaggcgcucauuuggcugcuugccggcugaucauccuucgcuccaggcucgcagcggaggcaacagucuucuguccgauuugggcacgugagugcugcaaacccagacagugagcaggugagcaucggacuaggugcuggaaaauuggaauggguuccugcuugucaggaaaauuggagggagugcuaagauuugagcugagggaaacucggaaccgagauuuggggggcggggcacggagcaagaaacccggggaaucuuauacaaagguggccagugcaugaaacagauucguggugcugagcucaaagggaaacggggaugauuuggaagacacaugaagaagugagcacagagcaagcauggguaugggcagugagggcggaaugaaaaggagggggagaguggguaagagacauagaaauuucacggagggauauagagauaugguauugggguuauaaauagggaugguggugcggggcagcugggaugacuacggaacuagcagagaaccggcuguuucuuugcuuggcucucaagcgcuacaacuuccacagcgaucucuucacuaacucuguuguguaaccaaacaagccuggaaagaggcuuaugcaggcaggcauuuaaacacauuuugauauagaauacugcuacuggacacauguauaucaugcacagggacuuccuaauccacagaaaaauaaccuuaauauuugcauagaauguuuuucccuagauucucuccuccucuuacagguaugaagaccccucacaaaaaaggugcagcaaaagagcaaaugggagaaggcguaggucaccacauuggcucuacaaccaucaagaagaaaaaagcuucucagaagaggcagaggagcagaucuucaucccguaggagcaucgugggcuguagaauuucucacggguggaaggaaggagaugagccgaucacacaguggaaagggacugugcuggaucaggugccuaucaaccccucucucuaccuggugaaauaugaugggauugacugugucuauggacuggaacuucacagagaugaaaggauuuuaaagcuuaaaauccuuccugauaaggugucguucucuggagucagcgaugugcgccuugcuaauaccauaauuggcaaagcaguggaacacauguuugagggugagcauggcucuaaggaugaauggagggggaugguccuggcucaagcgccuaucaugaacgccugguuuuacauuacuuaugagagagaucccguuuuguacauguaucagcuucuggaugauuauaaagagggugaccuccguaucaugccagaguccagugcaucuccuccagcagacagggagccagaaggaguuguagauggccugauagguaaacauguggaauacaccaaagaagauggcuccaagaggacaggcaaggucauucaccaaguuaaagccaagccuucuguguacuucaucaaguuugacgaugauuuccauaucuaugucuaugacuuggugaaaaagaacucuuaggguaaaauuugcauaguguggggaaacaaauguguacguuguagaugugcaaaaaacauuaauuuuucaguguauuaaaagcuugagaguuucugauaacccagaaacuuugccagcaaugcuguuguuuuuguucuggaaacuaccagucuguggacaugaccuguuaaauguaaaaacacauugucuuguguaagagaugaguauguuuggugaaugggauaugaagaaacagcugucaaauuaaccugugaauaaaguaccauuauuauuauaauuagucaucua

SEQ ID NO: 9804 - RNA, 5542 nt, Mus musculus
gaugcuugaagggaagauggcugauauuaacuucaaagauguaacuuuaauagucagcguguuugccgccugcuacuggaacagucuguucuguggguuuguuuuugaugauuuuucagcaauacuggauaauaaagaccugcauccaucuacaccuuuaaagacuuuauuucagaaugacuucuguggaacuccuaugucugaggagagaagccacaaguaauacaggcccuuaaugguguugacauuucgcuuaaauuaucuccucagugagcugaaagccaugucuuaccaccuccugaacacaguguuccacgcugucgucagcgugaucuuccuuaaggucugcagacucuuucuggauaagaggagcagcaugauugcaccucugcucuucgcagugcacccaauccauacagaggcuccuuggguaauaucucuagcuccuguauugggggccgugugacccauccaauagcugacugugaucauccacuucuguauuugcuaggccccggcauagucucacaagagagagcuauaucuggguccuuucagcaaaauuuugcuagugugugcaauggugucagcguuuggaagcugauuaugggauggaucccugcauauggcaaucacuagaugguccaucuuuuugucacagcuccaaauuuugucucuguaacuccuuccauggguguuuuguucccauuucuaggaagggguaaaguguccacacuuuggucuuccuucuucuugaauuucaugcguuuagcaaguuguaucuuuuaucuuggguauccuaaguuucugggcuaauauccacuuaucagugaguacauauugugcgaguuccuuugugauuggguuaccucacucaggaugaugcccuccagguccauccauuugccuaggaauuucauaaauucauuuuuuuaauagcugaguaguauuccauuguguaaguguaccacauuuucuguauccauuccucuguugaggggcaucuggguucuuuccagcuucuggcuauuauaaauaaggcugcuaugaacauaguggagcauguguccuucuuacugguuggggcaucuucuggauauaugcccaggagagguauugcgggauccuccgguaguacuaucuccaauuuucugagaaaccgccagacugauuuccagagugguuguacaagcuugcuaucccaccgaacucaucaucugucuuuuuccuagcugccuuucucucguauacuaagucaaaaggaccagauaauuccauagaucucuuauuuucucuucuuaaauuguaguguggaccccgauuguauuaaccguguuuuuaguggcuguugcaacauuguuuaaggaacaaggaauaacgguugucggaauuuguuguguauaugaaguauuuguggcccaaggguacaccuugcugauguuaugcaccuuugcuaggcaguuucugcgcgggaagggcagcauucccuuaucugugcugcagacacugaugaagcucauuguccugaugcucaguaucuuacuacucguugugaucagaguccaaguuauucagucacaacuuccaguguuuacaagguuugauaauccagcugcuguaagcccaaccccgacaccgcagcugacuuuuaacuaccuccuuccugugaaugccuggcuucugcugaauccuucgaagcacugcugugauuggaccauggggaaaauaccacugauagaaucauuucuagauguucgaaaucucgccacuuuugcuuucuuuugcuuucugggggcuuugggaauauucagucucagauacccuggugacuccucaaagacuguccuaaugccgcuuuguuuaaugguguuaccauuuauucccgcaucaaaccuguucuuuccuguuggauuuguuguugcugagugaguacuauauguuccuagcaugggguucuguauuuuaguagcccauggauggcaaaaaauuucaaacaaaagugugcugaacaagcucucauguguuugucuuuccauggugauacuaacccaugccuugaaaacacuucauagaaauugggacugggagucagaauauacauuguuuaugucagccuuaaaggugaauaaaaacaaugccaaauuaaggaauaaugugguucaugcucuggagaaugugaagaacuuugagaaagcuuugaaauacuucuugcaggcuaccuauguucagccagaugacaucggugcccacaugaaugcaggaagaacuuauaaaaacucaaacagaacuaaagaagcugaagcgucuuauaugcuggcuaaaucacugaugccucagauuaucccugguaaaaaauaugcagccagaauugccccuaaucaccuaaacguuuauaucaaucuggccaaccuuauuugagcaaaugagucccgucuggaggaagcggaccagcuguacggacaggccaucagcaugaggccagacuucaaacaggcuuacauuagcaggggagaguugcuuuuaaaaaugaaucagccucccaaagcaaaggaagcauaucuuaaagcacuagagcuggacagaaauaaugcagaucucugguacaacuuggcaauuguuuauauugaacuuaaagaaccaaaugaagcucugaagaacuuuuggaacuaaaccccaaacauaagcuagcacuguuuaauucugcuauuuuaaugcaggaaucaggugaaguuaaacucagaccugaagcuagaaaacggcuucuaaauuauguaaaugaagagccacaggaugcuaauggcuauuucaauguggggaugcucuccauggaugacaaaaaggauucagaagcugagucuuggaugaagaaagcuaucaaauuacaaccugacuucagaaguucuuuguuuaaccuggcacuccuguauuugcagacugcuaaggaguuaaaggcauugccaauuuuagaagagcugcuuaaauacuauccugaccauaccaagggucucauuuuaaaaggagacauucugaugaacuaaaagaaggauauaccuggagcuaaaagauguuuugaaaagauacuggaaauggauccaagcaaugugcaggggaagcacaaccuguguguuugaagagaaggaguuacuaaaagcugagaggugucuuguggaaacauuggcauuagcaccucaugaggaguauauucaaugccauuugaguauagucagggauagaaucuccucuucugguauuguggagcagccacuggccccaguugauaagacuccagguacagaggagagagaggaaaucccuucugaggauguaaaagaaaucagcagugaauccagaccaccacaaaucuuaaaaacaaacaauaacagaaacucuaaauccaacaagcaaucaacagaaaaugcagaccaagaugccccccauaaaacaacaaaagacaucaaagaaauugagaagaaaaaaguuacugcuuugaaaaggcuagaagagauugaacguauuuuaaauggagaauaauacuaauucugcaucauguaacaauguuugcaagaccuucagucuauaucauguguuugcuuguucuggagaccgaaaaaugucaagaauauauacugguuuuucagaaacgguguaagguccucucuauaggaucaaaaugagaguuucauugaagaucuaccugucccaggauauauauuuuauaagcuagggcacaaauuuuaauuugggugacuaaaagagaaaucacaaauuucaggucacaauuugaaacuuuuauuacagaaagaaaaagguguggguuuaauauacaaagcaaaggguggggaguacugguaagucuuucuacuaaucugauugaaaaauauggggugucaaagaugaacccuuggagauaaguccggauuguacugggcuuugugaauucccauuuauucgcucuuuuccauuuuucuuuaccucuuuggauccagaaauggacugguacucaugaaagacauucucuuuucuucaguaauucuucucauaagccaagcaacauuguauugcaaauguauacuguuuucuuucuguguucuuucauugggauuagaaggaaugguagggaaaaaaacaugauaaaauauaucaugcaucacauagaugacauauuagcuuaggaaugcauuuguccuucacucuaaacuguaaagcagggaaaguguuacauacacacacuccuaguggugcucacuaauacucuauucucucuuucacacugagagugcucugacauaagcuacauuaccaugacuacucaugacacuugcuccccaaaggguucugcuucuggcuuuaagcuuuagaguaauuagaguaaucuccuccaucuuauucucucuggucuucaguuaaaaucaguuuucuguuuccaaacuaauaccuucgccauucuuaccugcuuaagccacuacacucaguuuugcuuaacugaaggcaacacaaugugacauuuacuuuuaaacacuagauuccucuuauggcauauauuuuauuaaguauuuauuuuaacuacugaucuuucauaaaaauuuuaaacguuuaguuuaaauuguuaguuccuuuaaguuaacuaaucacuaauuacaucuuagaaaccauacuuccguaauguuuucuaugaaacuuuuuauaaauaggucacaagaaacauguucugcauuaaagauccauuccuuuuaguuucccagaggaccuggcauagauuucuuucuuucuuuuuaagauaacuuaacucuagcacuaaaggcaguggguguuaguucucgacccaggagauuuugguaaccaucaaugcaguaucuuguuucaguuuuuagagugcaucuuugugacuucagauauggaguggagaauaccucauguacuauaacuugaagaugaaguuacuauucucucuguauaucucuggaaaaguuuuugcugauaaucacuacaaugacaauucuaaguggaggacagcucaguacauaaagucaaaggaaaccuuuuaugauagcaaacauaauaaaaguuugaagacuauuuuaguaaauuuauauagcuagucaagugauuaggauaaauauuaauauccaacaguuuuuauagaaaaacaucuuuuauuagcacucauaauaaugucugucacaaagaaaguacucauacuugaauuuuaauuuauuuaaaacaaauccauuuugaauagcaauuauuaauuauucccauucaaugauacccaaccucauuucauacuagaauccuaugggagcuuuucugaaauugaaucaugcuucagucuuucccaaaaucucuuugagugauucucaucuauaguuagaguucagggcuacugcucuaaauuaguucagaaaagguccuuuuuuuuccuccuguguuaaauuuguaaauuagugauaaaacccaauuaaguuuuguuggcuuaaauccaacuaaggaauauauucuauugaaaauauaaauaguaaauucuaucaaacuugguuauggu

SEQ ID NO: 9805 - RNA, 3347 nt, Mus musculus
cagugucuggaacagagggcggugcuucggcgggcuuucauccuuacuggucgcgaucucuccggcuccccguccagggaggagcuucugcggacuuaaaaggcaccgucuugccacuucuuagcugcgcaguuuccccgaaguaaguuugccaguuuucugucuuauacugagguucgccgggucauggugccagccugacugagaagaggacgcucccgggaaacgaaugaggaaccaccuccuccugcuguucaaguacaggggccuggugcgcaaagggaagaaaagcaaaagacgaaaauggcuaaauuuaagauccguccagccacugccucugacugcagugacauccugcgacugaucaagguagguaaaaguccgggcucucccuagggcagaggguaggggaggcucuguugaccggggaaauccucaucugcaguucugagacgcagccaggccaguaaauuccgccuucuuggccugccaaccccagcccgggucaggcucggcuguucggcgccaggcaggacucagucaccgcucuacccugccugccccauuucucuucccgugagcuggcuaggcuggccaggaguuucauuguccuuuucuuuauaugucguccccaggaacuggcuaaauaugaauacauggaagaucaagucauuuuaacugagaaagguaacaaggcguggcgggggagggggaggggcggguaauaucuguuuccuggcaccuccaaaggucaacucucacugucucugccuccccugucuuacagaucuccaagaggauggcuuuggagaacaccccuucuaccacugccugguugcagaagugccuaaagagcacuggaccccugaagguaaccccugaucccugucgagaagccagagagaacuaauguuauaucaaacccguagagccuacugggcagaacccgugacuacgcgggcagagguuacugaggagcuggcuggaaauaacaaccagccagugugcaaaugacugaggaaaaaaaauauauguguaguguacuuucuaauagggcggguuaugagagagcuguuugagcaaguaucaaaguucuguagaaacccggaaaaguuaguuauaaugucauuuguuguaauuccguuucauaaaaugguuuuuguuugacccuaaccuaacuuuuuuuuuuuuuguaauuguguuaaaucacauuuuuuucuuuaauuugucccaaucuucagguuacagucucuagcuucgccauguacauggcccuucuguguacauggaugggcggggagguaacuaaaagacccuuuacacaauaaaguagaugaucaugauaaaugagguaagguccuauuaucgcacacuuaaaacacaguagaucagaaauuuauuuucgcuuccugucugucugcaaagaaauacaaaauggcuagaaaauuuaauuugcaaccauugccucuaauuugcaaccuuugccuccauuugaaauugaauugacacuccuuaugagguagucaguuguuaauuauuauuuuuaguuauguauugacaccuuuuuuuuuuuuuuuuuuuuuuuuuuuugcuggcccuuguugacuggucaggagacggcuaaaaggggaaguuguuugggugggugcuuucuugaguuuucuucugauguuuguuccuuaggcucgaagauaaucagaacacguaagggaugaacuaaguuuuagaaguauguggguguuauguaacaccuguuucugguuacugcuauuucuccugccuuaaagagugggggaaguaaauugaaaauuuauaugugggagggcaaguucugaaaguaaacaugguucuuuuggucuggucuucugaccuuaaggaagcaagaguugguaaacugcaaguauuuccucuucuacacugcuguguaaacccaacuuuugccaagccaacauaccagcaugucauuaggaugugaauaauguguguguuuaguuuaagucccuggcccuuuuguucuggcaaguacugaaaauguucucauuuccuaagugugaguccugcagaguacagacuagccaguccacaaguguagccuagcuucagcuaucucuaaugugugccuuuugcaaguacaugucugagaccagagagaucauucaucauuggucuggacuguaguagcauaaacauaaggaggcaguccaguuccuggcuacuuguuucaguggugcacgcauauauauuuucuuacaaucuacacuaggcuucugauucuaccaauacagcuugaauggguuguuuuucuucuuugcaucucaugggauacucugauuacaggacauagcauuguuggguucgccauguacuauuuuaccuaugacccauggauuggcaaguugcuguaucuugaagacuucuucgugaugagugauuacagagguacaguugacuuugggauuggagguaguuuaaggagaaaucagagcucuuuggccuuaaaaugacuuaaguagaauuguauuucuuuccuuuaggcuuugguauaggaucagaaauuuugaagaaucuaagccagguauguucacuagcauuucacugcauagagcccaggcuggccugguccuccuaugagcccuggcuggccucaagcucuucuucaucugccuagugcuggggauuagagcugugaccagauguccuagauuugggcuucugcauuuguaagaguuacgggguuaguguaaugagugaaucaagguugggucuugguaagagggugaaauguucucucuggcuuauacuagguugccaugaagugucgcugcagcaguaugcacuucuugguagcagaauggaaugaaccaucuaucaacuucuacaaaagaagaggugcuucggaucuguccagugaagagggauggaggcucuucaagauugacaaagaguacuugcuaaaaauggcagcagaggagugaggcgugccgguguagacaaugacaaccuccauugugcuuuagaauaauucucagcuucccuugcuuucuaucuuguguguagugaaauaauagagcgagcacccauuccaaagcuuuauuaccagugacguuguugcauguuugaaauucggucuguuuaaaguggcagucauguaugugguuuggaggcagaauucuugaacaucuuuugaugaagaacaaggugguaugaucuuacuauauaagaaaaacaaaacuucauucuugugagucauuuaaauguguacaauguacacacugguacuuagaguuucuguuuugauucuuuuuuuuuuaaauaaacuacucuuugauuuaaauauucagccugag

SEQ ID NO: 9806 - RNA, 2157 nt, Mus musculus
gcauuuuaauauguccaaguugggugcuauuauguuggggucaggcaguguuucucaacgugacucgugaauaaaguucagcuaggaaugaauucacugaaaacaaacaaaaaagacagguuuugaaaugaacgcagucccuugccauguagccaagucuccucaaacggauccauucugaaauacuaugaagacuggucacagguuuucacaacugaaaauagcaaagggcauucuagaguguucgcaggaagcgggagcagccucucggcuaccguaaccagauagcaauaucacagaccggaaguacccacucuuagugaccguuacuucgccuccauugcugcugccgcuaaggaagacgagucuccucaucuccagcgucaggccaccguaccaaguauaucacagaccggaaguacccacucuuagugaccguuacuucgccuccauuacuguugcugcuaaggaaggugagucuccucaucuccagcgacaggccaccguaccaaguauaucacagaccggaaguacccacucuuagugacuguuacuucgccuccauuacuguugccgcuaaggaagacgagucuccucaucuccagcgucaggccacgguaccaguguuacuuggaccuuguuaauaagguacugguguuucuuggaccuuguaaauuuguuaaaauggccucaucuaaagccaagcccuugucuuuagaagacugccguugucuccuuuguauggaauuccucauugagcccauaacucugccuuguaaccacacaguuugcaaaucaugcuuuaaagcacuucuccggaaaacaaauuuauccugccccuucugccgcucuuugaucucuucaugggcucggcaccauauucauauaaacagucuuaucaauaaggaacuauggggaagacuucaaacucaguacccagaggaaugcagacauaggcucccuggggaagaacugagcacauuugucuucaacgaugauccuccaauucgagugcuaaguaauccgggggaauugaggaaagaguaugaagaggagaugauuaggauggaggccgagcgccaggccaucaaggaaagccaaaacagagccacugaggaauacauaaggcaauuacuggcacaggaauuggaggaggaaauaauacuggaagaaaagcgaagacuggaagaacagcagccaagaaaggaggaagaggcucaaaagggcugcacaagugauccagucagaucgccaagaaaaaaaaagugcaaacaaaagcacugugacaauguuccgaaguuuucccuuucucagccucagcuugagucagcauugcaguaugaaacugugcaguauggcaagaaaacucucuugucugucaggggacaagaaacgaaaacggaauuaaguaugccagcagcaacuacuuugucaacagguccugagaauccuaaacuaaguacuuuaagcucacgugacucaauuuuuuauagcuauggugcaaaaauaaguucagaagaugagacaucaaaaccaagcugcuccagugacaacucuuaugucccauuuaagagcauuaaaccugaagcuaccacucauucuucugcccagguagagaauauaagcaaugagucaggcauaauagaaggaauuggaaacugcacaacuaaggaaaaaggaaaaaugccccuuccuucgagcaguaaacauacuucuaaaagaaagcaccaggaaucagcaucugaagcagcagcuagcacuucuuauaaaacacccucuaaaucuuacuuggaugacaaggaaacacaaaaccccauugccagaaagcugauagacuuggagcaauuguauuauaagaagcaucuacaagaaaaacaagauagguuauuugcauuggagcuucaaagaacauuugaugaagaaacgugggaaaggagggcuaaaaagucccugcugaacuauccauuccacaaugaugccccgaguccagacaccucagugaaagaggauuccaaagauaagaacaccugaaagguaaagaaauauaaaauauuuaagauuuaaaucaaccaucuuuuaaaaagauucaguugaagcauuuagcuaaugucagugggagaaagaugccagauucuacuagagauuuacaaacauaaa

SEQ ID NO: 9807 - RNA, 16839 nt, Mus musculus
cagaucaccugaaggacagagagagaguaggugccagggaggugaccaaccuggucacucuccccagugggcuggugaguggucccugguaccaacugggacaucucaacuuagccuaagauaaaagagguguagggauauauauauauauauaucacucuuucccagcuuuuuaaacuaauuucaaacuuagagccacagcucagggccuccaauuuacuaggguuaguggcuauuuuacagccuccauggaucaccguugccguucacguggcaugagccacagucgagucucuggaucucauauccgaacucccagggucccacuuccguuccauguugagcaggaggcuagggaaggagaagaaugggaacgagagcuaccucgucagaggccuaucaucuacggaccuccagaaagcgaagaguuacaggaaacuguaaugaguaagcauauucuccgaggggcggggggagggggcuucugggaacugaaauauccuggacauaugcuuuaagacugagugagcucugcugcauccugaccuguggcaccgcauuugguuuuaaaacauacauaccugggacacacuuaagucaccaaaccgcccgcuuacccuauaauuccuacuggaagagaaaggcuagccaggagauaccacuuuucagauuagacccuuuuaucucuugaguuuucaccaaacugaaaaagacuaugucuagagagagaagucacggaguuuaguaauagaucgcuguaaggaaaagaauauuguucuaauagucauaaaguauaugucaauuaagcuuugggaaaguaugguuugaagggauuaacggaucgaacguguagaggaagggagagcagacauaauaacgguccauagucagagguuuuauauucaagaugggauuagggagcucgaaagaugacucagaaguuaagagcacuggacgcucuuccagaggacaaagguuugauuuccagcacccucguggcagcucucaauugucuguaacuucuguuccaggggaucuuucaauguccuccccuggcuuuuaugaauagcaggcacacaagcagugaacagacauauagacaaaaaaaauuuaaauaguaauuuuucaaaacaggaugaacaggguguaaaucaguuaugguuuggaguucaugaaggcagcacuagggcugagggagcagacaggugacgucacaauucagucugacaagcuaaagugggacugagccccuaggcgcuggggcaauaacucaagggcggcugggcaugcccuaguguaucauagguaggagaggcaaggcagcagaggaagagggcucgauggguaauggguaguuaugcugugcuaugaggggugacuacgaacuuuacagcucuugacuggaaaagcaaaucuuugaagcaaaauuaauucccccaaacuucuuuuugccuguuggaggaaaauaaaugguuagcuauuugcucucaaguuuuucugggacugaaaagagcugaaaagaugaguccuggcacuguacaggcaaaucacuccggagguucaggggacacauacaugucuguuaaguucagcaauuuuguaguguccauggccuaacccacccacccccugcccccagccuccuaaaccuagaguaaucaacaggccaaauauagucaaccaguauauuucaaaauaacuguuuuggguguuuccccauaaaaagguaaaugaguuggugacuacauuccauguuauauucauucagauggugcccuguaagugcauacaaguaugaucugucaaaaacaaaaacaaaaugagaugcaugaaagugaccuuaauuagaaguauaaauugugguggcacacgccuuuaauccccagcacucagggaggcagggauaaguagaucucugcuuggucuacagagcaaguuccagggcagccagggcuacacagagaaacccugucucaaaauaaccacgaaaagucuacauuuuaaguccuucacaggcacauagguuagugugaacuugugaggggaugaugugagggguagggaagcucuguuacagagauggacuuggaaguacaccuucaaggacagggacagucagugcucuggagaucagucacuaggcacccgugcaaacuucuuuuguuaaauugggaaaacacuucagcuuggcucuccuuuugacgcaggcgcagaagcccacuggggggggcggagcuugcgcccacguggcggaggggcggaguggggcggagcaagucucgcgaggccgcgcccuuggucgcgcggucuccagcgcgccguuuuagcuggcugccuggcggcaggggacucugugcuuuagcagagggacguguuuucgcgcuugcuuggucauggaggcgcgguccaagcugcuggacgggaccacggcgucccgucgcuggacccgaaagcugguguugcuccugccgccgcugcugcuguuccuguugcggaccgaaucucugcaaggcuuggagagugaugaacgguuccggacccgcgaaaaugagugccacuucuacgcugguggacaaguguaccccggggaggcgucccggguuucagucgcggaucacucccugcaucuaagcaaagccaagaguagguggugccuugcgaguuuggguggaggagguagaacucgaggaaucuuagacccuaauuguggaugcuacaaaaggguggggcuggaguugggccgcaccccccccccaaggcugccugggaguucucgguccaccccaugccuuugugggugugagguuggagguggguuccuggugugaagaaagaaauggguuucucugaacagauuucgggagagguagcgguuacccccaaagccgcagauggggguguuucuagacccgggcuuacagucguggaggauguugugcaaacuaaaauacuuccuuacauauucgaaagugccugcagccguccuaucucuuuuuuccagggaagaaaguacauugauaaguugaauaaugauucacagaaaguuugguuaaacagaaaagugguuaaacaaaauggucaggaggucaaacuuuuuuucucuuagcuuauaaagauuguuauugagagucaucuccccaaacuuuguagaguuaauagauguuuauuuaaaaaaaaaaaaacaagucuuauggaguauuuuggagggaaacuggggaagaggcggaagaggcacaguuggguuggugguaaaucuuguguacugccaauugggcuuuucauuauuugucuuucugucuaguguuugaagcuaguggccacucucagaaaaagacacgucagacuaagaagauagugagaaaauugaggccugcugcaucuggauauuaagauugccaaaaaagugaucaggggacacagacacagaccauauauuauuugcuuuucccuaacccacuuuuccuagggauuauuuggcauucugugaguguguguuugaguuuuggugguuguggcacauucugugcuaguauucagugaaacaauaguuauacuuaacauuuuggggucaauuuuuuggacauggggacuggacagaucugacaaaauggcuucaaauucuguaguccuccuccuucagcuugcagagugcuggauuccaauugugcucuaccacaucuggcuacuucacaguuaugaaccucuaaagauaaugggauguugcuaccacaagccauaaaugaaaaagccaagccgauuugccuccguaaacauuuguaguuucauaguacaaguuaacuacuuuggaauuggaagauagauuugcuuuaaaaauauuucuaaguuucauugacuacacuugcaugaggaagauauucugaaaugugcuuacucaaauacacuuccuguuagaaacaaaaacauuccaaaggagauuuuuguauucauaaaaggggauauuguagaacaauuaaggcuauuuuugaaucauucuaauaaaaugaaaaauauuauaauacauuuuucucaaugcaaugaguguuaaaaaugagaaugcaaccuuauccauauuuguguuugggaaaaaaugguuguaguuugagagacagaacauguaaauugucuuccuuuacuucucuguauuuaccagaauucuuauuaucaggguuggguuuguuuguuuguuuuuuguuuuuguuuuuguuuuuugagacagguuuucucuguauagcccuggcuguccuggaacucacuuuguagaccaggcuggccucgaacucagaaauccaccugccucugccuccugagugcugggaucaaaggcgugcgccaccacgcccggcauaaucaggguuguuaaggaugugcuaagcguguuaggaaguguugcuugcucuguugagacaggguuucacuaccagguagcccuggcuguccuggaacucucuauguagaccaaucuggccucgaacucauagagacacaccugccaccucuuuaauuccuccugaaugauggaauuaaaggcaugcaucaccacauuuuaaaaaguagaugcaaagggcugcuuugagaauuguguuuaaagaucuuagcaaaguaacuacaauuuuucaaucaaaaauaaaaauuugcaauaaucaauuuucaggauaagauuuuuccugacaugguuuucaguauauguaaaaucuuuaaguagugucauaacaagucauuacaguuauuauaaccuccuauuuaagcauuugaaguauuguauauuuuagcacauuucuaauuuucucaucuggccuuuuuuucuuaacaaauuuugauuauuuagguaguuuugacucaagguaagaaaucacauguuauagauuaacuucaggaaaauucguccucaguuugucucuguagugugauuuauugcuggcuuuuacacaaaagaaugagcguugauuuuuagaaaccuuaguccaacuuggaagcaaguauugaucucauuauauguaauggguuuggaaguguuauaugacuguaucaauagcaagaguggacauaauuaucaaacggugcuggcuagagucacagcaugcccuuauaagacagcagcacuauuaaauugacaucaggucacucgaaaccuguucaugguuggggcgaugucuccuuuuucacagccuucuagggaaacucccaugaucugggauaauuugaagaagcuagagugaaauauccaguccgguucagugcagggauaagauuuaagacuuugugggaugggcagagacauauuucacauuuuauucugucuaauguuuguuaauacaguaaccauaaaaaauucuauauaaaaaguauuuucacuguuuccuccuauuacagauaugugcaauaacucacacucgcuccagaaguacuugauuguaccuguugccccugcauugcagagacuuucgugcuguguaauagcuauugcaggaauccugacaaugauaucuuacagacuuauacgaucacuccuacaucuugcaccuugauggugcugugacuaaacacacauuauuacuccaucacuaacuuuuaaaauguuuauacucacauuucuguguaauugguuuccuuuguaauucuuuguaucuuuuuauucucugacaauaaguuauuguucuaaguucucagaagucugugagcuuccagacuuccaaugaaguucaaagauuuagaagucccaauuuuuaguguuuuucuaaaacaguccuuggccauuccaacaacuuucucaguguuauagacccuuguuuuucuuucuuagucuccaagccagcaccuuauugggaaggaacagcugugauuaacggagaauucaaggagcucaaacugacugacuaucgugggaaauacuugguuuuuuucuucuacccacuggauuuguaaguaauacauacgcacaaguagcuacuaauaaagugccagucuuugucauuuguuauccaagagccacaaauaaguuuuucagaugaugguucuuaauaaggcaagcugagagaaggaagauaauaucugcuacauauuugauucacaaagacaagaaaauaaacuaguaauauuuuagcaaauaguuaauguaagaguuaauacauaauucuacuuacuguaaagaucuugcuauuuuuauuuucuauguugcuuuccugagacuugagcauuuuaauauuaauauauuugauauauuaauauuauauauuaauauuauauauuacauggaauauauacaaaauacuuuuugauugugggguucaguucugagagcauuauuuggacaaucauaaagucaacucacuguaaauuuccuuauagcuuuauucacauugaggaguuuauuuugaaaaauauaauucugacaagaaugaaauucuugacaagaguaaacagaacucccccucaaaagaauuaguuaucucaaccucuuauauucucuccuauuugaauuuuuagggaguuauauaaaguaacuaaaagaucccucuaucuuugacagcauaccuuuguccaguaagaugaaucuagaacucugggggugagaauuaaguucauucuguacacuguaagccaagacuuaagauuuucccuguaggacaaagaacaggaagucauuuuaagccuguuauuccgugcuuggagcuauagauaaaauauacaugcacgauuguugccuugcagcagagaaauuucaccaaauaaggacaggcuuuggccaguagaacaaaguuucccaacccucucguacaaagccaaguggaaagaauucuaauaaaaauuaagacauuaaagccaaagcaaguuaccuuucgaaucaguuuauacucuggcuccauuaacuaaaugaauaaguuaacuucuaguggaaaccagaaguagaaaucuugagauaauaagaaagggggaagaaucuaaucauuagcccuuuuagaaaauacuaaaggauguaacauaguccagguuaccaaagauaguuagaacuguugguuuuuacaucacagugcugugcuugaacagcugaguuauuuuuaaauccauuauugggcucaagugggaacuuguccuuuaagacuguguuuuucacaguuuugagccauaacccauaaauuaagaaucacauauuuuaugucacacaauacacaggguaacauucagucugugcacaagcacaaccaugcuugauguuaaaauagugaaaagcuuccauauaaagugguaaaauaaccacuuuucccacauaacuuuccaauuugacuuucccaauggauccuuucugaaaauuugagaucuaaaucuaaccucaaguuaagauugaauaacacuacugcacacaaacauguguacacacacacauauauauguacacacauaucuaauaaauaacucuacccuauguaugauguauuauuauaguuuauauuuuaauacugguuucagcuuacuaaauuaguuuaacuguaguuugaaaaaauacuacucaggagugcgagagauggcucagugguuaagagcacugacuguguuuucagaagaucaagguuuaauucccaacauccacauagccuuucacaacccucuguaacuccaguuucagaugacugaaacucugcuuccacaaacaucaagcucacacauguuacacagacauacaugcaggcaaagcacucauaaacauaaaauaauaauaaaacuucaaaaacuacuacccagaguaauauccccucaaccugccauucugauaaaaauuauauauuaugcugggcaguauuuuaugugaggcuggaauacaauguggaagaguaccuauccagaaccaggagguaggacuaaagaauauugccuuaucaguaacauaaauguagaggcuagcccauaggaauaagaaaaauaaguagcaagaugauauagaaggcauuguuuagaucccuugaaaucucuaaaacucugaacuacagaauauuaaaagcucgugaaaugggggcgcugcugcaaggaagaaggaaacauuggccacucccugaucaguagaauuaucagaagaaucuguugaaaugcaauagacaacucaacauuucuuucgaauauuuaguuaaauagccuuagaaugucacuuggagaaaacucaucucucaguuguucuuaaggugugucucuguaugcucagugucuguaauaaacaaaagcguguuugaaaguucauucagguauacgcuuauuuugagaauacugacuuguuuucuuuuucuacauuuuuagcaccuuuguguguccaacugaaaucaucgcuuuuggggaucgaauugaagaauucaaaucuauaaauacugaagugguagcaugcucuguugacucucaguuuacccacuuggccuggucaguguuuugucuuaaaacugggauaaaaugaauagauuugcuucucagucuuguuuagauagcucuuaacaugguaauauuauaguaaguauaauuauauauuggguguccuuaaugugaugaaaaaguaaaacauuccauuuucuguuauauaguaaucaguguguucaaauucauuaguuuuuauaguuuuuaaaacaguaaauuuuuaaaaauuaauuuuagacuggcauggcucaaacagaaggaucucugagaucaaggcuaguucaggcuacaaagugagaucccgucucaaaacacaaaaccaaaaauuuaguucugguaaaaauagauuaucgggcuggagagauggcucagcaguuaagagcacuggcuacucuuccagagguccugaguucaauucccagcaaccacaugguggcucacaaccaucuguaaugggauccgaugcccucuucugguguuucugaagaaagcaacaguguacucacacacaugaaauaaauaaaucauauauauauauaauuaugagaugauguuucccuuaucaaucugcaaagaaaguacaaguuaaaaagggaagacaugucauuucuccaugucuggcuguccaaaacuaaaaaacucaguguugcuaaggguguaaaggaaugacacuccaacauaguagagauuuuagcaauucuggagaacagcuugguaacaugucucaaaaucggaagucuaugaagguauaugaguuuucaauaauggcagcaguuuugugcuggauuuuuauauagugaagaucauugagaauucuuuggauuuuaaaaugcaauguucaguuuauuaaacuuauaaauacaaaacagguguuuuugauaaacacauuaaaaauuuuaaguauauguaacaaagcccaguugguugucgaucuauaauuauaaguaacaaauaaguccugauuauuaauagaugaauauuaaaucuauauucucauuuguuuuaccauuuuuguaaugauuauaaauccuucuaggauuaacaguuagcaugccaacuaagaauaaaguuauaccauuccaaauaauuuagaugugcucuucuaagagaaucuggagcuauauuaucaacuaggaauguuuuauacuaguacuagccaagguuucuauuaaguaccagaacuggggcugcaaccccccugaucaguauuuccgguuuuguuuaguuucugcugccauguuaguacccucccaugggguaacagcccacaaguguugucauuuuagguuacagacacuuaaaucagaggacugauggaucugaggucaugacuaaguucucacugcuucaaauggaguuuauuuuuuggccuugcagagcagugcaaggucuucucugucaagcaccuuagcugucuuccaagguuuugucucgugauccauucuaagacuuaagccauauccuuuuauuauaaugagauccaguauuaucuauaauuuauguguguuuaaaaaacccgcaaucugucugggcauaaugaucccugucuucagucccagcacuggggaagcagaggugaauagaucucugggaguuggagguuagcuuguucuccuaauuaucucuuuaaucugucaggucuacuucuagaaguuaacagagauguauacaaaaauaagaauauaggauacuuccagcaguauucauaaaagaaaaaugcaauagguuuccugccuaucaguagagaucaguaaaauaugguauuucauacauguuacccagugaggaaaaaggcacaaaaauaguacaguagccuguuuuuguuuggggguggguauauguauaguuguauuuguguacuuuuauauguagaaagaguugacuuuuaauauaugccauuuacuuaucacugagaggugaaguguucugucuauuacaggauuaauaccccucgaagacaaggaggacuggggccaauaaggauuccacuucuuucugaccugaaccaucagaucucaaaggacuaugguguauaccuugaagacucaggacauacucuuagguacccuucagugguuaacauuuugaaaacuccuaaaacauuuauaauucuccuagaaauagguguugcuuaggaguucaaagauagauauuuugauauuuauauauauuauuuugcucuauuugcaggaauagauugccuuuaaacugucgauguccuauuuaaacuaaaccagaguugcacauuguuagagcuggaggccuuucacaaccucucuauuuauagauaaaagaaacagauguguggguuucuauaaauuuagucacaguuauagaauaaguuaauagcaaagagcagacuguaucuuggucuccuaacuacuuagagcaccguuccuuuuuuucugaaccggcuccaguaauguuuuucuaaugcauaguuaggacuucacaaacccauaucuuuggagagacuaaggcacuauuucacucagcacccuuuuuagcauuuuugguuuuuuugagacaguguaucuaucccuggcccgccucaaacucucccaacagcucccagcuuuaccaguagcuuucaguggauuacaugagcaaauguguacaaaagagaguucuuugaucaaaaaggacaguuuuaaccuuuaaaaguuguuaaacacugaccaauuaauaguaccuaauaaugaauuggccauuuuauuuuuauuaauuucuuuuuuuuuuuugagauaagaucucuuaguccaggcuggccuugaaguugaacuacauagagaaaggaugaccuugaauacuuaauuguccucccuuugcuccccaaauauugcuauuauuuaaacucagaugcaaggauuuuuuccccuucagagagaaggucuguuuguugcuuucuaaggcagucuacguguagccuuggcuagccuggaacuggcugacuucuaacucaaaaagcucuauuugccuuuguuucccuggagcugggauuaaagacaugggucaccagauagauuaagagguuuuuguuguuguuuuuguuguuuucuaaacacacauuaauuauacguaauacuguguuccauuauaauaucuucauacauguauauaaugaaugcaucuugaucauauuaaauuccccauuauauauucuugucccacuccugcugacucucuccuaauuaguccuacuuguguguguguguguguguguguguguguguguguguguguguccuagugaauuuaaguaggauuaauagaaacauggaauccuuaccagcgguucaagaaaauguauuccauccccccaaacaaccauuaacugccuguagauacacaaggagggguuaagcacuuccauugcccucuuauaaaucugaaggauggaaggaaccccuccuccccaaacauuuuuuaaauuagauguauauaggcaugucuguguguggauagauaugcacauugagugguggugccuucacagagagccaucagauacucagagguagaguuaccgacaguugugagcugucugaagugggugcugggaagacuuguguccuccggaagagcagugcaugcucuuaacuacugaguaaucucuccaguuccccaaaacaaacuuuucaaacuuccauuuaacacugugauaauucaaaaguauacaguagauggagaauuggaguguaugaggcaauagaguagguaugcugcugauagcagaauacuuaacugagaagaaaugggaugaaccuuaccaccccugugcuucacagaggccucuuuauuaucgaugacaaaggaguccugaggcagauuacucugaaugaccuuccugucggaagaucaguggacgagacacugcguuugguucaagccuuccaguacacugacaagcauggagaagguaccuuuuuuuauuuaaaaauauuguacauauuuauaaugaauuuugcuccuuuuaaccgcuugucacccucucuuaucugcuucuaccaaaauucuuuuccuuccuuccuaccaagcucccuuuuacuuuuguguuuuuauuggugacccacugagcuuaauuaggguugcuuguaugaggugacuagaaguaggguuauuuacuaggccauggauagccuaucaguaccuguaccacugaagaguaugacacuuucucccccauuaaauguuucagugagggguggagucuaugcaucccuccccuuauccaugauaggauguugauaggcccagucuugugcagguaaccauaccugcuaugaucaugaguacaacucuugcguugugcccagaagguaucguuuccuaauaucccuccucauucucugguucuuaacacuguuucugucugucuuccaagguguucucugagccuuggaggagugauaaagauguugucuuuagggccagguacuuagcagucacuuauucucaucauuuuguccaguuaugaaucuguuaauuaacugccaccuacugcaaaguagcuuuucaggcugaaaacagcacugucuacguguauaaacaugaaacauuguuagaaggcaguuugacaucauguccauggagcaaaccaacgguaauaagaucaaucccucauaaggucugugaccugcccaucuuuuuugcuuuuuaauuuuuauuucugugugugucaggcagggaauaauuuuuucuugauuuaacacaaaaauaccuuauuaaaccauaacccauaaccuuuccuuuauucucccuccccuaaaucucacauuagcaacuuaauaucacacugaguugcagucuuuaaaauuuccauacuuuaacuaacaguccagguuaucuuuucgaucucaggguuuuuuuaagugaaaugaaaaauagacuugauuaauauuuauugcagauucuaccucuugaauucucagaggagaaauuuuucggagcacuuuuuacuccuuuaaguaagucagccugcuaaaaauacucuuggauuuuuuuuuaacacaacuagagccuugagaacuaacacaaggaaaaucuaucucagaagaaaaauguaaaauacauucaacccacccaauacaaaaaucagugcuguguuuuuaaaaguucagaaaaauaaggaaucaaaauuaaacaguaagcaaucaugcuaucuuuguaaauauauuucucauuucucugcuuaauaauuuugaucuaauaaucccaaaauauuuucauauauaaaacauuacucuguaccccugaaauguauaauuuggcuaaauuugagaguauauaaaauauaacucagucccuggcucagcacauucuaaaagucuguugauaaacaggauaccuuggcaguaccacaaaauauagcaggauauaagccagauaaucuuacuggccauguauauaaauuuagaggaaguuuuccaucacauaggcuuuuuaguuuaccagauccccauaucuuccaauuucauuauaaauauccauuuuauuuuucauauuauaacuguaaguaaaguauaauugauaaaaauuaaaauagauaaauggccuucuaauaaacucuauaaauaaaauucuuuaguguuagcagacaagcaaacagaagccaagugcuugauagucuggacauguuuaauguguuuuuucuuucuguggaaaaaaguuggggaguuacuaaagaaaauuaaacuguuuuuaaauuccuuuuuucucccuuuucuuucuuuuagucugcccugcuggcuggaaaccugguagugaaacaguaagucauauuaauauuguuauuuguuuuaaaggcauggccagagccaaaaauguaugccaacuuuaauguaaucuuucuuuauaaucugacugcccuguguuccaaagugaaguaauucuugcuaagcagaaaguauacugcagauauuuucuggacuacuggaaaagucauuuaaaucggggaagucagaauuuagauaauauuauaaauuuuaaagcugauaauccagagaaauauacugucaacaaaaaggagagaccaagaaggcaaaguaaagcuaugggagacuaaacuuagaggauguauauggaguuuccuccuauaguuugagccaagaaaucagccccaagcaaaaccucucugcguaguaaaaagcuucugagaaaaucugguuuuauuaaacccugaagcuaaagaaaaagagucaaagagaugcauuuucuuacuuagggauacuguuacuguuuauaagcaauccucugaguagccuuuggccagaauauaauuuuggaaacuugcuugaaacuuucuuaaacaucuaaaacuucagauauuuuaucuucugaaaaucaaacaguaguuggaaaaaauauuggauggaaggaaaaaauuaucuuaaaauaaaaauaccacuaggcaaagacaggcagggggguucacucugcuccuucagaugcguccccuuuucucuuuagaacguggguccugccuuuguauguuugugugacaggaggcucugcaugucaccauguguguuuguggagucugcuccccuuucaccuuuaugugggcccacgguucgucagacuuguauggcaagggcauuuacucacugagccaucuugccauccccuuugauguucuuucuuuaguggucucuguccuuucacucauuucacuuuagauguaaucugagaagucuucccacagugcuuuauacuguccccauucaguaucccaucaaccugaguuuguugguuuguuauugguuuggggguuuuguuuguuuguuuuugguuuuuauuccuuuuguuuuuuugagacaggguuucucuguguauccauggagcucacucuguagacaagucugaucuagaacucaccaaaguccaccugacccugacucccaaaugcuagaauuaaaggcaugcaaagcugccaccaccuggccggcccaucaaccuguuauuagaagcauuuaccauagucaaaaagugacagaauuuaagucugaagacauggggcaugcguuauuuaguucauuaaugcauauugucuggcuaaugucauauagcaauguguguugaaagaaggaccaaaccccaaaacacauggaauuauuuuugucaauuaaaaauugaguauauuauauguuaauacguguacauauuuuucugaaaaauccaugguuuucaccagauucuuaaaguuuaugucucauaaauagguagcauuuucugaauauaaauauauauauaauauauauacuauaaacuaaucuuauguaaauuuaucauuuaaaauagcuacugcucaagauaccuuuaaugcaguaacuucauguccccaugauccuuggaguuuuuuuuccuuuugaguauucauccacuaaauuuuuauuuaccuguguugccauuugcacuuuucagcuggagauuauauaauauugugcuguuagccagucuuagugauauaaacccauaaucccaguuauuugggaggcuaaggaaggaagaucaaaaguucauggccugccuaagcuauacaugaguucaaaacuaggagagaaaauacagcaaggucccaauucaaaaaugaaaacccucaagcagagcuuuagcuacagcucagugagaaugcuccuguuuaacaacugaagggccuaggguucguuuccccccccccccaguacuccaaauaccucugaaaaucccuuugauaaauccuuaguggacauacugcccucuucucagguuauuauuauagcaucauggaaucagcaaauaaauguuaaaauucgucugugguggugcuuucaauguguuuacuuauaucaggcucaaaugugccaugaaagcuugguggucaagagaaagauuuuuuuuaagguuuguuuguuuguuuguuuauguaauauaugugaguacauuguugcugucuacagacacaccagaagagggcaucgaucccauuacagaugguugugagccaccaugugguugcugggaauugaacucaggaccuuuggaagagcagacucggugcucuuaaccacugagccaucucuccagcccaagagauauuuuauaaguaaauuuuguagguaaauguuguguugcuuggguacagaugauguuaauucauugagaaauauauuugcuuuuuggaauagcugagauuaguagaugggcaaauguagcuuuuccuaaccaguauacagucugauaugguauacaacaaucaaugguuacaucuuuagucaagaagguggcaauuaaugccaagcuauucauaaugggccuugucuuuuuaaaaaugaauaauuugcuuuuuguuuuaacagauaaucccagauccagcuggaaaacugaaguauuucgacaagcuaaacugaaaaguacuucaguuaugauguuuggaccuucucaauaaaggucauuguguuauuaccauau

SEQ ID NO: 9808 - RNA, 575 nt, Mus musculus
gcccgcgccgagcgugcgccucgcccuccucccgcgcccgcucugcucuaggaugcugcggcagguucugcacaggggcuugaggacguguuucucccggcuuggccacuucauugccagucacccggucuucuuugcuucggcgccggugcucaucuccauccugcucggcgccagcuucagccgcuaccaggucgaagagagcguggagcaccugcuggcgccccagcacagccuagccaagaucgagcgcaaccuagucaacagccucuucccggucaaccgcuccaagcaccggcucuacucggaccugcagaccccugggcgcuacggccgggucauugucaccuccuaccagaaagccaacaugcuagaccaacaucacacggaccugaucuuaaaggugagaccagggcggguucuggcagccccuggcgccgcggcugcucuggcugugcugguuccgcgcggggucccggcucagaagccaccucuagugucccgggcaguggcucccacgggggcuccucugcacugcgcgccccuaggcagcaaccuagagucucagagucucg

SEQ ID NO: 9809 - RNA, 965 nt, Mus musculus
acgugagcaguuugaaugcuucauagacuugggcuuccuuuacaccaccuccaagguccaagaaguucgcuggcuucccuccguucaggaagaugaugucgcagguagccauggccagcccagcaccauucacgaagcaggugauguucccguccaguccuauauacuugagaucguaucuggcagcuucauuuucaaugggcucauucucggauuugucguccauagcaaauauguccuuuugucggaacucagcauugucaucaaaguuuaucuuggcaucaaaacagacaacuuguccuucuggaguuucaccgaagggguucacuuccaccugaguggcaucaaucuucaggaagagaugguacagcuuuuuaaucugaucugcagccugguuuuucagagacccaaggaagcccagauuuucugccaugcgcugggccuggcuauccuuuaucccuucaaagaugucaaucugcuccuuaaagaugaguucuggacuggaaacugccacuuccucaauaucaacgccccccugaggacuucccacuaucacagggccauuaugggaccgguccauuagaauggccaaguacguuucucuagaaauauccagggcuucagcaaccaucaccuuguuaacuuucacaccuucuuuuggaguuuguuuuguugcuagauuauaaccaaucaucuguugagccaacucucccacuacuuuagggucuuuuguuaaaugaaccccuccuuucaaaccgcuauugaagacaccuuuuccucuuccuccagcuaagaucugggcuuuuaaaacaauuucuuuugcauucaaucucuuggcugccuccagagccucuuuagcaguguuggcaacaaagaaccucugcacucucacuccgugcucugacaugagcuucuugcucugguacuccugcagguucagccaucuucgggggguuaagugaccu

SEQ ID NO: 9810 - RNA, 2657 nt, Mus musculus
ugaggacccuucauacaaauuuccguaguggcugccucaguuuacacuccucuuuuuucaguuuauucccaccaacaguguggaagggucaucccacaucucccuuccccacacucaucaguggaaagggaauggaagaugagaggguaaugaggggugacaguauugaaauuacauuuuacauacauauauggaaaugugacaagaaaccccaaaccaaaagcacuccgggcacacacugcaguuaugccaugcgacaccagcuccugcaaagacuuuuccugggauguaggguguguaaguaguuuuaagcagaagcucuugacccaaaguguuggccugaauccugacucuggucagaccuuggccauuugugugugcauccaugggggaggaaugacagcagaacuucuguccagauuuguucacuccagugacauaaucuauguaucaguuggugcuuggcacaaaguaauugcucagggauuaucuuuuguuaucauuagcaaguaucagaucuuaaaauauaccauaaaucaagcauuagaauccaaagaauaacauucacaaaguccuaagauuucacaaucacuaaccuguuauuuucauuccucccaaaugcccagucuuuuuccuuuaguuucuccacaacaccaaguuagaagauaacuaaaugaaggcaguaagauggaugguagaugcucuugacugucuaggaagggcuccuuuaagggagagcagggcagucuaccauuuguacgauaaaauugguuaagguuagauauuuguauuacaaagcugugugagcucuuagaaacucaagaucaugcccugcugacuugcacguuaucugggguuggcgggcuuaguguuagugcucaauaacauggaucuggggaggggacaggggagguggguuggggacuaaaaggaguagggaggaggaggggaggcugcuguugggauguauuaaaauauagaugauaggucuaaagauuugccuauuuaagauccaguaacuggcuuaguaggcaguucaagcuaacagaguaaugggcaguuuguuucaguugguaaaggaaaggaacaacuaaaugaguagauagauggcuuucucuuugcuggaacaaaggcauuuaaucaagccuaaaugccaaagcuuucaaacuuuagaugaugaauguaaacgucuucauggaaaaaacaguuugcuacaauaacauuacuggggaaauagcaauggagaagcgcuguacagaacuauccucuaagccaagcaacugcuugcugucuuugggaguucagaguuaguagaaaucauuccgacuguguuuguugcacuuccucauagaggaaaaugaccggucaugagacccgcauugaguaucagcaccucccuacuugugugcagcacugcccuaaguacacauggccucagggaaggccuagacuauauagguuggggaaccuagacgaggaagguucauugaugugguuauuggaaagccaucauuccugauguguggagaauuuccaguguggcuuuuugcauugggggagcaccaacauucuauacggcaaggaggcccaauaaauucauuagauccucagagugaacucuaauggaauuguccuugguuugucauuggaaccuuaggaggaaggguagauguuuauguucccuccccugggaagaaaauuuagcaacaagaaguuagggaauauucauaccucacaugaaaagcugauaaauccuagauauggucacagcaauugauuagacaugacagacugaguagucagcgucagagacccuccuuuccccacuuccccagcacugggauucuucagugccaacuuaacaacuauuuucauugguucuuugugaacuucacaucauucaucccaguuccacucaucucccaccuucauacuugccccccacccuugcaaccuccuccccaacaggaaaaacaucuuguggaaacuguagugugucacuguuccucucacacuauauccuuuuucccacacuucuuugcuugcaaauguccauuacaaugacuugguuugguacuaagccucuggcuucugcuauacuagaaauacuggauccucacugggacuccuccgggauauccuguaguuuuggauauguagguccagaaccuucacacacucuagcaguucaucgaugggauagauguugggauggccaauuuauagcccuggaucugggccugauagguaucagagcugcaccaauucuccuguaucuacaccaucaggacaagcucuccuacccugccccagcuggacugugcaaugccacugcuagcaaggggcaggaccaacucuccuacgugccauaggugucaaggggugagggcacgggcacaucucaccuucaccccugucacuacaaggcagacaaguagcagggccagcucuccuacgcucaaccuggaggccagcucaccuccaacccccacagccagggcuugcucuacugugcugaccagguaaggcguagggccuguucuccugucugcuguaggugucaaggggcaaaaggggacaucucucucuugccuauguuaccacagcagacaaguggcaggaccaucucgccugugucccugcuaucaggaucaccu

SEQ ID NO: 9811 - RNA, 84378 nt, Mus musculus
ggcgagcccgggcagagggaggccggcgcgcaaggugggaggccgcgugcgcaugcggacccgcgcggggccggugcgacacagcgggcgggccagacagugcgccugugcagcccgcgcaucccgauggagcgcagcggugggaacggcggcggcggcgguggcggcggcggcggcggcggcggguacggcggcagcgguggcgguggcggaggagccggaguccccucggaaggggcugccaagggcuugucgcugcugcuggccaaguccgcggaagcggccuccgggagagccucccaguccaccccgcgguccgcagguaagggccggggagcacugggcaggccgcgcugaggacccccggggggggcggggcggccaagggcugucgcccggucgcccuuuccgggggccuaggucaaccugcccugggggacuucaggcugcgucucucuuucggcagguggcgggguccccucgggcuuggcguguuugcgugggcgaguuugugggggguggcuggagagcggaggagcggguauccuuggccacggcuguccccgagguauggcucggcaccggaggaggggguuccgggauggcgacccugugggugcgggggcccgcugagguguuuggacuacagggauugcggcuggcucgcugccucgcuggcucccacccuccauccuaaggcgcgcagacggggaagccacagccagccaccaagguggcccagcuuugcgguuuacuuggccucucgggguugggaaaauaaugucgcaucgcccgcgggggcagcgacgguucauaaagggagcagggccacacgcgacugcugagacgacgaccccucccccccccugaagucgcugagguagugguuucccuacuggggcgucuggccccugccgcugcccuuucugguacgugacugcguggcgauugaguguucuagcccacgggacugcagcugagagcugucgccaagggguguggggaugugggucccuguuccuucugcccaaggggacggaacauggugaggacgcugggaagaacgugauaagcgccugcgucuucugguucuggggcuaaccuucuguguacuugcagguggugcggagguauacgcagugaggaaaagcauuucauuccaauuuuccuggcgacauuuuuuuuaaauguuaauaaugagaacuaauucuauauuccaucuuucauugcaguuuaacauucgaacgaaaagaaaaaaauaaacccucacacaauuuguagaauuugggaauuaucgcaucguggaguauuuccuauaugguggagggggaaagaggaaggacaucaacugaacgggcguguggguuguuuauguguuucuucguuuugagacaggaucuggcucuuuaccuuacguugaucuggauucccgugagccuucaagucagcaugaccagcuugaagaugcugccuuagucacuugaacaguucuuuuuguugggauagaggggacuaucuuacugaucugucuguugcaucauucauagaagggaaaggaaggcuaaauugauuucuaguuuguguucucguguguuauuaaaugcacaacuuaguaagacauuacaggauagugauaauaccugcccuuuaagucuagacuuauauuuucauuccuuuugcuugagaaaggccauaucugauaagaacccagaacccacacaucggagucugcucucugugguaaaggggauuccaugcaguaaaacauuagauguuuuuugaguuuacauuuuuguuugguggggauuugaaauaauagauuauuuugauguuucuugugguagagaaagggcuguauugucggauguccaguuuaucugggauuuuaauuaacuugaaggaauuuagggggcaguucuuuuuccuauugcucaguugcaauguggacacuaguuuuauuuuggaauuccuaaaauaauucuagguuuuaaauauauagccuguuauaaccauuuagaggucauucuuaauaguugugugaaagaaaacggauuuuuuuaaacuuuauuucaacagggaugggauggagacagguuuaugugaugcuauauaacccauauugggcaugaauucauguucccguuucccaucaccagcauuucugacuaaaguuuuguuuuucuucuguguguauacuugugaguugcaguuuccuguggcuguguggggaugagcuuguagaguucacagguucaauuuaggucucauuccucaggcacuuuccauuugguuuuuuugaagcuaagucucugacuggcuuagaacucaggguuuuggucaugcuggcuugucaaggagccccaaggacccaccuuuuccaggcuccccagugcuagcuuacaagcacauucuaccauauugaacuuuuucauggggucugcgaucgagcuuaguacuugcauggcaaggacuuuacucacuaagcuuucuucccagucccauguuuaauguuuuaaagauuuauuuguucauguauuuuauguauaugagugcucugucuucucucaccccagaagaggcaucagaucccauuacagaugguugugagccaccaugugguugcugcgaauugaacucucgaagagcagucagugcucuuaacugcugagcucuuuuugguuuucgagacaggguuucuguguagccccggcugcccuggaacucacucuguagaucaggcuagccuugaacucagaucuuccugccucugccugccauaugcagggauuaaaggcgugcacccugaccacuuagucucauucuuaauuucuaacuuguguuuuuuaguuaguguacagaaaagcagguuccauuaugacauuucauauuccugaucacucucccuugucuuccucccaccucacuggucaccuucgcaaauaucccaguuuucauguucuuuacacggguaguuuugaaucuagguucuacauaugagggaaacuugauagucuucuucccccuaaggagggauucuucacuuucuuucccccuuuuccuuauccccauccccuucccuuuacuuucuauguagcccaacuuacuauguaaccuaggcuggccuugaauugagggggauaccuauugcuuuaguccucucaguguugggauuacaggcauguauacuacauauagcuuucugaaggggggcuggccuuuuuuuuuuaagauuuauuuauuuuauauguguacacuguagcugucuucagacacaccagaagaggguaucugaucccauuacagaugguugugagccaccauguacuugcugggaauugcacucaguaccucgggaagagcagucagugcucucaaccacugagccaucucuccagcccaaagaaaggggugggggggggucucguuuuguuuuguugugcuuuguuguguuguguuuuuguuuuucgagacaggguuucucugugaagcccuggcuguccuggaacucacucuagaucaggcuggccucgaacucagaaaccuaccuugccucugcuuccgaagugcugggauuaaaggcaugugccaccacugcccggcagggguggggggauuucuuaauuauacuuauuguagaaccauuuaaugaauggcucugauacuaaaauuaguuuuaaggaugaggauauggcucaguggguagagcuaguacacuuaagauuaccuacaggaaaaaauagaauuuuaguuguugcgcuauucacaauagcuaggauauggaaccagcuuagauauucauuaacagauuaguggaguuaggcauaguauauaccuguaaucuuaggagguagaggcaagaggucaguaguucaaagccacucugagcuauuuaacaagaaaaccuggacuauaagagacuacucuuucuuuaaaaaugaacaaaacaagaacauaaacuuugggugaauaaggagaacauacauacauacaguggcauuuuauucaacuauaaauuaaaaaugaaauuacauuuucagaaaauggguggagcuggaaagcacuauauuaggugaaguaaccuaaacucagacagguaccacauuccuccaagauucugggcuuagauuuaaauuuuacauauguguauaugugaguauggguacaagucauaaaaggggaaaaacuuaggaggagaagcagcagcaaagaaagcaauacaauagaugugacauggaagcagaaugagugcuaaugaguggagggagcucaacaaaacaguguaggagcuagagagaugguucggaaauuaggacauacugcucuugcgggggggggggggacuggagugcuauacaaucgccuuuaacuacaucuccaggaggucugacacccucuucuggugucuuuggguacuacacuuguacacaaauuccuacauauaacagaauuaaacgugaaaauaaaauauuuuaaccuaccaucacacccaaacuaugaaaaugccauaugaaaucuauuauuuuguauacuaauuagaaaaauuaguauuuaauauaaguuacuaaacagcuauuuuuuuaaucaagguugguauuguaaaauuagaacauugaguguagauugcaggugauaccagccuuuguacuuuugggacuaaugaugaguccauauauuuaauccucacgccagucuuuuuuuuccuguuuugaggcagugucucauauagcacugguuggccucacacuuucuguauagggaagaguaucuuugaacuuaugauuuuccugccuucacaugccaaguuaugagauuauagaaauaugccaccacaccuuggucauguguucuggagaucaaauccagggauucaugcaugcuaggcaggcauucuaccaacugagccacaucucagccccucaggaaagucuuaauuguuuuugguaguuaggaucaaauccaagacuuuaagcauguaugcccauguucuauaccaauuuacauuccccacuccagauaaaucuuaaguccugagcuguuuuuuaacacauucucuugggucuggggauguuguucaguuuaguagagugguuaccuaguaugcacaaagccuuaauuucauuacucagcacuacaagugaugauaauccauccuagcugcuugaggucgucuuaugugggacccauuccuaauaagucuucauuugugcgccggccgugguggcgcacgccuguaaucccagcacuugggaggcagaggcaggcggauuucugaguucaaggccagccuggucuacagagcgaguuccaggacagccaggacuacagagaaaccaugucucaaaaaaaaaaaaaagacuucauuuguauuauuugaacuacuguuccuaaggaugcauggaguccugugggaacuacaaaggcagaauaguuggagauauuugaacuuauaaaauauacugucauauuggcauacuggggaugcgagugauuaagugguuuuccuaagguguuguaggacauggcaaggaaauagccuuggguguucccucagcaacaagauuuucaacuauugaaauccugugcuuguuucacuuacccaccagugaugccuuccuuuuagacauuucacuucuuggguccaauuuuaggugggucuuucagugccaccuagugcagaagguggcuggaugacuguccuacccuucuuugggguguguaugcacagcaggucuguaacuaauguuugccagcuguuuucuccaacaaucuaugcuagggugaaugcucagugauuauguguuagauuauaaaagugauagagaaacuuaaaauaguggaacuacaagucauguggucugaugucuguugagguuuuccugugcuucucagguaauuauugucgagcugaauuaaauuauuugcuuauucuuaguaaaccaaaacucauaaaaccaaguauucugaaaucgaagaguuuauuaaugguaagcaaaaggaaaggaguagcucggcgacaaguucccuuaagcaauaagcagcaagacaugugggcaguugggaagauguaaaaggcagagugagcuggagagaauggcgcagcaguuaagagcacuuguugcucucacagaggacuauaauucagcucccagaacccauaucaggugguucacaaccaccuguaaguucagcuccaagggauccaaugcccucuucuaaucucugaggaguguacauacacacacaaagaaggguacuuuguaaagaauauuugggaaaggugcaaguuauuuaaauugagucuacauugauuauugccaagaaaauaauugccuccuuauugacucagauuuaagcaaggcugcuauagcacauuauacuauuacaguauauuauuugguuaauguuuuaacgugcauuuaauaauguaaauuucuuuuuccgauagucuuaaacuuacuauuuagcugaaacuggccuguaacucggauucuccugcuucuaccucucaagugcugggaguauggcuugugccaucaugucuggcuaucagauuuuuuugaauacucuaucuuuccuccuuuauauucagaguuccuuuuguaauuacauuuaggauaucucagaauuuaaaauauaaugucagaauauuaacccccucccccuuuaauagugauaacauugcuuauaggcaacacaguguuucuugaugucuucucaccugcaugucuucccuccccaucccuggaguagaagacggcagggcugggggcuacaaacaggaaguucaguaaagucccuagggagucaaauagagugggauuggguaguauaggcugaaaaguauccccaaaucaguuaugcauuuguuuuauuuuaaagagcuucuugauuuuuuaaaaugacauuauuuucuauuaugugucuauuauguguguagguacguacaugugagagugcuggugccuauggaugccagaagcgucagaucccccugaugucaauauuaggaauagaacucagguccuucgcaagagcaguguggucucuuaaacgucugagucaucucucuagccccaguucaucgucuuucaaaguugcauuuaucuguuucuauucacaguggugagcauugaccacagggccuugucagugcuagguaagcacuacacuucccagacuucaaagcugcuuuaaacucaugguggcacacauucaagaguuaauuagcacucgaggcagaggcaggcuggcgagauggcucggaggcuaagagcacugacugcuuuucugaagguccugaguucaaaucccaccaaccacaugguggcucacaaccaucuauaacgggaucugacgcccucuucuggagugucugaaaaacagcuacaguguacuuacauauaauaaaauaaauaaaucuuuaaaaaaagaaaaaaaacuugagguuauugcugaguuuagaaacauacucugacccuucccucuaaucuuuugugaaaagaguugugccauaagaagaaauaggagacgauuaaaggugacuggguauugugggcugugaagagagaaauugauugcuguugucuuugcaucuaagguggccauaaccuugcaaugugaggucuguugucuuauuaacagaggccaucccugauauggucucugaauuccuccacaucugccucuuaggucagucugauagcauuuucuauugggaagcauuuuuuuuuccuuuugccuagaaacaugucccugucuuaaaagccuugcgaaauucagacugcaauugaggcuaaagaaaaugaauuuaugagugaauaagaaacuaaacuaaagccaccucaccagccccagaauuuguuuucuuuuguuuuuauuuucuuuccccugcuuucacagauauaugauucaucaugcuccucuuucaaaagaccugugcuucucacaucuauccagaucuuaaaaucuagcucacauuuuaaaauauagauagccacauauuacaaggacucuuuucuuucuuccuuuuuuuaagagaaaaaaaagacaucgugucuuuucuucuucuauuucuucuccuccucccccuccccuccccuccuccuccuccuccuccuccuuuuucuucuucuucuuuucaagacaggguuucucuguagcccuggcuauccuggaacucacucuguagaccaggcuggucuugaacucagaaaucugccugucucugccucccaagugcugggacuaaagaaaggcaugcaccaccacugccuggcuuuugcuggcuucuuauaaagauuuuuuuugagauuuuucauuaguacagagauguuuuuccucaaugaugaugaggaucuuauuuuuuagaauuauagcaaaaauuauauuacuaaaaugcuuagaggaagaaauuucaauuuaacagaauuuccuggucugcuaagaauuaauccuuauccauuuccugugagcuuuguugcugcuguugaggaucuuugaagacaaccuuaguuggcuuuuuuagccuuagaaagcugaguuccaucuuagaaagcugaauucagugugacugagcauugaggccccuguuacaccucugagucaucacuguaaaaggaucacagaaaauucucugauacugguguauuucagaccaacuucaguaaagaacaccauuuuuggguuuuuauuuuguuguugcuguugguuuuucuuuuuguuuuuguuuuucucgagauagaguuucucuguauagcccuggcuguccuggaacucacucuguagaccaggcaggccucgaacucagaaauucuccugccucugccucccgagugcugggauuaaaggcgugcgccaccauguccgacuagcagccaguucugaugagcuuauuaggacagauguuucaacacuugggacuguucucuuggcuaguagcauucuagguucuguucuccuuguccuguggucuaaugggauagagcuggcuuuagguauagagagucuuacugguaaaggccaguuagccagaauuugcuucagggacugcaggaaguagucucucugccugagcaguaugucccuggagcaguugguuguuuuucaccuuuagaucuaagacuugagugcuaguuuaauuaacaaguaugauaugccaauuggauagggauagaauaacagagcugagaaguuaaucuagaggucuuuucaucauagaagauaacuagcauucauguguucugaggacuagaauguagauaccaggagaacuguauuauuuugguaacauguggcugacucguuuuguguuccagugacaguucuaguucuagacugaccucugucagucuuuaauuguaagcauucugguugagaugggagaacaaucccucccugccaccucaagcaauguguucucauugugcuagugauagcuuuacuguaacuuagcucuguugcuuuacaaauaucuagguacuuacaucuuugccaaacuaagcaaugcaucaugaggcacgguauauaauuuauauauauuuaauaaaugcugauuuaauaaaugcccuguggauuccaaaagcucacuuagaacugaagauggaaagggaaacucaugcuuacauccuagcugccucagauccuagaucuaaaguagguggaguuucucccccaauaaaaauaagacuugaucagagucuugccucuaguuucuacauguuuguagucuuucccaagauaguugaucuguaagugaguaaugcucuagaaggagaguuaggccuuaaacacccaagggcacugguuggaaaugacuugaguuuguauguaaaugagaggaaaaugcagucccagcaagaccccaggaaccuccagauuuuacagccuuuguagagacacaggcuuucuguuauucucuacuccacucauguagaaauauacucagucucacuuacugaggaaagauuugaagguaaguaauguuuucuagcccugaagaaaugucaucugugcagacuuaaaaccugccuuggaaacuugaagcugaaauguuugagaaaggugaagccagaguggaagugauuucagaugacccuggacucaagguagugguggaugcaaaugucuugacauuagagaaaccuagaggugggcucaauagaagaaaggugggauugcgcuucccuucggggauauucugaugcaaguaacagcuuuucugguuuacucccuagucaucuuugcugggcacacaccuggcuuccuucccaagagcuauaagguuuuagggccuuagugguaucuugccaggaugccaccguguugcuucagcuugguauuauguugaucucugugauggagugugggugggcuccccauacaccucuguguguguaugugcgcgcgcucgcucacgugagcacaugugugcuugauuuuucugaguguggugaaggacuuucuuaucucucacaggaaacuaauuucuucuaccaaaacuuggcuguuuuauauuuggaacaaaaggaaguugaucuuuggaaaaaaaguauuaucuuaggauaagaauuacugugacagaccuaugccagacuuacagguuucuguuuaaagauacccugacaaugccaccaacuuuagugauuugaauugcaugggcaauucauagacuaaucugaagcaagccagccaugccagaauagaggcaggcuguagccaguuguaugcucaauauauuuaucagaaggucucagauaggcuaaauggagcuguggcuauguguuuaugaaguucagaugacuucuuggauguucacugugcuguaucugagcucuagaggucaaauaacugcauuuaugcucagaacucuaucuaaaauguggggcaacucucuuuucucucuguuuucucagaccagagaggcugagacugguuucccuuuaugaacucaggucuggaaagauucaugaaggaauguaggaugaguccuuuuagguaauuauuuuuuuuuaccccuuuccaagauaggucucagcuagacauuugugguagcuggcuggaaggguauauccccucacauccuaagaugggaaguucucuauauuacuacaguuuucucuuuauuugguaugaccuuuguggguaggcagaaauaagcacuuggcauucuuuuuuuaaaauuauauauauauauuuauuuuuaaggcauuuuauuagauauuuuauucauuuacauuucaaaugcuauccccaaggcccccuauacccuccccccacucauuccuguuuccuggcccugguguuccccuguacuggggcauaugaucuucgccauaccaagggccucuccuccaauugauggccgacuaggucaucuucugcuacauaugcaacuagagacacgagcucuggggguaaugguuaguucauauuguuguuccaccuauaggguugcagacuccuucagcuccuuggguacuuucucuagcuccuccauugagggcccuguguuccauccaauagaugacugugagcauccacuucuguauuugacaggcacuggcauagccucacaagagacagcuauaucaggauccugucagcaaaaucuugcuggcauaugcaauagcauuuggcauucuuuuugacaaauuuucacaaacaucaucuaugacagacccuuguuugagcuacaccuuuuccaguuaguuaauuuucuguuacaugauuuugaguuuguguguuauuuaguguuucuuugcugaaauauuaugaccaaaagcaaguuuggggugguguggaguggggugaaaggguuuauuuauacuuauacuuccauauuauagcccauuacugaaggaagucaucacagaaacucaagcagggcugcagccuggaggcaggagccgaugcagaggauauggaggugugcugcuuucugguuugcucuucauggcuugcuuagccugcuuucuuauggaacccaggagcucagcuuaggaaugguaccucccacaaugggcugaacccucucauaucaaucaccaauuaaguaaauaccaucgagaccaauauuguggaggcauuuucucaauugagguuccaaguugacauaaaacuagcuggaaaauugaugccuugccaauuugacacacaaaacgcauuacuguuaagccauaaucuuuccuuucucaucauccccaugauuacacauuaauaucaauaauaaaauacaagcauucaaaacuuuagaagucccacagucuuuaaaaauucagccucuuuaaaauagccagucucuuucaaaauccaaagucuuaaaauuuagucuuucggggcuggugagauggcucaauggguaagagcacccgacugcucuuccgaagguccggaguucaaaucccagcaaccacaugguggcucacaaccaucuguaacaagaucugacucccucuucuggagugucugaagacagcuacaguuguacuuagauauaauaaauaaauaaaucuuuaaaaaaaauuuagucuuucaacugugagaguguguaaaauaaaguaaauuauauaaguucucccuugaggggggaagaaccagggcacacucaaucugaacaaagcaaacucgaaccaguauaaauaacuuaaugagcaaugucuggaaagucacucauggucuuuuggacucuaccaaagggcuugggucacuucucuggcucuauccucugcaggacacugaagucuaagcucccacuggcuccacugucacacuccucugucugugaaaugaguuccuuggucagaagcaauauuguguggaauaccaugaugguggauauggcuuuauguaauauauccuugagguuaaacuguaaaaguauacugcuggccuuguuaacugaaagcaaauucuuucuggugguccuuauugauaaguacuuagaaaaaugcauuugcuagaucaguagcugcauauuaggugccaagggauguguuaaucugcucaaguaagccuuuuguacaucagcugcaauuggagucacuauuugauugaguuuucaauagucaacugucauucuccacaaucuaucugucuucugaacuggccagauagggaguuaaagggagaaguggugggaaccaccacgccugugucuuucaaguccuuggugguggcacucauuuucugcaauucuuccaggaaugugauacaauuuuuuauucacuauuuuccuuggcagaagcaacucuaaaggguuccauuuaaccuuuucaaccauaauuguucucacaccacagaucagggacacagugucagaauucugccaacuucuaaguauaccacauaugccgggacuacaaaauaaccacaggaugaguucagggacccacuggaccuacugugaguuggacuuuagcccuaaccccugaccucaauaagccccuaauuuaacuggaggguaccauaauauuucuugggaucuuccagaaucagcauuauuucagaaccauuucccaauagaccccagaaauucugacuguuaccuuuccuccaguguacaguuacucuuguaaaaggccauaaguaccucugagaaaggacuggggaaaggcuaucaguaaaacuuucaguguuuuaucaaucuccuucuuaggggaaccuggccaucccuucaaaccuuccccaucagucacuaguauaaaaaaugcccugcagucugaucuuauggagucauuuccucaauugagguccccuccuuucagauaacucuagcuugugucaaguugacauaaaacuagccagcauaguuuaauauucauuccugucacuuagccucccugcccuuauuugcacuaacugcuuacaauguagcuuuuaacuuuucuuaauuaaacaucuaugacuuaauuccuuaauccaguuuugauuacaggcuugauuacugaugucgguuucuuggcccuuuuguuuuauauuguuuaccacuucuauuuuaauuuauuuuaaaauuuuuauagauuguguauuugcuuuuauuuuuuaagacaaggacucacuuuguagaccaagcuuuucucugaacuaaacuuaccuugaacucauguugagccuccugcuucagccugaaauuacagaugugcuuugccaugucuggcagucaaccucuccauuuuggaggcaauacuagggauugaacuuccagagccucucacauguuaggucaauucuaaaaagccuuuaauuuuuuucuuuauuucguccuuaaccaaguuaucauugaguaucguguuguucagcuuucauguguaugugugcuaucuccuguuuuuguugguguuuaagaucagccuuacaaaagacacugucaauaagacaaaaaggccaccaacagauugggaaagguuuuuuuuuaccaauccuaaaucugauaggggacuaauauccaauauauacaaagagcucaagaagcuggacuccagaaauucaacaaauaaccccauuaaaaaaugagguacagagcuaaacaaagaauucucaacugaggaauacugauuggcugagaaucaucugaaaaaauguucaacauccuuaaucaucagggaaaugcaaaucaaaacaacccugagauaccaccucacacaagucagaauggcuaaguucaaaaauucaggcgacagcagaugcuggcaaggauguggagaaagaggaacacuccuccauugcuggugggauugcaagcuuguacaaccacucuggaagucagucuggagguuccucagaaaauuggacauaguacuacuggaggauaccgcaauaccucuccugggcauauauccagaagaugucccaaccgguaauaagaacacaugcuccacuauguucauagcagccuuauuuauaauagccagaagcuggaaagaaccuagaugucccuuaacagaagaauggauacagaaaaugugguacauuuauauaauggaguacuacucagcuauuaaaaacaaugaauuuaugaaauucuuaggcaaauggauggaucuagaggauaucauccuagugagguaacccaaucacaaaagaagucauuagauaugcacucacgccgggcgugguggcgcacgccuuuaaucccagcacuugggaggcagaggcagguggauuucugaguucgaggccagccuggucuacaaagugagcuccaggacagccagggcuauacagagaaacccugucucgaaaaaaacaaacaaacaaacaaaaaaaacaaacaaacaaaaagauaugcacucacugauaaguggauauuagcccagaaacuuagcccaagauacaauuugcaaaacaagaaaaucaagaagagggaagaccaacggguggauacuucauuccuccuuagaauagagaacaaaauacccaugaaaggaguuacagagacaaaguuuggagcuaagacgaaaggauggacuauccagagacuaccccacccagggauccaucccauaaucagccaccaaacccagacacuauugcauaugccagcaagauuuugcugaagggacccuguuauagcugucucguaugaggcuaugccagugccuggcaaauacagaaguggaugcucacagucaucuauaagauggaaggguccccaauggagaagcuagagaaaguacccaaggagcuuaaggggucugcaacccuauagguggaacaacaauauuaacuaacaauauuaacuuccuagguuuucuaacuccaggguugucucccuuugugauuucucuacugucucuaguuccauuuuuagaucuugggugguuuuguucauuuccuuugccuguuugauuguguuuuucaauaauucuuuaagggauuuuuguguuuccucuuuaagggcuucuagcuguuuaccuguguucuccuguauuucuuuaagggagucauuuauguccuucuuagagucaucuaucaucaucaugagaagugauuuuagauccgagucuuauuuuucuggugugaugguguauccaggacuugcuauagugggagaauuggguucuaaugaugccaaguaacuugguuucuguugcuuauguucuuacgcuggccuccugccaucugguuaucucuagugcuaccagcccuugcuauaucugacuggagccuguccuuccugugauccuuguugugucagaacuccucagaguucaucugucugugggauccugugauucugggauccuuugauccugagauccugagugugucagagcuccugggagucaagcugccucugggacccugagauccugguaugaccaagcuccugcgauccugugauccuguguguguuagaguaccugggaguggaucuucaucuggguguugugggacuggcugcagaguuugagcccaaggucugcucagggcaccggcccagacuggaaggaacucgugccacuggucagguugaguuccuggguuccuggguccugcuggucccaguuacuuccgguguuggugucgauguuguguucucuucacaucugauucugugauccugaguguguuagagcuccugggaguagagcuuucucuugguuuuguggggaaguuucugggaagaugugaaauuaagcuaugggaguuugaaaaaagauacacggugagcuaagguuaucuuaaguauauaaaaucucucguuaguaaucauuccuaaguuuugccuagaucagccuuaggcaguuauuuucuuuugcucugauaaaacaccaugaccaagacaguuuauaaaagaaauccuuucauuggacuuacaauuccaguggauuagagucuaugauggugaagggaaugcauuguggcaggaacagccaagagcucaucucucaaacugaacugcaaggaggaaguugaaggugcaauagggauggcaugggcuuuugaaaacuucaaaauucaccccacugauacacccccucuaacaagaccaccccaucuaauccuucccaacuaguuccaccaacuggagguuaaguaugcaaacauaagagccuaaagggaccauucucauucaaauuaccacaggcagauaagaggaaguuuagaaaagaaagccugugcaucuguuacuuacaauguagauaauaggaaauuucuuuuacagaaggauguauuuucggcuauuucugucugugguuccuauaaguaaucacuuuaagcuaaagaacaugggcauguugguacauaccuccagucauagcacuugguacguaccucuaaucauggcacucaugagguuggggcaggaguauugcuaugauuccuuccagggccagccuagggcacuucgucaguuagaagccagcuuggaauacagagugagagcuugccuaaaaacaaacaaacaaacaaacacaaaagaagggcuggagagauggcacagcaguuaagaucauucacuucucuuucagagaauccagguuugcuuagcauucacuugguagcuuuaaaaguuuguaacucuaaaauuuaggggaucccaugcucucugcuggccuguagggcacuguacacucauacugcacacacauauaucuaacaaaauacucaucuacauaauaguuaaauaaauacauaauacauauuggagaacuaucuuuuggguugaccuauucuuggaucuuaucaaauguggguucuuacauguaagaauuuuaauuugaaauuccuuuuacagugauaauauauguaauacaaacuaucauuuuaucauuguaagggcacacaguucaguggcauuaaguauauuuaccaugcugucucaccaucaguacuguuugcagaauauuuuuaacauugucaaugaaagcucuguaaugaauagguucaacaguaacaccccauuuccuucucuaucuucuguuucuaugcauuugccuauuauagauaacuuauagcaguggaguuacauaaaauuuacccuuuggugauugauuucacuuagcauaaugucuucauaauucaaugaugucauagcaugugucagacguuacuucuuuuuaaggcugaauaauucauucuuuggauaacauacauguuguuuauccacuuaucaauggacucuugaguuguuucccuuuucugcuaucaugaauaaugcugcuaugacauaggaaugaaaauaucugaauuucugauuucaguucuggguauguaccaacaaguagaauuccugggucauauaguaauucucuauaguuuggcacuauauauagcugaaaauuauuguauucacugauuuguagcuucuuaggacuuccaggagagagaaucuugaugguagcuuggcuaucaggaguuauucaagauuaguacaaaaaguuauuuauaucagagauuuaaaaucauuaucaagcccaccaugaggcuuuuagaccugaaguuuuaaguggcucccuugcuacuugacacauuuucagccacucuugaggcuuucuuuuauggaacaggaaguugcaaggaacaccacaaaugggucagauucuccagcagugcucuggaugccuggcuccuagaguagacucuccuucaugugguguuuguuuuucucuacgaccuuccuugccuccagacuacuucuuuuccauauuuauuucauguguaugcauguuugcaugcauguguguguguguguguguguguguguguguguguacaugugcaugugcauguauguguguauuuugaagaauugagcccagagacuugugcuuuuccagguugacccuuuaccacuaggccacauuacaccccuaucccauucucugauucagaucccaaauucugcagcuaauuguuuuuuuuuuuuuuuuuuuuuuuuuuuuuugguuuuuugagacaggguuucucuguauagcccuggcuggccuggaacucacuuuguagaccaggcuggccuugaacucagaauccaccugccucugccucucaagugcaccaccacgcccggcuuaauuguauuuucaaacaugaagcaauuuauuuaaaauagauaaauaucuuaaauacuugguuuucugauuuaguguucuguguuggauaaagaauaagccuuaauuuuguuuuuguuaaugugucccauuuauaccuuccccauguucucaucuuauaguuguggcuuuaauguuuuauguugaguauuauuauuuuuuuucauaguuuguccuuucuucuuuuuaucugugguggggugguacuaaaugcagucuuuuaugaagggugcuuuggcgcucacuguguagacuaggucagcuucagacuaguagcgaucuuccuuuaucugccuccugaguacuaggauugcaugugugagccucauacuuagauucugucuuuuguuuuuugcuggaguuagaacccaagaccuugcacaauuuaggcaagcauucuaccauugagcuauauaguacauaggcccccucccuucccccucucucuuucuuucuugacauugcaaaaucacccauuuaaaguauacaauguuuuagcauauucaaaguucuauaaacacugccauaauaaauucuacaacauuucaugaucccugaaagaaaaucugcacucaucaacaguauuucccuauuuccccucaauccucaacccuauacaaccuaccacuagucuucccugucuugauauauuuuuacaugcucccuuccccucauaucccuucuucuuucacuuuucucacaugacauuagcuuguuaacugaauccuugaguaauucccaaauugaaugaauuguugagagaagcaaauacaagaauucagcacccccaacccccagcauagggacaccuuuaaucccaguacuaaugaggcagacagaacacugauuuugaggucagccuggucuacauagugaguugcagcucaaccagauuuaccugguaagacccuaucuauauacacacacacacacacacacacacacacacacacacacacuucagcccccccccccaaaguaaugauggauacauagcacaguugagcacugugcuguccuuguaagucaccuucuuucauucggccacugugaaucuggauuuucacuggcuggucuguaaggauaacagagauaggucuaugaaaguggagccaaaaguugaucucguauugaucuaugauauggucuggaaguggugaacuaagacuucaugugagugagugagugagugagugaauucugggacagaauuuuugugucaguugugguagugcacaccuguaaucccagcacuccggcacacuuguaauucuagcacuucggagauacaaacaggaggaacaauguuagucucagcuauauaggguguuucaggcuagccuuggcuauguaagacccuaucucagaacacaaaaaacaaauuuaaaaaauuuuaaaaacuauaaaugcauuaaaaacuaauauuuaaaacuuuuacaaaaugcugcauugauuauaaacauaaacauagaaagguuuaguuaugcuuggguucuugcugagaauuucggacaagggaauuucuuguggguaaaucagaauauuuuguuauuucuuauauuuuugcuugugagccuaacauuuaauggcugagccaucucuccagcccuugucauuucuuauuggucacuguucccuauuaaggcaaaccacuuugcucaaaacaaauaaucuugaagaaagaggauuaucagggucuuaguaaugagucugcuaauugcuugguguuuaaaaaaaaagagcaguguguguuccugaucaugauacaugcacauacaugcuucuacaugcacauacaugcauguacaugcacacacauauucuauuauaucuccuuauugcugggaauacagcaaguaugagcaggucuuugcuguggaauuuucagagacacaggauaggaaaaaaaaaacaguguacgcuuaaacuaagaucuguccugccauuuaguguacgcuuagacuaagaucuguccugccauuuuuuuuuuuuaauucaugaguaaguuuugguugggggaaauagacuaaacuguuguucugagagcaacuuugaagugugugauguguguguguguguguuuuauguauguuucuauauuugucacggaggggugcauaaacuuguguauauuuggagguaaauguccaauauuaaaucauuucauucucugcuuuauauuugagccagggaaccccauugaacuuggagcucacugauugugcuagacugacuggacagcaagcccccauaauccugugugucucccugaugcuuggauuacaggcagccccugcuuucugugugggugcagggggucagaacucagguccucaggcuucuccggcaagcacuuuacuaacggagcugucuacacaauaccuuguuuuauuucuuaagacagaaaauugucagacuccugcugauagaagcucaucuguuuagcuagggaagcccucgagacucacagagcuggcuaaagugggucacagaggaccugaagaugguuacucgcacuuuuuuuuagacaaauguuggccaggagcagaaaucagguauuagguaccuuccgagucuacagccuuuuaauauuugcucaguguuaaucuaugauaaaaaauaagucagggcuuguaucccauaaggaaaauggaauuaggacacuguuuaucuuguuuaugauagaaaucuauacacuugcuguguuguccauguucacucauauaguaucauuugccuguuuuuuuuucauaugugugugauuacuucccaacaggaguagagucugaauucuuauggguaaauaauagacacauagaaaaaagccuguaaugaucagaagcucagaggguauggaagcaugaggucuguguggcuaccauauaauaaagaaagcuggggugaacagacuucaguguucaguuaccaguuuaccuuagggagcccuacucuaagcuguguagacuucauguaaguagcaggucauacugugaauagaguacaugaucuauauuagcuuccuuugaaauuguauauauugauauuuuauuuauuuauaaacauaggaacucugcuucuuuuuuuguaaauuagaaauauuuucuuuuuggggggggcuggugagauggcucaguggguaagagcacccgacugcucuuccgaagguccgaaguucaaaucccagcaaccacaugguggcucacaaccacccguaaugagaucugaugcccucuucaggugcgucugaagacagcuacaguguacuugcauauaauuaauaaaaaaaaaaacuagaaauauuuucuuuuuuaauauuuuuauuagguauuuuccucauuuacauuuccagugcuaucccaaaagucccccauacccucccccccacuccccuaccuacccacucccccuuuuuggcccuggcguuccccuguacuggggcauauaaaguuugcaaguccagugggccucucuuuccacugauggccgacuaggccaucuuuugauacauaugcagcuagagucaagagcuccgggguacuggcuaguucauaauguuguuccaccuauagggcugcagaucucuuuagcuccuuggguacuuucucuagcuccuccauugggggcccuguguuccauccaauagcugacugugagcauccacuucuguguuugcuaggccccggcauugucucacaagagacagcuauaucuggguccuuucagcaaaaucuugcuaguguaugcaauggugucaguguuuggaagcugauuaugggauggauccccggauauggcagucucuagauggucuauccuuucaucucagcuccaaacuuugucucuauaacuccuuccauggguguuuuguucccaauucuaagaaggggcaaaguguccacacuuuggucuucguuauucuugaguuucaugcguuuagcaaauuguaucuuauaucuuggguauccuaaguuucugggcuaauauccacuuaucagugaguacauauugugugaguuccuuugugauuagguuaccucacucgggaugaugaccuccagguccauccauuuggcuaggaauuucauaaauucauucuuuuuaauagcugaguaguacuccauuguguaaauguaccacauuuucuguauucauuccucuguugagggggaacucugcuucuuuaaugaggagccaggguaggaguuaugcuuuugcaucaugcugugcaguagauaaccaguugaguuucauuuucuucuaucuuuugucauuuuuaagcuaucuuugaguauauuaauauuauuuuucugagugauauuaauuagaaugcaaacagcauuuuauuuuuguaugaauuauacauguaucugauuaagcucugauuuuaauacugaaggauuauuuauugcuauccucauagggacaaaaacaagagagacccuauaucaacaaauuaauugguuuuaauauguauuucauguguguguguaugcauauacacuugcucacacacauugcacaguaaauguguaaaaguuuagaggacagcuuugagaugucaguugucuucgaccuuguugauguagggucucucuuguuuuugcuucuggccugcauacuccagguuagcuggccccgugaacuucugggcaacucuccuuucucugccucucacuuaguauagcaaugcuaggauuagagaugcaaaccauacauucugguuuuauauaugagcucauaucuauaauuccagcacucuagagguagaggcacagugaucaucagaaguuaagguuaucauaacagguacagagucuaaagccaguuuaugcuaaaggaagagaaagaaacgugaaacuucuuaguuguucuucauaacauuucccuuccccuucauuccuucuuuuauggcucuagcuagucaaacugcauccuuuggagcuuuaaucuuuugcuucaucauaguuauuacuaaguuuuugagacaggaucucacuaucuagaccaggcuggccucuaacuaacagaaauccacuugucuuugucucccaagugcugggauuaaagguguauaucaccaugcuuggggcuauuauuauuauuauuauuauuauuauuauuauaauauuccaauuuugcuacuauaaugaagcaccagguacaggcuacuuuuugaauaaagugauuuuuggcucauguuuauggaggcaaauaaucaagaagccucacauaguaauaaucuugcugguaggauuccaaguuggcaaagaacuugacagagcaucauccacaaugggcuggguccucuuccaucaauuaccaauuaagaaaaugcccuauaagauucccugcagcuccauuuuguggaguguggaggcuuuuuuuuuuuuuuuuuuuuuuuuuuuuuuuuuuuuuuugagacacgguuucucugugcagcccuggcuguccuggaacuuacucuguagaccagguuggucucgaacucagaaauccgccugccucuaccucccgagugcugggcuuaaaggcgugcgcuaccacgcccagcuggaggcauuuucuuaccuagcuugugucaaguuagcauuaaacuauccagcccaguuccucaggugauucuacuaugucucuaaagcugggaagcagugaucuguuuccaguguguuuaaaagagaguuguaguacaaacuagauccacuguuaaaucugugcccguguagcuacugagccagagauugacuauucaugaaaggauaugggagacuccccacagaaagugggcgcuuucauugaauuucuuauauaagcucuuuauucuugucccccagacacugaaguuucaucauaaaguuucaaccucauuacuuaguauaauugaggguguuuuaaaauauacuuguucagagccggaugugguaauuaauauacauccuauaaucccugaaaccuagaaggcugaaguaggaggaaugccaugauuuuugauugagaccagucugggcuacauuguagaaugauccuuucucaaaaagccaaaauaaacaauaaaauaaaauucacuuguucaguuaaguuuuaaaacagauggcuucccuuagaaaauuugaauuucaguaauaguucuuaacaguauccaugaauaauugacuaauauuaauucauuaauauucuaguagagugcuucaggcuaauaaaauucauuuaaaagugagguuuugcugcagcucaaggguaaugggaagcuauucccaccaacaguaaauuagugaagggugggguuagccuggugguugcuugcucaguaucacugguuuuuaauuuuuguauugacaaauuguauuucagaggcauacauuuaucugaauguacuugccuuggcaaguguugcuacaucuagaaugggaacagggguauuuccaaaacauucuuuuuuguuuagcucuaucccagggcuucauacuugagccagauuuguuuucuucauaguuuaaaugucuuuguuuugagguuguuguugauuuacaugcaguuauggaaaaucucauacagagagaucuccaaauuauaaugcaaugccacaacaaauguguuuauauuaauguagucaacauugaggcucccucuaucaccacaaggaccccuuucuugaugcccauuauagcuuucuacuuccuauuccccugccuccacaaucacugguaagcacaguucugucggccacccgaucuuacggaggcuuacaggauaagguuaugugucuagguuuugauaaagagaaaauaaagguccacauguaaagcacaauagaauaaaggaugguuauauaggaaaacaaaccuuagaauuuuaggugacacagaaagacuuucuuuggaguuaaauccuugaguguauuauuucuuuagaaagcguuuccugcauuggugguugugauaaucucacaugauuccucugucuuaaauuuagcuguuuuguuguggguaguaucugaucaaguccguggacauuucauuuauuuuccaacucuuuuuacauugagaugagcccaaaggucucuuguuagccucuggaaguuugucaguagucaaaagguaaaagcuggagauaaguuguuuagcuuuucuuuaaauagaaaguucuugaaacguuuagaccauuaaauaggagagacauauaugcugugaggaggaagagggaggaggaagagggaggaggaagagggagggguugggaccuuagcuuucuuagccaguguuauaguuaauguucuauuaaugugaagagacaucaugaccaaggcaacucguauaaaacaaaccauuuaguugggaaacuugcuuacaguuucagaggcuuagugcaugaucaucauggugggaagcagucagacuuggcacuggagcaguggcagagagcuuuacauccugucuucacaguuggcaaaggggguggaaaggaagagggaagggaccuuugaaacuucaaagcccacuuacaguugcaaaccaccuccaacaaggccacaucuucuaauucuucccaaacaguuccacuaaccugaaccaaguauucaaauauaugagccuaugggggccccucacuugucacucaaaccaccguacccaguaaaacuucaauccugauugaacucacauacugauuuuuuucaucugacccagaguaacuaaacuugaggggaaagagucacaggaaugaccuuucaggcuucuccaccauuucuaugcaguagaauagcaauccaaugugugcuaugugaccuaggaacugaacuucuacuuguuugucuuuguguaguucauggcugccaaauggauagcacagagauuccaccuuacccauguuaggcuguuuugcuuugcuuugcuuuguuuugcuuuuuauuagugcagcaaagcugaauugcuugcuuaagccaugaggaaccuaaguugagucuuacagcuuucacccauucuccagccagcaucagucucuaagauagcauggaguaaauauuuccaaaccaucagucugagagaagaauaaugagcugaagggauacuugcugcaucuaugcacagcugugcccauacuuggcucucaauacugccuauuucauacuucucugucagacuuguacuucuuuuccagacuuucaggcucaugggaucaggauaugauuuguuagucugcugaaucaaagcaccaaagaaggugcuacauuuccuuugaaaaacuggucauugaaagugagaguguucgagucaaguucccagguuaaauagaauccaguuugccuacuuuuaaccaugugaccugggacaaauuaauuaaccuuuuuguacuccuguuucuacacuuguaagaugucaucauagggugguugaggccaauaaauucauauaguguacuuuguucauaguggugugugugugugugugugugugugugugugcaugcgcguguguaaaacguagcauggauuucaggcuugccuuaaacuagcccuauaauugaaaaugaccuuccugccuucacuucucaaggacugagauuaaaggcaugugcuaucaccacgcguggcugcaguugguccauaguaacugcuuguuuguuacuucuguuaugaugaagcugcugcugaccaugucccugaucauaaggaguuucuagaagggaaacuugugucuuacaugugcccacaagagggcagccugagaccuugcauguccauggaacagccuucuggggcagcuuuuugaccauuucuuuuuccuuccaguuuuucuuugucuaguuaaagagcauuuugaucauuccccugacuugccucauauguaaagcagguuucuuaucaucaagacagaggcucaggucgagaguagguacauuggcugcaugugacuaggccucccaggcuuuuuauuuuuuuaaaagcuuuucagacagaacaaauuauuccgaguggaacuuaagauagagacuaaaaccuaaauuaagaaaagaccuuauguuuucuucuuauuccucuaucaauuucagcacuauguguguguguguguguguuguguuguacacccuguguaagagguaguaguuggaccuaggcaaaccuagggcagucccaguuauauaucacuuuagaggcugccagggagaggaaguuacuuuucuguacaggaaagaaggaugaaguaagggcuucacaagugguaugggagcauggaguaucauggaucuuggagccuagaagguggacgagguuaaaaagauggcaguguugguguugguggaacgaggggcaggcaauguaaacuagaagauauuaguggaggggagaaguggugaggucaaauuagauaaggaguugaagucacauuguugacgguuuggaaugaguuggaguuggaucuuuaaauccaugaugacauucauuuuguuggcaguaucauaauuaagaacugacuaaaacuaaacaugaauuaugucaguuuguagucaaggacugaauuauucuuguaauugucccuccaagggacaauuagcacuuauuuauuuaaucuugaauuuagaaaguuuuuuagggacaugaaaggagugggguauggauauggagaugcagggauauuucuuagacauuuggggggauagguauuauucauuucaucuuaacuguuacagacauuugcaugcuguguacauagaaguauauuuauuuuuugaaauucugagauacuaagauugacaucaaagcaaauuugucagaacuaaaauuaaauuugagggauacauuuugcaguggucuaaaguacuuauauguauuugccacaguugacuuauuucagaacaugaaaucuuuuucaacuguauaauauuugauauccaaaaucauauucaccuuguggcuuuugcucuccccuaaacuauucugccauggaccuucaagccagauuagaauaggacuaaugagugucucugcauacagcuagguuucugugucacuuaauugcauuucugaccccuccaggucaggccuugggacaaagauuagcuaaaggacucuugucagcaccacuacaccacacguuggaaagcacagguggaagccaugacugcugcccuugaauuguuggggcuggcugagaauguaugauaggaagugaguuccuugaaaugaauaggugacaauggauaauguguauguauguccagacgaagagggacauguacccaaccaucucuagcacucaguagauaaagaagaauaaaaaaacugaaaauuauguuuucuaucucacaggaauggauggauuuuuaaaaucagaugagagacaaagauuagccaaagagagacgagaagaaagagaaaaaugucuggguaaguuguauacuuuggcuauugaaguucacaaaaguagaaaaguagaaaugagguaauuucuaaaggucuuuagaaaucugugaaugacuggaaagagaacuaagacugguagacgagucuagaggcuugagugugaacucacacaguaacuugcaugauaacaaaagcuggaauuaauaaaccauucacucacaaaauauugacccuccacuauauccuaggcaggaugcuuggagcuauggacaacaauugcugccacugagggggcggggguggagagaugguuccauuguuguuguuguguuguuuuguuuuguuuuguuuguuuuuccagacaggguuucucuguguagcccuggcuguucuggaacucacucuauagaccaggcuggccucgaacucagaaauccgccugccucugccucccaagugcugggauuaaaggcauguaccaccacuacccugccguuuccauuguuaagaauacuaacugcccugugcucaguccaauggacggcugugagcauccacuucuguaucugccaggagcacaggguccccaaugaaggagcuagagaaaggacccaaggagcuaaagggguuugcagccccauaggaggaacaacaauaugaacuaaucacuacccccagagcucccugggacuaaaccaccaaccaaagaaaacacaagcauauguagcaaaggauggccuagucagucagggaggagaggcccuuaguccugugaagguuuuaugccccaguguaggggaaugccagggccaggaagcaggaguggguggguugguaagcagggggaggggaggagggagaggggguuuucagagggaaaacuaggaaagggguuaacauuugaauguaaagaaaauaucuaauaaaaauaaaauacaauauaauagaaaaauaaaagaagaagaagaaaaaaauacugacugccuuuagagaacacagauuugauucccagagcacacauaucagcucacaacugucuguaacucuagucccauggaauccagugcccucuucugguguccuuaggcauugcacauacaugguacacauacacacaugcagacaaaacacauacaaauaaauaaaacaaaacaguuucuuccucugucuuaggaagacucgguguccuuagguauccacuaugugcacucaccuucuccuuggagaucuagaagggccauccucaagagaaaugagaaaaugggcacgcauuuucugcauuacagcaguaugcccagugaggaagucuuuuauuuuuuaaccucuuguuaguuauagauaccaccauggaguucugugaguuagguagaugauaauuuccuucauugaacugagaugaauaagaagcuguuggauucuuguuuggccuucuggacaguucaggcacuaugaccccccagagagccuuuccuuagccuggcuagguagagguaaagauuucuuaguaaguggcuugaugcaaagacaagacuuuguacaucuuaaugcuuugcucagaucacugugcaugcucauuuaacacgauuuugauugaaugcacccuaaacuaucaucauucuagccacucuaugaauuaccuauuguauacaaguuuggcuuaauuauagcaauaauagucauaauaccuauguguggaaguacuuuuuguguuuuacaugcauugcauaauuuucuucacuauauuauuacugccacuguauaacugagaaggaagccaagacagagcgauaacauaguuauuaacaugccccauaccacuuaacaaauggcagagaagagagaacacccaaucucagucacugcauccugggauuucaucagguuauuguuucuguguucuuggucuuaauccaacuugcaugaggagcaguuggagugacacugcuuccauuucucagcugcucgggaacaacagaucuuagagaaacagaagagagccaagcuucaguaugagaaacaaauugaggagcgauggagaaaacuugaggagcagcgccaacgggaggaucagaagagggcagcaguggaagagaagaggaagcagaagcuccgggaagaagagguaaguagggucucgggagccuuccaccccagccagcucaguaacucacauagggccaacguguugagggcaucugguguacuacccaagugucaacugugagagagaccugccuccaaaucuuguccuggugacauagugcgccuucuuucagcacuguaauacaaugaguuugaggaaguagcacuugcagaggagcaaagagguuuugccauuucauuccaguuuguuguacaacccagggcaaaaugcuugccuucucuuggcucugguuugcuugucucugcugugagcaguuggauuuccugguuuccaaggcgucuuucaacuacaaccuuuucugaugaaauuaagagacacggcgggcuuguggcuuggauuuugggugauagaaaacuaaguauuaugccaggaggaggcccaugcuucuggaacagaucaaggccaaagcauauaauaagaugauccuguuauuuacugcuagaaaauucuguuugaauacaaagaugcuagugcauuuaaauuuuaauguagcuacucgcauuaaucauccuuuccaguuaccuuucaaaacagaaauggaaugcaauuaucugcauggaguccguuauuacuaagcucugggaguauauuuaggaagcauauuugaauuauagauuuucuuaacaaguguauuuuaaggauguaaucguacucuuguauauucauaagguauaaugacucaucuuuuaguaugaauauagcaguuugucaauuuccaacacuauaaaauacagagacuuuuauauaaauuuaguguuuuuaaaguguuuuuaaagucucugaaugcuuacuacuauauauauuuacuuuuguuuuuauaauaaaauaacauauuauaagauaaaacaaaaauuaacaauaagauuuggacaagacaagcaaacagaaggaaaaaagaucccaagaaaaguuuuuuagaaaaucagagauccacucauucccacagucaagaauuccauauaaaacaguaaacuggaugccacaugguaugugcagaggaccugguguagaccuuuguagggccugcccaugcuguuccagucucugugaguucauaugaauuuuaaucauguugauguagagggccuuguuuuuuuugguguaguccuccauccucucugccucucacacuuucugcuuccccuucuaugggguucccuaagaucagaaggggaggcgguuugauagaggcaccucauucagguaucucacucugacuaaugucugccuguggguuucuguuucuuccugucuacuacaggaggaagcaucucugaugagugggaaacuaaucuaugaauagaggagagugucaccaagagcaaugguuuuugcuacauuuuuuuuuguucuuuugaacaguauuauuugguuuucuccuaaaucccuaaauuaucuagucucagguucuuggucaccaaaacacccauuuuagaacaaaagauuuguggcuggcuugguguuuauguuucuuuuuugguagcauaccaaguaccuuacugucuugaccuugcagcgggagaguggggaaugacucuuuuuagguacuagcuugacuucuccauguuaaguguuuuauguagguguuguuuucagcugucaguuugcugucaguuuguggagagcaaccuauagucuuggcaacaacuugaguugcuucaggauucccaugagaccuguuuggccagcagcuagauaaaauguaacauaaugccauuauuugaacuuuauuuagugauaagagauggccagucaguacucugucuaauccauuauuuaguuauuucauuuaaaaagccuucauucacacacacacacacacacacacacacacacacacacacacauauggaagcuucuauuguauuaguuuaagcugucuuuccccauauucccucccaucuuccucuuccccuauuugauccccucauuccagccaaaccaucaucuuuccauaacuaucuguucuauucuacauuacuaaggagaucugucuuuaucccccagucacauacucuauaccuaaccucuguguuucuacagacuguagcuugguuauccacauauaagugaucauauagucuuuuuggauuugggauaccucacucaggaugauuuuuguuguuguuguuuuaauuuuuuauuuauuuuauguauaugaguacauuguagcugucuucagacacaccagaagugugcaucagauuccaucaugugauugcugggaauugaacucaggaccuggaagaauagucuuaacucuuaacugcugaaccaucuucccagcucccaugguugguuacuuucuaguuguauucauuuaccugugaauuucauaguucuuaauugcuaaguaauacuccauuguauaaauauaccacauuuuuuuuauccauccuucuucagagacauugugguggugugaauauguuuagcccagggagagacacuauuagguguggccuuguuggaguaggugugaccuuauuggaggaaguguguaacugggagugggcaaugggacccuccucuuaaccacaugagaaccagucuucuguuugucugcggaacaauauguagaacucucagccucuccuaugccaugucugccuagaagcugccuugaugguaauggauugaaucucuaauccuguaaaccagcugcaauuaaauguuguucuuuauaagaguugccuuggucacgguguucuuuacagcaauggaaacccuaaggcagacauauaaguuguuuuaguuucuggcuauuauguauagaucaccaaugaacaugguugagcaagugcccuugugguaggauaaaauguucuuuggguauaugcccaagagugcuuuagccagaucuuuagggagaucaauucccaacucucugaagaacugccacauugauuuucauaaugucuguauaguccaccagcaauggaggaguguuccccuugcuccacauccucaccagcaugagcugucguuuguguuauugaucuuagccauucugacagacaaaagacagaaucucaaaguaguuuugauuugcaguuccuugcucauuaaggacguugaacauuucuuuaacuauuucucagccacuugagguucuucuguugagaauacuguuuaggucuauggccauaccacccugaacgcgcccgaucucgucugaucucagaaccuaagcaggguggggccugguuaguacuuggaugggagaauacuguuagaucugcaucccauuuuuaauugguuuacuuguuuuuugauaccuagguuuuuuuugaguucuuuuuauauauuggauaugagcucucuauuggaucuguaauugguaaaaauauuuagcauuguauaggcugccccuuugucugaaugacaguguccuuugcuauacagaagcuuuucgguuucauggaguccuauuuauuaauuauugaucuuagugccugagcucucagugauuuguucagaaaguugucucccaugccaauguauuaaagguuauuagccacuuuuucuuuuaucagguucaguguaucuguuguuguuguugaggucuuggauccacuuggacuugaauuuuguacagggugauacguacagaucuauuuacauucuucuacaugcagagauccauuuugaccagcacuagugcagguuccuggagucauuauaaaaaaucaggugucuguggguguguagauuuauaucugggucuucaauuuaauuccauuguucaacgugucuguuuuugugucaauacuaugcuuuuuuuuuauuacuauagcucuguuguacaauuugaaaucagggauggugacuucccccacaguucuuuuauuacucgggauuguuuuagcuauucugguuuuguuuguguguguuuccaugugaagcuaaaacguguccuuucaagaucugugaagguuuguguuagaauuuugauggggauugcaaugaaucacuagauugauuuuucuuuuguaggauggccauuuuugcuauguaaucuuacugaugugugggaaauauguccaucuucugaugccuucuucaguuucuuuuuucagugaguugaaguuuuuauuauacaagucuuucacuuccuuagagaguuauaccaagauauuuuaaugauuugugauuauuaugaaaguuuuuguuuccccaauuuuccugucauuuguuuguaggagggauaguuuuuauguuaauuuuuuauccagcuacuuugcugaaaguguuuaucagcuauaagaauuaccuggagguguuuuuagguuuauuaauguauacuguuacaucguuugcaaauaaagauacuuuggccgggcgugguggcgcaugccuuuaaucccagcacuugggagacagaggcagguggauuucugaguucgaggacagccuggucuacagagugaguuccaggacagccaaggcuauacagagaaacccugucucaaaaaaacaaaacaaacaaacaaacaaacaaacaaacaaagacacaagauuucuaaagauaucuugacuucuuccuuucuaauucuuacuuccuuaauguccuacagcccucuuauugcacuagcuaagauuuuauacacuauauuuaauagguauggagaaaguagacaaccuugucuuauuccugauuuuaggggaauuucuuugaguuucucuccauuuaaauugagguuggcugugaacuuguuguaaacuguuuucauuaugcuaagguaugucccuuauauccauaaucucuauagaacauuuaucuugaagggaaguuaaacauuguccaaggccuuuucugcauccaaugagaugauuauguggguuuugucuuuuaguuuguuuauaugguagauuacauuuauaaauuucuguauauugagccgucccugcaucucugggaugaagacuacuugaucaugguagaugaucuuuuugaugucuacuuagauuaauuuugcaaguauuugauugaguaaaauugcgucuagcuuuauaaaggaaacuggucuguaauucuuucuuaguugggucuuuaugugauuuggguaucagggugacuguagucucaugaaacaaauuaggcaguguuccuucuguuuuuauuuuguggaauaauuugaagaguauuggcauuaacuccuuaacuccuuuuuuuuuguuuuguuuuaaaucugguagguuucuaugcuaaaacaaucuggcccuggacccugugguugggagaccuuugaugaguggcucuauuucacuguggcuuagaggcuauuuaaauugcuuaucugcucuuaauuuaauguugguaacugguauguauggagaaaauuaccuuguuuuguucuguuuuguuuuuuguuuuuagauuucccaguuugguggaguucaggguuuuuaaaguaugcuccuaaugauucucuggauuuacuuagugccuguuguguggaguuauguucccuauuucauuucuaacuuuuaaaaauuuuuaaaauucucucugccuuuuaguuaauuuggauaagaguuugucaggauugcuaauugucucagaaaacuuaacuuuuaaaaaauuuuauagauucuuuguguugcuuuuguguguuuaucuggugagauucccuuuguggcuucccagagagugccugcuggaguuggugacugagauaaaaacagugaguagugggagggagguuaggagggaaaacucugugugguccauuggagaugugggcagggagaaaggaagcagguguucugcuguccagcugaggauaaaacuggaggauuagauuuagaggagcagagggagcuauaaagauuccagucugccuaccugcuucccuagccagaguccacuuucuguuuuuuaguuuuaaagaggacauaaugcacauugaccauagauugaaccaccuaguacaaaauaaugauuagaaaugugaaacugucuucaguuacuuuaguugacuuugcuggaggcaaaaccaagauagagugccagaagacauggaacagucuaugcacuauuuuaaaaagucacaucgaaauagaggcugaagguucagaaguucaaguuuauccuugauuucauagacaguuugaaucuaugaaacuaaccucggcuauauuagcccauguaucaauaaaaaaaaauucaggauaaaaauccuaaaaugaaaacaaaacaagauucacaugggucuggugguacagcucuguaaccguagcuaauuaaguguuuaagacagaaagauuaaagguucaggagaugccuuggcuauagcauaaguucaaggauaaccugagcaauuuagugagacuguaucucagaguaaauaguuuuaaaagaaggcugagaguauauauuaaugagaaagcaguucccuaacacaugugugucccuagguucaauccucaauuuuggaaggggaagccaaugcaugagaagguguuuggguaguuuaagauagauuuauccuuucuuagcuuguauguuuuucaugagucacuggacuugccuauuuucuucccauccuccuuucccugaugacuuagaguuugucccuuucucccuugcauucacauuuuaauucuugacauccugcugauucaggcaaaagccuguaacuacuucuuccaggaaagaacacuaugcagugucacauuagaugguucucuugcuucagcacauccugcaaugucacaaggguccacuuuggaggcaauuucugugcauaauuuuucuuuauagaacauuaguguuggaagcacuuaauguagucagucucauauuccuuguugaugaagggauauuauguuagauacagccuaaucuguaguacuuuauagucuggauauuuucugauucugugcuuucuuuuauccuuaauauaauugaggauaugcucugaccacuggucagcaugaaaacaaccugaaaaugcuuuucuauuuuuucuaggaacaauguggcacaguuuuggcagguuaggucuaugcagagagcuggguuuucuaagguuauuuagcaacccaaggaaggagaagcuugccuuugucaccugcacccaccuucagggucccaggagacccagguauaguuuaaggacuuuccacacauaggguaaccaguucacuccaucagguuaguauacugcugaugcuaacuaagacuuaauguuuucaugagugaucucuguggaagugggauugcucuacacuauggaaguucuccaaaggaagccuucagugaucaacucaaugaagagcucaaugagagcuguuaaaugcucaacagcacguggcuauaaaaucauuuuuguuguuguuguuuuuguuuuucaagacaggguuucucuguguagucuuggcuguccuggaacucacuuuguagaccaggcuggccucaaacucagaaauccuccugccucugccucccgagugcugggauuaaaggugucuuccuaaacuuaugugucccaucacagaaguugguagucucaguaucccuuaguaucacauuagggguuuacaaauggccagagccaaauuuuaaaaaaaaguccugaaacaaagccacuaaugauuuagcuacauuaaugccagaucaucuggaauaucauuuuaucaggcaaaaccaauacauugacucuuaaaggucuuaagaauuggcaggacuauggcaguggcagcaguuuucuuauggagggagcccauguccaguauccacuugagacccuguccuuaaacaaacuaauauucuuaguagaagucaccuucaggugacuuccuauagcauccaagaugccacauaccuucagaauuuaaguucuagaacaaguucuucuaacucaaguuuuugguggacaguucauuauucucaucuaaucuuuauucaguguagcuucuugacuaauugcccuggaagguaggauuuagaaaaagaucaacucuugauucuugugcuaacaaauaacuaagaaaagcuucuuucaaaaaguagcuucgccuuuuccguuggauugacccaucuaaacuucucacacugucauugcuuaauggcuaguaaaacucaaacuggguaggugcaaaacaagaaauuucugaauuuauccaaacaaaaacuugacucagcuaaaggcuggcuauucuuagagggccuuggcuaacuaccuggcuauauauagaaaucuguuuguagagaggagaccucuugugaagagcccuauuguggaccacugugggcuugaguuucauccuugaacauguauaguagaagcaguagaaaagguauagcuuguucucucugccugcccccucccccuccuuucuucccuuccuuccucccucuugccucuuucuuucucuuccucuauucucuucucccuuuuccucuuccucuccuccccccucccuuucuucccucuuucucugaccaccagacaacagugucuggaucauucuguacuagaggacuuuuccugauugauugauugauugauuuauacuaauucuaguuuuaguuaaaauagaacauaauggauuucauuuucacauuugcauauauauacguauacauguguauauauauauauauauacacauguauacguauauauauauaaaaauauaaaaugguaucuuggcaauauuuccugccccacuaccuuuuccuacuccuccuucaccaaacagucccuuuucuauuuucuauuuuucuuuucuauuuucauguuacauguauguauauauguauguauguaucguuuaaugcaaauuccucaucugaaagaaaagugugauauuuucuaucagucccccuuuaguuuuaugucacauauguuuaugaaauaauaugaauuuauauuuaaaucuaauuuccauguaugagaaagaacauguuauaugucugagucuggcuuauuuuguuuaucaugaucuuuuaguucuagcaaaugacauaauuucauucuucauuauggcuagauaaaacucuaucgucggagcuggagagauugcuuuguguuuaagggcacauauugcucuuacagagaacucauuagauuccuagcacccauauggugcuucccaaccagcuguaacuaguuuuauggaaucuggcucacucuucuggcccccauaggcaccagacacacacauagugcacuuauauuccuucaggaaaaacacucauacacauaaaauuaaaauaaaaauuuaaaacuccaucguauauaaauaccacaauuucuuuuuuaaucauuuccuuuuaacuaauuuauuuaauuuuuaaguugguauacaaauuauuggguuccauuauagcacuuuuacaaaaagauuuugauuuaugucuauguggggaguaguacaugauucugaccuguggaggccaaaagaagggagucuucuggagcuggaguuacagacaguugugugccaccugacguggguacugagaacuaaaccuacaucuucuucaagaaacacugagccgggcuggagagauggcucagcgguuaagagcacugacugcucuuccgaagguccugaguucaaaucccagcaaccacaugguggcuuacaaccaucccuaaugagaucuggcgcccuccucuggugugucugaagacaguacuuacauguaauaaauaaauagauuauuuuuaaaaaucuuuaaaaaaaaagaaacacugagccaucucuccagauggauuaugacaguuucuugcucuagguccuuucauucucccaauugccacauuuucuugaucuauucaucuauuaauaggaaucuagggugguuccauaucuuggccauuguaaguacagcagcuguaaacauggauaugcaaguaucccuauauuauggcaacagaguaguccuucagguaugugugcacuagugauacaacucggucauucauaugguuaaugucguuuuauuuuuuauuuuuuugaaaaaucgccauucuaacuuccauaguugcugcacucauuuucauuuccaguaacuaugaaaguggggguccuuuccccaauauucuuuccaucauucauugucauuuauuuuuuuuaaugauagccaauccucccauggugagguagaauuauaaugaagauuuaauuggcauuucccuaguggcuaaggauauucaacauauuacaauuacuuauuuaccaauuuuauuuuugagaauuaucuguuuaaugcauuugccuauuaauuggauaaauuggggugauggaauguuuaauuuuaguaguucuguaucuguauacuuuuuuuuuuuuuuuuuuuuuuugguuuuuagaggcaggggcaggguuucucuguauagcccuggcuguccuggagcucacuuuguagaccaggcuggccucaaacucagaaauccgccugccucugccucccgagugcugggauuaaaggcgugugccaccacgccaggcucuguauauauucuugcuacuaauccccugucagauguauaguuugugaaaguucucucccauucuguaggcugucucuucacugauaauuuuuuccuuugcugugaaggaaguuuucaguuuaauaagauauaauuuauuguuucuugagauuauuuagugagccacuggaguucuuucuggaaaauuuuugccuacucuuaaaucuugaaguaguuucauuaggcuuuccucuguaaauuucaguuuggggucuuaaguugugaucuuugauucauuuuucauuuuuugugcagagugaaagcuaggauagaauuucauucuucuacaugugacuauccaauuuuccccaaugcucuacuggauuuugaauccagcuuggcuagcucaguggucacuguuggccacaguucuccagauuugucuagucaucuaguuagauguagaguuagucagaacuaaagggaucaggggauaagauuaccuuccucccugucuuccuucuuauaaguccacacagguacuaaagggacaagaauaugucuugccauuucccaaccucugguuggucaccagcgauacucgggagagccagagcuuaguagguacuauauacuuccaggauuuaugaauacuguuuuccuaguguaacuaaacuuucuuucccuugcuuucucauacucaacuuuucuucuguaagucaacaauaguucugugauccuacuagcagcagcaccugaaaacuaguuaaaaauguuaaguucuuggguuagguauacuuuaguucuugcuuaacaugugcaaggccuugaguucuaaucgccaguacugccagaaauaaauauaagaaugcacuacuccagauuccugagaaauacuaaauccuguggggagggaggcuucugaugcacccacacuaaaguuugaaagccacuguucugagcuguguuucaaaucuuccuucaaauucacauucauuuagcagugguaaaagaguuaacucucucagguacuagaucuaggaauuaaccuuauaugacauggugacauaaauaauaguaucuucauuuuauaggugaggaaauugaaggacagaaauauaaaauaaucagagggcuaaaaagcggaucacaagucuacucagagucuaaaggaacaaggccccgcuuuuguaaucuggagccacuugggaaauugagggugguuaguaaugaauagauuuuucugaaguuguuuuuuuuuuccuuccuaaguuugccagggguaugucuggcuuuaggagaacaagcaguucuuuauaauucugccuccucagaauuauaacugcucaguaauaaggcugguuucaguagucuuuguucugcguccccuuaauauauuaguaacuaucuuaagagguccuucugauccuuuugacauguagaaaaucuaccaaaacucauccugaauugaauuuauucuaggguaacguguugaaaacaaauuaggcugcuaguuaaguacuuuugguuuaaauucauguaauaaaauacuauuuagucugucucaugugaccauauuucacucauccaguguuguaaauuuuuauucccuccuaguuccaauguuuaucuggaagaccaucagugcuagucaucagaacuuaaugguucaaggucaucaggaaaggacauguaagaaauguacacucaugacuggaaagcacuugacuccaaacuagaacacaagugccuaagucaugauuacucaguucuugcugucccaaauuauuuuuuugccuauuuuuauaaaccaucaaaaacucuagcuauguauuuuggaguccaauaggguuagucuacucccagaugacugaaauguacugaccacucuuaccuuaggcuucucuaguagaggcaaggaguagaacuaguauuuugcauugucauugagcuagugaaggugcggaauuagaacaccuucaguucacugucaaggacaacuuuaugaaaguaacaguuuaguuaauauggauaauuugauaaaucuuccuuuaggagagaagcccggugacugauuuuauuuucuaauuaaaaauuacuuagucccugccaccuacacacauacaccuaacuauggcaaggcauggguauuuuauuuuguaaccagaagucucuguaccuuugucaaaucuuggacuaugcaauauuuucuuaagaguaauaugagcagaaaauuauuacaauguugaaacagaguccaaagaugaaaaugggacauuacaaaauagguuucaaaaucaaaugcuguccuuaaaaguuauauacaaggcugaaaauuuucaaauuauacuuuaauuuccucaaauggggaauagguuaugcuuucaauuagaaaggcuauauuugguaccaggaucaaauuucuuaaccagacuuaagacaggcuugaaagaguuaaugcuuauugagcauuauucaugagcaaguggagcuggcauagcaacaguuucuccccagggaggagaggggaggagacagacaggacaggacacaguguucacagucugugguuggagagccagcacuagccuagcuguauuguuuccucuccaccccagcacaaagguacugguguggugaagagagcacaugugccuggguuugggaugcugagcacagaaagccccuuuuggugccucuucuggagcacuaagacagcagcagugcaguacagcugaaugguccauacuguuucugcuaaaguucuacaccuuuuguaaauugggcaggagcgccuggaagcaaugaugcgccggucccuggagcguacacaacagcuagagcugaagaagaagugcucaugggcaggaucaccagggccuggcggacgugauggugagucuaauacugucucugcauugcagggcccuguagggaaucucgggagugacugaugucugcaggauuggaagauccugugcacagcuuuuaagaugcuuaaacugccaugcuuccuguauguauaugcauuucucauagaggagagcugucauucuuuuugcuaucagguacucaaagcaugaauacugggcuuuagggaagagugaaagaaaagcagagaaaauaaauauagagccugguagcugaacugagcacacagguccaaaaacagucucauuuuaggagagggaaauagcagaaggcacagucacagcucuagauaugccuggaaaagcagcaguuacucucuaagaagggcugggcgguuuccuuuuuuccccuguuuguugcucugauuuuauuuuaaaggaacuuaacuuacuuuacuaucuaauucauaaucaucuuuaaaucuucaaagaccuaacuuauggauuauuacuacuaucaggaugacuuuccccucuuuucaaugucauaguuuguuucaauaaucucaguauucuauuauacaggaguuguaugcuaccucuuucugagagcagauuguaaauaacugacucuugacuuugccaucuugugauuuuuaaccauuuggcaaugaauacauuuuuuuuucuuuugaaaaggcaauaauucauuuguuacuuuucuaauuucuuuauuaaaaacuaaaaugcagcaacaaauuggaacuuuuucuuuuaccucucuuugcucugauuuuuuucuguguaggugaaucagaaaauaccccaccccuuccucuaacuuuagcaaccagcacccccccuuuggacacagggaccacuacagcugcugccgaguccaccaacgguauacacgagcaucaccaugccauaguguucugugacaacugcucugaucacccuccuccaucacugucugucucaauugugaagucacucaaaagugaaaucacuuucacaauugauuucuuggucugacuugucaugacuuuucccccuagagcugugaacgacaugcccauauguuuuuuguuccuuugucaucacagugcugcaugccuuauaucuuagugucccggagacauuucauccucagcucacuaacuucugccuuuaaaaaaaucucaucaauauuuggcuuuugugcauuuagagucucauuagucaucuuguuuuacuuuuaaguaucaaaguacuuuuuuuacuucugguaaaaaaaaaaacagaaaucacagauucugaauagaauacuugggcuugguuaauguagugaauuucuggagaaguguuugagaggcagugguagggaauucaucaguacuaacauggagagucuaaauagucagacaauuuggcuuugugccagacauucuaucucucugucuaaaaauacaaaacauagaaaauauaaacaugaaaauuuuccauggucuagauuaagaauagaacuagcaaaacuuuguuuucauuuaauaauggcuuuagaaaugcuguauauuugacugguaaacugaaaaugagauauagaagggauaugauacuuaugagcaauauaggaagauauuugaauaguaagaauaaauaucuuugauuucucguaucccguugacacagccuauccuuauugguagugcuaaguagcacagauuuugcuuucuagguugagacuuggccuuccccauaguaaagcuaguuacaaggugagcugagggacucagacauaccaccuauaugaaugccaaaaauagcaagaugaaauaauauuuuaaugcugaauuuauaaaaauuaaaccacuuggucagcagaaauugucagauaugaggaauucuuucauuugaaagcaugaguuaaauuuugaaaauauuagguguuagcuuccuugauaggaaugcauggguuguuuuacuuuugccucagguucuaacacagauucacagggcacggccaguacuuuucguuugguuguaaugauuuaauuuagaagccaauauagaacaaugacagaaaacauaagaacaucaaaucuagggucagauauuuaaauucuuacuauacuguuaaaacauuugcagaggagccauuuugaugccuucucuuaaaaauaggaagaaaaucuaccacugcuaaguuagugcuacuuuaaacacaaacugcauuacaaguaacauuauuuuuccaaccugagccucaaauaaccucuaggaaauguucuguuucggcacauacaguuuuauucaagguguuugauaguucuaagaacuguugucccuaggucuagguuaguuuuguuuuuguuugauguggauauguuuaaaaguugcuggacacaagaaaauacuggaugagauuagcauguuuuuagcugaguauuagaaugaguuugaacauuuaaagagaagagcacagugaagaaauugcaaaccggugaaugcugucgccugaacauuuccagcuuaagauaaugaaagcagugugcugggcuccaguggaguaccacugaacguguguggaugaggacaggaaggacgcuuugagauaugauuucacaggcgacagugagagaaaaccaaugucuuuaaugcauuucucugcagcaugugacaaacuuucaacaucaaccaugaauuugccaaagcagacggagucuccuaugaguaaacaccugucuucauccaccguggcaauaucuuauuccccagaccgaggcaagugaauggguagaccuugucucuccaguuugcuucuuucuggugugagcgucuuaacacugcccuuugugaaagucuccuuucuuagccuucuguaagucuuaccacuguccuaaccucuaggguuuggcuuacaggacuuuggaaaauuagcacuuuguucuauaaagaaaggucauuauuaauuaauaggaauugacaguauucuaauuugccagaaccuauuucacagagcauagaggaguuuuguuuuguuuuguuuaaagaacccacuagauagccgggcgugguggcgcaugccuuuaaucccagcacuugggaggcagaaagaagcaggcggauuucugaguucgaggccuggucuacagagugaguuccaggacagucagggaaacccugucucgaaaauacuuaaaaaaaaauacuuaaaaaaaaaaagaagaagagacugcuaggucagugauauaauugauuauaauugauuagcuagaggagaauugguuagucagacuuuucuagaagacuugauaagagaaaaaaauaggacugugaagucauucaugguuuguaggccugccuauuuuauaaaugaaaacaaaaauacagaaagaagucgaugcuuuuuuaaaaagguaaaccaugaacaaccuuuuaaggcagucuuuuguuuugggagacaguauauagagggacauccacuacuuucagaaccucuguguucuagugaagucuuggaagagucacuggagccccggaguuuugccuuuuaguauacauggguuaagaaagagaggucucuucuuguguaacaggaauauccuaaaacacggaugaaggaagucagguauuagaagacugcugagguugucaggucaucaccaaggggugagcaagaagagguuugugacuuggacaaggcugggaggccuuuccugauuguuacucacugccauugauuuuauccccacaucccagaggcaugauauauggaguagaguccccagaagugucauaaugcuguucauuucugauguccguuuaugaguaaacugcucgaaacauggaaggaaggaagaguuugaaaagaaaauacuuaacacuuuuaacucuauguucauuagaucacauggucauagguugaucuuaaauucauuuuuugcauuaaugaacauguaaauauaaacaugccauuucaugauugacaacugaauuaucugcuuauguguauauucuagauugaaauuuuuaaaucuccauaccauuuacuaaauaggcaucuaaacaauaucuauugucauauaucccuaaaccaaaacauuuuaguuguuagauuuuauuuuuucuuuucuuuuuuuuuuugauauuuuguuguugauuuugcuuuucuuuuugaggcagcaucugauucuaugguccaggauggcuuuguaccccugauauuacuacuuacacucccaagugcuagguguaaauuauaacauccaggaggcaacgcaguuuggaucaugaauccuaccuacugucuuccauuaaagccaguuauuugguuggcuauuauuuuugugccauugguguaauuuuggccuuacuuaaaaaauuaaaagcagaagaaagaauuucucuuucuacuauuauaugaaggcacuuuucauuuaaaaaaaaucagcauuuuaaaauauuucuuuuauauauuuuuaaauuuuuuauugaaaauacauucuucucucacacaauucauuccaaccacaguuucccuccuucuguuccucuuagcaccucuccaccucuccucuccccuagauccacucccccuccauuucuucuuuggaaaagagcagaccucuaagaaaguguaaaauuaguuuaaaauuaguaaaauugggcaugaucuuuguuuuuccaguguuauauguccuuaguaagggaguucagauaacuuugggaagugggguuaauucuuuccaucuaguacuggucaccgagcuuguucuuuguucugcuuugcuuuguuuuugagacagguucuuacuguguagcucaggcuagcaucaaacaggauucuucugcuucaguccucaacugcuuugauuauagguguguaccauugcacaccgagagcucaccuguggcucagagaauaauguguugacuuaauucugaugccacaagagaaugaaggaaugaacucgaaaaucuugagugauguuuuauuuuuuuuuauuuuacugugacaaacuccaaaaccauccuuuguuagaguuacuuuaauuuucacaguuguucugccaccaaaauguuaaaugcuaucauucacuaucuuguuuaaacacuauuuucuuuuauuuuaauuuugcuuuuaaaaauucaauuuaauuccaucccucagcucauugcaugcaccuuaauuccauagacaccuuucuuguuuccaagacugcugacaccacauagccuuuuuaagccagcagcagaaauacauacaugcucuuugagcaggcccgugacucaggugaaagaguccaagcugugaaaucaaagaacauuucugaaacuuuuuuuuguuguuguuuuucaagacagggcuucucuguauagcccuggcuguccuggaacucacuuuguagaccaggcuggccuugaacucagaaaucugccugccucugccuccugagugcugggauuaaaggugugugccaccgcacccggcucugaaacauuuuugaucagccuuggauucauuccugaauuuuugcaucuuacuucucuuuugcugccuuuauaaaaugcuuucaaugacuaaauagcguuuucugccugacaguauuuugcuguugcuguuuguuuuaaaguugaauaauauauaggugaguaaauaauuuuaugacuggugacaugugaaucagguggaaaaucaacuugauagacuauggagguuagaauuuucuuaggagauuugggggggauagcauauacaucauuccccuuggaguaccacagcgacuacucacuuuugcucauugaaaguggaaguauuuauuuauuuauuguaaugaaagccacaucuugugguaaaugcuuauaauguuagcuacuuaguaggccaaaguuggaagaucaugaguuugaggccagucuggacaauauagcacgacugugucucaaaauuuuaauauuaaauugucaugaggauuaaaugagaucauaguauaaauaagguuacacaguaguuggcacagcauaaaagcucaacagaugucuagagccuugcuacucaaaaaagugauccauggaccagugauggaaacuuuguagaaaggccaacucugaggcccucccuaaccuguauauuaaaguuugacaaacacuggaucagacuaucagugaccuuucuuuauugaauacgauuagaacaugaugucaagguuuaagaggguaagcauucucuucauuugcacaugagcagcacagugacuauauaaggccacauuccaagauacaguguauucagugaaaauuacaucagacuacauaggccuguucuucuuuuuaccagagaggacaagaucucauguaguccagacuggucucaacuucacuaauguagcugaagcuagccuugaacucccaaauuuucugccuguaucucccaaguacugagaucgacaguaugugccugucuggcuauaaaaccucuuaagugguuacagugugguguggcacuucuacuccuagauacagagccagaaaaauuaaaaacacuuaaagggugaauguucuuagcagcauuauucacaguagcccaaguggaaacaauuugaauggauaaacaaaaugaaacauaucuauaaaguaaaauauuguucagcaagaaagucaugcugauagauaauaccuaauagaugaaguuugaaacuauuccaaguaaaagauggaaggcacaaaugucacgaauuacaugacuuugcuuauauagaauguuugaaauagguaaauccuagagacagacaguagauuacuguuuaacauggaaggcagggaagaaagguuaaugacugcuugauggauaaaagguuucauuugagagccuuaaaaugauuuguaauuuggucaugauugugaauauacuaaaaucaaugaacuggacauuuaaagggaaaauuauaugaugcgcugauucuaucucaucaguaacccuaaauucuuaaccaguaggaaguacccucauucuuaggaggagaaaugucucagggggucuucagauuugcucagaagguccaguaugcagcuagacuccccucuuuuauuuauuaugaugaaaagcuauacaagagaauccaccaagggggaaaaaggaaagacagagucuagggaagacaaggcacaagcucccagagucucuccaggaaucacugaggauguguuuacugaagugacuuaagacaaggaugagcugcccaccagggaaguuugguagauauuugaugcugauuuuuuuacagagaugugaccaugugaacuccuuguucaauauguagcaagauuuuguauucuugagccgggcagugguggugcaugccuuuaaucccagcacuugggaggcagaggcaggcagauuucugaguucaagaccagccuggucuacagaaugaguucaggacagccaaggcugcacagagaaacucugucuugaaaaaaaaaauguauucuugaaaugaaaguguauuuucagauuauuuuuacauacaguuuaaagcacaauaaaugaucuucucaccagccaaugauggcauccuugauaaagucuuacauucccaggcuuuguucagagacccaccuuagaagcuggcuuuuccaaggccagcagucaaaucugaacagucucuucugaauaguccauacucuuaaccccguugccaugucuuuaacagugagaccccacacaacaggauaaggccagccuguggcagugaccuuacauguaacuuuuagauaaccuggguuuaaaaguagaaucaaagccgggcgugguggcacacgccuuuaaucccagcacucgggaggcagaggcagguggauuucugaguucgaggccagccuggucuacaaagugaguuccaggacagccagggcuauacagagaaacccugucucaaaaaaaaaaaaaaaagaaaaagaaaaaagaaaguagaaucaaaucccacuaaccuuaaaggucugucagccauguuguuuccuuguuccuucugaaucuuuuucaccuggcuccagcccagcucuggccaguaaguugaagcuuuccugacuaccuucaauucaggucugaggcaaugaugguaaaggcaugaauaacaagcaccauucuuuaggguacauggguuccuauggaaaaugagaaggcgaggacuucaaggcacucagagcaggagauuucauugaucaagagacucacuccccaaucugcauuccuauuguaguuuuccagcuguaguugccccagggugcuuaguacagugggaguaauacauuucagucugugauuccagaaagucugccuaaggcuaucagucccaaaguccccuucuguuggugacacugacccaccuaccuggugaguguggauaguauaucaaugugcugucuaaaaauagagagugaaaagacccgaaaagaagaaauuuccacaagagauauacauuggaauuuuaaaauucaaauagagacuacaauggcaguauaccaaaaaauggccccucauaguuaucucaguaacacuguuauuucaguuuagacucagaaaucugugcacaguagcuugcagaggcauugugggaaauuuccucuagaagaagagaacuucuuagagcaauucuggaaaacaaagauuacaaauaucuuugugacaaugucccccaugcuacuauaaccagacuuuuuuccuuuguauucuauucagcauccaaaacuugauuucucaauuauucacuacacuugcacaagccucuuuuuaaaaagggcagaacaucuucauuggugggagaggaagaggagaagaauauauauaaaaaauuaaaucaucuuaaucagaaagauauaucauguuuagagauuauucagagucaaauccuaaauuuucaaagaagguaucuuagauauauguaccaggaaacgguaaaguaaguagagucaggcuguauaguccauuuuuauaaacuacuuuuaaaaaucaagcagaaaauaguaauauugcacuuugacaaucuuuugcaaagaauauacauauucuuugcauccaaauuauagcacugaagagcagcuuggauuuuuuuggauggugccaacauagaccauguccuguagacauuuauauagcccagguguuucagcaguauucaggguguuucacaguuuaggaggguuguauuuguaguagucucuauuugaauuuuaaaauuccaauguauaucucuuguggaaauuucuucuuuucgggucuuuucacucucuauuuuuagacaaaaauaauaguguaaaaaaaaaaccccaaaacauuaguuugaaacuuguucuggucucaguacguaguuccaacacacccacugagacaaaaacaagaaaagguuggucccuccucauuuccacugaaggaaaacuaaaaccacucccugacugauuauuuuuuaaccccaguuuagguagaauagccaaaaguagccaaagaauccccugaagcaacacucuuggaauugcaguaguuaucuucaaauucuguaugcaauuuuucaccucucacaacagagaaugucuuggauguuucauaucaugaccaacaacacuaccgccacacagcaccacagguucacuccuuccugcccccccccauuuccccaaacauuguuuuugcuuuauuuuuugaauuggagucacuguagcaauucccaccucugaugucaauuguuucuagggcccucaagaacaccaggguuuggugauucaucaauagaacucagagaacucauagcuccuggcuguaauucauuaugauagcaagauacccaaccaaguuugcaaaaggaagaaugcaugaaaaguagaguggaaagcgggucuagguuucuaaugaucuccuagaaaagucauacacauaguguugcaacugaggaagcacccuaaagauuuagugcccuggguuuuuaacagggucuagucauguaggcacucucuaccaaacaaauauccaaacuucacacacuuagaauguguucuuuuuacaaacaggguuugugcuguuuuuuuuuuaagcauucaccugugaaugucauuaaccuuccuaaaaucucagcuccuagauacugaccuaagcucacucaaccuuguaagcagaccugcacagacagcagucaggacuucuauguucugccuguauaaggcaguugaggcuuagacauuaaguagccuguccaaggaauccagcuaucagauggcagggcaaagucuuagcucccaaguacauuaaccacucaaaugaaaaggacuguugagucuuauuuaagaugaguccuaauguauauucaguagaaaaaccauaauauuuuuuuaaaugcggacuaaacauuacauuuuuuaagaaguaagcucuuuuuauccccugauuguccugccuuuuccaucugugcuuccuuuauuuucugguuauuguacuguaacucucuaguauuccaugccuguccuuguguagcucucgggagcccucucaaaucuucauacaaguccucuccaacccggaccacugagaaaaagaagaauacaccuauaucugccaugggagaugcugggaagggagccauggcuggaggagagccuucacagguaaauuuaaguguucuucuucauucuauaguuugucugacagugugauuguuucuaccauugaccugggggucucuccuuuguccaucuaucuccagggccuguucaaaggaugcauuugguuuaaguuuuuaccaaacuuuggaaaauuaucaaguguuuuugcauuccucuaaagcuuaaugucuuguagcagauuccugaugauauuguugugauaauacagccuuucuuccaggggacaugagucagaaggaguguugcagcgacccauucugcuuccucaggcuaucugguucuaggacucuugucucuguauacaaccaaaacugagguucuaggucaaacuucauucacaauagccuuugaaugauuuuuuuuuaaugucauacggacacuguuagugaaaagacuauuaaacagguaccucaauuuuauguauuuauuaagaaauuaugcugggcagugguggcgcacgccuuuaaucccagcacuugggaggcagaggcaggcagauuucugaguucgaggccagccuguucuacagagugaguuccaggguuauacagagaaacccugucucagaaggaaggaaggaaggaaggaaggaaggaaggaaggaaggaaggaaggaaggaaggaaggaaggggggaagggaaggaaggaagaaagaaaagagagaaagggagaaggggaaggaaggaagggaggaaggaaggaaagaaagaaagagagagagagagagagagagagagagagagagagagagaaagagguuauauaugccauauuauuuguguuaucauuugcuacauaguaaaguacccuaaaccuugucagauuaaguaaaaacaguaugagccgggcgguggugcccagcacuugggagacagaggcaggugaauuucuggguucgaggucagccuggucuacaaagggaguuccaggacagccagggcuacacagagaaacccugucucaaaaaaccaaaaacaaacaaacaaaaaguaaaaacaguaugucuucauuccuaaguuccuuggguuugaaauugaaguuagcucaauucagagcuuggugguuuggguacaagauuucaugaggauuuugucagaaugcuggccagggcuauagcaucugauggcuuaacugggccucuugugagacuuucauuacagggcuacugaaggagggacaggcucaguuccucauucccacaagccucuccacaaaccuacuugugaguacaaaauggcugaccucccucagaucuauuguuauucaauacaaagggaguugagugccaccuguugaaggaauauauauauauauauauauauauauauauauauauauauauaaucaguuguguuugauuauguaucaauuguuaauacauacaauuuacauuaaaacuacuaaauacuauugagacuuuuagcuuuauuaauuauuauuuuuauuauuuguagucuuagagagcaaauucaggaacuuccauguuacauugaguagucuaccacugucuuaauauccugagcacuauugaacauuuuauaaaaacauuuauuuuuuucaaauuuguguuugcccugcgauaguuaaaauaggagcugguauuuuugagucuaagauuuucuguaaggugggcuauuuguggaagaagguugccauuucuggggaccaaaugaggacuuguuacagaaaaguguaguaaggaaagagggugaggcuguuucugcaggccagucagugaugcccauuccuuucugccaagagaaguaaggggaaaauagagaaauguguguuuugcacucugcauuauauaccauguaugccucagaguuuacaacucagcaucuuggauauuaaagucccuuucugguaaagcuuuuguaguaaauguaugguuuuguuuguaugaauuuaauguuucaaauucuccaaacccucccauauacuucuccuugcucucuuucaaauucaugauuuuuuuuuuuuuuuuuuuuugguuuuuuugagaccggguuucucuguauagcccuggcuguccuggaauucacuguguagaccaggcuggccucgaacucagaaauccgccugccucugccucccaaaugcugggauuaaaggcgucagcuaccacacccagcuuuauuguuacauauauguauauacauuuauauguguguauaugacuaugaauaugaauauacuaauaugaauauauuaguaauuccuaaguacauaaccaaguauaggaagcccuuuuuugaguuguuagucaggguuguucaagagacacccaaaacauaggcuauugcucuuugccuuaguugcucucagagguggaagguuaguccuuauugcugaaaauaccauguacuuccgacacagaacccagaaacuucugagcuacaaguguauguuuuuguacucuuuccaguuccuauauauuuagggccacuaucugguuaugcuguuuguuaccucuugguaagauaauaaaauguggggcagaggaucuccauguugaagcacaaacuauuguuccaacuugaugaccuaaauauaaugaugucauaguaucauaauucucuacaaagauucauguuacauacauauugauaccucuguaagaaaacugugucacucugaucugguuuuuuucaaauuguagaaguaguaccagucaugagcuguggcuaucauauuuuuugucccuuacagauggagaaaaugaagaaggggcgaguggcaacuucugcugcuucugggggucauggguccccacugagaagaugcgagccuccugaagauauuuccaagagguugucuucuccugugaaauccaaguaagcaguauuucccuugucagaacucugaugguuaacagucaaacuuaguuugguuccauccaacauuguggcuucugcucugccaaaagcacgaccagcaaaaagauuugagcaagacaaaugccuaccuuugagguaugugcuccaugcuuauauaucuucuggauaaaugaaggaccauuuauaaguucauugcuugguaacauauauaggacucauauuugccaagauuauauguucaucguuuucucuuuaaagccuucaauucuguuuuucucuuccuuauucccucuggaauuauccuuuuucuucugaugaaccaggucuagcucuagauugaagugauugcauuauuugugggcaccugcucaccaucuuucauuauuggagcuuagcaauuuuguuuuggagacauagucuccaaaaccaaguucucgugaccuugaacugaucuuucugucucugauucuacaguguugagauaauagguauauguuaucacacgacacaauauuuuccaauaaaacacauaauuuucauuagggauagauaaacucaacaaggacaauauaaaaaaacaaauuuaugaucauugucccaaguuacuaaaaaauuuuaccaacaguaauugacaagagugauucaguugaagggucagugggucaguaaaaugguuugcuugcuaaaggugcuuaccauaaaagccuggcuaccugaguuugaucccaggaacucaccuaaaaguggaaggauuguccucugaccacuauacauguaccauugcacacauccccucuucaugaacacacauauagaaauaauaaaagagugaaucaguaacaaccuaauuccgaaguagaguggaaagguauaauguuacuuagaaguuuuucuaugcaggauuacauaagaucaucuucaugcaaguauauaauguuuuuugagcauauaucccucaguguaacauuugaguggagaccuaccuauaugaagugaggaucaggccucaguuggagccuucuucaucugaagcuuguuugcauuauaucaacauuucauguucaguuaguggucuuacuuugaggcuggagagugucuuuuuuuuuucuuaaaaagaaauacauuaaauuggggcuggcuuacaauuucagaguuuuaguccauuaucaucauggcaggaaacaugguagaaugcaggcagacauggugcuagagaguucuacaucuugaucuaagggcauagcaugaccauaggagaccuuaaagccugucugacacauuuccuccaacuaggccacaccuccuaauagugccaucccuaugugugaaucauucaaacaccugagucugugagggccauaccuauauucaaaucaccauagacaucaacaugggcccaggugauaguucagaccagggauauccgccuggccuuuggugauaucagaccuacuacugaagggccauggauccugauauggcccuuguuggcaaaacaggcuaggaccucaccauggccuuagggugacacuguuggcuacucucaugaggcuguuccucgcuaccuuggagucuccaguuccacauccuuucgugucucuuuuuuuaacaucccaauugcugcccacaauuccguccuccuuccccccuccccuucccugagaggaugcccacacccuggguauuccccuacucuggcccaucaagucucugcaggguuaggcacauccucuaccacugaugccauacaaagcagcccuguuggggaauggauuccccagacaggcaucagcuuuagggacagcccucacuccaguuguugggcuaccugcauggagagugagcuacauaugagcagggaggucuagguccagccuguguauguucuuugauuggugguucagucucugagagcucccaaggucccagguuaguuuacucuguuggucuuccuauagaguuccuguccccuuuagggccuuuaauucuucccccaacuccuccacaagagucccuaccuccacccaauguuuaucuguggauaucugaaucuguuguagucagcugcuggguggaaccucucggggaacagcuaugcuaggcuccugucugcaagcauaagcagaguaucauuaauagugucaaggauuggugcuuacccauggacugggucucaaguuggaccaguuauugauuggccauucccucagucucuguuccauccuucaucccugaaucucuuuucagacaggauaaauuuuggguugaaagcuuuguguguggauugguguccccaucccuccauugguaguucugccugacuacaggagguggccucuucagaacccucagggggguugucuauuuauuguuauaggacagaugcucaguaugugucugucuuaguucauuagagcuaggaaugcgucacaguuuagaguugcucaggcuuggggaugcauguacagacuuaauugguuaagcauccuugaucugacuauuugaaaucugagcauuucucagcaguaccaugaugcuuuaaaaaauuuggaauauggagcauuucagauuucaaaacuuucuauuaagaaugauuaaccuggggcuggugagauggcucagugguuaagagcgccgacugcucuuccgaagguccugaguucaaaucccagcagccacaugguggcacacaaccauccccaacgaaaucugauucccuuuucuggaguaucugaggacagcugcaguguacuuacauauaguaaauaaauaaauguuaaaaaaaaaaaaaaaaagaaugauuaaccuaaaaauaagcaaagaaaauaaaacacagcagggaaagggggaaaaaaagaaugcuuaacuuugguuaaagaguugagaggucuaaagagaagcaaguguuucugguuuuaaaauguucagaaaagccagacuacauuugggaggcugaagcauagggaucauauaaauuucuaggccaaagcugggugugguggcgcacuugggaggcagcggcaggugaauuucugaguucgaggccagccuggucuacagagugaguuccacaacagccagggcuauacagagaaacccugucucaaaaaaccaaaaaugaaugaaucaaugaaugaaugaaugaauaaauuucuaggcuggccugagccagaauaugcuacauauuuaaaccuuucuuccaaguaaauaaaaauaaaauacucagaaaaacagguuccuacuaggugaaaaauaguggaugaauaacauggguguagaccagucuagagaaucaugagagcuuauaugccccaagcauaaauuaauuaaauuuuagccaaacuauacauuaaagaacucauuggucacaacugccaauaaccacauggauggaucucaggaaugucauaaugauugggaaaagcaaguuauagaagaaucucaaugguaaauuucauuuauuuuuaguucccagauuacuucuuaaacaauguucuucagaauuaaaugugguaaaaugaauuuuuauaaaaauaacaugguauacauaaaauuuaggaagauacuggauucuuugaaugaggaaagauggggaucagacaaagaaggggcacacaggaauuuucaacauaaugacagugccauucuucuggauuaaaugguggacgugugggcacuuacuguuucauucuuuacaccuuaauauauuuuauaaccuuuguuuuauguauucaguauugaagaaagacaagaaaaagaaacuugauauuaaaaauuguaucccacauaagcaaacucuacuuauuauugacauuuucuaauuuaaauaugcaugggugcuuuacccacauguauaucugugcaccggagugugucugguacucauggagcccagauuccuguggaacugaaguuaaagaaaguuaccugcugucauguagcuacuaggaauugaacccaggucuucuggaagaacagccgguguucuuaaccacugagccaucucuccagcucuggguauguuuaugggagaguuucuagacuguuauuugggguagaaagagaugcccuaaaugugaacggcaccauuccaugggcuggcaagcugaacaucaauguucauuguuguuuccugacugcagauacaaugugacuagcugucuaaugcuuuuaccaucauguuauacuauuaaccaaccagcaaaacaaacaaaaagcacauguuuucuuuccuaaauuacuuuugucagauauuuuaucacaagaagaaaaguaacuugcacaaaaagguauuuugcauaggucaaaauaagcaucucauugcucuaaaucauuugcucauagaaaaccaggaauauuuaauuguuuuugucuaggagccauucccauagacuucucuggcagacgcacuguaugguuauccacucccauagauaauugaccguagggcacccuguguugacuauucagccguguuuugucaccaccauuuguuaauaggcuuuauuaucugagcuuuuuuaucugaacuuuuccauguaaaggauaauugaaaacaucaagagauaccugguccuauagguauauguauuuacccacuccguaauacuauauguuuaagucuuaucaaaggaucauuugaauuuggaucaacuuuuaagccuuucucuuuaguucauuucaguuuuaaagaauuauaaguacccuuucauccacauuuguuuuaucaucucauccccucuaucaguagacauauuccauuaucucccagaacuuuugaaaguaaguugcugacaauaugucccucaaaaacaaaggcauucuuuuauuuacuaugaagguugaucuucauugucaacuuguuuagauuuggaaucaccuaagagacacaccucugggcauguguuugagggagucucuaaagagguuuagcauauguuagcauauucuguuuauuaaugaaggguuaggauaguugaauauacacagaauuucuucccaaauaaucuauucucacuuaaaggguagaagggguuuguuccggguuuuuuuuuauuggacauuuuauuuacauuuuaaauguuauccccuuucccaauccccccuagaaguccccuauugcaucccccucccccugauucuaugagaguguucccccacccacccucccacuccugccuccccacccucgcauucccauacacuggggcauugagcuuucacaggaccaagggccucuccuccuguugauguccaacaaggccauccuuagcuacauaugcggcuggagccaugggucccuccauguguacucuuugguuggugguuuagucccugggagcucugcggggucugguugguugauauuguuguucuuccuaugggguugcaaaccccuucagcuccuuaaguccuuucucuaacuccuccacugagcucaguucaaugguuagcugcaaacauccgccucuguauuuguaaggcucuggcagagccucucaggagacagcuauaucaggcuccugucagcaagcauuucuuggcaucugcaauagugucuggguuucgugacuguauaugggauggaucccuagguggggcagucucuggauggucuuuccuucagucucugcuccacaccuugucuccauauuucuucccaugaguauuuuguuccccuucuaaaaaggaccgaagcauccacacuuuggucuuccuucuucaugaguuucaugugaucugugaauuuuaucuugguuauuccuagcuucugggcuaauauccacuuaucagugagugcaugccauguguguucuuuugugauuagauuaccucacucuggaugauauuucuaguuccauucauuugccuaagaauuucaugaauuaauugcuuuuaauagcugaguaguauugcauuauguaaauguaucacauuuucuguauccauuccucuuuugagggacuucuggguucuuuccagcuucuggcuauuauaaauagggcugcuaugaacauaguagagcauguguccuuauuaccaguuggaacaucuucuggguauaugcccaggagagguauugcuggaucuacgaguaguacuauguccaguuuucugaggaaccuccagauugacuuccagagugguuguuacaagcuugcaauccccccagcaauggaggaguguuccucuuucuccacauccuugccagcaucugcugucagcugaguuuuuaaucuuagccauucugucuggugugagguagaaucucaggguuguuuugauuugcauuucccugaugacuaaggauguugaacauuucuuuugguguuucucagccauucgguauuccuuagaagagaauucuuuaguuaguucugugccccauuuuuuuuagaggcuucuuuuucuuuuuuuuuuuaauuagauauuuuuauuagauauuuucuucacuuacauuucaaaugcuauccugaaaguccucuauacccucccccugccuugcuccccaacccacccacuccugcuuccuggcccugguguuccccuguacuggggcauauaaucuucacaagaccuaggaccucuccucccauuuauggccuacuaggccauccucugcuacauaugcaacuagagacacaagcucuggggggggggguacugguuaguucauauuguuguuccuccuauaggacugcaaaccccuuuagcuucuuggguacuuucucuagcuccuucauugggggcucuguguuccauccaauagaugacugugagcauccacuucuguguuugccaggcacuggcauagacucacaggagacagcuuuauuaggguccugucagcaaaaucuuguugguauaugcaauagugucuggguuuggugguuguuuaugggauggaucccuagguggggcagucucuggauguuccuucauuccgucucauaucugaacuuuguuucuguaacuccuuccauggguauuuuguucuucauucuaagaaggaacaaaauauccacacuuuggucuuccuucuucuugagcuucauguguuuugcaaauuguaucuuggguauucuaaguuucugggcuaauauccacuuaucagugagugcauaucaagugaguucuuuugugauugaguuaucucacucaggaugguauccuccagauacauucauuugccuaagaauucuauaaauucguuguuuuuaauagcugaguaguacuccauuguguaaauguaccacauuuucuguauccauuccuuugcugagggacaucuggguucuuuccagcuucuggcuauuauaaauaaggcugcuaugaacauaguggagcauguguccuuauuaccaguuagaacaucuucuggguauaugcccaggagaggaauuguuggaucuuccaguaguacuaugucuaauuuucugaaaccgcuagacugauuuccagagggguuguaccagcuugcaaucucaccagcaauggaagaguguuccucuuucuccauauccucgccagcaucugcugucagcugaauuuuugaucuuagccauucugacuggugugagguagaaucucaggguuguuuugauuuacauuucccugaugauuaaggauguugaacauuuuuuucaggugcaucucagccauuugguauuccucaguugaaaauucuuuguuuagcucuguaccccauuuuuaaugggguuauuugauuuucuggaguccagccucuugaguucuuuguauuuauuggauauuagcccucuuuuggauguaggauugguaaagaucuuuucccaaucuguuggugaccuuuuugucuuauugacaguguccuuugccuuauagaagcuuugcaauuuuaugaggucccauuugucaauuuuugaucuuagaacuuaggcuacugguguucuguucaggaaauuuuccccugugcccauguacuugaggcucuuccccacuuucucuucuauuaguuucaguguaucugguuuuauguggaaguccuugauccacuugggcuugagcuuugaacaaggagauaaaaacaguucgaaguauggcauugugcaaguagacuugguacuagaagagccaaguucuaagucuugaucugaaggcagcagaggggaauauauaugagacuucacggucucaucuuuuccaacauggucacaccuccuaauagugccacuugauguuggccaaacuuucaaacacaugagucuaugugggucuuuuuuuuucugacaauaaaguuugaaauaaauaaaauaaaaccaguuugucuauugccauaugcugaaaccaaauccaacucuaauguucaucuaaaaggaagguauaggaaauguucaauauugugucuuaauuuguuuuacauuaaaauaacaaaauguuugaagcuugauguuucguaaagaaaugagguuugguuuggaucacagacuuuggaggcauaguagaugaagagcauauagugccagcauucccuugucuucuggugaggcacucgugcugcaugggagaaaagacgaagaaaacuaggcacauaugaaagguccugcauaugugaggcagggaacgcugcuccccacuccuaacacauccuuauaggaaauaauccgaucccagaaaguguagcuuacugggccaguagggugauucauucuuuguaugaaggcauuugccacccaaaucuggaaaccuguguuuagugccaggagcccacauaaaggcgaaaggaaagaccccacaaaauuguccucugaacuuacaugugcaccacagcauggacacacacaucuuuuguugaauaaucauauccaaaccauguuacuauccuguccuaaacauugccacacacacacaaaaaugaguuuagggcaggguauuaccagguagauuucuuaaaauauuucucuuucuuccaagaccaucuuacagguaccauguauuucuuucaggaugacucugggaaguauauucuaaacucuacaauuaauucuauagaagguugaaguuauuuaguuuccuggaacaaaauuucuuaggaaaaguucuaugaucaagcucuguaucuguuaugccccacuuuuguuuuccaggauaacuucaaaaacauauccacagucgccaaagacagcgaagcccacauacuuagggucuccugugaaguauuacuuuccacccauugcaaacgaagaaacaccaaagaagaaggcagagaaggagaagagaaauaaggaaaaggaaggugccccuggucagcagagcacuguccuaccuagagaagaaagccuagagaagcgcauggcugacaaguaugccaccgagaaguauguagcagauaagcaugcaacugagaaacauucugccccuggaggaaaggcugagcacagugcagguaaaguggcccuguugauguugccaguuagacuuagcuuuccccucauuguucccucucuguccugagcuguguaucacacucucaugguuugggguuuuccucuaggacaacuucauccccuuauacugcuuuuucagguuugcucauaauuuuugaauccuccuuuuuuucugaguagaccuagaccuugacucugcuugugacuaagauuucauaggagugcuaagaugagccacauacagccuguauguguacuuuugcaugacaaagcacuagcuuuaguccuugaagucucugucaugcaaugaguucauuaauaacuuaguauuguagaacuugcuuguagcccuguacucgacuauuuccugccccuacuguggagugaacacacccagggacaagcuagcccauugcagcuucuucugcuuagugaccaguuuuagcaccguuuuguauuguuugccaucaccauacugaguuaaauaguauuguguccauuucuaugugaguggacuuguguucauucccccugaucuuuuuauuuauguauuuuuugcuaccauuugucugacugccucaggaaaacccacagcaggcaccacugaugcaggagaggcugcaaagauccuagcugaaaagagacgucaggcucggcuacagaaggaacaagaggagcaagagcgacuggaaaaggaagaacgagaaagguauacagacacuuagauuuguguaaucuauuguaaaggugggguuggaaaaauagcuugcuuuucuuuuuacaauuuuuauguugccaaaaccuggacagaaguauuggaaucuagauuguauggacuacagagaaggugcuuaggagacugcaucuucuucuauauguuacuaacaguugcucuuuucugaggaccuagaaauucacauuuacaggaucuaaaugguacagguaccuucuuuucccuucauagauauagaaaugaggcaacucuaguagaacuauagggagaguuugaacuuuuaugauacauugagucuuucuggaaagauagaagauacuagauauagagaucuugacucugcuucccaaaugauccuaacuugugcucaaaagucggggaggaaagagagucaauuagagucccagagauaagggcuagagagaagaggcaagcccaugagaaugaguuauguggaaauccucaccuggaacaggacaaaggaugucauugcagugguucucuaaagugggaaacauaguggaaaugugcuugcucuagucucauccucccuuagcaguucaucaggguuugaaagccacugugguaauaguacuagaacacuuuucugugauacugguaguccugcuuuuucugaucuuuguguucagaaaggaaacaaauuguuaaaggacaaggucaauuuaaucacuacaaagagaaagaauguucuugggauaaucacagaguacaauccugcaccauuuagagaaugagaacauggcaggaagcaagcagugcuguaucacaaggccagcacugaauuuauaauaacaaauaauaaauauuccugauccuugagcaccuuauaaaaaaucuuugugguuucugauuaaauguuuguugaucuauuuuucuaauaguugggugguaggucccuucuucugaacaucucuuacauuuuuuucuucagccuuuugauugauaucaacauguuuuguuauuguuggaugauguauucaagcugguuugggugggcuggagguuaaguaagggaaauuacagguaauaaaucaugggauuucgaaugacagauugguaaaaguagccacagagauaacaucccuauugcuguguacuuaagaacuaauuauauaccuucuagcuacuuucuacacucucacagcccagcugcagaaagaaucauuagcuccugucuuuauuuucccaacucaaacccuucacacuucuacacacccugcaaucauucauuacccaauucuuuuuuuaauuuuuauuuauuuaauguaugggugcuuugcugcauacacaccugcaggccagaagagggcaucagaucaccuuauauagaugguugugagccaccaugugguugcugggaauugaacucacaacuucuggaagaacagcucuuaaccacugagccaucucuccaucccuacccaauucuucauuugauucuugguuuccuuuggcucguggaacuuguucuuguuuuuuauucuuacuuguugucucuccuaaauguugccuggacuucaggcccuuaguacuuaacgagcuuuuugccugacaaguguccccuucgcauaguggugcuagcuaaugccccugacauccuuccaguuuucucuggcuucaaaauauuuauggcugacagcugaugcagcaguuuucaugcuuagccacgaacuugcucucauuucccuuccugaguccauuuccccuuuaccuuauguuuaucaccuauuucugaagcuaacuguaacuuuguuuuguaaaccuucucuauacuuuucugcaauauacugaagacucccaagucugugccuaugcccugaauuuacucuaaagcugcauuuuauuauaccaaaacaucuagauauaugugaauugaggaaaauucaauuccuuggccuuauuagccacauaucauuguuuauuuccacauagcaucauuuuauaagucauuuuauuaucucagaaaguuguucuauaaugcaaauccuauacuuucaaauguauuuaacugugucucacacuuaccucacauucagcauuucaaaggcauaaauuaguauuugucacucagacuucuuauucauuucaugcacuccauacucccauauaccccauuuccaacaucucagagcuacuuccaacguuucugccauccuucauaucacaucaguuaucagcuaagucuucauuggcucucauguuaacguucuccccaugcucuuccagcaccagauaggucaucuagacuaugucuguagaaucuuagcugaguguuucagaucucccagagcugauguccaugcuguuucuagagugacuuucuuaaauagaugugauuguccuuauuagugauucuuuugacuacaggguuuaucaaagccuaccaaaucuaccacggaccagccacuccuugccucucugccuucucugucuaggccagucugcgaaccuccucauauguuccaguaugcagcuccacaaccacacaaagcuuucuuuagcugugcuuucacaugaacucauguuccucgccaucugaugagucuuucuuucucacgaugcaggucaaguagcuccugcggcauuucuggaccuguacuggaaaaagaacugaucuauuucucuuuaccuuugagcuaagcuuccacaugacuaacauagccucauuuguguacagguugucucccuuuucuggcuaacauuuuuuuuuuuuugguuuuuccagacaggguuucucaguauagcccuggcuguccuggaacucacuuuguagaccaggcuggccucgaacuccgaaauccgccugccucugccucccgagugcugggauuaaaggcaugugccaccacgcccggcuucuggcuaacauuuuaaaaggccagaguacagucuuugaucacuguuccuuggugcucagcgaagagaaagaagcucaacuaaaaugcugccaguaacagcaguggguuaaguagacucccaggcuaaaauuuuauagugaaggagaagaaaaugguguauacauacugagacaaguaaaaagaaaggggcaaauuuugggggagauacuaagguuugauuugaaguauuuaggaggaugguaugcccaaauaauagaccauggaaagguuuuuuuaaaaacaagucugaaaagcuaaaaauuaaccaucugauuuuagauaaacauaggugcgugcagaacacacagguaguuggaaaucaaauagaacccugaggccaagaugaaauugagaugaauacauuuaacuccaaaucaguuuuccucucucuugccagaaugugaagcauugauagugcuacccgcaaggugagaaaggaaaguagcagacagccugaggcuggaacacagcggacaucucuuggaauaggaucaucuucacaucuguuuuguuuagugucaauaguuuaagucacaaagcugugguuaccaguugagaaaauguagcaaaagauaaaaauaaagauacucgugcuaaacucuggaaagcccaguuauugucacuagcuguugaggcaaauacuguccaagccauggaucugggagacucccuuuaaagaacaggcuuacuagguguucuagaaggcaacaaggcccuaagagaacaaaaagaugaugcgccgggcgugguggcacacgccuuuagucccagcacucgggaggcagaggcagguggaucucugaguucaaggccagccuggucuacaaagugaguuccaggacagccagggcuauacagagaaacccugucuugaaaaaccaaaaaaaacaaacaaacaaacaaacaaaagaugaugcaguuacagaugacugugacagcagugcucucucagaaguccacaaagcagucccagccucugggcuugggcauggcccaagauauacagugggauuguuggaguuaggacaagcauucuuauacccuaaauccagucuggugaagauaagagcuuccugggauuauaaaauagauuacauguagaagcugaaaugcacaagugauagcauuuacagucauuugcauauuaggcagaacaggcagggaacauucucaguacuaagagagugaaugaaugaaugaaugaaugagggaaguguagaagcaggaugaaguggucccaguuuucucugagaaggagguaauacugucaacuagaaugaggauaaagguugacuaaagguccacauagaguccaagagacacgacuaaaaaaacaugucaguggagacuaaagggcccaagagcaaucagcuuuguuugugucuuucucuagccagucuaggaaaccaaggaagggcaugagugauccuaaggaccacacagggugggaauuggggaacagagcagccucuguggucacaggaacccgaauccuggggagauccugauggaaggaagaggaaauaaguuauuuguacagugcucaccagggaaggucaccaaagaggcagaaggaugggcuaagaucaaaccaaagauugguggugaaggugaagcuuuuaaaaugaaaacugaaaacacaggagucaugaacagcaaaguccacauacucaucuacaagacuaaacaauucaagaccuaucgagcacaucaauagugugggccagcugugacgauaagggacuuaagaugugaaaugcuacagauugagagagaguccacuguaugaagacucuccccaguagccaaugaccaaagcagagaaggaaaacuggguuaguauggauaugauaacaaagaucaagagaaugacaacuguucaagguuugucgaacucuagaagagaaacuagaguguggaggaagguuagugacaaugacaaaugcaggguagggguggccuguguuagagggcuaguaggaaaagaugaagugguucuuuuuuugggggggucuucuuuuucuuuuuuucuccaauuuuuuauuaguuauuuucuucauuuacauuuccaaugcuaucccgaaaguccccuauacccuccccaccccuuuccccuacccacucacucccacuucuuggcccugguguuccccuguacuggggcauauaaaguuuacaagaccaaggggccucucuuuccacugauggccgacuaggccaucuucugcuacauaugcagcuagagacacgagcuccgggauacugguuaguucauaauguuguuccaccuauaggguugcagaucccuuuagcuccuugggugcuuucucuagcuccuccauuggggucccugugauccacccaauagcugacugugagcauccacuucuguguuugccaggccccggccuagucucacaagagacagcuauaucuggguccuuucagcaaaaucuuacuggcauaugcaauagugucugcauuugguggcugauuaugggauggauccccggguggggcaguguuuuuuguuuuuucaagacaggguuucucuguauagccguggcuguccuggaacucacuuuguagaccaggcuggccuugaacucagaaaucugccugccucugccucccaagugcugggauuaaaggcgugugucaccacgccuggugaugaauugguucuuaaagugagaaguugagaaguuucauacuuggaaaagguagugaauuaccuaguuuucccauggaaagcuuuuuuuuuuuuuuuuuuuuuuuuuuuuuugcuagcuuuaaaauacuuuuaagggagguaaaaggcaauauguucaguaaaaggauagggauuagauuucccugaaugcaccaaggagacgauaagcagaggcugguagguauaugggaaagaauugauguuuucagugauaaugagguuuaaggggauuuaggaccauagugaugcuacuauaacagucucagucucucucgagcacaugcucucucucuggcucucuggcucuagcuuuugcucucacucucuugcucucccagucccuugcucacuuacucucugacucacuuuuaaucuuugaaagagagagaaggugagugugugugugugugugugugugugugugugugugugugugugaacauguugagauuuaccugccaugguuagcacaugguccauuggcaguuugccuuuggaguguaucauccucucacaauacuuuuguucucaaaaggcuggaaaaagaggaauugaaaagaaaggcagaagaggaaaggcugcgcauagaaauggccuauaaacgagaacaggaaaaaaagcggcaggaggaagaagagaaaagaaaagcagaagagaaggcaaaagagaaggcugaggaggagcucuugucaaaagagaagcaagaaaaggaaaaacaagaacaagaaaagaaggaaaaagccaugauugaaaaacagguacagccugaggucucagacucuuguuauucagugucauuaguuaauauuaggcaaaaaucuguuuaguuggaaugacugauaauaauaaccauaauaauaacuugaagguuuuucuuaaacuccuuguacugguuauuaaauggaacucuugugaaauaaauugaagucauuaauguguuucaugucaguuuggauuucucuacuagaggcaaacacuggaauaagaauauggguuccauugguuuauuugggagaaagaacucauuaaucuggugugagaaucaagaaagucaguauagguauaucaaugaauaaguuauugugggugggcaacuggaacuuagugccauuggaagcccugagacuaaugauaaugacuuagaauuuccucccugaguaaggaaacugggcaagucacuaacacuacuccuuccugugugucuuaguuggaguuuuauggugucugugaagagacacuauaaccaaggcaacucuuauaaaagagaacauuacuaaauugaggcuggcuuacaguuucagagguucaguccacgaugcaaggcuuuuuuguacuaguucuaaaauacuuuuaaggaaaguaugcaggaagcauggcagccugcagacagacaucauguuagagaaggaucugugaguuguacaucaaaggcagccaaaaggagaugcgacuuccccaggcagcuaagagcaagcucugauuccacacuagguggacauggagcacuagaagagcccaagcccuucccccaaggucacaccuccuaauagcaccacuucugugggccaaacauucaaacacaugagucugugugcgcaaaaccuauucaaaccaccacauuguagacuacugcuuuuuaaggaauuaacuucuggagugucugccuauaugcacacuuucuggccagagccugcccauaaacacagagacuuucaccaucuuugaaaacuacagguguuuuuuaugguggggugagaguauaugcaccauguucaaccuuaccugcugugucagaaguauguugccuaagucuauauuaaauauugaaacauugacuuugagggagcugaugggaugaaggcaucugugcagagcucagggaacuacuccacuguuucuuaccuuacuagagccugugcuuugguuuguuucuuucagaaagaagcagcagaagcaaaggcgcaggaugcugcuaaacagaugcguuuagaaagagaacagaucaugcugcagauugagcaggaacgacuggagaggaagaagguaagacuggagggaucaggaggacuuaaggugaggacagaaacaggaaggaaaucagucuauaucuuuauuauuuuuuuucugucaucauauucuauugguuuuuggaaaaggagugguuagaaagccccauuagugggcuggggauguagcccaguggugugagugcuuguugaucauauauauauauggucauuugauuaacccucagcucucaaaacaauagaagucuuuuugugauuuugaauuuuuccauuuugccuuucauuucugucaguuuuguuacacauacacacacauacacagagagagagagacagagagagacagagagagagagagagagaacaaggauguugaagcccuauuauuaauauaguuacauuuucuuuguaaauuaacaauuuuaucaugagauuccuuucuuaguucuuuuuaguguuccaagacaggauuuauuuaugaguguccuuuguaaacaacauauaguuuagucaggacuugcuaucugaaucuaauuaaacaguguugucuuucuauugaaaauguuauucccuuuaaacuuauacuuauguaucaaguuggcuuuaagaagacugaucaugcagacccauuuuuguuguggccuagugugggcuuuguauugcuauaggucuaggagcuaagagaucugagauccuuucugagcuacuggucaacuuagcuuucuauugcauagucuugaauggcagacaguaauuugcuaauuuaaggagaagaaagggaaagcuaguguacaaauuggauguuaauucuagaucugcuuugaccuugcuuguagcaguggaaguccucggcagcgccaaugggaagcauuucucugcuacuuuccgucugcugacauuuaucuuuuacaacuuuucugaaagauaugaaagugcauauggagccaauuuccuuuuuauauaauuuuauucuuagaggccucuuacuuuuccccccagagaauagaugaaaucaugaagagaacaaggaagagugaugcgucucuagaagugaagguaggaauucagauggccauuauuucaugagugaagaacagcagaauacauuuagugagguugaagauuggagacgaaugcauagaaaauggagacuuuuccuguucuggucaagguggggcucaggaaggaacugagaccuuaaaggaaagaggaguuucagagguaaaagauucccuuagaacagaugggugguagugcaaggaaagacagaguaguugaagagaaaggugacauaauaauuaaggaauacacaagagcuucaaagaaccacuuccugcuauggcccacaaggguucuaaauacucccugguacuuuaaaaaaaugauuuguuuuucuuuaugucagucuuucauccuuacaucaccuuuugauuucuuccucagucauugccaguagcuucauuuaaaaaaauuauuucuuuuuuauaguuauuuauuacuccgcuuugucccuuccccauucuuuccaagucaucccccuucuguuuguuuccagaaggaagaccccaaaguggagcugcagccuccuccagauguugaaaauaaagcaaacaaagcaaagccaguuguccccaacaagaucggugagugugagguccgcuguguggauccuuuagguaacgaggacuagugagccuuccugcuggaggucaggguagcacaacugggcccagcacaguggcugcuggcacuuuugcuuccugaaacaucuuuccagcauaagggcuuuuggcuccauuuggaaacccacugcccuucuuuagcugcucuaaugacugaugguuggcccaggguacuuucuagggaccuugacugcauaucagauauuacuaagaccuggcuugucucuuaaacugagguccugcagacacugauaguaagaucauacucucuucuuugugaagcugauugcauggaguuacugguggcucuuuuuccaauaauaauaauaauaaacuauuguauuacuggugaaagaaaagaugagaauaguugccuuguuacguuuccuguugcuuuauuaaauuuggacauuaugauucaucugaagacuuuguguucuugaucagaaaucaauguguugaacaccugccagaaaguaaguggcucagagcgugcugcuccagaaaccuuuccccaagacauuuucucuacuggccuuaaaccaguugggggaccuguucaucuggauguccuugaugggaaaucaaacagucuggaugacucaacugaagacguucagucuauggaugugagguuuguucauuuauguugcauugaaguucagucucuuugccaguccuugcuucaucuuuuuucacuuuuucauuucuuuuaguuauuucuuuacaauaugccuuucuuucuguaucccuucacucgucuucuucaucuguagugaaucaccuugggagcagguuuuguugauacaggaaagcugucauggguguuuugcggcauaugauguauugaagaaggacugggagggagggaaagcacuaagcaaagauguguucccaaucuccacaggcuaucuagagguugguuuuccaccagggcaucauuuuuauuacuauauauauuauucauucaauguuaggugaugcaggaguaacugugcuuauaguggcuccucucaguuaaagcugucaaaagaugggggcuggugagauggcucaguggguaagagcacccgacugcucuucagaagauccagaguucaaaucccagcaaccacaugguggcucacaaccauccguaaugagaucugacucccucuucugguguaucugaagacagcuacaguguacuuacauacaauaauaaauaaaucuuuaaaaaaaaaaaaaaaaaaaaaaaaaaaaaaaaaaaaaagcugucaaaagaaaggguagcaguugggagcuagagagauggcucagugguuaagagcacugacugcucuuccuaagguccugaguucaaaucccagcaaccacaugguggcucauaaccauccauaaugagaucugauacccucuucugguaugucugaagacagcuacagugucuuacauauaacaauaaauaaauuuuaaaaagaaaggguagcagcccugaaucuuugaguagccagcccucugaggcucggaaguaggugcaccuucaaguaaaggagaucuuagccaagccaccgucuucuguguccacaaagucucacauuuaaguaagcuuuucauuuaaaucugagaauggugucagguauuuauaauccaaguacucuggaggcugagacaggagaaccaagaguucaauggcagccuuggccgcauagaauuaucugucacagaaugaugauaggggaaaagcuuguuacuaaaaaccuaaaguauccuugaacugguauguuugcagaugacaucauguggcauauuaaucugagauguaaaauagagcuaauuggcuuggaauugagauagaggaguuggaguacagugacucuccgagucagaaaaguaugacaguauuuuauacaaguuuuacuacagcucuuaccuauuaagacuccacccuuuucucaucagucaugagccgucugcuuuuucugagcagaugugagcagccugugacauacacugauuauuaauaucccauucguguacacuggguuuuaaucaaauacaugaaaacccaagcuccaacagccuggaaaaauccuguauacacugauaguagggcucccaccaacccucaacuggauaucugcauacccccaacaccaccucacagccaaccccccaccccccaacuggugccacucugcucccagcagagaaaaccagaggcgaucauacggguuaggacaacuuaucucccaccaacccacccccuuauugagccaagugugcuuuauuuuauguuuugggauuugggggcaggacaagacaugacaccauuggacaggggucauaaaagugaauggauuuuauacacugaggugccuacuggagccauaugugagcuuaugguggcauucucuuuauuauucucguugaauagugcuguguuuuugagacagagucucguguagcucaggcuggcccugaugucauauagcuggugcugaccuugaacuuuuaauucucccaagugaugauaugugcuacuaggaucagauuuccucugaguucuuaaggagcugaagugaggagaaugaaauggggaaaaguugaagguggaccaggugccuuaauaagacagcuugcccagauaccugaagguaugcuaggucaguugccauagcuuggcucagguaugaggaaaguagaucauuugaguuucugcagaucuacugguuuuucuagacucgccucuaagaacucaugaaggaaggagagccuggaaccaucuuuauucuagagucuuacagggacaagcccuuaauuuuuaacucuucugaccuggaauugcuccuuugcuagacccacagcaggcaacaguagugaaacuccuccaaucucuaaugaaaggaaauaaagaaaaagcaagccucagcuggguucaucuagaucagucagggugaaauggagccugguuuuagaaaggaugcagugagugagauugggcuuguaguugccuggggugacaacagcuucauguccccauucuucaacuuuaauugagcacaugcuucguguggcccugcauuaacucuccucaccauagucaccucacaucucgaagaaguaguggaaagaagaaauaacuccucuccccauuauacagaggaaggaaacugaggccagugauaggaaaagcaacucaccauagacggcacugcuagaagggcagcaccaagaggcccaguguggauuaguggcucauuucagcuaacuuggaacuuuuagcccuugcuuguucuuggaaugucccagccugaaagcucugggaaggcauugcuucucucuaguaaugugauggugccuguugguauuuuucuuucaggccucagacaccacacucacuccuuuucacugcucugccccauuugcuucuuguguccacucucuucccagaugugaacucacuuguuuucccaacuugaacuuuuccauaagagcaguauagcaaaaccauagaaaagugugggggggaguguacauuaccacaucauguuuaguucgaauguccucucuacucugucucucucauucucugucucuucuaguccuguuuccaaagaagaacuuaucuccaucccagaguuuucaccagugagugaaaugauuccugggaugucucuggaccaaaauggaacugguaaugcccgggcacuucaagauaucuuagauuucacuggcccucccgcauuccccaagaaauccagugaaaaccucagccuugaugacuguaacaaaaaccucaucgaaggauuuaacagucccgggcaagaaacuacccugaauaccuucuguugacaaagacagcguuccuuuaagaaagguacagucuuguaacugagaugugcuaagacgggauaaauaccgcccagccucuugcacaguugauuuuaaugaaaauuacaaacacaaauauauauugcagcacagaaauugagaagggugcuaaguaauugcuuuauacgugggccccuaauguaguguccuacucaugccccuucggguaggaagguugagaagguuggacagugagacaaggagagaaagcucaaauggcugcaggguaguaaagggaaccucacucaccacuuaguuucccaagcagccaucugucguggauuagcugaggugacagaagaaaggacuugauuuuuguguccugaauguuuucucccaacgcugaccuuuuuguugcccagagcuuuuguucucacuggcacucugauggucacucuugcaugguuucucaggaacacuuuggaugccugcacagcaagcacuuguaccuacugaaccuucuccccagcccuccugucuuaaaaagguuuuagauucucagaauuccaucacuuuuuugugguacuguauucuuuuaauagaaauuugaugccuaaacugaagucuaaucuuuuuuuuuuuucaaaaaaucaaauacaguuggacgugguggcgcacgccuuuaaucccagaacuuaggaggcagaggcagguggauuucugaguucgaggccagccuggucuacaacgugaguuccaggacagccagggcuacacagagaaacccugucuugaaaaaacaaaaaaaucaaauacaguaauagggugagaaggccaccaaguugcauuuuguguacauauuuccaccugaccucagucguccuugccuauagaguuuuuaguauagacauugggcucuagagccuccuucagucaguucucuggaaaguuccuagacuccuuugacacaaaacaggaaauucaugaaaggccacuauucauuuuuugagagagggucucauauagaccaagcuggccugaagucacuuuguagacuagaacauauuccauucccuccucccuuguccuucauaaaucugcccugcuucuucaagggagaacugaucuucacuuaacccaaacaaaacaugugccacuuuuggagaaguccuauaugaggaaaacuugaaccacuaaaauaaugauucuguaaaaacuguacacuauuucuguugagaaauauugcauuaaccaaugaagaaugcgaaauacuuggugucugcuucaaucucccaugcuguugcuuuugaauugacacaggugguguuuggaucacccucgaagcugucgguguugcaucugagcugcuggccgccugaagaagcuucuuuugcccuuaacugcugggcuccaaauuacuagauucaaaauguaacuguauuccuagguaguuuggcaaacccuggccucucuugguagaaaccuugcgaguuuugcuuuguggggcuuuagcagaguuucauuguaugguucuccuuaugagcuucagcugcugcuaaagcccuuccuugaccuucucuacuaucauagccugugugaugcugucugggaacccuacucuaggacacucgaauucccagagauggagcacagagacauuuagaugucucuuucuauaaaaaucuucuauuuacccacacucuaguuaaacguguacuacucaaccuggcugcuucucucccugucuuuuguguguguguauggggugagggaaaucuagcuacuuucuccccgucucaggauucuguuauuuuauuauuaagcuccaucaucugcagagcauuacucuccuuuacuguuuagggguugaagaaagguuugguugaaugaauaaguaaauaguggcaauuauuucuuuucccuuaugggagcugaaucuagcaaggacccuuucaugucaccccuuuaaaaucgccaaauuguugcuccaaaccauugaauggcuuuucagcugaaugaaucaaguaacauacagguggcuauuuucaugguuuugcuguuguuuuucuauuagaucuuggaauuuucuuuuguuugcuccugcauuugacuaacuguaauaaaaaaaaagagucagugcuuugaaagggggccccaaguuggucccaguaugucacuuuaauagacuuuaaacauucaaaagucugaacaaggaaaaugacacuagaauguauaacuccauguaugccauaugcuauauuuaaauguuucauuucuuguggugaaauguagcuuuauuauuaaaaugaccuuuucuuuggaacuuuuuguuuugacuuguaccuuaaagcuuuugaaaagauccuuaauucugagaauuacaaacagaagauagaaagaagucuuaaagcugguacaguuaaagaauguauuagucucagaagcuguguauguuuaugugauagaaucuaaauaaaauacagacaucuaagaaugcugugccauugaccuugaugaauaucuaaggagauaaaucuuuuaugauaagcacacagaugauaacauggucugacauacaaaagugucuguuucacugaguuccauugcaccucucaacacaguugugaucaccugaugccucauuugcaugauguguacauucgguuuaauguuaauacaucuuca

SEQ ID NO: 9812 - RNA, 16547 nt, Mus musculus
gguagagcucagaguauuaagaaagggcaggguaacaaaaauguaccuugacuuugauagucauuccacgacuuugaaucaaaaagguuaccgacauuagacugacucucacauguaccccucaggcacagagguagcucuugggaugaagaacugggagcuccgcuacagucuuaacacaagcuucuuguuccaguggagugaggacgauccagcccgagaugagaacaggcauuuaagugagacugaguaucucaaguccagacucacuaaaagcaucuuagguggagacaacuguucucuggaaagggaacucaagaacuguaaaaguagcugaaucaaacaaguuuaauucguuuccuuuucacagcacaugacauuucuguugcgauacaucauuacauccacguuguuacuuuuaaagcauuuuaugguuauacauuacuauacaauaaaacaaaauuggaaucauuauaggugguacagagaacccuccacccccugauggacugggaaccgacagagagcuuauagacugguugcaacuacaaggaguggaugccaauacaauagaaaagguaaauuucuaaaucaaaguauuccuaugauauuguugaaaagcugcuuauccauacguugaaucuuucagauuguugaagaggacuauacacuuucugauauucucaaugauaucacuaaggaagaccuaaggugccuccgacuacgguaagagagccuccccgacagcuuaggguuguuuucaugugaauacuuaaaaaugcuaguagcucuccccuaucuuuccuaugucacagcaaacagagcucauuuucucagguucaggguggcaaggcaugaagugauagaccuuucuuuacacucuuguuuaaagauccacaccucuacacagagccaccagcauuccuaugguaccauguucagaaaaaggcgacauacuuuugcuuuuaaguuagagauuauauuuaaagaguagauggcuggcuucaaguuugcuuuucuucugcaaauuauuguuuugcaggggugguguccucuguaggcucuggcaugcagucucccagcacagaagacaaaugcaggagucuucacagugagccaagccuggggagaaugggcaaaaaguccccuacaccugcucaugauuaaagcuucuguugguguacucacaaacuccgaguuuccacagaaagacccuuguccauuuaauucaagcacgugugauuguagagcauccuuguuuauaaacaagauuguaaguaaugucagcccugaccuaauauuuaaaaagucagcauaucgcuggaaagauaaagcauacguauuuuauaaacuaguguaauuacuuaaaugugaaagguuaaaaagugugccuugcaaugggaguacaguuucauguauguuaaaugucuaaauggaaaaaauuaaacuauuuuaccuuugaggugacugaaguucccuuauuuugaaacacaugauuuugucuagccuuugaucagagacaugauggucagugccuccacaauuccugguggcugcuacacuucuaccucugcuuugcauuuccccagcaggcauucacagcuaggaccacaccaccaaauggcagauuucuuccuuuuuaguaccuaacccgggauaugauggaugguuauaaacucugcaauacccaucucaaauccuauacaaauccaauacacucuuauucacaugaaugaauacaccaaauacagcaauguacaaacugcaugcaauuuuacucucccuuaauuuacauguuuucaagccuuuuguugucuggguauuuccuguccaaguugagagcacagaguuccuuacgcuggaugggaacacccauccacccaccuaacagucacccauuaacugacugacuuaaacuugauccacugguuggcaccacgcacuucaaagggaggaucacugcuguagaugugauagccuaguuccuccaacgggggcucaggaucagccguggcaaacugggcagcauccucgauuucuuuccucacuuccacaucaaucuccuaaacggcagauuacaauacaagagauuguuuucaauccagggcaguuuuggaaccaacuagaauguuugagaaccuguuguugguaguaauauuaugugacucuucaacagcauaugaauuaaaaauggaaagcauauuuuuaggaaaaagggagaagcaaaguuuuuguaugaaugugauuagucacuuaagacugugaguuuguaacucucaauugccuaugccagagcugauaucaggcaucaucuuccauugcucuccaccuccuuauucugagucaguacuaucuaucacugagggucggccagcaugcuccaagaaucugcuucucucuaccccuaccagaggcccauugucugugggugcaggaugcuugugcagcaggcacugaaccaacuaagccaucucccugguucauucucagcaagaggacuaaaauauagcccugugagccuucagagcacuuucucaacucucaggccaucugagggugacauuuuaugaggggugggaaacugguauaguacccaauuuuaaagccaggcuuaaccuccaagagcaacuguaccuuuaauucuucaacacuugcaagauugcuguucaccauucuauccuugagaagcauaauagggucacucuuacuucuuacuuccuggauuucuucucgagugcgguagcuguggagaagggagaugcagugagugacaggcccauaaaugccuguagaccagacagcugagugaaguauaggaguguguuuuugaaagagaggaacaaguuaauagugaugucaugucacugugggaauagcaggguggcaggcaguuaggcaucuuuuauagaaaguuauuagcaucuauauuggucaggcuguggcagagccucucaggggacagcuauaucaggcuccugucagcaagcacuuccuggcaucagcaauaguugucuggguuugguggcugcuugcagccaagcauuggacugagcauguggaccccaauaauggaguuaggggaaagagcugaagggguuugcagccccauaggaggaacaacaauaugaaccaaccagaccccccagggacuaauccaccaaccaaagaauacacauggagggacccauggcuccagcugcauauguagcagaggauggccuuaucuggcaucaaugggaggggaggcccuugauccugugagggcuugaggccccaggguaggggaaugcuagggugggugaggugggagugaauggguggaugggggagcacccucauagggugguugcagaagggaaaccaggaaaggggauaauauuugaaauguaauuaauaaaauaaccaauaaaaaaugaaaaauuaaaaaaaaaagaaaaaucuuugcuccaacuucaggcuucucuagcauucugacaagggccaaguuccgauucacuucuuugaucuggaaggcagggccaucacacuuuagccucaguauuuuacauggauggggcaaauggaagcuugcaguugugcuaguuccagguucugaggcaucacaagaccuaccaaggaaauauaccugccuugccuuucucacuaaggaaauauacccgccuugccuuucucacuuucccaaagcagcauggccagcaaaauguugggcaccaaguuacuggcuacuugggaagaaacaucgggguucugugguggggcaguugcuacacaucuacgcguccacauaauuuguucucugccuuccuuuaguccauucuauaaaagcuaaacuuuaaacuugacuucuuucaacugugacaaaccuccuauuucagaaguccauguuagagcuaagugaaaaaggacaacugaaacuucccauguggcaguucgccuugcucccuaccagugacauuuucaaaccccaguccucuucagguagaacaugccaugccugaauuugggguaaugccuaaacuaaaugacccccaaaaucauucuguaucgcagaccugccuuacauucaauucuacccuauaauauaguuacauaauaaugcucuuuuugaaauuacugcccaugcuauaacacauaggcuacacugcaggcugcuuucagacuaacacucgagauaaccacuugaugccaacaaaacggcaauuuuauccaguugcaaaagccaauguugcaguacucugccauuuuaaguagcccaaagccuguccacccacuauuauggaaaccgcacgcagauugcucacgaccucaccuuacuccagggucacucaugcuguguccaugguagcgguaagucuggagcuccaucaggaugggccccuaaaacaaacccaaaguguuuaaaaugaugggaaucggugccaacaaucauuggccucaaauggagaccaccccccugcccccauuaacauucaauacauucuuaauccuucuauguaucaucucagcuguccagaguuuacugguugauuuuucuuucgagacaggguuucucuguguagcccuggcuguccuggaacucacucuguagaccaggcuggccucgaacucagaaaucugccugccucugccucccaagugcugggauuaaaggcgugcgccaccacugcccagcuacugguugauucuuaagaccuauuuaccucacauuucuuuuuuaaagauuuauuuauuuauuauaugcaaguacacuguagcugucuucagacaccccaaaagagggcgucagaucucguuaaggaugguugugagccaccaugugguugcugggauuugaacucaggaccuuuggaagcacagucagcgcucuuacccgcugagccaucucuccagcccuaccccacauuucauccuucucaauuuuaccaaaaauacauugcaggggcguguuuucucagcuuagaacaacuaguuaaaccugaugcucccuuuuaagcuagucucgccguugccgaucccucccaggccauacaaugcuacguugagcagccaaacagauuacacccgacugccuauuaaguaaaaguaggcaugggcgggacccagguuugaucauccaaggggcuuauggcuaccagagggaggcaacacaagauuaacugaaccaaaccaaaaaauaucacgucgacgucaaagugaaggcaaaaugucaaggaaacacaaucgagaaaaacaggguguuuaccaggugagccagcacgacuaugguaccucacuggacucugucuucgagaacucauuaccccaggauaguucuaacugcuaucuggaaagccuucuuugaacuuugagauaaaugucauuauaaguguauaaccuaaaagccuaugaaaagauuuccagucuuaccuuaccagaccugcaauaggcagccgcaaacuuuguugccucucggacgcacaagauauccauuccaucuaccuguuaauaaaggcggaagggacagaauguagccacacugugcaaaccuauuucacugggguuguggugcuggagaguggaauccagagccucgcauaugcuagcuaggcaaguucuuggccacuaagccacaccucuccucccgcgccacuuuucuaugaccuagucaggcauaaggugaugagaccauagagcagcuagggaccuuacccugaguccaggaauaaaaucuccucuuuuguaguaguccgugcuggcugcugcucucucaacagacguccccaugccauagcgguuguucucacagauaaaaaugcaagguaauuuccacagugcugccauauuguaagcuucaaagaucugacccugaaaagaguuuagaaaauguucaaguggcuuaguuuugcucacuucucgggacccuccccaucccgaacaacuggugcucuaccuaacacagaaagcuugcacaaaggccaggagagggguauggcgggcaguguacgacuaauaugcaugugggggacacacuauaaagagcauggagaaacacugagcuaccaauuagcuuuauacucucauuaaucugucagacucacuugaccagauaaucagagugacucggcaacaucagagacaugccucacuaagugccgauccagagaauggggaguaacgagaccaagaaaccaacaauuaagguucugacacuacaggaauccggcauugcccuggaguccaagaaaguaagagucuauauauuuacaaguggagcuaaacaccuguuaaaagcauaugcugcucuuguagaagacccagguucaguucccagcccccacaugacagcucacgaccaucuuuaacccuggcuccagaggaucuucugaccucuacugucaccaggcagacaugcaguacacaaacauacauacaggcaaaacaaucacacacacacaaaaaaacuaaauagaucuuuuuucacagggccauaaaaccagaugugagucugccacaugaagugcuauuucaauaaacaauaugccauuucuuuuuaaguccaaauaugacaagucacaacuuggaaauucagagaugcacuugccugauuagcagcaccaucgccguauaaugucaaacagaccucaucuuuuccauuguacuugcaggccagggcaauuccugcucccaggggcaccuagcaaaaccaacaaccaggcaaggacccaguagaaaugaaucaguuacaauacucuuaaauuucaacuucuggagagacucuggagcuaagcuagugcuguaacucuccacucccacgcugucacuagucaccuaccggguuauuuuaaacaaaacauaacuacuauauuguuucaacaagggcugacauuuguccacccaaagauuuaccuacugauccuaacaagguaaaagugggaaccuagguuuauuauacaauaauuggauaugugugugcuguugcuguuucaccucucauugauaagaaugaggacccccuaaggagagugaggcuuugaauuugauuaggcugucagucuaacagacccuuucuuguaccugggucccagcaugagagugaggugagacgcaauucaucuuacugagcuguaauaaggugaagggauagcuccacugcuacaggcuuuuacucaugaaacacagcaaaaaguacgaacuuugcaucacuaccuaguaacuaauacauugguaagacuaaguguuuaaaaacaaaccaggguuggcgugauggcucagcggguaagagcacugacugcucuuccuaagguacugaguucaaaucccagcaaccacaugguggcucacaaucaccuguaaugagaucugaugccuucuucuggagcgucugaagucagcuacaguguacauauguauaauaauaaacaaaucuuuaaaaaaaaaagacagaccaaacucucaaauuuuauuacaauccuccgagagagaaguucuccugggugaagaaguuccuggaccaaaccuacuaacauaucugcucuuccucaguuaccugagcuccaacgaugccguugccuccauagaaguucuuggcguacaugugcauugacccgccuuucccuuuagcacaaccuccucuucguccuagaaauggcagcacacauccaugcaugaaaacccaaccacacgaagcaguaaccauccaauuguguaaccaccugucccuucaggagaacacauuccuccuugucucccugucggauaaggaagguuaccuaacccuccagugagugucugcucucuaguuacguacccuaaaucagcacggcaucuugacaucgggguuggaggaaguacaugaacccgacuucuccacugguacacugaauaauauaggacccaaaaccgucacaggaaagagggauaguaaagagcuaucuagaaucugucagcaugcuacaaagcacugcacccaauuuacuuucuccacuagacuucuugcuggcauguuuagugacagcaaaccuuauuauucccacuguacagggcuaugauuuuucaauuucacauugaggggucagguagccucauaaaugguuuccucaaagguacaacagagguaccaaagugccacgccagaaggaucauuucauuuuuuuuuaaccacuaacucauaauguuuagcaacuuaacgggagcuauccgaauaccccuccaugcacuaaccccucucuguaaaucuacaacaaaccuguuagcucugcaagaauugcucgcacaggcaggccccgagugaaggugaagccaugugcucgauaggcagugaugaggugguccguaggguuuaugccagccuccaggcccacgcagcaggcuuccuguaguagaggaggaaggagccaggaagcaaugccauuuccacaguugaauaaaaaauuuuuauuagaacuaguuaaaaaaaaucagggaaguaaauccugcuacuaguaauucaaaagacaaagguacaaaccagaaaccauaaccaauccacaaaagugcugucuccuuuagccuggacaguuuuuaaaauaacccaauagaauguaaugaaaaccaaacacgccuuagugaguucuguuuccauauggaaguaacugacuagaaccaagucauggcaccucuggguggggcauaaccauuccaacuccccacugauccaccuuacauauuuuguuauacauggccuguuucauuuagucuaccuugcuagcuucgguaaguuucugaauuuggaaccaguagcaguaaccaauugugccugcaguagcugucaacuuaaaaaguucuagaauggggcuggagagauggcccaguaguaaagagcaccacugacugcucuuccagagguucugaguucaaaucccagcaaccacaugguggcucacagccaucuauaaugggaucugaugcccucuucugcuguguccgaagacagcucccauacauuaaauaaaucauucuuaaaaaaaaaaaaaaaaguucuagauucaccuaggagacaaaucucugggugugucuaugaggaaauuuucggguuugagugggaauaucuacccuaaaucuggggacaccaucccacaggcuaggcccccagacugacuuaaaaaggacacaguaaggugagcagcagcacucgccucucugcuuucugacugcagacacaauacucucuccgcucucucggcucccacugcagugcccucaccaagacaggcuguaccuucaaacucugagcuaaaaaucagcacgcccuuauguugcuuugguuggcuauucugucacaaaaggaaguaacucagacacccaaaaagcaacaaaauagcuccccuuccccaggaauuuauacaguauagaugagugggguucuagcaaauuuuagggcaguaaaaugcuaagagcagauguaaaauucugaaacucuaggugugaaugaauucuuacgccuacacuucacaguggguccuaguauucuaguuucuagccuaaaacccuaccuucaaagucuucugacccaagaaguccagugaaaaacaguaaauagaacuauauuuagcugggcggugguggugcacaccuuuaaucccacagcacuugggaggcagaggcagguggauuucugaguucgaggccagccuggucuacaaagugaguuccaggacagccaggacuacacagagaaacccugucucaaaaaaccaaaaaaaaaaaaaaaagaaacuauauuuaaagcuaagugugguggcucuuaccuaucucagcuugggcaucgaggccuagccucaaaaaaaaaaaaaaaaaaagugggugggagggcaggcagaagucagugaaagcaaagaguuugcuaucaagccugacauuuugagcucaaucccuagaacccagaugguagaagggaagagucaaaccccacugcaagcuguccucugaugccgccaccacacauacacacuuacacacagggugacacaaauguccccccaacacacacacacacacaagauagguaaauaaauggugguuuuuaaauguuaaaguuauaaggacaggauggaggagaaguaaaaggaagugauaagggggagagggaaggaaggaaagaagggaagaaggaagcaaccuauuuaaaaaucccaauaauguggccguauaacaaaccuaucacuuaccugaccaucacacaagugacagaaaccacgaaugauuuucugcuuauacagcugauccgccuuuagcuccauccggcgcacagucugcaucauccuguaguacuugagcccauccucucuggugagcacuguggugacuggggggcccucuucuagccgaugaaggucacauuucugaaguggaggaagauggccccccuccaguuaccaccccacagauacugcuggcucauucuaagauccagcuccacuaacagacaacuugaacagcaaagacaugcagaccucagaagugcuucaagaaggcauaagcaggcugugguggcacacgccuuuaaucccagcacccuggaaggcagaggcagucgaucuauaggaguuugaggcguggucuacagagugaguuccaggacagccaaggcuacacagagaggacccugucuuguaaaaccaaaaaggaaggagggaaggaaagaaggaagggaggaagggggaagugagauagggaguuaagaaaaaugagaagggggaagggagagggaggggagggagggaggggagggaggaugugugauagcauacaccuaugaucucaucaauugaaaguuuacuacaggaucaagcguucaagguuaucccuuugcuagauaguuuggagcuaacucaggcucuaugagaccuuggguuaaaauaauguaaaauaaaaaaaguguuucacaaugcuucugauuccuuaaaucuauggucaucaauguuucacugaagcacaccccacaccacacauauauccaaccuuuggcucaagaugggccaugugcccaggacagcucugggggcaacccaacauauuugcagaugacagcaugucagaaugucaaagaggcuggacaccacaaccagaguacauuucuaaagccugcuucccuuuaacuacuagcaaguuacucuuguucaacuucucugagccuuugauucuggaauauucagaaagaaaagugaccccacccucaaagcaccaauaucaagacucccccuuuaaggugaaacugcaucaagcuauacauguccaaaaacuaguaacuaauaaaaugaaacaccucucaccuuaaucucaaauguagcaucauuugcaaaauuacgggaagcaaccagcacucggcuugccuagaaaacaaaaacaugcaaagaaagccauuauuauuauuuuuuuuuuugcugucaagaucaagucauugcuaucaugaacccaugcuuaaagcacagaucuaaaacagagccauaucauuaucugaaggcaaaauggagaguggcaaacgccacacucaucugcuuuguuuucaaagaagucacagugagaacagcaauaauuaccaaccaaaguaaagaaacuagauuacacgugggcuucggaagguucauuugcaaaguacuuggaauaaaacuauccaucaaucccuaucuacggggaacugcuuuucuaugauacauacccauagaggaggaggaaaaaaaaccgacucagaguaugagcuagauaaauaccuuaaugagaaacaccauauuagugcuggguuuguuuuugguuuuuugagacaggguuucucuguguagcccuggcuguccuggaacucacuuuguagaccaggcuggccucgaacucagaaauccgccugccuuugccucccgagugcugggauuaaaggcguucgccaccacgcccagcuauuagugcugguuaacaagagacuugggccagcccuucuacagcagaacagccuacaucuugagaagguuccacuucaagucccauaagggaagaaggguuucuuaaaacaguguucccuucuugauguuugaguggcuaucacugcccuggaguuaccaauuccuuucuacuuucacaacugaagaaaucuuggaacaacauucuaugugacagcuaagguucacauuagaccacaaaacagaaucauuccauuuuugccacuuucugcugcauuugaacauaucugcaagugaaccuuucgagugucuuguccuggggauuugaagcauagucaucagaucccauuuaaaccaaaaaaagcauguuugaucuauaacacaacguucugcagcacuggguuuguuugaccuuugugagaucagcaggcuccguauaccuccaaguacauaugagccaauagggcggaguguuaagaucuacuugcucuuucacacugccuccucccaaugcuggaaugagaggcaugcagcaacuuccauuauggccaggaaagacccucaguagaauccuaaaaucacugggauuacugaaugcuaucuaugugcaaguacaggcagcuggucugacggggaucaagauggcuccuggugcuguccagcuggggagccgagucuacagagcggacaccuggcggaagggauggucuacaccccaaucuggagugcaagauggcaucauccuaggcagaccagcacacagacuaaaacccaucaauucuuucuuucugagauuuuuuuuuccauugaguauuuuccauugaguauuuucagaccacagcuuaagcacagggaacugaaaaucagaaacuuugcaaagccauagacacaacguggagaggagcauacuuuggcaacuacucuacuacuauccgacaaagccaacaaauacaauggcacacuuacccaagggaaaaucgaaauacuaguaguaacggaugcugcaguuaaaucagaggaagagacaauguguaaacauagcuaucucaaaaugaagaacaacuaaaccagagaccagccagguagcaaacaaaugguugugcuauuuuuuuggcaguuaaacugagucugugaagccagaacuagcuacuguauugcaaaguaaauuucuaauuacaacuacagaaacuaguuuggggagcaaucuacagcagagaucaaaccagcgaggcauuaguaggagagaaaaaaagggugaguucuuucucaaagauauguuuacugagcugggcagugauugcucauuucuuuaaccccaucaccggggagguagaggcaggggugggggugggaugaguuugaggccagcccggucuacagagcaaaucccaggacagccaggcuaugggggcagggguuggagguggagagacacaacugugucucucagugccucucagaaaaccaaaauaauaagaauuaacuuuaaaugagauuccugucagcuuuucuuuucuggggcugggcagggguuggguuggcuggggauugaacacaugaccuccaauugcuaagggcaugcucucugucugagcuacacuuccccccuaauuaaauuaccggcauggagacuuugaacaaucuacuuaagaaaauaacaguaucuaaacacaggauuauucaaguggccaaguaaaaguauuuaagaauucucagaauguaccagcaugaauuaaaaaucuugccuaauaugcagacaaaaaaaaaugguaguuaagaaaagaaucucacaaaagaaagcauaacaaauacaagugacaaaggcaaaagaaaaaaauuuaaauucacuuggucuuacagacuuugaaagcuuucaccuccauuuaaaacuaaaagugcaacuuuuguaaacccuuucaaaguuucgcauccaaaaagugugaggagacagaggcaacuuuacagccugaggcaaaaucuccauguuucccugauuguuaagggggaaaacaacuagcagaauaaaagguggaaagguacaaagcacacagaggccacagcguaagauaagggcucugaacuaaggcacaacucggcagccaucaaagagcaagugccuaacacccccccccccucgccucuggguauccuuggcuaccaaugguucuuguuacacaaguucggcuggccacuguuuacuauugguaaggaucuuuuugcagggcuuaaauuaaaauuuaaaagucuuuucacccaccuguacaacaggaaaaacuaaaacccucgagccauuuuguguucugagggcggaaauaaagaaaucugcaauuacuuagauuugcaaaugauaagagauacgacuccagaguuugaaacacucagaaaggcuucaagaaugguuccuaauuaccauguaacaacuauagacacaaagaaaacuaguggcugggcgugcugcuccacuucuuuaagaggcagaggcaggcaccgaucucugaucggaagccaaccuagucaacaugugaguuccaggccagccaggagcuacacagugagccccuuacauaaagagacagagacacagagacaaagacaaagagaccuacuucucuuccuccuuagcaugccggauguggucacacaagauuuuaaugcaagcacuccggagguagaaaagcaaagaggucugaguuccaagacagccagggauacauagugagacuuugucucaaaaaaagaaagaaagaaaagaaaagaaaagaaaagaaaagaaaagaaaagaaaaguuaaaaagcuacuuucuggauauguuccaccacaacaaaaagugagaaaaaaacuggguacuuccuauggugaauucgacucuagaaucuauuucuuuuucccugcuguaaggugaauuuaaaggaaacgguaaacggcugucagacaaagcgauacaacaccuaagguuagcuucuagugucgaaggaagauuuaaaaguguucccagcuuccuaguacccucuuauacuccaaaagaggagcacaugucuucaaagcagaagguaugauuuuuauugauuucggacucuaaugcaacuuauagaaacuuugauucuagucagagcuguuuauuuuuucuuuccacugagaacaaagcuucuuuucguuuucaauuuuauuucaugcccagcccccaagcuauaaacaaauuucccuucaacuaacaauuucugcacacaagaaacuuguucaaacaaacugaaaaucaaugaugcacuuuuaacacgcgugaagaucguggccgaauucaggacacauacuaagagcucaauaaauguuggcuaugucguagaaaugugcuuugcugccgguucagauucaaauggugguuuuccauuccuugaugcaauuccuagagaaggacauuucgaccuuucuacaaccuccccacacugagcagaauugcaucaaauccuaaagaaaucaacagaaccagaauuacaagucaaagccugaugacaguuacaccaagagaaggcaaccucuguguggcuagaggucaaaaugcuaaaagcuuagguauuagacagcucuuaaagccgggccauaagucuuaaccucuaaucccaacucuccgaaaaccauugcuguuuucuuucgcuacuuugaacucuaagccucuguguguuuaaggguaaaggcggcuuccucuggguuaugcucgauugcucgaaaauugacugccaagaaaaaguucagaggagcagggaguggaggaaguuuguuuuccgugaaccugaccucccugaaccuuccucagaacagaacacaggugauccacaaaugcucacgcagcuggacaccggcccuuggcaggugccaggcagaaggguuggcauucgugccacugaccaacucaagauaaccacccccccagaagguagcguccucagaaucuccauuauggagaugagagaacuaggcccucagacgaguuuuuacauauccugcuucuugaugguuccuggugccaaggcuaguaaacgaagaagucggagugcgcacggaaccugacucccgggacugggagcucuuuauuucgucuuacguggccucauagccaagagcaaugacaugaaggagaguggaagucagcggaguccagagaggcuggagcaagcccaagcuccgccucccagugucccguaagggacgagcaguuguggggcgcugcaggggagcuggcgugaagcuccgcugggggcgaucgggggaagcacagcggaccgggcccguucucaagccgcucuucccccggccaguggcgacacggacugcgcggaaagcccacccaagucccgcagcucguccccagcccccagccgugcgcuccaggggggcccgguccgcccucuuccugccccgccucaggccggcuccagccccaccccggccucccgggaucaggcgaccucaccggcuucugcgcagagccugccaacacgcgggauacagcggcaagcaucuuccucauggagcgcagcagacucacgcggcggccgcggcacccaggcacucaaaaggaguggugcgggcguccccaagucuccuugaggcgcccggagccgaagccacgcccaaaacgcagugacg

SEQ ID NO: 9813 - RNA, 5547 nt, Mus musculus
aucugauccaacccuuuuauuugagauaaaucauuuuguuaaaauacuuauuuugugaugggguagaaaagucucaauaaugugaacaaucagaauauuuauguagaguugggaucugucuuuuguggaacauugccagacaacacuggcuuauuggccauguaggaauaauugguuuuguugaagcaagaaaccuacgccuuguuacugaugcuaucuuauuucuacagaacguagugaagcugaugcgaggucuucuccaguguaugaugaggcagguaggugaaaugugacaaacuuggaccuacagaaaauuaaagugacauuugugucauuuuaauugggauagcaugcauguuacauucugaacuuucucaagaagaaaaccacaauauuuugcuuaauuucucuuuuuaaaauuauccucaauaauuuuuaugcuauauaaccauagucucaaaggacaauuucuuucaaagacccucuuucagagaucuauguguauaaaagaggacaugucuuuuuuuuuaauuaagaaaagcaauauuaaaaccacucagaaagccgugcgcuacuucuuacuucuucuguguguuuuuccuucagauugagcucuugagcuuuuacagaaugucauuauugggaaugaguuaguggguaauggcacccauuaccaagccugaaggccagaguucagcaccaagacccacaagcucaacagagagaaacaguuuccauaaguuguucucuagcuucacaugugucccccccccacacacacauguagacacaaaaagauaaauacauguaaaucauuuuuuaaaauugacauuuucauuugccgauaucaucaguguaggguaaaugaaacaguucauugcaguacuauaaguagaaccuuauacuagacugugcacugguucagagaugcgugugacaccaucccauccuuaguuggaguauccaaauccaaagacauugugcuuuuucucuagcauguuaagaaaagagaaguuggaauuuaaacagguucuuuugcuccccucccuauguccuugacaaccuaccauguaccccugcugggagucuguagaccaggaucccuuuugaccucaucuguguagagcuuucuaaaaacucugugcacugagauauuuccauuaaauaaguaggaggaaucuccaucauggccccuguguguaguggucaguagcagcuacuucccauccuccuggcucccagaaaucacagguaagaggucuaguagcuccagugauuaucccuagagaugacuucugccagcugugaacaauauaccguguggaacaagguuuccuucuuccucagguggacaaaguggagaaguucaagcacacucagaguaccaaggacagucuacaugccaaguacaacacugccacauguagcacuguggugggugaugaccaguggggccaccuccagguggaugccaccucucucuuccuccuguuccuggcccagaugacagccucaggugagccagggccauuugaguaacaaaugagaaagugaagggggaaaugugcauuguaauaugauaacagaauaccaagacugggaaauuuaagcaguauggaaguuucuuuuuucauaacucuagaggcugaaaaguccaagaucccaaguucaacugucugguaagagcugccuccucugaagaaguagaaagccaugccuuugcaugacagaugaauugagaacugaaugccccgugaagccucuuucauaaggguuuuaagacauccacgagggaggaccaucagggccuaaacucauauaggcccccacaccuuucucauuagcaacacugaacuucagagagacacauucagagcacaccaaguaguauuagguuacuacaaauauagacuuaguuuuaguaguagguuaugcagaggaaaagcaugcuucccuaugugcaucuguguuugugauacagcaggaaaugcaggggaccaguccaagaccugcagguagaaacuggccucuaccugggcauauguacaguuucugcuuggcucgcccaaggcuggugacaaugccacugauacuugugagcuaaaaauguuugcuuuguucguuucuucucugcauaaacauaacaucuuacagagguacaugguuuaucucugacucuuucuucccuuaggcacaucugcaguaguggagcuaccccuaccccaacgugcugucuuccccugacguuacacaucaaccauaggacuuacuucagaguuaacuguugauacccaauaagaaaaguaaacaugcgauuuaaaaaaaaaaagacuuauuuauuagcaagcuaauuguauguaacugacaacucucuuuacaguauuccuucauaaccucauugcuuuucuuuauuagguuugcguauuauuuuuacccuugacgaaguggccuucauacagaaucuugucuucuacauagaagcugcauauaaaguugcuguaaguuuacaugcugaaguaugguaauuuuagcaucaacucuguucuuuuuuuuuuaaagauuuuuuuugagauuauacuguaaguacaucauuuccuccauaccuauucucccuucaaaucuucccauauacuaccuuuuuuuccauaaaauucauggccuuuuuucuuuaauuguucauacauacauccacccacccacacacucacacacacagacacacacacacacacacacacacacacuuaauauauaaauauaaccugcccagucuguauaauguuauuuauauguauauuuucaggacugaccauuucguauuggauaaccaauuggugugcucuucgcuggggaagacuauuucuuccacugucaguauuccuuaguuguccguaguucuuuguggcugaggcuucgugagccuuccccuucuauguuagcaugucuauuggugcuuuauuuccucaggucaugcuuagguagccauauugguucuuguugcauuuugcucuuucaguuguguauguagcauuuuugaaacaauacgugacacuugggguuuuuaauaaaaagaugaauagccaaaauuuagguauauauguauugguuuucugugugacaguauucugaauuaauucauaugaauggaucuuuaauucuaugugugucacuuuugaccuuggccucagauacuugcuaaacauuuuuuuuacauaagagauaaugcuaaaauaguuuuugaaauuauuuuaaauaaguccaaaggcauuggucaacuagagggguagcccuugugauuuuaagguaaguaaaauauuuuguucacugaaaacugaguuuguuacaaauuagugccauuuauaaauaagccuucagaguguuuuguguguuuuauuccacuuuaauauucuaaaguucuguacagagacuaccuaagcugaaauugagcaagaacagaaugugaguauauaaagcuacaaaguugagagccuuucagaagccacauucauguuucauuguauaugugcuaacauaaagaaacugucuucccauaguaguucucaaauccucccccacgucucauagcugcccuuuucucucucucccaggauuaugggaugugggagcguggagauaaaaccaaucagggcauuccggaacugaaugcaagcucggugggaguggccaaggugacggcccuguuugcucuccuucucugcggguuauugcuuugcuguuucucuucuuuaggaauguggauuuaauaggauugguacuucuuuuuuuguuuucaaaagucagcagcaaguauaugaaaucgaaguggcgccuguaucccagccaagugaaauuacaggucaagaaaauagguuuccaaaucugcaugugacagaaaaaucaguguguucugcccuuacuauuugaugugucacccaugaguccaagcucuugcugcuaagcugugcuagugauggacagucuccuuucugggucauacucgaauguuaaagaauaugagcauuuuguaggcgagaugcauaucuuggagucuacaguagucagugaagcuagccagauagaaagcuagcagggcaaaagggagauacugagaacccugggaacuuucccucagaguauuucaacucaaaaucauuuaggcagugaucuucuggccagcguuguaauaugugacucuaaccacagcuuccagagcacugaggcaggauggugacuuuaacucaggaaucugggccaaccugaacaguacgauaaaucccuguuccaaaaaggaaaaagagaaggcaaaagaugagacaaggcaggacagugcuggagacaagaauggaaacagaaguuaaaaggaaggagagggacaggaaaagguucuuaaagccaaacacuguguacccaugggcacauggagccuggaagccacuggugcaagccucuugcuguagacauuuaguguacuuccccaacuuccuucucaauacaggcgugaacugcucagacagcauguaagcuccauagccaaacuuuuuuuuuuuccauuuuuuauuagguauuuaacucauuuacauuuccaaugcuauaccaaaagucccccauauccacccacccccacuccccugcccacccacucccccuuuuuggcccugguauuccccuguacuggggcauauaaaguuugcaaguccaaugggccucucuuuccagugauggccgacuaggccaucuuuugauauauaugcagcuagagucaagagcuccgggguacugguuagcucauaauguuguuccaccuauaggguugcagaucccuuuagcuccuuggcuacuuucucuagcuccuccauugggagcccuaugauccauccauuagcugacugugagcauccacuucuguguuugcugggccccggcauagucucacaagagacagcuacaucugcguccuuucaauaaaaucuugcuaguguaugcaauggugucagcguuuggaugcugauuaugggguggaucccucauagccaaacuuuuuaaaggaacaaugaauauguucugucauagcaaacugacagaaaaucacuuuuuacaaaaaccaaacuaacguucucaauuaaccaugcaguaaguuagcugcuaaaauaggugaaacaaaagccaauucuggauuaauuuuaguacccuacacauauuguuauagacuuguuaauauuucuucuguugguagaauauuaauuucauaugaggaaauaucuuccuucuuauuaauagauugaguagugucauacuggaaagaucugagcuacugaaaaugaagagaggccaugacaauaggacucuagcuagauuuuaaagacauucuucauugccauuaggagaaacauguauguuagauugcuuaaugaaaaagagugucacguugguaugcauguguguuuauuaaaaagaaaauaauccuuaccuauuuuuguaggcagcacuugaggccauugaugaacuagaucuuuuuggagcccauggaggacgcaaaucggugaucca

SEQ ID NO: 9814 - RNA, 18723 nt, Mus musculus
ugugcuaaacacacugcuuuauuuuuacagcccacgucuuucaugaggauaugaauuguuaagaggcagucuuguuuugcuuuucaaagacauuuuguagagauuuuucacuaccguaaaucugauuuuaucuacucaauucuguagagauuaaguaaauauguaugaugaaauuaacagcuucuguguauuauucuuugguugcucauguggcucauacaaaucuauauauacuaugagagaugggagcaugcacacccacccacccuuccacaucuucuaaaagaacaaaacaaacuuuauuuuaaaacuuuauuucugcaaagccaaucaagaaguguuggaaggaaaaaguguaaaaguuauccucgcauauuugggaacuugagcaagcacuuuaaaaguuugagaaaaugacaguugaaucaaaggcaauacccagcaaugugugucuuaaaacaaugauguccguucuuaagcaacauuccuuuuuauccccuaauagcuacaauaugauacaguacgcaacagcucacuugaaagugcuagaaucagaggguaaagaaugccagaagccgucccacuuacauuuccuacuauacaaugccuuuuuggcgcuugacaaaucaagcauucauguagcaauacauucaauaaaaacaacucauacuuuggguuuaagauccuugccccuccaguuccgaugccgugacaucugacucuucaucauuguaaauauuuucagccuggagauaacaaccaaauagguaaaaacagaauuuacuaucaauuaaaggguguuucagugacucuaaauuauuugccaugcacuguuuagucacuuccuucagucaucaaguguguagcacaauaucaagaucccagcugacagugcaaugucaauugauauagugcauguguuuuauuauuauaugaguguggguaaauuuuacuagguuguuaaaauguuaagaaaauuuugugcaugguuggggaguugguucuuuccucucccuuuuacaugaguuccaggcauguaaucuuagaucauauggugguuuauaaaacaagugagccuguugagccaucuugcaggcucagaaaagguuucuuuaaacugcuuccacccuacaaauuauaagucaccuaaauaaugaauaucauuagugaaaugguuuuacaggaguuaugaaaaaaauauuucaacucaccaucugccauaucugcaugauguuaucuucagacacagagcaaaugacccaagguucauugggauuccagcugaagucagaaaucuuggcagugugcccuccaugaauaaacuuaauaaaaacaaaggucuugauuucauauccuuucuuauucuaaauacaacaguugucuuaaguagccugccccguaauuuagagguagagugacaugagcucuauauaauucauuaccacuccaauauucugaaggacuagaauucuguccauacauucaaaugucucaguacauuauucauauguuaaguuccaggaaauauuuauuucaucccuaacaauucuagccucugcccauuucuuauaacugugccaccacuuccaagugaauaaccaccaagcauuuccaacaugucugcucauaugcucuuucauaugccugacagaggagucuuccugguucuucucuagcugucuuucacaguagccuuuucucaauauucccaaggcacaauauaacaggguugcaaaaauaaauacuuuaagguccagacuugcagcauaggccaaugaaacuuuccccaaaaauguaaaagggugggaucuuguuuucuacaaggcacuaugccuaacaaaccuuguaguacagcuuuaucaguuuuaaaaaaacugagauaaacaaaccaagauggggggggggugucacacauaucucagagcacacauaucucugugagugaggccuuggcuacagaaaaaacuaaaagcaacaauuucacauaagugaaaugguaugguaaacagcuuuacaaauaaauaacuucguguuuuucucuccuuggggggggggggggcaagcuugcuucuaucaguugaaccguuucucuucacugacaacuuacuagucuuaaauuuaaauguccuuugauuucaagcuuucuuaugaguaccauaauagacuuuuuaaaaguuucaauuauaugggcauguaugccuauauauauauauaugaguacagugccuauggaagccagauaugucugaucucucuggagcuagaauuauagggcauugugugccaccuggcaugaguacugaggacugaauucugguccccuugccaagaacaguagguauuuaaaugcugagcugccucacuagccccauaaugguguuccuuaaggacuauaaaacuauugcaaauucauaauauauacacagagaaaacuagcuguagacaaaaggccuuugugaaaaaaaaaucaugaaggcuaagagucaggcacaauaaaguauuuuggacacuaccaucuguauaccacacacucaaugucucaucccccuaccccaccaccgccauggccucaaagcucauggccuuccugcuugagccuccuggguuauagaauuauuuuuuaaagcagcaaugauauaaaugucaaacacacuggucuaaaaauccccuauccuucucuugcucauuucugccuggcgcuacugugcacagaagccaaagagacaagggagcuugcacaagguuagcacuagugaacaccuucugugucuuggacuuacucucaaaggguuuuuuucaccuuaaaauucaugcaccauaaauucucaccuauguuagagacaaugaccaaauguuuggaggagacacauggugaacaauucagaaaagggacaaagagcuacuacuaagccugucaguauuucacagaaaaguguuaacuuccauaugguuagagaaaaccaugcugguaaucaaacagcagugauacuaccucccaaucccccucccagcagaaaaacaaaaacaaaacaagccucaaaaaacaccauaccugaaaucaauaggaacuuaaaguuacccucacugaaacauuuccagaaacuucuggggcuccauuuaccauuuguaauaaaugucagagccuacagagccuaaucacaaaaacuuccuggauuuccuuuuuuuuuuuuuuuuuuugaaaucacuggcaagcuaaaauuugaagcucugacugaccuaaaauagucuaguaaaaaaguacucaagugugcauaauaugacauuuaaucuaaugcauaccaggagcucuggaggcccaucuucugcaucuucugcugauuguucuucuccaauuuuacuauuaagaaaauaaagcuuucauuacugcaaagucuuauagcaugcauguguguuuuauuaacccagaaaguauuucucuaugagaaguacuuaagacagguuucucaacccauggguugccacucugugugggcuaaacgacauuuucacaggugcgugaaaacacacauuuauauuaugauucauaacaguagcaaaauuacaguuauggaguagccagaaaaauaacuuuaugguuggggggguucaccacaacaagaggaacugaacuuuaaaggguggcagcaucaagaaugcugagaacagacuuaaguauucuuuauuauugugaguuguucauuuggagccacuaauaaauuaaagcugcacaaugaagaaauauugcucauaauaaacauuaguucaauuucuuuuuuaacugugguuuuaaugaaguauaagccaaagaaagauuuguuaggaaaagucaagaauaucaugaguuugaggccagucugaucugagcuacacaaugcccugugucacaaaaaaugaaagcgaaaacacucaauccaacaauucucuuuucuaugcuacaugcaaggagacacugacaguauuuuaaugcuugugguacuagagacugaacccacaaccuuguguaugcuagcucuaucauugagcuacaacccuagugaacuguagcaaaagguauuuuaauuugcuaagcacacauaacaaagacuugagcaacaaagaaauagggcuggagugguaguggcucagcaguuaaggccacuuguugcugaugcacaacaggguuuaugucccagcccccacauuguacuaucccuauacaacuacucauagucccuguucuggggaucugauaugaguaccuggcacacauguguuacacacacaggcaaaacacucauacaaaauacaugaccaauuuauguuaauugcugauuuacuuuucuaucacagaacagaaacucuuaagguaguuaggaguuuauugaaguuggaucagcaaauugcuuuccugguuuaugaguucuauuauguaaucuguuagauugacacauuuaugcaguuccuugucaccagauccuaaauuaccuuaaaucccacacauucaggcggcgaucaguaccacuugaggccagaauaguuucauuauguggagaccaguggaccuagcaauacagauuuugaaaacuuauuuaaagagccuugguaccuuggucuguaaguaucauucuaaucuguauuuccuuaccucacauucuguauccgcuuagccuagagacuugacuguccaaggcuuuaaagugagcccuaccaauccaccuugauggcagcacugaacccaacacuuugugcuugcucuaccacugagcuacguacccaaauccuuagcuacucccagcuccccaagccugcaggcaggaagucauguuucuaguacugaagaagucaggaaucccagaaaucuuuagacccauaaccauccauaaaaccuuuaaaauuagccuauaaucucuaauccaaaacuauguauaggaccauuuuuacagugcacccaccauauugucacucuuaauugaaaaauccuugaaaauguacuucaaacugauuccauugaagaauuuuuucuuacuucuggaugggaggggacucucaaaaacaaugacagcaacaacaaaaauauccaucaccuugauuuauauagaauuaugaggagcuuuaucaaaaacaaaauguccaaauuccaccaaauaaaaaaaacuucagccgggcagugguggcacaggccuuuaaucccagcacuugggaggcagaggcagguggauuucugaguucgaggccagccuggucuacagagugaguuccgggacagccagggcuacacagagaaacccugucucgagaaaacaaaaccaaccaaccaaacaaccaaaaaacuucaaauauuugccccucacaugaaguccuugacauaaagcuaucugaaaaccaggccagcaagacaccuuaaugaauaaagcugcuugccauaacaaaaccugacaaguggaguuuagucacuaauccccucaagguagcaggauaaacuuauucccagaaaguguccuucaaccucccucuacaugccuguuucagcaugcccauacauauacacacaauuauaaauaaaacaauuaaaaguuacccucaaacucucacauaccuggaaaauuucauccuuaugcgauucaaagguguggaguuuuaguuucagauuacgcaggucccauaaagcuacagucuguagagaagaaacccaaugaaaaugauuucuauacuuuaugugugaucuuuaaaaugcuuauuaaaguacaaaacaggacuugguuaacaccaaaaccaaaagaaagcuaugaaaccuuaucugcagagccaguugccagaaugaacucgcuguagggauugaaugagaggcaguugaccucagcggugugugcauccaccaaauggcucggcuuagaagugguauuggaucuggugucccaucugaaacacacaaaaagacaagucauacagcuccaaacacuuggcucagucgagguuauuuauuucuguacaaagcucugauaugcuuacccauucacaaauauacaaaccauacauagcuagcaauuugggcuuuugucuauuaaaugacauauuuuaaaccuccaaauaacuaggaccacuacucuaauuccuuuuugauuuuuaucuuaauuacauaccaucuuaaauguacacaaaauacagauuauaggaucuaacauuuacuuuaccuauaauuagccuugccaaauucuaguauauucuucuccuacucuuaguaguacaauaguuacuuaugaaacaugaguuaccaggcuggagagauggcucagugguuaagagcacugacugcucuuccagagguucugaguuuaaaucccagcaaccacaugguggcucacaaccaucuguaaugggauguaacauuguacucauaaaaaaaaaaaagaaagaaaaaaagaguuaccaagugauuuuaaugcagcuccauggccacacccugauggaaacaacucuuccucccugagcuuuacucaguuaacucuagaucacaaauuuauaaauuauucaagccuuuuucuucauauuucuguagcaauuuuuaacaaaauaaacuguucacuauccacaugcagguaauuauuuaucaaguauaacccacaaaaagcuauuugucaucuuaaaacaacaacauaacuuucaagaaacagaacacaaucagucuaccaaucacugcugguuacccauccagauuacccaucaagguuccacucaaccuuccaucuuacaucauaaguuucugaucaucagcaacagauccaaacaaggacucaugcagcagaugccaggccacauccucuacaacagcugaguggccaguaaagauugcuuuagcauccacaauuuugccuuccuuugguccugcauuuauaucccacaggcagacagucuaaggaagaacaaaaaagaacaaaagcuaugaaaacgccaguuuuaaaagguaacagguuauuuaggaacauauucaucuccuuaaagcaaaauagacaguuguuacuguggaugcccaccagaacuagauguucguauccuauuguugaagacaauacauagaucuuaugguugcaggauggagaaaucaagcuagaacugaguuacauguuuuuacuacuugcuggauagccauccuggugccagaaggugcaaugcugguagcugugguagagaggucauuaacaauuuauuccgcuuuaaacucuacauaccaaggcaaaccaagccaagaugugcacacuggugcaaaaguggcaagacuguuacagaaaagacugaucccuuucuuguuuggaugugagaggcacacccaaagcagagaaucuggagauauaagccuguguaaguccaguuuaggaugccauaggccaauauucaacuacagcuuuuguuagauggagagcaaggaguaauugcauaacaucuauggaauaugaaaauaaaaauagugguaacacauguacaacuuuugaaaauagaaccuguuaaauuuuacacaaauaguagaaagguaaauuugucagucuucuuuuaaaugaugguaacccuccaaucuucaaaagagcuuugugaaauucuaaagcucuaacaguagucucaugaaaccauuguuuuaaaaccuaggaaagugguggcucacgccuuuaauucuagcacuuggugggcagaggcuggcggauuucugaguucggggccagccuggucuacagagugaguuccaggauagccagagcuauacagagaaacccugucucgaaaaaccaaaaaaaaaaaaaaaaaaaaaaaaccaaaaccuaggaaaauguuaacacaacaaucuauguaugauguuaucuuuuaaaaaaaauuucaaucuaugcagagauccuauagcuuagauuuaggacuuucacgaauaacauacaacagauuaagaaaaacucggcucuuacauggucaucagaugcacucaggagaugcccacucagauuagaauuccaggaaagaccauagccuuccuuuuggugaccucuuaaucuaagaucaggauuacauucuccacuuggaucuaagaagaaaaaagaaacacauugaccacuaaguuaccuguuuaucagaauuguaaagagccaagcuucaaauuccuuucauugagugaaccaaaagagcaauucuacaagaacaaagacuucaucugcugggcgugguggcacacuccuuuaauuccagcacuugggaggcuagaggcagguggauuucugaguucaaggccagccuggucuacugagcuacuuccaguauagccagggcuacacagagaagaaacccugucucaaacaaacaaacaaacaaaccaaccaaccaagaguacauauaacccacaagugcuuugacugguuuuggggaaaaaaaacaacaguauuaucacuauuacagaaauguugacaaguacagcuauuccaucuguguaguagcuaccccaucauucucaucccaaggcaauuuuuagaaauauaucuaacaugucugguuacucauuuaguccuugcauacccaggguaucuugaaaccaugaaugaccuuuggccaaccuuucagaaugugacaugcucagagcagugaaaacaugcugcagcaacuuguaguacaguuuaucaaguauucaucuaacuucauuguugaagcugcugguuuucauuaccaugaguguacacagagccuguaaccaaauuuaccuuagaagccccagaccuugggccucaaacaggcuccucuggacagucacuuagcaaaaauuccuguacuuuucugcuacagaaaaagcauguccuguuugaucccagaaaggaaauacucagaagccugucuggguccccgaucuaccugauucaucuuuuuuucuucugcuuuugcccuggauccacaccugcaaguauaaucugcuaucagguucuagcaaaucaccaaacuugcaggugguuaugagauuccucacuuugaaaguuauaaaauaacugccaugugggugcugggaauugaaugcacauccucugaagagcagccagaguuucuaacugcuguugagccaucucuccagccuacacaguacaguacuuuauuuuuaaaauauuaucgucuccaaucaacaaagauguguacuggccuggcuuuauuauuacauaccugguuuugcaggguguuuuguauagucaaaaaccaaaacaucagaagaugguguuuuuguggcaaugaugugaggauucuguggcauauaacgagcacgauucacuucuccuucaugguuaauuuuaauuucacauucaauuuucccuguuacagaaccaaagccaccgaauucuaaugugaggagacauaaaacauauacauucaggauuauuacucacaagucauuuaacucaaucaacucaaccaaauuuacaguccgaauagaaaacagauaguggagaaaaagaaaaucuccaaaauacaaguuaucugcuauaugaaauugaucucaaagcccaucugcauuauauggauugcuaccucauguuaauacaguugguucuaccuuggauauaaaaaaauuuaaaaacuggccuuucuaguuaagaucugauuauuuauaaaaaucucaccuuacauaccaguuuuucuuuucauucuuaguugcagaguaauauuuuaaacacacuauaauguacuuaaucaaugucccaugacccucuuauuuugcuacacugauccuaauuucuugguacuguauauguuacugugaaaaaaccucaacacauaugugugacuacuucuuuuaaguuaccccccccccaaaaaaaccaacaaagaacaaaagccaggcaguggugucgcauaccuuuaaucccagcacuuggguggcaaaggcagacagauuugaguucaaggucagccuagucuacagagugaguuccaggauagauagccggagcuacacagagaaacccugugucgacccccacccaaaaaaaaaaaaaaaccaaauaaaaguuacauggcuaagccaaaagcugacuacaaauuuuaaucuacaugcuaagaugacuccucccuuugacguuaauguugaaauauguaguauacccaccucccuugucacugucacagugggaagcaucaaacugugcaucaucauugggaauaugaacucgagcaaccaccagaugguucugcucaucagauguaugagugcccagcacuagccaaugaagggcauaauccuuuccuucuggucuguuuaggagaaaaaaaaagugaaacuaauccuauacaauuuucagcugcuaacaaauuuagucugguucccucaaaauuagcaugaacauuucuucagcaaauauauagagaacaccaacaaaacccugcuucccaucuaauuaccaacuuuauuauccccauacuuucaaauguaagaaaacauucuauuugaagaguuuaguuuuucuuuccugccuggagagucaucuuccuugccuucaauuaucauugugaaugcuaccuuucuuagaacagcauuaaggacaguagauucaacucaccaaacauaccaacaucuaucuacauagaaguucaucacugauccaauacucuagacuucucaaauuguacauuuagccuauagcugauguuuauuaugcuagauguuucuguuuucccaaugagauaaaacagaaugagugaagugguaagggaaaaaagggggguuuauauacugguucaaacuaaaucuagcuauauaugcaaccuauaaaaauagcuguauguacaaccucucuccagucucauucucuucaccugaaaaauagguuaagugaaauggcaugauauaaaaucauuucuuuuuguuuaugauaccuaugcaaugcacauucucaaguguuucugucaccuuacucuauggagauucacuuucaggcugaagaacuugccagugucuuuugccaccaucgaccaaacagcaauuuuugcacugcuauuaaguaucaacaaugcuuucccauugucuuauccagaagaauuucaacugcgccccacugucccacaaagaagucccaaaaccagacaaguuaggucacauaucuguuuguuccuaaauuucuccuguacaaaggaagcaguaacguuuaaaaauaacaaccaagaguuggaaauuauguccaugcauguccuuuaguaauaacuuacaaaauuaagugcuaucaaauuaaaauuuggcuuaugguaaaacaacacacaacuccugaaaauagguaggaguuacuaagcaauacgaaguuuagagaggaggguagcuauugguugaugcauacauaguaagccaaaaauauggcuuugggugagggcaggcauauguauauuuauuuuuacucagaaaaguuauuguggaaauuuuaggcuuuugcuggguguccuacaucuauaaucuuaauuauucaggcugcgaaagcaagaagaucacaaacuaaggccugccaaaaccaugcagugaguucagguucacagccagugugcacaacuaagcagaggcccugacucaaaaaaaaaaaaagagagugaguugggaauauagcuugguaguaguauagcauucaacucucaugcgugaaauccuggguucaauuucuaguguuagagacggggaaaggccuucaauaauguaauuuagaacauggacaaacuaaaaccuuuauagggaucuuaaauauaucucaaaagagaccuguuauggaggagaaacaaaagguuauuuuuuaguggagcuaugcaggaaaaugaagaccauuaaguauauauaauaaaagcagucagauagacaguuuaucuaucaucuaugaccuuuggaagaaguauuguuccagcuaaacugggggaaaucuuaaaaauuugauucaaauucaaauauuccaguuucacaugacuuguuucucucacauaaagauuuauuuuuauguuuuacuaauaaguccuucauuagaucaaaccuacuucagaucauggugguacacaccuuuaaccuccagcacuugggaggcagagguagguggaucucuaacuuugaggccagacuggucaacagaaacaaccuacuuuccuuuaaaaaaaaauuuauuauuuauauguaaguacacuguagccaucuuaagacacaccaguagagggcgucaaaucucauuacagaugguugugagccaccacaugguugcugggauuuaaacucagggccuucggaagagaagucagugcucuuaaccgcuaagccaucucuccagcccccaacaaccugcuuuccugaacucauuauuuuucucaauauuggacacacucaaagguaccaaugacaaaacaucuaugcuacgcauggugguacacaccuuuaauuucaguacucugagguugaggcaggugguggaucucuaagagcagaccucaucccuggucuacacaauaagcuucaggucaggcaaagcuacacagugagauagacccuaucucaaguuuauaaagauccuaucuagcuuuaguaccaaaauccuugcaauacuaagaaauugacccaacaaucacaaaaauaugcuguauuacaagacuauuuccaguagcacuguuuauagcagcaaaggaccaaaaacaaccuaaauaaauacccaucaacaaacaaguuaauagugacauaaacuguauucguaaguagaauuguguggcaucuucauaaagaaugggugugugucagcauauugaauaguaaagucuccaauauauucuuuuuguuuugagagauggggccuaugcaacccuggcugcccuagaacuuuguauguagaccagguccugcugucucugucucccaaguacugagauuaauuaaaguuaugugccaccacaauuggcuuuccaauacacuuuuauuaaguuaagucaaccagagguccugaguucaauucccagcaauaaauaguggcuuccaacuauuuguaauagggucugaugcccucuucugguaucugaagacagcuacaguguacucauaaaaaauaaaagaguacuuuaaaaagaaaaagguaaaucaacaacuugcuaucauaaaaaauaaaucccaggaacugaaagguagaggucaguugguaucaaacaaacaaacaccuaaggaguccaggucuggugauauaguguuguuaucagagcuacucaaaagcugagguaggaggauucauguucaaggccacucccaguagcugacacuuuauuucaaauuuuaaaaaaguguuugggacuaaugcuuggugggagagugcuugaccagcaauuaugaagcccuggauucaaucuucaggacaaaaaaaaauuaauguacuucuauauucucuuaauuaagauggacgaaaaauguaaggcagagggaguacucgcaauggaaaaacuucuucauaccauauacuucuuuuuuuuuuuuaaagauucauuuauuuauuauauguaaguacacuguagcugucuucagacaauccagaagaggaagucagaucuuguuacggaugguugugagccaccaugugguugcugggauuugaacuccuaaccuuuggaagagcagucgggugcucuuacccacugagccaucucaccagcccauaccauauacuucuguacugucugucacuucaauuauuuaauaaggaacaggaauauaauccaguuguagagugcaugcccugaaugcagcugaguucacuuuccaauuuauaaaacuuuucaaaaaccuaaaucaauuguucagacaaguccaaauaaucauuagaaaguauauuaaauauaagcaggacaugaaggagaguauggucuuguuacucaaagaaggcaggcauuuuguaaaaaucagccaauauuuccacccccaagauaacacguaaaauauaugcaaauaaaacucuccaaaaaugcagauucugcuuccaagcacauaagggauacucaaucuucauuauuuuuuuaaacuuuuauguaaaauacaaagguaacauuaaaaauacuuuuuacuggguaugauaacacaggucuuucagaaggcagagggacaggcacaucucugaguuuugggguagugaaggauacauaagaagugguauuuuaauccuuaaaauuacuucugaacaggccuggcaugauggcacacacuuuuaaucccaguacuuuagaagcugagucaggagugaaacaguucuaggcuagccuuagguacagggugagcuccaguccagccagggcuauauaguaagacccuuucuuuaaaauaaaaaagggcuagagauggcuuaaugguuaagagcacuggcuggucuuccagagguccugaguuguauguagucccagcaaccacauugguggcucacaaccaucuguaaugugaucugaugcccucuucuggccuaaaggcauauauccaaacaacacuguauacauaauaaagccuuguuuuagguagauagguagagauugaaaucagggucaaguaggaaucaguaagucaucacuuaacuguguuuuuacuccacacaagacacuuaccacgcaggagauaauuuaguaauuuccccacauguaagacaguacuacuaacaucuucagguaucuguaaaugaaauaacuaaaaaagacaagaguguacaaccugcacacaaagcuaauaagcaaaggcaauacuggcaaaaccuaagucucugacauccaaguucccacucuugggcuggugauauggcucagugguuaagaucacugacugcuguguucaauucccagcaaccacaugguggcucacagccaucuguauugggaucagaugcccucuucuggugugucugaagacagcaacaguguacucauaugcauaaaguaaauaaagcuaggcaguggugacacacgccuuuaaucccagcagagacagagacagguggaucucuugaguucuaggccagccuggucuacauagugaguuccaggacagccagggcuauacagagaaacccugucucggaaaaaccaaaaaaaaauuuuuaaauguaaauaaaaauaagucuuuuaaaaaauucaaaaaagccucuaucaugcuucaguuaaguaaaaagguuaaaaaaaaaaaaaccaaacuguucauaauuguuaauuaacagaaaaacaaaaagacaaaugcagcaaaauuccaaagaaccugaauacccuuguuaauagauagguugauguuuuuguuguuauucuuuaauuuuuuucaagauuugaaguauagcaguguuuucucugccucaggccuguguaagugagagaagagcaucaucucuuaggaccuggauuacagaaggcugacauaccagcugggcgcugggaaucagaaacccaaguacuuuguaagagcagcuagugcucuuaaccacuuaacuuauuccuuugcccuuuggauuuuuuugucuuccugagaaacacagucuugcuagguggugguaggguacaucuuuaauacuagcacuugggaggcagguggaucuuugugagcuaguggacaaccuggugucuguguguguguauguguauuuguuuauuuccagggcagccaaggcuacagaaaaaacaaugucucaaaaaagagggggggggaauauggucuuggggcuggagauggcucagugguuaagagcacuggcugcucuuucaaagguccugaguucaaucccccagcaaccacaugguggcucacaccaucuguaaugggaucuaaugccgccuucuggugugugucuaaagacagcuacaguguacucauauaaauaaaucuuaaaaaaacaaaaacaaaaauccauggucuuaugaguauaccucaggcaggccuauaacuuagaauuauacccaugugccaucacacccagcucauucuauuuuuauucuauuuacuuauuuauuuauuguguguggauaugcaugucuacaacaguguacauguguagaucaaaagacaacuugcaggagucaaugcuuucuaguucuggagacugaauucauguucuuaggcuuggaagcaagugccuuaccaugcgaagccaccuugccaacccucagucuauuuuagaaucuguucaaaacaccuuagccacagagcacaugccuacuaugcugaggcccuggguuugaaccaccuccagugcugaaaaaauuaaaaucaaugccuauaagcccccauuauguagcaauucaagacucuucucacuggacauuuagauuuuuaaaauggaauuuuaacauaaaaaaaccugcaaauaaaaaacaugagauuuugagacagcaagcccacaucuggaaggucaauauucauauauggaaccuagcccuuucaagugauuuuaaaacuagcuucuuuuuaccacuggucacaaauucuuccuuguauauuaguuucauuugacccuaauuauaggcucacuauacaaaaaaaagacaaaaaaaaaaaaucaauauacuuuuaagguaugugcccauauuccuauagaaaaaguacaugccaggcuggugagauggcucacuugguaagagcacccgacugcucuuccaaaggucugaaguucaaaucccagcaaccacaugguggcucacaaccguccguaaugagaucugauucccucuucuggaguguuugaagacagcuacaguguacuuacauauaauaaaaauaaauaaaucuuuuaaaaaaauuacaaaaaaaagguacaugccuaccuaaagguagucuagugaaggaagugccuugauucuggagccaaccgguuuugguugguugagcccuaguuuguaagcuaugagaucgccaguagugagcgcuugagcaccgugcuuaaaauucucauccccuuuccucacugguaaaucucugaaucgcaacaguaguucuguuaugaggcuuaaacucuucagaugugucagguucuauuauucuaagugcuccauaaauaucaguaauuaugccaaaucuuacaaauauucaagaaaaucacuuaaugcaucaagccauaauagcuuuuaauuuguuauguauguaaucuuuccuauuaaguuugaaaauaauguauugaucuagaguccagagauguuggucauggaauggcaaaauagucaucguuuccuauacacaguauuacacaauauucucuccucucaacacaccucuacgauagaaaccaucuuaaguuuugaacaaccacuugccgccucacccucggccuaaccaauuagguauuuauguucuguguguaaaauaacauuaacaauaccuagaaauuuaacaugguacuuaaaucuacacaaaauagaaguuggcagaaacccuuacuuagucacuucaggaagccacugaacgguaagacugggccacugaagagcaugggucauaaccaggucauacagaaacgguguauucuucuuccagauuuuauacucuucguugaugacacgcuccuccacaguaucuucaaacacugaaauuuggagaaagcccacaauuaaguggcugagaaggcucggagucaaaggcauggcuacggauccuggaggucaccucgagacggccacaccuuaucuauucuuuccuuuuaccuauccugcucacacgaacugcucucccacaaagugagaagaucaacaucaggaagcguuuucgccuccacuuccaagaucgggauuccggcgcuuacccgaauugggucauuaauugcccuaccaccgagcucgucagccuuuuuauagccgcucgcaccuguucuacgaugauccgcauuguaaaccggugccccgacccacucgaauagauccaauccacguggaacagcagcagcccacaggccugcucccuccaccccccacccucgcaggaggccccagcuccccaccaagccacgaucggcagccauaguccggcgggauccagcuccuccccccccucccgacacggacacgggccgcgaccccagacggacgacgaccacgcgcacggaagaauccgcgcccgccgcugacuucucgggccgcgagcgccugcgcccccgagccaagggcgucggagggagcuaggccgcggggugggggugggggugggggaaggggggccucucucucggcccccgcgcccggcuccggaaaugcucccggcccucggcggcgaccaggccccgugucgcgcaggcccccuugcaggcgcgcggcgagucucgcgcccagccccgcccccugcuccucacgccaauucgcgccuuucgucagcgcgugccgaggccucgggagcccgccagccccccggagucccggcgcccgcacgcccgcccgccccacagggcaggcauccuuacucucuuuacucgccaucuugcgucgggucguuucgccccccuuggccgccucggacuucucucucgcuagucaagagcagcccggcaggcgcuccuugccucucccaggcacgucacgcaguccucgcucggaaaagccugaguucggucuggccgucuggguucuccccccagacgccgcgaucuccucuucugccuccuccccgcuggcggguagcgaggucugagccgcucuccucucucucccucucgccaaacuuggaacgagacuuuucaacccgcgccucucagcccgcccaggcagcugagcgcaggcgcagccgcccugggaaauugg

SEQ ID NO: 9815 - RNA, 1196 nt, Mus musculus
gucagacugaucacuuuuauuuaaaacaucaaguuauugaagggauguuuuaauguaaauugucccuuaggaacaauuguagaaaugaguacagucccucuagauguugacguggaaggacucuucaauggcgaucugaaauuggguuuccucauccagcugaagauucacgaaaucuccguaaucaaacugaugccucugauuaaggugacuaacaaaauuucuggugaguugaggcgggucgccccauggaagagauaggcaaauugggcaagugacugaaacgacacgaccucgguggcugcuguugcaaugauccagcaaacguugccugcucaugguuacuucuucacacagaggacaaucgaaggugggcucaucaggugggcuugcguucucuuccucuucuuguaaaaccucagcauucgcugaggccggugccucguuguuacuguugcccacggaguuuggagacuguuggaagcuugaaacagauguagaaacuccaaauucauccugguacuuuucgcaaguuuuguagugcugccucauacgauagaguucaacgcgcugggaacagcaucggcaauuaccaggaaaaugucucaugaugguuucgaggucuacagcccucacuggacaagcucuuucucuucuagucacauuuccacggcacagggggcaguggagccggcucuccuucauugcacucaggaaacauuuucugcagaaaacaugcuuacaggccgcgacccgaacuggcguuuugaagacuucuuggcauaucggacaguagaaaucaucuucaguauaagacgugguggaggcagauucuuccucggccauaguggcgaccgguagaagcccaaggcgauggcggcucgcggcugccaagguggcgguggcggcucagagcuccccuccggauccucuccaagcagcgcuuugggucaagcucucuccgcggcagauccgcagacaggugguccccugcugcaguccgauuucagcgccuuucuguccagcaguugagugagcuucagaccacuggaucuccagcgaaugacgggugaugcucuguucuuaugagccucagaacccgccagacccgaagcucauggugauggagauaccuccuauucagccaucaguugagagguaacugcugccugccaggcugguuggucacugcagag

SEQ ID NO: 9816 - RNA, 25027 nt, Mus musculus
cagcuuggcgcgcggucuccgguccgccucuccgcucgccgcagcccgggcuccuccuccguccagccuccagggcgggaucugucggcucgcccuacccucgcagccuaagccugcccuccaccagacggguccccuccccgcggcaccacggcuucccuuccacagcacggcgacgggggcuuccccucagcagcugccggcgccucagucuccgcggccagcccagcuccgccgcguccgcggcccgccgccgccguaagugcugaaggaguccgcugagcuggcagggauggaaagagggagugauggcugggacgcgccccccgccgccccgugagcgccccgacgaccccaccccgaguccucccggggcgccgcgccccgaaacucacuucugccggcgguagcgcuccgcucuccacucggcagcgcgccggugaugcaggggaaccgguccuagguuccgcggggaccccgcggcaccugugguucgcugaucgccucaaguuugacggggcguuuuggggaggggcuggggugacggcgaccgaggacuuggcgccccuggcgggccagcggaugccauugucucugcuccacuccuugccggucaccucgcccagcuuuggguacugauggaguguagucccgggaggaggggaggcguccgagacugcgggaccccagggaugcuggaccagagcccacuccaaggcugagcucauuguuggguuuuuuguuuuguuuuguuuuguuuuuguuuuaauaccaaucuggagaaauuguugucccgggauuugcggcaaaaaucaaagcgagggaaaaggaauacuugugccgcggguuucgucccauguuagcacaucauuuguuuugaggaaaaugcuugguuucuucguccuccaaagugguagggcggauacuggaccccgcuacagauagccuagagcacaccccagucauuagcaaaccaucucuccuggucaagauuuaagaaaaccgaucggucccuuccccaaguucugauaacgguuugcguucaauguccaguucuuucgaugccguucuuuucgaugccgcugucuucaggacuuacaaggguggcacuuugcucucaaugaauuauauaguguugugugggguaauagccaauuuuaacuuuauuaaaguuaaauggcuacgccauaaauauccggauguuuucuugaugccuuuuugggauauugcgagguggauuuccugucuagagccaauuugauuuuauauuaguuacguaaauuccuccuccggguguucaaauuuaagguuguguggugaauauuaagaaucgcccuuggguggaucuuacuugcacugucacuguuaaaggaacuuaaaaagguuaaaacaaaacaccuauccaaauuuuaccuucaaauuagcuuuacaauacagcucgcuuuuaccaguugaauuauaaaauacaugccuuagaaaauauagacugaccaacagacaugcaaauacuaaguaaaucaaugcaaauuagcuucgguauaaaacauacucaaauccagcauaacauucaaaugugguuuuuguuuuaaaagaaguauucugugcacugucccaaaaauuuguuguuuuaaauuaaauaucuugugucucgauaugaguaacuuugaauaaagcuuuuuaagcguguauucucuuuuacauacauuaacucaguucuugagugcuuguuuguguuggauuuuaugaaaugcaaacauaaaaaucgggcuuuugucuuuaaaauguguuguuugugagaucuuuuugauuaauauugugauuuugcuuaaaauaugcuagcauaaauugaagggaaugcuuuaaaugacaagcaguuuuucugcaagaaauucagccuggaacuagaauagccucagggugaaaaauaguaggucuccucuuccuagacauguaaaucaacauccuaaaucaacuaccugaugucugcauuugccuuuaaugcacauagagugguggaguguggaacagguagaaaauuguuucuugaaauuaucagaguuuuuguucuucaaaauuuucacuccagcuuaccaccuguucugauuuccacacacucuuccacacuuaccuacauauaguaagaucuuuccaauagaauuuccugcuauuauaaccugcguagaaauguugauggcuuauugaucaugugucaggguguuuacuguacccccaaagcagcucugaaacaucaugugaucuugacuguugauccuagguaauuguauguaauuuugauuuuauuuauuuuaacagaugcaguuuauguugcuuuuuagucgccagggaaagcuucgacugcagaaaugguaugucccacugucagacaaagaaaagaagaagaucacaagagaacuuguucaaaccguuuuagcacggaaacccaagaugugcagcuuccuugaguggagagaucugaagauuguuuauaaaagguauuuuuguuuuuuuuuaucagaaagguaaaauacugucaaauauuaggguuauuucuaaugaggaaauugcagacuuuuaugucaauaaacaaagauuaauaaauauuaaaugaaauaaauuuaaaggaaaacuuuccauuuaaaaauaaguaacugcuauuuugauugcuugccuuaggcugaagcaauagcagcagggaaucauuuuuaaauuaauuauauaaaaaagacagacaauuauuccugcuuaaucaccauuuuagaaaaauuuaguaaauucauuacugggguaaauaggguauuuuaaauuuuuaaguacuucgcuaaauucuugcaugcauagauaacaguguaauaauuccuuguuauaacaaaucuauaaaauaauuacugauauuugguauuucuuuucugacuuuuagaauuaaucuuauucauaaagauccuggacacauagaccaucucaguauacagauguuuaaauacuuuguguauauauagaaugucuuuccuaguagcauuuauuaauuuaaaauagacuuuuugcugugaaggaguuauguuuagauaugauaauuuuaccaaggauagauuuuuuuuaaagugauguuucaaaauaacuuguaaaaaaauagcuuuuuuacacaguuuuuucuuuaaugcuacauaucuuuauuuuguugguaaccaaaaguuuucuaagcaguuuaaaagaaauauaauuucuucuuuuauaggauuuuuuugagggaacauuuccuuauuucuuccccauuucugguccccuuugaauaauuuacugaauucaacauaaaagcauuucuucauauaaaacauggucuuguauggggaguacucagagaacaguaugcaauucagugaugguggagagaaguguaauuuucuaucacuauauuucaaauauggguguguuuuauggaagagguggcaggggaaaacagagauuaauaggacauugagaccauuagacuucuucuuucauaguaaauuucaucagcuugggugauuuuuguauccaauguuugguuuaguauuuguugagaaagaucauacauagcauuugagaacuggaagaauccuuaagaacacacuuacaaucuuuuugcccaggguuagaaucuugaauaaagcaaauagaaauagaauugcuuuuguggaaucagaaaaaggaaccuuguacucuggcucaguuggucucugcucucugcacaagagacagguacuggauuugaaaaaacaguuuauuguucaaauuucaauuuauaaaagaugagaauuugugaguggugacuuggcccaaggucauauacuagugaugggcuuugggcuacaaucuaagucuuaaauguggaggcaauaguuuuaaauagguguggaaagacauagagaucagauuugcauuuucugcaaagagugcaguaaaacaauggcugaggagugggcugagacuggcaccugcaggaucaguaggggacugcaugaugauugguuccugagcugagaggccagaaagaccucugagagaccuguuaccuaggaaaggaaguggagucaccauguggccuuuuauuguucccuuguucucugaugggauggggugggaauagacauggaacuugaggguggaaguuagacauagcauagcagauaaucagcagguggaagggauaaagaagcagccgagugugucaggucaguaaagucauggaggcagagcgacuugagaguaagaacacuaaugccagguuuacaugaaggucacuaagacugagagcucuuggagucuuacggugagcguuucaugcauugacuguugccagaacauuuucaguggaguagagacagaacuuuugauauaaugaggcaaagguggagagguggagaaaucaaaauagcauguauagagaguauauaggagagcuuugccaaggccagaagagguuguaacuacccauagacaugaauucuggauuccuggacaggguuuauaaaaggugugagaaguuuaagcuuauucuagauagugaaaggagucccccguguggaggaggaaaauucuagcaagagaacaagcccaugaaugggccauuccaaggaaagagcagguuggggugcacagacagcugccacgcagcccaucccuguccaucuguccaucucccuaccuuuuucagaauuucaaaaagaacuccaaccugaucugauaauuagaucaaagauuuuuuucaaaccuaauuuggacuuaacaaaaaggaaaaaagcuuuauugagauguuuuguauucagaagacaaaauguauaaugcuuuucuuuauccauaucacccugaaaaccucaucugcuagccacuuaacuguguacuuuguuauuaucaggugaugugcuuucccuguuccgacuggaagaccuuuuaagccagagacuuucuacugagcgucuaagaaauucugcgcuagcacuugaacuguuccucuuagcguguuuguuaugccgcccuuguucccugagcauuugccaugcauguuuucccucgugagaggaagcaccggcuauuacaauuacuauucauaaucucugcaauagaaugauuuggguaauaucguugacaaucugaggacuugggugguguugccaugugccauuaucuaguauuuugacuuugacuaugcugggcuuugccuuuguuuccucaucuuuuaaguaagugcuccugaagcucgcguagagccaggacacugugugccgaguuugugcagcauuucagaggagaggcaauugaauuuuggucuuuuaagacuaauguuaaaaugcauccccauguuaccagcuugagaauuuguugaaggauacuuaaugauuuucuuuacuaacaaaagaaauguuaccaacauacuaguggguguugagaauuguuuagcuacauucacgcacagucagcugauauuuagcugacugcggagaagucauguguuuugaauauaagaauaggcacuuucagauguucugagugccaguaauuagaguaagcccuaauccauggugcuaaaaauaacuaaccauaccucucuccuuacuagucuauuauuaauuuuacuucagauuuagacuuacaaauauguacuuagagaacaaaaugagcccauuauugaguuuuaaagcaccauuuggcccuaaaaauagggaguauucuucagguucucuugguaaucuuuuacuaaaucuuuuuuuuaaucucuuucccuucuucaaagcucuuaauauauugcauugagcauauuuuaauuuuaaccaggugcaggauuauuuuaauacaguucgcagcugugguuuuuaauagaaaauuugggcuccagggucaaauuucuguucugagccgguuacucaagccugggucuccuauaaaugcaaauaguaaugcuaucuuaguaaggcuguugugaagauuaagauguaaaauaugcacaagccuuggcgaacauuuauugucucgcugacggugaggcucuuccuggagcuugcugcucuacuugcuucuucugaagagguguucuuaucaugcuaagaaggaauacuucuucaaguugcccuuuucucccccgucuuagugaaggaggcauuuggaggauugaaguugccacuggauagcauaggaaacccugauuggaucucuaauaugacugaaaaaaaaauuaacugcuguugaguaguuuucuucuuacaguguuuuagguuggugccuagacaaucaguccugcuuauuuuuaaaugcaugacugguauaauuuaggaccuucagguguuuuguugcuuaaauauuuuuauuuguaaagaaagaggcaguauguagaucaagaaacaaggagagaguucccauaccagauaccuaccuaacauuagcaugggacaaguuugaaaauaaucuuaucccaaauuuacuauuaguaaucucugcaaaagaauuauuuguuauucuguucauagaaacaauuguaucagccuuuugcucugucauuuuuauaucauuuacucuuuaguuuucauaauucaaagaaucccuuauaucggcgguucucaaccugugggucacaaccccuuuggcaaacccccaucucuaaaaauauuuacauuauagcucauagcaguaacaaaaguauaguuuugaaguagcaaugaaaauacuuuuaugauagggggucuccacaacaugaggagcagucuuaaaauaucgagcauuuaguaagggggagaaccaauacccuauguaguuugugccaggcucuccagaugcuggcauggauuagggagcauggagagucggaauagccuugcuuuucuaaauaaacaaaacaagguuagaaugggagcaagagcaaguguuuugcucaaguuagagauggugcccuguuuugucuuuccugacuucucuuacucgggacaagggaacacacugaaagguagaucuacuuugagagaccacaggcuugcagauuaaagauuucuguguauacauugcccuucaauaccauguucuaaaacauugacaauaucuucaauaagcccuucaguuggauaaauugacagcuuguuuucucccauuugcuuguagugugaaucaaucacacuaauuaaguaaacuuaagaaaacuggcucaauuauauuuuucaaauguguagaaagcaaucugaaaggaagaagagcaagaucaauuacuccuucuaagagacaugauugaauuauuuuucucuuuucuuuuugccuguguuuuccaaaauuucucuugcacauuuauuacuuuuguaaucuaggagaaaaagaauuuguuuuaaaagaagaauaaacaugauuauaauaagcaugaggacuuguacaacagggcaugaaaauauauuuagauaacaugauuauagggguaacauuuuucuguaauucuguuucauuacagauaugccagucuauauuuuugcugugcuauugaggaucaggacaaugaacugauuacccuggaaauaauccaucguuacguggaauuacuugacaaguauuuuggcagugugaguaguaguuuuaggguuuuuuuuuuauccugucucuaacaggcuuauuauuugaggauucuaacuuaaggagaggacagggcuggcucuuucuuguugucaguguuucuagucaacuuuucagaaucucuggccccacagauguacucauuuaauuauaauggugagaauaaguuuuaaaauaguaaaauagggauguuggaaagauagcucaguuggugccaugcuuaccacucaaguaugagaaccugaauugaaucucaaguaugcacaucaaaagccagcguuggcugcugcugcugcugcugcuuuuuaaauguuguauguaugggugucuugccuacauagacaucuaugcaucaauuguacacugguguccacaaaagccaaaagaagaugucaaauccccuggaagucgacauacagauggugaugagcuauaauguaggugcuaggaaaugaaccuuggucauuugcaagugcagacagucuuuuuaaaugaugaaccaucugugcagccccuggcuuuugcuucuaauucccagggugguguugacagauggaucuuuggagcucacugaucagccagcccuauccuagucagugaggccuaggucccagugagaaaccuugucucuaaaauccagguagauggcuccugaggaacaacagccauuugcacaucaguguacacaugcacacacauacauacaugcacccacacacgaacacacgugugaaauagaguucuauuacugacguuaacauucuggaagaguaaaguauaucauucagaauuguuagcagcuuaaucacauuacucaaaaacuguguauuuaaagaucaguuuugaugaguggaaaauuauuaaguugacuacauagggagugugcagagccagaucuuguaggcauugugcugucaagugcuugagauuugacaauuaagcuuacuuaaaucaauggugcuuaaucagcaagauuuccauuuggaaaagaauuaagaucaauucaaucugaugagauuuucuucacugcccaguagugaauaagcaucuuuggcuuaaguuuuaucaggccuuguuuuuguuugcuuauuucuuuucuuguugcuuuucagguaugugaacuugauaucaucuuuaauuuugagaaggccuauuuuauuuuggaugaauuucucuugggaggagaaguucaggaaacauccaagaaaaauguccuuaaagcaauugagcaggccgaucuccugcaggagguaagcuacuuaggcuccugaaaaggagcuagcauguuucgcuuugcuagggaaaucucaggcaucauuccuucgaguuuuagaagugaccucaaagcaugcuuuguauggaguguucaugugucagucacaucaacucaguuaucuaugaaugggugguucucuggggagaugggccuccccaucgggcuuagaggacagacagcuuuaauucaaauaaauaaaugaaucaauagagaaauaaaugcauauauuaaaaggggaaaacaauuggccaaaaguaacaaucauuuaagaacuugccauccuuuguuugaauuacuuaaagccccuccaccuuuuucauuaguauggauaauuaggaguugacugugagauuauggcauuuccuuuccaaauugguucauguuuucaccucauguccauuaagaauaaauguagucaagcaauugcuaguguuuucuaauuaaacuuuuuagagaacccucuggcuuugaguuaagaaaauuaacuuaaaaugaauuaguacuucuuuguucuuuugaaauaacuaaccauauucugucaaaacuguuauauucgugucuuaacuuccuuaccccagaaccauagcaaccccuuuccuuucuaauugccuucaccguccugagcuaaucaugugcuugaugcugagguaccaagcuaaauuaugcuuuagagcuuauggugcuuauuaaaauacagagaguuuagcaugaaaauguguuacuaaagaaaauauaggcuguuuucauuaaggcauauauauauauacauauauauauauauauauauauauauaugacauaaauauuugugucccauggauucauuuacuagaaguauugaaaguagguuucuauuucucauuuauuuaacccuuucuuaucuauuacauauuaauguuuaauuaguaaaauaaacuuuaaaaucaguguuuucuaguauuucugaaauugcuaccuuuaaaggaauaacuaaaagaagacuaacuuuaauuuuccguuauaauuucuuuacuuuugguauuuguaguggagggaacuccucguaaagccucuguaucagcuguagggccugcuuaaaauuuucuugauaucacccagacucuacaacugcuaaaugugaggcuacagacuguguguuuaauguaguaguugucagaaaauagguuggugaguacaaaacuguaguauuucaguggcggccuucacaccaucugcuguuugguagucaaaugaacacagaccguuuuucuuguguacacaguuugccauguggauuacugauuacaaacaugccauuuuggagguuuguaauucuaacaucaggucugcugacuuuaagacuauagucuacuguuauaaaauugguuuuaaaguuagcaucuccuucuguuguuuacuaucaaacuuaagagacaacaaacaaacaaaaaugaugagguuaaguuagggguguagaauguuugccuaccuuucaugaagcccugaggucagucccuagcucagcauaaaccaagauauggugggguaugccugaauauuagcacuugggaaguggagacagaagaaucaggaguuaaaggucugggcuacaaaggaaguuuugagggaagccucaggguaaccugaggcccugccaaaaauaaaacuaaccaaaaguuaggccccaagauugggaauucaaaauucuucauauuugugucuugucuuaauguuuaauuauuauagaacuauaaucucuugcagaacuuauuucuucuaaguuuuucauuauuuucugguuaauuuuuuguucuuuucaagacauuuuuaaagcuguuaaaaguucaguuuuugcuuuuaaugauguucccagagagugaugcuuagggcacuaggaucuccuugacccuggguuacuuuguaaaugcuacuagaaaauggcuccaugcuuugcacuaggacaaggccauuguguuuacuugauaguguguauuucccuugugaggggaucaaagcauucuuagggcagucaguaugugcuauuuaccacuucuuaggccugaggacagucacuguuguuguuaccaguaguuagaacuuuucauggauauggagauuuauagacaguauuuucaaaagucucuucuuguuagauuuaccaaaaugccuagaauauaauagcuucguaggucuuauaauuugagauauauuagucacuuugucaauguccugaagugauuuuguuucuaaaauugucuaaggaugcuauuguagcuaaauucauccuaaacuuugcagugaaaguacuaaaaaccugauuuuaauguaauuuuucauguauuuugacuuuucuauuuagugucaaaaucuuuauuuggacuauuuugagcacugaagaugauuuugaauuaacaaugaacuucaucuguuggcugaagaauauauauaaauuaauauaguuuugauuuuagauauuuuaaaaauuucuauucagaaaauuuauuaaaauuuuacuuugcacaauuuauauaaauauguaauuuagguacucuuucaucuugugggcagauauucaguggcuaaaguagauuuucuuguuaucaugcuacagaacaaaaagaauguauaucugaauaauaacugccaaaauauuagcaaacauugugauuuaauaguauauuuuucauauuugacauuugcaaccaacucguguuuauaacuuuugguugcaugaauucauaauuaccuuuuggagggaaaucccagaaauuggccuguuauucaauuuguuacuacuugacuguuggaauuuuaaacaugccaucuuaacaugccacugguacuaaaguugauuuuuauaugaacauaugacaugaugagauuaauaaaguuauauucuuuacaaugcuuagcauauuucccuccccacauaccuaguuugggggugggcaucugagggcuaaugaugcaauugaacauaaggaaauaauaguaugguuguuuuuuuccugugaagucaggcacuuaccagcuuuucucugcuccuuaauuuuauagagccagaaugaagaauggggagguuugucugaggauaucuuaugauaaagaacagucuaagacuuuaguuccuuugauccccaacuuauuuauugguaacuacuaaauuuaccauuuuuguggcaugaauaaaauggcacuaugcagagacuguugcacgugagaugauuucaaguccuugcuugaucugugaagaucaaauaguuaaauauuaggcaucaggcuugauauaaccuuagcgguacaugcaugaugguguugaucagcgcuuugagaugugccgaccuuucuuucuuauacuaacagcaucacuuugaaauucguggggauuuuuuuuuuuuugagcuuuguuugcuguugguauugcuucucacuaaaguaauccauggaauggaaaaaggugaggugccaaaagcaagcacuguacucaugaauuugcuucuacuugaagaugauccaguuuaugaauagggucaugggacuugcagauguuugucucaucuagaacaugauagucuauggagaauuacugcugcucaaauugauuuguuuuagugcugaggccugcaugaaauaucuuaaauaguuugcugugucuuuguaaaaguaaucacugaucugugggacugcauaaaaauggaaagguaagaauccugagagaaaggaugguuucuguaaaaaaaauugaggcuuuuauaauaacguuaagcaaauaaauauuucuuaaaguaucuuauaaugugaagauuuaaauuuuucaaaaaauuaagccuugcuacuuaagaauauuuaggcacgcuagugagauucaagaauaucuuaaauuguuuaaaaagcacauaucuuuucaaauauauaaaauugucauuuaacagcaaaacauuuuauuauaaaacuuuuccuuuauuuccuguuauaagauaaaaccccuuaaagucuuuuguaaguaccacucuuucauguuauaacuuuuaagccuaaaacucuuucuuuaacuggguuaaaaguuaaggcuauaguuauuaaugcaagaguacuuuaaauguaguuugggaucugcuagaacagauauggagaaaugagauuuuauugauacuugaaauagacaauccagaagcaggcagauauacaagguagaauggaucucuauccuuuagcuuuauuuuuaguaccauauacuaugacuagugucacuggugucuggcuuucaaauuguaaucauuuuguucuauguaguuuuagucagcuuccucuuccuccuccuccucuucuuuuuuguuuauccuuugaaauuuuuuagccacaccccccuuuguuucuuuucuaacucaugguggcuagcuacugugagcucuuuguuucuuuuuuauuauuauuauuauuagauauuuucuuuauuuacauuucaaaugcuauccugaaaguucccuauacccuccccccaccccccgcccugcuccccuacccacccacucccacguuuuggcccuggcauuccccuguacuggggcauauaaaguuugcauguccaaugggccucucuucccaaugauggcccacuagaccaucuucugcuacauaugcagcuaaagacacgagcucugggguacugguuagcucuuuguuucuuguuuguuuuugcagcaccuugggccagaacucaggguagagucuacccuaggcaaacccuucaucacaguccuauaucccuagcuucacuuggcuuuuuguaaugauuaaaaauuggaaugauuuaaauagucaauuauaaauuuaaucuugaaacaauuuuuacgagaacccauaguaaugcaguuuuauauuaaugcauuuauauuacuguuuuuauacaaaguacaaaaauuauugaauaauauucucauuacuugcugugcucucucaaauuuugucuucuauucuauuuuuuccuuuuuuuaaugucaaucuuaaccuucauaauugauuucaugauccuagaguuaggaccuacuaagagcauauugugaguggucaguggugauuuuuuuucauuaaacaguacuugcugaaaaauuuuagauuugaguuauuccccuacugacauuauaauuuguuuuguuuccuguuacuuuaaaaaauuuaauuuccauaguagaaaaauuaguaaauacaagccaacauacuugaauauaaucuuacccaccaagcagagccaaagcagugcauagcaucuccuagguagagaccaaggacacuguuaaauauccuauucugcacaggacacaccuaccaaagaauuagccagccccuaaaaucaguuguauccaaguugagaaacccugacuuacuuuaacacuuugagcuaaaaauuucauuuuucauuuaugaacuguuacaucuuuuuaauauguaguauuauaauguaguauauguaauauucaguauaaaugauggcugaaaauuagaaauacuaagaagugcaaaaacuuuaaaauugugaaaagaagaacauguuaacacauaaauaacuauagaaaaaucaccccugugauucauacaaauuaccuuugccugauaacuagcaacuggggcaauaauguaugguugccuuuagaaccuaacccacagcaaagcuuaugggaugucauggaaugaucuaauuuccucagcaacaacuagaucuguucacuucuauuaagguaauugaguuuuuauguggaaacaagauugacucuacccugcaggcaggcagaacacuauugaauuaguuggugauuuucucauccacuuuaggaugggaucauuccauaaaggaggacuaaagugaccagacuuuccagucagacuuucuuuuguuacagaguuuuuguucuuccucauccuaucagacuugaagaguuuguuugaaauucugauucuaaggaauuguuuguuuagaaaacuggcuaaauuuagagaauuucggggcaaauucaccgacacuagaauaagcuuaaauauuucuuuaaucugagcuaauuuuucuguuguuuuauuuuuuuauuuuaaaaguauaauuagaugccagagaaaguaauuuguccuuaguaucuuauaauuaacagguuuaaaguagcauuuguaagacauaauuaaaaauuacucaacucguucuuuuuaagaaaauaauaauagaaauagaugaguagcccaguaugaaagagcagagggcaugacuaagucagggaugagaaaaaaaaagucuuuccaaagggaauacaaacuaaaacaccaacugacccuuuuaacuauugucuuacaacaaucagagacauucuuguuacugcuuguaaacacuuaacguuguauuccauuaaggauugguuuuuguggugucuguuucaugaugaaacguguacuauaccuguugucccauuacauauacauccaaguauuuuauccaacuaagaaacacacacacacacacacacauauauauauauauauaugcacacacacauaccaugcguauguaugucuaugcaccaagacauagucucagcaugauauuaagccauuggaauuuacccaaauguccaucagugggaaacaauugaagagaauuauaguagucauaucugccauugcuaaucuaacugugaaauacaaaagacuaaauuuccauguaaugauauggaaagauacucaagauauaugaaauuacaaaugaucaagaagcagaauacugacuaugagauagcuucuaccuccauuuuucagauaagaaaaccaagcaaguuuuaaaauauuuauuuuauauuauaaauuuuuugguggaagaaugcugcagucugaauguauaacaacacaauguaacauuguuacauuguguuguuacagauggacuacaccaugagcccugucaucuuuuuguuuuguuuuguuuuguuuuuugguuuuuuuuuguuuuucgagacaggguugcucuguauaacccuggcuguccuggagcucacuuuguagaccagguuggccucgaacucagaaauccgccugccucugccucccgagugcugggauuaaaggcaugcgccaccacgcucggcugaacccugucaucuuaaaggugccuuauaaacuguuuucaauccuucuguuuuuaaaauucauugcucaaaauagaucuuggugguuuuguauauugugaggcccuuuggggcuuuaaaacaagguacaaaauacacuauuuuauaauacaaggaguauggaaagaaacuccuuuuaaaacaacugaaguaagguaauaaacuugaaaucacacuuucuuauauuauauauauauauauauauauuauuucuuauauuuauuauuauauauaauuuuuucucuuaucacauugaacuagaaucaggagaguagccauucagucuuggauauguaacaccauuagguuauuuaaguaucucucaguuuaacaguacuuaagcuaauacaauugcuauuuuaggaguauuucagcuuucugguuaguuuuacuuaugagccacauaauaaucuuauaauggugaaugaauaucuaggaaauuuuaugguauuuagggagacagugauuuugaaaagagagcuaaguugauucuugucugauguuuuugacaucuuaaacuugccacacuacaucuaguccuuuuguaacuugagaguggaauuauucuuaguacagaggaaagaugaaaaagcaugcauacugacgagaaggagcucaugcaaagaguaacgaacauuagaaauaaagggguuuaaaauaugcuggauugaaagggggauggggcagaaucaaaagcacugguuguaggcaagcaauguuuccuuuguuagaaggcacuaguggaguaaagcuggagaucuuucaugaguugaugagcaaacuugagaaguucuuauucuuggacuugaaaaauggcaucuagaggagacccacuggggacuggggaaaagagaaaauagcaagcgaagugugggguuuggcaacagacucaccaaagaauaaauaagugcugagcaaagggauuguccaaaaaggaaggcucauuucagguuggaaauaaugcauuuguaauagucauaaauucaguuugcugaguuuuauauaugugugugugugugacugcuuccaaaggugcccacaggaaguucaagauaguagaccuaguugugcagggucuuuuguauguugugaugggcuguaccaucaccucuaauccuuauguccuuguguuuuacucagaaaauguacugauaaggguccagaaugguguuuauguugaauugacuguauauccuuugcauaugagacggggagagucuuggucaauuacauaguuaaaucuuuuaccuaaaaguccagauguuaacagucuaaacuggacauuuccuaguauccuaaaaaugauuaaaggauaccauuuacuauauauaccaccauuuauuuuugagcauuuuagaggugucuuucuugaaggaugcucuuccagugaagagggguuucuuccuauaaagaauauucuugacaauugauaggugcuaauuucuuguuucaguauaguaguguggacccuuggcuuuaaaaaaguaguuuggauuaucaucaacccuuuugcuuaccaaagggucauuaaaaacaaacaaacaaacaaaagaaagaaagaaagaaagaaaaacaaacugaaaccuguuaguuaaaaaacaauggcagugccuggggugaccacauuucaaaaauuguccuuguaaguuuucuccaggaaggaaugacugcauuuuauucuauuuuuacuuuuauuauaauuuacuuuauucagcccuguugggaaaaccgccuuuguccuucaaugggcauaaaaauuauugugguuaguuuucauaugacaugauauaaaguugagaagucaaaaacuuuaaaaacuguaacauaaaggcaaagaauugguauugaaguauaagguuuuuugagacuuaaacuuuucuuguucucucuccagaaaacagagacuauguaucacagcaagaguuucauuggguauaagaaagcguacuagaauacgugcuggaaguacagacaugcaucaaaauguaguaggauauaugaauucaguucuaauuaucauuuugucaaguuuauuauuuguguuuugguauuauuuggaaaauuaauugcaauaccaauggauagcccuauuauuucauuaaauugauggguuuuaggaaauuuucccuguaauucauaauugagauuauaauuuaccuuuuauacagaauauugaaauugggugagacucauugacaaaguauucuuaaauauuguaaaucaguaauguuaucacagaugaagccuucccugugagaacgaaagcuucuauaaagugaagcacuguuacuaauguugcuuuacuuguuuuauccuugcucuauucuaaaugggaaaggggcagcuuuuguagccuaauauuuuagaguucuaacuuuaaaauucaucggggaugcuguaagguccauuucagaccccaccuugggauauuuuugucacuuuuugaugugaaaacaucuaacaucuugucagauauauuuauaagcagauguuuaaaaauuuuagggaguuccuuagaaucauuuugaggacuuucaaaaaaauuaaucuuuuagcuucaaagucacauuuuuuuaaaguaagucaacaauuaaaagcuuucauacuuaacaauaccauaugauggcuaguuuuaacuuguugggaggaagccuuuucucuggaccucuccuuaguguaauaggacccugaugaaugugacacacuggugaaagggaguuuucuaacugaacuugccacuaauuagcauuuacuuaaacuggcaaucuucucagauuaguaguaaguacagugcuuuaggauucugugaaauguagguuaucuuguuuacuguuacauaccaugaacuugaaaaagauaaaucugaacugggcauuaagaacuuaaguguucagccacaaaccaaagaacaaaagcaaaucugaugcuuuagaucauuuuacugugaacuaaacauucugauugugucuccaucagcuuguguacuguguguaagaauauaugcauuucuuuuguagccacgccaugaauauuuuaaugucccuguguacuaaugacugcucaucgacuaugcagacuuucacagaggaaauagagaacugauauacuuaugaaagaaaauguccucagcuuggugacuaauucuccuguaaaauaauauauagcauuuuauagcuaguaccuuuaugauuguauuuuucugugccuauuccuaauucuauuuauucuguauaugauaugacauaguuuuuucugucuacuacugauuucuucuuuacaaaauaugacuugugaauguuuuaauauucuaaacacauacaaguuaucauuaguaaaucaucugugauuaaucuuaugaggguauaagagaaagaccgggaacaaucacaaauguuuaccaaagaaaauaguuaggaacucaggcaaaauuaggagcaccacaauauuuaauguaguuugaucuuccacuguugaagaaaaccaagcuuuauuuagcacuaagauuacuuuauagucuguacaagcuaauauguuggacaguaucacauaaaaauguguugaagcaauauaagaaaaaaaucaauuguauaauucucuaagaucuaagguuaaaacauuucaauuuuuaagaaauuuuguauugccaauauuuauuaagccacauuuaugcagugucaaaaguccuuuaagaacuaucagaaagcuaugucacaaaguuucuuguauuguugcucaguaacagcccuugagucaguaguacugagccuacuuaugugauacaaaauucugauauucauuuucaauauucaaacauuuauacuuauuaguuaauggcuuccuaauuaauauauuaagccuucuucuaaacacucagugcuguguuaacaaugguuguauauuuuggaauacuaaaaguuuuuaauauuaauuuuauaaaaauaugcuuuuaauaauauuuaucaaauucuacuauuaaaauaccagauaacucauuugucuaucuagagaguuuaaaaccuaaguaaauuguuacuaaacaguaacuuaaguggcaugguagugcaugccugucauccuaguaccugggaggcugaugcaggagcaagaugaguuacuauaguaccuagggcaucccugucucaaaagacaaaaacuaaauaugccaaaaacucuaggaacuucagaagguacccaaaugaguuucccacugaaagaagaucuauaaaaugucuuaggaaauguaguguuaggcagcuguacaggucagcucucuccauuaccaucugaaacuucacaaaacauuggucuuucauuuccauuuuucccauccucccacacuacauguuguucaccugauuuuaauguugcauaaauaugcauugucucaugccuguuuguuuuggaugcugugugcugagcuguaacaaaauguuguguuuuugugagggggaggggguaucuguauacagcugcuugcuuuaaauuagcacauucucaaauagcuuuuccugcaugucugaaauaaaguauugcauguacuuugucucaugugaaugacuucuuucuucuccauccuuuuugauaaaauaacauuuuauauuuucaucucuccagguaauuuuuuuaaguugugauuuuuaaaaaauaacaauuucugagccuacaauaguacuaaguauauucacauuguuguacaacagauccccagaacuuuuucagcuugcagaacugaaauuacauaacucaccagccaacuacuucccauuucucucuuacugaaggcaggcccugguaacaaccauucuauuuuaauuguuucccuaaauaauuuugagcuacaauuucagugucaacuugcaaaaauuacauuuuguauuacaaacacuuuguaaaaacauugaacuuguccagucuuaaaggaauauaauguguaaauuaaaccagaccuuuagaaaggacauauauuauuaaauaaugcauguucaaaaagcaacaugauucucuccagagcacaggcagugagcaccuuggagaaaugugaugagcuuuagggaauaguuauagggcauuuuuaucuagagaugcugagcauaugaacuguauaaaaugcaguguaaugaugcuuuaacaaagucaggguuccaugaaguuuuccuuugaguugguauuagguggaagcacuuuuaaauucacauguccuuugacucaggacaaugacuauuuucuuuuccaccucuuuugauaaaauauuuuacauuuucauuuuuccagguaauguuuuaaauuguaagaaaaaaaaacauagaauucaccauuuuaaccauuacucagcccacaguaugaaauaguuaagugguucagaugucacucucaguauauuuaaugguuauaaaagccaaacauuuuaagcaggggagaugggacucuauugcuacuguuguuagacugucuuuaaaaaaaaaaaaaaaaaccuaucaugaaaacaucuagacaaaaacagagaaucccaaagaaaggauucauacacacaucauucaacaacagcaguuaucaaccucacaugcgccucaggcacaaagugcuacuucaccuuuagugcuccaguauuaaaguguuccuaacagcuaagaagcacaccacacaaaaugaacaagaacuacuuuugucuugugauuggcuccauuuuccuaauugucaggggaaugaaugacuucuuacaguuaaauuagguuccaaagacauuuuauaucagaugguucauaggccuucagucccucaauuuuuagcaagccuguuuuucccccuagucuuugccauuaaaaaccaaacaccuuuuaauaccaguuugccacauuccuauuuaggugauuauauucuuguggcaguguuuaccuuucucuuuuauccuccaacuuucuuagaucuguaaccugauuacacugaaguuaaaauuggggcggcaaguguacuucauagauuauacuaccucuuugaaaaguguccuuucccacuuaagcugauuuucacccauauuucauuacuagauaagcauauuaacaggcauucuaagaacauuuuuuggcuaugguauuuaauacuaaaugcuaaacccuucauuuagauuucagcuaauauuuguugaagcacuuucuuuaaaucaggcauugagccuuaaacucauucucaacacauggagguaaguacuacuacuuuuguuuuccaaauauggaaacaacagaguuuaagucauuuaagaugacacuguauagauuccuaccauucaaccuaacauucuaaagauuccugauguaauuuaauuuuucuuuuccuuguuuugugcugucucauaauuaggaugcaaaaguaaguuuauuauugguuaacaaaaucuuacauuauuuucaucuauuaaaguugcuaguaauagccaaacgucuggccuauaugguccuuuuuuauuuuuguaguguauaaaauuggucaguuuggaaauuuuuuaaauaucucuuuuagauuuggcugauuugucuuuaauauuuaaaaacaaauauucauucuuacaucaagacaaaaaaagcuuuuguuccaugguguuuuuucuguaugucaccuccaccagugccagugguugcccaggggaggucugggaagguaacuuuucuaaagcacuguaguggacaguuaaggaaaaaugacacaagcagacauuucucucgauaacaugugacaaaagugaacauugaaaguuuguucaaacacacuaaaaaccugagaggagggagcuuuucauuuggaagacauuuugaauuuuaauauuuuagauaauauuuuucuguauguauuuuuauacauuguugcuaguuaguuuacaaugggcuugauugcuguuuguguuauagcgauacccaacacauuagucaauaauagguauuuaguaagugcuaaaaacauucuucugacauuuuagacacaaaucugaaaacuacuggcugucagcagauuauuccugugauccugaauugccuucuuuaaucucuauaaugaacgugcccuucaugugagcuuuuuauauucucaagacucucuguaucugcuuaccagagucucacauuuucccuccacaggaagcugaaaccccacguaguguucuugaagaaauuggacugacauaacuguccucccuugcugaugacuucuuguggcauuucacacuguagauggucacugccucucauguccauguuagcuaaugguguaagaugaugucuugucaguauuacuguuuugcuaagcugcuucauucaggccuacccaauuuuuuuuaaagggaacuuugguuaaucaaaugauaaauuaagggacauaaauaugaauuaggaagauacagacauuuuaaaguauaaaggccagucucauaauuaugugcuuauauaaaauaugucuauauccauguauuauccaacaguuuggcaaaauacauuuacuauuguacuuaaaaaaggaaacuuaaauuaugugaaaccaaagacuagaguaacauuucaguacacauaaaaaauaaaaggaauugacacaucacacagaucaaauuaaugcaaguuuauugaaaaugucagcgaccaaauugauaccaaauacccauauuggauacaauauacuuuaaaucaaagggaauuuagaugcuuuuagaggacuaacuuagaaugaugcuguuuugcacuaaaauucauuaaguauucugaaugaauggaacaaggaacaaagacuuuccuaaucuugagcacauaauuuuuaaggccaaguaacauuugacucccugaggugaaguuuugguggucauaaucguguuuucaaugccccaaaauaaaauagcacgguuaauuaccagguauucuuccuaacaguauguugcucucuucacgaaguauuacauaaagucauuaucuaaagcaugaauguuccuuccggggugcuuguuaaagccaaauuuauuuugcuucccuauugcuuccuuccaguuagaagugcuauagacuugacagcagcucccuauucuuuccugucacugucuagucguuggaagucuuaugacagcuuaaaagauaccuuucauauagcaaagugagaguugacugagcaaaguggcauugguuggcccuauauuuuuugaagcuguauaaaugcgcggcaucacuuuuauacauccugacacauaccugaacacaucucccugauuucuauguucccuuguaauaugcuaggcuggaguaagcuuugcugugauugugaacaacuuucaagccaccggaacugucuuaucacaucaccaauuaauguaauaaauguucugcaacacuguggugugcuuuucucuuuccaaaaguuuuguucaacuagggagaucuucuaaaggaaggguacucuuuucuucccauacaauauugacaauuccucuccaucugacaccccagcccugcagcgaaaugugauggcgcuugcacgcacgcacgcacgcacgcacgcacacacgcacaaaaauagcagaaggaucaaggaauguucauguauuucaacucaguaaaaaaaaaucacauagauucuaugcuacuuacuuacaacacauuuucaauuaauaaaugccgcuuuuaagccaugaugcaguugacuuuuauacgcuuucugauuuagcaacucgauuauuccagauagucaagugauagccaaauggcaaauccucaucuccuacauaugagaaaguugcuaguucaugcaacagaaacagauuaauauuugcugaguguguugccucauguaagcagcaaaucgaaacuucuaguuacaguaagaguaugguuauggggccuuucugcugcugcaaauaggaacuauugcauucuaaaccggagacauuuaagaucaagggaaggauucucaucaaauuugaaagaggcauuuguaggucuaaagugccuuuguuuuuuuuuuuaauauuuuuuauuauuacguauuuuccucaauuacauuuagaaugcua

SEQ ID NO: 9817 - RNA, 25027 nt, Mus musculus
uagcauucuaaauguaauugaggaaaauacguaauaauaaaaaauauuaaaaaaaaaaacaaaggcacuuuagaccuacaaaugccucuuucaaauuugaugagaauccuucccuugaucuuaaaugucuccgguuuagaaugcaauaguuccuauuugcagcagcagaaaggccccauaaccauacucuuacuguaacuagaaguuucgauuugcugcuuacaugaggcaacacacucagcaaauauuaaucuguuucuguugcaugaacuagcaacuuucucauauguaggagaugaggauuugccauuuggcuaucacuugacuaucuggaauaaucgaguugcuaaaucagaaagcguauaaaagucaacugcaucauggcuuaaaagcggcauuuauuaauugaaaauguguuguaaguaaguagcauagaaucuaugugauuuuuuuuuacugaguugaaauacaugaacauuccuugauccuucugcuauuuuugugcgugugugcgugcgugcgugcgugcgugcgugcaagcgccaucacauuucgcugcagggcuggggugucagauggagaggaauugucaauauuguaugggaagaaaagaguacccuuccuuuagaagaucucccuaguugaacaaaacuuuuggaaagagaaaagcacaccacaguguugcagaacauuuauuacauuaauuggugaugugauaagacaguuccgguggcuugaaaguuguucacaaucacagcaaagcuuacuccagccuagcauauuacaagggaacauagaaaucagggagauguguucagguaugugucaggauguauaaaagugaugccgcgcauuuauacagcuucaaaaaauauagggccaaccaaugccacuuugcucagucaacucucacuuugcuauaugaaagguaucuuuuaagcugucauaagacuuccaacgacuagacagugacaggaaagaauagggagcugcugucaagucuauagcacuucuaacuggaaggaagcaauagggaagcaaaauaaauuuggcuuuaacaagcaccccggaaggaacauucaugcuuuagauaaugacuuuauguaauacuucgugaagagagcaacauacuguuaggaagaauaccugguaauuaaccgugcuauuuuauuuuggggcauugaaaacacgauuaugaccaccaaaacuucaccucagggagucaaauguuacuuggccuuaaaaauuaugugcucaagauuaggaaagucuuuguuccuuguuccauucauucagaauacuuaaugaauuuuagugcaaaacagcaucauucuaaguuaguccucuaaaagcaucuaaauucccuuugauuuaaaguauauuguauccaauauggguauuugguaucaauuuggucgcugacauuuucaauaaacuugcauuaauuugaucugugugaugugucaauuccuuuuauuuuuuauguguacugaaauguuacucuagucuuugguuucacauaauuuaaguuuccuuuuuuaaguacaauaguaaauguauuuugccaaacuguuggauaauacauggauauagacauauuuuauauaagcacauaauuaugagacuggccuuuauacuuuaaaaugucuguaucuuccuaauucauauuuaugucccuuaauuuaucauuugauuaaccaaaguucccuuuaaaaaaaauuggguaggccugaaugaagcagcuuagcaaaacaguaauacugacaagacaucaucuuacaccauuagcuaacauggacaugagaggcagugaccaucuacagugugaaaugccacaagaagucaucagcaagggaggacaguuaugucaguccaauuucuucaagaacacuacgugggguuucagcuuccuguggagggaaaaugugagacucugguaagcagauacagagagucuugagaauauaaaaagcucacaugaagggcacguucauuauagagauuaaagaaggcaauucaggaucacaggaauaaucugcugacagccaguaguuuucagauuugugucuaaaaugucagaagaauguuuuuagcacuuacuaaauaccuauuauugacuaauguguuggguaucgcuauaacacaaacagcaaucaagcccauuguaaacuaacuagcaacaauguauaaaaauacauacagaaaaauauuaucuaaaauauuaaaauucaaaaugucuuccaaaugaaaagcucccuccucucagguuuuuaguguguuugaacaaacuuucaauguucacuuuugucacauguuaucgagagaaaugucugcuugugucauuuuuccuuaacuguccacuacagugcuuuagaaaaguuaccuucccagaccuccccugggcaaccacuggcacugguggaggugacauacagaaaaaacaccauggaacaaaagcuuuuuuugucuugauguaagaaugaauauuuguuuuuaaauauuaaagacaaaucagccaaaucuaaaagagauauuuaaaaaauuuccaaacugaccaauuuuauacacuacaaaaauaaaaaaggaccauauaggccagacguuuggcuauuacuagcaacuuuaauagaugaaaauaauguaagauuuuguuaaccaauaauaaacuuacuuuugcauccuaauuaugagacagcacaaaacaaggaaaagaaaaauuaaauuacaucaggaaucuuuagaauguuagguugaaugguaggaaucuauacagugucaucuuaaaugacuuaaacucuguuguuuccauauuuggaaaacaaaaguaguaguacuuaccuccauguguugagaaugaguuuaaggcucaaugccugauuuaaagaaagugcuucaacaaauauuagcugaaaucuaaaugaaggguuuagcauuuaguauuaaauaccauagccaaaaaauguucuuagaaugccuguuaauaugcuuaucuaguaaugaaauaugggugaaaaucagcuuaagugggaaaggacacuuuucaaagagguaguauaaucuaugaaguacacuugccgccccaauuuuaacuucaguguaaucagguuacagaucuaagaaaguuggaggauaaaagagaaagguaaacacugccacaagaauauaaucaccuaaauaggaauguggcaaacugguauuaaaagguguuugguuuuuaauggcaaagacuagggggaaaaacaggcuugcuaaaaauugagggacugaaggccuaugaaccaucugauauaaaaugucuuuggaaccuaauuuaacuguaagaagucauucauuccccugacaauuaggaaaauggagccaaucacaagacaaaaguaguucuuguucauuuuguguggugugcuucuuagcuguuaggaacacuuuaauacuggagcacuaaaggugaaguagcacuuugugccugaggcgcaugugagguugauaacugcuguuguugaaugauguguguaugaauccuuucuuugggauucucuguuuuugucuagauguuuucaugauagguuuuuuuuuuuuuuuuuaaagacagucuaacaacaguagcaauagagucccaucuccccugcuuaaaauguuuggcuuuuauaaccauuaaauauacugagagugacaucugaaccacuuaacuauuucauacugugggcugaguaaugguuaaaauggugaauucuauguuuuuuuuucuuacaauuuaaaacauuaccuggaaaaaugaaaauguaaaauauuuuaucaaaagagguggaaaagaaaauagucauuguccugagucaaaggacaugugaauuuaaaagugcuuccaccuaauaccaacucaaaggaaaacuucauggaacccugacuuuguuaaagcaucauuacacugcauuuuauacaguucauaugcucagcaucucuagauaaaaaugcccuauaacuauucccuaaagcucaucacauuucuccaaggugcucacugccugugcucuggagagaaucauguugcuuuuugaacaugcauuauuuaauaauauauguccuuucuaaaggucugguuuaauuuacacauuauauuccuuuaagacuggacaaguucaauguuuuuacaaaguguuuguaauacaaaauguaauuuuugcaaguugacacugaaauuguagcucaaaauuauuuagggaaacaauuaaaauagaaugguuguuaccagggccugccuucaguaagagagaaaugggaaguaguuggcuggugaguuauguaauuucaguucugcaagcugaaaaaguucuggggaucuguuguacaacaaugugaauauacuuaguacuauuguaggcucagaaauuguuauuuuuuaaaaaucacaacuuaaaaaaauuaccuggagagaugaaaauauaaaauguuauuuuaucaaaaaggauggagaagaaagaagucauucacaugagacaaaguacaugcaauacuuuauuucagacaugcaggaaaagcuauuugagaaugugcuaauuuaaagcaagcagcuguauacagauacccccucccccucacaaaaacacaacauuuuguuacagcucagcacacagcauccaaaacaaacaggcaugagacaaugcauauuuaugcaacauuaaaaucaggugaacaacauguagugugggaggaugggaaaaauggaaaugaaagaccaauguuuugugaaguuucagaugguaauggagagagcugaccuguacagcugccuaacacuacauuuccuaagacauuuuauagaucuucuuucagugggaaacucauuuggguaccuucugaaguuccuagaguuuuuggcauauuuaguuuuugucuuuugagacagggaugcccuagguacuauaguaacucaucuugcuccugcaucagccucccagguacuaggaugacaggcaugcacuaccaugccacuuaaguuacuguuuaguaacaauuuacuuagguuuuaaacucucuagauagacaaaugaguuaucugguauuuuaauaguagaauuugauaaauauuauuaaaagcauauuuuuauaaaauuaauauuaaaaacuuuuaguauuccaaaauauacaaccauuguuaacacagcacugaguguuuagaagaaggcuuaauauauuaauuaggaagccauuaacuaauaaguauaaauguuugaauauugaaaaugaauaucagaauuuuguaucacauaaguaggcucaguacuacugacucaagggcuguuacugagcaacaauacaagaaacuuugugacauagcuuucugauaguucuuaaaggacuuuugacacugcauaaauguggcuuaauaaauauuggcaauacaaaauuucuuaaaaauugaaauguuuuaaccuuagaucuuagagaauuauacaauugauuuuuuucuuauauugcuucaacacauuuuuaugugauacuguccaacauauuagcuuguacagacuauaaaguaaucuuagugcuaaauaaagcuugguuuucuucaacaguggaagaucaaacuacauuaaauauuguggugcuccuaauuuugccugaguuccuaacuauuuucuuugguaaacauuugugauuguucccggucuuucucuuauacccucauaagauuaaucacagaugauuuacuaaugauaacuuguauguguuuagaauauuaaaacauucacaagucauauuuuguaaagaagaaaucaguaguagacagaaaaaacuaugucauaucauauacagaauaaauagaauuaggaauaggcacagaaaaauacaaucauaaagguacuagcuauaaaaugcuauauauuauuuuacaggagaauuagucaccaagcugaggacauuuucuuucauaaguauaucaguucucuauuuccucugugaaagucugcauagucgaugagcagucauuaguacacagggacauuaaaauauucauggcguggcuacaaaagaaaugcauauauucuuacacacaguacacaagcugauggagacacaaucagaauguuuaguucacaguaaaaugaucuaaagcaucagauuugcuuuuguucuuugguuuguggcugaacacuuaaguucuuaaugcccaguucagauuuaucuuuuucaaguucaugguauguaacaguaaacaagauaaccuacauuucacagaauccuaaagcacuguacuuacuacuaaucugagaagauugccaguuuaaguaaaugcuaauuaguggcaaguucaguuagaaaacucccuuucaccagugugucacauucaucaggguccuauuacacuaaggagagguccagagaaaaggcuuccucccaacaaguuaaaacuagccaucauaugguauuguuaaguaugaaagcuuuuaauuguugacuuacuuuaaaaaaaugugacuuugaagcuaaaagauuaauuuuuuugaaaguccucaaaaugauucuaaggaacucccuaaaauuuuuaaacaucugcuuauaaauauaucugacaagauguuagauguuuucacaucaaaaagugacaaaaauaucccaagguggggucugaaauggaccuuacagcauccccgaugaauuuuaaaguuagaacucuaaaauauuaggcuacaaaagcugccccuuucccauuuagaauagagcaaggauaaaacaaguaaagcaacauuaguaacagugcuucacuuuauagaagcuuucguucucacagggaaggcuucaucugugauaacauuacugauuuacaauauuuaagaauacuuugucaaugagucucacccaauuucaauauucuguauaaaagguaaauuauaaucucaauuaugaauuacagggaaaauuuccuaaaacccaucaauuuaaugaaauaauagggcuauccauugguauugcaauuaauuuuccaaauaauaccaaaacacaaauaauaaacuugacaaaaugauaauuagaacugaauucauauauccuacuacauuuugaugcaugucuguacuuccagcacguauucuaguacgcuuucuuauacccaaugaaacucuugcugugauacauagucucuguuuucuggagagagaacaagaaaaguuuaagucucaaaaaaccuuauacuucaauaccaauucuuugccuuuauguuacaguuuuuaaaguuuuugacuucucaacuuuauaucaugucauaugaaaacuaaccacaauaauuuuuaugcccauugaaggacaaaggcgguuuucccaacagggcugaauaaaguaaauuauaauaaaaguaaaaauagaauaaaaugcagucauuccuuccuggagaaaacuuacaaggacaauuuuugaaauguggucaccccaggcacugccauuguuuuuuaacuaacagguuucaguuuguuuuucuuucuuucuuucuuucuuuuguuuguuuguuuguuuuuaaugacccuuugguaagcaaaaggguugaugauaauccaaacuacuuuuuuaaagccaaggguccacacuacuauacugaaacaagaaauuagcaccuaucaauugucaagaauauucuuuauaggaagaaaccccucuucacuggaagagcauccuucaagaaagacaccucuaaaaugcucaaaaauaaauggugguauauauaguaaaugguauccuuuaaucauuuuuaggauacuaggaaauguccaguuuagacuguuaacaucuggacuuuuagguaaaagauuuaacuauguaauugaccaagacucuccccgucucauaugcaaaggauauacagucaauucaacauaaacaccauucuggacccuuaucaguacauuuucugaguaaaacacaaggacauaaggauuagaggugaugguacagcccaucacaacauacaaaagacccugcacaacuaggucuacuaucuugaacuuccugugggcaccuuuggaagcagucacacacacacacauauauaaaacucagcaaacugaauuuaugacuauuacaaaugcauuauuuccaaccugaaaugagccuuccuuuuuggacaaucccuuugcucagcacuuauuuauucuuuggugagucuguugccaaaccccacacuucgcuugcuauuuucucuuuuccccaguccccagugggucuccucuagaugccauuuuucaaguccaagaauaagaacuucucaaguuugcucaucaacucaugaaagaucuccagcuuuacuccacuagugccuucuaacaaaggaaacauugcuugccuacaaccagugcuuuugauucugccccaucccccuuucaauccagcauauuuuaaaccccuuuauuucuaauguucguuacucuuugcaugagcuccuucucgucaguaugcaugcuuuuucaucuuuccucuguacuaagaauaauuccacucucaaguuacaaaaggacuagauguaguguggcaaguuuaagaugucaaaaacaucagacaagaaucaacuuagcucucuuuucaaaaucacugucucccuaaauaccauaaaauuuccuagauauucauucaccauuauaagauuauuauguggcucauaaguaaaacuaaccagaaagcugaaauacuccuaaaauagcaauuguauuagcuuaaguacuguuaaacugagagauacuuaaauaaccuaaugguguuacauauccaagacugaauggcuacucuccugauucuaguucaaugugauaagagaaaaaauuauauauaauaauaaauauaagaaauaauauauauauauauauauauaauauaagaaagugugauuucaaguuuauuaccuuacuucaguuguuuuaaaaggaguuucuuuccauacuccuuguauuauaaaauaguguauuuuguaccuuguuuuaaagccccaaagggccucacaauauacaaaaccaccaagaucuauuuugagcaaugaauuuuaaaaacagaaggauugaaaacaguuuauaaggcaccuuuaagaugacaggguucagccgagcgugguggcgcaugccuuuaaucccagcacucgggaggcagaggcaggcggauuucugaguucgaggccaaccuggucuacaaagugagcuccaggacagccaggguuauacagagcaacccugucucgaaaaacaaaaaaaaaccaaaaaacaaaacaaaacaaaacaaaaagaugacagggcucaugguguaguccaucuguaacaacacaauguaacaauguuacauuguguuguuauacauucagacugcagcauucuuccaccaaaaaauuuauaauauaaaauaaauauuuuaaaacuugcuugguuuucuuaucugaaaaauggagguagaagcuaucucauagucaguauucugcuucuugaucauuuguaauuucauauaucuugaguaucuuuccauaucauuacauggaaauuuagucuuuuguauuucacaguuagauuagcaauggcagauaugacuacuauaauucucuucaauuguuucccacugauggacauuuggguaaauuccaauggcuuaauaucaugcugagacuaugucuuggugcauagacauacauacgcaugguaugugugugugcauauauauauauauauauguguguguguguguguguguuucuuaguuggauaaaauacuuggauguauauguaaugggacaacagguauaguacacguuucaucaugaaacagacaccacaaaaaccaauccuuaauggaauacaacguuaaguguuuacaagcaguaacaagaaugucucugauuguuguaagacaauaguuaaaagggucaguugguguuuuaguuuguauucccuuuggaaagacuuuuuuuuucucaucccugacuuagucaugcccucugcucuuucauacugggcuacucaucuauuucuauuauuauuuucuuaaaaagaacgaguugaguaauuuuuaauuaugucuuacaaaugcuacuuuaaaccuguuaauuauaagauacuaaggacaaauuacuuucucuggcaucuaauuauacuuuuaaaauaaaaaaauaaaacaacagaaaaauuagcucagauuaaagaaauauuuaagcuuauucuagugucggugaauuugccccgaaauucucuaaauuuagccaguuuucuaaacaaacaauuccuuagaaucagaauuucaaacaaacucuucaagucugauaggaugaggaagaacaaaaacucuguaacaaaagaaagucugacuggaaagucuggucacuuuaguccuccuuuauggaaugaucccauccuaaaguggaugagaaaaucaccaacuaauucaauaguguucugccugccugcaggguagagucaaucuuguuuccacauaaaaacucaauuaccuuaauagaagugaacagaucuaguuguugcugaggaaauuagaucauuccaugacaucccauaagcuuugcuguggguuagguucuaaaggcaaccauacauuauugccccaguugcuaguuaucaggcaaagguaauuuguaugaaucacaggggugauuuuucuauaguuauuuauguguuaacauguucuucuuuucacaauuuuaaaguuuuugcacuucuuaguauuucuaauuuucagccaucauuuauacugaauauuacauauacuacauuauaauacuacauauuaaaaagauguaacaguucauaaaugaaaaaugaaauuuuuagcucaaaguguuaaaguaagucaggguuucucaacuuggauacaacugauuuuaggggcuggcuaauucuuugguagguguguccugugcagaauaggauauuuaacaguguccuuggucucuaccuaggagaugcuaugcacugcuuuggcucugcuugguggguaagauuauauucaaguauguuggcuuguauuuacuaauuuuucuacuauggaaauuaaauuuuuuaaaguaacaggaaacaaaacaaauuauaaugucaguaggggaauaacucaaaucuaaaauuuuucagcaaguacuguuuaaugaaaaaaaaucaccacugaccacucacaauaugcucuuaguagguccuaacucuaggaucaugaaaucaauuaugaagguuaagauugacauuaaaaaaaggaaaaaauagaauagaagacaaaauuugagagagcacagcaaguaaugagaauauuauucaauaauuuuuguacuuuguauaaaaacaguaauauaaaugcauuaauauaaaacugcauuacuauggguucucguaaaaauuguuucaagauuaaauuuauaauugacuauuuaaaucauuccaauuuuuaaucauuacaaaaagccaagugaagcuagggauauaggacugugaugaaggguuugccuaggguagacucuacccugaguucuggcccaaggugcugcaaaaacaaacaagaaacaaagagcuaaccaguaccccagagcucgugucuuuagcugcauauguagcagaagauggucuagugggccaucauugggaagagaggcccauuggacaugcaaacuuuauaugccccaguacaggggaaugccagggccaaaacgugggaguggguggguaggggagcagggcgggggguggggggaggguauagggaacuuucaggauagcauuugaaauguaaauaaagaaaauaucuaauaauaauaauaauaaaaaagaaacaaagagcucacaguagcuagccaccaugaguuagaaaagaaacaaagggggguguggcuaaaaaauuucaaaggauaaacaaaaaagaagaggaggaggaggaagaggaagcugacuaaaacuacauagaacaaaaugauuacaauuugaaagccagacaccagugacacuagucauaguauaugguacuaaaaauaaagcuaaaggauagagauccauucuaccuuguauaucugccugcuucuggauugucuauuucaaguaucaauaaaaucucauuucuccauaucuguucuagcagaucccaaacuacauuuaaaguacucuugcauuaauaacuauagccuuaacuuuuaacccaguuaaagaaagaguuuuaggcuuaaaaguuauaacaugaaagagugguacuuacaaaagacuuuaagggguuuuaucuuauaacaggaaauaaaggaaaaguuuuauaauaaaauguuuugcuguuaaaugacaauuuuauauauuugaaaagauaugugcuuuuuaaacaauuuaagauauucuugaaucucacuagcgugccuaaauauucuuaaguagcaaggcuuaauuuuuugaaaaauuuaaaucuucacauuauaagauacuuuaagaaauauuuauuugcuuaacguuauuauaaaagccucaauuuuuuuuacagaaaccauccuuucucucaggauucuuaccuuuccauuuuuaugcagucccacagaucagugauuacuuuuacaaagacacagcaaacuauuuaagauauuucaugcaggccucagcacuaaaacaaaucaauuugagcagcaguaauucuccauagacuaucauguucuagaugagacaaacaucugcaagucccaugacccuauucauaaacuggaucaucuucaaguagaagcaaauucaugaguacagugcuugcuuuuggcaccucaccuuuuuccauuccauggauuacuuuagugagaagcaauaccaacagcaaacaaagcucaaaaaaaaaaaaauccccacgaauuucaaagugaugcuguuaguauaagaaagaaaggucggcacaucucaaagcgcugaucaacaccaucaugcauguaccgcuaagguuauaucaagccugaugccuaauauuuaacuauuugaucuucacagaucaagcaaggacuugaaaucaucucacgugcaacagucucugcauagugccauuuuauucaugccacaaaaaugguaaauuuaguaguuaccaauaaauaaguuggggaucaaaggaacuaaagucuuagacuguucuuuaucauaagauauccucagacaaaccuccccauucuucauucuggcucuauaaaauuaaggagcagagaaaagcugguaagugccugacuucacaggaaaaaaacaaccauacuauuauuuccuuauguucaauugcaucauuagcccucagaugcccacccccaaacuagguauguggggagggaaauaugcuaagcauuguaaagaauauaacuuuauuaaucucaucaugucauauguucauauaaaaaucaacuuuaguaccaguggcauguuaagauggcauguuuaaaauuccaacagucaaguaguaacaaauugaauaacaggccaauuucugggauuucccuccaaaagguaauuaugaauucaugcaaccaaaaguuauaaacacgaguugguugcaaaugucaaauaugaaaaauauacuauuaaaucacaauguuugcuaauauuuuggcaguuauuauucagauauacauucuuuuuguucuguagcaugauaacaagaaaaucuacuuuagccacugaauaucugcccacaagaugaaagaguaccuaaauuacauauuuauauaaauugugcaaaguaaaauuuuaauaaauuuucugaauagaaauuuuuaaaauaucuaaaaucaaaacuauauuaauuuauauauauucuucagccaacagaugaaguucauuguuaauucaaaaucaucuucagugcucaaaauaguccaaauaaagauuuugacacuaaauagaaaagucaaaauacaugaaaaauuacauuaaaaucagguuuuuaguacuuucacugcaaaguuuaggaugaauuuagcuacaauagcauccuuagacaauuuuagaaacaaaaucacuucaggacauugacaaagugacuaauauaucucaaauuauaagaccuacgaagcuauuauauucuaggcauuuugguaaaucuaacaagaagagacuuuugaaaauacugucuauaaaucuccauauccaugaaaaguucuaacuacugguaacaacaacagugacuguccucaggccuaagaagugguaaauagcacauacugacugcccuaagaaugcuuugauccccucacaagggaaauacacacuaucaaguaaacacaauggccuuguccuagugcaaagcauggagccauuuucuaguagcauuuacaaaguaacccagggucaaggagauccuagugcccuaagcaucacucucugggaacaucauuaaaagcaaaaacugaacuuuuaacagcuuuaaaaaugucuugaaaagaacaaaaaauuaaccagaaaauaaugaaaaacuuagaagaaauaaguucugcaagagauuauaguucuauaauaauuaaacauuaagacaagacacaaauaugaagaauuuugaauucccaaucuuggggccuaacuuuugguuaguuuuauuuuuggcagggccucagguuacccugaggcuucccucaaaacuuccuuuguagcccagaccuuuaacuccugauucuucugucuccacuucccaagugcuaauauucaggcauaccccaccauaucuugguuuaugcugagcuagggacugaccucagggcuucaugaaagguaggcaaacauucuacaccccuaacuuaaccucaucauuuuuguuuguuuguugucucuuaaguuugauaguaaacaacagaaggagaugcuaacuuuaaaaccaauuuuauaacaguagacuauagucuuaaagucagcagaccugauguuagaauuacaaaccuccaaaauggcauguuuguaaucaguaauccacauggcaaacuguguacacaagaaaaacggucuguguucauuugacuaccaaacagcagauggugugaaggccgccacugaaauacuacaguuuuguacucaccaaccuauuuucugacaacuacuacauuaaacacacagucuguagccucacauuuagcaguuguagagucugggugauaucaagaaaauuuuaagcaggcccuacagcugauacagaggcuuuacgaggaguucccuccacuacaaauaccaaaaguaaagaaauuauaacggaaaauuaaaguuagucuucuuuuaguuauuccuuuaaagguagcaauuucagaaauacuagaaaacacugauuuuaaaguuuauuuuacuaauuaaacauuaauauguaauagauaagaaaggguuaaauaaaugagaaauagaaaccuacuuucaauacuucuaguaaaugaauccaugggacacaaauauuuaugucauauauauauauauauauauauauauauguauauauauauaugccuuaaugaaaacagccuauauuuucuuuaguaacacauuuucaugcuaaacucucuguauuuuaauaagcaccauaagcucuaaagcauaauuuagcuugguaccucagcaucaagcacaugauuagcucaggacggugaaggcaauuagaaaggaaagggguugcuaugguucugggguaaggaaguuaagacacgaauauaacaguuuugacagaauaugguuaguuauuucaaaagaacaaagaaguacuaauucauuuuaaguuaauuuucuuaacucaaagccagaggguucucuaaaaaguuuaauuagaaaacacuagcaauugcuugacuacauuuauucuuaauggacaugaggugaaaacaugaaccaauuuggaaaggaaaugccauaaucucacagucaacuccuaauuauccauacuaaugaaaaagguggaggggcuuuaaguaauucaaacaaaggauggcaaguucuuaaaugauuguuacuuuuggccaauuguuuuccccuuuuaauauaugcauuuauuucucuauugauucauuuauuuauuugaauuaaagcugucuguccucuaagcccgauggggaggcccaucuccccagagaaccacccauucauagauaacugaguugaugugacugacacaugaacacuccauacaaagcaugcuuugaggucacuucuaaaacucgaaggaaugaugccugagauuucccuagcaaagcgaaacaugcuagcuccuuuucaggagccuaaguagcuuaccuccugcaggagaucggccugcucaauugcuuuaaggacauuuuucuuggauguuuccugaacuucuccucccaagagaaauucauccaaaauaaaauaggccuucucaaaauuaaagaugauaucaaguucacauaccugaaaagcaacaagaaaagaaauaagcaaacaaaaacaaggccugauaaaacuuaagccaaagaugcuuauucacuacugggcagugaagaaaaucucaucagauugaauugaucuuaauucuuuuccaaauggaaaucuugcugauuaagcaccauugauuuaaguaagcuuaauugucaaaucucaagcacuugacagcacaaugccuacaagaucuggcucugcacacucccuauguagucaacuuaauaauuuuccacucaucaaaacugaucuuuaaauacacaguuuuugaguaaugugauuaagcugcuaacaauucugaaugauauacuuuacucuuccagaauguuaacgucaguaauagaacucuauuucacacguguguucgugugugggugcauguauguaugugugugcauguguacacugaugugcaaauggcuguuguuccucaggagccaucuaccuggauuuuagagacaagguuucucacugggaccuaggccucacugacuaggauagggcuggcugaucagugagcuccaaagauccaucugucaacaccacccugggaauuagaagcaaaagccaggggcugcacagaugguucaucauuuaaaaagacugucugcacuugcaaaugaccaagguucauuuccuagcaccuacauuauagcucaucaccaucuguaugucgacuuccaggggauuugacaucuucuuuuggcuuuuguggacaccaguguacaauugaugcauagaugucuauguaggcaagacacccauacauacaacauuuaaaaagcagcagcagcagcagcagccaacgcuggcuuuugaugugcauacuugagauucaauucagguucucauacuugagugguaagcauggcaccaacugagcuaucuuuccaacaucccuauuuuacuauuuuaaaacuuauucucaccauuauaauuaaaugaguacaucuguggggccagagauucugaaaaguugacuagaaacacugacaacaagaaagagccagcccuguccucuccuuaaguuagaauccucaaauaauaagccuguuagagacaggauaaaaaaaaaacccuaaaacuacuacucacacugccaaaauacuugucaaguaauuccacguaacgauggauuauuuccaggguaaucaguucauuguccugauccucaauagcacagcaaaaauauagacuggcauaucuguaaugaaacagaauuacagaaaaauguuaccccuauaaucauguuaucuaaauauauuuucaugcccuguuguacaaguccucaugcuuauuauaaucauguuuauucuucuuuuaaaacaaauucuuuuucuccuagauuacaaaaguaauaaaugugcaagagaaauuuuggaaaacacaggcaaaaagaaaagagaaaaauaauucaaucaugucucuuagaaggaguaauugaucuugcucuucuuccuuucagauugcuuucuacacauuugaaaaauauaauugagccaguuuucuuaaguuuacuuaauuagugugauugauucacacuacaagcaaaugggagaaaacaagcugucaauuuauccaacugaagggcuuauugaagauauugucaauguuuuagaacaugguauugaagggcaauguauacacagaaaucuuuaaucugcaagccuguggucucucaaaguagaucuaccuuucaguguguucccuugucccgaguaagagaagucaggaaagacaaaacagggcaccaucucuaacuugagcaaaacacuugcucuugcucccauucuaaccuuguuuuguuuauuuagaaaagcaaggcuauuccgacucuccaugcucccuaauccaugccagcaucuggagagccuggcacaaacuacauaggguauugguucucccccuuacuaaaugcucgauauuuuaagacugcuccucauguuguggagacccccuaucauaaaaguauuuucauugcuacuucaaaacuauacuuuuguuacugcuaugagcuauaauguaaauauuuuuagagauggggguuugccaaagggguugugacccacagguugagaaccgccgauauaagggauucuuugaauuaugaaaacuaaagaguaaaugauauaaaaaugacagagcaaaaggcugauacaauuguuucuaugaacagaauaacaaauaauucuuuugcagagauuacuaauaguaaauuugggauaagauuauuuucaaacuugucccaugcuaauguuagguagguaucugguaugggaacucucuccuuguuucuugaucuacauacugccucuuucuuuacaaauaaaaauauuuaagcaacaaaacaccugaagguccuaaauuauaccagucaugcauuuaaaaauaagcaggacugauugucuaggcaccaaccuaaaacacuguaagaagaaaacuacucaacagcaguuaauuuuuuuuucagucauauuagagauccaaucaggguuuccuaugcuauccaguggcaacuucaauccuccaaaugccuccuucacuaagacgggggagaaaagggcaacuugaagaaguauuccuucuuagcaugauaagaacaccucuucagaagaagcaaguagagcagcaagcuccaggaagagccucaccgucagcgagacaauaaauguucgccaaggcuugugcauauuuuacaucuuaaucuucacaacagccuuacuaagauagcauuacuauuugcauuuauaggagacccaggcuugaguaaccggcucagaacagaaauuugacccuggagcccaaauuuucuauuaaaaaccacagcugcgaacuguauuaaaauaauccugcaccugguuaaaauuaaaauaugcucaaugcaauauauuaagagcuuugaagaagggaaagagauuaaaaaaaagauuuaguaaaagauuaccaagagaaccugaagaauacucccuauuuuuagggccaaauggugcuuuaaaacucaauaaugggcucauuuuguucucuaaguacauauuuguaagucuaaaucugaaguaaaauuaauaauagacuaguaaggagagagguaugguuaguuauuuuuagcaccauggauuagggcuuacucuaauuacuggcacucagaacaucugaaagugccuauucuuauauucaaaacacaugacuucuccgcagucagcuaaauaucagcugacugugcgugaauguagcuaaacaauucucaacacccacuaguauguugguaacauuucuuuuguuaguaaagaaaaucauuaaguauccuucaacaaauucucaagcugguaacauggggaugcauuuuaacauuagucuuaaaagaccaaaauucaauugccucuccucugaaaugcugcacaaacucggcacacaguguccuggcucuacgcgagcuucaggagcacuuacuuaaaagaugaggaaacaaaggcaaagcccagcauagucaaagucaaaauacuagauaauggcacauggcaacaccacccaaguccucagauugucaacgauauuacccaaaucauucuauugcagagauuaugaauaguaauuguaauagccggugcuuccucucacgagggaaaacaugcauggcaaaugcucagggaacaagggcggcauaacaaacacgcuaagaggaacaguucaagugcuagcgcagaauuucuuagacgcucaguagaaagucucuggcuuaaaaggucuuccagucggaacagggaaagcacaucaccugauaauaacaaaguacacaguuaaguggcuagcagaugagguuuucagggugauauggauaaagaaaagcauuauacauuuugucuucugaauacaaaacaucucaauaaagcuuuuuuccuuuuuguuaaguccaaauuagguuugaaaaaaaucuuugaucuaauuaucagaucagguuggaguucuuuuugaaauucugaaaaagguagggagauggacagauggacagggaugggcugcguggcagcugucugugcaccccaaccugcucuuuccuuggaauggcccauucaugggcuuguucucuugcuagaauuuuccuccuccacacgggggacuccuuucacuaucuagaauaagcuuaaacuucucacaccuuuuauaaacccuguccaggaauccagaauucaugucuauggguaguuacaaccucuucuggccuuggcaaagcucuccuauauacucucuauacaugcuauuuugauuucuccaccucuccaccuuugccucauuauaucaaaaguucugucucuacuccacugaaaauguucuggcaacagucaaugcaugaaacgcucaccguaagacuccaagagcucucagucuuagugaccuucauguaaaccuggcauuaguguucuuacucucaagucgcucugccuccaugacuuuacugaccugacacacucggcugcuucuuuaucccuuccaccugcugauuaucugcuaugcuaugucuaacuuccacccucaaguuccaugucuauucccaccccaucccaucagagaacaagggaacaauaaaaggccacauggugacuccacuuccuuuccuagguaacaggucucucagaggucuuucuggccucucagcucaggaaccaaucaucaugcaguccccuacugauccugcaggugccagucucagcccacuccucagccauuguuuuacugcacucuuugcagaaaaugcaaaucugaucucuaugucuuuccacaccuauuuaaaacuauugccuccacauuuaagacuuagauuguagcccaaagcccaucacuaguauaugaccuugggccaagucaccacucacaaauucucaucuuuuauaaauugaaauuugaacaauaaacuguuuuuucaaauccaguaccugucucuugugcagagagcagagaccaacugagccagaguacaagguuccuuuuucugauuccacaaaagcaauucuauuucuauuugcuuuauucaagauucuaacccugggcaaaaagauuguaaguguguucuuaaggauucuuccaguucucaaaugcuauguaugaucuuucucaacaaauacuaaaccaaacauuggauacaaaaaucacccaagcugaugaaauuuacuaugaaagaagaagucuaauggucucaauguccuauuaaucucuguuuuccccugccaccucuuccauaaaacacacccauauuugaaauauagugauagaaaauuacacuucucuccaccaucacugaauugcauacuguucucugaguacuccccauacaagaccauguuuuauaugaagaaaugcuuuuauguugaauucaguaaauuauucaaaggggaccagaaauggggaagaaauaaggaaauguucccucaaaaaaauccuauaaaagaagaaauuauauuucuuuuaaacugcuuagaaaacuuuugguuaccaacaaaauaaagauauguagcauuaaagaaaaaacuguguaaaaaagcuauuuuuuuacaaguuauuuugaaacaucacuuuaaaaaaaaucuauccuugguaaaauuaucauaucuaaacauaacuccuucacagcaaaaagucuauuuuaaauuaauaaaugcuacuaggaaagacauucuauauauacacaaaguauuuaaacaucuguauacugagauggucuauguguccaggaucuuuaugaauaagauuaauucuaaaagucagaaaagaaauaccaaauaucaguaauuauuuuauagauuuguuauaacaaggaauuauuacacuguuaucuaugcaugcaagaauuuagcgaaguacuuaaaaauuuaaaauacccuauuuaccccaguaaugaauuuacuaaauuuuucuaaaauggugauuaagcaggaauaauugucugucuuuuuuauauaauuaauuuaaaaaugauucccugcugcuauugcuucagccuaaggcaagcaaucaaaauagcaguuacuuauuuuuaaauggaaaguuuuccuuuaaauuuauuucauuuaauauuuauuaaucuuuguuuauugacauaaaagucugcaauuuccucauuagaaauaacccuaauauuugacaguauuuuaccuuucugauaaaaaaaaacaaaaauaccuuuuauaaacaaucuucagaucucuccacucaaggaagcugcacaucuuggguuuccgugcuaaaacgguuugaacaaguucucuugugaucuucuucuuuucuuugucugacagugggacauaccauuucugcagucgaagcuuucccuggcgacuaaaaagcaacauaaacugcaucuguuaaaauaaauaaaaucaaaauuacauacaauuaccuaggaucaacagucaagaucacaugauguuucagagcugcuuuggggguacaguaaacacccugacacaugaucaauaagccaucaacauuucuacgcagguuauaauagcaggaaauucuauuggaaagaucuuacuauauguagguaaguguggaagaguguguggaaaucagaacaggugguaagcuggagugaaaauuuugaagaacaaaaacucugauaauuucaagaaacaauuuucuaccuguuccacacuccaccacucuaugugcauuaaaggcaaaugcagacaucagguaguugauuuaggauguugauuuacaugucuaggaagaggagaccuacuauuuuucacccugaggcuauucuaguuccaggcugaauuucuugcagaaaaacugcuugucauuuaaagcauucccuucaauuuaugcuagcauauuuuaagcaaaaucacaauauuaaucaaaaagaucucacaaacaacacauuuuaaagacaaaagcccgauuuuuauguuugcauuucauaaaauccaacacaaacaagcacucaagaacugaguuaauguauguaaaagagaauacacgcuuaaaaagcuuuauucaaaguuacucauaucgagacacaagauauuuaauuuaaaacaacaaauuuuugggacagugcacagaauacuucuuuuaaaacaaaaaccacauuugaauguuaugcuggauuugaguauguuuuauaccgaagcuaauuugcauugauuuacuuaguauuugcaugucuguuggucagucuauauuuucuaaggcauguauuuuauaauucaacugguaaaagcgagcuguauuguaaagcuaauuugaagguaaaauuuggauagguguuuuguuuuaaccuuuuuaaguuccuuuaacagugacagugcaaguaagauccacccaagggcgauucuuaauauucaccacacaaccuuaaauuugaacacccggaggaggaauuuacguaacuaauauaaaaucaaauuggcucuagacaggaaauccaccucgcaauaucccaaaaaggcaucaagaaaacauccggauauuuauggcguagccauuuaacuuuaauaaaguuaaaauuggcuauuaccccacacaacacuauauaauucauugagagcaaagugccacccuuguaaguccugaagacagcggcaucgaaaagaacggcaucgaaagaacuggacauugaacgcaaaccguuaucagaacuuggggaagggaccgaucgguuuucuuaaaucuugaccaggagagaugguuugcuaaugacuggggugugcucuaggcuaucuguagcgggguccaguauccgcccuaccacuuuggaggacgaagaaaccaagcauuuuccucaaaacaaaugaugugcuaacaugggacgaaacccgcggcacaaguauuccuuuucccucgcuuugauuuuugccgcaaaucccgggacaacaauuucuccagauugguauuaaaacaaaaacaaaacaaaacaaaacaaaaaacccaacaaugagcucagccuuggagugggcucugguccagcaucccuggggucccgcagucucggacgccuccccuccucccgggacuacacuccaucaguacccaaagcugggcgaggugaccggcaaggaguggagcagagacaauggcauccgcuggcccgccaggggcgccaaguccucggucgccgucaccccagccccuccccaaaacgccccgucaaacuugaggcgaucagcgaaccacaggugccgcgggguccccgcggaaccuaggaccgguuccccugcaucaccggcgcgcugccgaguggagagcggagcgcuaccgccggcagaagugaguuucggggcgcggcgccccgggaggacucgggguggggucgucggggcgcucacggggcggcggggggcgcgucccagccaucacucccucuuuccaucccugccagcucagcggacuccuucagcacuuacggcggcggcgggccgcggacgcggcggagcugggcuggccgcggagacugaggcgccggcagcugcugaggggaagcccccgucgccgugcuguggaagggaagccguggugccgcggggaggggacccgucugguggagggcaggcuuaggcugcgaggguagggcgagccgacagaucccgcccuggaggcuggacggaggaggagcccgggcugcggcgagcggagaggcggaccggagaccgcgcgccaagcug

SEQ ID NO: 9818 - RNA, 23237 nt, Mus musculus
ggccaccuuuaaaauccaacaauaggaauguugucaagucuauuggcagauauacucuauguagugaguaaaaauaagaauuaugggacuugagcaucagauugaugaaaugagacaauugagugaaaaccaucaaagcaauauggccuuugaauuaaaaaauaaaguguguagggcugcaaagauggcucagugguuaaguguacuuuuagaggaucuggguucaauucucaggacccacaugacaguucacaaucaucuauaauucugcuccaggcggaucuggcauacucuuuggccuccacggacacugggcucccaaauguugcacauagauacaugcaggcaaaacacccauauacauuaagcagaaauaaaggguguggaccccuaacaagaaaaaaggcgggcugagaagauggcuccgugaguaaagguccuugguguaaaagcuucaccucgguucaauuccuggaucacauuguauaaaugaccccuaaaaguuguccucugaacacacauaugcacacacauacacagagagacagagaggaagaggaagaggaagagggaggaagggaaagaggaggaaaggagagauggagggagggggagaggugcacaggcagaaaacaggaaaaaauaguaaagcaucacuccagcauuaacugaugcucucgagguuauuauuacaaguaauuucauguguguguguguguguguguguguguguguguguauaauuucucaaaaaguaugauuuacaugauagcauuagcuagcaucaucuaucuauacaggugaguagcugcuauaaaaagacagacauauuuaaaaacaaccaaguuuauuuagauuugggacucugggugguuuugucucuacuaccugaccuccugccacgacuucuggaccuugacgagcuacuacuccggcuccggcuuugacuccaacuccugcucugguuccugccccugccccugccccugccccugccccugccgcugccccggccccugcuccugcuccggccccugcuccugcuccggcuccggcuccugcuccggccccggccccggcuucggcuacggguccgacugcggcugcggcugcggcugcgacugcgacuccugcugcgguggcuccuccugcucuggcuccaggggcccggacugugguccuuucuucuucuacugggugaacugcgccucucacgacucuucauuccauaucugugagauuucuucacccugugucugcuacugcucuuccugucagacucgccauuucucuuguagaagucgggacucgggcuccuccuccuccuccuugaccugccauaguauucaucauagugacuggcccuuucccuccucucugaauucuuaccgaaggaggagcuaguccaaucuggagacggguagaggucucuauuagcgucccuauauucauuguugggauuucugaacacgugaagaaaguugcagugcuuuccucuuggacacugcuggacuucaaauaagccuguaagggcaagugagaggcagcaauuaccacuguauuacugcgacucgcucuguuucucaagucugaggauggauuguuuucauacacugcucugaaggucuaacauaggagggggaauccuucaacguucuuuacaaaauaagaauaacauaauaaauacccaggcauggugacacaguaguguucagccagggcuacauagugaguuuaaggccagucugggaauacaggagguccuaucucuaagacacacacacacacacacacacacacacaaagaaaacaaaauaaaggcacuuuuguggcugaaaguauuuucagaugaccuuggagaucagguacugguauagagaaucuaucaagaacuauagcugaauaauaaaaugauguagcugauuagaaguugguaacuaucuaaauagagaucucucuaaagaagauauaccagaauaaugagacaaaaaaguuaguuauuaguuacugagaaaaauacuaaagcuguuuauauuuuguugcugguuuuaacgaaacaaaacuccugguuugagguuugaguuuuacucaaguauaucacuggaaucacccugcauuucuagaacucuagaaacuugcaaaauuaaacuuccuauaaaaaaaauauacuaccauccuguuuauauacccaacccuuaaucuuuuaucuuuuuuuuuuuuuuuuuuuuuuuugguuuuucaagacaggauuucucuguauagcccuggcuguccuggaacucacucuguagaccaggcuggccucgaacucagaaauccaucugccucugccucccaagugcugggauuaaaggcaugggccaccaccgcccagcuuccaacccuuaaucuuaggguguaauagugguuuucauuuuccuagcaaggaauucgaaaauuccauauauauauauauauacacacacacacauauauauauauacacacacacauauauauacacacacacacauauauauacacacacaaauauacacacacauauauacacauauauauacacauauauauauguauguauuccuauauauaauagagagagagagauugauuuuucaagacaagguuucucuguguagcccugggugucguggaacccccuguguagagagcaggcuggccucacacucaccgagaaccaccugugucugccuccagggugcugggauuaaagaugugcaccaucacugcccaggauuuuuuauuuaguuuugaaacuuuuaagguuuauuuuauguaugugaguguuuugacuguguuuacauaugugcaucauauacaugccuggugcccauggagaucaaaagaagauaucagauccccaucucucuagccccuccuuuuuaaaauugaucaauaaauuaguuuauuuauuucaagaauaggucucacuauauaguccaagcuggcuuugaacucacaauccugucuuggccucccuagacaaguuuuggaauguaaggugguaccauccaugcccaccauaaauguuucuuaaaugacagcauccauuaagagaaggcuguucaagauuuagacuugcuugauaaauuacauauuuuuuacgccaguuuuaagcaccugggaaggaagagcagaaaaacccagagagaagggagaagaauacccgugagguauuagagcuuugugucucuucaucuggggaacuugcagacugaucuggcucggcacucucuuagcaaucagaaaaugaugagagcuucacagcagcuggcuacugugcagugcugaaucauuccugguuuggcagccgcgcucagaugagucaguguaacugagagcacccaguguacaacuaaacugauccacaccuacuucaaguaaugugggaaauguuagccauggguaaugauugugcuggucaugacggaagagugcuuagggacugagccugaaacaaacagcucaagugaggaaagccaaugaauagaaaacaccuuugaaagugcagcgugguuuaguguggguaucuuuaguuuagaugcugcugcagugucacacacagaacccagaacugaggaucugaagacugaaaaucaacuugcaauucugucaccaauauagugugaccucaggcauuuauuucauccacagagugaagcacagaccuguuaaagaucuaaaccauaucuacacuaugguguccuuuauggaacuacucaucuguaguaugagacaaaaguggugcuucaucccucuaaaauacugcuuucuuccuaugaagaucccuuuuguauagugcagcuagcugugggggaaggguaccacuacauuggcuuuuaccacaaauugccauuuuccaccgggucacugggcagaauucacacuggagcugucguccugcauaccaucguccauuaaaaacagaaaaggcugcuugacagucuucuucccuuggaggcaaaaaucaagggugugcuuuauaguaacucucacaacauagcaaaccuacucuaaauuagccccuuguccgcuuacuguaggacuucagcucuuguauugccuagguaguccucagagcauucagauucccacagccuaguuuauucagagaccuuucucauugacuuccgaaaaguuuugucacauggaaauuggcuaguuaaagcuucuuaaucugcaagauuugacaauuacaugugcaaaaguguuuccccuugcuagaacccaugcugucucugcuguccuuacuacuauggcuaauugaagccauuagccauggcacugcuuagagaaauggcaauacaugcaggaaugacucaguaacuacauugcuaucuggucaagugcacccuauugggagcuuuaacccuuuguaccuuagauugguauuuucuacucuauuccaauuagccuuuauucaguuuguauuuuuaugaagauuauacuguaugaaagaaucaaaacuucagaaguauaaaaagaaugaaauaaaagaguauuauuuucacaucuugacuguuuaugagcucuucauauugacauuuugaaaaguaucaugcauaggaaagcuacauauucagugacagacaucaaagaaacaaugccauagcuaugaugaaacauggacgauguguguauguccccaauacuuacgacugguacugaacauacacauugccccucagaugagguuccagguugcagcugaccuaaggaacaaagaagaauucugucacacacacacacacacacacacacacacacacauacacacaaaguauucaaaagcagcaaaugaucacaugcauccuguccaggcaaauagucccucagaguccaagacaggcgaacacuuuccuaucaagucaaggccaaucuaagcaccuaacaacauuacagaccucaaaugccuggucucuggugauccuuguuuguggguuuuaaacccuauuaaguauaaaauguuucauaacauguacauaaaauguacaaaaaaacagaauacagggguuggagagaugacucaucaguuaagagcacuugcuauguguguguguacggauauguuucuguuuggaauacagauuauauauaugcauacuuuuacagacacauguauacauauaggcauacauauauucuaaaaaauauaucauacacauaaauauauaguaaccaaaaugauauauaaaaguuuuauguacaugugugugugucugugucugugucuguguguguguguguguguguguacugauugauucagguuggauauauaaccaacacauguagucuccuguggacuaugaguugacaaaaauguggccaaacacaaaaaucacaaacuuaauuaaaacauuaugauuuuucuucuaauuuguuuuugcuucugucaguucaauugugguucucaggcaugaacucuguagaucacauugugucacaaugucaaaaguuuggauacacuugcugguauugcuuuguacuuuuaaaauucuguacaaagagccugucucagaaaacguuuccgaauuuuaaagguccaaaguaauaccagcgaguguguccagauguuuuuccaauuugucuuuauuaacaacaacaacaacaacaaaaaaaccccaaaaaacaaaaccucaauuuaaacucaauuguaguuguccuaaaacucacuauguaggucuugaacucacagauccaccucuuccuucuaagugcugggauuaaaggagagugccaccaugccuggcucuauaauuucuauauagaugguauucuuuauucuuugucaaguaauacaagcuuaaugccucaacuacuauaaaguacacuaaucaaaucauauuuauaugucugcucauaauuaucuacagugcuugcacucucccauucacaaagccaucucuguagauguaaggccuucucugguggguuuccacuucacucugcuguacaugaacgcucucacgaguagcuuuacuaguacauauuuucuacuugaucuugauauuaauagaauuuacaucauguagcugugaauaauaccucauuuucauauaaguagggauaaauaauugaucacugcuuucaaaaauuacaaauuugauuugucuaaaaugacauaaauagcccuuaaauaucccuacugguguuuagcuuuuaucuuagaaaugaagcuaucccaucuuacuucaggguguuguuauuagaacauccuaagggggacaggauccuacucaauuuguaaugccaucuuuagacaguagacuaaagggccucagcuguucgugucacccaugccuuagggaccuuaaaaaucaguuaauccagucaggauugguggugcauaucuaaaaucccaguaauaaggaggcuaaggcagaaggauuacuaugggcccaggccagccugagcugcagagugagccccgucucaaaagaaaaagugcuacagcacuuuugcccaguguguacaaggcccuacauucaauccuuggaaccaccauguggguccugaagauuaaauuuagcuuugucaaacucgguggcaagugccuuuacucacugagucaucaugccagcccaagaggaagaccaauuuuuacuucuuguacauuuaaacuuuguuuaucuacuacuuacuuauuucuuuauuugggguuuuuugaggcaggauuucucuguauauagccuuacugaacucacucugaggaccaggcuggccucaaaacucagagaccucccugucuuccuccuaagugcugggaucaaaggugugugucaccaccaccuuuaaaauuuaaauguuauuaaaaacaaaaagccuuuuccgcuccccauuuaauugcccuuuucuaguuucuccuuuaucuuuuuauaauacuacguucuauuuccccuucuuuggaaaccaaauauuaaagacuauauuuuaaauuugaaaagcagauuguaaucucagauuucuuaaauauccauagcacuugauuaguccaacuguauacuuucauuuccgacagcaagaaaaaagaccuauggcuuuauuccuacuuucuccaaaauaagggguacuucccuugucguuauaucacaaagucacucagguucagauaugaucaauucacagacaaaguaagaggccuacauguugggauucacccacugagucccuggaauagcagaagccaaaucucacccuccucagugagugaaacucaacgucgguacauguaacaggguucugggugaggcgcugcauguccauuagagacagcagcuaagugaaggcuuggauggcuauguacaccaggccugacagugaguucaacuucuggaaagagcuguagcacaaaggcacugaacaagagagcccuuuccaacccaggcccuagcauucagaaaacaugccaacacaugcuuaugauuuccgaguguaucuacauggcacuguccaggguagaggaguggaaaggaagacaauguuuaccaaguuuaccaugcucagccucaggccaggcauauuuggaacaagcccuagcucugccccuauaugcccuguaugcccuguaugcccuguaugcccuguaugccccuguauuucaggagaugucaggucccauuccagucugugcucaccuuaaacugaaucacuuuucccacacucuugaauucaggcaggacaucauaauagaagucuaggaacuguugguagaucucuucuucacugaauucuaggcuugagucagggucauagucaucccuccgacacugcuccauuccaaauguuguaaacaugcccuuaaucagcaaggugggacuugauguggggaaguuguguuuacgugaacaccugcagaagaaagaaaagugaacucauguguccaagaacaaaaucacacauuaaaagcuuaccauuaaguucaagagcaagacucaaguaacaugacuguuuagccuuaacuacacaguaaugaacauugcugagaggcucaguuacagcauucaagaaaaauguuguaaaacuggcugauuucucacugaaauacaagauuaggaaugaauuccaaggucauaugccauucaagagccuuugaauacauucauagagauuucucuauguugaacuauugggaaaaggaaggcccagucaugugacagauugcagugacaagaauaagaugcuguauguagaaauauauuuugcuucuacaaucuucaacugauucucaugccuaugaaauucaguaaucugaaccagugagauaacucaguggguuaaagcacgugcugcauaagccuaaugaucuggauuugaucccuagaucuccauauccccccuccuacacaugcgcacacacauauacacauacacacacacacaagcacacacacacacacacacacacuacucucucuccuacacauauacaaugauaauuaauuuuuuaaagcugggcacaguaguggacacuuaaucccagcaccuaggaggcagaggcaaaacuaugaguuccaggccaguguuuuaaggugagagaauaucucaaaaacagauagauagauagauagauagauagauagauagauagauagauagauagacagauagaugauugauagacagaauagaugguugauagacagauagaauuuuaaaguucuaauuuuaaaagagacaauaugauaauuuaaaauuuuccaguuacucaaguaucaucauuuuaucuauauauagcauuuuaaaguuucauguauuuuuaaauauuuuucuccacucugauccuuaacaaccuagugaggcugaugguacuuuacuuuuucacuuugcaaagugugauggcuaguacuuauugucaacuugacagacucuagaaucaucagagaaaggagucuuaauaaaggauugucuaggcuaagguuaucgucugagaaugucugugagggacugacugccuugguacuuuaauugauguggggaaagccaucuuaauuaugagugggacuauucccugggcaggggacccuggagaggucaaauagcauaggcaugcaugcauuaaaucaccacccuugacuagcugcaauaagucccuccuaccuuggcuuccccacaaugaugacuguaagccuggagcuaugagccaagaaaccucuuucuccauuaaauuccuggauauuuuaccacagcaaccagaaaagaaugcaauacagaaaggcagcugaaaccuaaagcagcacaccuucccaagucaugugguugagaagagcaggaccucuggcacguggucgauuagagaguauaauaaauauaaguuaauuucuauucacuuaagguaacuaauaacugugaagaacaauuuuuuuucauaguuuaaaauggaacaagguuaagcuaacuaugcuauucuagaguaacuuuaaaaaaaaaaaacauaggaguucauuuacuccuuucucuugaagcaagcaguagaagggauaauacaguucaaagaccgaaauaaaauuuuccugguuggggugcuaauuagauaucaguaagacaaacuuaagggaaagaaaaacuuaggaaggaaguuuaaaaguagggaauagugaagaggaaaaaaggguacaauggcccuggccggacaauggcuauccuggucuauauagugaggucuagaccacccaagacaaagcaacaacaaagucguaauuaagguaucucuguggccuagcaccuaacuacugcugcucucaaccuuaguuaaagaaacuucuuucuguaguggacugugguuaauaacugaccaaagugcuaagaauaaguggcuauugaaugcucaccucuaaacugcuccaaagcccagggaacaucacagaaggagaugaaaaacauaagugcuaguggaaggaauugaauauugugaaacacuguuuccuagacacaacauggccauugcauucacgaacucaaagcaacuaugguuaccuuugcaagauguggugguucgaauaagaauggaccccauaagcucauauauuucaaugucuaguccguaguugguaggcuguugagggaaggguuaggaagguauggccuaauaagugaaggugugucacuggggauggccuuugagguuucaaaagccccucccuguagccucuggaucagugcucagcuacuguuccaucaucacgucagucugcuucccaccaugacgauaauggacuaaacacguuuaaacuguaagccaggcccaauuaaaugcuuucuuuuauaagaguugccuugguuucuucacggcaauagaaaaagugacuuaagacauaagcccugcauacaaucaagcccgucaacauccuaacauggagaggggaaagguacucaaaaggccuugucccuggcagucaaacugcuagauaggggacuuuagggaugucaccacuaguaaauugccaaaaaucuagugaauaagcucacacuugugcacacagaagcaacacucauuaaacucaguggguuauuuaaaaagaaaagacauucaaagaggacggacguacuggaaagaagggauccagagggauaagagaguaauggagguaaauaugaucaaaauacauuacagacauguaugaaacuaucaaagaauuuuuuaaaaacuacaaccaaaaaguuuaacaaaagcaagcauccaaagaaaugcguagguuaaggaauuauuucucuuccugacaagguguucacaugccuagaauguaguuccucaggacaaguuccaguuuagccugcauuauagauuaagaccucauuuugaaaagagagagagagagagagagagagagagagagagagagaacaagcaauggcaaugucucucuggcaugugaccaacuguugucugaagacagcucgggcuuccagaacuaaguucacacaaugcuaugccccaacucauuacuugaacaaugcaaauagccaaguuguucucauccuuugcuguuugugaugguaaaguuucaugugccucugauaacauauuuccucggcaggagguguuuuauacagaccauuguuuauuuuguguggaugcaccacaccauggcacaaaugugaaaguuggaggaucacuaggacucaguucucucuuuccaccuuggagauccagggauccaacuccaguaaucaggcucugcaguaggcgccuuuacccacagagccaucucacuggcucuuaagccaucuuuuauuauuucuacuugacacugaauuuucuuagaaaaauguuucuaaagguacggaagggaagguagccuccuucccucaguucccccagucccucagaagaagcccuuucuacuucuuuaccggauucugagucacagacaggcuggcgauccacaacuguagccaucaaauucacaagguacuacauauuauacaucaauccuggaacacaccagaaauagcuggaagcaucuaaauacucgcuacgcgucuacaauucugguuuccacaaucugaggugagacacaguuuuguuuagccuuuuuccuuuuuacaggauuccaccguguguccaggguugggaacuacuacugucuuuuaauucuuacaaaguucuauuaacucuguguauuuguguguauugcggaguauaucuauagguaccuguagaggucaaagaaguaucagauccucugaggcugccugacacagagcugggagcugaacuuagguccucagaaaagcagcacauacucuuaagggccaagccaucucuccagccugaagcuaguacucuugaaaaauaagaaauaagcucagcaugauggcacacacuugagauauggcagcaggaggaucaguaguccaaagccaaucuuggcuucauagagaguucaaagccaaccugggcuccaugagaccgucucaagaaaccaaaugauuacuagguaugguagcacacaccuuuuuuuguuguuuuuucaagauaggguuucucuguauugcccugguuguccuggaacucacuuuguagaccaggcuuccaggcuaaccucgaacucagaaauccaccugccucugccucccgagugcugggaucaaaggcguguaccaccacgcccagcugguagcacacaccuuuagucucagcauuuuggaagcagagggacauggauuccaagcccacuacacaguaagaccucaaaaacaaaaacaaaauaacaaaaaagaagaagaagaagaaaaagaaaagcaaugauuccgcuuaccccuugucuggcacagaguggguaaguaguaaugagaccaugccacccgccgacagcuuagcacaaaacgguaaguaguaaugagaccaugccacacgccgacagacucgcuuacuguuaggaagcgcuugcuuccuuugacuuccacauaaagucauaguauaaaaauaucaucauuaccuugcauuaccucaacuauuugcuaaaugacugaaaacaucaauaccaugucucuauguaucuuaccuucgaaaacuaaguuggagggcaagaagcaugaccauaucagaaaaugacaacaguaacaacaaaaauaaugaacaaugaaagugaugaaaacucaggacccaggcacccagcccuguguguucgccaugcucagcucagccuccaaggcaccucaaaaagguaggauuaugcaucaucuucauuucccugaugagggaguuacaauguagagaauuuaaccaaaggagucgauuccuaagucugaacauacugacagcagagaauuaagagcccauuccucuacuugcuacaauacuaucuuucauaaacaucucuauacccaugccaaauuggaagacuccuuaggggauggauuuacucuucaaaaggcauuucuggcuauucuaaucacuuccaacauguaaucucccuacccacgguggccuccugggagucaugugagcauggaagaaaccaacaagcaaaggguccuacugucucacuaggcauacaaaccacacuuaaggacacagaaaacaaacucgaagguauuuugggaguuguuuuguuuuguuacaaauaauucagacauuguuuuuugguugguugguugguugguuuggguuuuauuuuuuuaaccuuauaggucuuuugcuugcaugcaugcaugcaugcacgcauauauauauauucuuguguguguaugugucugucugauuuuguguuuucauggaauuucugugugugagaaugugugucucucuaacuguguuuauguguguuuuuucuguuuauuuugucuuauacuguuuuuuuuuuuuuugguuuuuagagacaggguuucucugugucgcccuggcuguccuggaacucacucuguagaucaggcuggccuugaacucagaaauccaccugccucugccucccgagugcugggaugaauggcgugcgggcgccaccacguccagccuguuuuggcuuuuauuugagguuuuuagaugccuguuuguuuucuaauaagaaagaaaggguauggauucugguggaugaggagcugggggaagaccuaggaggaauuuuuggaaaaggggaaccaugaucagaauauauuauaugaaaaaaaucuaauuaaaaguaagucuucccuaaggcuauggaaugcaaaggauucacucguuaagcccauuucauuagcaggcgaggggguaccacauaugugauggugagcauagcagacuaaagucuaugccgcuuccaaaaccccaacacuuuccagaauuucauucucacacaaagccaaauccauuaccuaucuccaaaucugcaagcucccguuuugcuguagaacggacaguuggcucgaucuuucuccaguacucuuauauccaugggcgguucuggguucugccaggugccaccauuuuccagcuguuaaaaacaaccaugaauuuacuggugauguaaaagcccauggaagacaguuucuccacuuagugaaauauuuuagucagaacacaaaggguuuuccguuuagacucgcauaguucagaaacaugagcuguguuccucucuuggcucccagucacuuuucuugauuuggggggugggggggacgucacuuaauguuaacagauguaguuaagaaggucuuugugugugugucuuuucgagacagggcuuuucuguguagcccuggcuguccuggaacucacuuuguagaccaggcuggccucgaacucaagaaggucuucuucuauucaucuauucugaaaaggguccauggauguagggagccagcagaaagaacuacaaauuacucugaaucaaggugggugaaccaaccauuugggaccaguaguaugugaugucacguagauacauuuagaguacuugauacaaguauagcccaugacaugauucaauaacacaucaauugucuucuguuguaauauaauugaaggguuauaaaaguuauucuggguaucccaaaauaaucaaaaccaccuaccacaaaagccauauuauuuaaacuauuguuucuaaugaaauaucaauugaucucaaaaccuuuuuugaaggcaauggucucucuguuguagcccacacaacaacagacuggccgcaaacuuguggucauuccccugcuucgugccccccaccccaccccccagcuaggaugccuggaacgugccacugcuaguuaucucaaagucuuaaugaaagguuuggaaaauaccucauuuucagccugauccagcaucuucugcacagcuuccuauaagugguguaaacauaggacuaaugaaaaccaggaugucaagcaagucauguccgguuucauacaugacaacacacacgugaacacacacagaaaagguuucugauucugauuuccuuucuaagcauauuaucuccuaaaaaguuuuuaaaagauauagagcuuagaauuuuuauucaaauacaaaauuugaauagaguacauugcaaauauuuaagucauaauaguuucagcaacauacuuauacauaaauaccagguucugguuuuugaaauaauaaugacuguuuuuuaaaaguuagauuaaacaucacaaauauuuaacagaagcaaaaacaugagggauaguaacuaggauuuaugaaaauuuuuacaggaagcccaacaaggcagcaauaaaucucuaacugguugguuuuaaauacguacaaaguuagguuccuuagcgccucaaaaccauacauaugacuguuuagcuuacuugguaaguaucucucguucuggcaacuuaauugucauugcagcagcuaggugugguggugcacgccuuuaguuccagcacuugggaggcagacaggugggucucugugagugugaggccagccugaucuacaaaauaaguuccaggcaagccaaggcuacauagagcaacccugucucaaaaacaaaccaaaacaccaaaaaaagucauuauugcuuaaugugguuaguuuugguugggaguuaagagaucaaacccaagauucuacuuuuaccacucugcuauaccucacucacaaaacagaacucuuuaucuccuccaucuccucacccccaugacccaaccuaacuaaauauccucaguaacugcgacagccauuuuaucauuuguuuaaaacaaacaaacaaaaaaccccaaaaaccuucaaacauggcuucgguucccuuuccuucuuccucccauagaauuugccagcuacgguccuguuaacuguguugccuaucuguuugaaggucugaccucaucauuaucacccacauuguaauuaauuauucauccaauuuucucucuggucccuguucuuuguagaaaaauuaggauaaucuguuggaaguaacaauacuaacagguugaagucacucuuuguuaaaaaaaaccacucucauuaguaugauaaauaaaagcaaacuccuuuccaucuaagaagcuuguaacccuccugccuuugccuccuucugcaaauccagcuaguaggcaccaucacagccugggcucacaggccugaaguggcaaguacagggcuugcaugagucugcuuuagguccuccacguauguuacagcuguuagcucgguguucuugucagacuccuaagagugggaacggguguaucucugacucuuuagccuauucuugagacucuuuuccuccuauucacuugccuuguccagccucaauaugagagcuuucaacuugucauagucuaucuugguuuuuuuuuuuucuguuugacuuuucuguuuggcugucucuuggaggccugcucuuuucugaagaggaaagggagggggaguggaucugggggagaagggaggcccggguagacagaggggaaacuguggucaggauguauaagaggagaaucuauuucaauuaugaucugccccuucugauccucccuagugucucccaugcucuugcucuagucuccuguggucucuaagcuucagggaccaccaggucccuuccucccaauaucuccacacucaguuaauuaucucaaacaucacuuccucagugacuuccuuggccagcaauucaaauaaguaucuugacuccuauuauucuaucacaccacucuccuaacauccuauuguaugaucuacuuugcugacuuacccucagccccucccauccagaagucacucaaggagaaccaagacucugcuuuucacugcuuuuucuuguauuugucuaagcaugaaaaugauacacaccgucuuguauuucuuuauauaugcuuagaauggauuucauuuuacccacuuugccuuaaccaagcucccuuuaaaacaaguacuuuuagaagccuuagcuuuuaccugaucccuagaaguuaaagaauauucuguuaaaacaggaauugauucaugucuguaaaguaugacaauccagaucauuuuugugccccuaacaucccaucuggauagugacucaucugaaaggcagugcucaaacaaugcuaccaacaaugagcaauggaacugccgucugagacacgaccugauuguggaaauugcugccaccuuuccauacaucucuccucauuuuaagaugagugacuauggaaugucgugccauucaaauuuagugaugguaaagagaaaaaauaucuucaaggcaagaugagcugugcauguuauauuugaaacaaauacacaguugaggaccagcagcaaaacaaaccaagcuuuuaaaaagaaucccaggaaauguacacgauauagacauauacauuacagaauuucuuuuuuuaaagcaaugguggggauuauuaaggaaagguuuuaacaaugauuuaagcauaagcauuaagagacagggagagaagcauguuagaaaaggacauuagcaugugcccuagagcgagcacagguuucucagaauuucuuaaaugaguauaauugcucugacaacaaaguuagacaggauaccagauuuaauaacaaaauaauuuuuuaauucuuuaaugucuauuaaacuaauucuugcugagacgucauuagcuauuaagucucuuuaugaguuuaguagguuuagaacuuuucacaauacuguucuuccgugaagaacucaacacauauaugacagaaccagaggaaacuaacacuugccacagagugguacagaguguaaaacagggcagcugcccaguuuacagagauguuuuacuacaacacagccacauccauucauauacauguuaucuaugucugcuuuaggguacacuggcagaccuggauguccacagaagccauacagauaucacagccuaaaauaugaucuaccccuuaaggaaaauguucacccaucucuaaaauaaacaguaagauaacuuacuuaggguaaagguaucugucauugcaccaccccaagaggagaaccauuuggaaacuaguguuuccaaauaacuaguaguguuucuaacaaaaacugacuccuuccaaaugaacagaacaugagcaaaauauaaaaccaaaggcaagcccugacaugcccacuggugaaucugcaaacucuuuacaugcacacgugcacaccaagaagauacgcaggguucuauccuccuaugacagaagucaccucucuuucucucuucucuugucguuucugcuccucuuccucucgcucuuuucucugcuguucuucccauucugccuuuaacuuucucuuuaaaggaaaaagagaagguaauuuuuuucacucauucuuaaaaacacauggccuacagaguaaauacuugaaaagcuuuagaaaguguucauuggaaagagagacaauaucaguuucuauuauguuuuauguuaacauauguagcucuccuuuuguuuacacaugcuggggaagggauccaaggccuugcacaugccuggcaagagcucuauaacugagcucuauaccccaagaaagacaacuuuuauuuaaaagagauuuuauuugagugccccuaugaguguauugcauaugugugugaggguauacacacugaagcgcguauguggguucugggaacagaagccaaguccucuggaaaagcagcaaguguucuuaacuccugagcuuucucuccaacccuguaacaaacaccuggguuuuuuuauuauuaaauaaccuuauuuuacuugauguguacuggugcuuugccuacaucuauguguauguaccauaugcaugccugcuaccucaaagucagaagagggcauuggauucccuggacccagaauuauggaugguugugagccaccacgagggugugggaaucaaauccaaguguuuagaacaacaaccaggucucuugaccuccaaucaucucuccugacaaacagcucuuaaagagacuuagcucagcuaagcacuuacucaaugaacuagauacuuaaugccuaccucuaguucuuccuuccguuuucgagcuuccucuucuuuuuucuucuuugcccugaauucuucuugugccuuuucuucccucaguaaccauucuucaugcagucucugccuguuaauauaaugauguaguccauaaaaacaaaagggaauuagucuagaauguauagaagacagggaaccaguauacaacauggaaaucugaacauauuuucuauaaagcagugaagaugggaguguggcucucggaaaagcaacuaccuucccagacagaaauuaguuacaauuacuucauaagcauuugcaccuguuccgccuuuucuuucuguuuucaucucaggcaaacaggucaaagcaguaucugugaauuuucacauucacauagcauuauucuuccuaacgaugcauucuuuucccacuaacauuacuuccuccucauccucuucugaaacucacucuguagacgaggcuggacuuacagagaugccccugccucugccuccccaaugcugagaugaaagugguguaccacaccuggcugaauguauauuuacuaauuuauuuuuauaacuccauuucaucuugucuuaaaaccuuuacuuaauuuguguguguaugaauguuugucagcaagcaaauaggcaugaguaucacgugaaugccuggugggcagaagaggugaaaagacugagggaauaggaguuucagaggaucgugagucaccauugggaaccaaacuuggauaaucugaaauagcaaaguaaguguucucaauuagugagccuuuuuuccagcucccuuaaaacuuuuguuuuaaagacaugcucacaacucacaacauaccuuuucccuagagguuuaaauguuuggaaagcaaaucauaggaaucccuugauucuauggaauagaaacucaaagauuauagacaaagaugccauggguuuuuuuuagagccauaaucauaaaccugacuuugaaaaugcacagacuagccaggugauacaugucaaugauccuagcaauugaaaagcugagagaggauuacaaguucuagguuaauuugagcuuauagaacaagacccuugccuaaaacaaacauacaaacaaagcauaccuccccaaaagguaaugucaccuuaaaucaauaagucccagacauccaacaguauaagauucucauuuaaaaucuuuauuugacuagguuucuaaccaccuaggaaacacugcucuggucaugucuguugcgggaguuuccagaaguuauuaacugaggaagaagacuuacccuaaaugaagccaucuguggacuagaguuccuggcuggaguaguaaggggaaagggaaaaaugaagcugagucccugcucccugacuacagacaaccuggagcaguuacuucuagauuguuccugcugccacagcagaacagcucucaucaccauacuguccccacucuggugaacuauagaagacuaaaaacuaugaauaaacaauuaugcuacauccauauagcuuacguuauacugucaauagaauuaggccuuuaugucaacacuuuauauguauauuuacuauacauacauacauacacacacacauauauuuaucaauaagaaauaaaaaauacuuccacuaaaaaaacaaaacaaaacaaaacagccgggcgugguggugcacgccuuuaauccuagcacucgggaggcagauuucugaguucaagagcagccuggucuacaaaguaaguuccaggacagccagggcuauacagagaaacccugucucaaaaaccaaaacaaaaaacaaacaaaaaaaaaaccaaaacaacaaaauagguacaguggcacaugccaguaauuccagcauuugguaggcuaaggcaguaagauccugaguuggagacuagucuggauuugucacacaaaaaaagaaagagaggaaaaaaaaagacaccuaacuuuagccugucagcuagggauuuaguuuguaagagguuauuuuccaaaacccauuuuuuuacaagauuuuauaugaaaagccgcuacuaguugguagacagcugauauuacaauaaaaugaguuuaaguguuucaguuaguacugaccucucuuccucuaacaaccuuucuucuucuagucguuuuucuucagcaagaggaucuucuuccuccucuuucugugccaauucuguagaaauucaaauacuuuauuaaguaaagucucacaauccuuggucaguuauucaugcaaaaaagauaaauauuuaaccuuuauaauuaugguaaaaaccuaaacuuaaggcauagugggaaagcuuuuaaucccagcacucagaaggcagaagcaaauggaucucugaguucaggccagcuuggucuacacaguaaauuccagccaaggcuauauagauccuaccucaaaaaaaaaaucuuaaaaagaauaguaguuauaagcuuccacaugugugcugggccuugaacucugacucuggucccccugccccucucuccugagugcugggguaaaggcguauagcaccagagugcuggcuaagcgggcguucuuaagcauuccucuaaccgcacuucuuuuuaaucaaugcuuccaucaugauacucauggcauggcuguacaacgaguucagaaucaaacaagaaaaggagagggggaagagagggaaagagagccugcaaauauuuaaugauuuuacaaaguuauagaaguacucaugaauauuuaaguguucuauuuuuuuucaacucuguguacacuggaagacuuuucaaaaauaaauaaauaaaaaucuggcaaaauaguuuuaauggaagaaaaguuuauaccuucuauucaaaguuuaaauuugaagggggaaaaaaagaaugccaguugagacaagugggaggggauaacugacaugagcuuaggaaauuguagcagauuagcuucagacuuaaagcaggaggguuuugucaucaguaacacaacagcuuacuguuccuuuuuguuuucauccuugauguuggagccugccucuccugaacuaguucucaaguacuguuccacagucuccggugguaaggcuggccaucaccuuaaccuagcacugcugugggagcucaacccucuugccugcauuuguaagugcuuggucaucuuauaaacaucuaauuuuaugaaucuacuaaauguauagcucuaccacuuagaauaucggguucugucacgugcgggccauuuuuaaguggugugguggcuagcugcagagaugagcugggcaggaaaucgagggaagcagcugcaugggcuggggguguagcucacuuggcagagugguuugccuagcacgcacgaaccgaucaacuugcaaagugccauggucgccgaaacucugucaccccgacacuucgaaggcagaggcaggaggaucagaaguuuaagagucguccucauuuacguggcggauguaagggcagccuagccugucugaggccgcgugggagggcggagcaggaagagagggagcaauuccacauccagagcaacaacuaccugccucucugagccgagcgagcgccugccgucgccucuuacgucucuccuucuuccggagggccaaguacuucuuacggcuggaagauugaaaaaacgcgcgcgcgcgcgcgcacgcgcacacacagagugagcauccgcacacccggcucugcacccucaggccaggggccagccuaggacagcgcucggaggcaaaggaagaaggcaggcuagcccgcgccggucgccccguccgucccccgccccuccuuccgcucccccccugcgccccgccccccaucuccucgggcggcccgggacagccccggagauagucguccccgccccagucgccucgccucgucauuuccuauaccucaguuucugcggccccgccguagcguccgccguagcccccgccguuuccauacugcugucgcuguguucucccacggcaaggucucagcggaagcagccacccagguccucggucgcccacuccgcgcggccaccaaccgguaccugcccaagacggaaggagacggcuuucuucccgcagcuggucagccaggcgccgcggccugagaaaacagacccucaaagaggccgccgcagccaccgcggcagaccugaguuuuccucccucggccagucagccaggcaucgcgggcugagaaaaugucuccucaccgaagccgccccccggagaucuuccacccccggaaacucgugccccagcuccucggggccucgcgggggccuuagcaccgccccuugccca

SEQ ID NO: 9819 - RNA, 23237 nt, Mus musculus
ugggcaaggggcggugcuaaggcccccgcgaggccccgaggagcuggggcacgaguuuccggggguggaagaucuccggggggcggcuucggugaggagacauuuucucagcccgcgaugccuggcugacuggccgagggaggaaaacucaggucugccgcgguggcugcggcggccucuuugagggucuguuuucucaggccgcggcgccuggcugaccagcugcgggaagaaagccgucuccuuccgucuugggcagguaccgguugguggccgcgcggagugggcgaccgaggaccuggguggcugcuuccgcugagaccuugccgugggagaacacagcgacagcaguauggaaacggcgggggcuacggcggacgcuacggcggggccgcagaaacugagguauaggaaaugacgaggcgaggcgacuggggcggggacgacuaucuccggggcugucccgggccgcccgaggagauggggggcggggcgcagggggggagcggaaggaggggcgggggacggacggggcgaccggcgcgggcuagccugccuucuuccuuugccuccgagcgcuguccuaggcuggccccuggccugagggugcagagccgggugugcggaugcucacucugugugugcgcgugcgcgcgcgcgcgcgcguuuuuucaaucuuccagccguaagaaguacuuggcccuccggaagaaggagagacguaagaggcgacggcaggcgcucgcucggcucagagaggcagguaguuguugcucuggauguggaauugcucccucucuuccugcuccgcccucccacgcggccucagacaggcuaggcugcccuuacauccgccacguaaaugaggacgacucuuaaacuucugauccuccugccucugccuucgaagugucggggugacagaguuucggcgaccauggcacuuugcaaguugaucgguucgugcgugcuaggcaaaccacucugccaagugagcuacacccccagcccaugcagcugcuucccucgauuuccugcccagcucaucucugcagcuagccaccacaccacuuaaaaauggcccgcacgugacagaacccgauauucuaagugguagagcuauacauuuaguagauucauaaaauuagauguuuauaagaugaccaagcacuuacaaaugcaggcaagaggguugagcucccacagcagugcuagguuaaggugauggccagccuuaccaccggagacuguggaacaguacuugagaacuaguucaggagaggcaggcuccaacaucaaggaugaaaacaaaaaggaacaguaagcuguuguguuacugaugacaaaacccuccugcuuuaagucugaagcuaaucugcuacaauuuccuaagcucaugucaguuauccccucccacuugucucaacuggcauucuuuuuuucccccuucaaauuuaaacuuugaauagaagguauaaacuuuucuuccauuaaaacuauuuugccagauuuuuauuuauuuauuuuugaaaagucuuccaguguacacagaguugaaaaaaaauagaacacuuaaauauucaugaguacuucuauaacuuuguaaaaucauuaaauauuugcaggcucucuuucccucucuucccccucuccuuuucuuguuugauucugaacucguuguacagccaugccaugaguaucaugauggaagcauugauuaaaaagaagugcgguuagaggaaugcuuaagaacgcccgcuuagccagcacucuggugcuauacgccuuuaccccagcacucaggagagaggggcagggggaccagagucagaguucaaggcccagcacacauguggaagcuuauaacuacuauucuuuuuaagauuuuuuuuuugagguaggaucuauauagccuuggcuggaauuuacuguguagaccaagcuggccugaacucagagauccauuugcuucugccuucugagugcugggauuaaaagcuuucccacuaugccuuaaguuuagguuuuuaccauaauuauaaagguuaaauauuuaucuuuuuugcaugaauaacugaccaaggauugugagacuuuacuuaauaaaguauuugaauuucuacagaauuggcacagaaagaggaggaagaagauccucuugcugaagaaaaacgacuagaagaagaaagguuguuagaggaagagaggucaguacuaacugaaacacuuaaacucauuuuauuguaauaucagcugucuaccaacuaguagcggcuuuucauauaaaaucuuguaaaaaaauggguuuuggaaaauaaccucuuacaaacuaaaucccuagcugacaggcuaaaguuaggugucuuuuuuuuuccucucuuucuuuuuuugugugacaaauccagacuagucuccaacucaggaucuuacugccuuagccuaccaaaugcuggaauuacuggcaugugccacuguaccuauuuuguuguuuugguuuuuuuuuuguuuguuuuuuguuuugguuuuugagacaggguuucucuguauagcccuggcuguccuggaacuuacuuuguagaccaggcugcucuugaacucagaaaucugccucccgagugcuaggauuaaaggcgugcaccaccacgcccggcuguuuuguuuuguuuuguuuuuuuaguggaaguauuuuuuauuucuuauugauaaauauauguguguguguauguauguauguauaguaaauauacauauaaaguguugacauaaaggccuaauucuauugacaguauaacguaagcuauauggauguagcauaauuguuuauucauaguuuuuagucuucuauaguucaccagaguggggacaguauggugaugagagcuguucugcuguggcagcaggaacaaucuagaaguaacugcuccagguugucuguagucagggagcagggacucagcuucauuuuucccuuuccccuuacuacuccagccaggaacucuaguccacagauggcuucauuuaggguaagucuucuuccucaguuaauaacuucuggaaacucccgcaacagacaugaccagagcaguguuuccuaggugguuagaaaccuagucaaauaaagauuuuaaaugagaaucuuauacuguuggaugucugggacuuauugauuuaaggugacauuaccuuuuggggagguaugcuuuguuuguauguuuguuuuaggcaagggucuuguucuauaagcucaaauuaaccuagaacuuguaauccucucucagcuuuucaauugcuaggaucauugacauguaucaccuggcuagucugugcauuuucaaagucagguuuaugauuauggcucuaaaaaaaacccauggcaucuuugucuauaaucuuugaguuucuauuccauagaaucaagggauuccuaugauuugcuuuccaaacauuuaaaccucuagggaaaagguauguugugaguugugagcaugucuuuaaaacaaaaguuuuaagggagcuggaaaaaaggcucacuaauugagaacacuuacuuugcuauuucagauuauccaaguuugguucccaauggugacucacgauccucugaaacuccuauucccucagucuuuucaccucuucugcccaccaggcauucacgugauacucaugccuauuugcuugcugacaaacauucauacacacacaaauuaaguaaagguuuuaagacaagaugaaauggaguuauaaaaauaaauuaguaaauauacauucagccaggugugguacaccacuuucaucucagcauuggggaggcagaggcaggggcaucucuguaaguccagccucgucuacagagugaguuucagaagaggaugaggaggaaguaauguuagugggaaaagaaugcaucguuaggaagaauaaugcuaugugaaugugaaaauucacagauacugcuuugaccuguuugccugagaugaaaacagaaagaaaaggcggaacaggugcaaaugcuuaugaaguaauuguaacuaauuucugucugggaagguaguugcuuuuccgagagccacacucccaucuucacugcuuuauagaaaauauguucagauuuccauguuguauacugguucccugucuucuauacauucuagacuaauucccuuuuguuuuuauggacuacaucauuauauuaacaggcagagacugcaugaagaaugguuacugagggaagaaaaggcacaagaagaauucagggcaaagaagaaaaaagaagaggaagcucgaaaacggaaggaagaacuagagguaggcauuaaguaucuaguucauugaguaagugcuuagcugagcuaagucucuuuaagagcuguuugucaggagagaugauuggaggucaagagaccugguuguuguucuaaacacuuggauuugauucccacacccucgugguggcucacaaccauccauaauucuggguccagggaauccaaugcccucuucugacuuugagguagcaggcaugcauaugguacauacacauagauguaggcaaagcaccaguacacaucaaguaaaauaagguuauuuaauaauaaaaaaacccagguguuuguuacaggguuggagagaaagcucaggaguuaagaacacuugcugcuuuuccagaggacuuggcuucuguucccagaacccacauacgcgcuucaguguguauacccucacacacauaugcaauacacucauaggggcacucaaauaaaaucucuuuuaaauaaaaguugucuuucuugggguauagagcucaguuauagagcucuugccaggcaugugcaaggccuuggaucccuuccccagcauguguaaacaaaaggagagcuacauauguuaacauaaaacauaauagaaacugauauugucucucuuuccaaugaacacuuucuaaagcuuuucaaguauuuacucuguaggccauguguuuuuaagaaugagugaaaaaaauuaccuucucuuuuuccuuuaaagagaaaguuaaaggcagaaugggaagaacagcagagaaaagagcgagaggaagaggagcagaaacgacaagagaagagagaaagagaggugacuucugucauaggaggauagaacccugcguaucuucuuggugugcacgugugcauguaaagaguuugcagauucaccagugggcaugucagggcuugccuuugguuuuauauuuugcucauguucuguucauuuggaaggagucaguuuuuguuagaaacacuacuaguuauuuggaaacacuaguuuccaaaugguucuccucuugggguggugcaaugacagauaccuuuacccuaaguaaguuaucuuacuguuuauuuuagagaugggugaacauuuuccuuaagggguagaucauauuuuaggcugugauaucuguauggcuucuguggacauccaggucugccaguguacccuaaagcagacauagauaacauguauaugaauggauguggcuguguuguaguaaaacaucucuguaaacugggcagcugcccuguuuuacacucuguaccacucuguggcaaguguuaguuuccucugguucugucauauauguguugaguucuucacggaagaacaguauugugaaaaguucuaaaccuacuaaacucauaaagagacuuaauagcuaaugacgucucagcaagaauuaguuuaauagacauuaaagaauuaaaaaauuauuuuguuauuaaaucugguauccugucuaacuuuguugucagagcaauuauacucauuuaagaaauucugagaaaccugugcucgcucuagggcacaugcuaauguccuuuucuaacaugcuucucucccugucucuuaaugcuuaugcuuaaaucauuguuaaaaccuuuccuuaauaauccccaccauugcuuuaaaaaaagaaauucuguaauguauaugucuauaucguguacauuuccugggauucuuuuuaaaagcuugguuuguuuugcugcugguccucaacuguguauuuguuucaaauauaacaugcacagcucaucuugccuugaagauauuuuuucucuuuaccaucacuaaauuugaauggcacgacauuccauagucacucaucuuaaaaugaggagagauguauggaaagguggcagcaauuuccacaaucaggucgugucucagacggcaguuccauugcucauuguugguagcauuguuugagcacugccuuucagaugagucacuauccagaugggauguuaggggcacaaaaaugaucuggauugucauacuuuacagacaugaaucaauuccuguuuuaacagaauauucuuuaacuucuagggaucagguaaaagcuaaggcuucuaaaaguacuuguuuuaaagggagcuugguuaaggcaaaguggguaaaaugaaauccauucuaagcauauauaaagaaauacaagacgguguguaucauuuucaugcuuagacaaauacaagaaaaagcagugaaaagcagagucuugguucuccuugagugacuucuggaugggaggggcugaggguaagucagcaaaguagaucauacaauaggauguuaggagaguggugugauagaauaauaggagucaagauacuuauuugaauugcuggccaaggaagucacugaggaagugauguuugagauaauuaacugaguguggagauauugggaggaagggaccugguggucccugaagcuuagagaccacaggagacuagagcaagagcaugggagacacuagggaggaucagaaggggcagaucauaauugaaauagauucuccucuuauacauccugaccacaguuuccccucugucuacccgggccucccuucucccccagauccacucccccucccuuuccucuucagaaaagagcaggccuccaagagacagccaaacagaaaagucaaacagaaaaaaaaaaaaccaagauagacuaugacaaguugaaagcucucauauugaggcuggacaaggcaagugaauaggaggaaaagagucucaagaauaggcuaaagagucagagauacacccguucccacucuuaggagucugacaagaacaccgagcuaacagcuguaacauacguggaggaccuaaagcagacucaugcaagcccuguacuugccacuucaggccugugagcccaggcugugauggugccuacuagcuggauuugcagaaggaggcaaaggcaggaggguuacaagcuucuuagauggaaaggaguuugcuuuuauuuaucauacuaaugagagugguuuuuuuuaacaaagagugacuucaaccuguuaguauuguuacuuccaacagauuauccuaauuuuucuacaaagaacagggaccagagagaaaauuggaugaauaauuaauuacaaugugggugauaaugaugaggucagaccuucaaacagauaggcaacacaguuaacaggaccguagcuggcaaauucuaugggaggaagaaggaaagggaaccgaagccauguuugaagguuuuugggguuuuuuguuuguuuguuuuaaacaaaugauaaaauggcugucgcaguuacugaggauauuuaguuagguugggucaugggggugaggagauggaggagauaaagaguucuguuuugugagugagguauagcagagugguaaaaguagaaucuuggguuugaucucuuaacucccaaccaaaacuaaccacauuaagcaauaaugacuuuuuuugguguuuugguuuguuuuugagacaggguugcucuauguagccuuggcuugccuggaacuuauuuuguagaucaggcuggccucacacucacagagacccaccugucugccucccaagugcuggaacuaaaggcgugcaccaccacaccuagcugcugcaaugacaauuaaguugccagaacgagagauacuuaccaaguaagcuaaacagucauauguaugguuuugaggcgcuaaggaaccuaacuuuguacguauuuaaaaccaaccaguuagagauuuauugcugccuuguugggcuuccuguaaaaauuuucauaaauccuaguuacuaucccucauguuuuugcuucuguuaaauauuugugauguuuaaucuaacuuuuaaaaaacagucauuauuauuucaaaaaccagaaccugguauuuauguauaaguauguugcugaaacuauuaugacuuaaauauuugcaauguacucuauucaaauuuuguauuugaauaaaaauucuaagcucuauaucuuuuaaaaacuuuuuaggagauaauaugcuuagaaaggaaaucagaaucagaaaccuuuucuguguguguucacguguguguugucauguaugaaaccggacaugacuugcuugacauccugguuuucauuaguccuauguuuacaccacuuauaggaagcugugcagaagaugcuggaucaggcugaaaaugagguauuuuccaaaccuuucauuaagacuuugagauaacuagcaguggcacguuccaggcauccuagcuggggggugggguggggggcacgaagcaggggaaugaccacaaguuugcggccagucuguuguugugugggcuacaacagagagaccauugccuucaaaaaagguuuugagaucaauugauauuucauuagaaacaauaguuuaaauaauauggcuuuugugguaggugguuuugauuauuuugggauacccagaauaacuuuuauaacccuucaauuauauuacaacagaagacaauugauguguuauugaaucaugucaugggcuauacuuguaucaaguacucuaaauguaucuacgugacaucacauacuacuggucccaaaugguugguucacccaccuugauucagaguaauuuguaguucuuucugcuggcucccuacauccauggacccuuuucagaauagaugaauagaagaagaccuucuugaguucgaggccagccuggucuacaaagugaguuccaggacagccagggcuacacagaaaagcccugucucgaaaagacacacacacaaagaccuucuuaacuacaucuguuaacauuaagugacgucccccccaccccccaaaucaagaaaagugacugggagccaagagaggaacacagcucauguuucugaacuaugcgagucuaaacggaaaacccuuuguguucugacuaaaauauuucacuaaguggagaaacugucuuccaugggcuuuuacaucaccaguaaauucaugguuguuuuuaacagcuggaaaaugguggcaccuggcagaacccagaaccgcccauggauauaagaguacuggagaaagaucgagccaacuguccguucuacagcaaaacgggagcuugcagauuuggagauagguaauggauuuggcuuugugugagaaugaaauucuggaaaguguugggguuuuggaagcggcauagacuuuagucugcuaugcucaccaucacauaugugguacccccucgccugcuaaugaaaugggcuuaacgagugaauccuuugcauuccauagccuuagggaagacuuacuuuuaauuagauuuuuuucauauaauauauucugaucaugguuccccuuuuccaaaaauuccuccuaggucuucccccagcuccucauccaccagaauccauacccuuucuuucuuauuagaaaacaaacaggcaucuaaaaaccucaaauaaaagccaaaacaggcuggacgugguggcgcccgcacgccauucaucccagcacucgggaggcagaggcagguggauuucugaguucaaggccagccugaucuacagagugaguuccaggacagccagggcgacacagagaaacccugucucuaaaaaccaaaaaaaaaaaaaacaguauaagacaaaauaaacagaaaaaacacacauaaacacaguuagagagacacacauucucacacacagaaauuccaugaaaacacaaaaucagacagacacauacacacacaagaauauauauauaugcgugcaugcaugcaugcaugcaagcaaaagaccuauaagguuaaaaaaauaaaacccaaaccaaccaaccaaccaaccaaaaaacaaugucugaauuauuuguaacaaaacaaaacaacucccaaaauaccuucgaguuuguuuucuguguccuuaagugugguuuguaugccuagugagacaguaggacccuuugcuuguugguuucuuccaugcucacaugacucccaggaggccaccguggguagggagauuacauguuggaagugauuagaauagccagaaaugccuuuugaagaguaaauccauccccuaaggagucuuccaauuuggcauggguauagagauguuuaugaaagauaguauuguagcaaguagaggaaugggcucuuaauucucugcugucaguauguucagacuuaggaaucgacuccuuugguuaaauucucuacauuguaacucccucaucagggaaaugaagaugaugcauaauccuaccuuuuugaggugccuuggaggcugagcugagcauggcgaacacacagggcugggugccuggguccugaguuuucaucacuuucauuguucauuauuuuuguuguuacuguugucauuuucugauauggucaugcuucuugcccuccaacuuaguuuucgaagguaagauacauagagacaugguauugauguuuucagucauuuagcaaauaguugagguaaugcaagguaaugaugauauuuuuauacuaugacuuuauguggaagucaaaggaagcaagcgcuuccuaacaguaagcgagucugucggcguguggcauggucucauuacuacuuaccguuuugugcuaagcugucggcggguggcauggucucauuacuacuuacccacucugugccagacaagggguaagcggaaucauugcuuuucuuuuucuucuucuucuucuuuuuuguuauuuuguuuuuguuuuugaggucuuacuguguagugggcuuggaauccaugucccucugcuuccaaaaugcugagacuaaaggugugugcuaccagcugggcguggugguacacgccuuugaucccagcacucgggaggcagaggcagguggauuucugaguucgagguuagccuggaagccuggucuacaaagugaguuccaggacaaccagggcaauacagagaaacccuaucuugaaaaaacaacaaaaaaaggugugugcuaccauaccuaguaaucauuugguuucuugagacggucucauggagcccagguuggcuuugaacucucuaugaagccaagauuggcuuuggacuacugauccuccugcugccauaucucaagugugugccaucaugcugagcuuauuucuuauuuuucaagaguacuagcuucaggcuggagagauggcuuggcccuuaagaguaugugcugcuuuucugaggaccuaaguucagcucccagcucugugucaggcagccucagaggaucugauacuucuuugaccucuacagguaccuauagauauacuccgcaauacacacaaauacacagaguuaauagaacuuuguaagaauuaaaagacaguaguaguucccaacccuggacacacgguggaauccuguaaaaaggaaaaaggcuaaacaaaacugugucucaccucagauuguggaaaccagaauuguagacgcguagcgaguauuuagaugcuuccagcuauuucugguguguuccaggauugauguauaauauguaguaccuugugaauuugauggcuacaguuguggaucgccagccugucugugacucagaauccgguaaagaaguagaaagggcuucuucugagggacugggggaacugagggaaggaggcuaccuucccuuccguaccuuuagaaacauuuuucuaagaaaauucagugucaaguagaaauaauaaaagauggcuuaagagccagugagauggcucuguggguaaaggcgccuacugcagagccugauuacuggaguuggaucccuggaucuccaagguggaaagagagaacugaguccuagugauccuccaacuuucacauuugugccaugguguggugcauccacacaaaauaaacaauggucuguauaaaacaccuccugccgaggaaauauguuaucagaggcacaugaaacuuuaccaucacaaacagcaaaggaugagaacaacuuggcuauuugcauuguucaaguaaugaguuggggcauagcauugugugaacuuaguucuggaagcccgagcugucuucagacaacaguuggucacaugccagagagacauugccauugcuuguucucucucucucucucucucucucucucucucucucucuuuucaaaaugaggucuuaaucuauaaugcaggcuaaacuggaacuuguccugaggaacuacauucuaggcaugugaacaccuugucaggaagagaaauaauuccuuaaccuacgcauuucuuuggaugcuugcuuuuguuaaacuuuuugguuguaguuuuuaaaaaauucuuugauaguuucauacaugucuguaauguauuuugaucauauuuaccuccauuacucucuuaucccucuggaucccuucuuuccaguacguccguccucuuugaaugucuuuucuuuuuaaauaacccacugaguuuaaugaguguugcuucugugugcacaagugugagcuuauucacuagauuuuuggcaauuuacuaguggugacaucccuaaaguccccuaucuagcaguuugacugccagggacaaggccuuuugaguaccuuuccccucuccauguuaggauguugacgggcuugauuguaugcagggcuuaugucuuaagucacuuuuucuauugccgugaagaaaccaaggcaacucuuauaaaagaaagcauuuaauugggccuggcuuacaguuuaaacguguuuaguccauuaucgucauggugggaagcagacugacgugaugauggaacaguagcugagcacugauccagaggcuacagggaggggcuuuugaaaccucaaaggccauccccagugacacaccuucacuuauuaggccauaccuuccuaacccuucccucaacagccuaccaacuacggacuagacauugaaauauaugagcuuaugggguccauucuuauucgaaccaccacaucuugcaaagguaaccauaguugcuuugaguucgugaaugcaauggccauguugugucuaggaaacaguguuucacaauauucaauuccuuccacuagcacuuauguuuuucaucuccuucugugauguucccugggcuuuggagcaguuuagaggugagcauucaauagccacuuauucuuagcacuuuggucaguuauuaaccacaguccacuacagaaagaaguuucuuuaacuaagguugagagcagcaguaguuaggugcuaggccacagagauaccuuaauuacgacuuuguuguugcuuugucuuggguggucuagaccucacuauauagaccaggauagccauuguccggccagggccauuguacccuuuuuuccucuucacuauucccuacuuuuaaacuuccuuccuaaguuuuucuuucccuuaaguuugucuuacugauaucuaauuagcaccccaaccaggaaaauuuuauuucggucuuugaacuguauuaucccuucuacugcuugcuucaagagaaaggaguaaaugaacuccuauguuuuuuuuuuuuaaaguuacucuagaauagcauaguuagcuuaaccuuguuccauuuuaaacuaugaaaaaaaauuguucuucacaguuauuaguuaccuuaagugaauagaaauuaacuuauauuuauuauacucucuaaucgaccacgugccagagguccugcucuucucaaccacaugacuugggaaggugugcugcuuuagguuucagcugccuuucuguauugcauucuuuucugguugcugugguaaaauauccaggaauuuaauggagaaagagguuucuuggcucauagcuccaggcuuacagucaucauuguggggaagccaagguaggagggacuuauugcagcuagucaaggguggugauuuaaugcaugcaugccuaugcuauuugaccucuccaggguccccugcccagggaauagucccacucauaauuaagauggcuuuccccacaucaauuaaaguaccaaggcagucagucccucacagacauucucagacgauaaccuuagccuagacaauccuuuauuaagacuccuuucucugaugauucuagagucugucaaguugacaauaaguacuagccaucacacuuugcaaagugaaaaaguaaaguaccaucagccucacuagguuguuaaggaucagaguggagaaaaauauuuaaaaauacaugaaacuuuaaaaugcuauauauagauaaaaugaugauacuugaguaacuggaaaauuuuaaauuaucauauugucucuuuuaaaauuagaacuuuaaaauucuaucugucuaucaaccaucuauucugucuaucaaucaucuaucugucuaucuaucuaucuaucuaucuaucuaucuaucuaucuaucuaucuaucuguuuuugagauauucucucaccuuaaaacacuggccuggaacucauaguuuugccucugccuccuaggugcugggauuaaguguccacuacugugcccagcuuuaaaaaauuaauuaucauuguauauguguaggagagagaguagugugugugugugugugugugugcuuguguguguguguauguguauaugugugugcgcauguguaggaggggggauauggagaucuagggaucaaauccagaucauuaggcuuaugcagcacgugcuuuaacccacugaguuaucucacugguucagauuacugaauuucauaggcaugagaaucaguugaagauuguagaagcaaaauauauuucuacauacagcaucuuauucuugucacugcaaucugucacaugacugggccuuccuuuucccaauaguucaacauagagaaaucucuaugaauguauucaaaggcucuugaauggcauaugaccuuggaauucauuccuaaucuuguauuucagugagaaaucagccaguuuuacaacauuuuucuugaaugcuguaacugagccucucagcaauguucauuacuguguaguuaaggcuaaacagucauguuacuugagucuugcucuugaacuuaaugguaagcuuuuaaugugugauuuuguucuuggacacaugaguucacuuuucuuucuucugcagguguucacguaaacacaacuuccccacaucaagucccaccuugcugauuaagggcauguuuacaacauuuggaauggagcagugucggagggaugacuaugacccugacucaagccuagaauucagugaagaagagaucuaccaacaguuccuagacuucuauuaugauguccugccugaauucaagagugugggaaaagugauucaguuuaaggugagcacagacuggaaugggaccugacaucuccugaaauacaggggcauacagggcauacagggcauacagggcauacagggcauauaggggcagagcuagggcuuguuccaaauaugccuggccugaggcugagcaugguaaacuugguaaacauugucuuccuuuccacuccucuacccuggacagugccauguagauacacucggaaaucauaagcauguguuggcauguuuucugaaugcuagggccuggguuggaaagggcucucuuguucagugccuuugugcuacagcucuuuccagaaguugaacucacugucaggccugguguacauagccauccaagccuucacuuagcugcugucucuaauggacaugcagcgccucacccagaacccuguuacauguaccgacguugaguuucacucacugaggagggugagauuuggcuucugcuauuccagggacucagugggugaaucccaacauguaggccucuuacuuugucugugaauugaucauaucugaaccugagugacuuugugauauaacgacaagggaaguaccccuuauuuuggagaaaguaggaauaaagccauaggucuuuuuucuugcugucggaaaugaaaguauacaguuggacuaaucaagugcuauggauauuuaagaaaucugagauuacaaucugcuuuucaaauuuaaaauauagucuuuaauauuugguuuccaaagaaggggaaauagaacguaguauuauaaaaagauaaaggagaaacuagaaaagggcaauuaaauggggagcggaaaaggcuuuuuguuuuuaauaacauuuaaauuuuaaaggugguggugacacacaccuuugaucccagcacuuaggaggaagacagggaggucucugaguuuugaggccagccugguccucagagugaguucaguaaggcuauauacagagaaauccugccucaaaaaaccccaaauaaagaaauaaguaaguaguagauaaacaaaguuuaaauguacaagaaguaaaaauuggucuuccucuugggcuggcaugaugacucagugaguaaaggcacuugccaccgaguuugacaaagcuaaauuuaaucuucaggacccacauggugguuccaaggauugaauguagggccuuguacacacugggcaaaagugcuguagcacuuuuucuuuugagacggggcucacucugcagcucaggcuggccugggcccauaguaauccuucugccuuagccuccuuauuacugggauuuuagauaugcaccaccaauccugacuggauuaacugauuuuuaaggucccuaaggcaugggugacacgaacagcugaggcccuuuagucuacugucuaaagauggcauuacaaauugaguaggauccugucccccuuaggauguucuaauaacaacacccugaaguaagaugggauagcuucauuucuaagauaaaagcuaaacaccaguagggauauuuaagggcuauuuaugucauuuuagacaaaucaaauuuguaauuuuugaaagcagugaucaauuauuuaucccuacuuauaugaaaaugagguauuauucacagcuacaugauguaaauucuauuaauaucaagaucaaguagaaaauauguacuaguaaagcuacucgugagagcguucauguacagcagagugaaguggaaacccaccagagaaggccuuacaucuacagagauggcuuugugaaugggagagugcaagcacuguagauaauuaugagcagacauauaaauaugauuugauuaguguacuuuauaguaguugaggcauuaagcuuguauuacuugacaaagaauaaagaauaccaucuauauagaaauuauagagccaggcaugguggcacucuccuuuaaucccagcacuuagaaggaagagguggaucugugaguucaagaccuacauagugaguuuuaggacaacuacaauugaguuuaaauugagguuuuguuuuuugggguuuuuuuguuguuguuguuguuguuaauaaagacaaauuggaaaaacaucuggacacacucgcugguauuacuuuggaccuuuaaaauucggaaacguuuucugagacaggcucuuuguacagaauuuuaaaaguacaaagcaauaccagcaaguguauccaaacuuuugacauugugacacaaugugaucuacagaguucaugccugagaaccacaauugaacugacagaagcaaaaacaaauuagaagaaaaaucauaauguuuuaauuaaguuugugauuuuuguguuuggccacauuuuugucaacucauaguccacaggagacuacauguguugguuauauauccaaccugaaucaaucaguacacacacacacacacacacacagacacagacacagacacacacacauguacauaaaacuuuuauauaucauuuugguuacuauauauuuauguguaugauauauuuuuuagaauauauguaugccuauauguauacaugugucuguaaaaguaugcauauauauaaucuguauuccaaacagaaacauauccguacacacacacauagcaagugcucuuaacugaugagucaucucuccaaccccuguauucuguuuuuuuguacauuuuauguacauguuaugaaacauuuuauacuuaauaggguuuaaaacccacaaacaaggaucaccagagaccaggcauuugaggucuguaauguuguuaggugcuuagauuggccuugacuugauaggaaaguguucgccugucuuggacucugagggacuauuugccuggacaggaugcaugugaucauuugcugcuuuugaauacuuuguguguaugugugugugugugugugugugugugugugugugacagaauucuucuuuguuccuuaggucagcugcaaccuggaaccucaucugaggggcaauguguauguucaguaccagucguaaguauuggggacauacacacaucguccauguuucaucauagcuauggcauuguuucuuugaugucugucacugaauauguagcuuuccuaugcaugauacuuuucaaaaugucaauaugaagagcucauaaacagucaagaugugaaaauaauacucuuuuauuucauucuuuuuauacuucugaaguuuugauucuuucauacaguauaaucuucauaaaaauacaaacugaauaaaggcuaauuggaauagaguagaaaauaccaaucuaagguacaaaggguuaaagcucccaauagggugcacuugaccagauagcaauguaguuacugagucauuccugcauguauugccauuucucuaagcagugccauggcuaauggcuucaauuagccauaguaguaaggacagcagagacagcauggguucuagcaaggggaaacacuuuugcacauguaauugucaaaucuugcagauuaagaagcuuuaacuagccaauuuccaugugacaaaacuuuucggaagucaaugagaaaggucucugaauaaacuaggcugugggaaucugaaugcucugaggacuaccuaggcaauacaagagcugaaguccuacaguaagcggacaaggggcuaauuuagaguagguuugcuauguugugagaguuacuauaaagcacacccuugauuuuugccuccaagggaagaagacugucaagcagccuuuucuguuuuuaauggacgaugguaugcaggacgacagcuccagugugaauucugcccagugacccgguggaaaauggcaauuugugguaaaagccaauguagugguacccuucccccacagcuagcugcacuauacaaaagggaucuucauaggaagaaagcaguauuuuagagggaugaagcaccacuuuugucucauacuacagaugaguaguuccauaaaggacaccauaguguagauaugguuuagaucuuuaacaggucugugcuucacucuguggaugaaauaaaugccugaggucacacuauauuggugacagaauugcaaguugauuuucagucuucagauccucaguucuggguucugugugugacacugcagcagcaucuaaacuaaagauacccacacuaaaccacgcugcacuuucaaagguguuuucuauucauuggcuuuccucacuugagcuguuuguuucaggcucagucccuaagcacucuuccgucaugaccagcacaaucauuacccauggcuaacauuucccacauuacuugaaguagguguggaucaguuuaguuguacacugggugcucucaguuacacugacucaucugagcgcggcugccaaaccaggaaugauucagcacugcacaguagccagcugcugugaagcucucaucauuuucugauugcuaagagagugccgagccagaucagucugcaaguuccccagaugaagagacacaaagcucuaauaccucacggguauucuucucccuucucucuggguuuuucugcucuuccuucccaggugcuuaaaacuggcguaaaaaauauguaauuuaucaagcaagucuaaaucuugaacagccuucucuuaauggaugcugucauuuaagaaacauuuauggugggcauggaugguaccaccuuacauuccaaaacuugucuagggaggccaagacaggauugugaguucaaagccagcuuggacuauauagugagaccuauucuugaaauaaauaaacuaauuuauugaucaauuuuaaaaaggaggggcuagagagauggggaucugauaucuucuuuugaucuccaugggcaccaggcauguauaugaugcacauauguaaacacagucaaaacacucacauacauaaaauaaaccuuaaaaguuucaaaacuaaauaaaaaauccugggcagugauggugcacaucuuuaaucccagcacccuggaggcagacacaggugguucucggugagugugaggccagccugcucucuacacaggggguuccacgacacccagggcuacacagagaaaccuugucuugaaaaaucaaucucucucucucuauuauauauaggaauacauacauauauauauguguauauauauguguauauauguguguguauauuuguguguguauauauauguguguguguguauauauauguguguguguauauauauauauguguguguguguauauauauauauauauggaauuuucgaauuccuugcuaggaaaaugaaaaccacuauuacacccuaagauuaaggguuggaagcugggcggugguggcccaugccuuuaaucccagcacuugggaggcagaggcagauggauuucugaguucgaggccagccuggucuacagagugaguuccaggacagccagggcuauacagagaaauccugucuugaaaaaccaaaaaaaaaaaaaaaaaaaaaaaagauaaaagauuaaggguuggguauauaaacaggaugguaguauauuuuuuuuauaggaaguuuaauuuugcaaguuucuagaguucuagaaaugcagggugauuccagugauauacuugaguaaaacucaaaccucaaaccaggaguuuuguuucguuaaaaccagcaacaaaauauaaacagcuuuaguauuuuucucaguaacuaauaacuaacuuuuuugucucauuauucugguauaucuucuuuagagagaucucuauuuagauaguuaccaacuucuaaucagcuacaucauuuuauuauucagcuauaguucuugauagauucucuauaccaguaccugaucuccaaggucaucugaaaauacuuucagccacaaaagugccuuuauuuuguuuucuuugugugugugugugugugugugugugugucuuagagauaggaccuccuguauucccagacuggccuuaaacucacuauguagcccuggcugaacacuacugugucaccaugccuggguauuuauuauguuauucuuauuuuguaaagaacguugaaggauucccccuccuauguuagaccuucagagcaguguaugaaaacaauccauccucagacuugagaaacagagcgagucgcaguaauacagugguaauugcugccucucacuugcccuuacaggcuuauuugaaguccagcaguguccaagaggaaagcacugcaacuuucuucacguguucagaaaucccaacaaugaauauagggacgcuaauagagaccucuacccgucuccagauuggacuagcuccuccuucgguaagaauucagagaggagggaaagggccagucacuaugaugaauacuauggcaggucaaggaggaggaggaggagcccgagucccgacuucuacaagagaaauggcgagucugacaggaagagcaguagcagacacagggugaagaaaucucacagauauggaaugaagagucgugagaggcgcaguucacccaguagaagaagaaaggaccacaguccgggccccuggagccagagcaggaggagccaccgcagcaggagucgcagucgcagccgcagccgcagccgcagucggacccguagccgaagccggggccggggccggagcaggagccggagccggagcaggagcaggggccggagcaggagcaggggccggggcagcggcaggggcaggggcaggggcaggggcaggggcaggaaccagagcaggaguuggagucaaagccggagccggaguaguagcucgucaagguccagaagucguggcaggaggucagguaguagagacaaaaccacccagagucccaaaucuaaauaaacuugguuguuuuuaaauaugucugucuuuuuauagcagcuacucaccuguauagauagaugaugcuagcuaaugcuaucauguaaaucauacuuuuugagaaauuauacacacacacacacacacacacacacacacacacaugaaauuacuuguaauaauaaccucgagagcaucaguuaaugcuggagugaugcuuuacuauuuuuuccuguuuucugccugugcaccucucccccucccuccaucucuccuuuccuccucuuucccuuccucccucuuccucuuccucuuccucucugucucucuguguaugugugugcauauguguguucagaggacaacuuuuaggggucauuuauacaaugugauccaggaauugaaccgaggugaagcuuuuacaccaaggaccuuuacucacggagccaucuucucagcccgccuuuuuucuuguuagggguccacacccuuuauuucugcuuaauguauauggguguuuugccugcauguaucuaugugcaacauuugggagcccaguguccguggaggccaaagaguaugccagauccgccuggagcagaauuauagaugauugugaacugucauguggguccugagaauugaacccagauccucuaaaaguacacuuaaccacugagccaucuuugcagcccuacacacuuuauuuuuuaauucaaaggccauauugcuuugaugguuuucacucaauugucucauuucaucaaucugaugcucaagucccauaauucuuauuuuuacucacuacauagaguauaucugccaauagacuugacaacauuccuauuguuggauuuuaaagguggcc

SEQ ID NO: 9820 - RNA, 16232 nt, Mus musculus
cuauaccucaguuucugcggccccgccguagcguccgccguagcccccgccguuuccauacugcugucgcuguguucucccacggcaaggucucagcggaagcagccacccagguccucggucgcccacuccgcgcggccaccaaccgguaccugcccaagacggaaggagacggcuuucuucccgcagcuggucagccaggcgccgcggccugagaaaacagacccucaaagaggccgccgcagccaccgcggcagaccugaguuuuccucccucggccagucagccaggcaucgcgggcugagaaaaugucuccucaccgaagccgccccccggagaucuuccacccccggaaacucgugccccagcuccucggggccucgcgggggccuuagcaccgccccuugcccagaauucaaggcguuaaggccuagcuccgcccccucccaucuaaauuccaaggcgacgccucuaggucccgccucucuccgcggcuccacccaugagcgccccagacgaaguuuaagaauccgcuuccucuuugcaaaaccugcuggcucugguuccaaaggaaucagguuugugacccuuguucuuaauccugagaagcagagagggaccggaguuaagugcaggggaacgggaucuguucggcuggcucuggaguugugcuuggagaaagaggaaaaaaaaaacaagccgaaagcgucuggaggugaaacugacuggaaugugcugggaagcagggaauuuuguuacuggaacaaaagugcaaggcaaggguaucuagagauuggcugcugcuaccccaugccuuugugcaaaggggaggagggcuggagaagagagcucagcuguaacuguaaugagagcuuuacuacuauuucauaagauacaaguuugguucccagcacccaccagacaguucacaaccaucuguaacuccaguuucaggggauccugugcugcaaacacgcaauggacauacauaaaauaaaucuuuaaaaacauuuacauaugcaacgagaaaaugucccucuucuuaauccucggcuggcuuuugcagccugccucuaggaucuugguucccuguguuuguugaggagucuccuucuacucccugccucuggggaacgcagacccccaggcugcugcugcggagguugagcuggacaacuauagcagucuccaggaguguuuuuuuuuaauggggaaauuuuacguugcaauguaaaggauuaaauuagcaggacaagguaguucacaccuaauccaauacucuuagaacuuaagaaacuaaggcaagaggaucagggguucaaggucaaccuuggcuauuuagagaguucaaggccaacuugagcuaccugacacuuccauuaaaaaagaauugguggcucaggccuuuaauuccagcacuugggaggcagaggcagguggauuucugaguucgagacuagccuugucuacagagugaguuccaggacagccagggauauacagagaaacccugucucgaaaaacaaacaaaaauaaaauaaauaagaaagacaagaaaaagguaauacuguaucacaaucaucuaggugaggugugauguggaacuagagaggaaaauaaaaauagggcuggcagaugauuaagcagguaaagaugcugaggaucuaaacucgauccccaaggaccuauauagcaggagagaacagacucccacacauuguccucuuuggcaugcauucccacauuaaauaaauaaauauaaaaacaacaagugggcaagagacaagaaggcaagaguaagaggcaagagagugaggagguggcaagcagccccuuuuauaguggaccaggccuaccuggcuguugccagguaacuguggggaggagcauaccugacuguuggcagguaacuaugcagguggaguuuagacagaaugcuaacacuuugcucuuucugcucucaagggcaucaguggacaucuccuucaccuucugcggcaacuucccccgcagugcuuaucagaagccuuaccuggggccacaaguuucuuguuuugucacaauugaugaacucuuaguuccuggauuuuguugaguuuguuguugucauuguuguuguuguuacuuuguuguuugucuugucuugucuugucuugucuugucuuauuagagugucucuguagcucugacuguccugaagcuugcuuuauagaccaggcuaaccuugaacucagggauccuccugccucuagcuccugagugcugggguuaaaaguaagcgccaccaggacuggcuuagucccucuucuuaauccuggcuuuugcagccugccucuaggaucuugguucccuguguuuguugaggagucuccuucugcucccugccucuggggaacgcagacccccaggcugcugcugcggagguugagcuggcuacccauucacccugcucccagccaaugcuuugccucggguuuuuuaauguguagggugcuuugccugcauacccaguuccuguagagcucagaagagggugcuagaucuccaggaaguggaauuacagaucauaaacugcccccugggugcagggaauccaacccaaguccuauggaagaacagcuaguguucuuaauggcugggccaucucuuaagcuguuucccacccucacccccauugccuuuuguuuuuguuuuuguuuuuguuuuucgagacagggcuucucuguauaacccuggcuguccuggaacgcacuuuguagaccaggcuagccucgaacucagaaaucccccugccucugccucccaagugcugggauuaaaggccugugccaccacugcccggcugccuuuuuuuuucuuuaagacaaguucauaaauaucccagacuggccucaaauuccauauguagacaaaacugaccuugaacuuauuuucugucuucaugugcuggugcuggcauuguaaguguugacacugugcuuguuuccaguuugcuuccuuccuuccuuccuuccuuccuuccucccuucuucuuccuuugcuucuuucuuuuauagauuuguuucuuuccuguccaaguuaaaacugcugguacacccaguggcuaaacuguuccugccccucuuaauuccucuuuggaaucuuugagcugaaggccaaccccuauagaaaacaucacccuucucuguuuuauuaagacaccuagcaagcuaguuuugguggcguaagccauuagucccaauacuugagagacaaaggcaggaggaucuuuguaaguucaaggccagccucauauauagagcaaguuccacaacaaucagggcuacgcagagaaagcccaucuugaaaauucaaaagucaccuagugacaaaugcuuucuuuugucucugaguuuacuuuguccagcccagugcaucaauaaggaaauuggcuuuggagcugaaugagccaggaaacuccaucuuugguucuuaguggucuaaaauggaucccugaauaucucgucuuuagauuucucaucuguaaauaucaaaguguaaauauaguuccuauuuuaggaaguauuuuauugugaagguugaauaagauagccccugcuauaugugcacacaauguuuagcaaugauauccccaaaccucaccuguaaaagcgucguuggcaucaccaccaccaucaucauuagugugaaagcauccugacucuccuuccaaaugugggucagugcugguggcgucacagucccaucauauguccccuguaugcuggacuggcuuuccucacuugugugcuucuuacauuaaaccuuuccugcuugcuugcuuguuuuaauugcuuuucuugcaaacagggacucauguagucucaaaucuaccugauaccaaguaugauuuuaacucuuacuccaccuguuucuguagcccgggugcugguaucaggggcaugugccaggugccuagcccuuauaugaaucuuaauguucugugagauuuggccaaaauagccccaaacuccaaagagccuggauggcacugaugaucgcagcugugugagucaccagucguacagaucccugugacuaggauugguacuucaaauugcagagcuuuaguggcuggaacaugcacugcaugugacugucacuuuagaacaaaaagcauaucuuccgggaagauguuccaauuuuuaaaaaggacacagauguagauuucauauuauuaugauugauaagugaauguaaaucuccuucaauuggaggaagacauuuauuuuucaaguuaacuacugaauucauuuccagaaaacaagcuugaauugcucaaguuaauuucuuugcagaaggaauucugaaagccaauuccauuuccaaacugaaauuacugucauuugaauucaauaaagaaagaugccuuuguaaacuuuggggaagcaaugccuaguuuuagaauagacaaccuuaucugaaugcaugugcaggauaacucucaggugauuuugagccuacucuguuccuccuuguggcuuaccuauacuucuucagaauaauuguaaaaucugcuggcaaggcauggccuacccaauguagccuggaccuuguuccugcccuuccucugaaugucccauuucagauuaaggagaaacugcucuggacagcccaaacuuuauuccacuccauuuuaaacacaacgcccuuuaaauuuuugcuuacuaagucccacggcccuugggguauacaccuuggagacagaaacuuuuggugggggugaaccucaacuguacuaaaagugacgcagaugcaguccagacucuaucugccccaggaagcuuuggaggaccagcucacaaaugauccuaagauccacuugugccuuauaccuaccugugagaaaaaugucugcuuugugaaacuucuacacaaacaugguuuguuuuaccacuuagaugaguuggggaaugucugcccagugaacauacuccacacggaguaaucuugggaaggaaaaauggggcuggcagccagcugugccuaguaacaucuaaaaacugcaugcuaggcugugcacagaggugagccaugggaaguuggugggucugcuucucugguuuuuccccuuauguguuuuccaguugcuagcugaucuguuaaaggauaucucuuuaauuuuaugaauaaugagaaugaaaauacauuaaaaaccacugacauuguaaauaaucauaaaagcauggaagagcucagugcucuacuacuaccuacuggggaugagcaacacauuucaugcaaaacuguuugggcuggggagguagcucaguggguauugugcuugccaagaauggauaaggugcugagcucagucuacauaaaaccuuucauggugguugcuaugguuugaaugggaagugucccccauagacucauguauuuaaacacuugguucccaguugguggcacuguuuggaaggcuauggaacaaaccauuaggaaguggagccuugcuggaggaagcacaucacgagggcuggacuuugacuguguauaaauauccaccuucucauucugcuuccugggugaaugaaaaugugauuagccugcuuccugcucugguuaccauuucugcuuuccacugugcccucugcuccaguguagacucgaucccucgggaaccauaagccauauaaagcccuucuucucuaaguugcucuuggucaagauguuuugucacaacaacaggaaaguaauacagugauacacacuuauaaccccagcacuugggagaugaaggcaagaauauaaggaaucugaggaaaucuuccgcuacacagagaguagaaggccaaucugggauacaugagguaugagauacacacacacacacacacacacacacaccucuccagacaagccuuugggccaauucauguuuaggaagguacaaacaaagcauauuuuaaaggacaugguuugugauggcuugaauaauuaaagaguaacuaauaauaagucaaaaguuaugguugaauuacucauacucuguucucuuaauguacuggaacuccccaguucacuacuugugccucccuuuuuacuuuaccuagaaccaccuacuuagccaaaaauguaucauuucacugcauuucacugcuugccuuuaaacguuugaaccugguuuuuccuauuaaaaagucugucuugaggacagacugaugccacaauuggguuauuccuuuuuguaguccugaucacucaguauuaagguguucguucaauaaacuacucuugcuuaacugagaucagugaucuuaugguuuguguggcgauuccugaaccucaacacaggccucaaguucacagugauccaccugucucaacaaccagagaggacagugguggugcccgugccaugaggccugugcuaaaccugugcugcuuaaucacaagcuggcagguaccaugugcggcacccaguucauaaaguaucaguauaugcuaugcccacuccagugacgucugcuugacauuccgagaggccuggaagcacucaugaggcaaagaguuucaaggaaacuaugccuccuggaaccuuggcauucccauagcucguauacucauacccuauccccguguuagucugguguauggauccacgugcucucuuucaguguugucuuauuauaagugccuuuaaggauugauuucuugacauagcuaagcuuggaacucaguaggaauucaguaagaauguuaccuauucaguaacacuucuauuacagauggugaaacgaauuaggcauuacaaagaacggagcuagaauagcucagggcuggucugcagagugauuacuuaggacaguagccagucucacccaaacaaguugcgaauagguggguuaaccaugaaagaguuagggaaucccccagacagguuucuucacuaggcccaaaggaacagcauaaucaggcauuuacuaagaaccccuguaaugagaucuggugcccucuucuggugcgucugaagacaaccgcaguguacuuacauauaauaaauaaauaaauaaauaaauaaauaaaucuuuaaaaaaaaaaaaaaagagccccuggcagugggcuuaacaauagacuagcauuacaccuggcuccuuccuuccuuccuuccuuccuuccuuccugucugucugucugucuguuuguuuguuuguuuguuuguuuguuuuucaagacaggguuucucuguauagcccuggcuguccuggaacuuguuuuguagaccaggcuggccuugaauucaggaaucugccuaccucugccucccaagugcugggauuaaaggcaugcgccaccacuuccggccaccuagcuccuuucuuagugguaaacaacgguccuuuuuuuuuuuaagguauuuuccucguuuacauuuccaaugcuaucccaaaagucccccauacccaccuccacaauccccuacccacccacucccccuuuuuggcccuggcguuccccuguacuggggcauauaaaguuugcaaguccaaugggccucucuuuccagugauggccgacuaggccaucuuuuugauacauaugcaccuagagacaagagcuccggguucguucauaauguuguuccaccuauaggguugcaguucccuuuagcuccuuggguaauuucucuagagcuuaucuuugagcacaaggaucuccuggucuccuucaccugcccucucugaagagcauuuugcccuguuucauagacucugggucugcagucuagaggaugccugaggaguuccuucauagcuguagagaucccacuauuaacaggaggggaaaaugaaauucaaggucauucucagcuacagagugaauuugagggagucugguauacaugaaaguuucuaaaauagccaugaugaguaugaugaugaugauggugguggugguggugaugaugaugaugaugucugaagaugccuccaggaaugaaauacaguacucauuuuguaagugguagcagaacuucuccccugcccuucagugaacuauaugaaaauguacaaguaucugaaauaggggucaaaggaugguuuggugguuaagagcaccagcugcucuuccagaggacccauuuucaguuuucaccauccaugugaugucgcacaaucaucuguaaugccaguuccaggagauccaguacuguccucuggccucuguggcaccaagcacauaugcaguacauauauaaacaugcaggcaaaauauucauacacaugaaauaaaaaaauagaucuuauaaaacaagcaucuggaaaauaaaaguaagccuuauguuaagauggaaugggcaaaaacugaugacuaacugguucguauggguugcggcaccauaguguuuuguuuuuuguuuccagaaaccacagaagccugugaacuagagaaacuauggacccuguguucuuauggccagcuaguucagauaagaccagugaggcaauguuuuucacagcccaagugacuaaauuccagggccagagguauagggaucuccaagucgaaguaucagaaagacagaaaggauacuugcuugauugguuggcuuauuuuugguauauaguaggccauggcauugaaggguggggaaguaguucuccuauagacuacaaaauaaguguuguaugucauuccuagaggaaucuccugcaucaucaucaucaucacuaucaccaccaccacuaccaucaccaucccucaaauuugcucuaaggcaugugcgagcaacaagagaccuugguccuaauaaaaucuacuuuuuccuggauguaguguacuugguagggauuaggggacaugguaaaagauuuggugcuccugcacgugcacaaauucucaccuuaaaaaacaaauuaaauuuuaugugugugcacacaugaauuuauguguagcacauguguagacacucuugaaggccagaagaaggcauuagauccaguggaaacuggaauuacaggugauugugacuguguuaaugcugcaaacuaaacucagguccucuguaagagcacuaagugcucuuaaccaccaagcuaucgcucuagcuccucuccauguuuuaaagugaagacucuugugcuagcuaguuuugugucaacuugacacaagcuagaggcaaagggagagaaggggaggaagccucgacugagaaaaugccuccauaagaucuggcugcugcuaaguuuguagaguauuuucuuagugauugaugggggacgggccagcgaauuauaggugguaccaucccugggcuggugguccuggguucuauaagaaagcaggcugaggaagacaugagggcuaagacaggaagcagcaccccuccauggccucugcaucaacuccugccuccagguuccugcccugcuugaguuccuggccugacuuccuucaaugaugaacagcaauguggaagcacaagccaaauaaacccuuuccuccccaaaggaggucauagugccuugucacagcauaguaacccuaggacaccucuuccuuccucuacggucauguuuagauuuccauauauuacauuuuuuuccugucuaauguucuucuucucaucugaaggcucuuucucccauaaauugcaucuuuuaaguagaaugugucagugucuuuucuugucuaacaccugcucuuuuauuauuauuauuauuuaauuuauuauauuuaaaagaaagaaggcauggggaagugggaagaugaggaagaaagaaggaaagauggauuuguaucucuaugauauauuggggauguuuauguguacuguguauucaaaugcugauuucuguacccagagaucugguuucagucuaaacuuugguauuuucauuauuaugaagcaucucaugacucaguaucuuguaaacauuauacuccaucaccuucuaauuaguuaaaguaagagacugaacagccuauaggugugcaggagaggaaaaggcgggacuucugggaggaaggggagaaagaaagagagagagagagagagagagagagagagagagaggaaggaaggaaggaaggaaggaaggaaggaaggaagagugugugugugugucucaggugcagaccaaguggaauugccaucaggacagcaaugaagaaggaagauccaggagagacuaagaugguagguaacaggggaauagagcaggccagcauuaucagguuagauuggcucagaaucugccuagcuauagugcuugaagcuuuuaauaaacauaaaugugucugugucauuaucauuauucagaacaagaaugagcauaggaaaacccuuacuuuuuacaaagauauaaagacaagucaguauucuuuacauugguucuugauccaaucuggaagaguugcugcaauaagguguaaaagguguguaagaggcuaggagacacagaaggagcucaaguacccugauaaaugaauauuuuguguuugcccuuuggagggaaaauaguugaaauacaugaauuuaauaaaguaaauagaauuaauuuucaaaacguuuauuuuugugguaaugggaauugaacccaaggccuuguacaugcuaggcaaaacacucuacuacuagacaguauccccugcuccuuuuaaaucaucucucaaucucuuucucucucucugucucugucucucucucucuccucucucucucucucucucucucucucucucucucucucucucucucucucucucucucucuguguguguguguguguguguguauuaucucucccugacucucucuggaguauuuguguguguguguuuuaaugugaguuccagauauugaaacucauauguuagacuuacacaguuuuaucaacuaagccaucucccuguaccuucuucccugcuuuaguuucauuuuuguugcuguaauaaaauacccugacagaauuaucuuaaagggaaaagggucuguuuuaguucacaauuccagguuaccgcccaucauugugaggaagucaagguggcaggaacuugaaauagcuagucacauccuagccacagucaagagcagagcaaaugcaugcauucuuguuaaugcucagcuugcucucuacaauuauauaaaccagagcucccuugccuaggcaauggugccaccaaagugggcuagguuccccacgucauguaacaagacaauccuccccccacagacauguacacaggcuaauucgcucuguauaauuccucguuaagacucucuucccagguaacucuaaauuaugucagguugaccauuagaacuaaccaucacacccccauuuaaucgcuuuaagcugauagguuauuucugucaaacgaaccaauucaagccagauuagauuaugucaaaggcagguuuauugagaagcugcucucaggcaacuucacuagccccaaggacugaggccaggggagucuccaugggggaagggagagagagagagagagacagggagagagacagggggagagaugggggaggcaggggaaaggagaggggcagggggagggggagagggagaaauucuggauaauguacagaggagccucugggggaagugcaauccaacuccuggaaaguucaaguuugggggacaggguaugccagagagaaacuugggagugcugggagaaccuggaggccagaaaagcuuugauauguaaaauaugcaccucagucccuuguccugggggucugaaaucaaacauaagcauguuuugcagauucuaagacacacaugcuaaagucugcuuccaccuuuuguuuagagaagagauaucuccaagaucugcauguauaccuccaaauuuaccuuucuuuaaaacugaauuuguucuggaccucuguggcaaaauacacauaaaauuuaccauuuuaacuauuuuuaauauuagucaucccaagucuuuguaaguauacaguucaauaaugcuagauauacucauauucaacaagucuuugggacguuuucauccugcaacucgaacacuauccauuuguguuagacuuuuuguuacuauaacaacuaguuggaagaagaggaacaguuuaaagaagaaaauauuuauuuuggucaaaggauuuaaaaguguuggguauggaaguuaagggggacacugagacagauuguuggaguuaagaaauguauuagaagucauuaauuccacggacgggcacaaaccucaacacccacagauagacucuguacgugauggugacucugaagagaaacuggauccuagagaggaggcaggagucaggguuccuucuuacaguuuucugaggaaauacaaaagguguagggcaugcaccuccagccagacuuucugaucccccagcagauggcaggaaagggaaugaggagggugauaugugccacugggagccauccauaucccuuugauguaucugagccugaaaacucccaaagugagaaauuaagacaccugggagccuguuagcuagauagucacagaauugaauaucucaauaggcugccuguuaguaucaguggggcuggggagaugagaguggcuauuauaaguauuguggccugaccagcaaucuggccuggagucuaauggguuuuaguccaugguagcuggucccauguguuugggcccgaagugaagcaaaaaaucaucacagaggagcuugguggaguaaaacuauucccuuaagcagccaggaaacagcaguaacagaacucacccauaauaggacaaaacccccaaagacacacucucagagaucuauuuccuccagccaggccacagcuucuacaguuccaccaccucucgauaaucuauucaaauucugaaucuaucauuaaauuaaauugaucaucauuaaaucgaucacauuagauaguucaugauauagucaucuuuggaaacuuccauggguacucaguaaaaacuccugugagccucugaaccaaauaaaguugacaagauuaaccauuacagcacuaaacccaauucaccuucccucccuucccaacccuuagcaacugucuaauuucuauucccaggguuuugaugacuuuagacacaucguaggaguggaaucauauaguguguguccgggaacuggcuuauuuuacuuagcagaauggcuuuugcuuucauccauauuguccauccagcaggguuuucuucuucaaagcuaauauucuacuguacuacauucccuuuauaauuuaucuggcuuggccauuuagguugcuuccuuggguauuugaaauaaugccaugagaaagagugugcaaguaucucucugagaucuugguuuggauuuuugguuaaucucuacccagaggugggauuucuggaucauaucauaauuuggguuuuagugaauauaccaugacauuucucugcauccucacaucauucuauuuuuuuucuuguuugguagucauaucaugauggccaugcugugauagcucauuguugcuuugauguacauuguccugaaacuuaguguuguugaguagcuuuuuguguguauacuggucccccuuguaucugcuuuggagaauugucuguucaaguccuuugcucauuuuaaaauugggcuuuuggggggaggacuguuccugaguuauugacguucuuuaguguauuauggauauuaagcucguaucauauaugugauguacaauuaucuucuccccuuuuauaguucucuuuccacuuugcuggguguuuuuugugauaaucaaauguuguaaguuuauguuacuucaaucuuguuuugcagacuaaauaaaauacuucccauauuugaagcacaaguuuggagacaacuauaaacauucuaagguaucuauaaggaaguacaacaguguugcagauuccucaaaaauaaguaaaucaucuagauuucauacugacaaguuucucucuguguuuguauaacaaagucuuccaaaacacuguauuaaucaggagguuuaaaucaggcaccugcuguauaaagcaccucagcugacccuguggaacagcucuccauacacaaaugcugccaggagagagcuggucucccaggagugcggacacaccugugagcacagguaaaaccaccaucucugcucaaaauucuggcccaagagggacccaccgagagcccucaggacacaggaaccaaggaaaagcuggggacacgauccuuccaguuucugccuacaccccagggcugauccagugccacagcucaccauacccaaauuaauccuggagagaacugguuucccaggacuacugacacacaggcuugcaggagggauaagccacagucagagacagcaaugccagcuaacaccagaguuaaccagaugguaaaaggcaagggcaagaacauaagcaacagaaacuaaggcuacuuggcuucaacagaacccaguucucccaccacagugagcccuggauaccccaacucaccaggaaagcaagaaucugaucaucuccugaugaugaugauagaggaaguuaagaaggacauaaauaauccccuuaaagaaauacagaacagaaauaaacagguagaaaaccuuaaagaggaaacacaaaaaucccuuaaaguauuacacgaaaagacaaccaaacaggugaaggaauugaacaaaaccauucaguaucuaaaaauagaaguagaaacaauaaagaaaucacaaagggugacaacccuggagacagggaaccuaggaaagagauccagaguaauagauacaagcaucaccaacagaauacaagaaguaaaagagagaaucucaggugcagaagauaccauaaauaacauugacacaacagucaaagaaaaugcaaaaugcaaaaagcuccuaacccaaaacauccaggaaauccaggacacaaugagaagaccaaaccuaaggauaauagguauagaagagagugaagaauuucaacuuaaagggccaguaauuaucuucaacaaaauuauagaagaaaacgucccuaaccuaaagaaagagaugcccaugaacauauaagaagccuacagaacuccaaauagauuggaccagaaaagaaauuccuccugucauauaauagucaaaacagcaaaugcacaaaacacagaaggaauauuaaaagcaguaagggaaaaaggucaaguaacauauaaaggcaagccuaucagaauuacaccagacuucucaccagagacucugaaagcuggaagauccugggcagaugucauacagacccuaagagaacacaaauuccagcccaggcuacuauacccagcaaaacucucauuuaccauagauggagaaacgaagauuuuuuuccaugacacaaccaaauuuacacaauaucuuuccacaaauccagcccuacaaaggagauggaaaacuccaacacauggagggaaacuacacccuagaacaagcaagaacguaaucuucaaacccaaaagaagauagccacacaaccauaauuccaccucuaacaacaaaaauaacagaaagcaacaaucacuauuccuuaauaucucuuaacaccaaaggacucaauucccccaauaaaaaggcauagacuaacagacuggagacuccagagaaccaaauaacccuaucaagaaaugggggccagagcuaacaggauucuccacugaggaaacucaaacagccgagaagcaccuaaagaaauguuuaacauccuuagucaucagggaaaugcaaaucaaaacaacccugagauuccaccucacaccagucagaauggcuaagaucaaaaacucaggugacaacagcagaugcuggcaaggauguagagaaagaggaacacuccuccauuguugguggaauugcaagcugcuacaaccaaucuggaaaccagucuggcaguuucucagaaaauugggcauaguagaggacccagcuauacuacuccuggccauauauccaaaaggugcuccaacauguaauaaggacacauacuccacuauguucauagcagccuuauuuauaauagccagaagcuggaaaagaacccagaugucccacaacagaggaauggauacagaaaaugugguacauuuacacaauggaguacuacucagcuauuaaaaacaaugacuucacaaaauucgcaggcaaauggaugaaucuagaaaauaucauccugaguaagguaacucagucacaaaagaacacaca

SEQ ID NO: 9821 - RNA, 1082 nt, Mus musculus
gaaccugcaaugcaaaugugcuauuguuagaggcucuuagaagcugucuugagaguuaacaauuaccagguauuccuugugacucuuguaacuuuacacuuccuugugacucuuaacugguaucuuugguaucuuccaacaacgcccuccccacuuccuuaaguuucgguuucuuuaaauacccccuuacccagcuacucggggcgccacgguccucuaccccugcgugguguaugaccaugggcccgagagcgcucuugaauaaaaauccucuugcaauuugcagcaagacccguuucuugugggugauuuuggggugucgccucuccugagucagaacgugggggagcccucacauugugggucuuucauuuggugcguuggccgggaaacgcgaccaccccucacacccgagaaccgacuuggagguauggggauccccucuugcgugcgugugugccggccggugucucuguuuugagugucuguuuucugaaacgaacauuggaacaugugcuuguuguguuggguuguuugugucuuguccuauguuucugaaguacggcgaagucugaguuuggauccgucugaguuuauugaacuugugccuugguuuuccgguugcgagaucguggguucgagucccaccucgugcuuugguuuuacaccuggcagagugagaaacaagugagauucucugguuuugguugucuagguagaaguggacgacgguguuuguagacgauggggugaugggguuuucugaaaugcgcgcgucuguauuugcagcuguccuuuugggccguaaggaccggaggacuguggucggcagacgugcuaagaggaccacaggcuguggcccugggggacgcccugggagguagggagagucagggacgccuggcugucuccggagaucggucagagggaccgaguucuguugaagcggaagcuucccccuccaacaucgucuaauucuuuugccugcuuguggaggacaagaaagggucgagugugucuggaucuguugguuucuguuuuguguguuuuuguguauguguuuagagcuauguaaaaaucua

SEQ ID NO: 9822 - RNA, 5790 nt, Mus musculus
agcgacggauggaggcgggcuggugacaugggcggagcgcgaaaaucggccuguggucuuaggcgcaagggugaucgcaugccgcuguucgagaucaaaggccugggcaagucacuuguggcuguucucagggucuccucagcggucucccuguagagcugcggucgaaagccggagccggagccggagcgagccagagccggauugagccggaaccggagcuaccggagggcgggacuuccgguuucugggcccaagacagagggcgggucaggagucaaggucucgcgaggcugcggcgugagguaagggggcguaagcaagcuccucauaggcuggcagccucgugccgggagcccgcgcggagguugaauucgguaaggaugggcgacugugugugaccgcggccgcggggucgcagggccugucuguggggacaaggacuaccccuuuggccuuuacacgcacugucuugagguaccuugguccggggagacccgaaagauguagguccgagaguauaacggaggggcuacucgagcuucccccaggaaccggcuucccagggcgcucucgucaguacagggucacuaacuaaccccuggggauuggauccgguuuggagauggggcgacugcauuucuagacaccgaggcugaagacgcuggaacucauccggauugggggggggggggacggauaacgccacccuccagggugggcauugguagcacaguagugucgggaacacaagucugacccgucuccacuucucaaguucuuaacaucuuuuuuuuuuuuuucuuuugugcccuacuccagaucgagagaccaggaacuucaaaauagugccugggauccggaugacagcaggcauuaagggcuggcuacuggacugaagcugcuggaaacuuguaaguauaacuccaccucguuugucuuuuccugaaaaagcuugagaaauaauuugaauguguacaccuuaguuugaauaaucucuucugaaaaccacgguugcuuuuucuccugcuuucuggacuguaagucugccaaucuccccuuugcuauccaaaaguuugguuggcaugugugugcccgaagaacugugagcaugacuaguaugcacaacaaagcuuuucuuuuugaaacuuuaagcaugcugaaguuaugcagaaacggagagagaguugcaaccagugucaacuaucucagagucuaguguggccuguuugaggucgucuuuuuuugauaaggcaggucucuauacuucuguuuauuucuguggaucucaaccuguccagagguuagauuuuuaacauuuucaagcaguucaggguuaauucuagcuggaugguguguaagugugugccuugcugugaacauggaaaauggagugaauuagaagaugguuuuucucacaucccucucuaguccuuuccuguaaguuaugucuguugaggucuccugccguaacauagcuguagacauuuuguuccaugccugccagcuauuucauauuguugcaguaauauggguaccagucauuaacacagaaaaauaacuugacucaaagcagggucaugcugaccacauaccuuguuauguuccgagguuaugacguuuguuaaucuuaagaaauuccacaacuauaagcuucaccaguaggaccuaucaaauuaaagaacuguuaugugacuuccaacauuggcauaugagcucauugugguuuuaguuguuuuagccuuuauaagcuggcccugagaaauguuuggggucauaguucccaaagucugagcugugucagucaguccuacgguguguuguuuaauaaaccaucccuguuugacugagguugguguucaugugguuuguggggugacuccugaaucccaacaauauccagguccugauaaugccaggcagaagggaguaauuauaauaggagauaauaauuuuaguuuuaacuauggguauguguguaggcuucugcaugaguccacuaaaguagaaagaggcugcugggucaccuggagcucgagucacaggcagguaggagcagccugccauggcacugagacuggaacucacucagguccucuggaagagccuuugaccauggagccaccucagcuccaggacuuaauuauucuccauugugugcaucuuccugagcccuguagcuauuaaagggcauuucugaccucucaauagcaccuucccccaaaugaucacacuaaaaugggucucaagacauguccagaccuccccugaucacauucaaaagggucucaagacauguccagaccuccccugagaaggaugauguuguuagaaaaccacggagacaagacuuguguauaugugaucuugaugaguuuaaugaaaugucuaauaucuuuuaaaugauuaauauguauccacuauugacaaugaauuaguguuuuugaacauuacuuugcucuaaggguuucucaacuucuuugcaguuuauuaauucauguaggagaggaaacucauuacuagugcuagguuaguuccacccgaggcuugaaagugcaucaugaacacacugccacuggcaguuucuuuucuccagcauugauuguaguuucacugaaaggaauuagcccugaccaaaauacauuccuggcugcugguuaugccuacacccucccucgccugguuauucagaacacucgcacuugaugugcuuaggcuuaaaaggucauguucaucuaguuacuaauguuuuugugagugggacuuuucuuucugcagguuauuauuaugauuugguuuuauguauggaaguuaaaagcugaaggccugaaaucgcaauguucauauuaggauuguuugcuggguuugguccuaaccaagaaaacaaaaauaguggcccacagaugcggaacuugauuugauugacuucccauacuguaagccauguucauauuucuaaauuguuuugaaaaaaaauaauguacaguaggccuugauugagcuuucaggaugcuaucuacacugucucaaccuauuucuacccaggaaauauuauggucuuugcugcgcuccugaguauauguccucuagugauaaugcacccuugguaauacucacuguuucuggcaacuucauugacaggggaagaccagguguacacucaagaccuagaaugaccaagaauguggaaccuuaaaaaaagguaaagugcgcugggcgugguggcucaugccuuuaaucccagcacuggggagacagauuucugaguucgaggccagccuggucuacaaagugaguuccagaacagccagagcuacacagagaaacccugucucaaaaaaaaaaaaaauagguaaagugcaaaacccuuugcuaguucccacagcucagaacucaauguugacugcuguuucaaguaagaggauugucaacauaucguuaacauucuucuucagauguucacaucugacuuguugaaagcagcauuacuaagaggugguaguuuauucagaaaccagcauuucaggccaucccugagcacugugcuuauauuucugcuugcugaauggaaucuuugguuguaaacuaagauuguugccugcuguuuucuuagauaagagacuauaacuggugacuauucugacuugaauuuaacggcuugcauauguuaguuacuaacgaaauuccuagucaccuagaaaagaaaugaggcauaagguccuaaacuguggggagauaaacuguccuuugcuauuaaugagcuaugacacauaugagcuagaaugggaaugguagaaauguaauguuacuccagugauugguaaugcuuauggucccuguaccuuuagaaagaagugaagcagggcucacaccugggacccuagggaggucaaggcaggacuucaagacauucugggcuguauagcuaugaaacaguauccccagcaaaaccaaacagauagagugugagucucugaaauguagccacaagucacuuguuauuuacaaguaaauuuuaauuucauuaaacauuuauaacugugccuacuccuugcuauauuuauaucauacauuuccaucuucaaagaaaauuugguguuaugacugcauuacuaaguucucccaguuuuccaauuaauuuggaaggccaucagacuuggagagcaguaguaauaacaggcuuguuuuaugaagucuuuaggaagaauucugauggaggauggagugcucuuucauuaaccuuccaauaacugguguucucuaggguggcggcccagggugucccauaggucuccgugcgacuaggaggggcagcgguggcggcgguggcagcggcagcagcggcagcggcggcagcggcagcagcagcagcuagcaaccuggucaggguacgcucuccauccacagagaugagccgucaggcugcuacagcauuauccacuggcaccucaaaguguccaccaucccagaggguaccugccuugacugacacaacugcauccaacaaugacuuggcgagucuuuuugaguguccugucugcuuugacuauguguugccaccuauucuucagugucagaguggccaucuuguuuguagcaacugucgccccaaacuuacauguugucccaccugccggggcccauugggauccauucgcaacuuggcuauggagaaaguggccaacucaguacucuuccccuguaaauauuccgcuucuggaugugaaauaacucugccacacaccaaaaaggcagagcacgaggagcugugugaguucaggccuuacuccugccccugcccuggugcuuccuguaaauggcaaggcuccuuggaugcugucaugccccaccugaugcaucagcacaaguccauuaccacccugcaaggagaagacauaguuuuccuugcuacagacaucaaccuuccuggugcuguugacugggugaugaugcagucuuguuuuggcuuucauuucauguuagucuuggagaaacaggaaaaauaugauggucaucagcaguucuuugcaauuguacaacugauaggaacacgcaaacaagcugaaaauuuugccuaucgacuugagcuaaauggucauaggcgccgauuaacuugggaagcgacuccucgaucuauucaugaggggauugcaacagccauuaugaauagugauugccuaguguuugacaccagcauugcacagcuuuuugcagaaaaugguaaucuaggcaucaauguaacuauuuccauguguugaaacggcaaucaaauauuucuggccaguguuuaaaauuugcauuugacuucacagagaauaagccacccaucugccugccaaccuaaaacauuccugguagguagaagcuagacaugaagguaaagaaaaagaaaagcuguuaauacaggaaacaguugcauguaguaacacuaauagauuuaaaaauaauucaacaguaaaccacugaaaaaccauauauacucaagaugggcaucuuuuguauuaagaaaggaaacguuguaaaauauuucugaacuuuguauuuguuguagauugauuguauuguugacaauuuuucggggugggggugugccugcacacaugcgugcacgugugugcuugguuuuccuuuaacaagccaucuacgugucauagcccacuguuuuccccuugugagucaacacauagugcugcugugguuuugguuugguuugcuuuugguuuuugauguguguguauuugauaauuuuuauucuaguuuuucauuaaauaaauuugacuuuucugucau

SEQ ID NO: 9823 - RNA, 103618 nt, Mus musculus
ugcgcaucacucuuuggaccgacuuucaaaaggcagauccagagagccauggggcggagucagagaauccaaacccaggguaaauaaagggugugucccccgguccaaggccccugagaccuagagacucccgccuucuggaggcccgcaacaaagcgcugagucacgcugacugacggcuggcgcuccgcaaaccuguccucccuuugcugugucccugccgcuguggagucuaggcaccuccgacuguggccucccuccugggccugcgcuacugcccagugaguggccuggggaacucagcccucgugagagugguguguguauguguguguguguguguugggggugggaggaaugcuccgaccaguuuucaugaugcugucuuucccagcucacuacuggggcucggaggggagcugagggagggaaaugcuuaaauagccaccacgauuugagaugauagcuugguuuuucucuuggcaacacacugcaauuaguuaacugcuuuauccuuguuccuguguauagggccuaaaugugggagucuggaagaagccagaaaaauuagguggaggcaaaacuacuuacuagucgcuuauguguggaugauuacggggcuggacucagaaguucauuucugucucccacauuucauggcccaauagaugcauguuguuugccugcuagagaggauccguuuuaggaucugccuucacaaacugaagggugcuucuauguugagucccuauaaagaacagcagcucacuuucuuacagcccuauuuacauccuuugaggcagacgcuucuuaaucccauuguauagauggaaaagcugagacacacagcaucccaaaugaaagcagccuggaauguggcaaaacugagauguaaaucugagguguccaguuccagaaucugccuguuauuaaagugcuucucuuaguuuaaggaaucuuugaaggauugguuagaguucauauggugaucagaucuggggcuuggaauuacuugucugcaaacaccugaaguuagaagugugugugugugugugugugggggggggugauuguauuuguugugugauauuuccuugguuaggacuuagacuucaaucaauaauggaacacuuuugaauaauaaauguaguauauguguuguuccugaaucaucgguuccauugccugggguacuucauaaaugguuugucugugcuuuagaggacuuuauuaagaaguucaaagauuucuugccuaaaaaauuaccugcacaagaucuacauaaaauuaagucagccaguaagaauaccaacacagaugggagaagguuccacgaaguaccaccccuaacugaggaacuugggcaguuggaggcugcugggguaggaagugucaguucucuuuaaggaacugaccccuauuaggaugcccaugcuucaguagaugacccaacacccauucguauaagaaugggcaucacuuagucucaguaggcuauggaaaauacaagauuacauugggagugagauguggagcaggggucugaaaggaguuggaaggggaacaaaggguugcuaugauuaaaaaaacccgcauuguaaacaugcuuaauauuauuaagagaugaauuuuuaaaaauggccacggacuuuagagauagaugaguauuugaauucaguggcccuugcagauuuccuuccaugccagcaucaucauauucuggugagagucacauaccccuaguguuuuccauuugcuuccaguaucaccaaaagagcucccacuuccaucuuccaccgcaugucgugggguagccauugaagggugugugcacggugugaggaggucaaguaugccugccacugaagggaagcguagaaaauguucuuuagauaucccugcugaguucuuccaaagaguugcuauugugaacuuuuggacaagaugacugcaggauucuaagagguaacugcuaauaauaggguucuagguaccucguaaauacuaauacaugcacaccauagcuguguuucuaaaaaucaccuaaucuaggccaugaucauagucaguauucaguaaauugccacuauaaagauuuggagcaagucuaauguuaauauccuuaguuuauaaucuguagauauuuccuccauugugauuucuuuuguuguuuauugucuuucuucuuucuuuccaucuucuacagcucaacaucagaacuuucuuuauaaacuucaaaauggcauccucuaaaaagguuacucucucagugcucagccgggagcagucagaggggguaggagcacgugugcgcagaagcauuggcagacccgagguacgcaggguggaugaguacaucccacuuugaguuuuccuuucuaaagcgacuagugggauauugaauggggauuuggagagagaaggccaagcuggucucaagcuucccuguguuauuccagugggagaaacauggaacuccacaacuggggccccguguggaucaacaccagccuaaaggagguuucuaguaugcagauaauuagguucuggguagcaggugcagcucugggagaugugacuggucuucuguacauauccauguacuggcuugagcugagaagcaugcuggcugucagccacagcaugcauauccucagaugugcccagugcauauccucuccauccuugcuuacaugcucaugcuucagugcauggguaacuaugcaucucagcaucagauuccuaggaaaagcaaccugauuggcugcacaugggucagcucucugucuaaucacacagaauaaaggauuuguauuugugcaccgagguccagcucuaugcaccuucguguguguauguggggggagagcauaagggaacucagagacuguaccucuagauguuuuccaacaucagagaaggucuuuauuggaauacuagggaauacaugaaauuuagggacggaucuuagaugcauagaaaguuaugaaauaauggucccagccaaaggccauagugccaugcuauauuaacuguugcgaauaagagaagaaaugcauuguagggacagguugcauuuugggaaauagggcugauuuguagcucuuacccucuacuccagaaauuuccuacugccucauugcuaagcuuuaucucucuuguugcauagaaguuacugugucugcauuuugacucaaaaguguguuugaaagcauucacggacuuguauuguacaccaaguuugguuuguuuugcuucauucugcaguacuggggauuauacacagggaagcccuugcacaugcuaggcaagcacucuaccacugaguuccagccacagcccucuuuuuuggagcuguuuuaaucuaucuaucuaucuaucuaucuaucuaucuaucuaucuaucuaucuaucuaucuaucuauuuuugagaccagagucucauuaaguugccuaggcuggccuuauacuugaaauccuccugcuucagccuccugagcagcugggauuuccgggcucaccuuugcuuguaggguuugaaaagucaucgcugucuucagugagugcuauccuacacuguugauggcuuugaugucuuacauuuuaaaaauuuagcaaaaaauguguauguguguguuuguacgcaugugugcgagugugcaaguguguguguauguaugugugugguuuuuuuuuuuuuuuuugagacagaguuucaguguuuaacagagcccuggcuguccuguacucacuuguagaccaggcuggcucaaacucacagguaccucugcuuucgaauucugggauuaaagacgugugccaccacacccagcuguuguuuucuauuuguauauggcaaggaaugguccaaacuagcuaaucaacauuuguauuacuucacauaauuauuuuuaaaagcuauucuuagcacauuucaacuauauaauacaucaucacuuuauaguuaucgagugcuauugauuucuugaacuuauucuuccugucugaccaauauuuuuccaucaucccauugcagacucuggaagucaccauuguguuucuguuuguuuagauuccacacccgagugagggugugcaguguuugucucucugugccuggcauugauuggccguugagguaggcagcgaacacuccuccccccuuuagacccgucagucuucuuucuucugucugguacuuucucuuuccaacaguaacuuucucacagauagcuccugaaauuuaaaaugcaccauuuuucaaaggaaagacacaaauaaguuuaucuuaauggcuaaaugcagagggccagauggaaguggagcuaugcucuauuagaugucauuuugaacagaaaaacuagaaagaguucuaagaccucacagacacuuguuaggaugcuacuaaaugccucaccaaaaaaaccuuuuuauuuaaucuaaaaauacuagaggacuaagucauuuccaaaaugaaaaaaaaaaaaaagaacaaaacauacauauugaggauagcugggacuaauuaguccaucuaucaauuauguucuaucuacaccagugguucgcagccuuccuaaugcugcgacccuucaauccaguuccucauguuguggugacucuaaugauaaaauuguuuuuguugcuacuuacuugauaacuaauuuuugcuccucuuaugaaucgauguaaacauugcuagagauaguuugcuagagggggguguggcccacagguugagaaccaauguucuacaucauuggggauuauuuagaaggcaguuuuguguccugaaaaguuucacuuaacguggugacacaagaacuuucugucauuagagauucuucacaagcaucauaaacauuugaaaaugcuuugccuggauaagccggccauuacucuuguccucaggucaaguguuugacuauauguuaacauaauuucacauucuacaaaaagauagacccccucccacucuaugagcggagaaugaagacauuggucuacauugagaagguuacucuucagagucuauugaccaaggcuuacauccuaaagaaauagaaccuuuggacaaagcuauuuuugcauugaagcugcaaaaguguucccuuuuaguagcugucacaaguguuuuuuucuuucuuucuuccucucuuccuaucauugcaaaugugcaaguuaaagaggaacuuaaaaucagccuuucuaugguuuauaauaaagaaaagauagguuggggguggcucauaucuuucaauacaguuauccauggaccaggcuaggcagucacagaguuugaacgacugagcagccuuuggaaggugguuccuuugugcucccaggaggagagaaaccaucucuuaucugcacuuguuuuuaugaugcccaauuccaccagauacugcucagaagaaugugguugucuuuggguuguuuaauuauuuaagagaauacuuugaaacaaagaaagcuagagggauuagcacaaugaauguccugguccauauccugccucaaagcauuuugagcagaaacccacaugucaucuugcucgucagaauuucaguuuguuucuuagaaauacaagaaaacaagagaggguaaugggaucuauguaagacaaaaguagaaagggcgagcuaccucaccaguaggagguaaucagcaagaggagaagggagguguggaaaaauacacaguguaguaauauaugaaaauagcacagugaaaaaucaucauuuuguaugccagcuaacaaauuacuguaaagauguggagggagaugacacaagaagagaggaugauaaaauuaauuauauaugacuauauauaacuauaaauaaauauguacaauacauaccuauauaauuauaguccucuuauaauauuggaacauucaaaggauuccaugauauugugaaauagcuguuugcuaaggcaauagcaaccaccacuuguccucugacacugaagggaagaagaggacaaaaauguguaaaggacaaauaucaacucucaguccucauuugauaaggaauggcccuaaaaguuucacccuagaauugccuugugguagccagagucaaccauaaagauuagcuggaagagacuaaagaaucuaacaaaagcaccacccagaguuugugggguguacucugcauacuuagaauuauucuggauucaauagagggucauuucaaaagcacauuaucagucuuaucuccaaaggcccgugcuucugauaggcacuuccagcacuuccugacuucccaaaucugcugggcuguuggagcuuuauuaugggguugcuacaagccagagggcugcuagccacggguuuuguuuggaguucuaaagauguugaaagaacagucuuggaagcugccaguuaaaauuggcagcuaaagguuuuggaaguaggugaaggaaaagaaacacaagaaaagagagaugugauugaauuggagacguaguuaaaacauuuuagaaaaaucagaguucuuauagaaaucuguucuuuuuuuuuuuuuucaaaguuuuucacauuuuuauucuuugugcaugaagacuagcaugauugguuccacuugguagucaguugaauccauucaaggucgcuuaguccaucuuaauguagccuauguccuuugcguagugccggaagcacuggcggcacaagguuagccccuauuugcggaucagacccuggugguuagagcagaugcagcaagaggggaacccuggccaaacuuccgugguugacuccaguagagcugcuggugacuggcucugagggacuuuugggauagcauuugaaauguaaaugaagaaaauaccuaauuaaaaaauaauaaauuaaaaauaaacaaacaaacaaauaaauaaauaaauaaguugaauccaaaaagaaaagaaaagaaaaaaaagaaaaaagaaaaaagaaaucugucuuuguggacaggugguauauguuuauugaacgugcugcucaagcuaugguaaaugcuugcagauuaguaagaauaaauuuucagcccuccugcaaguagcacuucaguguagcagucuaacacaacuguguccucuuguuuauuggugugucucuuacucacaucacuuggcuucuggccaguuaaguaaguccaucccucugacacuugaucagcaaccuggguucuguagccuuuccuuaugcagacuuucuucuuguggguguguucauauggcagagauuagugacugaaaggagccagugugcaauuaauacacaucaugcugacaugguuuaaauguauguguccuuccucaaaucaaagugugagauccuaaccuucaaguuaaugguauuagcagguagugucuuuaagagguaguuaugccaugaggaugaaauccgcauaucugggauuaaugaccuaauaagggugaucacagagaguuaguuggacccugccaucauguaagaucacagcuagaauguauugccuauacagaaaacggauuuuuacuagacaccaaagcugcuguugcugccuuaaucuugaacuucugaguuuccagcacuguaagaaauacauuugaauuacuugggagguacucaguuuaugauaguuugugauagcaccuugaguggacuaagacaaagcaugguaccaguuucuucuauuguuuugggcaauaguuuccggauucuuuguagaugacucuuuaucaaauagccauuuggccacaaucuuaauaacaugccuccccauucuuuaaaagugggcugcauaguuuccaagccuuucaaauuuaauuuucuuuugaucaaccauuuugugcauauauuacuucuuucuucuuauauuuugccacacguggucaaggggaaccaugucacaccgccaacacuuugucuuuagcugauuuuauugcuugaaaguucugcucuccauggaauugacaguuuuugccuuguaaccaggaucaccuuuccuucagcuuccagugugugcuucaguucuuuccaagaaaucaugcguguuuguuacuaccaauguuuuguccgggauuguucagcuaguguuuaagaugauggagggggagugcugucugugccucucacucauuccuuuaaccccucccccccaauuucacacuccagugacuguaauguagcuuugauuuuuuuuucuuggcuaacucucaaaagcuuucuagccuugaacuuauuacccaguccuccaaaccccaaaaccaucuccauauuuugagauuuccauuccagagcaaaagcagggaauaacugauguucuaugggugauugacagugaccgggguuuacugaagagagauaguauguuuugucuucacagauuauuugagaccaguuuauuugcccauaugaaucuucuugucacaaagaagcaauaaagacauaucaucuucauccauauuaaaagacaaagaagaaaaagacacauaauuagcuuaguugauagauaggcaacagcaagaaaauucaaaauccauugauaaacuuaauaaguagaaauggaagggcagcucuuuaacccuaugaggagucuacagaaaaauagaaaucugcaauuauaaaacuuuauaaacagccagcuguauaaaaucagggauaugacaaugacacacaccucuuaccaucguuuuguuuguuuguuuguuuguuuuuguuuuuguuuuuguuuuuuuguuuuucgagacaggguuucucuguguagcccugguuguccuggagcucacucuguagaccaggcuggccucgaacucagaaaucugccugccucugccucccaaguucugggguuaaaggcgugugcuaucacugccagguuucuuaccauuguuuuuacucaaagaggugcuagcuugcaaaacaaaggcaagaagcaaaaagagggguaaguuagggcuggugacuuaaucuuggugguggagugcuuguguagugugcgugagacuccagcuuccauugcccccccccccccagcauuggggggaaaaggaaauaaaaaguacaagguuugaaaaugagaaaaagacuaagcuauuugcucauggguguugguugagcucuugcucucaaauauuuguccccuuccugcaauaggauuguauguuuccacccaccuuuaggugugugacucaugagucccaggguaaguguccuucucuuuguuuggccagaccauguaugugcuguuuuaacaugaaccccagaaagagaagaugcagaggccagcuggacucagcaaaaccuagagaaauugcaacuuuugguuuuaagucaagcaaaaacuauuuguaugaacuacuggaggaaagcuuauugauagauacacuggugccgugaccaucuuaggaaauaaaacucaaaagaacaugcugggcaauuaauaaaauuaauaagaacuuagcaguguucaaaaguuauauaucuauucauauuuauaauucccaauagcaaacuguucaaaauguaauuuuaaaugcaguuuaugauacuauuugaguaugauguccagacaaauuaaaaaaaaacaaaaccuuuaugaagaaaauuauaauuccuuauugaaggacauuuaaagacuuaaauaaagauaacauguuuuuaaaugaaguauagacuuaauuuaaguauuuacuuuuuguuugauuuuuaucuuuuuuuuuuuuuuuuuuuuuuugcuaauuacacaaacuuuuaaugagauagccaaguuggugucaaaaaugcugccucagagaauaccuaagauagagcaaaauggcaggaaagggucagaggugagugagaagccaagagaggaguuucaagagccagaaagucuuggaaguucagcugaucauuuaguaaucaccaaaccagauugauuauauuuaaauccagaccaauaacaauuuaguaauaauauauggguauuuauagacuauuccauugcagaaauuucuauuugagccauuaauagagaguaagaauugacauaugugcacaaacaugaguaaauuauuguugauagaagaaacuaagggcuuauuuaagcccauaaauaaaauuauuuauuuaaauuauaauaauaaaauuauuuauuagaauaaagcccuucauaaaauuacaaagaaaaccuguuucuguacaagaauauugaggaacuguuaauuuuauauggccauggaauuccgaugagugaugggcagagacuuugcugagcauaccaaucucucuuacgcgcuucuuucuggaccaucguccuuuucuccuuuccauuugauuagcuccaacaugacuucaagacuccgcucaagagccacuucccuggucguaaauuucuauuagaaguaaaaaucaaauuuucaaaggcuuucccgaugucaccuguucucauaugugugaaguuguuuuccuugaaaacacuuauaaccacagcuuaguuauugauuuuauaaacagcuacccugugacguuaaaaaucuguugacaaucacgagauguuuguucacucuguacucuccuccuacaaugucaauucuaauguaauugaugaauuguuaugugcagguauacuuucuuccugaauauaauuugcauuuuagaagguugcuuacuuguugcauaaucuucagugaguuuuguuagauaugucuaugaauguagcccccauaguaugacuuaaaauccaugucugacaugccaaauuuuauuauuccaguugaaaaaucuggauccauuuuuacuguuugaugaauuuaaaggaggaaagccgggaggauuuccugaucauccacaccgaggauuugaaacaguaaguacaaagguuugacugcaaaagugugucugaaaauuugauuuuuauuucugauagaaaauucaaucagaaucaaugaauauaggcgaaaauuaauuuagaagauucuugccauaggcugcuauauaguugcuauagugauuuuuauaugaaauauacucaaauuuaaauauuaacuauuuuaauauuauuuaauuuguguccugcugacauuucuaucucagcaguucaaaaagagcaagaauuggcuuaucauauaauuggcuccccuggcaauggggaaaaagacaccuuguugguggugguguucuuaugacagucaggagcggagcagaugacaguccucuguuuguccuagcuugaugccugucuugguggccaaagcuguuuuaugcuuaagacauauaaaaaucaaaucaaauacagauaucauagcauaggaaaaagaagacagacagauaccuguguuccaccaugccacauggugcuagagaaggauguccacagaccugcccucucccccaaggcacagaggcaggggcauagacacacaaagccuggcuuaccaccacacagugcaguaugggaggagguagacagauagagaccuguggaccaccaugcuacccacagaccugccuuuggguucauggcacaggugggguauagauacccauuugcuagaggaugucacccaggggcucacuaaccuccagcccagccugcagcuggagucauaaaaauuugcaaguauguggugggcagaugggagagaaagagaagugggacagcuugagguuuauggagagaaauggaacuggagacucgaggguggagaggaggaaccuauugagaguggccagcccugccaccugggucauggugaggucccagccccagcugcugcugcgggucaugucuagguucauugcuacacagcagcaggaaucaguguugaugucugugacucguuuuugccacuaaagaacgaggggacauccuuggucagggcauggccccagcuucacccaggcagcacaguggagcuggcccuggugguggggguucgguagagcugaccacaccacucauuuuauauaugguggcacuggugccaccucuucacccccagcaaucgggaaagcugcccacagugucaugauuguggaagagcuagcucugucccuuaucagcugcagcacucaggagagcagucaauuaguaaauauuuacccagggcuuacaacaugcgaggguugguggaagcugaucuuucagauguugggggugugcuguauguuauggaguguugcuagaagacagaacaaggcuugagcccugcuuggcuucuauauguauucuaguuaagggagcaaagacagacagggaaagauuugaucacuguauuuaaccauggaaagacuuagccaagagacuuccagaaacaagaugaggcuaguuagaucuguguuccuucguuuauacauuugccuucaaguucucucugcuaacacuuuggcugcacugugucugucuuacuucacaccuaugaugagagucacacuuucaccuucuuuauaccuguauuugauuccaauccuuuguccagagcucuagaacucuggcugccauauuccaaaucuuuuaagcucuuuuuacacauuaguaucuaguaguaucuaguuuacuaguaucuaguaucuaguauuaguauuaguauuaguauuaguauuaguauuaguauuaguauuauuguuuuccaaacaauccuaagaggaugguacuuuauucuucauuuggucccaaugacauuagauuuguuccaguuuaacauacauguauaccucgaugguggccuugagcaacucucuuuccuuagagucgggaauugccugauuuaacauacucaagaggauuauaaauuguuucagcuuagauuagcccauucuucucuggcucuuguugaaggcaaugacuguauuaaacaauggcugcuaaacuucuguuuccauuagguaaagugcccuggugggggcacugcuuuguaaaucauaugguauucagcuuuaaagaacuugguaaagaagcuuagcuauagaauaucgauguuuggccuguuucucuugauuaagaauuuucccuucaauuauagcuguaauuacauuuuaucauuaucauuuguagauuuuguauuuaugaguucuucugcuuggaaaacucaccauuaauugccaagucaaugcuuguagagcuuugaugauguuucgggauguuagagaugcccgacucauuucuugccagcugagguguaauaagauaauuacuuccuuguucuggcucucauaauguagaccaguguucuuguaauaauccuacuggcauguuucuuauauuuuccugcuuuuugauguuuucuauucaaaacaauuccugagcaucacacaguguucugucuaguauuccucuucuggccucauuuggcaucaggcacguacacaaugcagguauauaacacacaaaacauucauacauguaaaauaaaaauaauacaacuucaaaaacuauaaaugaaaaaaugaauccuuccauuuaaagccaagucagucuuaggcucuuacuacuuucucucuugaggucaauuuaaauuccaaagacuugucauguuugaaaauucugacuaguauauaaaauaaaaaaaguagauaaaaugauuuagaaauaagaacauaagugggaucuauuauuauaucaccacccagaaauaguaauuguuauugucugauuuuuucuaguaucaugauuuuuuuuaaaaaauguaacuauuagaacuuuucaacauucuucaugaagcuaauuaaaaauggcuuuauuccugugucuagaauccuuguagauguggcugcugugucacaugugcaucaguauguggcagagaggagagauuaugucuacacucaguguucugaccugugaacaucugaaugaucaguagucuaacaguccuugaaaaaagugaggccgaguccagcagcuguaugacuccaggcagaccaagaagucauugcagugaacauuuguaagcaaagaaaucuggacaaaggguauacagugggacauacugugccacacuacaacuuccaaaacaagauugaagauuaggcaagccuuuccaaacuuaguuucaaagaagagguauugaugguuugugcacuccugaguuuuucaacugccucguggagaaauggauuuuguacauuucaaaauuaccuuuaaaugauagaaucaagacauuccagguuuuuggacuggaaaccuuauguuucuggguaugccucaguccuguaaaacugagguagugcgucaguuuuguuuaaaguauauuacaggagcugaggagaugacucagaaggugugagcauuuguugcucucgcagaggacccagauuugguucccagcagccacaugaggaaguguauuauuaaucaggguuccccaaaggaacagaaccaauaugaauaucuaucuaucuaucuaucuaucuaucuaucuaucuaucuaucuaucuaucuaagaguuuuggagccauaauuaaaaaacaagcaaguuaggaguaaaucaccagaucugugucacagggacauauuaggaugcugugcaugucguuauuaguuaaacagagaaguauagcuuacaguuucaugacaagucucagcagguuccuugguuuuuguuagaacaaaaccacccuguuuccaagggugugcccaucagaaaagcaaugcucauaauucuugguugguagccagcagcauuugcaggcgaugucugaacaauauccuggagaggaagggaaaggcccuagugauucacacuuaacaaacuuacuacugacuucaaaccuccugucuccacacagcuuguuucuuaaagugugcugcgaaccauuuucuaacauaaaccauuccaagauggcuguaucccgguuggaaagaaaaauuugauuaaauucaacaccaaaguuggcaaggaaagaaaacauuuugagccaggcauggugucacacaccugaaauuccagcacuugggaggaagaggaggagguggcaggugauagauauucaaagccauccuuaagcuacaguagaacguuagaggccagccuggcauaugaaagugugucucaagaagucaaagauaaauauuagggaaaacuaugaaauuauaacuucuucaauaucacagagacuguccauuguucacugauuauuuuauggugcaucucagcuguauuuauauggaaaugggggcaggaagacugccuguaagaacuaugaugaccuaauacagucugggaccuuuaaggcuacuaauaagaauuguagauauugaaaaggaggaagaaaaauuauacagagauaaugcauuaguaaaggaaaagaccaaaguggcuuauauaccuuugguuaguuauuuaaauggaggcgggcaggagcucaggauuuguccugagguugccauuauaggcaagcauguagauuuuaacauauguugacuugguauugcuugugaugaagcuaaaggguuauaggaauguagcaaaauuaauccccacucuaagaugucccuugguaccaacauacuaagaacaucaaaguauuguacccaaagcggauggugcugacagagaaaagguguagucuccccucccccagccugaaaccugcuugcucagggguggagcuucccgcucaaucguucugccaugcccacugcuggaaccugccgcuuugcuguucggagcugugcacguggucacccugcuauuggaccccaagacuaauuggcgggaaucgggccccuuccccugcuuuauaacugcgugcggaacaguaaaauugagcuuugaucagaaugccugucuuagcuacauuucuuuaucucgccaccuagccccucuucucuuccagguuuccaaaaugccuuuccaggcuagaacccauguugugaucugcuggccggacacaacauuaaggcaguucaguuagaugggguucuugcauagaccuagagaucaucucuggcugaacauguaagacacuggcaacuuuacuuccgaagaaucuuaaugagagacuugguucuccucucuccagaucaaauguggcuaguuuguguccuaacucuaguuaaucagauaaguuacuaauaucuggcagugugcaaugaggagguugacccucugcacugggcagguuucucuaagaacuguguuacguggguaccaucauagcaucccaccaauagaaaagaaggccaaaguaaaagcauaacuuaauuguguaugcgugugugugugugugugugugugugugugugugugugcauacaugaguuuagauguggggguggaggucuuuggguuuacacagaacguaggaaauggcuaaggaggaacgagagagguccauuugaagacgcuuuauuguccaagugaggaagaaacugucagugcuaucagaaaugugugagagguuucaauuaaaccuuagucuuucaggaaggguguccucggcugcagagcaaugaugagaacagguuggagaaacuggacauggcagggaccccaaagcaacaguuuuagaaauguucuugguucucuggccagaaauaccagaagggagcccaaguuuuucccauauccccaaugaguaccccuacccagaggcuauagcuauacuugugggucgggaccagaacuccauuccagacacugauccccucugguggcugcuuuggagcagaaucuccagauuuucauggggaaaaugacuuacaucuguaccccgauuucaguccggcuccuaaaugacguuagaauuaccacuucagagggaacaauguugggguauaagcaguuaaaaaauagaaaaaaauauauggccaagaugucuuaaaauaauuaaucuguuuguugaauauuaacaguugaaaauauuaaaaucauguucuacagaaaggaaaagaaaagaaaagaaaagaaaagaaaagaagagaaaagaaaaccuuuuucuuaaguggagagcuaacuagucaggucccaucugagcaaagucaaugaacuggcuauggaccuacuucucugaaaugcagcacugcccuuaggaaggccaguccaucuuuagccauauuagagcggugggauaauuaucuguuuaaugagaugcuguaguuuuuuuccucccaguguuucagcuccuaauggagucucuuacagagcauagcuagcuacuuugcuuuguaagccugcccucuuuucugaauuacucaggaaaguguaccuucccuuugcuucauuguauuucuuuccuaagcaugcauuuccuaacccuuuagacugccguauucuuccucuaaagccaccccccucuucaccauguggcugccuacuggcuaaccucuaugcuggcuuaacucaaggagcauggcuuuuuauuugauuuuacuuuuccuccucuucccuuuucuucuccuuggggcagcugccaugauuuauagcuugcuugcccugggguaucuuucuuguagauuauaauaaguuguccucaagcuacaaaaaucaaaccaaacaaacaaaaacuugaugauuuaguagagccuuaagaauaaaauugauucuauaaauaguggggguaaagguagaaaguauauaguagaaacagcaaguacuccaaccagauuuagaaacuguauauguaaggguggaaugaggccuuaggcaugugauggaaucuaaucuaaagcuugagucuuuacuagggaaggcauggaagccaagccagauuggucucuaguugugaacucaugggaacggcuacauccagaaacccccagguugacacaauugugccuaaaguagaaucaucuuaagcccagaagcuuagcuuuugguagaguauucucuauuucagugguucuccguugaagguaacuuugucgccuggguccuuccaaaaugucuaguaacuuuuggucaagucucugagcacuacugccaucugguggguagcagucagagcugcuguuaaacuuacugcaggaauugaugcugucugggcccagagacccaaauuuuccuaccugaaagugcaaaguaauguucuuguuucuccaaccuuccaguauugugagggaauggaucaaguuaguaguaucuaaagaguuaagcuuauuuauguugcuuccugaaaccauaaaggagaucauuuugguccaucugauccaaugaugcccagaacagcuuuagaaauaaaaccuggucuaugacaccaaacauagggcacauaggaaacagauaaauuucucaaugaauuuuucuguccaccucauacauacuguauuauaguaauaaauaauuuacgaguuacagacuauuuuccuagaauguuaagguagaaaauauggagauggggagauguaauaaugagaacuuauuaaaacacaauuucuggcuggagagacagcucaacagccaagaacacauguuucacuccaagagggugaaccucaaaccugcugaggauaguauguauaaaaaggaaauucagacacuucauuuuuagguaccucccaugauagcuuucaacuauagucagaaccaggugggauaacuccccucuuguucacaacagagcuggccccuuccucaccagauaacaccuugucucaugacacuagguccuuaagcacaggcaccgcucuugugccaaaaagacauacuuauuuaccaauguaccuauuagcgaagccugcaucuaguuuaguuaggccugacuguaguccagugguucucauccuuuguaaugcugcaacccuuuauauaguuccucauguuguggcaacccacagccauaaaauuauuuagguuacuacuucauaacuguaauuuugcuauuguuauaaauccuaauguaaauaucugauauacaggauaucugaucugugacucuuaugucacucuugcgaaaggguaauuugaccccaaaaggggcaagaucuccagguugagaacuagaagcaugacacacauccuuugaauuggcagggggcucucuuaagcuacaaguuguagcuacugacuuuuccacuguaugggcauagaauacuauugugugcuugaaaugugaguagucauagacguugguaagucauauacuugacaauagaagugagguccgucaccacaucuuuuuauuggagguaggucauagcaguuaagaagguagcugggaguuacacggcgagucagaaguuuuguuugaagagagucauccuaagauugcgcuuuuggguuugaagaggaagggauauuucuucuucaggagaucuagggacagguggaagguagugagggagucugugauucaacuugccugaguaguuagguuuaugaauaugauuguuacagaaucuuaacaugcaugucagaaauuuuacucagggugcaagggaaauggguagauuugaaagacauuagcaaaguaagugaguuucuuuuuuuuuuucuuuguagcuagauguuauuaaguaaagcucuugaauguccauaaugaaggaccagucaccucaucuuaggguauuguagcuuugggucuuuuaauugaucccaucccuucaggaaucacaaggauuauuuucaguuuuguauacagcccugggauuuuaucuuuacucgaaauggcugauucaccugaauuggcaaaguucucuuguuucuuucaugaaaccccuaccuaauucugccugcuguuucaucuccugucagaucucuccucagaggcaaccacugugcucauaaaaccuccucagcauucaugaggcaacaugggcuaggaaaaauaguuucauucugagagacagaaaaauguugauugaauuucuugcucugcuguugcuaugcuguaaccuuaaugacacugagccacaauaaucaaauguagauuaugguauauacuuagggcuaaauguuuaguaaaugcaugaagauuaugaaauauaagauugauuaauguauucaauacaucaucaaugacagcuguauucaggguacaguugaguuuuuaaaaaaugucuuuguugaaagugcuucaagauguagucauacacaaugacuuucugaauacaaccccagugacucaggaaacagcagcaaggauugacaaaugugcaucuaauuaaaaagcuucuguguggcaaagaaauaaucaacagagugaagagacaggcuacagaauggaaauuagaaguucacuaauuauuuuuccucaaaugaaucuccuugucaaagggauuaauauguagagcauauaaagaauucaggaaauggauaccaaaaaaauucaccugagcaauaaaugagcaaaaaguuuucgaaagaaguacaaauggccaauaaguauaggcaaaggauguugacucuccuuggucauccuggaaaugcaagucacacuuagguugagauugcaucucacucuaguccagaauggcucucucuaaggccacaaacaaccacaaauguuggugaagauacauggggaaauggaacacguauucgcuguugaugagacuguagacuguacacaauagaauccauuguuuacacuaauuaaauguuucaaagucccagcuuccguggaucuuauauucuuuuagauaaccaauaaaaugaauaauuuuaucagacagcauccuguagugaaaaagcugggaagaagaaacaaucuggcauaggauagaguagacugagauaggauuuccuucagucugugaucuuugaacuguggccugaaugaagugacaaacagaaccaugggaauaucuggggaagcaggugggaaggugugagggaggacuuacagaugugaucccugcccaaggcgaagucacagaugugcucauucuccaacuuacugaacaugugcuggguuccuggucacauguuaucauuuuguucugaccauaccucaggagcccaacuuaaucggucgauguuguaucugaguccacugaucccucuaagaguaaauaaagaguaaacaacaaacugucuuuacuuuugucugcagcucacaacucgcagauggcaaccuggugacucuaagcaggccuaaaccugacuagcuucuagaugcagaaagagcaccccccacccccaauagggaguacugaggcaggaguucuugaaggccuggccccuguguaggucuaugacaggaccaugccaaaguaggacgagaggaacagcauccugcuugcauuugcuggcuugaugaacauccaaacuguguucccacccuguguuucaguuuuauuuuuuuaaaaacacuauuguuaaugaccaccuuuugggacuuguguguauuauaggaucaguguuagauguguagaguuaguggagugauuuuuuucaggguucagagagauugcucguguugugaagaaguuuuccuuuuacaaacauuggauuuccggcccugagaacaguucacagcuucuauuacacaauauguuccuugcuggcaucucuugucagccgugaccucaauuugcgguaucuuuacuacccaguuaccaguagggaaaaaaaaaaaaaaacaacucacaauuuuagggcaaaaagaaauggaaaggaaauacaguuguuccccuaauguacaguuuuggcuuuacaggguaagucuuguguuuuguauccagacacagaaugaggucuccuccuugcucuucuuucuauauagcagcuggaacaaaacaacaaacugucuuuucucuugugugggaauucuuccagcuuaauuuaaaguucucucggacagucacuuuucucacacuuuacaugguaaauuacuuuuccuucaucgcagugugagauugugucuuucuccaaaugcaaaacagccaaagaauuaagaacuuacaagggaacaaaaauacuugguaaagauccauggaaaggacuagaaggaggaaaggaagacaggagaccaaacaguauaucaagugcuccgaggaacaccugguucagauuacaaacuuauuacuuaauuggacacacacaacucgagcuuaaacauaacacaauucgucaaccacccauggcaguucuccaggcguuugugauuauguaaggcccuaaaaagaucauguggcuugucuccacgcucagauguaacugccccaggguuuucuuucuuuuaaagauguucuacagacagaaauucauaagcaaaguugccaucaagcauuuaugacacuuagcaauaauaaaaaaacaaauauuguauauaaagacuaauaauauaaagacauauauauguauauauuauguguguguguuuuaugguuugcaacuugaaagacauuauguuugacuugaguaauuaaaaauaaucugggacuaugauuuaagaaggucuucuuugagaacccaagagggagauucauuacaagcuaaacguaaauaggaaagacaggaaagcaauuauagacagugcuccuuauaguuuggcuacuucuuugaaaacuggaaacuugcuguauguccccuuaaaguuauugaaugucaagugauuuauucccauucuagccuuagugacucccauagaaauugaacauuaaaugugagaaagucuguguuccauuguccucacauguaguguggagucauacuugcuguuaccuuccuguccaaaccaugagcugggggguaaauuuauaaagacuaauugauaacacucauuuuaaugauuggaagaggcauccuuguuuucggaauaaaauucguuucuauuggggaaaaaaaaggaaaauauucauuguagaaaggaacuaauaauaaaacaugccugcauuuuucaucuugagaugaucaccauugauguucaagcaucucucuauauauuaauaaucacaggaugaaauuucauuugaugaauuuauauguaguauuguauuugacuccuuuaacauauaauuauuaucacuucauggccuuuugacuaagaucaaauauaaaauauaacugucauuuuugaccagucauaucuuccauacauauauuaaaucucauauauuagacacuuucuugacuaauuaacuuuuuagguuagcauacaaaauaagagauucaucauggaaucuucauacaugugcaucauuucacuuuguucucaauuuuuccuucccccagcuacuaugcaggauggaaaagggaguacuggggugcucccugcauaugugcagggagggagaacuacuagaucuggagaggagugaggaaggaaagaguacaccaaaccaaaaugguauaaaaugccacaagaaaaacuguucauuuauaugcuaauaaaagcacucaugcucgcacacacacuuuuuuuaauucauaaauuaaaaaagaacugcaaagaacugcaucaagucaggaagcagagagagagagagagagagagagagagagagagagagagagagagauugcuuauaccccuuucuucuauauauucagucauggaugccaccuagcaguauagugucaucaugucuagggugucccagaacccacguggugguugucaaccaccauaacuccaguuccaggggaaugucuguccucucaagccuccagcagcacccaagcaugcccauggugcaugagcauagaugcaggcaaaacacccacacacauauaagugaugaugcugaugugguaucucacagguacucaaaacuucauaaauauuuucucauaccucuugggaauauguuuugacuuucuuuuuaaaaauauuuuuucauucuuuuucuuugugugguuuuacagaguuaagauuuagggaguugguaaaaguuguuaguuuaggagguugguaacaaggauaauucauuuguaaguucugauuuucuuaaagaaagaaggucuuuuauuugauuuaguauauuugagugaaaauuaaagucccaacaguagauauugcaauuuuaaucagauuucauuuuucugguucacucauauaauaauaauuguuaaugauaucuuuaaguaaaauucaaaaauuaaaaaggauaaucacauuaaggguuaaagaaaauacugagguagcuggugcaugacaaacgcauccaguuaugagaauauguccacagucauugcuguuaagccugcaguggcucauuagcagagcacuaucgcaggccuuucacaaauucuuagacugaaugcuaaucuuuuuaggagucacaaggugugcacaaauuauccaauuuacauaaagcaugcaaagagagccuugugucaugaccaccacucauuguaaaccuccaguacuaacuugaauauuuccuguaacaaaaugaccaugucuuugaaguaauuaaauguuguaugucuuugaugucucuuuaaucuuucuucucugauuugauuacaagacccuuaaggaagagaauauuagaguuguuucuuuucuuuugauaaaauaaugacaugagaggcccauuaguuugagagacaaaaugcccaccauugcugaaaucuaauuuucaaauuuuuuuugucuagaucacaguggcaaauagaacucuguauagacagaaaggcuuuauagucuccgcuguuggcuacagcagccauuagcuacgggaggcuauggagcacuugcaaucuggcuagugcugcugcugggcugacuuuaaauccuauuaguuugauuuaagugaaacuuaagcagcuguaggugccuacuggccacucuaugggacauacagcauuucucuucaguuuuagauuuacucuggacauggaucugggaaugugagcauguacacacuugugugaauauggucuugccgucugcgaaugaagacaugaaucugggaucacugacuuuaauuugaaaugacuugacauaugucauaaacaguuuugaguacccacugaggcugugggccugggugucaggaauguuuccuuuggguuuccugcuauauccaagaacagguuuacuuucaccugugcuucaggcugugggagacccaucaugaacuuuccugggccgucaggguaagugcuacuguaacuggcuaugggcacuggcauuccuggacugaaccccuuguaggauggggcauagugaaauucccucaaaggcgugguguagauaguaaaacuaccugucauauaaucaagucucucagguugcucucugucuuaguucuccuaacagcaaguucuugguggaaaaauugaacacaucuccacagauacucaguccuuugcuccucuaugcuauaaugugacaacugcacacacugcaguauuuuaauacaugcguguauugaaguguuuugaugcauauauauauauauauaugaaugauuaucaccucacaagguuaucauguguguauucauguauguacaugugucuauuuguggguagaggccagaggccagccuugcuuguguugugcuucaggaaccaggaacugccugucuuucuuagagacauggccucucacuggcuuggagauuuucaauuaggcuauguuggcuggccagcgaaccccaggggucuaucuaucuuuaccuccccaacacugggauuacaagcaucuauccugacugauuggcuugcauguguucuaaggauaucaagcucagguccuuggaauuucauggaaugcacaucaccaacugagccaucucuccagccucaccauaucaaaugcaauauuauuaauucuagucacaugcugugcauuggaccccaagaacuuaucaucuaauugugggccuuugauguacauuuccauauuucucccauuccaaaccuuaguaguagcaacucucuaaucucaauuuauaugggaggucaugcaacaucaaauuguuguuuugugucugccuuauuucauguaaugcaacaucuuccagcuuuaucuacacuguaaacaauaauaguguaucuuucucuuguaaggcuuuguauaguccucauuuucaucaucuauucauuuuuauuuagacuuuauuccauaacauggcuguuguaaguacucuaaguauuauaaguaaguauacaguaaacaccaguuucuugguaugucuuuccuaugaugacuugauuuguuuugggucuguacugaggauuaagaaagugggaugacaugguaauucuauuucuaguuuuuguuuuauaaauaacuuucauucuguuuccuauggcagcuagagcaguuuacuucucaccaacaguauauaaggguucccccuuucucauaauuuuuuuugaacaaucaccuagguuuugacuuugauaguauguaccuagaaggugugaggugaugucacauugugguuuugauuuccauuuuucugauuagugauggugagcauuucuucccauaucugcuaccauuugcauguuuucuuuggcaaaaugucuagucauauccuucauccauuauuuuaauggaaaagcaacuugaaauagcaagaauauuuuacaaacuaagauaguguuuaauaugugaaacaaauauggaacugaugcaaaccaaaauacagaacccagacaaucugguuuuacaguagucaaaggaucaacuuuuucuucuguucuuuuuuuuuuuuaagguaucuuaucuucuggaagggggcagcauggcccaugaagacuuuuguggacauguugguaaaaugaacccaggagaccuacagguacugucaugacaggggauugcugauugguuaacagucuuagguuuuguguguacuuuuccaguacuuuaacccucucucccacuucucucucacucuaauaccacugauuucuccagucuuagcuucuuuucuguugcuauaacaaaauacaaaagcaucuuaaaggagaaagagcuguuuuuugguugacaguucaugguauuaccagcaaaaaacaggggugucuuuguugguuuucagucacauugauaaagaauuuaaaaacagacucagaaguagcauuuauaagugagaggaaaaccaacaguacaggcaagcugugaaacuuggcagcugccagaaagguggagguggagaagcugagagaaagucauguccuuuuaagugagggucucagaaagucagcguguucagcaguggagguuggcaaguagcugcuuguuggaaggggagaggagcgucagagaaagagagcaaaaguccagagaaagcaugcuuacgcuuuugguuauauccaaauaagagguagaaggaaaguaaaggcaagucauuuuggacuuggaauucagaaaguggguaaguagugaggaucuauaagcauuguacugagggaggggcuucucauuaucucauuaaggggauacuuaauuucuccaaucucuuuagccugacuuuuggugaauuagcuuucuuugagggcuagucucguggauaagugauuggcaggcccaaguggauuaguucugaagggaagaaaaccauuauguaauguucuuuaagacaaucagaaugccaugucuccauccaaggcgagggguagaacucaaaugccauucuuuugacaggacgguguagcuuucccuuaaugggucucaacaaaccucuaccuugucauauaguaucuuaaggugggacaugacuuaugcuuuucuuucugcaguauuaccaaggaaacagguguuugggguccaaagcugaccacaagggucucuucugaguuuuccaaggguacuaacagcagucuagcuacauaacaaagguauaguccaccauggcagggaaggcaaggcuccuagagcuugaagcagcuggucauaucacauuuauaaucagaaacagagagcaagagugcaugcuagugcucaccucauucuauugcauauaguucaggauccccugccuaaagaauaguccugcccugacucaagaugggcacuauccaucaguuaacacaauccaguugcccccuaacccccauagcaagugcagaggccugccucccaggcgaguccagauucugccaggcugagaacacuagccaucguagcccucuuuuaguggauucuucuauucuggcuggaagcuaacacagaucucuugaauguucucuucucauguuuuucuugaccccucaaucacucuguguguguguguguguguguguguguguguguguguguguguguuuugcuggggaucacaugaaaucuuccaaucuuuauuacacuucuuuguuuauuuguaugugugugcauauaaguacaugcuagagcacauggauagaugucagaggauaacguaugggaguuggcucucuccuucuaucagguggacucccuggauugaacccaaguugucaggcuuggaagccagugcuuuuuuacccccagagccaucucacugucccccaucagguuuuagugcuuaccuauucuucauuuuguuguuguuugguuugauucuacuuuucuccaaguguagucaagaguuacucucccaguugucauuucuuccccaauucacagaagucaugguugguuugucuguauccuccccuugagccuguauugaagcuguucaggaaguggucgcuuauggauagucucacuggcaaauucaguaguugaagaccauuucaauucagucuuucucaauuuauguucugcauuugcgacaauucauuacuuauguuucaguucauuugcaugguucaauguugucacuuagcacaauaacccaacguuaggcaagguggcacauacauuuuaucccagcacucagggcagaggcagguggaucucugugaguuugaagccaggcugguuuacauagugaguuucggcauagccaggguuagauaguaagaaccuauuugaaaaaaaaaaaaaaaaagagcccaaacucaaacuauguuccauauuacuuuuguguguaacacguuauaauuuaaaucccuuggaacugcuuagaucauuuuggucaguugugaagguaggagcucuauaucagaccauuuacauauuuucugggaugcaaaggacccguauuggaucauuguguuucaaagaaaauggaauuaaaaaaacaaaaacaagaggaaaaugcugucaugaaagcaaaaggaaacucccggcagagcagaacuggaaacggaguuaaccaugcuuuaucuaaaagguuaaucaagagaccgagaaaacgggagggggauuugaguuggauauuguuaagauacauuguauauauguaaaguuuuuaaagaacaauauguaaaaauacugauagaggaaguucuaguggaguaggaagaugcuuuuaaaauaggaagaggcccuugaggaacaucaauugcucuagcuguugucagacagaaaacacuggaucccuccauuagaagguucagguggccuuuucaaacagaguggaaagaaauguaguuagacucaaugaaguaaagaaaucuccaagccagguagugguuuucuuucagguccucagacuuaucuccagcugccgguuccuuuguauggacuucuccucccauuucuuucccauuguccaugcuuccuuuggguuucagccuaauggcugaacccucagguaaggcaacuugagccaccucauguaugcugguagaacucuuguuguucuucacaguaucaaccaagcacagggauaaugacacugauuaguuugaguagcuguguuaggguucuuuuucccucuccaagggcugggugaaagauagugcugauggaccucuucagaguucagguggugacaguuccuauguauccauacacagcaccccaucugugcauguauuguuggguuucucucagaggcucuuggucacuaauggaugccaaguggaaucuaaauauuuuaguagucccuggcuucuguacaauuauucugaaguuuaucuacaugguucccagugggccuaagcuccaggccccagagcuguaacuugcucaugaacacuccucuuugccuuuucccuuugcccuacuuccucuauuuugcuuucucuaucccuuuccaacuaaacacccugcgcggaaguccuuguuucauggucuuguaugggugaauccaagcuaaaacaagcagaaaauguaucuaucauguuccaacccugcauccucagugucuguggcuagugcuuggaacgggccuccagcaugcucucaaauauguaaacaaacaaacaaaccccacuugaacuaucugccuaacagccaaaggcaagaauugauucucucaguagugagggcuccauuacuguaauuguaugccuagagguacaagcuuaccauuucuagguuaggggauguuaagggcuuucccaugucugucuaucuagucucacauacacguuccucaucugauggacauguuagcugcucauugguacauuccucccugggaauuccacucugcgucaggaaauugacucucccaaaguuguguuuccuacucaggaacaauccugaucacucuuuacugauuucaaggcaauccucaagauuuaucccaacuccacaucucccuguuggguuggcuaggccuggaaucuaauugcguuguugccugccaucucucuuacccaguacugcuuuugugcccuucuuaggucaaaucauacuccaguacaaucuggcuacaacuccgcucaaccugaaacucaaguaucacagaggauucuuucccuuguacaaauuucaauucugauacucugauucaaaauaagggaggcuuagguaacuugaaagaaccgccgggaacugucauagacuuuuguuauuucuugagauguccaggcacucugaccacuguccuagauggauaugucccuuugccaugguguaguuguugugugcauagacuuguuagcagauguguuccauuugacuucuuguugguuugguguuugcaguggaugacugcaggacgaggcauucugcaugcugagaugcccugcucagaggagccagcucauggcuugcagcugugggugaauuugagacgcucagaaaagaugguggcgccucaguaccaggaacugaaaagugaagagaucccgaaacccaccaaagauggugugacaguugcugucauuucaggagaagccuugggaauaaagguaugucauaccuguugugugucucugaaaugugaaguauauggugacaucaggguagguguaucuucaucaucagcucucacugacuuuaucauauaugugucccaguggauagaguugcuucauagauauuagaauacauacaauuuaagggaacccagacauuuuuugcugugugcaaacucuuugaguuggaacacuuauaagaaauuaugcucauauaaagaauuugacugaaaagcaguuuucuaggcgugucuuaauauaugugcagauuuacccuauuucuuaacauuuguuaguccaauuuaauacuuugagucuuaacucuuugcuacugcaaaguuacugcuuuuaagagacaaacaaaaaaugggaccaaucucacuucauaaagauuuaugcaaaugauguaugucccacuuagugaacaagaaaagcauaugacaguauuacacaguuuuaagacaaaauuaacuguuugggcuggagagauggcucagcauuuaagagcacugacugcucuuugauucccaccacccacauugagacacagucaccuauaacuccagucucagagguucugaccccccucuucugacuuccauggguacccacacacaugcagacacaaaaauacaaaauaaaaucuuaaaaaaaauagcauuucacuuaacuuacauaggacauacacuguauauuuucuuucuacuguuuggguuagggucuugccccaaauaaaaucaauuuaggaaggagguacgacaaguauuguaguaauugccuaccagaacaauuuucugaggaggcaaaggauccacacagcaaccaguaggugguaauggugagcuuggucacaggaccuuggaggucguggugccuagaaguugacccugagaggcagacuccuguguacaugauuuuaaaggaaguacuccuaggaaacagugaagagaaccuggacaaaguaugaagggagcuaagcaagauaacugucucaggcaaagaccacaaaagcgcagcuuuaaccagaccucacuggggacucaggaucaucaugcgucagcauugguccugacccaccccagacaagacagcaagguuuucaugcucucuccuaaaggucauucauugguugauucuggaguguaggguaaaaguagccaagggaaucugguaaggggccuggagaugugacaucuagcacaucuagaauauuucaaacugcuuugcuguucgcccagugagcaacgagcaccuacaacuguuuucaccagcauuuuaucgguucuaucuguuuagcucugugccccauuuuuuaauuggguuguuugaguuguugaugucuaauuacuugaguucuuuauaaauuuuggauauuagccgucugucagauguaagguugaugaaaaucuuuucccaaucuauaggcugccguuuugucuuauugacaguguccuuugccuuacagaaacuuuucaguuucaugaggucccauuuaucaauuguugaucuuagagccuuagccauugguguucuguucaaggaguuuucuccuguaccaaugaguucaaggcuguuccacucuuucuguucuauuugauuuaguguugaggaccuugauccacauggaguugacuuuugugcagggugauaaauauggaucuauuuucauccuucuacaugcagauauccaguuagaccagcacaauuuguugaagaugcuuuguccccaccccacccccauuguauaguuugggcuuuuuuguaaaaaaucaagugucuauagguguguggguuuauuucugggucuucaauuuuauuccacugaucaacgugucuguuucuguacccauaccauguauuuuuuuuaucacuauuguucugcaucacauuagcuagcuuuauagagcccaggacuaccuuuccauguaaugguacugccugugggcugggcccuccuucaucaacuaacaaucaagacaaucucccucauaacugccuacccaccaaugugauccggacgguuccucaguugaacuucccuucuuggaugacucuaggcggugucaaguugauaguuucacuaacugugacauuugguguauuuugauuauauuaugugcaugugagaauuauggcuuaucaguggcuacuaaauaauuacucaaugacacacguugcauaauuaucagguaggcuuggauuguugucugggacccacuguuuguuuguuuacauuguuuuauuuuguuuacugugcauuauaagcacagcuuuggauugacauuugaacacauagguggauguuuguuuuuauuuguguuucuaguacacacaggaauaauugaaggggaaaacaguguuuacucuguagugcagcuggaaauggcuuuucuuuguguuucugugacuuaauuguuuuuguucaucaagccuggagucuuucuuuuucagcuuuuuuuuuuuuuuuugaaguuuccucuccauugugaagaggagauuuaagaccuugugagcucuucugauaaaaggccuagaccaucacuaaggugccccagacaagaacacaagugaaauuggcacauuuucucccuauguauuuuuuuucgucuauuaccuguuuccaggacucugaaguucuagggacguugagguagauguugaaggguaggagacgcccucugcauuucaaccaaagcacaagacuuugguugaaucuauuaaaauugucugggaaauuguauuuagaauacagaugugcugacacaugacugcaaucccagugucggguaggccgaagcagggggaaucaggaguuugagaccaggcugggauauauagugaaaaacuauccaaccuuauaugccaaaauaaugugucugucugcagaaaaaaaaaagagagagaaaucaaacuggugaguuacuaaguguacuggcugguuuugugugucaacuugacacaggcuggaguuaucacagagaaaggaguuucaagugaggaaaugccuccaugagauccagauggaaggcauuuucucaauaagcgaucaagggggaagggccucuuguggaugguaccauaccuggguaguagucuugguucuauaagagagcaagccgagcaagccaggggaagcaagucaguaaguaacaucccuccauggccucugcaucagcuccugcuuccugaccugcuugaguuccaguccugacuucuuuggugaugaacagcaguauggaaguguaagccaaauaaacccuuuccuccccaacuugcuucuuggucaugauguuugugcagaaauagaaaccccgacuaagacacuaaguaagcaaagcuagcaauuguccugcugugugucugccucacugcuggaaugcugagcacuguuggcauaccgcuggggaggcagaaugcaaucagacauaggggguuccagcccguauuuccccaggugagaacagugggaggcuggaacggaugcugugggucucaaucuccuguguacccauauaccgcuugggaccuugaggaguugagaaaagaacaguggucccuauaugccaggcaggaaaggggugacugaguccaagaugggguggaaucaagcuuaguucugagugagugcugaaaaugcugaggggcugaaagaaaaaaguccuucuccaggagauuuaggcaaggcuuuuuacaaggaaggccucccccaguggcaauccuugaugaaggagaugguccuugccugccuaaacugccuuauuuuuaugguggauaugaacauauuuguuuuacugagugugaaccagggauuaaauaccuucuucaggaaggcaugcccaggaagggaagcucauuggcuaaacauguguggccuaucuagcuagcccauuaacauggagagcucuagguuuuuaugcuacaagacugguuguccucucagguggugucaugguuacauguuccaggagaggauaggcagagcuugguccagcaccugcuauucucaauucugagauuccccaggguuuuugaacuuucuucaaccuuaccaguucuucugucugguggcacaguccaugugcccuacaagcaauaucauaaauucuuagcguuuucaaugguguuucauuuauagaaaagucaaggaaguuuugagguugaaguccauuccaguuauagacagaagggcauuuuaaagcacauccaagcugcagacuauaugauguugcaauuuuaaccaaggcuuagagaacagaaguaauguuuuaccuuugggaaaugccaugcugguagcugcuggccuugcuuauuucauuuuguugaauaaaauuucugaaauauauuauacucuccagaguaaauaaucggucuuuauuuugaaagcauuuauuuauuuauuuauuuauuuauuuauuuauuuaauguacauuguucugccugcauguaugccugcagagcagaagagggcgccagaucuaguuauagaugaucauagccaccaugugguugcugggaacugaacuaaggaccuguggaagagcagccagggcuuuggaagcauuuugauagaaccuauuggaaccuuccaaaguacugguuuucuagaagcauucugguccaugguuaccuguauggacagaccaggugacacaccucaccauguacuagauguaugggcuguguggucuuaaagaaaugaauugauuuuucaagacuuaguuuuguaaacacugcauaagugguagcuguugauauuauuuugauuguuuuaugucuaguuggauagaaauuggguaaauauuuaugugugcuaccaauacuaaagaauuucuuuugaaguuuggaaaagguaauuaaucugcugugaaguaaggacauaaauggucuagagcuaccauaaagauauaccaaagauaguucagcaucaagaagauucuuuggggacugcagagaccaugguuaaggacacaaacuucucuuacaaagggucugugcuugauuccuaguacccauaucagguggcuauaacuguuuguaacucuagcuccaugggaucugaugcccuauucuggucucugaggguaugugcacucacaugcacauguccacaugcaugcaugcaugccugcaugcacacauauaaaaaauuaaaauuaaaaaagauaacuaaacuagauacaagugaugcuaagaauauaccuuucaagaggucgaucuacuuauaaccaacauaggcucaccaacaacuucccuuccuauaacuaaucuauguagaaaauuuggugaccacugugaugcacuugacuuuaauauucauauggauugccugacagauuuggacaaaguggagauucuuauguagcagaucugcagcaguggggucugagauugcaagggucuaacgugcuucugggugguucagugcuguagcccaggaaccaaucuguaguuuguuaaugggcguggcauccaggccaggggaaugugcucauucuuaggaaguuugguuuggcucuuguagguaaugugaaaugguucaauccagugaguuuuagcaagccccacauaagcauuguggauuugaauauuuaugucuacaaaaacaaaugugaagagugcuuuguaagaugccauaagcuuuacaauuagcaaaaccaucuuuuuuauauacccaaagguaaccaugaccauuuuucccaggucguuugugucuaagcauuuauucagcccuugaaaugcuguagccaauuuugagcaagauucugccaggacaccacagucugaaguaaauguugaaaugggagagaagaaaaaugggaugguuugaauacuuucugucacuuuugaaaggacacaauugcauguuugcuucaugagaguaugcaauuuuccaaaccccauuccauccuuaucagccagccaauccacuauauuuauugccagcucuuuuuggaacacaauguuguucccccucgaugccucuauuugacuccugcugcucucuacauuccaugaugucagaaacaaaccuugaggaggucagagaaagacagucuagagccagauggccaggguucaaggcuagcuccacuacugaaacacguugagaacuuauuuaagcuggcugaaccucaguuuucuaaacuguaaaauggagauggucaugauaccuacuuagagagucuuuuaggaggaauaaguugaauauauacuccauauguguguguguguugacaaagcccuauauggaaguccuauauaguccuguacaugcuguuuucaugccuuuuauaagccuguagacaauguuaaaguggauuacauauacaacauacucucuguuugaaugggcaaacuuggugaucaugggcuggaugacucuaccuguuaccaaaagaauuugccauuuaccuaacauaauucacuccaaucauuuugcauucuccaaucauuuugcauucugaggaaauuugaguucuuggauucuauucugugccuuugcaugaagcucuucccuaaagcuuugccugccugagcugcccucgauccccuuagugauguggacaguguuguuccuccauggaagcugccccuucuuucccaagcucaaaagaauaaguuuaccaaguagcauuuuaggaacuauuauacauugaagauggauaucauaugcaugcuuuuguuguuguuuuguuuauuuguuuguuuugccuuucaauuccagcaaguucauggagauagccugacaaauacucucuuccuggcagggguuaggugggaaaguagguuucugacacagggagccugacagaacaagcuccagcuggccuagagagcaagcaaaggagagaugcucaggaagugauccucgcuccgacccuguagguauguuuuauaaaccagaacucuguuacaacuuagcaaaucugugacucuagaucuguagguauuuaacaaacauucccuuugggcugaaaguggguagauaaacuuuagauuguucucuggguuuuguuuuguuuuguuuuuuaaauauggguguguuuacauauuuagaaugccauguuaaauuggaaaaggauaugugugagagaaaugagcagaaacaaaugaagaaccuaaagacaacaugaagaugucaggaguauaacaaaauagagaaggacuuagaaucuuuaaagagcuucuaaacauaauugccuggcuguagaugugcuuacaguuugaaggcaaaaagaauuuuuuucaauuucaagauuugaaguuuuauuguguacuuuuauuguuuauguucauauuauacaucaauacauuguauauauuuauuauauuuauuauuauuauuaaaacaugcuuccacuuguuaaugucuuagaagugaagauuuucaguauaagaaaaauggauacaaauguaaacaaacuaagaaaauaguauacuauccaaugucaaauuaagcaucaaauagacauuuaaaaagcagaugucuaccuuugagcaguuucuggaaaccuaauauaauuuaucacuuuaguaaucuaagacuguuacguuaaaagauuauuuauuuauuuuugauuauguguaugcaugugugucuguagggaggcgugugagagcggggggggcgggguccauggagaacaaaaaaggggaucagauccucuggagcuggagcuacaggaaguugugagcuucuugacaugggggcuugggaacugaauuugugcucuaugcaagagcaguacuuguucuuaacuccugagccaccuuuccagcccuggcguuuucucuuuuuuccuguuacauagcccaagcuuaucuugaacuuuucauucuuuuaccucagguacccagugccaugaaugacuacaccuggccuggcuuuacuaaucucaaucaaucaaucaaucaaucaaccaaucaauggaucaaucaaacccauccucacugcucuggaacuucaaccuagagccuuauuuuugagcgcucuacaauacuaccagcuccccaugacuuuuaguggugcaagguuucauuuugcuaacuguuuguauuagcuuuuauuuacaaugauuuuuccuuuaggguguaacacaauuagauagaugguaugauaauuucuuuaaaaugcuaccuuuaaaaagaucacaaucacaauauugaauuaugguugaguuucucuucugaaaauguaacgaaguguauugucauggguagguuggggaagagaugaaaagaauuacucuaaugaggcagagagcuuccugggauucuguugacacagaaaacaugagggaacaugauacuagggagaaacauugaagugugcuauagaaaauggaguuuagacgcucaguauuuucuucugcucgcuacugcucaucaagaacaaacucagaauuaucccuuuucauguagccuugccagcugcuauagacuaagaagcaucuugacuucuguccagauccccacagcugucccaucuucacaacucagaacaguuuuggauauuucaguuacaucucccauuucucucuucauucagucauuagguaccuacuuugugcacauuguauauguuagagauaugaugugaaugagauauagccacuagcuucaaaagcccucauaguuuaggguacagaaagaaaccaacaacaucaguaguguaauaugacaggagaaacaaugaaaaugaccauacauaaaaguucuaugauuagccagaaaaaaagaggaguaauucugcuuauguggauagauggagagagggaggagaacagaaaggguagggauuuugugucuuacaguggcuuguauaaaaggcuuagauaugggcuggguauauaucucaauacaugugcuugaaguguaaguauucgaacucaaauccaaccuccaaaccucacauuuauaaaaaagcugggcauaguguuacauuccuguaaucccagaacuggggaggaggagacaagcugaucucugguucucacuggucaaccagucuggucuauuuggaaaaccucgagucccggugagagauucugucucaagaaagauucugucccaagaaauaagguagaugauaucugaggagaaaugacacccgagacugaucucuggcccccagaagcacacauuugugugugcauucuccacauaugugaacuugugugcaaauauacaaaaauaaaaauuaggguuaagaaaguaaaauggaaaauugcuuuggaaaguaauaggggcuacauaggcaaccagguauugguggaguugugagaguugugaaugggaaagaaaggagaugaucuaaauaaaauacuguaauggagggaaauucaaaaguaaguuugaguaagacugcauuguuccuaagacugacauuaacuguaugugguucuguauccuucucucccauuguucuauaugguugggagaaugaucuaugauggccauaguuugguuuugaaugagugagcuuauuaagcauauuucaagcaaaagaauaauaacaauagauagcaaaacauuaucaaguugauggauuggccagucaaagcuucuggcagaaauugacuguggaaagccccauugaggcaucuagcugguguucuccauagagucucagacagugcagaugaaacuucugagucuaagaacaaagggcaacguagagcuaaugucaucgaacuggaugcucucaaaauccacuagaaccugcugaauuccagauuggauucuccuuccauggaugaggcuuccauaguugaauuuuuuggccucucuuuccaauuguagacacuuauauaucauggaauaaacaauaguaaccucuguuggaggucauuuaacuccuagcuuuucucaaggacacagugauuuuaauaccauuaacugcuuacuauuuuucccucucuguaucacagggccagcuugacucaagauggggcaggguuggaggacauuugauauaacacgcuuuugauguuguggggaagagcugcuuccagagauaguuucucggugaccucaaacagugcaagacaauuuaucaauacaauauaugccacuuucagaguuuauuugaauagcuggccuugagguucagaugggugugguccucagcacacucuguguaccagcaucucauuucugauaccaugaagcuauuuguucuacgggagcugccucaaauaggccagguggucccaacugauacucagccucauuucacagagaagcgaacacuuggcuuugauuugguguugagaauagguaaaauuaggcugccaguauuuuuaguaaaaagaggacaccaaagauaugcacccaacaacuucaaagagcuugaccuaugguaggcagccauaguuggcacuucauuuggaguuaggaauguucaaauaaacaguggucaagaucuguucaaaucagcuguacaaaagguuacucuugcccagggcagcccgaucaccccagaaauaccauugucgguguacacuaagggugccagauguucuuauuucuucaagaugucccugcugccuaaucaccuaggaaguacauuccaucuuuucugacaagcccuagccugccaacaacagaagaacggauaggggcauuuaaagucagaaguuacauucuauagcauucauauagccuucuauauauauauucuauagcauucauauagccuuggccuuacuggugacgcuuacgaauuuucagggaaauuuagacuaaaaugcuaaugcaagcuaucaagaaccaagguauuacguuuuguaaaggcaaguuagcauuucauugcccucacucggauggcugccaagacuugcauuuuuaaaauguaaugagucuuuccucaggaacauauuaaauauauuuuaacuaaaggcaaaaauaaagggcagcuucacaaugugucuucagacuccugcaugaggcauuaaaaucugaggcucaugacaugauaacaugcuaaggaaauagcuauaaauacagcacuucaucuugaccggagcacauucuuaauuguuugauaaacuuauauuaaaugugauuagucagaucagugccagauauaaugauuuuugcuugaagcauuagacuuuaaugauauguuguuuauaucucaauuaaucuuaaaaauaaucuauuacuaaugauagggaauaaguaauacaaauagcuuaaaauucuaacugaaaugugcuguaaggcaugaaauugcuacuguauuuuuagaaggaggagaauguuuugguuagaaaacuauagagaauucuuuuccacauauacugcaaauccaaggccauugucuuagcuuagaaagaugagauggggaaaaagaacacacuugccauuccuggaaggucuuccaaaaucauccauggaaaaugaaaaggauuugccagaaaaaaaaaauaccauuaacucaccugagcccagcuaacauguacugugggccaucuguaugagacuugucaagguauggagagagugggagggagaguguaaagucguaugggagggccagacacaucagcuggagagaugagugugcugugaugagcuugcagacuagugaaugugguaagcucaugggaaggcagaguaggaggcucaguccaaugaaagggucaagcaaugcaggaccaagccuaaaagagagaacuaaccuggcaaaugagugugagaggggccagggagauggcucagucuguaaagggcuugcuguacaaacacgaggagcuaaguuugauccccucaauagaaaagaaaaacaagcaaacaaaguggucauggacuggaaagguggaucagcagucaagagucccauguuaggaggcucacagccauuugcaaguccagcuccagggguguugcacaacaccuuuccacaguuaacaugagucuucgaaagaaaugccccuguaaugugagcacugggaagguggagacaggagggucugaaucagugagcucuaguuucagugagaauucuuucucagaaaauaaggugaaaugcaguuaaggaagucauccagucuugaccucuggcgucuacauucauguuuagacauccacauugucaccaagcuggaaacacacacacacaugaaaacacacauguacauacauguauaugcugacaagaagcauaggaaacagcacaauuaaggaugcucgcugacaccauugcacacacuagcaagauuuugcugaaaggacccagauagagcucugucuugugagacuaugccggggccuagcaaacacagaagugaaugcucacagucagcuauuggauggaucacagggcccccaaauggaggagcuagagaaaguacccaaggagcuaaagggaucugcaacccuauacauggaacaacauuaugaacuaaauaauaccccugagcuuuugacucuagcugcauauguaucaugucggccaucacuggaaagagaggcccauuggacuugcaaacuuuauaugccccaguaaaggggaaugccggggccaaaaagugggaguggguggguuggggagugggggggaggguaugggggacuuuugggauagcauuggaaauguaaaugaggaaaauaccuaauaaaaaaaaggaugcuucuaugccauggugugaggcaguguuaaacuaauguucagaacacacauucguugucucaagcaugaaaacuggucagguuaucaucuuuuuuuuucccuguaaaacugcuuggcagcuuguuuucaugugugugagggccuuucauguugagacuauagcuguuccacauggagugcagucuuaguugauuaauaucuagcuuguccaggaucauugggaaagugaccaauuauaauuugacuuucuuuagaaauucuaaaagcccuuguucucuuuccuuauagacagucaggauuaacauuaugaaaggaaaucaugauggucauaaagguuuuuuuuuuacccccgcccccccccugggucaacuauagauaguaacucaaaagaucucaauguuucucuuugaagaaaaccaaucugaaguccacaacaaggaucuuuucccuaaaaccuucaagcaccugcaucugguuaguguuagucucaucuuuacucucugacaugaaggcuggcuccaucauccugaccucuuuccaugcuucucuaauuacaaauaaguguuccacaagaaagaggaagagcuggguuguggaaaggaggaauaaaaauagccaaucauuucugggucuccccauccuuuuggcacaagguuuucuuuuucuuucuucuuuuuuuuucuguucuguucuguucuguucuguucuccccuuccccuccccucccuucccccccuguacugaauuugaaaucccuacauaaccaaggaagagcucaagcuccuauccccugccacaccacaucucacuuugugcauguuuggguuacuaguauccaguaauacauccauuuuuaugcuaugcuuggaauuaguccuugcuaggcaagcacucuaucaauugagcuacauauucaguaaauuaggggucuuacagacugucucacuccauccucaccaaugggcuuucugccaauuaugucuuuuuggaugccuucuucuuccaauuagcuucccuuucuggcaguggcaugucugccugucagaaaucaguacuugccaacauugcuuucuaucaugagagacuucgaaugucuuggacuaacuaacaaaacuuggcugagauacugauuugaagccaucugguacuuaucagucuaaaagaggguuugagcaagaguuucuggugagugucacuagauauuugccuugauuuuaacuggcagauuaguugucagccagguaaaagaagugcauugacaaggggcuggaauuugauagaugucaaauacagauugcugaagagaccaaaagaggauacuugcuuccuucaucuucugaguuuagaaugaguuaagacauaaacugagaaaauaaugacacggggaugcaaacaccaucccccccuuccagucuaauguggacaagaguguaggcuugagucuaaggcuuugguggguuuauuacuuccucuccgcugauaauaauacaggacaugagguucucauagauagaugagaaccaugucccuugguguuauggucugugaucuacuaccaauucagucaaucccauacaaucaaggagagaagagggaggaaaggagagaggggggaagaaagaaaguaagaauuggugucugcuuuuuaaguggucuguguagauuuguauggcugggaagauucuaaggagaccuaacacaugugaaaaauuggauugccacguuaccaaaacuauaccuagaauuacagagccaauuggccaaugucaugauagacucaaaugacuauagauuguguguucagaccucaucucugccauuuuaguauaucuguaacacaaaagaaaaacauuuuaaaugauuuucagccuuuaauucuucagcuuccaaguagaaaugcuauuacauagccccugaauuauuugaaugcagcagcacagaguguauuuacuaaauauuggcuuuccucccucuuaucuaugacuuccugcucccauauuuccuuaucacaaggcauuucauagugacagacuuuauugugaagucuuuugaacuucuugacaagugaacugaaaauggcuagcaaccuuaauggguuuaugaaguacaaaggucuaaaucagaccuuauaaugaaagccuacaacuuaagaauuuccuauuuuuuuuuuuuuggaaauuuaccaagaagcuauuugcauuuaauagcugcuagaaauggaaaaucuauuuacuccaaucaacuggcaggcccugugcccaggaguaguuggcuaacacaaaggggaugauuccauauuucuguggaccuuuuuuuuugagggugggguauuuucggucuuacugguuuuuuguuuuguuuugauuuuuauauauuuauauagagaggaagaccaugaugaaguugguuggguggggaugugggggacgaucugggaggagcuaagggaggggaaagaauaugaucaaaauagacuguaugaaaaacuuuuuaagcuggaaagaacccagaugucccucaacagaagaauggauacagaaaaugugguacaugaaaaugugguacauuuacacaauggaguacuacucagcuauuaaaaagaaugaauuuauaaaauuccuaggcaaauggauggaccuggagggcaucauccugagugacguaacccaaucagaaaagaacucacaugauauguacucacugauaaguggauauuagcccagaaacuuagaauacccaagguacaagauacaauuugcaaaacacaugaaacugaagaagaacgaagaccaaaguguggacacuuugccccuucuuagaauugagaacaaaacacccauggaaagaguuacugagacaaaguuuggagcugagacgaaaggauggaccaucuagagacugccauacccgaggauccaucccauaaucagccuccaaacgcugacaccauugcauacacuagcaagauuuugcugaaaggacccugauauagcuaucucuugugaggcuaugccggggccuagcaaacacagaaguggaugcucacagucagcuauuggauggaucacagggcccccaauggaggagcuagagaaaauucccaaggagcuaaagggaucugcaacccuauaggugcaacaagaauaugaacuaaccaguagcucgugccucuagcugcauauauaucagaagauggccuaguuggccaucaguggaaagagaggcccauuggucuuacaaacuuuauaugccucaguacaggggaacgccagggccaagaagugggaguggguggguaggggagugugggggguaugggggacuuuugggauaguauuggaaauguaaaugaagaaaauaccuaauuuuaaaaaaaggaaaaaaaaaagacuuggaggauaauguuaaaguauaagccaccucuccacguuuaaaauaaaaugucauaucaaauuuaauauuugaguaauauauuauacauauauauccuuguucuuugaaucucaucuugauacuuuaaaaaaucgcaucuguauuucuuuuuuaaaauuuaauuuaauuuuuaauuuuuuuacacuccauauuccauuauccaccccucauccccccuccaacuguuccacaucccacaccuccuccccaccccaccccaucuccacguggacacccccacaccccaccugacaucuaaacucccuggggccuccagucccuugagaguuaggugcaucaucucugaaugaacacagaucuggaaguccucugcuguauguguguugggggccucuuaucagcuggugugugcugucugguuggugguccaguguuugagaguucuuggagguacagauuaauugauacugcugguccuccuacagggucacccuucuccucagguucuuucagccuucccuaauucaacaacaguggucagcugcuucuguccauugguugggugcaaauaucugcaucugacucuuucagcugccuguugggucuuacagacggcaauuaugauagaucccuuuuugggagcacuccauagccucaguaauagugucaggccuugggaccuccccuucagcuggaucccacuuagggccugucucuggaccuucuuuuccucaggcuccucuccauuuccguucuuguaauucuuucagacaggaacaauuaugagucagagaugugacugugggauggcaaccccaucccucacucgaugccuugucuuccugcuggaggugggcucuauaaguucccucucccuacuauugggcauuucaacuaaggucccucccuuugaguccuggaagucucucaucucccaggucucugguguauucuggaggguccccccaaccuucuauuuccugagguugccuguuugcauucuuucugcuggcccucagggcuucauuccuuuuugcucacccaauaccagaucaggucaccucuccucuccacucccuucccugccauguccacuuucccucccaggucccucccucucuccccacuugugauugcuuucuucucucucccaagugagacugaggcauccucacuugggcacuuuagcuuguugaccuuuuugaguucuguggacuguuucuuguguauucugcacuuuuuuuuggcuaauauuucuuaucauaagcaauguuacaacuacuaacccaguaauaaauccuuuauuuggguuguaaaucucuacuugggacauuuuuuuagaaauaccaucauaagcucaagggaucugaguauuuuaauacucaguguagccugccacaucucaugugcucaauagacauacauggcuaaguggcaacuguguuggaugcugguguccugaauacuuuuuauuaucaggucuuuugaucuugcuuuuacuuaaguucuuuggaaaacagagacguaaacaagucuuagguguacuuuguccuaguucucuuucuuucuuuuuuucuuuuaauuuuuuuuauuaauuagguguuuucuucauuuacauuuccaaugcuaccccauaaguccuccaaacccucccccuaguucucuuucuguuucugugauaaaacauuaugacugaaagcaaguuggggaagcaaggguuuuugucugcucauguauccugauuacaguccaucaccaaggaaagccaggacaggaacucauggaaagaaccuagaggcaggaacugaaguacaggcuaugaaggaacacugcuugcucuccaggcucccauuucuuucuuuuacuucucaggacuuccugcccaaaggugacacuguccucagugggcuggauccucccacaccaauuauaaauuaagaacauucuccauagacuuaccuacagcccaaucuaauuuaggcaucuucucaaguaagguccaucuucuucaaugacucucuuuugcauaaaauugacaaaacuaaccuaacuaauacacacuuccagggcagugugaguaaggaagaaaggaagugagacagagacagcuauauaaaaugccuauuuauaaacagugucucagaacuuuguaaaggugugagaacacaaaauguaacuguucguucacaccuuucaaucccuuuuggucacugauuggccuguugaggaauggggagucuuugcucuucugaucuguauucccuaccccuaucugguagcuucugaagagaccacaaaccacaccuugugguuuagcucuucaccuaaaucuuggugugaaagaauuaagaacgucaguaaguuagucaggucaaggagcugccauggcuuucaccacugcaagggcgauugagguuaucagaaauuagggguaacgagggaggaaccauaugagugaauggcaauaguugcaccacaguaguggcagcaaccaagggcccagaaguacugaagcugagagacccagcugagacacaccauguguucauuccuauucuuuccacaugacaaggugggauacugacagguuagcagccugcucaggguugcuuauggaguggauaguagauugugaauuuuaacuauccagccuuguuugagagccugaccaugagcuuacaauggguccuuaccccaauaccaaucagauuuuuagcuaaguguacaccucagcugcuguggaaacuuuaaagauaaccuuggagcgaagaugauuguugaagggcucagagggggggaaaaaaacaaccuuaauccaugugaaucuguguuaaguggccaagcacuuccuacuugauugagaauuuaugagcagcuuccacagguuccaucuauuuggcauauuugguaaguagguuucaguuuguuugagauguugcugaauaaccgaaaauuugcacuguauauuugauaguuuuggaagugauugaaaugguucuuucauuuugaauggguuggugugguaaguuuggggauccggugauuggucaaggaagagagucaccuucaugauagguagcaacacagagaaucaauuugggaauuacuugggcaggguuaugugaggagggaacuucuuuccagcugaaaaccuuccagggacaguggcaugaggaaauacgaaaagagaauuccugaauaagugaugaaaagcuguaagaggacuuagguggccaagugauguccagucaggcagaacaucuggaugugaaguuuuacagcaguuugaggcuuuagagcaauggguacacuguuggucuugcuacuugcuagcaguuguugggugcacuuuggccagaagauccuggggauagcugugcugcauagcauauaaaauagguagguuccagaugguugaaaaugcuuuaaagcuauuugacauuucagaauuugaguuuggcaccaguguguauugggcuaauggucuuagcuugcuguagagagcuaaacaacaugggaugucauuucgccuaauguacagagggccacugcugccccauuuguaugauagcugaauaggaacauguccauucauucagcuucaccauuguuguaauagagcauuagagaauuugaaugaacucauggcagcagaucuaaaauuccugauccaguuugaugcuucucaaagcuagccaaguccuauucuuccaucuucuuguaaccguuuaauuugaauccaaaugccaggcauuacuguguggaugacaaagcuauaauccagccaggcacaaagcguucccaaggaucacacagcucuuugcacaaaggccuugacuucauaccaagguuccugaaucuugccucauuucaugugaaccuuucucucugugucacaucguucaacucuugugcauaaauuuguuggacauggcuacuuuuagcuaauuuucauguuacaaagcuuaaagcuuuaagauccuucuccuauaugaaaaaugguaccuuucaucagauauuugcauccacuucuguguguguccgaauguccugcaaacaaucacagaggagaagacuugucccaugaugcauuuccucuuuaucauacaaugaaaucuuauccuugccaaauaguuucucauguuagaucuugaugcacuuucuugcaagaacucuuaaaauauuuuaguaaauaccaaauggagccaauacagauuaaaaauaucauaaugccccguaaggaauauuuuagcauuguguaauagauuugcugacucaauuuuagaacuuauugccucuggacuagagacaaagaauaggaaggcuccuuguuggcagauauagaggcuguuuguggucucacuuuuauugggcuauguauuuuuuuuaaagaaaauggaguuuuuucucuuugucuuggauuaaauauccaagaugugggacaucugcauccuuaugggaaggauacagacucaaagggugaagaaaucaaacuccaguuucacugugacccuguuaccaguuaacuuucaggucucugaguuucaucagcaucuucacucucauugccuuuaguccuccucuccuugcucccucucccauaaacaaaaggcaggaaaaggaaauagaguguuacuguuaauuaaagggcugcuuggaagaugauucuauggaaacuacaccgaaagauaauuucacuguguccaaaauucucugacaguuaagaaacucaaugcucaauccugucugcaucuuuuauuguccauagaggucacacugcuuucugacccuucucaacuccuacacugcacagaggcauugacguguagucuaagagcuccuagucuucucucuauguagcgauucauguaaucauccaaauaagauuacaggguuuuaguuugucccacauuauuuugacagugaggauagaaauuaaucuguccugcuucuuaucugaaguuguucaacauaaucaagaauucaaaaaauuagagugcuuuagguuagagacagaagacaucauuuuauuaaagaucauuggucuagucuaaaguuaggagucugcuauaaauacgguggaaaaucuacuuuuaaauuccucacaccuuggaaggcauggcucuccauguggaugcauggaaaggugucugagaggaaacagaggagcuuggacagccacaagagagauguacaacaugauucuaggagcucuugggugcuaaaugacuuucuguuagauggaaccccugagccaguugauaaacaccuggguuuccccacugagacguucccauuuugccagcagagaaagauugagccaaguguaccuagaaauguaaugacuggaauauauuacagauugucagcugaggauguagcuccaugcuagagaucuggccuaguguguacaaggcugaguugaagccuuagcaccgaugagagaagagcaguaaaagaggaaagcgguuauagguccuccaucaguguucuuuugcaagaaagaauuaauagauagccagaaaaagcaauaugcuagugaguacacaguuucuuaaaaaggaaauauggggcuggagcgaucucucagcaguuaaaagcacuggcugcuuucagaggacccagguuugauucccaguaccuccaugguugcuugcaaucaucucuaauuccaguuccaggggagacagugcucuacucugcccuguucagauaccagguauacauguggugcacauacauagguggaggcaaaaaaaauaugcaaaguaaaaaaaaaagaaagguuuguuuuguuuaaaaagggaaagccaaguggccuaacucacauauaauaaguccccauucagcaccugguacucagguacauauaauaugaacauauagaauauauguucaauauauuaauuauuauucuuucuuuuuuuuugagacaggguuucucuguguagcccuggcuguccuggaacucacucuguagaccaggcuggccucgaacucagaaauccgccugccucugccuccuaagugcugggauuaaaggugugagccaccacgcccagcaauuauuauucuuauaauaacaauauuuaguauucuuugcuaaauugauaauauuaugcaaacuaagugucaaauugaaaaaguaugguaauaccaauuuuugcuucuuaaaugaagugaaagcuaagauagucaacuguuuuuacaggcguuuccuaagugacuugauaaaagagaauuuaguuggaagcaagccaguuacuguaagaaauuaacguacugauguuuugucccaguaaagaaauauagauuuguacuauagagacauugccuuuaggcucguucuuuucuguuacucuuacaugcccgcauacacacuuuucaaaaguuuuaggcagguuaguuuguuuuuauguuuuuccucauuagcaauuaauucuucuccuuagugucuauaaugaggggaauauauaaauguccaaauagggaauugauuagaauauguaaccuuguaacagcagaguagauguaaaaacuaugguguuucaaaccugcucugaaguguagcaaaaauuauagagcugagaaaagacacugacaagcaguguauacuuucagaggaaaaacaaaacaaaacaaugucuaaccaaauaauuauguuaacaaauuuguuuuggguugugguaauuuucacccauaagggaaccagcaagaaacauggcuagagguuuacaguaauauucauguuaagcucacaaguuacacacacacacacacacacacacaccacccacaaaacacaauaggcagcacucggagguggccuaauaggauaaugacagcauagaagcuaacaacucugcuugcuuuucuuacagagcacugggauugcuauucccucauggagcgccuuagacuaauucacuuccuugggcuauuauagucaauuggugaaguugacgcuuaaaaaaaaaaaaaaaccucacaaaacagcucccugaaagaaauaugguguguuuacacaucuugugugccacuagaucucugacacuuguuuuccguggcacacagcauggugggagaaggagcaaaccucaggaauauaaacagacaaccuucaucuguggcaggaacaguaguaaaauggaagauacuucagguugccccagucaccgagagaaauguagcagucucucuguccugggaaaaugguuuuaagcauauggguuccauaugggagcaauuuccaucuccuaauuaagagcagauuuauaaauaaaagaagaggaaggaagccagccugucaagggcgugaaaccaaaagucaggguaacugggaaggcuuugaagaaaugaagguaguuggcuuuuggaaggaagugguuucauaggccuuauuuugucuugaauguuuagagaucauuauaggaguguugccugagacucauuagggcuuuaaugcugacuuguuucuagagaaauagagaccagccccaaccacugaauuggcaguggcuaggaaaauguacccuuaaucucuuaugaugcauugcuuaucuucuugaaacuugauugcauggcucccaaacaauaagauuuuaaggaauacaagcuuaaaacacuuucgagcauuuugcaaacauuuccaauagagaauuaugacaugaaaagaaaggaggaggaaaaauagcuuuggaauucugugccuucaugggcacugguaauugaaaccaaaaacaaacaaauaaacaaaacucaacaaccagaaaaagagguaaaauaaaauaauuucauugcugaaauuuaaguucauuuggcaagucuguacuaaaauuuguugagggauuguguuuuucaguuuaucacagacacacagccaauguuuaguuuuaaugagagagaauaugauauagauaaguccucauuauuugaguaacuauucauacuuuaauguacauaaagauacacaaacacagaagggaaggauacaauguaccuauugguaugcaauaaaaguaguaaauccagacuuucucaaagugcauuugacauugacauuauugucuuggaguugaauaaacacaauuuauaucugcuacuucaacugaauucccagagagacgagacaguaaaaaaucaaaaucuucuugcuuuucaaacaaaaacaacaaaaaauaaaaccuguauuuuguguguguguguguguguguguguacugaaaugaaaacuuaagguuucuuuggaaaaucaguuggauggugcuuugcuggggcaaacaagugaagggguguuuuccugagguaggauacaggugaaaagcuaaggcagacuugugaaggaacguuuggcugaagcagacaugaaagaaaggauguucuacuaacgcaaacgugugaaaggacucgugauaaaagauucuuucccaacagcacccauguauuggucugccuuacauuguguaguugagcuucauuugucaggauuccauacaaaccaaaaccuucugguggugugcugcaguuucuugcugcuuccucggacucuggcugacugacagagagaugucagcugagacagaugcaugugcugaggcaagacccguggaggacacgugauguuuggagagcuauaaauaggacuugaugaacagugacagagauugagcuuggcuuucugguagagcuagcuagcuuguuggucucucugaucuucacucugcugagagaaauauauccuggaacguuuccccguguuccuccuuggucccucuugcuaacuugugcugaggcugaugccuagcugucucugcuaggucaugucacugcucuugccaaccugacucugcugaacuggacugcugguguauccauuaaguguucaagcugccacagcuaaucugugaacugagcuguugauuucgagacaacacagauaggauuugcuucaaagaaccuuucuaaacagguccacuuucccucauauccuuucuuucccaauacuucuggugggugguagacuagaaaggagguuaaaguguuuaagaacaaucaaaaaauaaggcuuaacauuugacaagauccaacacccauucaugauaaaagucuuggaaagaucaggaauucaaggcccauaccuaaacaugauaaaagcaaucuacagcaaaccaguagccaacaucaaauuaaauggagagaagcuggaagcaauccgacuaaaaucagggaauagacaaggcugcccacuuucucccuaccuuuucaacauaguauuugaaguauuagagcaauucgacaacaaaaggagaucaaggggauacaaauuggaaaagaggaagucaaaauaucacuuuuugcagaugauaugauaguauauauauauauauauauauauauauauauauauauauauauauauauaugugacccuaaaaauuccaccagagaacuccuaaaccugauaaacagcuucggugaaguagcuggauauaaaauuaacucaaacaagucaauggccuuucucuacacaaagaauaaacaggcugagaaagaaauuagguaaacaacacccuucucaauagucacaaauaauauaaaauaucuuggcgugacucuaacuaaggaagugaaagaucuguaugauaaaaacuucaagucucugaagaaagaaauuaaagaagaucucagaagauggaaagaucucccaugcucauggauuggcaggaucaacauuguaaaaauggcuaucuugccaaaagcaaucuacagauucaaugcaauccccaucaaaauuccaacucaauucuucaaugaauuagaaggagcaaucugcaaauucaucuggaauaacaaaaaaccgaggauagcaaaaacucuucucaaugaauaaagaaccucugggggaaucaccaugccugacauaaagcuuuacuacagagcaauuaugauaaaaacugcaugguacugguauacugacagacaacuagaccaauggaauagaauugaagaaccagaaaugaacccacacacauauagucacuugaucuucgacaagggagcuaaaagcauccaguggaagaaagacagcauuuucaacauuuagugcuggcacaacugguuguuaucauguagaagaaugugaauugauccauuccuaucuccuuguacuaaggucaaaucuaaguggaucaaggaacuucacauaaaaccagagacagugaaacugauagaggagaaaguggggaaaagccucaaagauaugggcacaggggaaaaguuccugaacagaacagcaauggcuugugcuguaaggucgagaauugacaaaugggaccucaugaaacuccaaagcuucugcaaggcaaaagacaccgucauuaagacaaaaagaccaccaacagauugggaaaguaucuuuaccuauccuaaaucagauaggggacuaauauccaacauauauaaagaacucaagaagguggacuucagaaaaucaaauaaccccauuuaaaaauggggcucagaacugaacaaagaauucucaccugaggaauaacgaauggcagagaagcaccugaaaaaauguucaacauccuuaaucaucagggaaaugcaaaucaaaacaacccugagauuccaccucacaccagucagaauggcuaagaucaaaaauucaggugacagcagaugcuggcguggauguggagaaagaggaacacuccuccaucauacagaucuuucacuuccuuaguuagagucacgccaagauauuuuauauuauuugugacuauugagaaggguguuguuucccuaacuucuuucucagccuguuuauucuuuguguagagaaaggccauugacuuguuugaguuuauuuuauauccagcuacuucaccgaagcuguuuaccagguuuaggaguucucugguggaauuuuuagggucacuuauauauacuaucauaucaucugcaaaaagugauauuuugacuuccucuuuuccaauuuguauccccuugaucuccuuuuguugucgaauugcucuggcuaauacuucaaguacuauguugaaaagguagggagaaagugggcagccuugucuagucccugauuuuagugggauugcuuccagcuugucuccauuuacuuugauguuggcuacugguucacuauugaucuuuuaagagguaacuuuagaagucaucuuuggcugaaaacagucucuuucccgauggugccuuccauaccuaaugacccuaggcaaccagaucucauguccccugugugcugcauuuguuuccuguauacuucaaacucuucagagugguuguaaaucuuuaguuucgaguuucgcuugaugucacugggcuuucugguuucauuuagguguguaccggagguuuguuguucuagucuuugaaacugaaugaaugcagcucgaucuuccacaccagaauauccacaaaccuaagacuacaauaggagacauccauagaggaaaaaaaauccuuucuuuguccucaugauucauaauucuaauuuaauacuaagacauauucuuuuaccaugcccaaugcacuuguccuaaagacaggcagggggauugcauauagguaaagauauuaaugaauaucuuauguauagugucaaugaaugcauggcuacacuugggauuuuucaucgugaaacaucuuucaaugucuauuaaaauaccugcuguauggcagucacuguacauugguccugaaaauucaauguugaaaagagcagaaauguccacauacagauuucaaaaucgccaaaauccuguccuuaucaaaggcaguaauucuggacgcuagauucuccuuucaggucuaguuacaaaugugugguuuucauaugagguuuuuaggaacauaaaauucauauguagaaaaguacacaaauugagaauacaacuuguaaaauauucaccaagggaaaaaaaauccaugaaauaagcagccagaccaaacaucaggacauuccaguuuccugggaucuucuuuccuuugugggacuccuuuguguagccuucuaguuacccuucucaccugcuuuuccagacuucugauaucgcaugccaguuuuaccuuguucugaccuuuauaggugugaaaucugccuugauuggcucaaucuuauccuuccacaaugccucugaguuguugcauaaguuagguuuauuuuuugccccuacuaguucacuguuaaauuguauuauaauccaguuaucuauucuauuauuacauguuugugggaaauagucuugauguugauauuuccagguuggggcuguuaagcuuccucuaugugucuucugguggacauuucugcuggaaauacacucacaagugggauuguugggcgaaaaguuacuuaugccuucauguccauuacaugucaaccauauuuguuguaaguguuugcacuaaagugcgguuccaguagccguguaugaagccuaucagucacuccauguuuucuccaagcucggcgguucuauguuuuuucauuuuuaaguaaaacaaaccaaaacaacaaccaaaauugaauaauaacugggucuuugugcaagcaauaagacauggugaaguuugcagcaaguguuaaccccuuagauuuucgucugcgcuuauaauucaggauggcguccuauugcauuaccaccucugcuggagcuguugaugagaucaaaaccacugauuacacugaagaucugacaaaguuugucuuacuuugggguugagauuuuguaaaaccagcagguggccagcauuuuuucccuugcaaaagguccaaaugugggaaaguaaugugcaagucccuuauuugaauuucaacguggaaauggcuuuaucaaguucuguguaauauauauguaguuaagcauaaaaugauuuuccauaucagcugugaggcuaaaugugacaaaauuugaacaguuaugggccaaucaaaauccaaauauagggcccuuggagcuguagggagauaaauaccuuauugaaauuagcuugcgaauaauguuguaaagccaggaggaagcauaaauguaaugugcccaggccaacuacagaaaggcugagcugaaggaaggaaucuuauccugcaaccaaagagaugccccaguagguaaaagcaccuacuauauaugucuagcaacuugaguuuggaucccuggaaucuguauaaaagcaagacacaguggcacaugucaaccaucccagcauucuugugguaagaugggaagugaacagcagagaaccccuggaaucuugaggcucagcuagccuggaauaaacagagcagcagcaaacagagauucugucuuaaggaaggcagaagauaaggaccaauaccaagguuguucucugaccuccucucucgugcugugacaaacacacgccaucacauacaaacaugugugugcgugcgcaugugcgcacaugcacgcaccccccauauauacacaauaaauguuuuuuaaaagaaacuuauagaacacuucugaugguuaccuuuuucuuuuuucagucgaagguuuacacucgcacaccaaccuuauaucuggacuucaaguuggaccaaggagcaaagcauucccagccuauuccuaaagguacaguggguucuggaauuugguagccaugucaggaagaacaaccaaaugaaagcccaaucagcugcuuucuugggaauguaauaucugcacgaccuucuaggaacuuuguguuuaauuauguuucgguuagcaaagucugcauguaugugcuugcauagaauaggugacaaguccuaaaguuugacccuuuuccuguccucugucugaaaugcauuuaauuggauauuuuaaaccacuuauuuauuugcaguuuccacaauauuggcugucuauauucagacacacuaggcaucaacuuacgcaguguuuuacuguaaaguuacuucaaucaaggucaccaggucucucuuuuuucuaggucaaauuccaucacagcuccaaggacugucuaaacucauuuugcuuggauguuuuguugcaucaaauauuccuugaaaugugugguccauuggcugugucccagacauguuuaguuuaucauauucgaugguguuacucaugguaaagugaugugacauggauaucuggguuguguuuagcuucuggcauaaccagucaaauauaauguugacuugguugugucauuacuagacuaauuggauagaauggaagcacacauugcuaccauccuaucucugauaccagaaaaaugccuguguuuguauuccaagggaaacacaauuaaggggggccuggauacauucuuccugaacccuacccaauuuuaucugaauucuuucccauaaauagcauuagaaucauuuuuuaccaucucuuucuugccuuugggcuaggcacguuuccauuggguuuugcuaaucuugcagaagacagauguuucaugcaauggggauuuggaagacaguugauaucaggaauugagccugaugaugcaucauuuacaaagaauccaauuugucgaguuucugacaguaccagauuucuuuugcauuggccacacauuuuucccauuagcucuuggcuaaaauaagaauacauagggucuccuuuuuugcacggugacuuuuaauaucucuugaaaggcaaucugauuuuuuccugcuguaaacugauguuuugagaauauuguuaucauucaucaugagggacauaaguuugcauuucuaggaaaguaucuuuuuuucugaucuucaaggccccuuuauauacaagcugauaguaucaacauuugacccuccacagccacuccguuuauuuucucuaucuuuccagacagcaccccugcuucuggguacguuauagcauggaucagaguguuaauaauagaaaacugcuauggugagggacauuuuccauucagugaaccuuuucuuucuuuuaaaacuuuucuuuauggugccgauaaauggauaagaaaacuaucuucagacuacacagaguguaccacucuggaauaaugucccccuucccucaggauguccauguacuaauucccaggcccuaaaacccugcuacauagcuaaggggacuuugcaucuauguaugguggagcuugcauauaaucccagauccugggaagcuuaggcaaguuaaagucauccuuugcuacauagaaaauuugaagcuacucuaggcuacaugagaccuugucucaaaaugacaggagaaagagaagugccauauggauuuaauguagacguguaaucauaauagugaggaaguagacacagaagcagggggaucaggaguucaagggcaucucaccuacauagugaauauacggccaaccugaacuacuugagacuuugucuaaaagggggggggcacuuugcagguagggaggguucuaugguuuggaucuauguauugaaggcuugguccuuagccuauggugcuuuggaggcaacucuggaaggcuauaccugagggagcuuagaucuuuggagaugugcccuugagggagauacugaggccuccucucucuuuucauuuuugaauuuguauuuucauuuuugggugcuaugaagugagaagcuuccccugucauucaugugucgccauguuguacuaccucauguaagcccaggagcaacauggcaaacugaucauggacugagaccucuaaacaaauaguucaccaccuuccuaaugcugagagccuuuaauucaguuccucauguuguggugaccccccaagcauaaaauaauuuucacugcuacuucauaacugugauuccgcuagguuaugaaucauaaugcuacuucauaauaauuuuggaaauagaggugcaccaaaggggucauaaucuacagguugagaaucccuuuucuaaaucaugagcuaagguuaauuuucucuuuuguuaaagcugauugcuuuaguccugcugcagauauagaacccaacuaauggugagcgauuagcccggauaauccaggagggcacggugucaucaggauagucagaaaaagagaagcuacgacuuagaagcagagugauguuaguaugauucuugcagugacaaugggaaacugauagagcauguaaaacaaugucacuauauaccagcuucuguguuugccuuggaagugggggagaaaggagaagugccagcugguucccauucagauugcaaaggggauuucaauauuguguacuaauaaaucacauuaggaugccuucagguaaacuuuuaaauguaacuaauacauuacuauauauuucacuguuguaaauuuguugcuauuaaaacuuuccuucuccuucucucugugcccccccuucucuuuuucucuuccuccccucccccuuuccccauggcaacuucccuggccucaguccuuggggccaauaaauuugcuugcuugagaacagcaucccaauaaaccugccuuuaagaauaaauaaauaaauaaauaaauaaaacgaacuuuucuuuuuuuuaauuagguauuuucuugauuuacauuuccaaugcuauugaaaaagucccccauacccccccuccccuacccacccacucccacuucuuggcccuggaguuccccuguacugaggcauauaaaguuugcaaguccaaugggccucucuuuccagugauggccgacuaggccaucuuuugauacauaugcagcuagagucaagagcuccgggauacugguuaguucauauuguuguuccaccuauaggguugcagaccccuuuagcuccuugggugcuuucucuagcuccuccauugggggcccagugauccauccaauagcugacugugagcauccacuucuauguuugcuaggccccggcauagcaucacaagagacaacuauaucuggauucuuucagcaaaaucuugcuaguguauacaauggugucagcguuuggaggcugauuaugggauggauccccggguauggcagucucuagauugucuauccuuucaucucagcuccaaacuuugucucuguaacuccuuccauggguguuuuguucucaauucuaagaaggggcaaaguguccacauuuuggucuucguucuucuugaguuucauguauuuugcagauugcaucuuguaucuuggauauucuaaguuucugaacuaauauccacuuaucacugaguacauaucaugugaguucuuuugugauuguguuacuucacucaggaugaugcccuccaggaccauccauuugccuaggaaguucauaaauucauucuuuuuaauagcugaguaguacuccauuguguaaauguaaaacauuuucuguauccauuccucuguagagggacaucuggguucuuuccaacuucuggcuauuauaaauaaggcugcuaugaacauaguggagcauguguccuucuuacugguugggacaucuucuggauauaugcacaggagagguauugcuggauccucugguaguacuauguccaauuuucugaggaaccgccagacugauuuccagagugguuguaaaagcuugcaaucccaucaacaauggaggaguguuccucuuucuucacauccucaccagcaucugcugucacgugaguuuuugaucuuagccauucugacuggugugagguggaaucucaggguuguuuugauuugcauuucccugaugauuaaggaugcugaacauuuuuucaggugcuucucagccauuccguauuccucgggugagaauucuuuguuuagcucugagccacauuuuuuaaucggguuauuugauuuucuggagugcaccuucuugaguucuuuauauauauuggauauuauuccccuaucugauuuaggauaguaaagguccuuucccaaucuguugguggcauuuuugucuuauugacagugucuuuugccuuacagaagcuuugcaaauuuaugaggucccauuugucuauucucgaccuuacagcacaagccauugcuguucuguucaggaacuuuuccccugugcccauaucauugaggcuuuuccccacuuucuccucuaucaguuucacugucucugguuuuauguggaauuccuugauccacuuagauuugaccuuaguacaaggagauaggaauggaucaauucacauucuucuacaugauaacaaccaguugugccagcaccauuuguugaaaauacugucuuuuuuccacugaaugguuuuuguucccuugucaaagaucaagugaccauagauguguggguucauuucugguucuucaauucuauuccauuagucuacuugucugucgcuauaccaguaccaugcaguuuuuaucacaauugcauugaaguacagcuuuaggucaggcauggugauuccaccagagguucuuuuaucauugagaacaguuuuugcuauccuaggguuuuuguuauuccagaugaauuugcagauugcccuuucucauuuguugaagauuugaguuggaauuuugauggggauugcauugaaucuguagauugcuuuuggcaagauagccauuuuuacuauauugaacgugccaauccaugagcaugggagaucuuuucaucuucugggaucuucuuuaauuucuuucuucagagacuugaaguucuuaucauacagaucuuucacuuccuuaguuagagucacaccaagguauuuuauauuauuugugacuauugagaaggguguuguuuccauaauuucuuacucagccuguuuauccuuuguguagagaaaggccauugacuuguuugaguuaauuuuauauccaacuauuucacugaagcuguuuaucagguuuaggaguucucugguggaauuuuuagggucacuuauauauacuaucauaucaucugcaaaaagugauauuuugauuucuuccuuuccaauuuguauccccuugaucuccuuuugcugucuaauugcucuggcuaggaccucaaauacuauguugaauagguaugaagaaagugggcagcauugccuagucccugauuuuagugggauugcuuccagcuucucaccauuuacuuugauguugacuacugauuugcuguagauugcuuuuaucauguuuagguaugggccuugaauuccugaucuuuccaagacuuuuacaaugaauggguguuggauuuugucaaaugcuuucucugcaucuaacaagaugaucaugugguuuuugucuuugaauuuguuuauauaguggauucuguugauggauuuccauauauuaaaccaucccugcaucccuggaaugaaaucugcuuagucagguuggauguucguuuugauguguucuuggauuugguuagugagaauuuuauagaguauuuuuugcaucgauauucauaagggaaauuggucugaaguucucuaucuuuguugggucuuucuguuguuuagguaucagaguaauuguaccuucauagaaugaauuggguagaguaccuucugcuucuauuuuguggaauaguuugugcagaacuggaauuagaucuuugaaggucugauagaacucugcacuaaacccaucugguccugggcuuuuuuugguugggagacuauuaaugacugcuucuauuucuuuaggggauaugggacuguuuagaucauuaaccugaucuugauuuaacuuugguaccugguaucugucuagaaauuuguccauuucauccagguucuccaguuuuguugaguauagccuuuuguagaaggaucugaugguguuuuggauuucuucaggaucuguuguuaugucucccuuuucauuucugauuuuguuaauuaggaugcugucccugugcccucuagugagucuggcuaaggguuuaucuaucuuguugauuuucucaaagaaccaacuccccguuugguuaauucuuugaauaguucuucuuguuuccacuugguugauuucaccccugaguuugauuauuuccugccgucuacuccucuugggugaauuugcuuccuuuuuuucuagagcuuuuagauguguugucaagcugcuaguauguguucucucccguuucuucuuggaggcacucagagcuaugaguuucccucuuagaaaugcuuucauugugucccauagguuuggguauguuguggcuucauuuucauuaaacucuaaaaagucuuuaauuucuuucuuuauuccuuccuugaccaagguaucacugagaagaguguuguucaguuuccaugugaauguuggcuuuccauuauuuauguuguuauugaagaucagcuuuaguccaugggggacaauuucaauauuuuuguaucuguugaggccuguuuugugaccaauuauauggucaguuuuggagaaaguaccaugaggugcugagaagaagguauauccuuuuuuuuuuuuuuuuuuuuuuuuuuuuuuuuuuuuuuuuaggauaaaguguucuguagauaucugucagguccauuuguuucaucacuucuguuaguuucacugugucccuguuuaguuucuguuuccacgaucuguccauugaugaaagugguguguugaagucucccacuauuauuaugugaggugcaaugugugcuuugaacuuuacuaaagugucuuuaaugaaugcggcugcccuugcauuuggggcauagauauucagaauugagaguuccucuuggaagauuuuaccuuugauuccuaugaagugucccuccuugucuuuuuugauaacuuuuucuuauuuuuuuuucuuugugaugguaggguuggauccgggagacauaggccuguucuaucacugagucacauccugcagcccacuuuuuaaaauuauuuucaauugaccaguaaacuaguauuacuucuuccugugaaacaugacauuuuaaaguauaaacugcacaaugacuagaucuaguaccuaacacauuccuaccucacacuguaguuuaaugauuaaaauagaacaauuuuugaggcacagucuuaugaugcagccguggcuguaauggaacuuucuguguaaaccaggcuggccuggaacucacaaagauccaccuggcucugcuagagcucuguauuaacccuuacaauccuccuaaucacaugagccaggaugauugucccauuuuuuuccagugaggaagcugagguacagagagauuguauaacuuguuuaagauccauuagguaguaaaugcugaggugagauuauaacuagcccaguaucacucacacugugauuuuucacccaccgucauguuccauacuuaaccaauuaaugguccuuuagugacuccucuuccucuuggcacuuauguuuaguucuaagauggacauuaacuauuuauuccuguauuuaugauuuguugugagcugucaguugcuaugugaucaaauaauccaucuuauugucagcuauucuaaacuccaguauucaggggaaaacacaaugcuagguaccaugaaguucuuguugacgccacuauagguuguuuuguuuucuugacaauuuuauacauguauacaauguuugauaugcagaauucuugacuauguuguggauacagugauccugacacucuuggcuuaguguauuuuguaauccaagaggagagcagagagcacuuggguuugguauuguggauuccauggguccacuuucggccuagcuaucagcuucacaaauguuggccuacaaagaugcugaacaaaguagaaagaaaagggauguaaagaaaaaugagcaaaaauuugauuuaaaaaaaaucucccaaguucuaggcauucagcaucugugugugugugugugugugugugugugugugugugugugacaggaacauccuauuuuacaccaaaaggauaaugaagcaugugagauaguguguuggcuuugggagaaccuagguaaaaauauacaguaacuauaguaucuuugaaacuuuucagugugucugaaauuacuucaaaguaaacauuuuuuuaaaauuaguuuguuuggaggaagagggcaggagacgaccaggcagcucugccucucaucccagaaggccaggugucaggucuagagaggaguuaccugaguaaguuaacuguggagacauccuaugcaggcuucugguaucggagcuacuuaggagucuugugaauauuguaagccucggucugggaguacguauguucccuucuuagccccuuugcccucucuucuaagaugacuucuguuaggaauuuggugugucagcuggccauguuuuucuacuucuuccuccacauccaugcauaagaguaguuauaaauugacuggaauuaugaacucuuaaugaagucaggagaaaaauggucuggcuuaagcccaggaauguaggcugaggaaaucucucacuaaggauauuuuuuaagaauuaggaaccucccuggaaauagagugaaugccacagaaaaugauuuacauauuuaaaacgcacauuguacauuuguuuuauguuugacuaacaaagaucugacuuguauauguugcugacuuaacuauccucagggacuagaaggaaaauaugaucuucaucucagcacaguuuauuuguuauuuuccagggaaauaucuucccagcugcaaaaagacagccaccacgguaggguggccaccauguuuguggggagaaaagggggaaauugaaggcuaugcuacuucugauagagugacaaaaauuugaggguggcauccauuucuagugcagggcacaaaugugagaguagaguuguaggaagguagaaaggggggaagaagggagggagggagggagggagggagggaggaaggaagggagggaggaaggaaggaaggaaggaaggaaggaaggaaggaaggaaggaaggaaggaaggaaggaaggaaggacgaaccugaaaugugcacagaggaagccaggcagugguggugcuucacaacuuuaaucccagcucuuggaaugcagaggcaagaggaucucugugaguuugaggccagccuggucuacaaaggcagauccaggacagccaaggcuacacagagaaaccaugucuugaaaaaucaaaccaacacaaaaucguacagaggaagagcccucagcugaugcaauccugccuuuaucaaaggaguaauuugaacaaaauauguuucuucuuaaacauauaguauauauucauuuauacuauuugacauuuauuuuccuuuuggcagcacuaagaaauagugcuccuuagaaaugaaacaaagguuaauagcacauuuugcugcaaagacgauaaaggggagauugcucgacugcuccuguuccacuaggucuaauguuuugugcucuccaccaggcaacucgaauuguguucuacugagcaaagacguucuguaaucuaguagacuacuuuaaugagaagcaaaaccagauacaugcacguagaacacucacuuggcagcucauuggagcacacacacugucuuucagggguuugccaaaauggauuuucaaagggagagaaaaaaacagaaccaaaugaucuguuuggaggaugaaacaggaacugaaggagaaaugccauggggauaauuuaaaagauccaacauaaaaaucucagccaagcaacugagaacgaugggguuuugggcacgucccucgaaagaauuaccuuucagcugccuuccgagugugaagagaggauugaguacaugaaggagggcacaucaugauaggaugugcuacugcucuguguucucauauggacagacaguuaaaacacagcacuaaaguucuucuaguuuugaagcaaaugcuaaguaguacauaaaaggcaaaaguccccaaaggauaaauaccaaauugcucaccacuuaugucgggguagcaauaagacuuacaguuuagauggcccaugcuuuaguaaucuuaaaauaacauguuacuuuuuuccccucaagauaaacaagaaauauaagccaucugcacuuagcagaagaaagguuaaccauuuccaaucuaaaucuuucuuuuuaaagcugagagaaaagggauuucauuguaggguagaauuuuuaacugggcugagcaggaauagaaagagugaucauccauuagaaaggaacaaggcuccuggcaaagccagggugugcacacaagaauggaguaauagauuauuggcacguauuuucagcaucuaugagggaccuuccacccuccuguuguccuacuugaauaccagugacuauucccucuugauauguauaucugugccacaacauguaccaacaguaaagguucaauaaaugguggaccacuaaaugagggaacaagucagcauauucucagauggcuuagaaucgcucuuguaauaucucaggaaacaccagaaguagcgguguguguuugaaaugccagcacuggggagucagaggcacacagaucccugggccuugcuggccagccacccaggucuuagcugugaguccuagguuccagugagaggcccaggcucagccauguggaugacuucugaggaaagacaccugagguugaccacuggccuccauguguacaugcacacguguguaccuucacaagucaugguauccugguuuuguuguuguuuuuuguuuuugaaaacuuauagugacaauuccagggauuuuacaagccaucugaaaccuguuaaucaccaaaaguuuuggaucuuucuuuguagggagcaagugaagucucaagugccuggguguugcugacaugaccauggccaugccaaggacuccaguggcucucagcaugccaguggcaaagccguccuuuggguggggcuuggaggaauggcaaagcuuuccucugguucaagggcaaagguuaagaguuuaugcagagcggugcacgccuuuaaucccagcacuugggaggcagaggcagguggauuucugaguucgaggccagccuggucuacagagugaguuccaggacagccaggacuauacagagaaacccugucuugaaaaaccaaaaaaaaaaaaaagagaguuugugcagaaaauauacagcauggcuuccgucuccaccuggguuguuuccagccuagagaugagagacugcuucccuacgagacugcuucuauugagauucccaccuccuuauucauauauauuucauucccaggaugauccaguuaggucaaucuccagaaugcuccaggauguggcaccuguuauugauauauauauacucuuuuauaauagauagaaaauggggugugaucacuggaaacuauuauucacacauggaaguacagcaaacugaacaugaagcuagacuggagugcuauaguguguagcauagugacagagcuguaagaaacaaucuguaggcuggagggugucucugugauucacaaugcuuauugcucuauuggaugacuauaauucagaccccagcacacagauuuguuguccccuucugguaccugguaaacacacccacacaaauaaaaaauaaaauaaaauaaaauaaaauaaaauaaaauaaaaguggcaauauaacuuuugucaaauugcuaaaguuaacuauauaauaccuacuuuggguggcccuuaaauagcaaggacucuaaguccuuuaaguauagaaauguuuguuuguacaugugcugcguauguauguaugugugagagagaggagaaaaguauguaaauauauaauauauaugauaaguagcucacagaauuaaagucuuaaaacauaucuaaaagaaaaauaaaauauuucauacucauuuuucuuuuguuacuguuauauauguuuauaucauauauguaauagagacaaaauauguauguauguauguauauauauauauauauauauauauauauauacacacacacacguguguguguguguguguguguguguguaucacacuaauagcacuaacaaugcaaugccucugguccuuuuccaggguggacaagcuucauuuauaccaucucuggagauguauauauuggugaguaagggauaagucauuugggguuuaauugcaguuuaauucaagcuacugaaaggauaaacuaugaaacuauuuuauguaauugaauacugugccuccuuucuucccacaccaaucuggagcagggugccuuacagcuuccagaguguucagaaacaaagaacaacaugaacaaaaacauccaggcaaaagguacaggaguguuaaaucugagagguuagcaguuucugugcccauaaagagguggggcuucaguaggcuccaaugagagccguagucuguguaucccuuuggagauauaagaagacuagguauuucagguauuucacauuuucuucauuuauucuaaggguuguaugcugcuauuuguagugaagugcaucuuugagaauaaagcaacacucauuuuauacaugagcaguggguuucuaaaagaagauauuuaugccaagguuucacaucuguacaccugaggcaagaaccaagcuaugggaguauaaaagaaaguggccgccaugacuuuguccuuugaauucuugguccccaauugguggcacucuuuggcgauguuggugaggugugaccuuaugaagaaguguguuacuagaaguaggcuuugagaggcuaaagacucucacuguugcgaauccuugcucccugcuuccugcuugcuggucaggaucuaaguucucaucguccagcuccagccacagugcugugucugcugccagaguucccugcuaagaccaaaucucaucccuaaggauccauuggccaagcaaaccuuuccuuuuauaaguugcccuuugggauuuuuuuuuuuuagaaacucauagcaguagaaaaguuacuacuauccaaguguuccucaacugcaaucuccauguccugccuacacuacauucaguuauaauacagaguucaggccagcuuguguuuucaagccugcccaaacggauagcagaagagaccgaauccacaugguaagagaagagcaggcagaacagguugccucuguuuguguucaucccaaccauccccauuuuccuggagaugguaaaaagcucuguguagggaugacagcgaauggcugagccacaguauauucuauaaauguucugcccaagccccucaugacauugcuuccccagucccugcugaccaacuuccaacugucagugucuaccccacuuuuccugaaacuugcaaagauugcucugccucacucaggaagcacagaagcaccaaagcaucaacauucuggacguuggcugucuccuugaguagguuaugucagaacucauuccugaauuucccacugggguuauucucaagcuuuuaaugauggucaggugccuguccuucuuugcugugaugcuuugaaugacaaugggcccccauaggcuccuauguuugaauccuuggucgccaguugguggagaaguuuaggaagaauuaggagucaugguccuguaggaggagcugugucauuagaggugagauuugagguuuuuaaagacccaccaugccaucccaauguguccucucugauuucugcuuguggaucaugaugugagcucgcagcuauucuuacuaccaugccuuuguuuucccaucaugaaccuuaacccucugaaaucauaagcccaaccaaauaccuucuuucauaaguuaucuuggucaugauguuuugucauagcaauggaaagguaauggcuacacuuccuuucccugaauaacucugcucauugacggacugcuguucacuggaauuaucuccugaauuaacuccuuauaugacaauauucauuugaguuaugauucaggaagaagcuagaggcuuaccucuccucaucuccauccacagugaugucugacauacauguggguguggcaucccaagauguagccccagauuccccauuucugagaccuucuagaguugaaugcucuuuaccacagucgcauuggggaugccagcaggaaacuuccuccuugggaaauacauuugcaacuugcauggagcauccucauuggaaaauauauucucaguuugcagauagauggccugcuaaugacaucuguacagggcaugaugccacaucccaagugacuuauuuaaaccauucuuuauauucuaaaaaaaaaaaaguguucaauuacuugagucuucuggaaauaacaguuaauuugaauuucuucauaaugugauauaaaugggcuucguuccucuuucauuaaauagcacuuuaauuacaagucccaaacaaaauucacauauuuuaucauucaagagaguaaagauucaaauuaaaaaacaaaacauaaaacaacccucucuagcagugguacaguaagugccugugugugcacagugagauguaguaacugucugagaagaaugaggcaucauuuauuuuuuugauacccugguaaucauacaguacuuuauaaaacuagaaaaaaaaucuuuuuuuggagguuucauccuugacuuaagauuuuaagauaaaaaauaaccugaagagauaaacuauaauaaagaaaaagcaugaaguuuaaaguguuaaauagucuggaaauguuuauguagaauaaugaaaagaggggguuggagggggaaccaaacuucauggaaagggccagaaaauauuuuugucucugagacuacuaugucuugcccauguagcacaaaaacagucauggacaauacauaaauuaauggaacacaugcugugauccaaguuuuuguugaacuucguguauuuaccauguacccugaaccacuguuuuuaauucuuuacaauuuuuuaagugaagaucuuccugugcuucuugacucugcaaacgcucacaaaugguuuugucccaaauggcauuaaagagcggauaaugauugcguaaagcuugauaaguaaucugcaaagccucuuuccuccaguaauuacagccucauuuccagacagaccuuuacccccagaugucaauaagugaagcauucagaaauucuaggcuaagggacacccauacuuguacuuguuuuccuugagguaagguggaaauguccugagucauuucuucucacuggcuuauuacccuaccccaugaccaugggccacauguacaaaacaucuggcagaagauggaauuguggucuuuagccucuaagugaauuugugugugaucaaaauaaaguaaaccauggacagaauccagcuccacaaacuggccucuuaggacucugcuucaaccaaugagcgacaagccaaaugacuucauuuguaucugaucuccuugcuuugcuccuguccaccccuucaugagguugccaaugagaaaaacuaaagcacaaaacaacacaucaccagagggaaaaaaaaaaagaccaaacagaaaucacugucuauagugagaacccagaaaaugauuuuuaacuuuaguacuucaauuuuaccuugcuuauaaacacaaauggcgccccacucaaccccagauggcaggagcuaaccaguaagucauauauuuuacagugucaaguauccauuguucaguuaaugaaaugucaacauauaagguaauaucuugggcuagagcaaauaggccacaauuuggauggccaaaguaaucuuuuuucauuuuuguuuuguuuguuuguuguuuguuuuuagaggcaggguuucucuguguagccauggcuguccuggaacucacucuguagaccaggcuggucucgaacucagaaauuugccugccucugccucccaagugcugggauuaaaggugugugccaccacugccuggcauguaaaaguaaucuuagaagacgucauacaguaaaaauuuaagagugcuauuaaucgggggaacaaaggaaggggaagggaagagaaggguugagguagugagguaugagggaaauauauucaguuauauaguugcuggaauuggccuuauggaacccaguacaauaagaucuuuuaacauguguguguuguguuaugugggugcugugguacaugcuguguaugugcuuguuagugugaaugugugcacaugugcucgaauggaggucagcaucaaguugcuuccuccguuaccucccaccucucuuuucaaaagucucucccugaaccugaauucuacaguuucagccauacuggcuagucagugagcucccgagauucucagccucuggcuuccucuuccucaucagcauccucagggaugaggacguggaugaggcagggcaucccaggcuguagaccaacaauucccauuucaaauccucagaacccacguaaaaggcugaacgugguuguucgugccugugacccuaguguuaugggggaggaacagaaaggaccacuguggcuugcuggccuagcuccagaguccugagcuacccugucugaaaagaauaaugcagagcauaaauuaguagaaugaguggaaaaugggauacuucugcaaauaagucaaauacuuuguaaaaguaaauugcuggagaaaacaaguaagagaaaacugagggauuagggaaaguguaauaaucuagaaggauuuaggggaugcuuaaaauggguagacauuaaaaagaggaccaaaggcagaagagaugagcccauaggcaaaguguucaccauccaugcauguugaucagagaugagcuucauuacaucuauuaaaaaaaaaagcugaguguggugguagcaggaaucuguaaaauuaguucuguguugggaagacaggaggaucucuggggcuuguuagccaaccagucuaagcaauccuugaguuccagguucagugagagacccugacucaaaaaaauaaggcagagagcaauugaagaagacacccagugucagccucuagccaggcuacuacccacaugcauaugugcacaaaugcucauacacagagaaauacaugcuaaauaaauguaaauaaauugaagggcaaggcuucaaucuagcuaccaaaccugccaacuauauuuaucaaaacuuauaaauugcaggacauuuacauuuuaaaauaaggugcuuggggcgguuuguuuuucgauuggugucagucucuguuguaguagagcuucugcuauacauauauauuuagugauguuaaaaugugugauagacaugagcagaauguguggaacagagugcuaguucuuauaaagcgaacaaaaugaaaagaggaugcucacacacuggagcuggaccccaaccuuaaaaaacacacuuuaaaagguauuuugcccuuuuaugauuguuaaggcaaaaaaguaauaacauuuuugguuaaauguuccuuaacuacauuauuagauuuaacauucuuggcagaaacugccaauggaaaguauuuuauuaucugauuugucucaauuuauaauuacaaguagucagaaacaauaggcuauauuucaggggaacuuauuuuagguucaggagauaaacagaugagugaacuaccauagaaaugaucuggaaaggaagauacaauccaucuguucucucuggugcuauuuugaagacuuugccuaggaaacuagaaacucaagguagacuaaaaaaucauccaccaagcagcuugacucuggugucaaugaggaaaguguuccuuggaguagaacauuucaaauagccccuucugcagcucacugugauuucaguuauacaucaguagggaggaacaugggcacccagcaucaagucugcuucuaaauuaggauuucuuuucaggccaaucaacauugcugucaagcacacuauccugauacagggugcuugcugagaacuaccaacucagcaggauuucuuaguguugucucuugucagcucacucuauuaaaacuguaucaggaaacauacuacaugacaaacucagcguccuggagcgggcuacgugggugcuggcuguuacauaugaauuaguugaagauagaaauaugguucauuauccacagaggaugucaauaaaacacaccuaauaaaaugccuucccuugucacaguuuaaaauauuauccaacucuaaaugauauuccucucggacuccuagacuuuuauugccaaaccccuguguaaguuggaagucaauggaguucuguuauucaccccaugacauuugcugacaugugccuuugaugaauggaugcuguguugugguuggcucuugcuacuuugcagggcuuauugugccugagcucauguuguuuccuuggaauuagcaaagguggaaguauuuucaccaggaaagucguuauaaaccauaaucaaugguguuauauuccagccaccauugucuuccaaagccagugauuaaacaguuuuuauuuuauuuuuucugccauugaccuuuaaaaaaaaaaaaacauggacuaaguuccucagacaauguuuuuaaauucaguaacaucauuaaaguauuaaagaaccaguuuaugcuacaauuacauguaugcuucucuguuggcaucugaaaugacaugauuuagcagccggucugcucuuaauuguaugugacaacuagccuaaacucuauucugagacaugcacugcacuguaacacgguauaaaaauaucugugacuucucuuggagacagagcuaucagcagagcaaauaaugcugugguuuguuggcuacaguuaugacugaagaaaaacuacauggcagcuaagugauggagaaaguacaugugcuaucugucucucauccaaggccacacuuagucacaguucuagcugcagaauucuuacuccaggauaagaauucuuguucuguccgaauccuguuucauguuuaucagcaacaguguaagccauaugcccucuaugccuggaagaugaauucucugaaaaauauggcuauuagaaugcuaaccaauaucccccaaauuuauaaauugugauucuguuuguauaauaauuugucaaguuacuguuuccuuuaaucacuucucuaauauuauuaaagcuuuagcuugaucucucugucugucucucuaugucucucugugugucucucugugucucucuuucucucugugucucucugugucugucugucugucugucugucugucugucugucugucucucucucucucucguguacagacauaauacauauaccugugcauauauggaggccacaaggugaucuguccuaucacuuucuaccugauucccuugagauugggucauguagagacuaggucauuuacugaacccggagcuaagaugguggccaacaaacccccgugauccuccugucugcuccccacagugcugagguuacaaccauacauggucaugucugcuauuuaugugaaugauagggauuugaacucaaguccucaggaagugcucuugugcacugagccaucugagcccucucccuaacuccuugaaugguggaucuuggacugucuguuaucuguucacauaccuguuugguuuuuauacccagcuggaagacauagccuuaaaccucacccuucgcugcagcuuucucugucuauucuagcacacuugggucucuccauuguccaguucccucuugcagaacugcuacugcucuucuuggaucacgccugcuuaugccgaggaccaucaaacuuagauucuuucucaacucccucccacccuucuuccaucucuuccaaccuaucuuucucuuuucacuccuauccacacuguaauccacguucacuuuaguccauuacagagagcucccaacagguuugccugaguuuaggcccacccuccauuuccuuuuaugcucugcuucuaaaauuacuuuuucaagacagaucuuaucauuucucuccucucucuaucucucugucucugacacucucugugagugugugugcauauguguguguguuuguguauguguauaugaaugugugugugagcgugugugugaggggggagggagggagggagggagagaggaagagggagaaagagaaggggggccuuuguauggauaaggaugauuuaaaggauuuucuugauacauuuucauccuuuccaguaacuguuaaaaucgugauagaagguucacagguuccuuagaaauucucagccacucccuucaacugacucucuguccucuuauccacaauacccuauuccaagugcuguuucuuaaaggucuuucuuaccuugcacagcucuguuaaagucuuacuuucuccagaacaaaugccuggggugcuccaaccugaaugagcccccccaaauuccuuuucucaaugagguuuuuguuaucuugaaguguuagcuagcuuuauuucaucuguaagccuuagaagggaaggaacgcuagucuaaagacacacacccuccagagugcuuagaaggugcccaaccggcagaguguuucggagcaggccuugugcaugguucuauaaguugcuauccaacucaucuaguuuucuguuaaauucuucucuaaugauugcauaugcuuauauuugguuggucccaagaacauuuugaauuauuuagaugcaaggaaugaugugauuugcacguuuuugcauuuuucucuaguacuugaaaguuggagaugcucaguaaauucuuguugaaaugaauuaucgauagcauuugauuuuuuuccagcccugcuucuuauaggguuuguauuuuacacaagagaacauucuuuuuuuuuuuuuccauuuuuuauuagguauuuagcucauuuacauuuccaaugcuauaccaaaagucccccuuacccacccacccccacuccccuacccacccacucccccccuuuggcccuggcguuccccuguaccggggcacacaaagucugcguguccaaugggccucucuuuccagugauggccgacuaggccaucuuuugauacauaugcagcuagagucaagagcucagggguacugguuaguucauaauguuguuccaccuauaggguugaagaucccuuuagcuccuuggguacuuucucuagcuccuccauugggagcccugugauccauccauuagcugacugugagcauccacuucuguguuugcuaggccccggcauagucucacaagagacagcuacaucuggguccuuucgauaaaaucuugcuaguauaugcaauggugucagcguuuggaugcugauuaugggguggaucccuggauauggcagucucuacaugguccauccuuucaucucagcuccaaacuuuguuucuguaacuccuuccauggguguuuuguucccacuucuaaggaggggcauaguguccacacuucagucuucauuuuucuugaguuucauguguuuaggaaauuguaucuuauaucguggguauccuagguuuugggcuaguauccacuuaucagugaguacauauugugugaguuccuuugugauuguguuaccucacucaggaugaugcucuccagguccauccauuuggcuaggaauuucauaaauucauucuuuuuaauagcugaguaguacuccauuguguagauguaccacauuuucuguauccauuccucuguugaggggcaucuggguucuuuccaguuucuggcuauuauaaauaaggcugcuaugaacauaguggagcauguguccuucuuaccaguuggggcuucuucuggauauaugcccaggagagguauugcuggauccuucgguaguacuauguccaauuuucugaggaaccgccagacugauuuccagagugguuguacaagccugcaaucccaccaacaauggaggaguguuccucuuucuccacauccucgccagcaucugcugucaccugaauuuuugaucuuagccauucucacuggugugagguggaaucucaggguuguuuugauuugcauuucccugaugauuaaggauguugaacauuuuuucaggugcuucucugccauucgguauuccucaggugagaauucuuuguucaguucugagccccauuuuuuaaggggguuauuugauuuucugagguccaccuucuugaguucuuuauauauguuggauauuaguccccuaucugauuuaggauagguaaagauccuuucccagucuguugguggucuuuuugucuuauagacagugucuuuugccuugcagaaacuuuggaguuucauuaggucccauuugucaauucucgaucuuacagcacaagccauugcuguucuguucaggaauuuuuccccugugcccauaucuucaaggcuuuuccccacuuucuccucuauaaguuucagugucucugguuuuaugugaaguuccuugauccacuuagauuugaccuuaguacaaggagauaaguauggaucgauucgcauucuucuacaugauaacaaccaguugugccagcaccaauuguugaaaaugcugucuuucuuccacuggaugguuuuggcucccuugucgaagaucaagugaccauagguguguggguucauuucugggucuucaauucuauuccauugguccacuugucugucucuauaccaguaccaugcaguuuuuaucacaauugcucuguaguaaagcuuuaggucaggcauggugauuccaccagagguucuuuuauccuugagaagaguuuuugcuauccuagguuuuuuguuauuccagacaaauuugcaaauugcuucuuccaauucguugaagaauugaguuggaauguugauggggauugcauugaaucuguagauugcuuuuggcaagauagccauuuuuacaauguugguccugccaauccaugagcaugggagaucuuuccaucuucugagaucuucuuuaauuucuuucuucagggacuugaaguuuuuaucauacagaucuuucacuuccuucguuagaguuacgccgagauauuuuauauuauuuguggcuauugagaaggguguuguuucccuaauuucuuucucagccuguuuauucuuuguguagagaaaggccauugacuuguuugaguuaauuuuauauccagcuacuucaccgaagcuguuuaucagguuuaggaguucucuguuggaauuuuuagggucacuuauauauacuaucaaaucaucugcaaaaagugauauuuugacuuccucuuuuccaauuuguauccccuugaucuccuuuuguugucgaauugcucuggcuaauacuucaaguacuauguugaaaagguagggagaaagugggcagccuugucuagucccugauuuuagugggauugcuuccagcuucucuccauuuacuuugauguuggcuacugguuugcuguagauugcuuuuaucauguuuagguauuggccuugaauuccugaucuuuccagaacuuuuaucaugaauggguguuggaucuugucaaaugcuuuuucugcaucuaacgagaugaucaugugguuuuugucuuugaguuuguuuauauaauggauuacauugauggauuuucguauauuaaaccaucccugcaucccuggaauaaaaccuacuuggucaggauggaugauugcuuuaauguguucuuggauucgguuagcgagaauuuuauuaaggauuuuugcaucgauguucauaagagaaauuggucugaaguucucuaucuuuguuggaucuuucugugguuuagguaucagaguaauaguggcuucauaaaaugaguuggguagaauaccuucuacuucuaucuugugaaaaaguuugugcagaacuggaguuagaucuucuuugaaggucugauagaacucugcacuaaacccgucugguccugggcuuuuuuuggcugggagacuauuaauaacugcuucuauuucuuuaggggauaugggacuguuuagaaggucaacuugauccugauucaacuuugguaccugguaucuguccagaaauuuguccauuucguccagguuuuccaguuuuguugaguauagccuuuuguagaaggaucugaugguguuuuggauuucuucaggaucuguuguuaugucucccuuuucaguucugauuuuguuaauuaggauuuugucccugugcccuuuagugaguguagcuaaggguuuaucuaucuuguugauuuucucaaagaaccaacuccucguuugguuaauucuuugaauaguucuucuuguuuccacuugguugauuucaccccugaguuugauuauuuccugccgucuacuccucuugggugaauuugcuuccuuuuuuucuagagcuuuuagauguguugucaagcugcuaguaugugcucucucccguuuuuucuugaaggcacucauagcuaugaguuucccucuuagaaaugcuuucauugugucccaaagguuuggguacguuguggcuucauuuucauuaaacucuaaaaagucuuuaauuucuuucuuuauuccuuccuugaccaagguaucauugagaagaguguuguucaguuuccaugugaguguuggcuuucuguuauuuauuuuguuauugaagaucagccuuagugcauggugaucugauaggauacaugggacaauuucaauauuuuugaaucuguugaggccugauuugugaccuauuauguggucaauuuuggagaagguaccaugaggugcugagaagaagguauauccuuuuguuuuaggauaaaauguucuguagauaucugucagauccauuuguuucaucacuucuguuaguuucagugugucccuguuuaguuucuguuuccaugaucuguccauuggugaaagugguguguugaagucucccacuauuauugugugaggcgcaaugugugcuuugagcuuuacuaaaguuucuuuagugaauguggcugcucuuguauuuggagcauagauauucagaauugagaguuccucuuggaggauuuuaccuuugaugagaaugaagugucccuccuugucuuuuuugaugacuuuggguuggaagucaaucuuaucagauauuaggauggcuacuccugcuuguuucuucauaccauuugcuuggaaaauuguuuuccagccuuucauucugagguagugucuaucuuuuucucugagaugaguuuccuguaagcagcaaaauguugggucuuguuuguguagccaguuuguuagucuaugucuuuuuauuggcgaguugagaccauugauguuaagagauauuaaggaaaaguaauuguugcuuccuguuauuuuaguuguuaaagguggcauucuguucuuguggcugucuucuuuuagguuuguugagggauuaccuucuuguuuuuucuagggcguuguucccguucuuguauugguuuuuuucuguuauuauccuuugaagggcuggauucguggagagauaaugcgugaauuugguuuugucguggaauacuuugguuucucccucuaugauaauugagaguuuggcuggguauaguagccugggcugcaguuuguguucucuuagugucuguauaacaucugcccaggcucuucuggcuuucauagucucuggugaaaaaucugguguaauucugauaggcuugccuuuauauguuacuugaccuuuuucccuuacugcuuuuaguauucuaucuuuauuuagugcauuugauguucugauuauuaugugucgggaggaauuucuuuucugguccagucuauuuggaguucuguaggcuucuuguauguucauaugcaucucauucuuuagauuugggaaguuuucuucaauaauuuuguugaagauguuugcuggaccuuugaguugaaaaucuucauucucauccacuccuauuauccguacguuuggucuucuuauuguguccuggauuuccuggauauuuugaguuaggaucuuuuugcauuuuccauuuucuuugauuguugugccgauguucucuauggaaucuucugcaccugagauucucucuuccaucucuuguauucuguugcugaugcucaaaucuaugguuccagauuucuuuccuaggguuucuaucucuaguguugccucgcuuugaguuuucuuuauugugucuacuucccuuuuuaggucuaguaugguuuuguucauuuccaucaccuguuuguauguuuuuuccucuuuuucuguaaggacuucuaccuguuugauuguguuuuccuguuuuucuuuaaggacuuguaacucuuuagcaguguucuccuguauuucuuuaagugauuuauuaaaguccuucuugauguccucuaccaucaucaugagauaugcuuuuaaaucuaggucuagguucucagguguguugggguucccuggacugggcgaagugggugugcuggguucuggugauggugaguggucuugguuccuguuaguaagauuccuccguuuaccuuucgccaucugguaaucucuggaguuaguaguuauaguugacucuguuuagagauuguucuucuggugauucuguuaccgucuaucagcagaccugggagacagauucucuccucugaguuucagugcucagagcacucucugcuggcaagcucucuuacagggaaggugcgcagauaucuuguauuuggaccuccuccuggccgaagaagaaggcccaaaacaggaccuuucucagacacuguguugcuuuggcaguucccaggugguacagacucucaccuaagcagacuaaauuccuaaguuccuuggagucccgggaccaagauggcgaccgcugcugcuguggcuuaggccgccuccccagccgggugggcaccuguccuccgguccggaagguggccggcuguccccggcccacacagggugcugccucagcgccucugugcuucugccuguuccagaagcugucagguucucuggcgcacccucucaccuguucagacuaauuuccuaaguucggcgggucccggaccaagauggcgaccgcugcugcuguggcuuaggucgccuccccagccgggcgggcaccuguccucugguccagaagguggccggcuguccccggcccacaaagggugcugccucagugccucugugcuuccgccuguuccagaagcugucagguucucuggcgcacccucucaccuguucagacuaauuuccuaaguucggcgggucuuggaccaagauggcgaccgcugcugcuguggcuuaggucgccuccccagccgggcgggcaccuguccuccgguccggaagguggccggcuguccccggcccacaaagggugcugccucagcgccucugugcuuccgccuguuccagaagcugucagguucucuggcgcacccucucaccuguucagacuaauuuccuaaguucggcgggucucggaccaagaucgagaacauucuuaugaacuugccauuucaggggcuuuuaaaagucagucacauagucauacacuaagacuauaaguggaaacauguugcaagauucacuuaccugcucauuucugcacugaaaaccaguccguuuuagccuuuagcaauagcaaguguaaacaaccuccaaauucaaggggcuuuccuaaguguacuauuucuaaaauucaaaugagcauugugguacuaaguaguugaccaaaaguguggugauuauaccacagcaguugcugacauugcugugccaucuguuguuguagggccugaugaugcucaacaaaagauagaaccacaucacacagcaguccuuggagaaggugacgcuguccaguuggaaaauaagguauuuuaaacuuaauuuuguuucuucaugcccccccccucucucucucucugugugugugugcaugcguguaugugugugugacauguaugucugugugugacauguguagguugaacacuccacacauaugcagaugucaagggaggaugucaauggagugucccaccucccaccuuauuccuuugagacuguugggucagggucccuuucugaaccuuaaacucacuauugcaucuaggcuaccuggccagggagcucucagaaucaaccuguuucuaaacauccgaacacacacacacacacacacacacacacacacauacacacacacacacgcccugaagccugggggguuauagguaugaaugaucacacacauauuuuuaugugggugacugggauucaaauucagguucucaugguuuagcagcaagugcucuuaccaacuaagccauuuucccagccccaaauauucaauuaucuuuuuaaaaauguuugaguuuuauaaacucauauaggauguuuugaucaaauccaccaccuuccuuuccuuuccaaucuuccccccucucccucauuauuccuucccaguauuccuucauguacugccucuguuuuuaacuccccaaguccaccuaguaugcuggcuguauguacaaggguguaggacugucgucaucuggagcauggguaccuucucagggguuggauuccugaagacaacaaacacuuucuuccccaucagccauagauacaaauaguuccucagaugggauuggaacuuuaugaucccuccucuaucccugaugggauuuugucugguuugaucuuguguaggucuugugcauaaagucguagcuccuuugaauuuguauguauaauggccaucauguccagagaauaguuucauuauagauguccgcugucuggacucuuacaaucuuucacuucccuuuaauuuccugaacuuagacuuuuuacugauuuccaugaaaaugcuuccauugagauggaaauuuuuuucucuuccuugggaaauaaaucaugucacuguuuuaucaagccuguuuacuaauuucugcugauuacauugcucuauuuugagguuucuauugguauaucucacaguuucauauguauucauaucuugucuuuugcuaccauguaaaagucuauauuuggaucuagaggcaaugcaucuucagcuuuuaaaauauuaccaucauaaaacugauuuauuucuuuuagcauaaguaaaacuaagcuagccacccaggaguaugaaugcagauaugcaugcucacagagaguccuuucagaagcauccccauuuggagcuaaaaagagaguguuauguuauucauaguuucuuuaaaugaaucucuccuuuuuaugguuuagcgcucuugggaacaauuuuuccagguuucucaguuuuguuuuuuguuuuuuguuuuuuuaaaugucuguuucaucucauugagcaaucgucucaucauucugugagcccauuaaggcuuucucauugcuuugugucacuccccaguaaggaagacugaggagacaauugugccccagcaccuggguaguuccacugugaaaagcaggaauaggaacuauuucaguggccacugaauggagaagugaucucucucacuucuagcucucugacccuaguaucacauaaugcaguggacugggggagauuuucuaucucuauccaacguacuaguaauuuaccugcuccuauacugauguccagaagcaccucuaggaacuauuaacagaaaaaaacaaaaugucugaaacaccagaaaaugcauaucccagggucuaugcccucuguuuuaugucaaaccauacaaaacugccauguuugaccuacaaaaaaaaucgacauaccucaacccaauauaaagaaaagguuugaaaauuauuuaugggccagacguuuguaauauauuuaguuuccaauaggaucugguuauguuuggcaacuucaguucucccuauuacaucccaaagaauaccuuguaggaaaggauggagaagccaagauggaaagaagugaugggggaagcugcaggucagaacauagcuagaguagacaaaaauaaguguuaguucauuggcaaaauggcagcugugacacaggggcauuuuguuaccauuuuaugcaguuucaucauuguuuguauggcaaccaugcauugugacaacuucagaaugaaaaaaauauauauuuaaaauaauaauaauuuucauuuaaagaggucaugugucuguaggaaguccccuuuauauuacaagauagaggcugugaucauugggucuuggcuuugccacuuguuggcugugugacuguggauauguuucuaaauuucucugugcuucguuuuuguucauuuguuuuuacauuuauaauuuaucugugugcaugugugugggagugcacaugccacagaauguauguggaauccagaggauaacuuucaggcaugguuucuuuucuuccaccaugugguuccaaggcaucaaaccugagucguccagcuuggcaccaagucccuuuacucaaugaucuguuucacuagccuaggcuucauugcauuugucugcaagauugaaagaauugaggccaacuauguaggacuguuaaaaccaaucugcauuaccuaugccagggucuguuccagaucuagcacagagggcaguaaauuaugucaaaaaggccagauucagaucuauuucuuuguguuuuacugguucacugucuuaccuguccaauuucuguauugaccauggauuguuauaguguguagguagaagucuguuauggcagagacugcauccuuaaaacuuucuggcccuucauuugucaguccuuggugcaguacauuuuagguacgcaauaaugguaaguggaaauaaaacuccugacaacaccuaauuuaacugauuaacacauaagcauugucuaaugaggauucacaucacagguucaaugacacauagcaauuuucacaucuagcaacagcucugagggauacugaccaauagguuuaaaagcaaagcucuucaucuccauguggaacucacguuagccugaagauucuaacaagaaaaaaagaugagcugaauuguagucaagaaugaggaacugauuugcaccucacuuccuucuagcucuguuucagugcaucucaccugcaugucuuccaccauacauggccggccaauaguaugggccaguccucuaggguggccacucuguagggcaagagaagaagcaaagaaaggauggugcacaaagccacaccuccauuuucuuugugccauuucaccauuuauuugcuuuauuucggguuaacauggggcagcccauaagaacccagacuuucuuccuuaguggguagauuaccuuauccuguuauuucuuuuucuuuuuaugugaugaugcaaaccccagucuucaugcuugugcaauaagugcucuaaccacugagcaaucuccccuacccacaccauuauuccuaaguuugcuguaauaccuaacaguggcaguggcuuugguuuauaccagguuuaaaagucuuugggccagacccuuugacuucguggacaaaguccaaaguauggguacuguauaaugaauucaaauauuucaaaguucuuagagauugcaaacgucaagcuauucaggacacaugauccugaauugguacaggucaccuugaugugccuguuucaaaaguuccccaugucgguuuggccuacaauuggugugcugaaauuuucuccugagugaugguuagaaguacaugaguacacuuacaaagacuccaucuaaacuuuagaccauguuguaccagagucuucgaagaaucgcaagcucauuuguaguaaguguacggaaguagauaaacacuggcugucaugaaaacaauggcugaggacaccuaugcucuuaaacugucacaguucauggaugucccauucaaaugauuugauuaauaaccaguaaaucccagaaaugaaacaaaccacccaaugagagcuaaaggcaaugauuugcuuuauucuguguaaaaguucaugauaaaaagaaccacuagaaauaaaaaagaaacacuagguuguuuuuuuaaacucauuauaguucacuguuugaucuuuccacugaugcccaaaguauaaauagugaagucuagaaagaacaacugcaugcaauuaaaucaugcugaacuucaauuucuuuuggaucauuuuuccagguaauucaucacaguaauaaaugcuacuguaggcagaaaaugggccuuagcuuugcucacaagccugcucuuauuguaagcuuugugguuauaaucaauuuaaccgaguuagaaacucauaauuuggaaguuaucaacacauuaaauuaccccugggccuuuccucuggacuuugaucauguauuguuggucccaaugaaacucaacauauuuccuagccguaaguuaugggguaucaaaagcaauuuacguauuuuuguuuuauuucguuaaagugccaugaugcacuugaagaaaucaaaggacaaaucuuccaaguucguuucuaccaugugggugucaggaauaaaauuggguggucaguaccuuuaccugaugaugaucuuguuggcccugagggcaagcuuugaaaguuuuuaagucagaugaaaaagacuuaaccccacaacacccagaggaagcuccacucucaggugcucuaacacacucaggaucccagaaucacaggaucccaggagcguggucacacuaggaucucagggucccagaggaagcuugccucacaagaacucugacacacccaggaccacaggaucccggaaucacaggaucauggagacagcuggacucugaggaguucugacacagccaggaucacaggaaggacaggcuccagccagauauaucgagggcagguaguacuagacauaaucagauggcaggaggcaagcauaagaacauaaacaacagaaaccaagguuacuuggcaucaucagaacccaauucucccaccauaguaaguccuggauacaccaucacaccaggaaaauaagacucggaucuaaaaucacuucucaugaugaugauagaggacuuuaaggacauacauaauucccuuaaagaaaugcaagaggacacagguaaacagguagaagcccuuaaagaggaaacacaaaagucccuuaaagaauuacaagacaacacaaucaaacaggugagggagaugaacaaaaccacccaagaucuaaaaauagaauuagaaacacuaaagaaaucacaaagggagacaacccuggaguuagaaaaccuaagaaagagaucaggagucauagauggaaacaucaccaaaaagacuuggcuaggaacgaggaagacacaccaaagcaaaaggcaggagcugcaauuuuuaaagguccugcuucagaguuggaguuguucuacaugaaaaagucaucugagccucuaggaccauguacaggaugcugaaaaucaguguccguaaaggcauuggcauagaggcaccuaaggacucgccuaucuuuggcucaucguucaaccucuuugcuuuugcauggcuucuaucauuugacacuaucaaugaacauuuucuacuggggcuuugaacuacauuaacacucuaguaaauaccuguaguggucauuagaguuuuguuuuuuuuuuuuaacuaaugccuuguuaggaaaagaaagacaaggaauagggaggggggucaguggguaaugguacuugccuccaaaccuggcaaccugaagucaauucccccagguggaagaggagagcgaaugaucagaagcugugcuuugaccuucauauacaugccaugauaugcaugcacugccgccccaugcucacaauaaauaauguaaaagauauuuuaaaucgaaggauagaaaauagauauggcuuaaagaaggggcagcccagaugacgaaucuguagcaagaucgcugaaagaaguuuggagcggaaaccuucaaguuuuacagggauggaaaacuucucuucgacuccugaaggguucauaauuucucauuucagacaaaaugcacgcguccuucccuccugcuguccaaauaauaacuggaaagucaucauuuuauuugaguaauauaaaagagucaagcuuuuguuuuuagcacuuucucauuccacaguguggaaacaaggcauguuuaucacuccccaaagaccucucuucugauuaggaaacuuucauugugaacagucagcacuugcguagccuuucuuuucugcuccguuaacucuuuccccuccacuuccugacccuccaacucaauuuuguguccuuggccauguccaaaacaaacaacagaacacuguuagaugauccuuuucuccgugucucuaagaggccuuuucaaacaucugagggaauaaguccuuugugauaacugacuuguuaaaauugcuguugaggucuuagucauuaaacaucaaauuugaaaagaaaaaaagaaaaaagaaaaagaagaaagcaugccagaugcaaacuucccucaguuuuguccaccaguagcucacuacgaaaacuguagacaucucuaaagccucaugguauuuugguauaugguauggcaaaacaaaaccuccuuucuugguucucugaauuguuguauagacugaacaacgauuguguugguuaaucguaguugucaacuuggugcaucugagaccagagaaucuccacugaggagucaccuucauugcguuggccagggugcauggcuguggguuauuuucuggaugguugauugauguaggaggugugugggucguagugguagacaauaucaucucuaggcaagugggccuccgcugaugagaaagguagcaaagguagagaaaggcucagcugcuaagagcacuggcugcucuugaagaaguccugugauugagguuccuagcaaccauauggcagcucagaaccaucuguaguucacauuucaguggaucuccuuguuucucucugacuucauucacaugguuaccaagcaugugugugcacagucagguaugcagacaaagcacucaugcauacaaaauaaauaaaucuaagggaagggaagaaggaagagagguagcagagcaugagccuggaagcaagcuagucagcaaugcuuuuccauggucucugccuuaguucccgccuccagguuccaguauuggcuuuggucaggguuguaucagagaaacugugaaacuauaauaaguacagugacuagcuguuagaacuuuauagaagcaagagucaguaggggguggauggagaucugugccuacagcaaagaaauaauuugacuacgugagccugguggcaucugauuucaaaagagugauuugcagcuagcuuucuauugguaugcguuuggggagugagcuggguaugagucaguauggcgaugaugacuaaaacauggcagaccugaggaugcuuagacuccugugaagaaguaauagaagcaucaacuaagugcaggggugaaaagccaccagcccugagauggcaggagaagcagaugaaaacuuuugaagaaaccauucuaccaugucuucuuacuuaauucuuaauugaagccaaaaagaaaaguucauugcaguccucuugcagcuuuuauuaaauggauagaagaaaaagagguuaauuauuaauuuuguuaacuacaaaaguaaaucuucugagacuaugcauuggaacgacaucaaauuaaagagauuuguauuaguagaagaacauaacuauuugauauaauuauaauagagcuucguauuaguugaaauguauaaauauuugauauaauuuagaauaguguugaauauuuagaaaaugccauauaauuagaauaugaaugaaguuuuuaaaacuuaaagcuuuaaaauauauaguaauuugguuuauuauaacuaucugauugaaaauuauagaccugagagaaaacugggaaaaaugcaauaaaaacauaaaaauaauauagaaugcucaguuaccuauuuguuuuuuuuggggggggcagucgagacaggguuucucuguguaacccuggcuguccuggaacucacucuguagaccaggcuggccucgaacucagaaauccaccugccucugccucccaagugcugggauuaaaggcaugugccaccacacccgguuuucaguuaccuauuuguaaugaacgauuaguaguuaguggcuuaaaauaauaacaguuuccaguuucugaucaucauggugguugacuccucuacugagcucuuauuugugggaugccucaggucuccuuuaugugugccuccuuucugguuaggucacuauuugucuccuuauggcccuaauaagaaaguuccuuccaagccagaguauuggcaaguaggagacuugaaggcauuaaaaacagaaaugcaagaagucagaaaagucaccagaguuaagcgcagucagucacuagcaugacaccaugaaagagaggccaauggagauguguacagccagagcugugggaaugggucuggggacacuuuggguuagaaggguuagccacuggggagggagcagaaugaggacaagcuggaaccuaucagcaccccugccugccauucacuacuaaccaccauaugauugcaagagcagagcaugguagcuacuuuaaaauauuuaauguuuuuauaauauaaugaucaucugauuuuaagccagaaacgcauugguuauaaaaacaauucuccaaacauuauacccacauauauguguacauuuugcauuguauauguguuuucauuuuaaaggcacugaggcacauuuccuauuacuuuaguaagugacagagcaaucaagucuugguuuuggauuuguauaaguauuauuuccauuuaaaaaaaucuauuguuagacugggcuuagcaguuaagagcacugguugccauucaagaggacccagguuagguuuccaucacccacauggcagcucacagcuacuuguaagcaguacagguauagcaacacccucuucuauucuccuuggccauguaggaaaaacacucauccacauuaaauaauaaauaaauaaauaaauaaauaauuaguuaaauaagucuuagacauuauauuguugcagaaaagauggaaagaauuuaagagccagaggugguggaugagcccaagggaagaguguuuuccagacacaacaacguugauguacguaugaacucacagagacugugacagcauacacauagccuguacaguucaaacuggacaaaucccacccugaaaaaagggggacauggucacaaaaucucacugcuaaccaaggaucuauuuauaauggauagcuacugggagaaggaaaaccaguuuuccauggagugacacagaggacaucaacuacacuccaggccaggcuccguguacaggauuaguuggccaacaaaaaauagacuccguguguguguguguguguguguguguguguguguguguuuguguguguguguguguguguguguguauacaugugcgcacgcuuuuugggggcuugguuugaagguuauuuuaagaauaagaaaaaacagccgggcgugguggugcacgccuuuaaucccagcacucaggaggcagaggcagguggauuucugaguucgaggccagccuggucuacaaagugaguuccaggacagccagggcuauagagaaacccugucucaaaaaaccaaaaaaaaaaaaaaaaaaaaaaaaaaagaauaagaaaaaccaugaaauuauguaacuagggagaaggugggauaaaagguaagggaaagauaaccaaaauauauaauauggaaaaauuaaauggaaaagaaaagacaauaaaauuaaaaaaaugauuuuguucaugagagauaagcuaguuuaaucagauaguuuguugggaagaugcuccuguuaaaaaugacccuagcuuuggugcugaagagaugguucugugagugaauugccuggauaauaaagacuugagucugguucccgagcagccaugugugagacugaaugugauagcauagaucuguaacccuauaucagagauaagccaaacuagaucccuggagugugcuauccagucauucuaggcaaagggugagcucugcuuucacugagagacccugucuucaaaaauaagguagagagguauugagaaagacacuugacaaagaccucuggccucuacacacauacauaugcaaauggaccuacauacgcacacauagacacacaaacacaaagaagacauaaauuacaguuuucuuucuuuaacuuacagauguugauacauugguaaccugggcuuauugcugaauucucauugcuaaaauauuuaaacauccuaaggaauaaacauucccuuaucaaggauugcagagauguuucugaaauuuuuccuugguaccauggcccacuuaauuuguaucuucacuaugacuuguuuccacuuugauacuuaaaaauaaacaugccucucuggagaggcccuuggucuugugaagauuauaugccccaguacaggggaaugccagggccaggaagugggaguggguggguugggggcagggcggggggagggaauagggggcuuuugggauaccauuugaaauguaaaugaagaaaauaucuaauaaaaaugccuuaaaaauuguaaaauaaaauaaaaugcucacuguucagugcuuucuuugaugaccuuaggaccccaaaagaagccauuuugucuuaauugcuggggagccauuaagagaaccaguuguccaacaugguaaguccaaaaugcuaauuucccuagcucacuuucuuuuccuuugacacauauacacacauauguguguauauguauguauauauacacauauaauuaaguguguauguuuguauguguguguguauguguguaaaauaaagagcuuuauuuuagcagauauugcauagaggcuuggagguuuaacaauauggcacugucaauguuguuucaacucuugauagaaaguagaaaggcaaaggcauauauacugaagauaccaaacuugaggcacugaugcuucauagcagucugcagcugugguaauacagacagucccccaagaaugugaauuugcccacuggaaaagguauuaacucaucugaaugaccuagucaccuuuuaaugaucccaccugccaauaauuccaacgaacaaucaaauuucaauaugacuuauggaggggaaaaucaauauucaaaucauagccaguacuguccuugcaaucuauucuauuuuuaguguauauauuuuaguaugagccucuuaugaauaauacuucuuugaaauuuucuauaguaguuuaaauaaaaaaaaaauagagggggcuggaaugauggcucagcagugcauacuccacuagcagaggauuugaucuuaguucucagcuccagaaguucuaaugcccucuucuggcccuccuugggcaucugcacagguacacgcacaugcacacacacacacacacacacacacacacacacacacacacgugcgcacuuacuuaaaauaaauauuuuugaagaaacagaaauagaauuaguguguggaggaggcagugcuguaguugaagguaggaaaugcuggcagagauacgcaaucacuucaaccucuuggaucuugauguccuuguaucauuggcacuuuauuaaaugacaaaaaccuaaaagcaccuagaacccaacuuguuauuuauauuuuugccuacaaaacauacugugcaacucacugaguauuuaauuaagcaugacuuaagaucuuaucauauuccauuacuuggcaugaauccccaggcauaaacuaugaucucagauaagccccagcuggucaugcauuuaaaucacacggaauauuuagaaaguauucuuuuuuucuuccagcaauaauuuaggggggauauuaaaucauauuuccccaguuugugacauuucacguuaaauuuguacaguucaaaaugucccucccaagguucauagucccuucuuccuuuugucacgacugaauaaaauuguucuucugcaaagaaaacuacaaccaaauguaguaggcucauuaucuaguuguagacuggaauuuguagaggagaagugugcuuggggugaaacccuuuuacguuagcccuuuccuccauagcaguuuuuagaaguucaagaguccaguugaaaugaagaugacaaagcaaaauggcaggcacuguguaugcaaauccucuuccagugccuccgacacuggguauucuuguaaacaccagccaacauuaaucagacaaaaauauaugccucuugggcugucaguuacuagaggcaaagcauuuugucuaguuagcuuaauuuagucuccuuuuuacguuuuuuguuuuguuuugccuuugcauguuuauaggcagccacaaacauccugaguacuuggcggcugguugugguuuuugugaauuauuaacagccugcuccuccugugauugaguggucagaaugaugacauuaggcauagaagucauagcauguuggaauggaaaacuaucuuaacuuugauggaguuaugucccuccuacaagugagaaaaaaaugcagauauuucauuuucuuagcauaugcauugaugccauuuacuauuuacuaagaaucggucauagucuuuugcaagugcuaauuuauugagucuucaaaaccacacuggaaaccugucuagggugacaagggaaugaagaaaagauggacauacagacacaucuucagagagcuggacucgguugcccuguacuugguaccacugacuaugcuacaacccagaaucuuggcacuuuucauguguguguguguguguguguguguguguguguguguguguguguauguguguguguguagcacaggggaaagaaguuagcucaucucuguggggucucuguguggguggucucugcaguuggagacauugguucuuaucaauaauacacauucagucaagacuuccucuguucccuacaccuuccuaggugacccaaggacaguuuauaaaacugagggacaugguauggugucaaaauaggauauagauacauacuacagaaaguuguggcauaagauuaguguggccucacuggggaaacaaugggaaaauuauuaugugcagcaagugaguccuugacccaguauuuggucuguuugacugauaaaaucuaaaguggccuuuuccuagcccuuugaugaauuacaaaaaaaugguuaacacuaugaaauaauuuuuaaaaaugcuucuugccuugaaauauauuaauaaaauuuauuaaagcuaugguguuggugaucccuggcaagaggaugaucacacuaguauaacauaucuuuuggaauggugggggggugggaagauaaauuaugaugggaaugaaagauaaaacaauagaaacauuaaaaaaaguuaaagaaagacgaaagucccuuuacuugcaagaguaugauagugacucgugacaggaaggagaaacuagccaaacuuaaaaacuugaccuacucuaugguuccuauagggcacaugaagguaucuucuggagaacuaccaaaaaaugcaaaugugcaaguuguuuggaagugauuaauacuucucuuuguuguaaggaaaauucuguuaguuuucaaaauagauugagacacaucccagaaaggcagagccccguccacugcuuagccagauaccaaaacucugcuacaaucuagcugguuuuauaauaucaaguugguucaauuccugccauaaguucaggaucuacaaaauaacaacuacagaaugugcuggaaaaagggauugucauugcuugugaggaaccuucaguagacagugagacucaauccuguuuaucuaagucuggucugaaugauaacauauaauuguauauaguccuagccacaaaacacaaaugcuaacuaguuccguaugacugaacagugugaaaaugggcuauugaugcccagcuaugccuagauuuuguuuuaacugaggagcuauaggaauacauaacaauuauagugauagaggaacaugucaucacccagaacuuugugaaugucucuuucugcccuagguccauuugugaugaauaccaaugaggaaauuucucaggccauucuugauuucagaaaugcaaaaaaugguuuugagggggccagaaccuggaagucaaagauuggaaacuaaugaagagcugagacgcugccacuuggauggacuggccauucgguauauuaaauuuccaaggcuaguuuagcuggugcuucugaagccacauuaagcugggcuuagugaugcagaguccuuuaaucccagcacucuaggagucagagacauuggguaucuccgauuuccaagcccaucugucuugaaaauggaaaaauaaaaaauagaauuccacauuaaaaagauguuuuuuuguaaugaaucuucagaaugcauuauauucauguuugaaauugucaaagaauauguuuaauuuaaaaaggaaaacuacaaacaauaaaaaaauggcaguaacauauguaaaauauuuccugauacaugcaaauaauuuuacuuguugcuuuuaaaaaaucaauguucuucauuugguagaaauuauuaagcaccuauaaaaauuaauugcuauuuac

SEQ ID NO: 9824 - RNA, 60631 nt, Mus musculus
cagcaggauuccagccaagacuucccagcguuuucugccaaacucugucagauuuaagacauaugcuccugcaagcucucuugaagguugugaaaaaguuugaauccauaguuggguuuuagccugcuguaacugcaaguguuuguggucauaccaccuccuuauaaagcagcuagaaccuugagcguagggugggguuuuuuuuuuuaucuucaacuuucuggauaagaaaugucuguagagugauuucuaguuucaaguggaagauaugaccaccuccugauuauuuuugcagcgggaaacuuugaaauauuuuucauugcuuucucccauacuaagauugugugugaggcagugagggagucccuugacuuacucaagucauuucauuggauuuuaauuacaacugaucaugugauuguuuuuuuccauguaaaguuuggggcuucaaacuuugcuucuggagaaugccuuuugcaacacuuuucaguagcugccuggaaacaacugcuuagucaucgguagacauuuaaaauauucaaaauguauggagaauggggaauggggaauauccucaugauguuccauguguacuuggugcagggcuucaggagcgaacauggaccagugaagguaggugagcuugaauauuucucuuuauuggcuuucacagaaaaaguccuuugcccucgcugguuuugaagcagucuaaaagcccugccuauucuuagccuguguguauuaaugcuuuacuuugggggcuuaauaaguuucuuaccaugaauguuugaaaguguguguguguguguguguguguguguguguguguguguguguuuggaauggggacagaacaugagcauucuggaaaucuuugacacggaaccaguuugcucccaguugugcuugcagauggcacagugguuuucuguugaagcugugauuugccucugugacacacacaauuuugugggcccuugguuuguagguuuuugugagcagccagguugaguaauuucuucuguaaauugaaaaucacagugguuuuuguguguguguguguguguguguguguguguguguguggauguuuucugucugguuuugcuuauuaccaauuaccaauugcuaccauucaggaaagacaaguuuucuugggguuuguuuuuguuuuccuguuucugcuuuagagaaaugugucuaagauaaaguagucagcagaucuuugguucuaugagcaggcaucaaggacagcccaagacauugagaaccaugcaaaaaggaugaacaaugggauuacugacugcuagaauaacauuuucguuucauauuuuguaucuuucaagccuuuuuauuuuugaaaaggacccggaugcaauuguuuugacuggagugcuacuaaaucaugacugauuuagaaaucucuggcuaugagcagauagaaaucagaugugggcuugaguuuuauggcuugaauuuuccauacgggggagcauaucgccccccagaggggaaaauuaguucaugacgaugugaacucuuugacaugggaaccaucauaugcauagaguccauaaacagguaguaacucugcauccagguuucauaggucaagacuaacugcuccauuuacaguuuucacccugucaacuauacucaaaaguggauuuccuuuccccugcagccugacauggagguccaauaucaaggcugguggcagucagguagagcugagaaguguccuuucugccaugugcauuuuggacucacaaagcuugaaagagucaggcugcuacaucgaagacuuucuaacccagcauaguacauaauacuguucgacaguucacuuacuaccagccuucaacccuaugccccagugaagucaucccucuucagaauuuuuacucuuuuauagacacagcuaccagaauccucucuguguccuggauauagugaaguuuuaaguuuacuguuucuacuuaaauuucuugaauggggcagugagaaagagcgacuggauuuuuaugugacagaaaacaugcccuaacagauggcaaaugugcaacauguguuuacuaacaugccuuucaauguuucucuuacauguccuuauauuuucccuugaaaaagagggaagcuacaucuagugaguuuacagcuaccgggcccccagcuaaauuagauuguuucuuauaugaagugcugccuguaauuaaaguuuggggacacacauuacuggguggugaagcauaauaaaauacauaauuuugauuuauauauucucuucuccccacacaccuuuuuuaaguguaaaaaucaauuuauuauacagcaaucacacagaaugcuucucaucuaggaggaaaauggcuucugccucccuuuccacccgacucacgauacuguguucuucagaugccauacuuucaaaggaaaauaaaaaggccucaauuuccaaagaagcaaccucuacuaacauuuuuaagugacacaggaauguuuggaaaggacuagaaaagaaugaucuguaacauacaaaaugcuauucugcccauuuugguaaaaauaaaauuaauccucugaugugggaagucaggaacuuaucuaccaauauguauaaauauaauugugauggguugacauuuucuaugcuaaauucauucagcaaauauuccauuuuauuuuaaaaguuggagaaaauuaagguuuuguuuguuuguuugguugguugguuugguuuugguuuugguuuugguuuugguuuugguuuuucgagacaggguuucucuguauagcccuggcugaccuggaacucacucuguagaccaggcuggccucgaacucagaaaucugccugccacugccucccaagugcugggauuaaaggcuuuguauaguauccgaguacuuuuguucucaugaauaaaagggaauucacuugggaaaacaguuuuuuuuuuuaaucagauuuuagagacaaguuuuuuauucuucuauuuuagaaaauucacacugagauggccuuucucagugcagauuucuuagaaaauucacacugagaugcccuuucucagugcagauuuccuagcucugcaugguuugucaggccuugggugguuugaggcuuagugcugcacugagccuuugcaaacacaccccuuuuaaaaugaaaacaaaaccaaugaaaucuauuucuuaacagugauguccuucuuauuuaaauuaaaauguaucauagaaauagauucaggguaggaaugguuuaagauacugguacuugauuaguuuuugccuuuagauauacaaauauguaacuuguuauucaaaucagcaugggucccccucaguacuaagucuaugagaguauccuuuucuccacucucccuucucuggccacaucuguucuagaauggcugugauguuaaaucuaucuccagguugcucccuccuccuggucugaacuuaacuucuuagcuuagagaauuaugcuguuuauuuagcuuagacaggcagcaacugugguacucuucuaugaaucugugauuuuuuuuucuacuauaauaacguaaaugucuacgagcauucaggacaauugugcuuaaugccauuugagugaaaaacauccuaauuuuacucuagccuuguaguuuaugcuuggaaaacuagcuguuuggugucaacagugcuuggaauauguaagcugaggcaaaucauuucugaaaucuuuuuuuaaaaaauuaguuuaaaaaacugugcuugcuucauuaauauauucagauugcugccuagauaugggauuuauuucaguuucuauuuucucaagugcuuuauacaguugagaugagcagagauaguuuccuaugguagucacuucacaacagccuaucuuauagaucuaaccauauuauucaguuauacccucuagauauuuacuaaaugauucucaacaacauuaugcuuugucauucaauaugaccuucucuccagcaugacuucaggcugcuuuaacaaauaauuguugucaccagguaugccgggaguccuuauaagaugcuagauaaagguagugucuauagaccuuuuccauggaguaaugaagaccuguuaguauagcaguagagaagucauuuuaggucaugauaacucucagaacucuuuuggaagaguuucuuucuucuuuaguuuugcucuauacuaucuuuuaagccaccucacuuguaaugucuauagaugguggagucauucagugccauauaagauuagaauaagccccaaauccacaugccucaagaaaguucuucacuauuaugccauuugccuucucuugaaauugucuaagaaguaauuugcauggaaacagcugauggguacugccuuccaucuuuaauuccagaaggcaaacccacuccuaccuaccuaccccauucucacucacaaagucauauacaggagaguuuucugccuugguugcuagcuagaugaaccaauaagauuuuagcaauuuuucugucucacuaugaauucaguugcagcuuuuacaucauucuagcauauuaugguacccaagauacacuagaacccucucuuacaucuuguguguauuacucauuuuuaaucgaaaaauccugacuuaacaccugugacuaaaauguugccacaaaccugucacaaagauaacuugugaaauaaacauaaugaucccauaaagcacuauuaguaaaaagaucuggaacgcucaggcacaaguauucccacaaagguaguagagaaauaggaaugcagaggacaauaaaauuauuccugagcaauguuuagguccaacucuuuuuuuuuuaauguuucuuuuauuuuaagcguaucugugucaggauaugugcacaugaguaugaaaaccugcagaggccacaagaggacacuauauccccuagagcuggaaucaccacccaacaaggaaccaaacuccuguucuuugcaacagcaguaaauacuuuuaaccacugggccaucuccgaagcccaaagaacucuuuuuuaucaugugauaugagcagagggugggaguuuagcauaauugggaaugaauugagauaaaaggagacagcgauaaaauuggaguuccugcuuaguuuguuuuuaugauggugaguccacuuuucuuucuuuuguuucuguuucuuauggcccuacuaagauacuaaagcauuauaaaucaaaagcauccugaggcaucuucaacaucaugaaagccuuugcuugcugagauguccuaacccauaaagacucuccuguaccucuuauuacaaaaaacuuuccaauauuugauaauuccuuacuuucuucaucagguauuguugaauaucuacugugucuaggauaugagaaugcagcaagaaauaaaacaauauuucagcucccuuugaguguguauuuugcuugugcuuaguagaaguggacaauaaugugucagggacaauaaugaaaagcacucacgugaaggaggggacacaaaaugcuugugaucaaggggagauucuucuaauucagcuauguuugcgcauaguccuuaaagaacugaaugaggcagaggcuaaagagggaggagcuuggauguucugaggaugagcaggauaacuagagugacuguggaaggugagcagcgagcagaagugcaguugucacaguuggaaaaguagcagggugggggugagcuccaauagaacuuuauagaugcuacaauuuuaauuuauguaaauuuuaugcaccagguaaccuuguuuucauuaguuccaaccauuuagaaggcaaaagcuucuucuuaacucacaggcuguucaaaaacaggcucaacccuguggcucauggggcacaguuuacaccucggauucaguguugguacacuguuugauuuuguugauggcauacaucugugucugacauuuguggucuguuugucccuguugauuacacccucaccaugaggauggaggcuuuucagcagagggguguaucauuguuuuguuugcugcuguguucuaaccaccacuuugcaaagccugucgcacaguagaugccaaaagcgguauuuauuggcugguugauagacuagccuuggaugauucugacauggucaggucaaagacaauacuggacagucucuggucaucaccauggcucaccuggcuucaugauuuguauaaaauccagaaccauuuuuaagguaguguauuuagccuguuauuuuacugugggaaugagauaagguuuacacgacuugguugaagaauucagaaauguccuuccagcccuaggccaucaaacagggaguucacuuccagaacccaaagauagaaagugaagucacuuuaggccauucuuucagucugaugaucacagaaagaaagcuacacaaaacagcaucuagccauacagugucugugcaccacuuagacacccuccugucuuuaucucugaaagccuucagaggcccuaucuguuuucaucuugggcgcuaauagaaagauguggaaauuuuugacaaagauacucuggucagaugcugucuuagugaguugcucggaaacccuuucucccugggagaaagcaagcuguacauucaguucaguaaacacguguggaaugucuuccaugugccaagcacaugaguggacacgaugcuucuuauaaaauaaagaugucuuagucauuuuugugucuuaccaaccucuggggaguucacuuuggccuguaucaaggauuauuuuaaugccugaaacugaaaguaauauuaaaauuucuuuuuaaauuucauuuaguaugcuucucucauauuuucuaucucaacuguaguuucuccucccagccuaucccucccaaccccccccccaccucccccagauccacuccuccucuguuucccuucacaaaagggcagaucucucaugauaccaaccaaacauggcauaucaagcugcaguaagacuaggcaccuccccucauauuaaggcuggaugaaguaacccaguaaggaggagaagggucccaaaggcaggcaaaaaaaucagagacagccccugcucccacuguuaggagucccacaagaacaccaagcugcacacuguaacauauaugcagagggccuagggcaguuccuugcaggcucccugauuauugguucugucucugugagccccugugacccccugguaaguugauucugugggccauguucuccugguguccuuggccccucugguuccuaccauccuuccucucucccucuucugcaggauucccugaucucugccuaauguuugacuaggggucuuugcaucagcuuccaucaguugcuagaugaagccucucugaugaugaguaugcuaggcucugguauaagaguauaguagaguaccauuaggaaucauuucacugauuuauuuauugccaguugugccuaggucucuagaugauccaguccguggcuccuggcccuccaggcgugucaggcauuggcucuccuggaaugggucucaaguuggaccagucauuaguuagcuacucccacaacuucuguguuaccuauaccucagcacaucuugaaggcaggaaaaauuguaggucaaagguuuuguggcugaguuggugucccaauacuuauacuugaaaauuuguguaguuacagaagauagccaguucaggauucauaucuuccauugcuaggagucuaagcuagggucacccucauaaauuccugggaguuuccauugcacuagauuucuaccucacucccgacgugacuggagagauggcucagccauuaaaagcuaggcucccaaccaaaaauacuaaauuucuacaagauuuauuucaccauuaacugaucucacuaaauaacuauagauagcacugacauguuggaguaucgcuuuuuggaaaaaggaaaucaacauuaaaauaaaaauuauuuccggagagagaaaaauauuuugcuguucuguugugacuggaacucuuuagaaaguauaauuuuuauugaaugaauaugaauagccgccucagacacaguaaaaguuuaauucugugcggugggagggucucgguuccggugggggaauuugguuuuuguuuguguagggauucauuguggggacgaggaagguagaggaaagagucugguacuuuagugagaccugcccggaagauggcgaagacuggaaucaggagagacaugaacacugaacaaaaauaaaaauaaagaaacaagggagggcagagugagaagagacgaccaugggacagaaaaaaaaaaaaaggaagacaacuagggaaggacuuaaaacugacgacagagggucgaaaagacaaggacuuagggaaaagaaaggagaaccccacccuccaaaccagacuggugggaccagggagggggcugggugaggggacuggaagcuuuggagaccuccgcggggcagaagagaucuaguccaaccagauacaaggaauaggccccuuguucccucccccaggucccggguaggguaggggacuggugucucagugcugcaaugggggguggggggugcgccccucccccagucccuccucaagcuucacuuuguuuuucuuuuuucuaauuggauaucuucuucauuuacauuucaaaugcuauccccuuuccugguuuccucuccaaaagucuccuauaccccgccccccccagcccugcuccccaacccacccacucuggcuucacuuugaaagguaccgcucuggcgacguccgccaacgcgcagcggggcggggcagagggguggagucggagaggccgguggccugcuuccaauccagugagagugggcgcggccuggacugcggccggccccgccccucgcucaucuuuucuccccaaccuccucgcacccugcggauugagcaacuaaguaccacccacauguguccagaugccugugugcucgccgcucacuggauucucuccaaguccauucggugcuggugaagguuaggcgugcccgggcagagcccaaccccaagucuccauccuccccggccgcgcucccuccugccccauucaggugugguguggaccagugguacuuguccuccuggcgcugcucggguaacugugacucuggaacagugcucugcaucuguuucuauugauugcugggagaaaccucucugaugacaauuaggcuagggaucaaucuaugaguacagcagaauaucauuuuuuuauccuaagucacuggacuuuccaaccucaggguucuggucuuccaggcugugucaggagcucuuuuuuccuuuugaaacugugguccaaaccuguaaaauaggacuuugaugauaaggucaauucaucaguauuuuuaaaagcuuuccuccacaugcauucaaggugaaaggaaaucuaggaaccucugcuccaaauccuucccaagagggaaugaauaaagcaaccaacacuguggccauuucuuaguggccuguuaggaauguaaccaccuugaaggucucuagaaccagcuuugcucuguguauaguaagauguauaagaagacaaaguagcauugcagagaccuucaaccccgugcuuuaaaaacugguuguuggagcuaaaaaccaucagagaaugauuuguuauuuaagaggagaaucuuaacagucuuggacuaauuacagaaccaaggcagccacucuaauaagaagcagcgaccugggaaugcugucucucggccucucaucuugcugggugauuuuaaucaguuuagaucugauuagcacuuguaucugagaacuggaagaaaucaagagcaacucauuuggcaaaaguucagcaaugaaaaccacugcaauccaagguuuaaguguguguuugggacaauagucacacuuugauguugaguuuucucauacacauguggauaacauaaaguugauuacacaaauauccaccaguguagaaugccaauuagaaagagauccauuuucaacacuucccaaauguaugcccuagauaaauuacuugcuuuuuuuuuuuugagucguuaguguuuccauuuagaauuaucaagggacuguuuccaauuucucaguuauuucauauuagguuuccguuagcagacuaagaaggcuuucaauagcuuugaguaugaaagucaauguugugguuuuacaaagaaacaagucauaggagauauuuagucuucacaucauuuaauauuuuaauucagucugcaggauuacuacuucauccugagguuuuuuagcauaggauuuaagaaaaaaaagaaccugaaauugaauugagaccuguaagaaguacaaagccauauaucagcuuuauccaaggaugguauuggaugaaauuuuaccuccauaaaugaaaauucuuucaucaaaguacaauuuaauaauuuuucaucuaaaauuauagaggggguucauacaugaguacuucugcauuuauuauuuucaccuuucccuuucccccauccaauuccuucugacucuccccuccuccuuaaauucaugaucucuucuucuauaauuauuguuacacacauaacugugcaugagcaugcacaugugcacacacagacacauacauacacugagcccaacuuaagaaucuuucuguaaaguaucuguugaccuuccucacuagcuuacugaagcaaugcugucaaaccuuuuaucuugaagauugaauagaugugagguagcuuuuccauagaauuagaaagaggaggugaauggucaggcaaagaggccauuggcaaauuaggaucaucauguguaacaguugucauggaaaugagcaaguguucaguuuugucuacaguguucucaacuaaagaagcugagccaugcuacucaaguucagcaaccugcucacacaccccaacugugcucuuuaagauuccugcucuccauugacaaaaaaguccuuauuuccaacuguggagggauaugagaaaccaccaagauaaucucccugagcugcugaggcaaucuugcucucuacagagccacauggcuaccuguggcucgccuguuucagaggguagucuuuuuuaaucucuccauacuggggguccaacuaacacauuuccuacagcuuacaaguauaguuaauacucuccuaucucagacaaauauauauauauauauauauauauauauauauauauauauauauauauauauauauauaccugcauguguauacucccaucuggauuuagguaaaauggcuaagguagcuuuagccagguacagucacacagccugagaugccaggacucuagaagcugagacaggaggaucacaauuuccagaccaaccuuggcugcauaauaagaacuugccucaaaacaagaacaccaccaccaccaccaccaacaccaccaccaacaacaacaaaaggcauaaccuugaagauauguguuuugagacuuuuuuaguucacaaacuauaaauguuaagaaaaaugguaaacaaacauguaaggcaaucuaaguagaaaaugcugauaaacaauggaaccaugaaguuaaagcugcaggacugauggaugugagacuggggaagacaggugaucaagaacucagcuccagaacuugagagauagcuuaguuggcaaaguacguccccagcaugcacaaggcccaaagacugauccccagugcuugggagagugggaaacuccaauaggaaauaggcuccauugguuuugaugguuuugauggcauaguauauaauuguguguauguuucauuauuucauauaaccaagccccuacuuuugaacaagaaguuacauguuaaaaaccuuuucuugacuuggaaccccucacaaauauaccggucuagucuaguugcacuguauuagccauugcaaaucagacgcaacugaagagaaacagugagacuucagcauagacaaggaaaucaguggcuguugucacaaaauuaguauaauaggagagucuauagcuuuucuguggcuguaguagcaaaguaccauaaauuugguagcucaaaacaacaaaaucccccaaaucaaagugucaacucucuuggcaugaacauuaccucgucugcuucugguggcuguaggcaaucccugaguuguggcuucaucacuucaucuccaucuucaucuucacauggacuuacugugucuauguuuucuccuggauucuaaggacguuggucauucuauuuucgguuuaugugacuaauaccacaaaaacuuuaccucaauuauacaaugcaucuuuuuuuuuuuccugaguaagacaaugugcagaggcucuggaaguaaggaaguagacccuucauuucaaaggccaccauuagacauuguuuuuuuuuuuuuuucuccagacacaggucuacaucagaauaaccuuaacuaguuucuuuucagaugcucuauaguuucaauuguuagcaaccaugguuaucaagauaucuuuguaacucacucuuaauuaggauuuuucuuuugagcgaucaucccgguccauguuggaacgaucugaacaacagauccgagcagcuucuaguuuggaggaguugcugcaaaucgcgcacucugaggacuggaagcuguggcgaugccgguugaagcucaaaagucuugccaguauggacucacgcucagcaucccaucgcuccaccagauuugcggcaacuuucuaugacacugaaacacuaaaagguaggugcaggggagagugguauauuuuuucuuuaucacauagccaaguucuuccaaauguuugagcacgguaguuaugcaucaguggggcacaaaagggcuuuggcuuugugacaaaaugcuucauugaaaaaaguugggaaugggucucagaaauccacacaugcccuccauaaauaaaaagguguaauaaaacauaaaaaaacagucauuguaggaaucaguucucgccuuccaucuuguggagcaggauucuaacacaggucuucgggcuugacagcaagcacauuuagccacugaaccaucuugucagcucaagaauucugauuuuuuaagugucugcuccacaaagaaauauaccuaauaugauuuuucuaucuacaucuaacacaaggacaugcaaauuaucaaaauaaauuuagcucagaaauuugagggcaaagcaaauacagaaagacugauuuuaguaaggagaaaauacauguuuacuuaagagcaaaagaaccucaaguauuuagcaaaaaggagcuuuuaauugcuaugcugacagaaaaaaccaacaauuuagcuauagauuuuuuuuucucuucaaaaucuuguguuguuuauuuaaaagugaaaagggugaaguugaaagguaagguaugauagugguuacucagaaaacaacaaagacauuucuugacacgaaauaaucaaagcuuacaaguagaaaauaacauacagucagccucugcguccucagguucugcuccacuacccacacaccauggguucagccagucacacguccuuagggaaaugcuuguguacugagcauaugcacaccuuuucuuggcauacaaccuacugacacaacuauucauauggaguguguacauuuuauugguuacuggaaguuauucaaauguacagaaagguguagguggacuauuuacaaauucuagcccacuuuauauaagggacuugguaacucaaagcuuuuagugucuguaaaguguccuggaaccagucuuccauagacaccaagggaccaugauacuucuaaauuguuuccuggaguagggcugggaauggauguguggugcacacuuaauccucuuuaaugacauccagacugagaaacagacuccuuacaagacaacuauuuauauauacugugccacaaugagugaacuguuuuagcauaaaguugugugaccuugauuaugccuuuaccucucugaugacauaucaaaacaacccaagaaacuagugccauuguuagucuuagagauauaaauaugauuucauaguacaugaguacaucuauuguuuaauuucaguugauccuuaagccaaguauccuuuuuaaaauagauaucuuuguuuccccuguuuguuaaagaauaauagauucuuuguaauuacaccccccauauauauauauacauauauacauauauacauauauauacauacauauauauauauguguauauauauauauauaauaggauuugacuaugggaaaaguuauauguaguugaaggaaucccacagcaguguaagugggaagaagguucuuugugcucaugcaugggauugugugacaagugugaugagucagagcuuugagggucuaguuguucauucauguugugauuuuacaugggcuucacaaaaaacaaccacaucuggagaucacaggcucugaccagauuauuagucugaaggucugagggguauguacagaugaguuguggagacaauuuuuacuauaaaaauuuucaaaagucagccagguugacauuuuauaaggaagaggccauaaaaauuggagaauucgcagucuccaugcuuucucuccugauuauauggaggauuaucugaagcuauucacgaaguuacaagcaauggauaaucaaauaaguguguuacaccaauuaugguuuguuaucuauccucugucauggauuucaggguaauucccuaggcaguaguaaagaacacuggccuuaggaaaccuuagucagugccauuggucauaacugcaugagauuuugauuguaaucuucuccaacuuuuaaaacuuagaacuuuaaagagaaaaagcaaguggcaaguaacauuuaaauagcauucgaaacaagggauauuuucauaaguuacucccucugucaaagauuuacgacuaguaguagcaauugaaauagcaccccccaguaauauuuaauuaaauaauuaaauauagucugaggaugaaucuuuaucaucagaaauuuuaaaauguucauuuuauauuauguguuuguauggguauuuugcugguguguaugucugugcaccacaugugugcaguacccaauggaagccagaagagggcaucagauccacuagaacuggaguugagacgugagcagccauaugcaugcugggaacgaaauauggguccuuuggaggagcagccaauacucuucugagccaucucuccagguccaucaauacacaguuuuaaagauaguguacagaaacauuuuuuucagguauuaccccacuuguaaaacagauauuuuuagcuucaugcuuuuguggauuugcaauacaagaauugccaagaugauuguuugguuuguuuucuuuugauuuaaagucucucuggaggcuacagucaaggccucuuggucuggguucugaucaucucaaugcccuugcaaguucauucaguuguuuguaagauuaaguucugcacaggcacuuggacugugaagggcuccuuucuucacuggcuuuuggccaggggcugcccucacuuugagguagcuucagaaaugacuuucaggcuggacagguaguguggagauuaaacacacauacugcucuagaagauaacuuaaguuuaguuccuaguaccuauguaggguggacuuacaaccacucagaacuccagcucccaggguauuuguuaaccucuucugguaucugagggcuuugaacucgugugcaccccaccccuacauauaugugcaccaccucauacacacauacauaugcauaauuaaaaauaaaaagauuuuuuaaaaguggcccuuggugagaaaagaaguggggcagugagaagagaggguaaagagggguggggacaagagagaaaccgagucaggaaauaguuucaaccuaagcaccuagguggcauccugcuuugcuguguucucuucacaaaacgccaaucacucguucucaucagcacacaaaaggaggggagauugcaaagggcauagucaccagaacuggggguccccaagggucaguguuaaagcugcauacuacaaaagguuuucaacauacuccuaggaugacguagucugcauuucuaucugugacaagcugaaagaaacucccccugcucccucaaaccuguagagaggcuacacacugcauuaagagucaaaaucuaacuuacaaaaugaugagaguggggcuggagagggcucaccuguuaugaguagguacugcucuugcagaggacccaaaguggguucucagcacccacaucaggcagaucaguacugcccuaaauccagcucuagggaauuuaacaccucugauauuugcaggcaucugauucccucucccucucucccucccccuccccucccccucuccccucccccucccucccccucucccccucccccucccucccccuuccccucucccucccccucccccucucccucgaucucuaucucuaccucucucugucugccugucucuauguuucucugucucucccucucagucuucucucucucucucucucucucucucucucucucucucucucacacacacacacacacacacacagagagagagagaauucaaauaaaauaaguauuuuaaaaauggugaauguaaacgaggaaaauaccuaauuuaaaaaaaauggugaacaccagacaugauggugcacaccuuuaguuucagcacucaagagacagaggcagguggaucucucugaauucgaggcuaccagccugaucuacauggcaaguuccaggccagcugggacccugucucaaaauaaaggaaaaaaaaauggcaagagaaaaugaaacaaagcuauacaagaaaaauauguauucuuugcuuggaggugugugguacauguauacguauauacagaugcaaaugugucccuguuugugaaugugaaggucagagaucaaugcugaguaucuucuuuaguugucauucuccaauuuaguuuuagaaauagacucucucgggauggcucagugguuaagagcaccgacuacucuuccaaagguccuaaguucaaaucccagcaaccacaucguggcucacagccauccauaacgagaucuggcgcccucuucuggagugucuggagacagcuucaguguacuuacauauaauaaauaaaucuugaaagaaagaaagaaagaaagaaagaaagaaagaaagaaagaaagaaagaaagaaagaaagaaagagagagagaggagucucucauuggaacuggagcucagcgggucccaaagggccacgugucucugcuuucccagcacugggaccauaguacaucagugugccuagcucuuuaugugggguuucaggaucuggacuaagguccucucauuugugcagccagcacguuucccacaaggccaucuccucagcccuuuguuucucuuuuuauuaccagaaauguauuuuggguuuuuucugguuccccucaaauuagcuauggucauggagcuguuccuucuguuaaaaugaaagggcuuaucucaucaucuucuguaaacuaucagaugcuuucagaccugcaaagucugauuugagaaaaaaaaaagaauccccuuggaauguccacucauguguuugccaagucucagggcacuuacguaagcagacagcagauauucauuuuaaaaccauuccuaccuggcuucagauagcagaagugcuauccagcuguagccugucuguuucuugauaaacgccacucauacuuuuugucuucaccuuauuccacugacuuccuuauuagccacccuuugcagauggcuccaguguagcuauaugcaagguauagugcucuccccgaaagggaaaaauauuuuaugaagugaugguaucaauggaaaaauauagagguuuuacuuuuacauuuuuuaaaacaaaucuuugccuaaaggauggagaaaaauauccaucuaaggcuuagaaagguuucucagugguuaagaucacuugucacucuugaauaggaccuagguuaaguucccauauaguggcucacaacuaucuuuaacucuuguuacaagggauccaaugcccuucucuaaccuacaaaggcaccaaccacacacaugguacacauacaugcaggcaaaacacccauacacauaaaauaaaauaaaaaacauuucuaaaagacauguuuaaauguccaccuaguaaaauaaacaaguacaaaagaaugaguuggguugggggagcgucaugaaaagcaugucagggccauuuugccuacuggccccaaugaacguuauuccuguaguuauagaugaagaauggcagaggacccaaugcagcccuagagagacaugcguagaagucgccagugagcuggggaagacaaccaacacauucuucaagccccccuguguaaaugucuuccgguguggaggcugcugcaacgaagagggugugauguguaugaacacaagcaccuccuacaucuccaaacagguacgagaaaugaagaugcugucucuaaccuugcugcccagcacuaaauacuucaugugcugaaccucauuuaauucccccaaacaaacacacaggauaucuuauccuccuuugcaaguaaagaaacaggcucagggggguaacacaauacccaagauggcacagucucaacaguuaucauccaccuaaugcuguaguaucaagaauuaguacauauggcauuccauaacaggguguccaaaagaaggaaggaagcugugccaugucacgcagcuguuuugauguauuuaguuuacuuggagugacugacaaaagguucuugaagggugaacgugagaaggaccagcuaagaggaaggggugugcucucacucuaaaacuaaagaggcugaaggagggagcagacaaaggaacacagggagaaggguagaggacuucucaauuggcaguugccaaacauuagcauggcauggcauggaagcaggcucuucgagaggcaaagcaagcagucaugagagcuaguggcugcaggcacacagcccaacagggaagggaggagagaagauaucuccaucgaucgaucacugggguagcauggggaacaaaggaacaauaggcagcacaagacuuuggaaagcaucccgcaguguucaugagagaaauaaacuaucaaucacaucaccuuuugcccugcagcuaagcuaaguguuccuuucuguagcuaucaucuucguguaacgugucgugaaugcauuaucaaaacacuguaaucaagccacauuccuguugguccucuguuucaaauuccucacauguuaauacaacuuaucuagcauuugcuugucuccucaugaucauguagaagacaacuauauaggcgccaaauacaugcaugccaaggaauguucuaaaugcccauuuguuuuguuacaaggguaaaguuuucuuaauuuugcauucccuaccaucuaaacuguccuugacacuggagaauuauuuuugucuaaacccuuuuggagaacuguggaacucagaaaucugaccccuacuauuugauaauuagaaacaaugauguaaguauggcuacaaucaacuguuaguaagaccaugcuugcauaauauaagaggguucaaguccugaucguguuauucccugaaguauaacugaagaauugugcaagaacaugaaauuuaugcugaaaaacacccuuacuuguucuuguuuucaugacacgaugaaagauccaaauaaacacaaccugaaugaauuguuuccacuuaguagauaguugauugcuuuguuuuggcugaggcacucaacaaaugauucauaugaaugaauuuauucaaauguaagugcacagcagggauuuuuguuuguuccaaauagccaugugugugcaguuuggcacuuucuaccuuaaagguacagaucaugugaucaacuaccuauuagaaccaaaguaaauggaacugcauggaaugaugauugaguggccaaugucucagagucaagcucaaguucaucuacacuucuugaaacuugugugugcucuuugggcaucucuuuaucugucauguaagggaucaugaauaaauauaaugcuuuuuaaauuauuauuuuuuaauuuuuauuuauaucugugucugcuacaugaauucagugccugugacagccagaagauggcaccagaucuccuggagcugaaguuaccuguguuguaagccacuugauaugggugcugggaacuaaaacagggucuucugcaggagcagcaagugcuuuuaacuacugaaccaucucuccagggccccaaauauaaugauuuuuacaagugauaaauaaauuaaucaucaaguauguacaaaagagcagguguauaggaacauagaaauaagcauacuagcuauaauuaucugucuggauauggucccaauuuagcuacacaauacuuuuauagcaaaugcccuaaaacucaggggcuuuaauuuauucucucuuguguaucugagguucaaaauucuccaaggugcuaugugaguccaaccugcuuuguauguccucccuuggacuagcguagcuuacaggcuauauccauuucauggcuauaccauaagcaagacauaauaaaucucacaaggcaugcacagucccaauuuguacuauguggugucagcuaucaucuuauuggccaaaacaaguuuuauggccaagcucaaugccaggagguaggaaauugucugucaucaauagaaaugguuugggaagggaugaguaaguaguuuaaauaacaaucaaauccacccacgucccaaagaaccaccaaagauuuuauuuuguuuauacuuacaauuuauauucaauuuuaaaaacaagagcagagagcagggauuuuuaaagaacuugaaugauagugaaaagaacagauuaggaaaacacuuaggagagcaagcuggauaaggcccccugucuccugacucccggcauuccaaaccgcuuacuuacaaugacuaacucuauugcucaugaauaacuuugcugaagucauuaccauaaaggauaagggcaaaaaugcagaugguggaaacugagaaaaguauacaauaaaauuuacaucaugguucucuuucuuugcugcagcucuuugagauaucagugccucugacaucagugcccgaguuagugccuguuaaaauugccaaccauacggguuguaagugcuugcccacgggcccccgccauccuuacucaauuaucagaagauccauucagaccccagaagaagaugaguaagcauuuccuggacuugauaaugucuguucuugcuuuugacaaaacugcauguacauuccuuuacccauuauacaggcauccucagaaagacauguguugcacauuuucuguuuuauggagcauuaaaaaacaaaaagacaugaaaguagaagggggguuuuuagggaaaggaagcagaugaagaggaggaggcagagaggaaaagagaggagaaaagugcaggugaaguauauuuuaugcaugcaugaauaugguauggugaaaaccauuauuuuuuuacaauauacacuaaucaaaauguugaagacacaaauagaaaaaauauaaguugcaauugcauuguaauugcaaaaauuacauucucuucauuaaauuuuuucaucuucugacuuuaaaaccagaucuauucauaguauuugacaaacacauuauuuuuuuacuaggugcuauaucuauauuacaguaggacccaaaaccuugaggaucaugaacacagcauguuuggauucagacaccuucaggguuuuacuguggguuuuuuuuuguauguuuguuuuuuauuuugauauuuuugagacaggaucucacuuuguaucccuggcugaacugaaacucacucuguagaccaggcugcccuugaacucugccugugcuuccugagugcugggauuuaagaugugcugccacauuggcccaacaccuuuguucuuagaaugaguggccgaaugcauuguaaaacugcuccagccucauagcuaccaugucuccccucacuccugugcaaacagugacucucauaaauccaaguuuagucucuaaaguuucccuaauagaauauuuauaacuauagaauuauuaugucauaagaugucauuucuaaauauaaaguaagcuccauauuuucuuuuguuuguuugugucuauguaugcaugugugugggucugcacaucugugcaugugccauuggaguccaggagaaagugcuggaucguuuagaggagggauucuaggugguugugagccgauccacauggguguugagaacugaacucggccccguggaagaacaguacucauucugagcugcugaaccggcucuuuagccccaacguuaaggucuuuacaacucuucucacacaguuguaauuuuuucacagucaccaugccgugagagacaaacauuuguucuccuguaucacucuuagaaacaaaauuugaaagcacuaacaugcuccacacagaauguuuagauuauuagauaucaaauauuaagaaugacuuaauauucccaaaguaggauuacucugaaaaacuuuuaaaucugguucuuugcuuucuuuuccuagauguccucauuccaagaaacucuguccuauugacaugcugugggauaacaccaaauguaaauguguuuugcaagacgagacuccacugccugggacagaagguaaggauggcaguagugaaguacuaaccauacugauagaaggaauacaacauuuagcauggcugagcauucacuaugaccacguguauuaguuuucugugguugugauaaaauauugugaccaaaagcaacuuccgggaggaagagcauauuuugacucauguuugaggguaacccaucauaguggggaagguaugugagcaggcaggcagggcgucaggagcaggaaacugaccggucacauuucaucugcacucaggaagcaaagagaaaacaggagcuagaguaaggcuauaacccuccaaagcccgccucuagugacguacuuccuccagaaaggcuucgccuccuaaagguuccauaaccucccccagacaacugagggucaagcgucucaaucaaggcacaacaucccacaauguucacaacucaugaucaucccucuuuacaagcacacagugucuaccccgagauaucuaguaauuuccucacucucacacagauaacagugccagaagugguuggauuuuagagccuucucuguucgcuucgcuguucauucucaaagaaaaguacaaaguggacaaagcccccuaaagcagguguuauacucuaaugaaaacuacuuuggggugaaacucauaggucauuuggaacuugguuucuuucaacugcaccauuugaaagcaagcaaauacucugggaaaaaaauaaaggaaagaaggaggacacgugggaacauuugucuguaacuggaacacaucaugcuccugggcuaagccaaauagggaauugcuagccugucauuccaucucccgaucuguuaaagcucugaauccuggcaugaacauaugguugaacaaacaugaugguuuacuuuuuuuaaaauuuauuuccacacaugugacuugguuccacugaaaacuaucacaggggaccaugcaacgugaacguugcuuguuuuaaacucugaucuccuagcaagaauagcaaggauccagagccauagaaucugucugaaaugucaagcucuuagugcucuuguccucagguuccaguucucggcaccaguguaagagcucaaacuaggaugggagguaaaauauuuuugaaguuaucuagccaaaggcucacacacauauaguuucaacacagacacaacaaaguaaagggugacaauugaggcagcaugacacaaugcaguugcuaaaucaccaucagccaauccugcguggagucgaagccaaggaguucccuggggggggggcaccucaaauaaacagguugggcccuacagacuugaggaggggucauaaccuggguggggcauuuucuuucagggggauguuaauuccuggggaagacucacuagguagguucauacauugaggauggaaagagagaugugcucugagcagggcuuaggugagaaagcaaaaacccagugcugggaaagguuagugggggaacacauugguuacuuuuuaggugcuguaauaaaauaucugacaaaagcaauggagaggaaaaaagaaggaaugaagaaggaaggugagggauggagggagggagggcgggcgggcgggcucauuuugccuuucacuuugauacagaacaguccaucaugcugggaauggucuggcagcaggagcagugcugaucacuuuguaucuccagccaggaagcagacaagcuccuaucuaucagcauuuccaguuccccucccuccuucgguucagucugacugcccagcccauguguacagugggucuuccucaauucaucuucucugguaguaugcucauaggcacaccaagagcugaaaguacuagaguccuguaaagucagcaaugaagguuaaccuuacuaugggcacacauacauacugaggggaagggguagauuugaagggaugaagcuggggauacuugcaugauuggagugaaagaggugaucuuuuagacaaaugaaaaccacccaaaugcuucaagaaagacagugguaacacccauugggaauguagaaagauccagccagcaacuguguggaagagagugaguugcuuugagcagaacauggggcagggaaccuuugggggaagcuguaacagugguggaggugagggaggacggaggguguggauugcagcucaguuacuuuuaguucucaccacuccuaacguucucaugugccaaaguucccaucugcuucuccaguggucccauucugcccaugacacauuacuuucuguguacuaaacaccuuuucugcauacaaagauauugagcuaaguuccuugucuacagucaucuauucuccaaaugaaugcaguugaugcaaguccgacucaguuucauugcuguaaugaauaagacauaauaauaguagugaauggaacaaggcugaggacaggauacauugguaauccagagucgaugucccuagguaugaacaccaauaugaaauacuucgaggugucagccccaguuaguugcuguuuaaccuaguucuccuacauccagucucuguucccuuuaacuugcuaaggaccuauguucugcuucugccacauacugugcugaauuccucaggauuguguuccaccuaaacuacucuguggggccaauagagaguuuucuugugagucuuugcugccaccuugugcucaauaugaacccuugacuguuuuucaguuaucaagccuuccuugucuugcccuacauugacauuugccucagggauuuauaacguauguagcucaucuauguccuggucaugagauucaaaauggacucuuugucuaaauaugugccaauuaaagagcagucaaaaccaggagaccggaucaugagagauugccauuuuggggagagguggcggggcaggggguggauaagagagggcuaagaaugagcaugaaaguuuuuuuaaggucaagaucauggaagaucuuuuauauccugauguaaaauuuggccuuuuguguguggaggaagauuuaagacacuuaaagcguagccaggcaugguggcucacaucuuuaaucacagcauugaggaaacagaaacagguguaucucuaugaguucaaggccagccuggucuacauagcaagacccaggaauagccagggcuacauaauaagaccuugucucaaaaaauaaaugaauaaaaguacauguaaagcuuugguggugauagggauuagguuugcauuugauagucaugugagggaaagacugaaggggugcacagugugguugugaugugagcggcagccaccaacacaagaaauaccagguacugggugaauugugaccgaggcagugucauggagaagagagggcaugaacaagggacaggguggaaacccugacuacaagaucuaguggacaauggugccagcccccaaaugaggcuaacugaacaagaagcagguuuggggaagagauauucauuuucuuccaaaaccugcaugaaugcugagauuaaaagugcacgggcuuccaaaauuuucaccuucuccacuaauuguuugcuuuugcuuucuguuggagacagacucuuaggaguuccagucuagccuuaaauucaauauguagcagaggaugaccuuggacuuucaauccuucugccucuaccucuggagugagugcuagaauuacaaucaugugucaccacacccagucuaggagccacaggagacugaacccaaaacuucucauggacucuaagcaagcauucucuacccagaaagccacgccuccuagccugucucuuacucuuuuugcaauguauuucaguucacugaucgagaucagaccagaguucauuguuaccuuuauauguuucuuacaaguguggugaucuaagaugagggaaugcaucauuagauaucuggaaauucugaggaaaacauuucuacagcauuaguacuuccgguucccacacuuuuaaaauacuggagagcacugcauucauacuuauaggcagccuauaucuugcuaucuugucauuacuggcugguuacauagguuagauagauagauagauagauagauagauagauagauagauagauagaugauagauagauagauagauagauagauagauagauagauagauagauagauagauuuuuaauucauguguaugaguguuuuuugccugcauugcuuuuacauggugugcacaaaaugcccgugcaggccagaagaaugcaacagccacccuccacucccaacccccaccccuagauuucaguuaugggcaguuuuaaauugccguguggguguuaagaaccaaaccugaguccuccgccggaguagggaguucucuuaacccuugagcaaucucuccagcacagaaguuuauauuuuuaacuggucagucaccaccauaaaaaucugucagaaacauucaccauaugguguuuuuuaaauuuaaaaccuacgaaaacacaugaguucuaugcugauguuauaaaaucacagauggaucuuuuucacccuguggaaauauuaagguuaaaaaacuuauagacaaggagauugggagguuccaaguuuuacugggaagauggacaacuugcaauuaauuuggaucaucacuuuccuauuucuuuuagaccacucuuaccuccaggaacccacucucuguggaccgcacaugacguuugaugaagaucgcugugagugcgucuguaaagcaccauguccgggagaucucauucagcacccggaaaacugcaguugcuuugagugcaaagaaagucuggagagcugcugccaaaagcacaagauuuuucacccagacaccugcaggucaauggucuuuucgcuuuccccuuaacuugguuuacugaugacauuuaaaggacauacuaaucugaucuguucaggcucuuuucucucagaguccaagcacacucuuacaaaaaaaaaaaaaaaaaaaaaaaaaaaaaaaaaaggaacacagacguuuggcaucuaagaaauauguggaaguaucuauagagugaugauuaaauugcuuuguuucaaaacagggucucacgaauuacagaccuguacugccaugccugccauuacacugucaugagugggaauaaaagaagucacuggcauuuaaacagcaggguuaagggaguguucucucucucucucucucucucucucucucucucucucucucucucccccuccccuccccuucccucccccucccccucccccucccccucuuccucucccuaucccucuuucucucucuguaggcaagaaacuuauggaugacuauaaccuuuggaagccauugauuggauuuugaucaguuuccaaaucuacccaaacuaaccacugagauuuuuuuuagaaauuaauucaauuugucccuugacaauuucauacacguauaaaaugcguuucuaauuaccuuuacuccuacacucucaacccuagccuauuccugucaacucauuuccuccuugcucaucuuucccacaacugaagaaagugacucccucaucuuccagauuccaccaguagccuacaucuccuugcccccaccccugaugaguccccccccccaaaaugcauaauuaacuguugagaaguuuggccuuguguaggccuagggcagaucaucacagcugugugaguuuccgcuugcaaagucugcagcaugccuagaagauggguguuugcucauccuucucuccaucuuuugauucuuacauuuuccccagcuccucuucugcugugcccccaagcuucacgggaggugauaucaacaucuuuguuagggcugaaaccuuagccaguauagugcccacauagaauauugcauuuauacuuuacauacaugucuggaaauuuuucuuugagaacaaugaaaugaaaucagaacggcaugccauauuugaaguuguuccuugcuucuaaauucucaucuucacuuucuuucacaacagcugugaggacagauguccuuuucacaccagaacaugugcaaguagaaagccagccuguggaaagcacuggcgcuuuccaaaggagacaagggcccagggacucuacagccaggagaacccuugauucaacuuccuuucaaguccccccaucucugucauuuuaaacagcucacugcuuugucaaguugcugucacuguugcccacuaccccugccccccccccuccccgccuccagguguuagaaaaguugauuugaccuagugucaugguaaagccacauuuccaugcaauggcggcuaggugauuccccaguucacugacaaaugacuuguagcuucagaugucuuugcgccaucagcacucagaaaggaaggggucugaggagccccuuguuuugaugaauaagaaaagguugccugaaacagaguaguaggugccacucgauugguuccucgggcuggcaaaguccaagggcaaugcucaugaguuauugugcuucuuucuuaugcggaauuucauuuguaugaucagcacugaucaauucccauuccacuuguacuuuuuagguuuacugaagcacugccugauguuuuauauguaaauguauuuaaaggaaauaaacacuguuaugcagcccacagaagucagcguuauuuacugugcucuuccuccacauuucaugcuaaugggaaauauuuuuaagaccaaagggaagcuagcagugggagguucagggaacacauaaauagacuaaaacuagaccuugguuuugggaagccaaggcagaucuccaaccggguuuaucauucuaaacaaggguaacacagggguucugggaagcacucuguggugugugaauaaacugaacacauugaacuugaccauccuccuuuuauggagaggagccuaacaauguuaauauuuccccaccaccugggauuugaaaaaaaaaguguguguguguguggguugcuugcauguaugauugugcaccuguaagaccccaaaagccuuacauccgggaugucccacucacauagacacagagauggagaucgaugcaaaaugcaagagguuuauugaucuagcaugcuggggucguccugaaaucgggauggaagcgaccacaaauagcuaaagcacacaucuuuuauacauuuuuuaagagcaguuuucagucacaguuuagggguggcaguuuaucauugguuaaccuuuaaccgcauuaagggggcagaguuaaggaccggagauauuguguggacuuuucuaaacaaucagauuuaucucuuagugaguaaacuuaaggaccagaggucaauucuggggaaagaacaucuugacauuuacuuuuuuuuuuuuuauaaccauggucauuuugagcuaccacaaaucuuacacaucaugugcauguugugugcccuuggaggccaaaagagggugccagaugcccugacaauggaauugcauaugcuugugagccacgagguuggugcugggaaucgaacccagguccucuggaaaaaaaaaaaaacacucagugcucuuaauagcuaagccuuccuccagccccuugcucuucaagacuuugaguguuuguggcuucuucagaaagccugugccccuucccuccaguguuuguuuuuguuuuucuuuuucuuuuucuuuucuuuucuuuuagauauuuucuucauuuacauuucaaaugguaucccaaaaguccccuauacccuccccccacccugcuccccaacccacucacuccugcuucguggaccuggcauuccccuguacuggagcauauaaucuucacaagaccaagggccucuucucccaaugauggcugacuaggccaccuucugcuacauaugcagcuagagacacgagcucuagggguuacugguuaguuuauaucuuuguuccaccuauaggguugcagaccccuucaucuccuuggguacuuuaucuagcuccuucauugggggcccuguguuccagccaauagaugacugugagcauccacuucuguauuugccaagcacuggcauagccucacaagagacagcuauaucagguuccugucagcaaaaucuugcuggcauacgcaauagugucuggguuugguggcuguuuaugggauggaucccuggguggggcagucuuugcaugguccuuucuucugucugagcucgaaacuuugucucuguaacucccuacauagguauuuuguuccccauucuaaggaggaaugaaguauccauacuuuggucuuccuucuuuugaguuucauguguuuugcaaauuguaucuugggugugcuuaaguuucugggauaauauccacuuccucagaaaauuggacauaguacuaccagaggauccagcaauaccucuccugggcauauacucagaagaugcuccaacauguaauaaggacucaugcuccacuguucauagcagccuuauuuauaauagccggaagcuggaaaggacccagaugccccucaacagaggaauggauacagaaaaugugguacauuuacacaauggaguacuacucagcuauuaaaaacaauaaauuuaugaaauucuuaggcaaauggauggaucuggaggauaucauccugcgugagguaacccaaucacaaaggaacucacaugauaugcccucagguguuucuaagaguauucacuguccagucucaucugcaugucaacuuaaauagcagcaggauucuucuguguccauagcugcccugaagggaccacaaggccuuuucuucucuguccauucaaagaagugcccgggccuggugagaugauucaguggguaagagcacugacugcaaggagcucuucuaaagguccugaguucaaaucccagcaaccacaugguggcucacaaccgcccauaaugagaucugaugcccucuccuggugcaucuaaagacagcuacagugaguggaguucaauucccagcaaccaugugagggcucacaaccaucuguacagcuacaguguacucauauacauaaaauaaauaaaucuuuaaaaaaagaagugcccguacauagaguucauuuguggcauagauuuuacugaaauuuuggcucauuagagggaauuaaauagcaguauuacuuaugaaauaacuuaaauugaucucagcacuguguguagauaugacaggggacagccccacacagauucuauuaugguaguuaccacagaauuguguaaauacuuguguuuauaucuguccuucuacacuuccaugacccuuuuaggauuggagaauuuccugaucagaggaugugacccaaauuucuaaggucagaccacccuggaguaggacagucacaaagaaaaagauaaugauaaaaaaaauauaaccccauggugauauuguuggauccuggccuaaaucccugcccuuccucuuuaaauuugcuaagcaguuccuccauucuccuuuuguuuguuuaaguuguuugaagccuguagauugggccuuccaauacuuuuuggcuuuauuucugcuccccccacccuuuuuucuuagccuaacuuugggacuguuguuggagcaguuccacaaaacaucugcugaucuccaaacaaugaaugaugcaaaaagagaaagaguguagucacaaaguggcagagaaauguggaagccugagacuuaaauuccaaaccugucuuccagaggagagaggcuuggggauauuuauggaauaaagaaguaagcugaaaggugaucagaggggacacauucaaugcucuaugaauauguaauuaaucuuuagagcuuucuaugggacccuugcucacaaaacgacagucuuaucaaauccgugauguucgcaggaucugaggguggaguuuucacacaaaugcucugcaucaaaaguuuacacacuucugacaucugcacagguccaaggaacuacuaggaugguagaacagaaaucccugagaagugcccuaggcaacuguucccaucacaggucagagcuucgucuacagcagagcaagugggggaauaauaacguacugggcuguauggcuucccaaacuaaugauuuuuacagucaacugaaaacaggcagugugagggcucaagcuguguguuacauugaaaucccugugcuuaggggaucuaucaaacaaaaugccucuaaccugcaaaccccacuuucccaaggacagacagcuuccugaaaugcugggggcagggguugggggugggggcuauucaugaaagauuaaaagcaaggguuuuccccucagcaaauaagccagguugccccagcugcacaggaugugguugaaucacacaaagguggcagguauggagggagagaggaaguaugucgggauguaugcucucccuugacuggaccaaggugggaaauacauagccuuguggggucuaccuuuauaauaccugaugaacgugauucggcaccguucucugggaaugccagguauggaccuggccaguguccacuguccuuuccaacacugaauaaugcuuugcuucgaauuuggcucaaaaaaugggguaguggucuuaucuugcccauugggauuaacaguagcugaaagcaagggauccagauguuuaccuagguuuuccccuggauuucagaaguagucccacucugcuguuacuguccuugcucuugacacuuccugcuaggggcccaggcacuccccucgugcugcaugcuuguacucgcccucugugaccucagugcugaugcggcuccccauaguguuauuuuuuuuuaaaucaaaucucugagagggcucucaagcagguaggcuugguaagagcacuuggcguucuguccccuaccuuggcauugcauuuacuuccuccugcuccacaccccuccaggguauuuggugaagcuccccugaugagugagucaauuacugugcucauucauuuuucuaaaauggguuuucagaucuuacuuuaugaguguuuuaccugcacauauguauguauguauguaugcauguguacuucauauaugccuggugcccaaagaggacagaagaagguguugggucuccuggaauuggaguuagagacaguuguuaacugccauguagggacuagaaacugaacccagguccacugcaaaaagaaaugcucuuaaccauggagccaucucuccagccgucagcucacuccugacaggcuagaaagagagaggucaagucacccaugaggaacaaggacacaaaguuuaaggaugagcucuugcuucgccauggcucgucaggauggaacuuguccuccuggacgguuuguucuagccauuuuuuuugucauuccugugaccaaaaauaaaaugccuuucagggcaaauacgggagaaaaugagggaccugccuggcuccauuuugaaugcagaagccauuauacuguauuguuaaaaauaaguuucuguuucuguuuccuggaaccugacacgaccuaaccaugaccuuacauguuuugggggcacacccaaacccucccuaauccuuccgaaucacauggugacaucugugggauuuuaaaaaaucuguuuguucacuuuuuuuucuuuugagauuuucauguaccuccuuagcacuccaucguguucagaaaaccugcuuugcaacuacugaugauuuuaguucuuaaaaggguccuaagaaaauggacucaggccuguucucuuuaaccgaacagaggacacagucacuggccagcucuccggugcacccccgauaaaaaucaaacuugcuucaaauguggcugaaaauggugguagugcccuucuuuuugccuggugggauuaacacaaggcauauuuugacucauacuuucaggauccaguccaguauggcagagaagucaugguggcaggagcaugaggcuccugaucaugagcaggagcgugagguagcaucaagccugcaguugggaagcaaagagggaugcaugcggugcucagcuucuuuacuccuguuaauucaguucaugagcugagccuacgggauggugcugccagcauuuggaguuggucucucugacucuaggaaaccucucugaaaacacccuuucguacaugcccagaugauuccagauccaucaaguucaugauuaagguuaauggucauaagguagaauugcuugguguauuguuucauuugaguucauuaguuauaguacaggaauauuugucauaccaauagccuuugaacauuaucugaaaaugcucaacuugucagaaaaauuaaaauaugguagagggaucuccaagagcauaaagcgagcugcaaaugacagcaacacacaacaucccugauuauguaagccacggggccagagaagugccauagcacaggucauaaauccaugaccaaaacaaugugguggcaagcucuuuagagacagauaacaacugggcagcauaaugauaagcauugaaauacugacugacacacuccguaugaggggguggcagaaacaguucacuuuaaagcacuugcaacauuucacaguacaguaaaaaaaaaugugaauuuaacagaacuggcauuuuguaugaaaacaaacccuugcauaaguaaacucuuaguaaagaauuauguaauaaacaacaaaucauuucaccaaucuuaugacagugaagaaaaauucucuaaaacuaaugucaagagucacuacacaacucaugcugcucagagugggcuagaagacaggaaacccuggauuauuucaaugucacaacucuugauaagagcuuuguggaggaucaguucucaaaauauuuaccacaugacaaguauccccaaauauucuaauauuugauuuuuguaauaauuuaauaaacaaccagccugugguuacuuuaucacugaugcuauuuguucuaaaacagagauuuguaagaaaaaaccuacauccaguuuuggaauccacuuguaggugauguucuguuugaacacauuauaucauuauaugcuuauuugcuguuguauggccucuagcugcuuuugguuuuauaugaacagaauugguuaauuauaauagcaacugauaauccauaguguuucaaaugugugcuucauggucccuuucagaaacauucagucaauaugcacuguaaaguagucucuauuuugucaaguaucaacuagcaauaaauagaaagaaugagaguguuuuuugaaucccuacugccuucccccccaagcaaaagacaucaccuauccugaaugggcuguguccaacaagcugggauuacugucauucuguaaguauaguaaguaugcaaugcaaugaaacuaaggaaaaacaugcuuauggucccuguuucucuacucuguuacuuccucagcucacucuacacauggaaggagaacuauauacucuccuucaagucuuacauagggucuaacuaaccauagcccucuuaggcauaauuggaauuaggcugccagccucgguggcugcuacagguuuggcugcaagaaacaugggucacagucuauauccaucucagcagauccuggcucuacaaucacucuaaaaccagcccauuucucuggccucagugguccuacaaaaucaaaggacccucagcuugcuaaccauagaaggggaggcucuugccucuucuuuaaagaagaaugccauuacuaugcaaauuauucuaggaagguggaagaaaggauuaaagacuuacaugagcuggaaaguacugcauaauguccaggaauggccucuugcaggacucuuauuuuggucaucauugggcuccuggcucuuacacuucuuuggcccacugauuucccuauuucuuguaauaaugauugcccacugucucuucaucagguucuuucaggaaagaauuaacaaaguuagcugaugguuggugaagcagaugcuucugacagaauuuccccaaggccucuuaccaccacuuaccagugcuagccuuauuugaagcaucauuccagacuacuucaaggcuagcccccgagagacccacagaaccugagcauugagcaaaacaucagauguuucugucucguuccugacuuccucccuucucagcuucuuuucgggcauuccaggcuuccugggcccugacacugaugccccaauuuucagcagaaaguaguuauagaagauauuacuucaccccuuaucaucaacaaggggcaggaauguuaggucucaaaccaaggacaagugucacucaguacuuaugauuccuaccuauacaucucacccuauccccaccccccaaaucucuucuuuccaagaacugggcuucugcucuucuuccccuagccugaucccuauguaacucagccauuuuggcuauguaggucuccuuggcaggcagcuccucucuugcucucuccuuccucucuccucucuuggucugguuuagucugccagccauguucagccuggacucuucccucugccuacuuucucuguugaaucuaaaauaaaauaaaaugaaaaucuccauacuuguggcauccaagaggcauagaacaagagauguaggccugucccuaaauaacucacuuauaccauccccucuaaagcccagagaacauugaacacaagggucaggaagcacauaagagcuagaagauaggguuaaggguugcaaaaugacauucuccagacuugguauaaccauuucaaucauuaacucacagaacuguaguuacugcacugagacagugcaagaccauauugacaaucagucaaggaagggguggggacucauaggaccauauccuuuaucucugaacuguugguguaagauuugugguagcucaaaaugaccacgguuguaaaaaguuaaguacauguguucuuuucccauaauuugccucacugcaaagugugucaagagauaguccucugauuguauagaaaaggccucacaaugucucugguccuuaagucugccccuuaauguugcuaaagguuaaccaaugauaaacuccccccccaaaaaaaaaaguauaaaaugugugugcuuuagcuacuuggggucucuucuaucccgauuucagaaugaucccagcaugcuggauuaauaaaccucuugcuuuuuacauugaucuccgucucugugagugggacaucccagacguaaggcuuuucgggucuuacauugguuauuaauaaauucugggagagggguaaucacugucucuaguuguguaucuaauccugaacacaacagauuccaaggcuagcuccaaauccauggucacacacauggcccuaguuaguuucagcagaucacaaaacaaaaucaauaaaccuaauuuuguaugugugugugugugugugugugugugugugagagagagagagagagagagagagagagagagagagagagagagagagagagagacuuguggauuuauggcaugagggacagggacaguggacaguaaugguaguacucaguauguaggauguagaaggagaaaauuauaaaacaacaaaaaacaaagauacaaagauucuggggcaggagaugcuucagugguuaaaaguacuugcaucuacaacucuaguuccaagggggcugacuccaucuucuggccucuacaggcacugaaugcacuuggggcacauaaauacauccugggaugguacugccaacugucagacugacucuuccuaccuuaguuaaauaaauuuagaaacuccuucauagacaugcuuggacuuuucuccccuggaugauucuagacgcugucaaguugacaauaauuauuaaccaucacaaguccacuucuugccaacuugacacccagacaugucacuuuuaaguaauaaccuucugcuccuuguccuuaugugcucauggccaucucaugauccaaagugcauugaauucaacugcaaagcccauagucuuaaacaguuucauuacagaggugauguggggaaaauggaaccccaacaccaggagugagaaacccucuuuugcaguguuggucaggguugucaaagauacuccccaaauacuagaggcuauuguuauuguccuuuguuguccccaccccaugaagcgaauguuaaguucccauuguaaaagacaccauguacuucagacacagggcucagaagaccugaccugggucugaccugaaagccucuucccugaagacuagcuuugaugacaccagaaggaacucuaagagcuuccaaaggaggaaaacaaccaauaguccuaccuagcuacggcacuuaggaauuacaacaguaaccaggaugcuauaauaacacuaagggugcaguugucaccuuguaucuuggcaauaaccaacaguucuuuaacuggacuuaagcaccaagcaacagaagggaaaucauaucugcuaguggaaaccuaaccaagcuagcucugaguaguugucuggugagaccauagaccuuguaagauagccuacaacuuccacuuuacuaaacuaguauaauuccuaacaguauucuaaauauauauucuuauacccacagauaaguggagcucucagcccucaacuuuucaaagaaaugccucuuugcaaaagacagagaccauuacagaaaaccauaaccaauaacaaggcagaggcaagugaccguguggugcucagccccaaaugguccaucuacaacacaacuccuguacccaaggcucagggaucacuguugaagagaggacaaaaagaccguaggagccagaggaauaggcugucuucugugagacuuugucuccuagaaaugucagggaagcuucaggcaugcaaucucaauaacauaacugcccaaacaaaaccugaauaaggagcacaacuacagacaugcuaaggugaaagggcuaaagcuaauaaaaccucagucugagacaaagaacuacaaguaacuaagaaaugcugagagcaguagaagagagccauccucugggaagagcccuccaauuggcuaauaccaaguggucagccccgaaaccaaauacauucaagaaacauuauauaaacaggauggaguuauauauuuagggauauagguagauagauagauagauagauagauagauagauacauacauacauacauacauacauacauacauacauagauacauagauaaauagaaaauaaguaggcagguagcuagcuagcuagaugauagguagauacauauagauagauagacagauagauacauaauagguagguagaucgauaucaacauugauaucgauauagauauagaaaaagaugagaggccaaacauuugaggguggugcugugagagacuggggagaagaaaaggaauaugauguaauuauacuuuuuucaaaaauaaacaacaaacaaacaacaacaacaauaauaaaaacauucacuuccagcacuauccaaaaguguaagcuacagaguuucuuuugagauugaagcaauaucuuaacugugaaccucuacgaaaucaaaaacaaauugcauacuuccuauauaguggcaugcaguaaauguuuccauuccagaaaggaggaacuggaggcauaggaaggaaauaacauaacaaaucaaagaaagaccaaagcucaucagaucaaacacugaaucccacagcuccaugaaggguaucugggguuaugagggaaucaaucauaugggcuccaaaggccuuagacaguuuugccacuccagcuguacuaccuccagcauauaucaucuuuuucuuugcugcuucuacuccacguauaccucuuuuuccuguggccaucacugacacccugggguuuccauugcaucuuaagcuucucuuucccagcuucacaaacgugcucuucagagccucuucccagggaauaccuugacauguaugucagcuuuguuggcuuucuggaaucuuggcacuaagccuccaugaccccccacccccaccccacucugcaucuuuccuguccauacaucagcaucauguggaugaugcuacaaaguccugcugccagcuugacauagaggcugguccccuggaucccaguuugcaguagccucucugugcugacccugggaaaucucuucccuagaugcuuguuauggacaagggaacuucuuuaauggcauccucccugucgaucagugguucucagccuuccuaaugcugugaccuuuaauacaguuccucacauuguggugaucaccaagcauaaaauuauuuuauugcuacuucauaucuauaauuuugcuacuguuaugaaccauaaugugaauaucugacauguaggcuuucugauaugugacucccgugaaaggguccuucaacuucccaaggggucaagauccacaaauugagaaccacuacuuuagacucuccuuuuaaaugaauuuggguuuucauaagaugaagucuuccauggguaguguuuuacccucaggugucuuuccuguugucccaacaaagagcagaauguuucuuuuuaauaccauguaugucuuaaacaauuacaguuacuuucucagcauccccuugucuguaaaguaccaacucuccuugucaaauugcaaacauaacaugaauuuccugcauuagguaucaugacagagauauaucucugugcugucaccggaagcaaccuaaggaguuuucccuaauucuuggcucaguucaaacagguuccuuagcugugaaacaaaacaauuuccaggugaaacuacaugagguagagcuggaguuuccauuucaauauagauuuucagcaguaggguuaaaagaaggacagaaaugcgugagaagaauguacgacacacccgaaagcauggguguggguuucucugagaaacucgcuguccauugucuuuauuaacaggucacauauaggauuugggugguuuugaagcuaagaauuucaaaggguugcuaaggaagaucacaggguggcucccaaauggccugggccaggguuacaaugacaaggugaacuguagaugacaggaaugaagaacuucaucuuuacuguaaacaagaugaguagucuuacuucagagucccagaagaugucuagggaaaugaauagggcuucccucaagguauacauguaguuuuuaagccugauuuuuuucuuuugcuguuuuaacacauaauauccauauaagaaaggaauauuaucucugugucaguaucuucucaucagauguuaauugugcuacaauucucuuuuauuuuuugagacagggucuuacuaucaaacuugaaggucauaacccagacacaagucaggucuggccaccuguccucaauaugccaauuaaaaggacaagauaaaaaguggaaaauuagcugggcaggcuggugcaugucuguaaucucagcacuugggaggaagaggcaggcaaaaagaucucugugaauucaaaagcggccuggucuacaaagugaguuuuggaucagccagggcuacacagaaagaaacccuauuaugaaaaacagcagcaacaaaguggaaaguuaaaacuggagauguauucaauguggccacaucaaggaagagaggcaaagagguuagcaaaccccucaggucagucuucaucuucuggguugugaggugaaaucaaaguuuaaauagagggcccaggauaugcacaucuaagcagcccuggucuaagucaguuuuuguucacucaccguagucuggauuccagucuuguccuguaagauggucugauaaacuugcuagaacaacgugaaaucucuuucugggaaaaauuuaccccaauggcugacucuauuuguuucuccuagcuuaagaugucuggggaaauuuccauuuuuuuuuuuuuuuggcccauuacuuuaacagucugauaguccaacugagagacacaagggucucuucaaaauauuuucauuucugccaggccaguuacagucucaaugugucguucugacuggccuggaauuugcuagguaggcuaaccuccaacucacagagaucuacauccuuuuugccuucgccuccggaguccugggaucuaaagguaugugucagcacaccuggcuguguugggacucuuggugcucagaugguggaaggauccaagcagacuccagcuccuuccccuucucauuucccuguaaguuucccugucuuucuguacugccuuagaauucccucuagauuaguucuugauaagauuuuuuucccuucugaaacccuucaagccaguccuccagggccuugggacucucugaucugccaaacuaccacuggaauggucucuuaggcucagcuuacaguguucuagggcuuuucaaaggugcaagcaccaccuuuggucagauuccccacaguaaugguuccauuuucaaguaccaauuuucuguauuuguuauauuucucacugcugugagcaaaggacagcagcaacuuaagggagggauugcuuugacucacuucuuuuuuuuuuuaugguacgcagcuucaacuuuaccaggauacuggggaucaaagccaacuccuugggcaugcuaggcaugccauugcugacuuauuucccucuccagccccacguuuuaaaaguguuuaauuaauaacuuguucacauuuucuaauugguuauuuacuaccaguugguguuugcuuugacauacuuuucucaaaaacuuuuaucuugaguuuuuuuccuauuuaucuauuauuuuaauugcacuuggaguggauucaauuucccuugcuacaugucugugugucuuucuuaauauuaccucuauccuaauacuuuggaauuucucugagagaaauucucaccuccaugagaguaugucugugagauauagaccacacaagcaguguuaauggcauacugaagaugacuuuguaaguagcucaauucuguuaguaaggguuuaucucucgacaggcaucaacugcugcaaugaaguuuuucauauccauuaucaaguguguguguggggggugaguaucaggcaaguuaucuguugcugugugcuguguaacaaacuucauugaaacuuuguaucuucagucaaaaaugacucucgagaugaugauuaugguggugguggugauuauuauuauuauuauuauuauuauuauuauuauuauuauuccugauucuguugguugaccaggauuggcuacacgguuauauuguuccacacagcgcaggaagccauucaauuaaaguagaacucaagguaagauggaauggccaacaugagucucauucuuccaagucuuucuccauguggcuguucucauuuaacauccugccuaggcuucuucacacaaauaaccauaagcucuuaagaggaaaggcuacaacagggcauggcccagugcauaaacauuuacgaagcauuugcugcaucucguuugcucaggguaucauuagugaagcaagccacauggucaagccccagacucaaugugggagggauuaaauacagguuaucaguugaugggucauuuauugaaggccaccaauguaaaaauuucucacaaagcuaguuccugucccuagccacacauggauucugccaguauuuauuauuccguaggagcuaaucccugguccauguuuuacuuccacucgagauuugucuagggccuagguagcuuuucaucuugauuaacaauuugcaauuuugauucugcgucucuuugguucuaccucucucauuuauauuauaucugaaauuuucgauuugaagcagaacaaggaagagugucacaaaauaaugauugaaaaaugucaucuuugcuggaaaucugggucagcaucaaguacauuuucuucagcaauuuuucuuaagcauucgaccaguuugcucuaacucuuacugacaaugccaguauucuggcuaaaucucuucccuaccucuuucuuguauaauugcacaaaaauaucuuuugaacagucagcaucugccucuguaucuuuauucacuuuuuuuuucuugaaaggaucuuguucucaacuuuuauggacacccccuacuucuuguuucauaaauguugguagauagaaauacuuuuuucucugaagcucccagccuuuucccacauauuucccuuagcaauuccuuuucucauagacaguuccauaugcuucaguuucauuuugguuuggaaauaguacucuugccaaguuuucucuuuguguacuuugcauauagauagccagccagcuuucacuacaugugugaggugccucccacucuaaaauuauccaaggaagcuuauuuacauaugaauuugcaaagaacuaaauuucaagggaagaugcugacuacuuuauuugacaucuuuucuuuuuagacuauuugauaguacaacuggcauuggcugccuucauaccuuaucaucagaauauccagcacagcaauauuuuagucaaauucuaguggcuuccaagaacguucucuaaagcaguguuucuuaaccuuccuaaugcuguggugugaugacccacaaccauaaaauuauuuucuuugcuacuucauaacuguaauuuugcuacuauuaugaaucgucauguaaauaccuccuauacaggauaccucaaagggguccugacacacugguugagagucuuugaaggcaugcuuuguggucguucaggcagaauacuacaguucaaaucugcuacaacuuuuuuguuuuguuuuguuuuuccagacagguucucuguguagcccuggcugcccuggaacucauucuguagaccaggcuggccucgaacucaaaaaucugccugccucugccucccaagugcugggauuaaaggcgugcgccaccacaccuggcacaacuuuuuguuuuguuuuagaaaauacccuuaacuuuaccacaagcuucaaguggaugccagucauggugaugguguuguugcuuagaaaacaauuuauucuagaaaaugcaggaauggccaugcuggggaaucugcagguaccaacuauaaagagcaggugacuauuacaacaaucgagagauucugucuucuuggccaagcacaaucuggcuccagaccgcaagacaguuuuggcugaggacugcagcagcuugagcgggagcguuucagguuauaccuaagauucccugacacccccccccccccauagaguuguaagacaaaaacaaaaucugaacuuuuaaaaggaaaguccucagucuuuaggacacgcacagauauguagaucuaagauucaaaguucagaguuuaguuuugacuugcugugauuuuucuuuauuuuuguacuuuuaugcaucacauuuagcaauccugccagaauaacaagaauggaugugguugguuuggcugugguaccauacugacuagaaacgcccuggccuugauuuccccgcccccuacccugcccuuccucuuauccccgcccuccccgcauucccgcuccuccccccagcccccggcccggcccggccccgccuggucucucuaaccggaaggaggcggggagagaccgggcuuccugaaaagagacgcaguaacuaagcaaccagggcacuuacgcccgggaccuuccgcagcucuuaggagacgugcuccugcgcucgcugacgcuacaaucccgcgcuagagacuugggcccgacugggcgucucucuucuacguaauucagaaccucugugugauugguuaucaugggggcgcggcgcucggaucgcggacgcuucugauuggugcuuuggagcagcggggcgggauucuguuaacugccgcgggagguccggacaguggcggccaugggacuggaggguaaguacgcgucuuggcuguccuuucuaacguucucggucucucuggaugggguugugccguucucacaggaccguggcaggcuguggaggaggugaagccuacucuaucugaggcccggaagucggguccgugggucuccguaaucaaauggggauugagggugccuugaggguuggaacugguucuuagacugaguuuaguagagcgagugacuggaaucuuaggacguuuuuccgagucccuuugggucuggccggaucuugucucauccuggggugcuggcugguggacccgggcugauccucuuuggcucuaguacacccgagcugccucucagggagugcgugugcacugccuugggacuggauuaaaguauacuucucuugauuucucagcccuguccgagcccccucuaaggauccucagaagcuucuacuaauaagggaguucccugggcacgauugagaauuuugaggacuucuugacuuugucauuuacauggcuuggguagggaaguuguacagaucgcuuagcauguagggcuggagagagaauugaccagauuuuacagccucuauucacuuauagaagccaagauucagugaguauuuucacauacuuucauuugguucauuauuucuguucuuaucauucacuucuuaaaacgggauaggacuaaaggaccagguuuagaugacacaugacaguagcacagcauuagccacuugaggcuuugcuuuccccuuuugcaaacuucauauuuucuugcuuccauuauuuguuuacuuacugguuguaaauuuggucuucccuccucuuuuuuuccaguuuauguguccgggugcccccauguagcugucuuacccugcccuagaacccucaauucucugucucccaagcacgugcuccuuucuuuccugccuccucccucugaauuucugagacgauuuuaaauguaggugaauuugugggagaaaauggacacauguaguugcaggugagagcugaaacucagagaguuaggauaguaauccuccauugaguucuuuguagacuuguagaucucaacuaaggcggauuuuugccagaucucuaaagcuguggcauuaaaagucuaagcaucuauagaacagaguauugaaugagcacuucauaugagcaucacuuuagggaacuccuaaagggaacuuuucuuagccuuagauguaggaaagagcccacauguaaagccuguguccuguuccauuuccuuucagggucuacacugaaagggugcucaggggaaaggcuuccauaauuaaaagaaggguucugaaaagagaagggagcaguuuaagcauagcuauccuugaauaaggaaggagaagccagauugucuucagcaugagcucuagggaacacuugaagaggguguucuuaaaaagaaagcucuaguuccagguacauuuuaaaggaaaccacagagauaauaccagcagagccuuaugggauguacugggucacuagcuaagcugugcagcccuaaucagcacauuuucugugaagaaccagaugguaaauauuuuaggcucugugggucaucugauuucuuucaaagccacagaaguagccauucagaauauaagugaaugggcaagccagguuccuguaaaaauuuguucguaaaaauagacaaugugccaguauacuuagauucacauccuagccuguuuuaguauccuuuucugcuucacaacccagaacaaaaggcagugcuauaaaacagccuuuuugcuauuuuucaugacucuggaaucugcuagacuuagcuagugguacuuuuaugagucuuuucagggguuucuguagaaggcugcauuuagcuagaggucuggcuagaaauugggcgcagguaagaauguagagguggcugggucccuaucucuccauguagcuuguaagcccuuuuccucucauugucucccccauguccuucuaaccuaguagcuguaugauaacuccagaaguaaaagccaucgaaccuuucauaggcugaggucaaagaucugcaugucccuuuuaccauguccuguggcuuacauggucccagugcaagggagauuccuaggugcaguggugcacaccuguaaucccagcccucaggagacugaggccaggaauauugaauucaaggucagcaugagcuauaagcuaaaacuuggcuuuaaaaguaugugggaagguauggucgcuaauagccuggcacauuguguucuaacuucuuuaagcuuuuggcuuugcauuuacacuauauaauugauaccuuguauaggucugucaacuagacuauggccacauauagaaaacucuuagucuguguaguguuggauagauagugauuuaauagguaagaaagcuuaauaagcugauaagagugauaagagaagcagggaaauggauguuuaauuuuuugaaagaauugguuuuguagcaaaccauuaugcacugugacacaacguuuaaaaguggaccaguuucccagcucaguuaacacauugcagaaucucaguucuuuuguccuauggcaucacccugcuaagcaaguagauguucucaaaugaauacguuuauagugugcuuugcuuuuauuucuaagugaaaaacuuuaaaaauaugccuuaacauuaaaacuauuucuaacaggauuugagguaugaaaggagaugcaguuuugagcugauguccugcuuuucucuuucaggugacagaagacacauuucuuaacuggcuugcucugagaacugaugcuuggaccaccucagcauggccaauagaagaggaggugggcaaggccagccuccuucagugucgccuuccccggguagcucuggaaaccuuuccgacgauaggaccugcacccauaauauaugcauggugucagacuuuuucuacccaaacaugggaggcguggaaagccacauuuaccagcucucucagugccucauugagagagggcacaaggucauaacugucacccaugcuuauggaaaucgaaagggcguccguuaccucaccaauggccucaaaguuuacuauuugccucugagagucauguacaaccaaucuacagccacgacucucuuucacagucugccauugcucagguacauauuuguucgggagagaauuacgauaauccauucccacaguucuuucucugccauggcccaugaugcucucuuccacgccaagacaauggggcuucagacagucuucacagaccauucccuuuucggauuugcugaugucagcucggugcuuacaaacaagcuucuaacugugucucuuugugacacaaaccacaucauuugugucucuuacacuaguaaggagaacacuguacucagagcagcacugaauccugaaauaguguccgucauuccuaacgcuguagauccuacugacuucacuccagacccauuuaggaggcaugauaguguaauaacuguuguuguugucagcagacuuguuuacagaaaagguaaugacauaguagcucaauuugcauugacagcuuguuuuuuuuucauuucuugucggaaacuguuuaauacuuguauguuaugauuacuugucuuuucauucuguaugguggcuuuaaaaugacggguaacucuugcaagggaaggucagauaaucaguuuauacaucuaagaagagaaauggauagaguggcuauaaaugcugcccaaccuuugauguuguaaugguucccgaacaaaagaaaaccauugaccagauguccuccaaucagaucuuuguaaaaaaaaaauaagagauggcugugcagguaagaaugugcuauguggccuuuucuuuuuagaucucagaaguaauggcuucuuauugcaggaguuugcaaagcucaccuagcacaucugugacgaugucauucagagauggcccuaaugacuauuuucaugcauugucuuucaugcaccuguacacgauauucagaaucagugggccuuuuagggcccguggcuaucuuauggcuuccugguuuuauccacucuuaugcaaggcacuaauaucagcagucagucaagugacaaaagaaaggaauagguggcucagagucaaaaccuggcuuauggcugaucuaggacagguuacuuaauagcucuguguccguuuuuuauuuguuuaggucagaagaggaaccugugaagguucagaggcagcucuuaagaagaucuuugccuagguuccccuccaccccagccugucuuuauuucaggaguaauucauugcuggcuuucgaguuucuguggcccuaauggucuccacuguagcauuuauguuuauuauacauuugaaacaaccugcuuauuaacauagaaauagucucuccgauaguaguugaaaagcugcccaauaaucagaaauagcaugugcaguuggggggcaguaacaaauacuaccuaucccccuuaacuguuggauuuuuaagcauuugagcacaugcugaauuguagagagcuugguuuagagcucuaggacuugaggguuagcucacuggcucugccuguguccuauugcaugguugccacucuggguuuccuuuaaaggggugggaguggggcuaaaggguuggaaacaaugugcuggauuuuuaauuugcuuucaguucuacuccaguuuagauaaacucucaucugacaggggauuuuuuauuucccugauguucauuuauuggcuuuucaagcuauuuagcuuucauagaaacuuuucagcuuaugcacuauuuaauuaaauuauucaauacagucauaaagaaaauggguauucauugaauuugugcagaaaugccaacaggcuccgcugugacauguggcaguauguauauucaggagucagcaguggccaguggagguggagguuguaaguaaguaaguggaguuggguagacaacuugaacucaguuacauuuucuggggugaaggaaauccugucuucauauuuaaucaagaugauacgaauggaauucuguauucuaaaccccugcugggauauuggugauguauuucuuauaaccuuaaaauuuuugcccaaccuauuuuuagugaauagcuuacauuggugagauaaaugagaaagcaugauggugugugugccugaagauuagcacauuuacucauacagagagaggguaaacaugcucuuaucuuauguguuuuaacugucagagcuagcaucacaguuauggccuuuccuuuucuucuuuugccugccuuucuuugucucucucugucucugucucugucucugucucugucucucucucucucucucucucucucuguuugucucugucucugucucucuuucucaagacaggguuucucuguguagcccuggcuaucuuagaacucacucuguagaccaugcuggccuugaacuuaaaaagcucugccugccucugccuccugagugcugggauuaaaggcgugcgccaccacugccuggccccuuccuguuuucaguucaagaacucaacagauaaucuauugaaccuucuccauagaucaggggcccugcaaaauguaacacgaggaggaauggccacaucuauggcccaggugugacuaguuauauuaaugaucuauuccuucucaauaggguaauucccuugggagauguucaguggaccagaugugcaaggcccauugguguagauuaagaggauagaguuauguucucccugcccagcuuuuguggagaaaaggcuggcuucugagucuucuuccuuccauguaguuggggcuccccucucuucugugggugcaggcacccccagauacuugcuguagugguaaugacaacuuaacauuuguauucugcaguugcuaaagccugugcaugguacaguaccucauuuaccccaacaacuguaggguagauguuaccugcauguaacagacaaagaaacagucucagagaggguaaguaacucgcccaagguuacacaguaaguaacagaucacaaauaaguucagcucuugaguuaaggucucccugugucccuacccgcagucuagccauugguauccuagaacaggucugaacauuuuguagaacauggcgagggcugugccaagucaauuugauucagaggugguuuuugucugguuuaugugaaugugauuggcaggccuuuuaugugucguguguuagacucuuuuuuagaaucuuaccucaguaagcuugucgguuuuguguuuuauagugaggaaagaaaaccugcuguauuacuagaauauaauaacgcaaugacugccuuaguuuuguauaagguuuuugucagaauuaaacaaccuagugcauuugaaguagauuguaaaugaacuaagaguucaguaaauguagcuaugauggguuuucaugaagaguggauacuugauguuuuccuuuaaaggaggaaaagggggaguagggagcuaaguauuaaguggcacuaagccacuuccugguuauccaaccaauggcaagccuucgucauucagaaaacauaugucugaauauauuuucgguguacauaaucauuuugaaaauccauuagugagugcacaaaguggaaaaauuuugaacagcuuccagagaugugggccacuuuagaagcucacaauagcuaaguuucuuauuaaggaaagaaucauuggaagaaaugauuuuguuacgguuuaucuugccagaagcuuagagcagaaaauguuccaaaagaagucaucugcacagaacugggugguggugucuguaugcucaauaucucaauguaaagaauaaagcaauuuccuuuaucuggagcucggguagaauuuaugaaacguacuucuuuggauuccuaguggucacuugaaagaaccaggggauggucauccugagagcacaaacucucaggaguggugagguaccaaagcguuugcugcguagugugcuugggcaauggccuaaaagcacagccagcauccaacuguuccucguagcuggauuaagaagacugaaugcaaagcucuagggauuugucauuauccacacuuuccacgaaaaaugaaagauguaggugugggaucuauaaaaaagaaaagaaaacccagaugaaccuauauucucucccaccaugccuuauaauugguuugccuauggugaggaagaugggggggggaacugaaguuuguguucauaugcaaauguacacguguauguuuuuuaauggaauaaacccagcucaguagauuauuucauguuuacuuuugaguguaugguuugcaauuguugaugaacuaaauucccuaauagugucaguacugcuguuucuuugaauagcugcuacuccuuaaacuaggaggguuugacuuacucuauuacuuuauguccccugagauuauacuugcaugauguaugaaaaccauuuucuucaaaaaaaaaaaagcaagauauagccuuaggucuauggacuauaaugaccuuacaguuaaggcccuggcaccuuuauuuacugguauucauugugaaauucucuguaugaacugacuucugaacaaaaugaaggcaguaguuagacuguggcuuagcccuuuccuguugcaggaaguggaucauagaccuguugguuuuuauagcaggagaccuuggaccuuagguauacaugucucugcaguuacuaggccauaaugagaggguggggugguuuuaaaagcuacaaaaagagcugcgaugagaccuagauuucuaaucagcugugcacuuuggagaagccguguuaauuaaauagcacguuuccacguaggcuguaugaacaagugaauggcuuaaaggcugcaaaguugaaacaggauuguucaugauauggguauguggcaguagcggugcaugucagaaccugugucuccaaguguuguacuugggaaccgauggcaguuaguaaaugauuuuccgcaugcggcuagugauaguugauaguuaaaacuaguggauucucaaggacucugaugaguauuuuuuaauguuaaauauuaauauuucuaauauucaaucuuacaauuucagggacugauuugcuuagugguauaauaccugaacucugucagaaauaccaagaauuacauuuccuaauuggaggagagggaccaaagagaaucauuuuggaagaaguacgggaaagauaccaacuacaugacagguauucauggcuaccaaguuacuguagguguaaaacuggcaguuguuggcuucugacuacaugccugccuuaggugugcgccugcuucaauuuauaagaggcaugcaaauagaaggcaugcuuuugugagcuuuuaucaaauaggaaaucucacagaauauauaacuguuguccauuuauugaaaaacccugucauaaaacaaaacaaauuaauguaauagucauuaagcacaaacuaguuuugcaaagguugaaauugcaucauacgagcugugacacaacagguuccuaaaguugugucuauuacacuggggucugacuguaucuaagcuucugagguggacagcaauguuaguuccaguaagagugauacuuuuaagagugaugcaauaacagacuuggcuuagaaauuaaauuucuuucguggcaugacuuuuuuuuuuuuaccuccuuucucucuuauugcaaaaauuagggugcagcuuuugggagcuuuagaacacaaggauguuagaaaugucuuaguucaaggacacauuuuucuuaacaccucccucacugaagcguucugcauggccaucguggaagcugccaguugugguuugcagguaaaacacuuuaagggcuuuucuugugggguucuguguuugucauccaugccaaacugauacauuuuuuagcuuggucuuuugcuuuuccugaggaaugaguccgguggcucacuugcacucuccgguuuucuuaaggucgucagcacaaagguuggugggauucccgaaguccuuccggaaagucuuauuauucucugcgagccuucaguaaaaucuuugugugacggucuggaaaaagccauuuuccaagugaagucggggacauugccagcuccagaaaauauccacaauguagugaagacuuucuacaccuggcggaacguggcagagagaacugaaaagguaaggcacgugccaggaagaaaauuguucagauuccuuggugcuuugugugcauauuugcuuucuauugcaggcaagcuugcccuuugcauuuugguguaagugucugaguccuaccaaaugaauguaauuauuuaugcagcaggcuugaugcauaugcuuggcuaaucuucgacauaaauuacugccccuggacucugaagauaguaaugacacagucuagucucauuaaacucuuucuaaagaaguugcaaagguuucuagaacuuguagcacuuagaagcagaaauaaaaucauuguguuggggcuauuuauaguuaauucugcagcacauggggucucuuagcgaauggugggugauugcagugccuuccuaaguugugaauguugaauuaagaaugcuuccugaaacucuaguagcccuuuugcugaugauuaauauucugucagaaaagauuuucauaacuuuagguugauugacacuauauuauaauucaaaauauaugugaaacuaagaacaaauagucagccguaagaaagcagcuacagggaauuuccaagaacacauacaggcuugaugggccuccuagagagaaagcuuguggcaacuacuucuugauccuggccucagggaacauuuauucuacuccauuucaucuauuaggucccccuugugucuaccucuuguccucauguuaccacaugccaugcugaaggaaagaacucacucuuuuaguauguggaaauccuguaccagaaagacagccaagcggagcauggagggcucgucguuuagacuuggguuuuauguuauuggugauaaauaugguucagcagugaguuuccagccuggagaaaauuucuugguuugagaugcaaguucuuauaugugcagucucuuucuaaaacaggacaauaggauguauguuucauuaaugucggagguauuggaagcagacauaguuuugacugaagacauauaagcuaccuuuuuuuuuuuucuagaaguugggcugaguaccaguugccuguggggaagcaugucagaaucacauggcuagccucuucagacuacauucuccauccuuguguccucuuaaccgccccaaccacuccuuaaauucugacuucucccucguggaacagaaaugcaguuuggauuaugguuggcaggaauauuuggccagacagguuuuuuuggugaucuuggacuccgcccugauuuagaauccuagcucuguaaauuguguuuugacuuugucaucuuaugaaccuccaaagacugagcuguugggaagcaguuuaccagucaguguuaaaggggcuaauuagcaauuuuguaauaauauuuuuccuuguaguuaugcucugagaucauaguaaagcauuuuauaugauuuauaaucucugcuaagucauaguucauauuugaaaaaaaaagaaaggaaggaaggaaggaaggaaaagaaucuaaccaggcaugaugauuuguacugggaagacuaaggcaggaggauggccaugaguuccagucccagcuggucuguacagugagucccaggcuaguucuaugcugcccuaucucagaaggccaaacaaacagaagaaaaguaaauccucaucucuaauagccauguucccuccauagugguaaaugauuuauuccuuaagauaauaaauuaguugaccucggguaagauggacaaccagaugauuuugucuauuaacucgaggacacuuugauccuuuucagcuccuucuaguuugauuggguuacucagaaaaguaaauaggaaacuugugaucucagcgcucuggaggcgggugaccaaacacaacugaaggccauccuuagcuaucuagugaguuugaggucaaaaaaagugcuaagagaguugcugcugugaacauaugcguuuuuuucucccaguuacaaucuaccagccucagcgucagcauuguucugauuaaaauguuuguacuuagagugucacuaggguugaagaaguagaucaacauacagcaugcuuuuuaaaggcuucugacccucccucccccagaagaguuugcacugacaauugugacuuucucggauuuacaaggaaacaguuuccaggauguggcauccacgggguugcacaaagcuaggcaccaaguccuuguucucagcacacuacacuuugucuuccccuacucugccgcucagcauuugcucugucuucuuccugcuucucuauagugucaccaucuauaagcagcccaguguggugacugugugugcugucuacuaggcauuuaugagagcuuucuccacccagucaaggcauuagcccagcuuagcagugugccuacugaaaaagcuuucugaccuuagaggacuuugguuuuccaguagucaggugacuaucaccuguucuaugggucacucauuguucagcccagaauuaagucaaugguaagcauuguucuaaauaacagcaaacaugggugauuugucucuacucauguuugccaguugcucccggucagugugggucacgggucacccuuuguuacaggcacaugguggcuuggagugcucacucauucauugucaccuucucucuugcagguguaugagcgagugucgaaggaaacuguuuugccaaugcacaagagauuggacaggcucaucucacacuguggcccugugacgggcuacauguuugcuuugcuggcugugcucagcuaucucuuccucauuuuccugcaguggaugacuccagacucuuucauugauguugcaauagaugcuacugggccaaggagagccuggacucaucaauggccucgugauaagaaaagagaugagaaugauaagauaucccaaagcagguagaagcaagcccaaguuaacaaguccuauuagauacuugcaauaguccuguuagcauuugaaaggaguuuugcuccuguguugggcuuuagaguuggauuugcuaccucuguaugguucacuuuuguuguugcaaaaagauaaacacuuaugcaauuccugagugugggaacuccuugcacuucuuuaaaauuuaggggauaaugguuuagccacucagguaggacaguuuucagauuacugagaccccccuaagcagagauguuuuaacauuauauuuugggagccuugggugcugaaaggccaaauguuucuggauuguuuuuggccaauuuuucacauuauaccauuaauccacauucaccagauguuuacaugcuuucuuuagggagguacaacaguuaugugaacuguuuuaaggcaaggucauguauccuucucugggcaucauugaagucauguuccuagacacuuacuggguccacucaagggauacguggaaugugauuucuugagcaagaccaucuauugguugccagcauguuugaacaccugcuguguaugaaaaguugaccuagaugguuccugagacuaaggacuggucaacgagaagugguaaaacugucaacauggcgaaaugcucaagcuacugaaugacaggagaucaucgcuggcauacaccaaguaccuuucugaccuguucuauguauaugcauucucuuaggaagagcccuucucucucucucucucucucucucucucucucucucuguaugugugugugugugugugugcguguguguguaugugugcacgcgugcguguguguuguugcuuuuuauguucuauggauugaccgauacaacuguugaugcuugugcuggccaacccucugcuuuuauagugcacaguucagucccccauaaaugccuuuaugguuucuaagcagaacagaaaaggugugcuaucucaaaaccagcugcucuuccugcccucuguggaagccccuuccugucacucuggucuugcccaucucugauaaguauugccaguguggggaaaggcuuuucuccagaaugguuuauuuagagcguauuaauucugaaacucgucagagcucgcaggcuuuuuguggguggaauuucucaaucguaauuaagguuuccagagccauggguuuuuaaaucccaaacuguaugugauauguauuauuaauccuuugaacucuuucgcauggguuuguguggggaacagacuaaaaugagagcagcgagccacuuguggguguuccauucugucaguauugugauucuguacaggaguuuuuuuuagcgacauuugcaaaacuuuuaaaagaguaucuuaacaugccuauuacuugguugccaccgauauaaaagagauauauuuguguuugguuucuauggaaacaaaugguagagaguaauuuuuaaaauauagaaguuagggcuucuuuuauuggagaaaaaugaccuuguccaaaccguucagucuuauuuaaaucuuuaugcgcugagacaggcguacagguuaacagugccaauauccacgguagacugaggcauguguaacacuuggcuguauuuauucuacucuauuauuucuucuauguuugcuucuagcuuuuauuaaaauaucauuaaaugcuucaguuguucuuuauuuaagaugaacauagaauugaaaauuaauuugcucuugugggcaaauauguaauuuaugaauuaaaauuguuuuccuuuuuugaacaaguaaaaauaaaauuugugugacagaaaccauuuucaggcuuccuggauaccuuaguugucaguguuguacuggucaggaugugggacacucuuccacugugcuacucauaauuaucugaaaugaaauuagcguggaugaggaaucguuggaaagauacuguguugcuuuugaugucauacacaugaaaccagugugcuaaaacaugcucauguccaguaauaaagaugagaacgcuguuuuaauagucuuau

SEQ ID NO: 9825 - RNA, 44422 nt, Mus musculus
cgagggcuggaagcaaauggccagcugagcuguaggggcugagcuucagggaaaagcaucagagugcuccaggcuacuuggggcgggacaccggugccaggaggucgucggaaggcgggguuucuccuuuagagaagcaagugggagcccagcagagcacuuauucccgccucuaccccggacaacacuaugggauuggacaguguggaggcacuuccuucuacguuccggugucacgcgacccccucccccccucccucccuucuugaucuaccuuugggcugggcuggcuggugaugagacacuuggcugcaggcuguggaaggagcgacggguacaaccacaauagguuccgcgacugugaccauggccgaggugagcagcaccucaucgcugccugggccgugagccuggaagacagcuuccaggcccagggcccgugcgcuccggugcaggugagcuguguugggagugaucuggguaaggaccgagagcaucuuaagguuuuguugugucuccuauccagaauaacgcucagaauaaagccaagcuaaucucagagacccggcggagauucgaagcugaguaugugacagguaagcaugcuuucugugacuuaaaguggggugugcagugagcauauccaacuuuuacugguguguuuguggguguuuugacgggagauguuaagagaccuuuccaaccuucacuggaaagaugcuguacauguuucaaagguuuugccauacugugugcgcugcuuuacuugggcagauggugggcuuccuuuaaacgguuagugaaaguuagaaaucaaaaugccuagcaucuccuuauauccaugggccucacaggcuaugaacauauuggccaaugacauaggugacacuguucaguucauggcuccuucgcuggccuuucaccagaaaacgaaccuggaaacugccauuguacuguugccauauaguuuguacauaauuugguaauccaguuccuuuuauuuugcuuaauuccgcuucuuaaaaccaaaagugcuacgcacaaguucucgcuccacacuguacuuaaaaguuucuguaagugcagaacugguuuauugguugaauaaucuggucacugucauagaaucuugucaaguacuuaaucugcugacuuagugcuuguacauuguuuuuaaacauuuggaauaaguugccuugauugauacuaauguagcccccuuccacaaaauagcuuacuuccauguuccgaguuccuguuuccauaucuaugaaaugcaaguaagguuaagaauuaagugaagaaacguguaucagaccaucaaguguggaacuaaauccaguagguggucaauuuagauuuugccucagucauugguuaccauggaaagaacuaaacuguuguauuuugauuguagugcuuggcagaagagucauacaccuuuauacuguucugugcuauauaucaguucaugaccuagaacaaauaacuaaguccauuccaaguagccuggcccguaaaucuuuucaugccuccuggccaauuuucuucauguaccaaacuuuguaccagagaguugcaaaagcacucuauuaacuuuuagcacagagaucuuauucaugucuauuaucaucucugguuacaguaaagaaguacuucuaaaauaacuuucuauaggaguauacuucaucgcuaugugguuuauaguaaguugagauauaacucauaacuaaugaauuggccauucuacaaucaucauuuacuuaugcucaaggaaacaagcagaaaauagaugaauuaugcaaucuccaaggucuuaaaaggucaccgugaugccacugucucaucuuuaaaugagggaagugauguguaguacgauuaagcaauuugcucagaaucucggguguuagagucuuagcuuggcuugcuauucaagccuuuuggauuucaacuuuaguaaucuuucagcaacguugugaugucaaauuagaucaugucauuccccagcuugaaacccuucacugucuucccacuguauguauuuagaauaaaguccccauucuucucaguggccuacaauugggaagccauauguuuuauagcuccuagcuaccugcuacuuccuuuccuguuauuucucucuuugcuuaguacagauuugaccacucccugcauuaaggaagauacaaauaguaacccaguacacacacacacacacaaaaccaaacuugaauacuuagucuaaaacaauguagcugauguauuuucuauuugacuuccuuuaaaaaaaaugcagugaccuacaaaguugacaucacaauccaaaccaugacccacaguuugaaaaauauaaacacacuaaacacacugccucauuugugugcuucaagcagaaugaguuuguuuguaucuugggacauuuccauuucucuuccucugggaugcuuuuccccaguuaguauguaaggcuaggucuuuuuuuuuuuuuuucccuuuugucuuuuuagaauuuaaauguaucugugaggcuuuuaaauguaucugucaggccuucacugguuauuaaguagcuuccugcccugcuuacuuuccauccuagccuguaauugucugauuuguuuauuguucauucccuccaguagcuaauggauggguuggguuaguagcagcuauagaaguuggaggcagaagccuuuuauucaucuuacuccucaguaccuugcacagugcucaguaccuacucuuuaagugcauauagcacuacuuuaagauaugcauuagaaaaccauuggaagaauugacauuuuaaaccaagaacuaucuaaccagcuccccuuaccuaccaaaagccuggcaaacaaaacaaagacaaaaacaaaaacaagaaaacagccuucaucauauauauuauaaagacaagcuuccuuucccccagaaucaggcacuguguaugguauuaaguauuggggugguuuuacccuuaaauauacacaaugagguauaggugaacuggugugugaguuuucuccacagaaguuguaacuguuaaacacuucuguuaguaaggaaagcagaaaccgugaaaggccuuccucaccugaaaguugcacuuguauucugaaauacgauaaggcucuuuaguucauaugcauucucccuucuaaguuuggcuuauagaaauuaaguuugguaaagcugaugggguucauuugcgcauguaauccuagaauugaagaggcugaaggaggaggacauuuaaguuccaaaguaacauggucuguuauggugacuuccggguaggcacgaacuaaaagggaaauccugauuaaaacauauaaauauauaaacauauaaauagacaaauagauagauaaaauaagaaaaaguaacuuuguauuuagaacauucacuugcuuugcagucucuauuuucauuaguaauauuuuguuucauaaaagguuuaaagcaaacaaaccauaaugauguuuuuccuaaauaaaacuauuuauuuuccccaaggacuuuccuuucagacauucaguugaaaacagguucuugggaaucccaagcucauuuauuuuucaugccuucagaaaauauuaccaaauauggauagauuuuuuugagcagacaaaaaagaagaaaauacagguucauaauuaauuuucuccuucauuguuacugugagaaauuccaugcugagucucaaaugagaaacauguuuuauucuuuuuacuuucucuuugugacaauaauuuauucaguccugaaaguacucauuaucugcuuaauucuauaaagcaguuugucaguauuagagaaaguggaaugauagagccauuuuucuaacuuguacaaucuagugaaaguauucgaacaaagacaauccgccaaagaaggugaauuccauucugagcaauaggaacugaagaagucccuuggcgaggcaguaugcaccuguaauccuagaaagugggaggaugugcaauucaaagaagcuaauuaucucugccuaccuagugaugugcacuccagccuaagacccaugaaaccuuuucucaaagaacuucuuugagugagaagugcuaaggagagagagauaccucuuggugaucagguuaggacugagugagaagcaacuucauggccaagcuuggcagcucccaaacuguagaaaaacuugcucuaaaacauggugcuauugggaaauggcagaaucuuuaagagcuguuuaccgaguaagggagucuuagauuauugggagugaugccuuuaaaggugguuaugauacccugcuuuuuuccuuuuccuuguuuugcucccuuguuugggccugcuacaugcccacugccuuaugucccucuucauuccaggcccgauggcaucuaggccaacugaucacaaacggaacugcuaacccucugagacaaaauaaaccuuuacuuucuucaucucagagacuugcgaugccaggaagcugacuaacccaggugguauuucuuaggaauguaggcagaacuucgcccgguagagaagugaucacccagggucagagagucugaggaaaggcacugaggugaaaagauaugcagcuccguaaggaagcaguagaagcuugcuguggugagccucgacgagaagugagcacagggauggaaacagaagaaaugugcugggaccuuggaugucaguguuuguacucaggacauguugagaggcagcugagcucaaggacugggucugauauuuacaggcauaugaaucgauuuaaaggaauuccguugauagcagaaaagucaaaagccuccauaccaucuagaaauagugcuaccaacacuagauagauuuuuuuccuaaucuuuuugucuauaugcuuaugaaaguaaaguuaaaugaccauccuguuuauuacuuguaugcuauauuuuuauuaggauaucaucuauuuuuaauauuuggaucuauuaauaaaaaacaguuaccauuuaauuucgauaaucacuuauuggacauuuagauugcuuccauguuuuugcuaguacaacuuuaugaagcaguuaaaaugauuuccuuuggauauauguuguacuggcugguuuugugugucaacuugacacaggcuggaguuaucacagagaaaggagcuucaguugaggaaaugccuccaugagauccagcuguaaggcauuuucucaauuagugaucaagguggaaaggccccuuuuagguggugccaucucugggcugguagucuugguucuauaagagagcaggcugagcaagccaggggaagcacgccaguaaggaacaucccuccauggccucugcaucaacucuugcuuucugaccugcuugaguuccaguccugacuuccuuggugauaaacagcaguauggaaguguaagucgaauaaacccuuuccuccccaacuuguuucuuggucaugauguuugugcagaaauagaaacccuaagacacaugucuugaaaucagauuauuauguccacaaauaaacacucgggacucacuugauaaucuauaccaaacucccaucauauaagucauauaagcugcaagaguucauugcuacuggcccuguagaauaauguuugucuaaccccaccuuauccacauuuagugucauaauuccuuaaaugguaguuuuuuaguuuucauuugauugcuaguuugccuaaacuucuuuucauaugcuuauauucaguuauauaguguuuuuaguuuaugccacuauuacugauuugggcagaauuuuaauguauucagaauuacccauuguauugugguuucuucaguugcuauuugauugcucucacccagggacaauucugcacuuuuaauuuuuauuuuguuuuaauugaaugcugauguuuuuaauggacauaaugucugaagcuggaaagaguaagcagccgugugugaaaggucuccucagccaaaugucuagauccacugucgucaaugcuuucuauguccugugacguuugagagacacuuuuccugcccuuuggucuugcucauucucuugcuuuguauuagaucuaugaaguuuccuucaccaacacuuuauuagauuuuugucucucucuuucuuucuuuuuuuuaccuuuauuauagaggcuaaagucagcuuuuuaaaaggaucaaguuuuauccuuaugauagaucuaaaauuaccaagcuugaguuauaaacuuagaugagaauaaagaauugguagacgugcuuacaguuuaaucaucaaucucaguaaugacccccucccccuccccccaccccuccuccucuuucagugggcaaaggcuccccuggguaucccccuacccuggcacuguccccugaguggcuccacccagcaguggacucagacagauacagacaccuacagccaaacaguggauggagcuuggggauucuuauagaagaguuuggggaaggauugugggccccacaggggauagaaacuccauagaaagaccaagagauucaacuaaccuggacccuugggacuuucagcgaugguaccaccaaccaaagaacauacaugggcacagauguaccagaugugcagcucauacuucauguggguuucugugggcuuuuuaaaauucauauguguauguuauuuaucccuauucaauuuucagugucuagugacaguuucacuuuuaaaccaucuaauaauggaaaggugucacuucuaggauggugguuuuuuuuguuugugucacaguuauuuuagaagcuuggacaagaagaguacaguaugcuuaucuaauuaacaguauaaccuucauuuauugugugguacuagggagcccagacccuuccuugggcuagacaaguacaguaccaguagcccacaucuccaaaguuaacaugugcuccugacaauaggguauagcagagauuuuuuucauuucugaaauuuuaauaucuuaacuaauaagucugauuugguaaguguuuuaguuucuuuuaauuacuauaauaaaacacccugaagaaaagacaauagaagggaaaaaacacuuuauuuuacuuaaaauccaauauuauggguaaagggagacgagaaccucaaauugcaagucacauuacauuuacaaacaagacaagagaaaaauguaugcauacaggcuuauuugcuuccuuccauuugcucaauuccucuacucuuacagaguucuaaacuccuugccaagggaauagugcugccuacaguggguuagacauugccacauucauuaacuuaauuaaaacaguccuccacaaacaugccacaguccaacccaauguagagagucccucaucgagacucauccuagaugauuccagguuguaucaagaugacaauuaaaccugaucaucauaauaaaguguccaaaagaaccgagugugauaguucaugucuaguaucccugcacuugaggugaagaucgagcguugaaagccagccucagcuucauaauauaucugaggccguguugggauggaucccugucucaaaauaaauuaaaaaaagaaaaaaaaagaaacaacagaagaucccuacaugauuaaauagaauaguaagaauccccaaaggacuuuuccucuucuuucaccauuuuucaaaagggauauacauuuguuacauuucaguaaacaauguuacaacauuuauguucuuuguuggacuuguuauuuauauuacuuuuucuaauuagaauugguucuuuuuuuuguuguacugcuguauauucucagugaacaagucauuuaacaacucaaaagcuacuuauauagccuuaaaaaugcuaaguuccaggaauuauaaaggaaacuugagaaauccaugcaccugugaaagaaucuauuccuguacauuuccuucacuacuagaacacagcacacuuaagauuucagaguuuaacaccacagugaacuaacuugacuguagauaugcauauguauguauagagggguauguguguguguguguguaaguuuuguaccaaacaaauagaaaauaaguauuuuaaaauauaucuuucuacucuugucaugcuuacaaaacuuaucaugugaucaauaauaaaaagucucagaaaaucuaaagcagcuagaucauaaaggccagguucucacaccauuauauuugaauucauaauauuauauuugaagucauaauaaacagguacuuaaaaguaaauuaaauuuuaggaagccgaaacaaccaacauaucucucuggauuacuaauguugcagcaauguguguaauucuuacuucuacuaaguagcccauauuuuuaaugaggguaucacaauggaaauuaccaauuauaugucaaaacuaauagaaaacuaauauggaaagaucaagguaauuuuagcugaagucauuaagcuagguuuugcuugguugauuuuuuuuuuuugggguagguuuuugguuguuguuuuguuguuguuguuguuauaauacuuugugaucuuugcuggcuagguauuugauaaguuuauuuucuguaaaucuuugacuuauaaagagcaagaacaauguaauguauuauuaaagaucugggcuaugaggaacaucagggguggugggagccagacuuucauggagauaaucauucuauaucaaaaauguacugugcaucaauuuuugguaaggauuaggaagguggggaagugacauuccaaacugccugaccucuuggagcucagcaguggaggucagugguagcccuacucaucucguaccugcucccucauuacacagggacucugugggugugacuuaaggagcuguuccugcucgguuuucaugaacaauauuuccauaugguaugugugugugugugugugugugugugugugugugugugcacgcgcgcgcacgcgcgcauguaugcuggagauugaaugcagggcuucacacaugcuagcuggcacacugcuauugaguuguauagcucagccuuucuuuucucaguucuuaguuugaaaaaguaucucguuaaguuuccuggcugucauugaauucacugugucacugguguaggucuuggccuugugaucuuccuaccuuggcuuccugaguaacuggaauuacaggcuuguguugccaggccuggauuuuuaaugaagugggccccacacucucccauuugaccugggcuaagaagaacaaacacaagauuguacacaaugagcccacaaggaggcccggacagaguccaugauaauguaggaauggccaaaaugcauuaagucuguuuagccuggguauuagcuggugacuggugagaauuuagcccuugugcucuugauggauagcaacugaaauagaaaguuccaccuuccaugcaccugaccggugaucauuuaaggccugcuucuauacagcccuugccugagaauuuuuuuuuccaguuuauguuuuaaagggauuuuaaauaagcauacaauguaucagcaacagagguuaucuauuucccucuagguaugaguucuuuuuuaaucuaacuugccaugggguaggguggugagaauugccagguccugcaguaggacagagguucacuaaaucaauuccuaauuuagauuguugauucuuggauacccccacccacacacacacaaauuucaugaucuagacacagaacccaagaaugccuguguuagcauccucuugugacucugauacauauucugucauagaagaucacuuuucacucagucuuccagauagcuugacagauaccgagaauuuuggaguagauuguggccaagugcuaaggaagugguuuuugguuugguuugguuugguuugguuuuugcccaauuguggggcaaaaauagggucccgugaucgcuucggggcuagggccacugggcgagguggacucaggaguuugacugcgcuguagagcccacagaacugagggcagguauuggacugugagaagccaugggauccaguuccaggggugaggaaagggcacagucuggggucccccagaacugcugggcucugacccucgggcaccacagaucccugggcaccgcggaagagcugguucuggggucgaggaagagcugagaacuaaauggggacccuugggcagacucuggccugggagggggguggcaaaggaaaaagagcaggaaggagagcuuccgcagguugcccuggggaggagagagucuggcuagcucaggcggcuugcucagggggguggcuuagggugguggcagcuguggcuggaguauagggaggccucuuggagggagguuagacccuuagcuuguuaggggaagaccugcuccauugcuccagcacgcugucaggaugagcagagaagguccaugguuuuaagguguuuauuguagaaagguagagagaggggagaaguguagagaaguagagggcagccauggcaacauggagagaggguggaagggagugggggagaggggaagaaagagggcaagagagaagcaagagaguaagagagcaagcaagagagugaggaggagccgggcaugguggcgcacgccuuuaaucccagcacuccggaggcagaggcaggcggauuucugaguucgaggccagccuggucuacagagugaguuccagaaggacagccagggcuauacagagaaacccugucucgaaaaacaaacaaacaaacaaauaaauaaagagagcgaggagggggcaagcuaccuggcuguuauggggaguaaugcuguugccagguaacuguggagguggagcauaccuggcuguugccagguaacuguggggguggaguccagacagaauaccaggagcuuggggcauugccuacaugacauugccacacaccucucugguggggcggggugggggugcuguggaaggcuauagcugcaacaggagccaggagccaggagccaaggaggaguggcugaacuccuaccgucccaugaaggaggaagucauugcccaucucugggguuccaggccaagaccaggcugucuguacauagcucaccaccccacacccaaugccccauacccaaugacuuccauucuuaacacauccacaguucucucccaaaccccuaucaggccuuucauguaaccuauacuaaagauucauggaggaaucuaaggccuaggaggagguuuccucuggccagcacacaugcaccugugcacaguauaaauaauucaaauaaauaagaauuuguaauaaauuaaaaaaaagaaagguggauuuuguuguacuaaauauagcuaauaaugucccuuguucaugcuguccguccuaagccaugggaugcugaccuuucgcuuucuucucuguucucauuauucuccuucugucugccuuguaucccuggucugucucuuuccucugcugcucucuuguguucucucccacuuuccucccuuggccuuuucccucuuuccuuuugucgcuacuuuucuccugccucucucugccaaacucuuccccuuuccagcuaucucuucucauuucuuuccccuucucugauuucauuuuugcaugcccaggauuaaaggguuaaaacagcaacaacagaauuuccuauguaaauauguuccuauuaauaauaaucaugcucaauggagaucuucgauuucagagacugguguacaugacaacuacagaaggaagcagacuuuaaauuucuaguaguagucugugucuuguuaaugauggggcuaccgguagcagucauguuaacaauaaugguuuccuuuuauuuuuuaauuguaguucauuuuaacugagcuugcaucacuugccaaauaucguucuaagaaaguauauuucaguguaggcugggacccuaguggauaucuaagacucuugugggagccagugaggucaaaauucucaucauaauccuaaauaucauuugcuucuuucauugugcugacauuuguacugguuauacaaaagcaaugggaggugagacugcugacucuaugacccgagccagggcaaggcaucacuguaguguuugucuuaaucaugaacaaaaggggacagaaaaagccagauuugucuuugaaaguuucuaacaauggagcaaauuuuaaaccuugaccuuugaacacauguccauuuaaugucuccuaugaaaccauggggaugaagcuauagaauauuucuacaugcuuaguguguuugacuugggaacuuacuuagucucccuuuucacugaauaucacuuuuauugggaagaagaacuaggaaacucugcuuaugcaaacuuggguacuugacagacauuuuccugcaagaggaugaaggcaacuguaauuuuaaggaacauauccuacagguacaauggccaaacuaaaugaucccuccuuaaugagacagaaggucauguuaucucuuuuaaagucaucuuauucucucaaaugucauuuauaauuaaagggaaaaugugcuuggaauacaaauuaauuuucaaauuacagagcuuaaacaguuuuccaagguugauguaguaugagcccucucauuuuauaaauuagaaaaauagagcccauauauugaaaauuuuaccccagaugacauuucacaaauggaugauuuauagaguccuauuuuauggugguuuaaauuuccaggcacuuucaugcauucuuuuuuaucugacccucacacaggccucggaguauauaaaacaguauaaagaucaagaaaguggagacucaaagaaguuaaucggcucaaaagcauuuucuacuuccugcccuuucuucucuuagcucaagguccugaacgaaaggcagugcaaauguagaggagauggacauuguacaacucagcaacuaaauauuugugaaagaugaggaaauggagaagccagggaaauuccugaaacugcuguagcacuuggaggagaauggauaguugagaaacugaaaauaaaaacagaauagagucuuucucucaauaaauguugugucaucugcuuuggagaauucuucgauguagagauucugagccuuuacuguuuuuugggagagauagcaugcauaccaguaacucaaacuuguugaggguugaucuguuacuauguauuuuaguguuagauacuggcccucaaggucuacuuaaccccaaggaggaggagauccguacuacuuaaccuagcuccuuauuuuaaaaccauugguaaaauaaagaagccuacagccugggcagaagagaggugggcgagguuuugguuccugagcuuggagucuaaagcaggaccaggagggagaagauggauagaagagaagacaccaugggguaauggauccugagaacuggccaugagggcuagccaguuggacagaguaagagcaucccagguagaccguggcaaguuauaucucaggguuauuggcaggaaguagacauauagcauagaaguuagacaucugcccaacucuagugcuuuuucacauuauaguuuuauuauuauuauuuuauuuacauucuagcuguuauuccccucuuuguccccccuccuacaguuucucaucccauuccuccuuccccuugccucggaaagggugcuccccccgccagcccacuuccuucccuggggccuuuagucucccaaggauuagguacaucaucuucucccucugacaccagcccagcccacguaugcugccugguagguggcacagucucugguagcucccuggggugugaguuaguuaagacuguuggucuuccuaugggguugcccuccccuucagcuucuucagucucucccuuaauucaaccauauggguuucugaccucaauccaaugguuggguguaaauaucugugucugucucaguuaucugcugguugggacucucagaggacagccaugccagguuccugucaguaaacaaaucauagcaucaguaauagugucagcccuugauaccuuacuccccccacccauaagauagaucccaaguuggagcagccauuggagcuccuuuccuucagucucuucuccauuuuuugucccugcaguucuuuuagacaggaaacaacugccagcucuagugcuuuaaaggguuaaguuuuacaucauuuaucugggaacugaaugaucaaaggugggauagaaaccucugauugagaugaacuauuuacuacaacgcuaacucaugauaaaaauuguuccgugccuaaacaaacaaacaaaccaaccuuaaaugaaguucuguugcuugcucacugaagaauuacuuuuggucacaggaaauguuuguguaaagaggaaguaucugaaaagaguguuaccaaaugguagaauuuggguauguaaaggugauuacauggaaacaagaagaauucaccacaguaaacuagugagaguaguauauagggaggaauaucugcuauagaggcuaguggagaauaugacguguauaugaaaaaugauacacaauuacaacugaauauaauuacuccacuaaauuguuggaaaauuucccucagaaucuggcaaugugauaauguugcaugcuauguuuacaugugaaguaguuccugaaaaaccuuguauguugaaggcuugguccccugccagugacaguugagaagugacuggaucaugggagcacuuacuucauuagggcacaaauccauugaugucuagcugaauggucuguuaggagacagggcccugcugaaagaaauuaguauacccauucccuggccccuugauggcugccucugcuuccugucugccaugauaugaucaguucuuuucccuaguaccauucugcuauagcauacuaccucaucacaggaggaagaauaauagagacaguuggcacagacuaagaccucagaaacugugagccacaucaguguuuccucagcuggucuuauuggugcacaccugugauccuaggacuuaauugaggaugaaggaugacaaguuagaaagcauccuauaaucaaaaaaaaaaaaaaaucuuuccuuccuugguuaauuuugucacagcaacauaguauuagcuaauucacucuagauuuggacaguucucuauuugaauuuuuuuuuaaagugauacucugugggauguauagaaguguaugacuguagguccagcuacuuagacugaggcaggaagaucaguugagccuccaagaauugcaagacauccuggacagcacaguuagacaucuccucaaauucuguagccuuucgauaacuuuagucugaucucacugagaaauccagucaauucuuucaagugcauuuucaccugaaaacauccuuagugugccuuggagaagcuuggauuggucuuccagaucuuucuucuccuuugccaauauguuacuuuuuuuuuuuuuuuugccagcguaauuaaccugauuuagauguucuuuccuccuuuccccuagaaaagucagaaaaauaugauucacgugauguugaaaggcuucagcaagaugauaacuggguugaaaguuacuuauacuggagacauaacguuguggaugaaacccugaagaugcuugacgagaguuuucaguggaggaaagaguucucugucaaugguaagcuggccgacuuagccuggccaaggcaggagcaucuguauaauuguuacuguuagauguuugucugcacuugcacucaguccuagcagucagcauaaacauuacaagauuaccucuagaagccuaaucauacuuucaaagggacaguuuaugacaaauucuuaggaggcgaaucacucauaagaaaaucagaugacaaggaacugagucacacagugucacuaaaagcaugauuaccuagucuguguuugguuugguucuguuaaacaacaaacauagccuuccaccucaggccuaaauagaaaaacucauugcugcgcuguuuuuuuucccaguuguuucucauauguuucuauaucuccagaguaccuuaugccuauugauuauucuaaaauugaaugggaacccccagaaagaaaguuucuuaguguuguuaacacguguugacacgucaagucguuauuugaaacccacccagaaucuacagaggcagccauaaaaauaagagccuuuccugcacuuuccauuaucuguaaaucuuuuguuacuuguuuucucuggaaauccuuugcccauuguuuucucagaagcaacucuuucuaguuuuuuguuuguuuuuuuuuaauuuauaauccagccauugccccccccccccugccccguucccaguccaccccacaaaguuccucaucccauuccuccuucccccuguuccccgagaggaugcucucccaccagcaggccuccgcccucccuggcucuucaagucucuggaggauucaggcaugucucccagugagcugggaccaggcauaaguuauauuuuauucaagacuuaaguaaauuguaucuuguucaagucuaagugagaagaaacuacuaugugacauuuccuuuacagugugaguuuucuuuuuagaaccaugaauuacuaccaugacugauccaaguuuaucacuuucuagaccuuagugaauccucuauuccaagaugguuauuagaacuuggugguauuuaucuccaugguuaugacaaagaagguaacaaauuauguaaguauaugugauucauacucuagacuuucaagaccuugcaauauacaucuguauauauacuuuccauaugcauauauaacuaguuuucugcaacuggagauagguggccaucuuuacuccugccaaauacuaucaaggcauaguuugcauuauuauaaauuaagcaguaaacacaaaugcugugcuuuaguuucuugucuauccaaggaaauguauagaagagguuuuggggggacuuaggguuucagaggguuagccuucaccaccauaauggccagaaguaugguaauaggcaggcaggcaugacacugaagcaguaguuacucagucauaggcauuuuagguagucaugaucuucuucucccuuguugcuagugcuccaccuaguaugucuuuuuauggagacucuuuggaccauugcuaaauagccaaaacagacauguaagugucuccuggucuccucuuagccuuuucugaaauauguguaguagugggcauuaaguugucuguuguucaggugccuuuuuuuuauccccucuuccacuugcgcaaaucucgguugaguuuguacuacaguaucggagcuuaugggcauccugcucgccuuuuccuuagcuuguuaaccucacuguauuuugacagcacacugcacagucuucuuauuucucugccucuucuuucuuaguuucuuuuucucauacuucuucugugguuugccccugaaacauguuucccaaagccugcucgagcugauaauguccccauggggucaucucaaacacaucagccuugccaacuucccaauucauggggcagauccugugcgauuuccaaacagcucgcacaugcccagcuggugucucuugacugugaucugucuucaucaugaucuacagcucacaccuacugcucguccuccuucccucuugcucagcucuggcccauguguuggcucucccugcaauuuagcuuucauuguggccccguuucucuucagcagccacucccacaguucaguccugccuguccuguuccccugaugucagcuccuucccugguugugaccagauagguuccuccuucaccucuuccacuccaacaucuauggcauugcccaagcuaggcuuugaaaugggaagaccaaauggaagggaggacuucagaauuauuuagcuagucuauucucugucucuuuucuacuucuuuucuugccacccaucccauuuuagucuuagcugccaccaccuggagcauuugcaugguccacucgccugcaccacacucucccaggccuccugcccgccugccugugucucuucucuguguggaauguguuuucuagcaauuuaucaaagcauuggcuuuccucuugagcauagugaagaacacuucugcuuuauuacauguuuguucaccugcaguucucuuuucagagagaaugucacuuaaaugugaagucuguguauuuccuaaaggagaaaaaaauaguuugccucucuucugcuuucauuuaaagcuaccaagugcaacuguuuuuuauuuuaaaggggggagagguguuuuuauucaaaacaauuugaauuauaacugaaggaauaugucaaaggaaagaauauauauaugcauauauuucauauauauaaauauauauuucauaugugugugugaaaaugccauaaauuauaugcuuauuuuuuuaucuguuuuucugcauaagucuggaucagagugaaguaucacauaaaagaucagaaaaccauaauggacaagaagaagcucauagcauucugguuggaacgauaugccaagagagaaaacgggaaaccuaucacagugauguuugacauguccgaaacuggacucaauagcauaguaagcauucugcauuaauucugagucauucuuuguucccauucccuccauccuugcugucuuuuugccaaccaaauauuguaaaaugaagcuagcagaaugcaaaaggauucauuucccccuugcauugccugugaaguuagacauggacuaggguuugcagagaaugacauuugcuucuguauuuggcaauauucccugucuaguguauaacauggagagguaagacuugaaggauggcaagguacauggcacugugauggaugcugaacuuuauuuuuugccauguuaaaguccccccacaccaaccuccaugacuggcacagaguaacacacucacuaaauaucgaagaagcacaugcaugaucgcuaugaccuuguauuuuuaccuuguuuugaaguugcaugugaguuuacccagugucacgcucuguguauucuucuuggauuuuuaaaaauuuguuuacuuuauuugguaagguugagaaaccagcuuucuucagaugacuuuuggcagcuugaaaacagaguuuaauuaggaguugcaguaucaauacuuuuuuacauacacacggauagccccagcaccucauggagcugaggccuaaacaucauuugaacuuaggaguucagggauagcccaggcagcagagugagaaugucugaaaaaauaauggaggauuagaaaaagucucaauauccaacaggacaaaaugguaaauuauauuauaccuaauugguagccauauauguuggugucugugaagaauguguaauaauauuggagaauacauuuuuaagaggaaaagaacugcguuacgauaguauauugcuguguaacccaaaauggugaugucuuagauuuaaacagcaaaacgaguuagagagaacaauucaaacgagcuuuaggggagggagauggaagcauguuuuuucacauuaagaaucuaauacccaucgcuacucggccuuuuggcuaagaucaagugaagaaucuaauacccuguauuuuuuaaauguaguugccguugaguggauuuugaguuauaaaguaaaauguuuuauaucauaaauuaaacucaaauuauuuaaauaagacuauacucaauaaaguuagacuaugauucuauuguccuuuaggcgccacagucaccuauuuauuaccuugcgacuacaaauaauguaugcuaaugauuucugaucccuaauauagggagagggaauugacaagcgcuaucugaugaguuuucaacagacucacauguugucauuucuaauuuguaaagaaagucuauugguucuauuggauaccucauucuuuaucaauguuauaaagcaccugagucuuuauuggauaauuugguuuauuauauaacacucaugauucgcaaagucaguuuauaaagaugcauauagcugaaagggguuugcagccccacaggaggaacaacaauaugaacuaaccaguacccauuugauuggacuaaaccaccaaucaaagaaaacaaauggugggacucaugucucuagcugcauauguagcagaggauggccuaguuggucaucaaugagaggagaggcccuugguccugugaagguucuaugccccaguauaggggaacaccagggccaggaagcgggaguggguggguuggggagccaggggaggggagggggguuuuggagggggaaacaggaacagggauagcauuuaaacugcaaaugaagaaaauaucuaauaaaaaauuuuaaaaaagaaaaaaaugaugcacauaugggacauaaaaugcuuuaguaagaauuggacuaccauguugccuguaaccuuuuggcuuccuagcuaaaaagaauggaaucauuuaauauucuacaaauagcugaauuuuaauaauuuaggaaaaugcauucucagcaguugaacuagaaagaaaaaccuuguauuugucaucaagaggaugaacacuguaaaugacacagauaccauucugaaagcauccuuagagauuguacaauggucuauuucauggagguguguuguguaauacccaguguagacauacaccacugacuugaaaucccccaaaaugaccuuuuaugaacaaggacagccuacugaauaaaugaugguaaugacuacuagauaaagacuaguaauagcugagaguagucacagauuaaauuagguaaccaguauuuuauacagcaaguuuuuaaguccuuuuaucugacuuuuaauuaacuguagauuuuuuaaacuaugccuacugcauauaaagacuauuuauaaagguauuacuauauacuaggacuucucacagaauaaauaguuauaguuaaggaugcuugauuucaguuuacugcaauuaaaggcacugcaacucauaugcuaggaaagacuuuauagccucuccugucuagaauuaccagccuuucaauagcugugcuggauugcagcuugucuacuuagcacuucaaacuagaaguguuuauaaggcugcugaacaggaugaauggauuaauauaggggauggaacaugacuaauaucccugauggccucauuuccuguuguuguguaugaagcaagaaaacuaacgaggcagcuguuuaauacagucuccuaaaaauuggaaugaauaaacagcucuugaucauaaacuaaaaaacaacaacaacaaacuaaugcagggcaucuuaaauaagaaguaaauuggcaggucagaucaaugggauccuuguauagagaaauaauacagcauauuuuauugaaauuuguauaagguaaaaauuagauuuaggaaguaaauacuauaccauaauggguguguuugugugugugcauauauauuauuuaaguuaguuauguuguaaacuguauauccuuuucaauaguucuuuaauuguucaauagaaauuuuagagucucucuguggggauugcuuuuauauccauugcaugccccauggcuuuuauagcuugaagcauaugacuaauuugaaguaauccaaauaaauuuuaaaauacccaugaguauaugacuucuucaacucaauuuuagggccaauucuuagcuuaauaaccuaaaaccauaacccuuagggcuauagauacuuauauuagcuuauuuuuuaagaaaaauaguugucucaguuacauuuaauaauuuaucacuguucaaaauguauaauuuaauguugucugauacggacagucuuaaaauuuaaauauuuauuuuaggacauggacuuuguacgauuuaucaucaacugcuuuaagguguauuaccccaaauaccucuguaaguaacuuaauccuuuauaaaaauauaauauauugagauuguagaugguauccaaaaaugguaguuuuauguuauagacucuccucccugaaacacuggguuccuaugaaguacuuuaaguguauuccuagguagacacguaacaccuuaucucaguagaugcauacuuuucugaagucguuuuccuucaggguuguuguuaugagugaagugcuagacuccaaaagagccugcaacacugcucacccagcugucugcaauuauauauauauguauuugcaacaugagcccauguggccugaucuuugucuaaaauuauauuucucauacggaacuugcugcaugcaagagcagauaagcgguacuaauaaaguucauuguaaggcaaauaaugcacaguguguuacuacuugcugcuuuagaacuagcaguaagagaauacuaaaccagaauguacuacauucaacucugguaucuagaggguuucucguuguucuguuuucuuauggugcuggggauugaacacggggccuuuguccuugccaggcaaguguugguucuaccacugaacuaacauccacagcauuguuugguuuguuuuuaauuuuaacucucccuuuaaugaugggaguucaaauuauggacucuuucuaagccuuagaagcucauuuuucauuuguuggauuuauguaauagauuacccauugggaaaguaagugaccaacccaugcaaacagucgauuuuauuucgccccagugugauacaagccaaaaaggcagaagaggcaaagggcuaucaaaaauggaaauucacagagcugccugcaugcauuccuggcagauaccacaguuauggucucuuggggagcaaaagcauaauggaagucuagagucaacgccacuugcagccuuauauugaaaacccuucggaggcuauuguugaauguuuauagauaaagaaaaugacaguauucagguugggaaacuugaauauucuacaauuccuuauauaucuggcacaugcccugauucauuaaaucuugcuaagcggugcccaugaauggauacuaaagaaauacuacuucacgauaucaacuugcuucuuuuauggacaaaacaaaacugaaauauugaacaaucuaaaggauaagccauguagaaauaguacuaauaacaguauaauauuacuuuauaaaauacauucagccuucuaaaacaccuguuggcugaauauuuaaguuugugaugagccucugaggggaaaaaguguaauuauuuguuaucuauaaaauauguccaggauuauuuugaaagaacuguucauugauucacagauuuauauaaugguacauagaaauaucgcucaucuagcuaauugcaaaugaugucucuguccuaucgaaauugugugguuuugcagacauaagguuuuauagggucuuaaacuuacuguucaaaagcugucaugaacuccaacuauuagaccuuaguuauaucccugcuccaaagcagaaauacuaagcacugagcuaccucuuacugguaccaaguucuuuuuguauauuuuacuuugugcuaguuuuacauaauagucuaggggauucucauuuuggacaagagugaaauugcguauugauucaucugcaauagaagaaagaaucggcuaucacaaauccccuuugugguuucugauuucuuucucacauuugcuuauagggcuacuuaacauucucagcuccauauguaaauaacaguuguguauacuucagaauuuuuggcuuccuagaguucauuaacaauuaagaaaagaaacaauuucugugucucagagucaaagggaagggacagcaguaugacuagucaacgguguaaucucaaggaaauguauaagugaagccauacauuagacauggaaaucuuguuuuuaaagucuagcacaucauacccaugaccccuuaacuauuuucuuuuguaccuucguuaaacuagcaagugaacagagggauggauggguuguuugccaaagaccagggacagugcauuacugggacuccuccccauugugagucagugguucaguuccagccccacucacacauuccugaauuagacccuaagcagccagcuucauaguucucauaugcuaguccuuuucuaggucaggucaaacugauagacuauuguagagggacuaagucacaugaagugauuuuuuuuuuuuuuuuggucuuucagcaaaaauagugaucuuugauaugccuuggauaaugaauggugaguauguuauuauguuuuuugauuuucguuugucuuacuuggccaacucaacuaugugucuaaugccguuuaggaacauguucauauuauccuuguggacucuuaaaaggcuggagccaaaguucucagagguuguuuugugaagauacaggacugccugccauucucuccucagagcuugggaguucuucuucuuguuuuuucuaaaaucagcaggaagccauuccaacaccuggguaaaacaaugauaaggaaccccccagaggugaauuacaaaacaugcauuggcuagguuuucucuugguucaaguguugagggacaaagugggagaaaucugaaagucaccccagaucacugaagucacauggcccuuuuugacagccauaauuuugcuaagagucuuuugaaguggcuauugaaaaaaaaaaucccuagugauuugaaaggcaauucuuuucuucacauugauuuuguugguguuccauacagauaggacagagacuacuguuacauacacagccaacaacagggaaacucuguaaacugaaauuuggugcuuucaaaaguucuuuauuggcaagccuuuuaauacugguaaagacuaaccaaauaaaacacuuauauuauuaaaauauuagaucaaaaaaaaaaaaaagcccaggucacuacugacucauggaaauaaaaaaauaguuauagcaaugaacuucaaaaaugagaugaaauugauaaauuauuagaaagaccuagacugccaaagcugacucgaaucagaaguauuggccaaaaguaaauuaaucaaucaauuaauugauugauugauugauuuaaaaaaaguaaaaauaaaauuuuaaaucccacaaagaaacauucaggcccuggugaauuuucuggcaaauucuaugaaauaguuaaagaauuuacccugacccuuuguaaacaguucuaaaaauaggccccaaaggaaaacauuaacucauuuauaaguaaauacaauccugcuaccaaauauccgacaacaggaaaacuggagauggcaaccccuuccaacuacagaugcaccaaugcucugauguacaugcugaagguacagcacuggccuggccuguguggagcccugaguuccacacugcagaaggacaaaacuaucaaaccauagccaaagaaacauaaaaaguauuacagguggcagagugcuugagaacugaguuuaaucccuaagaaucuauacaaagaagccagucauaguagcaacacgcgcuuauaucccucagcucugagaagugaggguugggagaaggaauaagcagagcucuggagcucucugcccagccguucuaauguaaucaaugaucuuaggacagcgagacccugucccaaaaagacaagguagaaaacuauugagcugugacaacuaagguugucuucuggcuucuacauacaugcauauacauguaagcacaacacacacacacauacacacaccaccaccaccaccaccaccauacaccaaaaagcauuauaagccaugacaaaauaggacuugucuuagugaugcaaaguugguucaaaguaaaaaaaaaaaauucgguauaauauaucauauuaauaaaaugaagaguccaaacuacagaaucaucucaguagaguaaaacacacacacacacacacacacacacacacacacacacaugccaaaaaucuaauacccuuucaugauaaaacucuuuuaaaaguagcaacaguuaucagugaguacauauugugugaguuccuuugugauuguguuaccucacucaggaugaugcucuccagguccauccauuuggcuaggaauuucauaaauucauucuuuuuaauagcugaguaguacuccauuguguagauguaccacauuuucuguauccauuccucuguugaggggcaucuggguucuuuccaguuucuggcuauuauaaauaaggcugcuaugaacauaguggagcauguguccuucuuaccaguuggggcuucuucuggauauaugcccaggagagguauugcuggauccuccgguaguacuauguccaauuuucugaggaaccgccagacugauuuccagagugguugcacaagccugcaaucccaccaacaauggaggaguguuccucuuucuccacauccucgccagcaucugcugucaccugaauuuuugaucuuagccauucucacuggugugagguggaauggauacccacgauauaagauacaauuuccuaaacacaugaaacucaagaaaaaugaagacugaaguguggacacuaugccccuccuuagaagugggaacaaaacacccauggaaggaguuacagaaacaaaguauggagcugagaugaaaggauggaccauguagagacugccauauccagggauccaccccauaaucagcuuccaaaugcugacaccauugcauacacuagcaagauuuuacugaaaggacccagauguagcugucucuugugagacuaugccggggccuagcaaacacagaaguggaugcucacagucagcuaauggauggaucacagggcucccaauggaggagcuagagaaaguacccaaggagcuaaagggaucuucaacccuauagguggaacaacauuaugaacuaaccaguaccccugagcucuugacucuagcugcauauguaucaaaagauggccuagucggccaucacuggaaagagaggcccauuggacaagcagacuuugugugccccgguacaggggaacgccagggccaaagggggggaguggguggguaggggaguggggguggguggguaagggggacuuuugguauagcauuggaaauguaaaugagcuaaauaccuaauaaaaaaaaaugaaaaagaaaaaaaaaaaaaaaaaaaagaacucuaaaaaaaaaaaaaaguagcaacagaaaguacuguugaaacaagucgauuuuaaagggaucugaucaaucuauaggacugccaucaacaaauucaagaaguucccuaaauggcuuucaaauguuugaucacuagcuagagcucacugaaaacaacugugcucgucauuguuauuuauugcaaggaaaagauuuagaaagacguuccaaaugugaaacagaucacgcucacuaucgaugugaccagcacacagggaauauugccaaccaaggaaauacugaagugaaggcugcaugccuugguuaucagaaauugucuuggggcuucauuauguaggcaugagugauuuugccugagccuagucccaacuagugcuccauggccuacugcccuaccuuaaaucacacuugguucuucucucauagccaaguccuauucuaauccgaggucauguuguucccacuacaccaaggcucccaggccaacaaaaagagacaauccuaccaaacaggaaggcuuccucccagaagcugggagcaaaagccagaccucucuuuagguaaggguaauuuuuuuaacugcaucugccagagcucuuuggccugacaaagggcuuuuaugguaacccacagcuagaaacaguugugaauuauuucaauaaagcuggcaugaaaaaaaaaucagacuuaacacuucguuuaauuccaagaacauaacuucaauccugucaaggcacaggcuguuuuaaauuaaaagggaaaguuuaaauaguacuugaacaaaagccuaaaucauagggagccagaauaaagaaaaaaacaugauuuucuaaaccacacuuuaaggguucuauuauucugguuucugcuuucuugucuacugccacuuuugcauauuuacugccacauuauacuuuuagguuuuuuuuuucaaaauagguuaaaaugucccauuagaaauaauauuuuaauuaagucuaaaacuaauaacacgacauaggacagaauuguagcugucaaguagcuacauuugguagcaguuuauucuuguagccucuuucucgugguuauauaaacugcgcagccugggaaaaaggcagaguucugagucaggaaggaagcugguucuggcucacacccauaaugagcaggccccuuccuccuguuucugccuuucccuuugaggagggauuuuauauugaggguuuaucagaagagccacaccguaaaggacucuucacaacaucgugcaguuccuuccugagacacagagccauuuaguucauugucuaaaagucauaguuguugaggccacugauggauguggucacaggucaggacccugagaagcuuuucggugagcaucaggguaauuuaggcuuccuggaucuccguggagcagucgaagcguugugaggggcaugcauaccacaaagccugcuggauuuaaaggauagcaagaguccagccucagaaaaaaggcagaacagcuccaaguucuaacgcuuucagaagggcugggcuagugcauacaguaaagugcuugacaaagccaguguggugacuugcuuguuuuuccucagcugcuuucaaaauugugaaaagcuggcuuggccccgaagcaguaagcuuguugaaguuuacaaguaagaaugaaauccaggaguaugucaguguggaauaccugccuccccacaugggugggacaguaaguaccauccuugaaacuuguuaagguagaacaccgaacaaugcuaggcuucuauacuauguauucaaaaggaaaagggcaaaucuuuuuugucuguuuguuuguuuaauuuuuauucuucucccauacaauacaucucaaucacgauucaauuuccccuacccaaggagauguaggcccuaucuuaaugcaaaaagaaggauuagugauaccccuaaaauaagaugcagugguguggauauuuucauguuuuaaaguuuacuuuuugaauaggcuauguguacauaugauucuaaacugggggggggggaggugcauucaauauucaaaaguauauuuagaagcaguucuuuauaaaaugucuccuccucgugucucaagcacccuauugucuucugugguugcauuucuuagauuaauuucuagagaugugccuagcauguguagacagguguaggcaaagacacagaagccuuccuccuacucaucucuuuuuuauauaauaucauuuuuuauuaauuuauuuuuuacacuccauauuuuauccaccccacccccguccacccuuccacuguuucacaucccacaccuccucuccacccacccugucuccauguugauuucuucaccccccaccccaccugaccucuaaacucccuggggccuccggucucuugaggguuagguguaucaucucugaaugaacacagacuuggaaguccucugcuguauguguguugggggccucauaucagcugguguaugcugccuguuugguggcccaguguuugauaaaucuuggggaacaauuaauugagacugcugguccuccuacagggucgcccuucuccucagcuucuuucaaccuuaccuaauuucaacaacaggggucaacugcuuucuguccauugguugggugcaaauaucugcaucugacucuuucagauguuuauugggucuuugggagggcagucaugcuaggucccuauuugugagcucuccauagccucaguaauagugucaggccuugggaccuccccuugagcuggaucccacuuugagccuguggcuggaccuucuuuuccucaggcuccucuccauuuccagcccuguauuucuuucagacagaaacaauuaugggucagagaugugacugugggauggcaaccccaucccucacuugaugcccugucuuccugcuggaggugggcucuacaaguucccucucccuacugucaggcauuucaucuaaggucccucccuuugauuccugagagucucucaccucccaggucucugguauaugcuguaggguccccccaaccuccuauuuccuaagguuaccuguuuccauucuuucugcuggccuucaaggcuucaguccuuuucccuuacccaauaccagaucagguuccccucucccccgccucccuuucauuuucccacuuucccucccuacucaucucuuuuaaguagguaguguguugggacagcacuguaccucuccgguuucccuucacaaccucguuuaaagaucauucuaagucaguguauggcugcaguccuccaguuucaugaacuauaaguuacugaauuugauuuugaugugugcccuugguuuucuucccugccuuuccuacccagugguccuuuuaauguaaugcaaccuuaaaaacgugcugccaaaguuuagaaggguuguuugacuugcacucuaaggaucaaacccugagucagauucaugcuaggcaaaugguauugcccagcccucagaauuuuuuuuuugaacugaguuuuauuucuuaaaacauaggucagaaaugaguggguauguuuagaaauauuaauguugugacuaggugugguagugcacaccuguacccagcacucaagaggcaaaaauaagaucaaaaguucugggccagccgggacugcauggugauucuuuguuucaauuaaguuugguuuuuuuuuuuuuuuuuuuuuuuuuuugguuugguuugguuugguuguuguuguuuuagaauuuacauagcuguaaaaaugaaugcgaaagcgaauauucuuaaagugugaaaccucuguaaaugauuguaagcauauuuugccugccugacaaaauuggauuuaaagagaagcaaggauuaacaacauucgcuuuuggugucacuguuaguuuucauuaauuagaagagacuugaaccaauaaauuuaauuugaagucugaaccuuucuuauucggaaacuuuacacuuuguauuugaaccuaggaaaacuguaugcuacgucggauacuauauuacaccuguaguuaaagcaaaaccaugguugcaauuuuccccuuuuuuauauuuuauuuuugaggcacagucuguuguagcccaagauugccucaaacuuccaauucuucaaccucuaaaguacucagauuauaggcauauagcugucauacucaccucuccuguuaaacacaugaguuuuguuuauccacaugaguuuuguuuuuuaaaauguguguguguguguguguguguguaugugugugugugugugugugugugcacuuuuguacauauaugugcagguauccaugggggccaaaagacacuuuaaaaaauaccuucgagcuggagucaggagugcaauuuucugugagcugccuaauguuggugcagggaucugaacucuggucucugauaaagcaguagacacucuaccaccgaaccacaucucuauccuuuggcuuucuuuuugcuugauucuguguuguguauaaggcugugugcacauuuguaagugcauguguuuacauauggaggcuacagaucaacaguagaugucuuccucuauugcuuuccaccuuauuuuuugcaucuauaacuuacggauuagcuaaacugcaucuauaacuuacggauuagcuaaacuggcuggcauuugauccccuaggguccuccugucuguaccucccaguacuagaauuaaaagcaaguauaaccaaccacacauggcuuuucacaugggaucuaaguucagcucuucaugcuagcucaacaaucacuaugcccacugagccauauuuuuuaauauauauuuuguuuggguuuugggauuuuuuuaacuugguuaguugauuuggguuuguucuguuuuguggugcuaggaauugaagccaagaucucaaacaugcuagcgaauuacucuacccuugaaccacaucgagaaccaauuaucaauauuauugcacugccuguguucugugcuguguguggaugagucugcccuacuuagauauuuauucauuucauuccucuucugguuuuaugguuuaaaaaucgcacaagauauauacaguacacuucaugcguuuagucaucugaccuuuuuuguguggaguaagcuaaagaucuaacuugaguuguuucuuacauggcuuagucuuuauuuacugcucuuucccuuuucuaguuugaaaugaaucccauuuuuucuuuauaguuaugcuuauuuucuuggccaaaguaguccaguuuucaguauaccauaagagaauuauuucucuccacaguaagagcagacugauaacgaacguugucucauguaggauccauucaaguauagcuacccaccacugguagaugaugacuuccagacaccacuuugugaaaaugggccaauugccagugaggaugaaaccucaaguaaggaagauauagaaggugaugguaaggaaaccuuggaaacgauuucuaaugaggagccaccagcucugucugaaaagguaauuuuaggaaccaaguauaauggaaucaaaagcugccagcuaaagcuugggacauagcucguugguacaguacuugcccagcauauaugaugcccuagguucaguccccagcacaggggaaaguacugugcugucuuccaagcucugccaggggugagugcuugagccaauccaguuaccuugccucuacacuuuucuugaaaaaaaaugggaugaggggaacugaauuacagcaucauauauuuauaaagagcuaacucugugcuuuguacaaaacacggugaaguacaucuggaaggaaucuuugucaaaaauguauuuaagguuaaaaauaaaaaugauuaauuugaaauuucaccagauccaguucuucugaauuucauuuugaaggacuuguuaauugcuguucuucacaaaacuuagcaagagcuugcuugauaaguacauuauaauuuagagcagaaacuaccaucaagucuguccuguuuauaagggcaucguacaaguauuuccccauggucagucaugucaguauacauuaaacaugucauuuagacaugcuaaacauguuuuaaaaaaaccuuuguuuugcuuugaaucuagaugguuauuuguuuucccagugccuuguucaacuagaacuaaaacaucuucaucuuuucuaccuuguuucuguuucuuucuuucuuuuguuguuuuuuauguauagaguaacccaacugagucuguuuccaaaaaagaugaaaaugaaaaaguugauucaaagacgaaaacuuuuaaaaagccauugaguguuuuuaaaggacccuuauuacacaucagguaacaaagcuuguauuggcugccuucuuguaacaggucuugaucaucuuggccgaggaugggguacuagacgauuaagaagauuaagaaaacuucuacccuggcauuaagaguacaguacaauuugugcagaguacaaugugccuuguuuuccagacuuagugaccauuucuaucuuuuuuuauuauuauuauugauugcagugugugucucauagcccucgucacacuuuggauaggaguauugaauauugacuaaaucuuaaugaugcuuggaaaaauaaaaauaaggggaugaguuuguugaucugaccuucugaaagaccagcuugcucuugaagaaugaggcuuuaacuaaacccuaaaggaagacauguuucucucuguuccaauuuauuaauucagaggagucagauagggagcuagggauguagcucauaguuaggcugcuuuccugcauuaugugaagcccugaauuugaucccuaacacugaaaaguaaaagaagcccagagcuauuuccuguauuauucuggucaguauugcuauagcaacacuagucagugaugaccuaaugugaccuuuuggucccuuuccuuuaaacuuuucauauguaacuauguuucgaguauaucaucccucaacaauucagccagacugcuacagaauuuaaucucaaagucucuaauugacgaaacuguuucuucuacauauggguugaguacuauuggagugggauguauagccauugucuguguagauaucugaguaaggagagacacauaacauaaauuuugucucccauguuguuucuuugccauuuuccuccuuuggaguuuguauguuugcacuuuuuugucugcuacuuuggaagucaguguuccaugcuucuccguagacccauccgaagcauaaauccucaccugcaacucuugaggguuaauggugacagaagccaguaaggcagguuagaauaggacaacuuccaggauugcacuguaaacaugacucuaauaccugugcccugaucagagucacagaacgucuccuucacaugcacaagguccucaccagugucaucuccccaugcugccugugauauuucuacuguuuacugggagguacucugacaucuauaacauugcugugccuucaugucuccuguucuuugagcuccaaaaaggacugagcaguucuacacuuuuaaugucuugcccaaaggugggcaaggucauccuuaaacaugaauauccuugauguguaugacaugucuaauguaacauaacagacagaaacauaccugcagcuaggacuaccaaugcaagguuucaauuccagcagucuuaggaggcaagaggcucacacuugaaggcuagucuaggcuaccuagagagucugaaaaccuuccuguuggaagugugugugugugugugucccaccacuuaaagcaaaaucacuagcccagauguccuucugguuguuuugaggcacuugaucuguccggcuaaugcuauuaaacuacacaacaauuuuuccagagaguugagucuuuucauuuuagguuguagaucuuccaguagccacuaauggcaaacuuggaagcuugagucuuuaauaguuuuacuaguuuaacugcccucuggaacuacucuaaauuucuuuccaugucuauuuuuuucuucuccauucucagaaaagccauucuauaguaagaaauuauucuguuacuuaaauguaucccuaauaaucuuucucugagcuuauguucuucucuguuuguauaaaaaggaugcucguggcuaaucuguuuguaauuagggaacacugaagcagcagugccuucuguguuuuugauaauaaucuauaaccucccaaggaguuuaaacugagccaccuuagauuguguugauuguaggauuaauucagcagcuucguaauucucuucuuucccuuuucuauuuuucuucugaccuuagggaaaaccauagggcuucccagcaugcauagcaucaggaaguuuaauauauaaaaugguauuagguaacuguuuuggccaccaucuuuuguaaggaagucucuugagcauaaacuaccggccaaacauguuuuuagacucaugaauccagugcuguuuagucugaguacugcaaaugccuucuuuguuuuccuccuagcccagcagaggaauuauauuuuggaagcauugaaucuggagagaagaaaacucugauaguguugacaaaugucacaaaaaauauuguggccuuuaagguaaaaaagaaaaucuuaaagucauaauaaaugacgagggugggucaauggcagaugauuuggggcauuccuaaaggagacaguuauaguuaaacaauguguuguguguccugucccccacccccauccuguacucccuccuaguagaagggcugauaagugagcuuagucuccuacacuucguauuuggugacacauuaguauucaguagaaacuacacucccagcuauaucacgugugagggaaaaggcacauuugauucgauuguuuuguccuucaggguugugguaaauuagauguuuuaucuaauaaagauuggccucuggccugcacacacaugugcaucauacaacaagaggaaaacuagggacaaguguaauauagugcauguccuuaaucccaguccauaagaggcagaggcaggugugucaguaugaguuggaggccagccuagucuacauagccagcuugggaccagcaauggcuacaaagaccugucucaaaaagguggggaaaagccaagugcugauagagcuuaaaaguaguuacuuuuaucuuuuuggugauuuguuuauucgcugcucuucuuuuugaaagccguucuuaagccuugcccccaaaacagcaugugauuaggggguaacuauguuucuaaauaggugagaaccacagcuccagaaaaauacagggucaagccuagcaacagcagcugcgaucccggagcuuccauugauaucaucguuucuccacacggaggugagcuguugucucucucucucucucucucucucucucccugucucucucugucucugucucucugucucucucccugucucucucucucuuucucucucucucucucucucucuuccucucucucucucucucucucucucucucccugucucucucucucucugucucugucucucucccugucucucucucucuuucucucucucucucuuccucucucucucucucucucucucucucucucucucucuuucucucucucucauauguucagaaguaguugaccaccaaauaauggacuccagaggauuuuugagugcuuuuauuugguuacaguuugggggugggggugggguguuuguuuucugaguggugguuuauuuuguuuucuugguugcggggaguguuguuauauugggguuuuguuugauuuuugagaaaaaacuuaaaguuuggcaggguagggaugggagaggaucuggaaggacuugggggaggggaagaguauggucaaaauguuucaacuuaaacuguuuuucuauaauaaacuauauuuuaaauaguaauaacgcuuuaagccacaaauccagccccccacccccaccccaguggcaguucgaguucauaggucaaauuacucuuuugaaaugcagguuuaaccgucucagcucaagaccgguuccugaucauggcugccgaaauggagcagucaucuggcacugggccugcagaacugagucaguucuggaaagagguuccaagaaacaaggugauggagcacagguaagugugucugcuagcagccucuccgcugugauggaagacccagagucagaccugccucacagggggacggaggccgacacugcccauuccuugcaacgguuagauuccugggcuaccucgauuaaagaagggagcugcuccaggccugaccagugggcaggugcauaucucagaccuucaagccccccuugucagaaagcucaccugcuucagagacauaccggcacuauugucuguaucaggggaaagacaaagcaaaggggacacuggcaaauccuagugaguucuauuggaacugucccaugccacaguggcccuggagccacuccaagaaucgagucacucuguucccacgggaagagacagcauagauaacaguuacaaaagcugcucagagaaacaguauccuauuuaaaaggaggugggugcacaguucuuuuuugggggcggggggguguucgagacaggguuucucuguguagcccuggcuguccuggaacucacuuuguagaccaggcuggccucgaacucagaaaucugccugccucugccucccgggugcugggauuaaaggcgugugccaccacacccggcucugggugcacaguucuagccuugcgggccccuguaugucagcccugaggaguggcuuuaaauggaccagggaagguaaaggccacaagggaggacuucuuccuaguuuggcuuacuuucacacccuuuaaaaaaugggauaacuauuucuuggagugacaucgguuuuguccccccuccuccccgcccaaggacauuugccaguauccagaaccaucuuuuguuuuucacaacucagcaguuggggcgggggugggggcagugggcaucuagcaaaugccccuccaccuccuacagugcauuugaugaacaccacucccucaaaauuaugacagcccccucuuacacgcguucacgcgacgcgaccggccaggaagaacgcaacaaaccggaaucuucugcggcaaagcuuuauugcuuacaucuucaggagccagagagcaagagagcaagagcucuauugcuuacaucuuuaggagccagagagcaagagagcaagagcucuauugcuuacaucuuuaggagccagagcgcaagagcgcaagagugcaagagagcaagagccagagcaagagcucuauugcuuacaucuuuaggagccagagcacaagagcgcaagagugcaagagcaaaagcaagagccagagcaagagcucuaucgcuuacaucuuuaggagccagagcgcaaaagagcaagagugcaagagagagaauggcgaaaccccguccccuuuaaggagaauuauccuccgccuaggacgugucacucccugauuggcugcagcccaucggccaaguugucgucacggggaaggcagagcacauguaguggaaaacuacccuuggcacaugcgcagauuauuuguuuaccacuuagaacacaggaugucagcgccaucuuguaacggcgaaugugagggcggcuccccacagcccccccccaaaaaaaaacuaguagcacuaagguagaaacccugguuuauaaaguaguuaaggauaaucucucugcuggccaugacuaggaccugagggaaaugaaagaggaagucacauggugacugugacugcacaaagagcuuucugguagcaagcaaagcaaguugcaagaaaaaaaagaaauguacuuggcuuacgcaaaaagcagcaaggaacugcuccauuuuccuuaacugggugggguggccaagagacagcugggagagcgagugcuggcucauugcuuaggaggaauucucucaggagggccugaccuggaggagcauucugugaucaaaggacugcucuugucagggaggaaaaugugucucggagcagaagugaaccaugauauuaagcacugccauucagaaaaagaaagaguauuggugcugcccacuugaugguuacaucacugacgguuuugaugauuuuuuuuuuuuugagacaggguuucucuguauagcucuggcuauccuggaacucacuucguagaccaggcuggccucaaacucagaaaucugccugccucugccucccgagugcugggauuaaaggcgugcgccacuacaguuuugaugaucuuaaagagcucuuucaggaggcaggaaucacagaagccagagcccaugcugaagagacagauggagaccucugggcuaaacuagaggugccacagauugcagggcaacuguggagcugaugaaggaggcuuggcuucuguuuguuacaggguuuuggcuuuuguuguuguuauugguuuuuucuuguuuguuugggguauugguuuucuuaauguuuuguauuguaauguuggcauuuuggggguauguguuuuaugauccaugaucucauuauguagccaagguuagccucaaacgugugacaauucucguggcucagucuucugagcacuuuaccucacaagugcucucccauaugucuagccuaucuugggguuuugagagugagaaguccgagcacuguucauuuaaacaggcuggggagauaggucaguacuagagugcucgucucacaugugcagggucuuagguuccauccccuguacuggcaaauagacaaaaaaaaaaaaugaggcacauggcaacagagaccuaugacugcaaaccacagucauaggagguugcagcaggauggucaagacagaggacuacaugagcuaaauauggaaaccacgcuucaaagaagaaaaaaguuaacagaaaaguauuucuagcaucacuggaaaacguuuaugcaggucgggcucugaggagaaguaauaacaugcauaaaauuucaaauuauaggcacaaaaaugcaucuggucaugccuuuguuuguuuugguuuaguuuagucugcuguguucaugaaacagggcuucgauauguacuccaauggugacugagccucaagaccuuuuuugguuugacugaaaagcaugagaaauuguggaaauauuaagaaugaguuacauaauaagaauuaugaaacacucagaaugagggguuuuguuaaauagaaguugccuuccuuuuucuguugcuuuggguuuuaccaguuccuaauggcugccuucuguggagcuaucaagagaaaaucacuguucccaccuagaaggugggagggauccuggugguuugguacuaaaagcucaaguaaagcacuauccguccaugcuagaaauuggaagguaaucuggguaaauucuacugaacaacuuagaaaaggcuuucuguugaauccccuggggugguaggcaguaugcacagccucuuguucuuuauacacagaagguagcuaaaaggggacugagggcuaagcacagugguuuauaaacaggcacaaagccuggccuuugauucuucaguggagaaaaaagacccuggaaaaaaauaaaauauagacugagcugcuuucugaguugagccuagggagaggaguugaaccuuucgucucccaauacacaaccacuugcauuuaacucugcauuuccuaguuugcuuucagaaauuauauauauauguauauauauauauguguguguguguguguguguguguguguacacuaaagcuuugaagaaguuauguuuccuuugaauuucauaggcuaagaugucacaccguugagagcagcaaaccgaacagucucaugcugaaggacagcauuuccaccaugucagauaaaaccagugaagaucuguaccugcaaguaagugccuuuucucccuccuugaacaauugccagugcugaucaguaccacagggccaucugugcuccacuagccuaaugggaacuuuuagcagagauacuaccaauguuucaggauugcucuuuguccaacucuuucuuccucuuuuaguuuugguuuaguuuccuuuguggggcuuagaguuuguuuguugggguuucuguuuuuguuuuguauugguuugggggggggcuguuguuuuuuauuuguuuuuguuuuuuuggggggggaggagcuugcuuuuugagacuaagacucaccuugaauccacgauggcuuagaacuccuuguauuccuucuguaucagccuuccaagugcuagaguuacagcuauaagccaccacaccuggcuuggaagugcccucuucuuuaugaggaggccaaucagaaaugguaagugccagguugccaucugaaggucucugcguguuuaaagccuggcaauuuuacuauggaaucagagccaaaucguaaagcacacagugcuuuggugaguacaacagacaccucuuguauaaaaagcaccaucuaaugccuuucaacgugaaggaaacaaagaggcuucuugcauagaacucaguggugaaauguuuacuuggcacacagugccugggugugaugcccaaaagaaaagaguauccaaagagagaaauaucucaaaggugccuggaccuccaggaagugaacacucucuucccgucucaacuacaaaauuggaccuuuuagaauagagcaucagggacauacaucuccaccaaacauaauggaugccucccuggcauuucuaguucccaaccuuucagaguagaugggccccaucccuucaguguuuagaguucugauauuccaguuuggcauucucauguuguuuuauugauaucaaucucucauccuuuuuccccccauucagcucaaucguuuacuagaaagcaauaggaaacuggaagaccaacuacagcgcucuaucugguuccaacagcuacugcuugccuuaacaauggucuugcuugcuuuuguuguuucuuucuuuuauucauuauacaauuaaaaguggcaccuggucaaaaccauaaaacuccuucaggcauuaucuggagaagguauacagaucccacccaaaccuuuccacacaucugggcuuccuacaaggaaauaaagcagcacauggaagggugccuaucuuggaaaugaguuguuuggcuagagagacguuugaggcauugauuauuagagacuauagcuaguuaggaaacuaaguaaacguaugugcauuguacaaauuaauagcauaaacguaauuuauuuuucuuuuugauuugaacgcuuucaaagcaaauuuuuaucauguaaauacacuagcugaacugaaaagacuaauaugcuuuguuguagccaaaaaaaaaauguagucugcuuuuuuaaaaauuacagaauuacuagccaagcugacuuauuaguuuuucuauacuauguauguaaaauauguauauuaaaaaaggaagcauacuuaaauaauuuaugugaucaugacuuuguaacuuggagaacuacuuccagaugauagucgauaugcuuuuggaauguaaagcuauuuaaugccaaaccuccuuagccuuuguuucucagugucacugagcagccugccucuuauuaaauccgggcucuuuaaugaauacucuguuuucgauacaauaugaaaagcuacaugugguuggguuuucuuugauuucucuuauuagugcccagaaggaacgucucugaaagagccccccuuucuagucaauucuaugcaguuucccuauguuuggacacugaacuuuuugccuggguuuauuauaaggcccuacuuuuccauugugccaucuucaucuucauuccagggcaaaggaaucuccucuguggaccacaaaugaugccaccuucacccucgcuuuuaaaugaaaggcauuauuauauaacauuguuugaaagucuaguuguccauuacuauaaauaaccguggguuccaaaugguucuugugaaaauuguugaugagaaggaaacuuuaaaaguauucaugugugcaaauauaaaagcaaagcagaaaggcuuagagaaugggaagaauuaucacuucccguggcuucucuggcccacugacugcucugccuuccguauacuuagacucauucauauggcuccuaaauuccuauagagauacaccuugcagaagcagaggcuaaugaaauagcuuuguguaaucauuaacaugaccaguuucugucacuuucgauucaaauccauaucugccuuuuuaaggaagaaaguccucugccuagcaaaugaauauuccgccauguuuggagaguuguucuucucaggaguagaguugggggcucucaucuugaagccguugauucccagaccgaguuuggaggagugauguaauggagcuccuuaagaagucggccgaggaaagaaaaccuuaaagggacacuagugugaugcuuugucuuaauguggguuuuucuguuucaguuugccaccuccagaugugaaacagacugcaguccacacuaaguacuaugucccuguauguucacagugacuucccaagugguagaguugggggccuuaauauaaugucaucccaaaguaucugucuaugcuuuucauuccucaucagauaaacaggcaauuaauuagccaagaugaggaauauaauuguccuaacagugucccuuuaauguuucauaaggaaaucauguugauacacuaaacacccuucuuugcuuguugucuggucaguugaauuuaguaacaucuuguuagcauuucuguguggugaaugugacuaaaaaggacuuugggaaauuaacauaaugucaacaguaacuggacucuucugcuaaucuugauuaaucuauagaguuacauuugauuuuguccugucuuuauuugguuuaaucuaaucauaugugcaugauuauuuuuaguauucugaucaauaauuuucucuuuaaucaugucauugcuuuuucaugaucaaauuaccagagauuuucauuuugauuuuuauuuucacucgggaauggaaauuaauacauuuuccaugaaaacauuaauaaaagaucauuagcuugaucugcaaguagccuaaaauacaaaugcugguuaaccuagucucaaauuucauaaaaccauaacuuuuauaucuugccacuaauuuugacuggauuuaauagcacuuuauuguacaauuauaaaaaauauauuccuggaauuguugccaguguaauuucucuaacguucuggugcuuuucauauauuuucaguauuuuuauuacuauauugguauuuucuuuguauaaauugaucaaaagaacauguuuucuauuuuaauauguuuuagaaaauaauuacauuuaugaaauaaauaucaucaggaaaaaaau

SEQ ID NO: 9826 - RNA, 16683 nt, Mus musculus
aggcuccgccccucccagguccccucuggcuaccaccuccugcaggcuuugccgccugaguuguucaggcaacuauugggccgguugucccagcgugcaaugcgcgggcgggagguuuggaguccuuuggugcaacuggaacguggcaauuuggcagccuuggagaacugguuuugguuugguuugguuuucuccugaccgcucgcagauaacuugcauugugaguauucgcuauauucggcgauuauuucuguuaagguucuuuucuuuuggcuguggugucuggcuuuauagugcuggcaacuuggucuguagccuagguuggccucccuucucagacaugaguuuucugugucagucucucugauccugguuacagguauaaccaccacaguuguggacugggagacgcucacaaggcaaccgucuuugaacucugaguuaagugguuauagaaaguuaaaaggaaagauguuauuuugaguuacuuguucuuaacgagguggggguagacucuuguuccugccauguaagugacauuugugggugucaccgcucuagaaugggaguguagcugauuucuaauggggagaagccaacgaugcugccaagcuugcaggacaggucgcaauacuuauccagggugaaaugcaaacauugccgagacuggugaaagcuuagauuuauaaaguacuacaacaaacuauuagcuuugguggcuuaguugaacauaacaaugcugccuuucuuaaaaacugaccaacacugaagacuacuuguacuggcaauuagagaaaacguuuucccaggcacuggggaugucgaucacagguccagcacaugcuggagaccucaaguuccagccucagcagcccugccccucugccaaaaaggacaacccacguuuuaccuagucuguagcugguugaccuuaaaaaggcaguuaacaucuuuucccaaagcguuuucaauauuuguuuuuaugggaaaauuugaacacauuguuuaaaguuuguuugaaaacuuucauaaaaauauuugaguaacuccgagcuccccuagacucccacuucccuacuuugauacccauauucuuuacuaaaagucaaccaucaugguaaggauuacauuccuuuuaacuguagugugauauuccaucuguuuauuuucuuaaugguaaucauucaaguucuuaauuuuuauguugcaaauaggagugcaguauauauuucccgguuguaguauuguuucauauggggucagguuggaaaugcaguugccaaagaaacacaguucaguucauugcuggguuaaaaucuguagucaucuguuucauaaauuacuuguucauuauacccauguguguguguggggggugcucgagugugugugugcgugcucucgcgggcgugguacacagaugaaugucacaggauaguuuucuggaguuguucuuaccuucuacucugcugaggcagucuuucuaguuucugcugcugcuuugcauauugcagcuuuauaauuccugugggcuuucaggagggucucccaucucaagaaaggaaugcacugauugcagggcacaucacuguaucaggguuguuuucuuuuuucguuuguuuguuuguuuguuuguuuguuuuuuucccuagugaacucugcuccucccacuuguucaggcauucacagcuaagcacuuuuccccaguucucugacagaagguacuuuaaagagaacaucuaagaucuauuagcuagcuugugauaaauaaguuucuaacaacauuuguuuuguucuguaucuguucucuucagucucucucucucucucuuuuuuuuuucuuuaggauuaaaggccucaacuggaauccauuugcaguuggaacuggaucaacacagagacuugaugcauuagaguggccggcaaacaagcaaugccauuuaaugagcaagcaaaguucuugugcuaucauggggaaauccuugucuuucaguuguccagaggagagcgugcagauuuagaaaugccuacagauccacuggucuuaggugucaaaaggaugauguuugacagagaaacuaguacauuccuucugauauccacuguuuuuuuaaacaucaacgaaaaagauucucauuuaaaaauucuguguuguaacuguguguccgauuugagaacuagaauuaaccuuccuugcguuuugauacaauguagaaaguacaauagugaagcuuucaaauauuguauccugcuucuucacaaucucaacagaguggagagacuuuugaguuuugaacuaaaccaugcauuggaugagaacacaaagaucuuugacggcccuauaguuuucuggcaguaucucaaccaguucuucuauaucucuucugcaauugggaaaguuacuacuauaucacuuaugcuuuccucuauugaguggaucggugagauugaaaacuuuggccuagguuucuuggggcuagcagaaccaucugaggauaaauguacccagaagcuuucagaaucagacuaugaauuuuccaauuccagccuuugcgcauaugcucuuaaaagucaagaaauguuaagcaaugguuaccugaucccucuugcuuacaguacuaugguaacacacgugcaugucugggcggcggagaugguugaccaccaguuaagaacaucucugauugcccugacucgaaagaaucagcucauuuuguuucaaaauggcauuccuguaagagcaugucagcuuccauuuccagguccccguucaguucagauucuagaugcagggaaaagaaaccgauuuuucaucgugucauucccguccaaggcuugugcuguuucagaaaagaaauuuaagguacggggcuuaauaucacucuucuaguaguucuguuuguaaucuugggcuuuucuuauauuuugcuucauuuugguuuuguuuuguuugaaacaacuggaucuguaaauuuuccaguccgcauucuuggccuccugagucuuagguuuacagcuuugugcuaccaucaugcucaaugguuucuagacuuucuaagcauuuccauuuuguuagucaguuuuuaaucauuagucuuuguagaugauucuucuuuuuauguuuuucauuguuuuucaauguguaggaguacauuguagcugucuuuagacacacuagaagaggguaucagaucccauuaucgaagguugugagccaccauguggaauugaacucaggaccucuggaaaagcagucagugcucuuaaccacugagccaucucuccagcccauuuuguuuuguuuuguuugguuuguuuuuuuucuuaaaguuguguguacucuaccugaugugguuuggggccuugguguuggaagucauaaugacuuugaguuuggaugcauaaauguauaacuuuaauuauauuuauuugucuuuuuauuauaacuauaauuuuuauuaguauaaccauauuggaaugccuaaguuagaggaaguacacuaauuguauuugaacuauuauacuuagcaguuaaagcaaaacaauacauaugguggaauuaaaaauggaauggaacauuugcuaauauugaacucugagccuauacuauuuauggccaugugugagagguuuuugauuaauagaaugaauauuuuauuaaauuauaaaauuauccuuuuaauagcaguuuuguccccauauagacuuuuuccugguguuauccaugaaucuguucagucuacauuauuccaggaaggaauugaguagcuuacaaaaauacaaaugagcauuaacucaagugaauaaugaaaaucuaagucauuaaauauugcauuugcucccagacaagcccuucauaaaagcuccagggauauuuaauucagugcuagggcuacauuuucucuuaggcuuucucucaaguggaaacugucccugcaaguuuugacaagaaucuguuuagugaacauuucaaauuugagcccauugucagguaugcacagauauuuguauuuucaauagaagauucauacguuuuguaguuguacugucuaauauagccacuagcccuauggaguuauugaguauuugagaugugagugcucagaauuaaaacguauuaauaauaugaaaucaaucugagauuucagacuuaguaaagggcuggguauggugccacaucucaacaguggggaaaccaaggcugaacuaauacaauccugucuuugaaaaaaaggauguaguaaaaaugcaggaaaauauugugauuccuaauugauuacauugacuugaaaugguaaugguguggcuauaccagguuaaauaaccagccuuccauaucuagguguucuacauacauugauucugccaacugccgauuuaaaacauuugacacaaacggggguuuuauugaauauauauaaacucuuuccuugucccuauucccuaucuaguacaguauaaccacuguaauguugaauuuucauuguauuugacaucuuaaauaaucucgauguuuuauaguauguggcagaauguggguauuauuauuacuauuguuauugauuuuuugaggcagagguucucuguguagcccuggcuauccuggaauacacuuuguagacuaagauggucuugaacucugguauccaucugccucugucucccgagugcuggaacuuaagccaugcaccaccaugcuugggcugauuauauacaaauucuauaccaauaaaaauccacagauuuuuuuuuuaaucuagagaggguuuaggagugaaucuuccacuuacacugaaaggugacaauauuaaaauuaucuuuaccuuuuuacugaaaguuuaaaauuauauauguacuucccauuuuugguucaguucuacuuguauuaaauagcagugcuugaaagagucacugcaaauaugcuugcacauucauggauaaguucuuugauguuuaaaugcccuaggaacccuaggaaaguuaggaucuacagccauaaaaucuccccagcaugacugccuacacaugagcugaacacaugaaacggauuuugauugucagugucuucuuucuguagugcaaugggaaggcauguggguuuucagauaugccaccucccuauacaagugaagaaucacagcuuuagaaaguaauacuggaggaucaggguugguguuuuauuauggagauugaagugcccuguuuacauucuucugaggcauaagccaccuacccaugucaucuagguaacaggucuaucuauguuccuuggauucuaagugggaaguugagcuauuaugccuaagggaggugaucugauacuuguguuaaaagccuuuagcucuauggaccuuuaagaaaucuauuuuaaacuccucgucugcuauucuauuuuaaauguaacagaucauucuauuuagguagaaugcuucuagguguccugcuguuuaucccugauaauaacagugccucuuccaccaccacugggguaaagcuguuaaguucaucaccuuucaauuaucagggauacugacuuccucaggaaauugguuugauuguaaacagcauaucaacggaggcuuaugggaaauaggucguccuuaaauuaaccaugcuguagaaaagacucuuuuacuagaguuuuacucaugcuaaaugcuaggcuucccaaaguguuaguuaugggaaguguuugaauuuguacacagaucauaagauuuuaaauauagaaauugagaugauaaaagccuuuagauaagcucugacaaaauaugauauaaauaucucaguauuugguuuuggaucuauaguagcuuuaucuuuagcuuuuauauugcuacuuucaucggucauuuguaagaaugaaguuaacaguuuaaaacugcguggaacaaaaagacuuaccaguugguuuacauuucuuuuuucuuuuuuucuguauucuuccuguaaugcugccuuucuuucagguuguugcuaagugggaacaacuuagcuuaguacuggugaaugacuuugcuggaguuggaacugaacaaguacuggucguuuuugaggacucucuggaugcagaucagcugaccucauuuacaguaacagauuuugucaaaauaugguauucaguaaguucuguuuauguaguaugguuguuaguauauagauauagauauaugauauauguuuuauauuuauuuuaauauucuaaguauguuauauauuuaauaugagauauauauagagagauauaauauaauguauauaaauuauagagucauuuuaguacuuaaauacuuacuccucuauugaaauaguuaugauuucauacuuuaaaguucuaaaauuauaucagugaaucuuuuauauguuauccuucucaacaaauguuauauaaaucgaucauguuuuuuuacauaaacuuguauuacauauggcauaucuaauggucacucaaaugucaguagugcuguauuuugcuucugaaauaccauuuuguaccaguaagcaguauugccuugaugaaggaauaaaagagcacgaagcuccuucugaaaagaggaaaggagugaugugagauggcuuagugaugagggccugaugaccagaguuguaugccuggaaccuacauggcaggagaaagcugacguccacagguuuuccucugaccuccacguacacgccaggacacgugcugggaaacagccccagaaauaaacaaauggaaugaaugccauaaaugcuuuaaaguacaaggaagaggugaagcaaccuugaaacuuuuaucauaagggggauuauuuuccccgaaguuucagaucuaagcagaaugggaagcucugccaaugguuuucuguuuguuuguuuguacagugaagauaauuguucuuugcucgaggguuuucuagaaaguaaugagcugauacuuugugauagaaauuugaggugguaacaguagggcccacagugauauuugccuaauuuccagauguugaaaacacauuauuucuuuuuucaugaggaacuguccuuuggguaaauaugguuugcuuuuuuuuuuuuuggauccucugaauuuucaauuuguuucacaauuuguguugcuguuuucugucauuagaccaaaccacuggauugcugugaagacccuuuggcugaagaggagcaugaaaauuauuauuuggugcuuccagcacuggaaggccaauuagacguuagugucucuguucccuaguuaccucuggguuuguuuuuguuuuguuuuguuuugcuuuguuuuguuuuuucauuaacgagcucuaacugaagcacauagcauugaaagaaauaugcuugugggauuaagcagcucuguguuuagacaaaagggguauuuuagagaacucucuguuuggggcacagauguaaaaaaaacaguuaauacccugaagguagauugugguguuuuaggccugugauuuugcacuugaaaaggugaggcagggugauuguuauuuugaguccagcuuugucuauacacagucccaggacagcugagucaauacaacaagaccugucucaaaaauaauaacacaaaugauugugaugcuacauauaaguauguugucuagaaaugauaacauuuuguucuaggauuuaguaggguugacaagcucuaugaacaaaaaucaaagaagcccaguuuuggaagcauucugguguauaagaucaguaguauguuuuagcgugucucuuagaggagcaaugaauauaaugacuuacauacagcacauuaaacgacaaguagcagucuacucucaucuucuuccuaaugaaauucucuacaaaagccaggcauaguagcacaugccuguauccacagcacuugagagaaauaagaguuuaaggucaguauauaccaacuuccaagccagcauagaugagacuaauucagaccaaccaccaaagucccuguaaaagaauuacugcuuuuagcuaaauguaccagccauauagcacucuguuaguuuucauuccugacagcauuccuaacauaauguccaaggcaaugguucucaaccugggggguaaaaugccuuugagaaucacauaucagauaacccugcauaucagagguuuuuuuuuuuuuucauuacaauuccuaacaguagcgaaauuacaguuaggaaauuagaacaaaauaauuuuauaguugggaguuaccaacaacacgaggaacuguuuuagagggaugaagcauuaggaaggcugagaaccauugcucuaaggaagggauuucuuuggauaccaguuucagagaauccaguuccugccuggccagcagcaguugcuuagggcuucagaugaagcagcauauugggacaggagggguaugguggaacacagccacccaucucaugguagccaggaagcagaguaugccuggguuaaugugcaucuuucuuuucccucuuuuggccuauagggugaugcucugucacauccagagugucccaugcccccuuuaguuuuuauucuuggaaauacccucacagaucauguguucauugaucuuuuugucaacuugacaaaagaagccagggucaucuggaaaguagaaauucuuuuagugacuguucuuccccuacuucucauuuuacacgggauggaaucuacagacccagaaagaugaaacgccucagaguuaaaaaaacuagaguccauugcaucaacuuaguuguuagcagggaaaaacauggaggacccacaccaggaagagacgauugaguauguagcaaauguugaugucauuguucaugaugucccacaaguagacacaacacaaaugcuggucaccagaaguugaguguaaucauaggcuggaauggugucaaacacugaaaaggaagaucaacagcuguuagggacagcaugagcaaccuuaaaagcugauggacacacaaugguccaauugaggcaauguucagaaacaauauaagccuaaaaauucuccucagaacauggagaaaaugugcuaaaauucagaggcaaagcaaaguucugguaagacuccaggguaguguugacuccuagaaagaaaaaaaaaauuguucaggcuucuccugcagcuccuagaaucuauacauuuacuuggaugaaguuuugugggugcugacugcauuuuuagacuucacacuuuuccaaauugugccguuuggggacuguguaguagaguucacaauaaggaauuuuaaagcaggguucaguguuaaguagggcagucuguugcuaugucaggguuugguuuggauuucugguugaaaggagauaaaagaaaacaguucuuaccauaugugagaaaauucuggaaagguaagcaaucucuugguuccaggauuaugugucuacaaaaagacgacuaggaacccuuugauagugauuacauuuccuacagugagcuugguuuaguuuuaugguuuaauaaccaagcuucacaauauuugaaacuagagauuugcuauuuuuguccuggaacacgggacaggaugagaaaacccgauagaggccaguguuaguuucagaugguuccuuuucagucagccgaccuugaguagauacaucuccucccacccaaauuauaaauacccaaguauaugagcgauggaguaugagcgguccgaagccaggagagcuaggccuaccugagaugcuucaaaauauuaacuagacacauaacacacuuuguaaugagguaaaagcuaaaaaguuuuuggaauaugguagaacauuuuauuggaaacuguauuaauauuuaaacagucucacaugucuaucuaaaugaaacaacuucagucaauccaaugacaagacugcuuuaguagcaaaguauaguccaugauuauuuucauccuuagagcuaaaaucuaagaaucuuguacaguaaaagauauauugcucuaugcccuguucugagccaaaguuaguuuccucaguaguucuuagcaggguuuucuuuuuguuuguuuuuguuuguuuguuuguuuguuuuugucaguagaggguuguguuuauaaaaaagaggagaguauguucuauggggguguggugagguaugggggaaggcggugccucagcggguccaugccaaggcaucccuuccccaugagggaccagccacacaacaguauaguauagaauagaguuuauucagggcacagggaaaggaguuaaaaggguaguagagcagagaggagagaguaaaggccagccaugagugaagaggggggaagggaauggggagagaaaggggaaggcaagcaggaaaagagcaagggaggagcaagagaccaagagagggaggagggggcaagcagccccucuaauagugggucaggccuaccuggcuguugccagguaacugugggaaggagcuuaccuggcuguugcccgguagcuauagggcggaacuuagacagaacgcaacauagaguauauagcaggacaaaaccaaauaaagcaaaugaugacuauuacuauaucuuaccuuuacauuuuuguugucaaaaguauaugaacagaguuucaaacuucagguuaacuuuucgauucaggauguuuuuacucaucuaaacacuguuuugaaacaaguucuuucaaaaagaaaaaaaaagguuuuguuguuuuguuuuauaaauguaacaauguugcgaggccucgguuuuauucagagugguauguguuacuagcuccgcaauaaaauggauacuauuguauggagauucccaacuuagugacuaaacuccauagcuguuacuuccagaauccugcugugaacacaaaguaacucucugacuaagaguaacagucuauaaacaaaagagcuuuucucugcaaguguucucuguagagguuaucuggaggaaccuggacucacaauacgcccuguugaaauugugacuuuuguuuucuuuuuguuuuacagaauucuuuuauuuuucuuaacaaaauccagcagcauaucucuuuuaaggauaaauuuauugcaaagucuuggaaggcucuuuuaaacgcaguuuaugggaaaggugacagucugccaagugaugaaaugguuaaguuagaccagguaaacuuaaucauggcauuucuuuuuuuuuaaccauuuaaucaauugacaauguacgauuauugaagggauuuauuuaaauuagaauaaaguagaaaauaucgcuuguuggauugaaaagaagaguaaccaagcaauguucagaauauugaaaaacacugguuucaauauuuuauuggucuauuucaguucaaagccagcuguaccacuuuguagcugugugacuucaaacaaguuacuuaaccucucuagcucauuugucuuauguguaaaauguagagacuacuacaacuggcaaaggcuacccugcuuauuaugaggguuuaauguauugaugcacagaugguauuuagacaucaaaguaauagacucaauaaguaauaguuauuucuccuaacccugugcauucuauucaaauuguaauccuguguuuauggaaauggcuugagaauggucaggagaguaaugauaaaacuucagcagaauucuauaaacuacccauaaaaggauaauuuaguuaguuuuauuaaugcggaaguucagaucuuaagcucagugcaagucacauauuggauuguuuucaccauacauaugguauauauugucaagcuuuauuaaaauccaguuuuauguuccuacuggcucuauauuggauaagucuucuuccacucagguugugauucuugaccugaguauauaauugucucaugaauuuuauuuuaguaaguuauauguaaccucuaacuuuuaaguuauuuuauuaucuucauuauuuauuauuaugcccuauuauaauuuauuuuaaaaaguuucugugaugccuagccuauugacauugcaaaauggugcaaucaucuacaaacguauugggcuguauucauggcuaucuucagaaggguguggucuaugguucccaaggccagcacgcuucaucaagccaugaagcuacaaagcugaugggccuuauauacauuucggugagucaguguauuuuuuuuucuuuuuuuuuuuuuagucaucuauuuuaacauuuuucuuuaaggacggucuuguuccuuucugugaugaaggugaagacagugucccuaccccugaggaaaacuuaccagacaauuuuccagagccagaacauauuguagagcagacauggugccauguacuagaugaugacuuaguugugggcgcaaaagucacaucuuugaaggaguaaguacauuuucauguaauaaugccacagggaugcuggagaccagcacugccuaauagacaugugcacaaggcacgugcaauuuucauuguucuaguagccuuauuaaaaacugaaagaaaggguaagcauguguauacauacacacacacacacauacauauacuagaaguaacugcuguaagaaaaguacuauaaacucaaggcuuguacuaaaagaguuaacaguuuccauguauccggaaacacaugauaccacugcuuuucuggcuuugacuuagaagucucucuaggcuggggccaucggacacuaacacagcaagccuacuaacccuggcuuuaauccacaaucccaaaguaaauaaauaaaugaauuaaaaauaaauacauuugaaugagaaaaaaaacugaaagaaagcaaguagaauuaauuucaauauuugauugggucccuucugcccaaaguuucauuucaacauaauacucaggacaaaaaaaaaaaaaaacacaaaacaaaacaacaaaaaaagaaaacuauuaaugaucuauuuguuuucauuuugagcuuuugaaauuugguuuguaugcgacauugcaauucauacuugcuaucucucuuguuaaauaacagucucuaauaauaguggauuuuucuccuuugggcuagaauccauggagaggaaaauaauaucugcuguuuccaccauacuagggauccacaaaugugcacgcagagaaagaaaagguuggaaugacucugcuaguauguagauucaacuguccuaacaguaauggaguccaagcaacuuacuuagugauugguuuccacuuaaucuuguuucagugagucucuugguuuccugagacaagaucuuccucuguagccuaaguugaucuagaucccuguuuugaccacccuggcuucaaacucuugauucucauguccuaguuauugcagcuacaggguuccaaguguguguuacuauuccugcuuguucacugauuucuaagauguuugaggcgauggaccauauaggguuugggcuuuuuguuucacguggugacuuaggugcaucuauuuucuaggauacaaguuuugcaaauuugaauaugugugcuguuuuuucaugcaauauauauuuugaaacucugccuuucccccuguaaagaacuaugggcugacuuuacugauuucaugcugugcuaucccuuuccguguugcccugucaccuuuauuuuuuccuaaaucagaagugugaucgaaaggcugagccagagugacauuggaauuuauguuaaggguguacuucauagguggugccuucuuucaucaagaagcauguaaaagugcuuugggauuuagcagccagaauaaccguauaaagcaaaggcccucgcuccucgguaguuacauacuuacauuacagccuuaaauauugugcuuugugauuagccauagaagccuggacuuaacguggagcuugcugggaccuggguagauuguuguuucuggguauuucuuuauggaguauuguucuuaauaauaaaacccaacagaaauccaugcugauacuuucaauucagacuaaaaaauccauauucauagucuuaucacuaccagucuuguaucuccauuucucacugccccccccccgaaaauuuuguucucugcuaugccaacaaaauugcuguuuucuucauuguguaaucgauguaugauauucagagaaucauaauaucaacaauaugacuauaauaaguuguuucuuuaaaguucuuugaguaauuuuuaguauaguucaguaggccuugcagauuccucuuugggugugucaccauuccuugauaauguugauagaguuggaaugugccuaaauaagcuuacaucagagaagaauuucugaaagauaagaaauaaucuauauuuaaguuagauuuucaauuacucaggagaguguaagacagaaguauuuucauauuuuauguuaaagguauuuuacucuaaauuauuacuagaacuuaacagugacuaguuucuucucauuuauuuuuaauauuauuuuacuuauuccuugauaauuucauacaauguauugucaucauauuaacccuccacccucaacucuuccccaucagcuuccacuucccucucuacccaacuugauguuaucucugcuuccauuuuuaaaaaacaaaaaaccagcaagccuaguuuauucuggccagcuccucuugggugugggguugggccuacccaggagaggucacuggauucuucaaauuucugaggcuuuuacucccaauacuuuagauauuuugccuugaaaugauuauuccaagggaaggagggaaugacuguuuuguuguuuuuguaaacauuuaaucaucuauuugauuuaaaaaaaaaaacguguacaauaaaccaaauucuuuuguuuuuccccacagaucuaaugagaugacuuuaucacugauaaugaaucaaggcaacagguccaguuuucaucuuaugaagugucacagucaggugauuaguuugaguaugaauucuuuuccagaagcauacuugaugucaaaggaagcaggaccagacagcgaaaggaugcagcuggucucuaguagcguggaagcggaaagcucuuuuugcggccagucauccaaggcagagucuacacgcauaaucacugcuguaacgucucuuucaccacuucuaguguucaaccaauuguguugcacugugcugcuaaacauuagugacagagauaauccuaaagcuacugugcaugauuauauugucuguggcaaccuugauuuuaaucuacaagaucuuuuuaguaagaaccaccuccuggcauucccaaagaaggaaucaguagguaauuugaggggucauuuuuguuguuguguacuuaauugaaucagaagauuuugaaaaaugguugcucguagacagaauuuaaggcucgaacuugggauguguuuuucuuauagaacauacagaggaucuuuuuucacuucuuggaguauugcccaaguaucccuucugugucacaucaccuacccaugccccgaauuuuaugaagguauggcucuugaaacacaugaaaugugaaagaauucaagaauguacagaaauauaccuuuauaaaaagcuacgaaauuguggagcacucuucuccugggagcagagaacagcaucugaaggaauuuuaacaauauauugcagguaaugcacauccaguucaaaccaguucagagaaaucugugugucuggguggucuaauaacagucucucaaagccaggugguggugguguaugucuuuauuccagcacuugggaggcagaugcaagcagacuucuggaaguuuaaggcuagccuggucuauagagugaguuccaggacagccauggcaacacagaaaaaccccguguugaaaacaaacaaacaaaaaacaaacaucaucucuguguagaacugugugcccggauagguugcagucauggcuugguauuguuugaaugcauagaaaauuaaugucuguuuuagucuuuuguuuuuguuuuauuuguuuuuugaaccuaguaauuauuuuagaauuuaccucaugucuauagggaauauucaguaaauacuacgcugcugcuguuacugagcaagugauacauaauacggccccuggguugauugcuaccauguuaauuggcauaggacacguguauugauauaacuaauauauuaucaaucaaagcaugcauuuugauucuauugaucuuuguguuuaugaauaaauauuaauugauugcuagagcauuuugcaugugacuguuguauguugucacagucauaucacacagacuuguuuuuuauuucaggagccaaggaguuuuguuccagugucucgaccaucucaucaaaguucucccugaaauauguuccuucaaauaucugaaggucgaaaaugaggauuucuuaguugaucauuugucauccacuuuggaggcagaacugguuaccuuuuguucaguuucuacuucugccuucgaguauguuagagguggauauaacuguagaauaaggagaacagauaauagggccaugacauuuuuagggagaagggccaaaauccgucaguccaagcgcaaaguucagagagaaaggauacugaagcaccuuaauaugacaguaaauggcagcagcuaugcggagaugacuuuggcguuggcugagauucaguugaaaucagaccucauuguaaagacacuggccaauuuuguaauugcacuuuaaaacucaugauuuaaaauauuccauaauuauuugccucacuuguuagguuuugauaauauaaagauuaaagcuuauuauaauuccuagag

SEQ ID NO: 9827 - RNA, 20061 nt, Mus musculus
ucacucccccacuucucccgccccuuccuccuccccaccaccagagcuagguccguuguugcccaccgcccgagaucugccagcugcgugcccacgaggugacuucgggggcugauggguugcuuuuggggaguaagggaauagcguggcggacuccugaagcuuggaguacuggcuuggcgcucaugcuguggcuuuaauuaccaucacccggcagcacgaggagguugccuagacccgugagagucccaaccccugacagacuguuaaaacuaguucuaauuuaugcucucaagcccuaugugcuuccuaauccuugggugccugcugagaauucuguucccaggcccccaccucagacuauuccaguucagaucuugagaagugaggcucaagcaugggaagguuugggguuuuuguuuguuuuguuuuguuuuaacucacaguguaauucaaacgugcuguggaucacaauguugcaggaagucugucaggacacguuucugcagagaugucuaagcuacuggcucauuuacaaaaacaaaacaacaaaaaccugaguuucucccccgccccccuugcaacuuuugaguucuguaggucagaauucuuaguugauguuaucuuaagaacauuugacaguugcuguggguagccagaguucugaaccauuuucccuuuuuuuuucugaaaugauuguuacaaacucguugcacaaauuaggcucuggacuccacuguuguugggguuuuuauuugcuugggggggguuguuuguugguuuuuguuuuguuguuguuuuuuaacuaaaagccagaacauuacucaaaaucuuaagacuaaaaguuacagacacaaagccucuaugaauugugagauugugauacuguuugaaaguacaauuuaugcuagcaugauucgucaagauaacagugucuuugggauggcaguggaaagagaaaccauguguauaugcuuuggguaaaucuaacacgugcaaguucacaguaaaguguaugaucccuucuguugacugcugggcuggggggaaaaaucaacccaaguugcagagaggcaggcguuuccaucgugaaacuguuuuacagauggcagaggcuuauugguguuucuucaaguccagcguuuaaggagaaguuaagauaagaaggauggcaggaaauuaaacauagcuagagguuagauaagaguucucaagcacacuauagaacucucagaauuacuucuuuauguugggaaauccacucauaaagcacuuggacaaucagaugcagacuguaacauuuaaggccagaugaacuggaaauauauuaauauauuuagacauuuggaacuucuuacugauuguuguuuuuaguuacugccccuuaauaauuugggggagcacggguaggagagaauauuaucaggauauaacagacaaucucaacaauuccaguagcccccaaaggcaggagauuauaccuguuauuuucucugguggaagaaaaaugggaccucuaaaaggaauaaaguauagcaucuaucccuccaaauaagugcccggagcaaguacaguaugcagaaaagaauuuagcauagaauuaucagaaauauguuuauagaaaguaauuuaaaauaauucacuggaaagauaaaaguggucuuaacuacccaaauuacucaagauuuuugcugcugugccagcaauugagugugugcuguguuuggcccugacuuuuuuauggucacacucagauaugcuguaugaaacacaugccugaaaugagacgaacaccaucuguuucuucuuuugaaccagauuaucacugucgucauccucuguuguccugguuuuuuucaguucuccccguuaccugugguguuucugagucagaguaucuugcucuuucuugggcuucuaguugauuucugaucgacacuagccacauaaaggauucugcaggauugcaaaguaaaccauucacaaaucuuuaucacccuugcugauaaauuaaacagugccuuuccaugagugguaugugauuugggcaggggagguggcaagaauuguuaacuauacccuuucagucuccucccaccccgccccaugccugccuuggaacagcacuuaaugcaacacccaggcaagcauaaacuggagccucggcuugagaaagugaacgggguuaaauaauacuuacuugucucccuccaucuucagcucugaagguggcuguuagagauggaaacacagucggcugcuauaugcuuguaagcaggcccuguguccagcugaagauggaguuuggggagcuggcaagguagcccaguggguaaaggcacuugucaccaaaccugacacaugcacacaauaaaccaauguucuuguuuuaaaaguggagcuuggacucguucucugguggaaguaggccauuuggacucaugccaucuuugaugucuacaugacuaaguagggaccauacaaagccauaggaaaaaaaaauccaugagagugucaagccugauacguucaaccaaguacaacagccagcuaggggugguggcauggggacagcaagaguaggaggguaggaaacaagagugucagaagucccuguuuuuaucauuuuucucauugagugaacuacugguauuuauacaauugacaggcaucucuaaugggcuggcauugcauguucaggaagauuucuuacuaucacacgugaacuuguguuacucaaggcaccuucauuuacuucguuuuaguccucagcauacugcuuuguagcaggcaguguguucucauggucuucauugcacccccagacugucagucuggcucaaagccaaaucaauggggcccucaacagaaaaaaaaaaauugacccuccaggcuguagacacaaagacuaauaauauaauaauuucuuuugaauaucuuccuuugcaaaaguaaaagcaaaugaccuuucauguauuuaauuuucaaaauuguauaaaggaagaugaagcagaaaggaaauugguguuauagaauauacauuaucguucugaggaggacuugugguucuauuuuacuuucugguugcgaugacacguccuacauccuauaauuauaagauuauaaauauucaagaaaaaaagaaaugguauacaaauaugcaaugaaaagaauaaauaugagauaccacugccuuucaacaaagcauuaucauagguggaauuuuuuuuaucugggggaaaaaaugacagaauuuccaacuguuguucuucguuuauaguugugcauuuaaaaauaucucucucagagcaagcagugccacuguagaacaaaugugcuucccccccccuuuuuucuuuuuugccuuagaaaggccguaugggaaaauauaucauucaagacugggaggcucugucuugucuguaggccucagcggugguuagugaaugaccucaaugcugucguggguuuuuuccucccuccuuuggugguugaggacagacaaugaauggucucuguauuccccagagcucagcuggguggugaccaugaugccauuguguuccgcuguggagggcugcccaguuugcagagcugcagauccggcccucccugacauugccaaucgcuuuucucucaguucuaccagcccuucagaagaaaacucagucccugaaggcuuguuccagaaaggagaaggagacuugggucgggagagugaaagauaaaauggaaccugcugcccccacaugcuugcuuuccuugacaugaaaguacugcuguaaugccugggaguauugcagugugagcuuuaccagggaugcuaaguguucuuguuaaauccuuagccagcuuuagaauauuaacagaugcauuuacaaaggggcagguucccuuugaaggaagacuguacucuuuccagguauaucuccugaaaacugucgugccugcuuccucaagguccugucuacuaaugacaagugagcagucuguaccagaaaccauggccccccgugugcuucagauugauaguguuuuacaggacuucuuguuacuguuuuuuaacagauuuuuuauguguauaaguguuuuacuugcauguauguaaguguacuacauucauauagugccgaaggaagccaaaagaugcaucagguccccuggagcuggaggcacagaagguugugagccacuguguggaugcugggaaaccauccucugcaagagcaaucagugcuccuaacccugagccaucucuccaguacuuguugguacuucuaauaaagucuuuauaugucuaagaagagaucuaauaaauguuccaauuuccuuacuuauuaguagaaacauuuacuccucguuugccccaaauauuagggaucacugaccaagauagaguugaucauaauuucugguuuuguuucuguuagucuuaaguggagccugauaauucaugaaagguaggagaaugcucuacugagguccaaguggaaagugaagacuagucgggaugcucaguauaccaguauagaacauacaagguaucaucauaguaacauaaaaucgugaucaacaggaaggugggaauuguuugaaaggugaggggugcuuguuuugucguguuuuuaaaagcagaguugaacauugacauuauauauauauaaaaaaaaaucagugcguguggcccacaacccuaaaaauauuuccuaucugaaccuuugcugaaaaauucuagcauaaaauaugaaaagugguacuagaaauccugagcuaagaauuauaaagcucugugcaaauugcuaugccuuucugacauguuucucugugcuuuaucuuauuugacuuugagagauuucuuuguaaauuucaaucuuaacucuucaaaauuauuaauuugaagaucuguaggaucuuagggguccuaaaauuuaaaagaauaugacagauuggcuuggggagucaggaagaaaaaaaaauaaagccaaugaggcaaugagcauuucuuauauccaacccuagugacccucuacuugcugaaggauggcaccaauuugauuauaacuauuccagcagccaaaacuaauugaauuccucuucuacuugguauucaaagcaaauaaaauugcuagcaaaguuccuguagucuaucauugacauaaauugcauuuuuccuuuauggccuaggucuuaaaaaaaugucugguagcugacugggggguccguaacucuguagagugcuugcuuagcuuguacaagggccuuggcuugccucagcauggcucacaaggaaugugauuaguuaguuaacuuacguuaccuucuugauggugggauacaccgggcucgaggugaaccucuugugguuggaaaguugaaauccacuuucuuuaguaagcaaagaugguuuuccuggcuucuggcuuacagaaauguuuugagugagcacugagugaucccuauuacguaguaucacugcaaccuugcugccuaauuauuuguugaacccaaaucauaagcaaccuuugugcaaaguagaacuccuuugaagcccuuuuuaaucacagccauugacauuugagcugcugggcaaaugucacuaauuacccuugaucaucuccagggguuacugcccgaagucucauauuacuuaaaugucuaucuguaggaaaagagccucugcugucucagaauaugcuagcaccuuuaaggccagcuuggaucuuacguaagucaaaacaggauuuggccuauaauaaauauucauucacagugagguuucuucaguuugaguucaucagacuugauccacuugcaaggcauagaaugacgucuauauuccaagcacuuugguuugcuuggauugcuugguuuauuuauuuauuuacauuuuuuaagacagggucugagcuuauagcucagacuggucuggaacucagugcuguagcccgugcuggccucaaacuuugucacuucugcuucagacucccgaguacugggaucacaggcauguacuacugcacccugcuaggaugcaaagcucuaaauuuccaggagacacacuaugacucuuggacuuuucucauuuaauuccaaugcuauuuguuaaucaaaaaaccaauuugauuaggacacacaugagcucacuuugaugucauugugugcugcaggcacuggaaguucuucagguuucggugacagaaauaugaaaccuagcuaaaguggauuauuauuaauauuauuauuauuauuaauaauaauuaauacuuaugggcuaauauuuauuauacuuuagcacuuaagucugcacugauuucuucuaucacugcauuugcguuuuauuuuguuggaugguaacacacccaauuacugacuguuuucuauuuccuccauagccuauaaagaacauuagcuguuagcugaaucuccaggaaaugggcccuguuugaaugaaaccuuuaaaucacaguugaaaaguggaucgauucaacuuaaaacacucacugcauuugauaaauuucuccugguuuucauccaccuugugugugugugugugugugugugugugugugugugugugugugugugugcguacacacacacacaccagcauagcccuaaauuuaucagguauggacuguguuuaagagaaguuugcgggcuggugagauggcucaguggguaagagcacccgacugcucuuccgaagguccagaguucaaaucccagcaaccacaugguggcucacaaaccauccguagcgagaucugacucccucuucuggagugucugaagacagcuacaauguacuuccauauaauaaauaaauaaaucuuaaaaaaaaaaaaaaaaaaaaaaaaaaacacaagagaaguuugcagugucauccacccucuuaguggugcucuaucugaaagcuuguuacauuucauuaugaaugguucuuuaaguaucaggguuuuugugcuuuuauuucaugaucuuaaauuugcaugcauuuuaagauacuauuuuuguuaacuguuuugagacaagaguucuguagcccagaaugaccuugaccuugaagcauggcaauccuccugccucagccucccaagcuggaauuacaagcaugcaccgccacaccugauauaacuuguuaaaaguacuucugguguugccaggcaucuuagaaacuccuuguuaaggagaaggaauuaacuuuuuaauuuauuauuaguguguaugugcgugugcacaggccaaggccagaggacaacguuuggaaucuuuccacuguggguuccaggucaucagucuggugugaugaccugccgaucgacuuaccagcccucacauuuauuuuaacuggguuguaaaagauguguagguaaugcucugccauaccucuggagccuucuucugcaaggaagcagggugauuagggaaaagaguauuguuugaaacaaaaaccaaagcugagguaggcuggagaagcgucuuguuggaagaagcuucuacaagccccacacuuagggcuucuagucaguuggaaagacagaaugucuucaagcuucaagacagcccaagaacgggcuggcaagauggccccauggguagaggugcccaccagcaagccugacaaccugagugaguuccaggagaacugacucagucacaugugacuucuguacucagugugauggcacgcacaacacgcccacauaggccauaaauaauaaggaaauguucaaaaagaaagagaaggcaagguuauuuuaaauagacauuugccuauguuuacaacucguaaaguagacugacggugguaacacgugccuuuaauugcagcacaugggaggcagagggagguggaucacugaauucaaggccagccuugaacauagagaguucaagacagcaagagcuguuacacagaaacccugucuccaaaaagaaaagaaaagaaaagaaaagaaaaaaaaaagaaggaaggaaggaaaacuaguaaaguaguauuguaggcuuggaacccuugcucuaagauacauuauuuuguguacugcuguuacuaaguuaugugguuaugguuauuuucauagacuuuucuuugaguaaacaaguaguggaauacaaaaccaguugggguccuuugacucaaucacaccuaagggagauugcucuucuccggaccacaagaucacaacccagguaacagauucuuguugcaagaagaucagucaugauacugagacaaaaaaacagccucuuaagggcuacguugaagaccauggaauagcugugacuguccuauagaguggugacgaaauguucucacuguguuuguguuugucuuuuaguucccacuuggacuuuugcaaucagagauaacagcaaugguaagauuaccuauuuuucuuaauauaugcagccauuccaaaagcuacugaaaucugaaacacuucuggcccuaguguuugagauaagggauacuuagccugucuaucagacaacuaaaaguaaaaagagcaucuuguaugauauuagacauaugucucacacauugaggaauggacucagcgagcagauuaguaggaaauaagggaaggaacccuagcauggucauuagaaugagcaggccauuucugacuuggagcuaauacagauagccagguuaacgaaugucaggacuuuuaucuuuccuugucuugucaaaaaguacacagacgacugcuggggaagaagaacauuaggagugggacagggugaaaccugguaaucagggguggcuacaaucaaaauacaucguguacagcaugaaaaugucauuauaaaacuguaguuacacauacuaauuuuaaaaaaucuuaaaguaaacucuuacuauaaauaaauacugugaauaaaaugaaggcauuuuucaaagaagauagauaaucuuuauuugucucuguccucagugucuugguuucuuuucuuguuguugugauaaaauacaaaagacaggaaaaaguuauuuuggcucacagucgaaagguacuguucaucguggcaguaauauugcauacacaaucaggaacguggagugaugaaugcacgcuucuguccuauuuauauagucuaguaucccagcaaaggaauggugccauccacugaaaagaucuuccagacucaauuaacauaaucaagauaguucccccacaagugaacccagagaucuaccacccugaugauucgugauccugugaaguugucaacauuaaucacauuauauaagcccccauaaccuucagcuguuguucuguggggagcugaaguacagauagucagggaauguguuacauuugcccucugcagugagcacaaaccuaucuuacacuuguguuuuuaagcuuaauagcacccucauggaaaggagugugguggcuugaaugggaaauguucccucgaggcuccgguauuugaccacuugauccccaguugguggcaguguuuggggaaguucugggaaaguguaguauugcaggaggaaggacauuacuuugagugugggcuuugagaaugcauagccuugccccacuuccaguuuucucucucucucucucucucucucucucucucucucucucucucucucucucucucucucucucuacuucaaguucauguuugaagcugugaucucagcucucugcucaggcugcugugccuccuggccaucauggacucaaacccucuggaacuguaagcccucuaacucuuucuucuuuaaacuguucuugcuccugauauuuuaucacagcaacagaaaaguagccgauaacacucaguaaauagcuguugguuaguuaguuggauaaacauuugaagauucucuagagacugaaccauuugaugucuguuuauauguccacucuguaggccuccaacuggagggcuagugcaucuugguauucucacccaguauaugcaagauacuggcaacauuaucaucacgcaaugcuuuggaugcagggccaccagaaugccuacagaaaguucagggauuccuauuucacauccccguggcucuucccucauggagcucuucccuggaacucuccugcuuaugaggcugggcauccuugggacucucaaggccagcacauggcgcagcaggagucucccuaccguguuucccaucccaaaagcccugggcagccucugcguaauagcaguagaacccaggcauccacaagagggaaugaagcacggugugaggaggaagagcuggagucagauucagaugaugaaguagagugcgaccugagcaauauggagaucaccgaggagcuccggcaguacuucgcgcagaccgagaggcacagagaggagagaaguaagucucuucccugcccugauguucacggcgcuuuucuugucugacaugccgaguucuuuuauaacguuuuauuucggugcagugaauaaucuaaaucuggucuuaagccuagaaaaaacuauagugaugcuguaccucaguuauaucugguccucagaguugguuuauauagugcuguucauuugaguuccuaauaauacaccuaccauuuugugagcaucagacauucaaccagaugaaauguguaugugcgcaugcgugcauaccuucucuaauccacauagccgacccucaaggcaugaaacucauuuuacagcugagaaaagugaagcuuaaggaggcuaauuacacaaucacccacuugcuaguaggaguccacucuugcagacugugcuccgcucugcaaugcagcuuucucugggcugugcuucucccugacacugugagguuucccaaaugcuggacucugagcgcuucucugggacacagcucagagcugcuccuauacagcucccugcacuauacagucagugugaaccuaaacagaguaacaaaaugccuccuagguacagcuuuccuguuuucuccacacuacaggacagagcuuugcaguaaagcgcuuagggcuuuguacaguaagucccaaagcaggaauuuuucuuuuuaaaauuucuacuauucaucagaccucuuauuauuauuauuaagugcccuugaaaauguacagauauuucuuuucccauuacaaccaguauucugucucaaaaugccuuucaguagggucgcauuggguauuguauauagaauuuucacuugguugguuaguugaguuuuugagacagucuuccuauaugguccaaauugaccugaaacuucugauccuccuaccucagguuucugaguuguuucaguuuucuggguuaaagauauagaucauuauagccagcuucuaaccuagaauuuucuaauaaacagagacauggagaauucaacaaaggaaaguuucauuuccauuuuaaaaugccugugcccucuuaacaauagauuaggcuuuauugauccccaguagaugccagggacugagcagcagacuuugcauaaaguauuguuuccuuuaguaucugcuugugauucuucucucaccacuuguucucuucgguuuaccuguuuucuucugaguaaacuguugauuucuuuggcaugcucauauuagaaaguauauccaggggcuagagaaauagcucagugguuaggaauacuugcugcucuugcagaggacacaagcuccauucccagcacucacccaccuguaacaauaauuccaagagauccagugccuucuugggaccuucaggagcaugaggcauaaacacgauucacaaacauacauguagugauaaaaagaauguauauccaaacaacuauaugaaagcaauaguuucugaugugcauagaauacauuucuccuuuguuauguuuaauuauuuauuuaucugugggagagugugcaggucagaggccauacuugccaaaguugcuuuucuccuuauaccauaugggucaccgagauugcacucuggucaucagucuuaaugacaagugcccuuacccaccaggccaauucaagaaccccaugguacauuucuuucugugguccccagaaauaaauuuuagcuuuucucagaaugcauacaaagcaguaauuugucuaauuuagacaugcaccaaaaaugaagagguaaggugcuggagcuuguucacguguacuuguuauacugugaguuacaacauggguuagagagcacaggagucuaaacuauuacuugcgagaaaaggcauaccuggguucuuaaaccuaagacuucagaaguagucagucaacaagcauaugucauuuacacaguccaucauugucagugagcuguugaauaaaauucuucagccuggacagcaagcauguucuugucuccauugauuacaucuuuaaauaaugaaagcacaaaacuugaaacaggauagggaauccugcauggcguuaggaagaugcucccuggauaaagcgccugucucacaagccuucagaccaggcuucagauuucuggcaccaacauggaagcuggucaagcaugauauccaucuguaauucuaguacucugauccccaggauaagcuggcuuugaagauuagccuuucagguagcucuagguucagugagagacccuaccucaacuuaaacagaaaaguaagguagagaguaaucaagggagacaaccgacaccaacuucaggccucacugcaggcacucacacacauagacaaguaccugaaagguggcaguagccccguggaaaggugguugcccagcaugcacaagggucuugguucuauccccagcauaauaaagagaaaaaaccaacuccuucagugccuuggaaacacuuaugcuuuccauuauguuauaugucaucauuuccucuuaacauacuuccucaaaauguuagugauaacagcacuucuuagaaaauagacaguuguaacauuuuaaagguuagcugugauuucaauucuuaggaaacaugguuagcauucagcgggauacauuuuagucauaaauagccaucaauugaaacugcaugauacuuacaaggaacaugaaugaacguuaacauuccccauaggaaagaaagcccuccagaaaaaacccugccccugcagucccgacauugugccagaaaggucuuuauuagaugugauucaaggguggauguuggcucaaaacaaggacguguucucagagagugugauauucuuaaaugaaauugaaauagacuccuguuuaaaugauguauagaagaguagcugugguauauagcccaaaguuacugauacaaacaagggguagagccaguguccaaagcagcggaaggaugguuguugccagguagcuguggagaaauggaacgcuuaagacuugggggagcacgaucuauuuggaaugagagaaaagguaaguucacuuggagcuuagacuacuguguuauuuuuacugaagaguccacuuguguuuguacaucucauggggaacaugugcuccauuauguaccccauucagaggcuuuccguccuuguguccauagugacugacccuucaagucaaugcacugaaaaccauuagccuguccucuagaaaacaaggcuuacagcccaguguuuccugagcuguguugguuuaaauaauguggauaaaguaugaaagcacacugacucugaccauuccaaguaugccuucaucuccucuaguacggauguucggaagaacuaaagaacagccauuaagauaauggauguggaaggucacagaaaaguagaagggaguggguaaaggcacccuccuugcuaaagcuaagccggugauuguccacucacuucagggcuauauuggauggaaugggggacccagagugaggagacuguguuuugagucuguugcugaugaggcaaaaaggcauccuugauuuacucaagccugugcugucucuugcuuaugcugucgccauuaacuuuggcaacauagcagaaaaucucaucagaaagcccugcugauccuagaaaaaugaggggcgggcgauaccauucuucaacauauaucauuguagugcuuugucucucaaacugugcugccuuugagcuaauuauugaguagcauauuuagugaguaauuuccugcuguguaaaauuucccucaaguccaaguugcuuccugugauuauuuuuucccauuauggauuauaauucuacauuaguaauaacucuuuucuaaaaucaucuuuaauuagggagugcaaggaguaugaauguucguacaaugccuauauaggccaaaggcuuuggauacccuggaaccuggcauuaaaggcaguuguuaaauccccugcccuagguacugggaaccgaucuuagaucuucugcaagagcagucugaacucuuaagcaguaagccaucucucaguucuccugguagcuucuuauagaugcacagacugauaccaaaaccaugggcccuaaacuuagauggaguccaguaaaguuuuuccuuuaaaauguauuacuaguuagaggugaggcaugcuuguuuaauuccacaugcauauuaacucuuguauuguuuuauaggguugcuguagcaaauuacagcaauguucauggccaaacagcagagguuuauuuuuuucacauccaaaaucaagguguccccagggcagccuuccuacaaaggcccuaaagcagugcuucuccacguuccuauugcugugacccuuuuaauacagcuccuuaugcugugcugauacccgaccauacaauuacuuuugcugcuacuuuauaacuguaauguugcuacugucaugacucauagcuaaguaucuguguuuucugguggucuuaggagacuccugcuuccugcagcacuuggugucuucuagcaucccuucacuuguagcaguaucgccaucugucuauacaugacuuucccugugucucuuuguccuuuucugucucauauaaggccacuccccuuagauuuaagguguacacuaaucuagugcaaucucaucauuaucuuuuaucugcacaaagccucuuuccgaguaagccccagugacgagaaccugcugcucggccucuucagccccaguuugaagcuggaauggaaccuaaguguuguuuugauuuguaguuagugagucaauuccuguauguuacucacaccuuugaugccugugacaaagaccugucaccuaggaaggaaagacuugcuuuggcucgggaguuucagauguuacaguucaagaucagucagauggagucguggcuuugggccuggaaaacaguaaaccaugaggugagcguagcuucugguggaagcagagcaugccuacgcugacaggccucuuccugcucugggccccagacuuuuguguggugccacccacauuccugacagauguuucucccuuccuugguugaucaucuagaaacacugguagacgcuugcagaggcgugcuuuaccaucuccuaagugucccucaaugcagccaugcugucaaucaagacucaguaucacaaccacaugagaaagagugcucaguaacauugagugcuacggcugauuucaguuuuaugaugagacaggcuguugcccaugcaaggcgaccauacuauuggcucuccauuguaacgcugauacuacucgacuugagcugggccagucacauccaguuagcuaagcccucaccuuaccuugacaaggaaaaugugcugagugaggguuaaggaugcugucuuuacuugggugggaggaauuaaagaacaauuaauaaacugaauagaggccuucaagcccaggaauuguaucauacaauucuugguucccuaagucaauauauucuaaaauauuuucagaaacuaacugaucauuagaacacagcaaguugaucagagagcauuuguuuuugaccuaaaugguuuagucuagccuauaagucaguugauaaauacuugccuagcuugagaagagucugcaguuacaucuucagcacuguagaaaccaagcaugguagcacuauacuauaauccuacaccucagagguguagcccauaaauuaaggaauucaagaucaccuuggcuacauagccauccugggcuaaagauagaacccagugcuuguuaaaaacugugugucucuccuauagggcugaacaacaauaugaacuaaccaguacccacaaagcucaugucucuagcugcauauauagcagaggauggccuagucggccaucacugggaagaaagacccuuggucuugcaaacuuuauaugccucaguacaggggaacgccagggccaagaacugggagugggugaguuggggagcaggggaagggguauaggggacuuuuggagaggaaacuaggaaaggggauaacauuugaaauguaaaugaagaaaacaucuaauuaaaaaaaauacaaacccuguguaucucaccaggaaaucuaagcuuacuuuaaaguucugugagaagaagcagaggugagcaguuccaggacagaggugaaggaaugauagaaagugagcccaggggaaaaacacgcuccccauuggggauucuacccuagcugcccaucacaaacacagggaucucuagaaauaagaaacagaacuggcaggugcuuuucucuggcccaguuuugauuuuuguuuucccuauagaagugaggucagcggugaaauggccauuuccccugccacauucaccaccacacuccucucccagagcucagcaugacuguagacugcacaugccucugagcacugaacagcgggaaugcugauguuuucaacuuggcccaaagaccaaaguuuugaagaaaauucuuggugaccugcaauucauuugugauugggccaguucugugcauuucccaggaaaggccaugcaugccuuuucugcuguuuccugucauuugcuuuaugcacuuauuuuuccacacgugaaaguaagggcagauguucuaagacaacaguggcuguauauguguggccauagccauuuuuauuugucuugucugcuucugcguauguguguaagugaaugccgaauguuuggggguauucucagaggccagagggcaucagacccaucggaacugggguuccaugagugcugggaaugaaaccaggcuccugugcaacagcagaaugcccucacagcacuucccuucgugcuucuggcucucucggacucaugauguagaccagccugguuuggaacucacaguuuuaaaccugcuucugccuccugaaugcuagcauugaagauacgugcuaucaggccuagcuguauaucuauaucuaauguuuguaaaacuccuagauauuuccaagguguuagucauaaaaaaaauaaacaaaaaagaacaaaaacgggauuuacaagggugacuucgaauagcuauauaaaugucuuccuucacacuugacuagcucacugcugucuucccuuccagauacuagcagagaguggcccaccauggaaagaaugauuuaucccauaguguuauuccccuacagccaguuuaaguccuuaucucagggcauuccucuggguaacaauaguggcuauagauagugugcuugaagcuaucaauuucccucuugacagaguugcuuacaaaagugugccugcccacuuccuucucccuucugcugcuuugcuuuguugacauucuuauguugguauuuacauaggaguaagaauuuuaauguugggacugucugugguuuaaacaaaaggagagaagggaggaagacauugaaucaaugcuuccuuuaccaggauuuacugaauuaguagacuuggcaggucuccccugugcuaagcugggaccugacaaguugagcuccacaccaggaaaagcagcuuuguuauguagcuggaagaacgugagucagauccagaggggccacgccacauacaccccacauuugugcuaguaagugugaggaccagaguucggacccccaagcauccucagaaaugcuagacgugcauggcaggcaugcugcaaucccagcauaugagaaguggagacaagggcccaggagcagcuaaccagacuagcugcauuuugagcucuggcuucaaaugacucagcccaucuaaaauggauaguaauugaggaagacuccugacaucaaucucuggccuccacguucacauguguacacacacacaggcacaccagacuugagugcaaaaggcaaagaaagaaacgggcugaugggcuggcucagugcagagauacacuugcugccaagccugguaaccaguguuugauucccuggcacucacguaguagaagaagaacacuguucugacccccacauauagcacggugaauguccauccccaaauguaguuuuuaaagaugugcuuuugauagcacugaacguugaaggaaacuuuucccucccagggagaaacaguacaugaaagcaaacaaggacugccugccauuaauggccagucagaugacaagagaaagccaagugcuuucauuuuucuccuguaucuucaaggucugcuguagaggauuaguggguugggauaguggguuucuuggaggcauuuugcagguucuguuaguggcuaguggccccuaagaagugaacagugagcuucaugccuuaggaucugcggaucaccgcagcugccccaacaagguccaaguuugcuauugggaaggacaguaggaggagcuuagggagcacagauggcaugugaggcgugguagcaggagugucagcauccagcagauccucucccugcaugugucuaucuuuuauggugucaguccuauccauucccagggcgacagcagcagcuggacgcagagcgccugaaugacuaugugaaugcggaccauggccuguacuucaaccaccguaggucacuggaacccccaucugagaagcccugggagcggcgccaagcagagaugaagcgcuuauauggcaacagugcucccaagauccuggccauggagacugcuguacagcugagcuuugacaagcacugugacagaaagcaaccaaaguacuggccugucauuccccugaaguucugaguccugggcaccgggacccuagggaaugcaucacaguuccuagccucucccucuucaucucuucuggacauuuuucagagaaagaggccuguauaccaacaugguggauacagucugucaacaggagagagguauacuguugccaacacaaggaauguucacugacaaagugauaauuuauguauuguacuggcucuugguuuucucuuuaacaguccaguucauugaaauuauugccuagcaauacugccuauuguuuugcauuuuuaauguccuucuuuaaaccauccagaaugucauaaaagccuuaagccacgugucauuuauuccuacauuuuuauuagauauuuucuuuauuuauauuuuaaauguuauccccuuuccuuguuuccccuccuuuaaaagcucccuauccccugcuccccagcccacccacuccacauccuggcccagacauuccuacauuuuuaggccaguuuucauacagugcaugcuagcuacaaacuuaaaaucuuccugcuuccaccucccaaaugcucguuugcagguuugcacugcccacacugagcuucuguccacguauuuucugugacuuuuucuguggaccccucugaaaaccauguaagugaacaguaaaagaaguggcacugugcaaggugugguagcgcacgccuuuaaucccagcacuccggaggcagaggcaggaggauuucugaguucgaggccagccuggucuacaaaguaaguuccaggacagccagggcuauacagagaaacccugucuuggggggaaaaaaaaguggcacuuguuauucugcuaggugucagcccgcaugcucuauaagaccugagaguaaguacucugggcuuggcaggccauguugucucauaacugccuaacccugucuuuauagcauaaaaacagccauaguuacugaauaaacaaaugaaugugacuguguuucaauaaaauuuuauuuguaaaaaaaaauaaaauaaaauaaaacaggcua

SEQ ID NO: 9828 - RNA, 12569 nt, Mus musculus
cccugcuccguagcucaucccuacacugcccgccgcccgccgccugcuccgcccgcuccggccgcucggcccgcucggccggcucagccuaaccgcccaggcuuuggcccuccgugacgccugcgcgcucuuaggcgagcagucccggccacgucucgcgagagcauagccucagaucucgcgagagugauuuugggacucccaggcugaggcucccgagcgcagauuaaagaggcggccgguucucaucucggcuccucccuacaggugagcucuggagggaagcaggcggcgggcguuccggguccgcgggggcauccaggccucccgugaugcgaacaguggucuucuaccucuacccagcccugacucgggacagcacgcccagccccccggcgccgaguaauccccguucuccuaguugguauagccuccguguccccuuggaggggaccuccgcgcacugggacggaggcuuggcguucuccaggucgcuaacgcagugcaucuucauugcaaugccauugcccuuugcagccgguuuacuguagaaagcggucucgggcaucguagguugaccgcauccuuggucaguuuccauuaaaugccagugguacccuaccucgcccuccagacuuugacagaugcucucaaagagggcaaaagcgcaucuccuugagaagcacggagcuucauuuuauagaaaagccccacuaguuuugcugaucuguggggcaaguugaauuuacagcugucaggagcaaguuucugaaagguuccuccauagagagauuugcuauaaauauggacggcuuugaacuggggugcaugcguuuuaucuuguguuugccuguuaacuaaaauguuuaacuuguaaggauuucuaaauucauccugcucuugcacuaguagucuuccaccauugcaccauaugaauuuuuagcuuccugguaacuucagaugucagcccugggcuuggccuuuacagcaguuuagaauaagccugucaagucuagaguuaaaaaaaaauacuugaucuuguguauguacugcacucccucaaacccauaccagacaugaauaauugaucauagccauucgaccacacuguuucucagcaccaacuccugacagccauaccagacaugaauaauuaauugaucacagccuuucacugcugaccacacaguuucucagcaccagcuccuggcagccauaccagcaaagcagauuuugcucauaaggaaccacgagcuaucccuagucaaaucccuuuccuacuagacauuauauuucaagaauauacuaaacacccaccacagaacacuucauccucacuuagcuuaaaacacccucgacuggcuccuucaguugcucuuauuuuguuuuguuuucagaccauucauugucuaaguccccacccaccccccugcucccaacauauuguuuaaagguauccaucauuugaaauuaugauuuccagaacuaaguauuuucacaggagauguaaugaggaugacagcagcacuuuccacaccuuguuugggcacugucuucacucaguuuuugguuguuuuguacuuuuagauuuauuuuagagguguguguguguguguguguguguguguguguaaugaguacagguacccacagaguccagaagaaggcauuagaucccauagagcuggaguuacaagcaauugugagcugccugauguaggagcugggauugaacuuguguccucugcaagagcaguauguucucuuaacugcugcacaaucuuuuugccccagcggucuuaaucuuuauucagccuagaauucuuuagcuuuucuuucuugacaugucaggcugcugcugccucacugagcaauaaauccaaacuuuucgauucucauuucuuuuucucuaggguucucuccuuuuguuguacaguugguuuguuguuacugguuuuaguuuuuugaggcagagucucauacuguggccuagcuggaccaacucauaauuguucucuuguuuuagccucccuagugcuggguuuaaagaugugaaccacuguagcuggcuucugcugauuuuaaaacucaaguacaagacuauauauaucucagucucuuauaucuuaauaauuuuaugcaacacugguagacuuacaggucccauggugucuuuccuguuaccccauuuugaggcagggucucccuuuauauagucuuggcugucccuggucuuauaugcaagccaugcugucugaaccucacaaagauccaucugcuuccccgucacaagugcuggaaucaaagauguauagcagcagaccuagcccuggagaugauuuuuauuccucacuuuggucugcuaggaaacucuuaauaguuaccuuguauuugaaugugauaaguugucuuuaaguuacugaguuaguaccagccaugauagcacagaccuacaauccacgcacucaggaggcuaaaacaagaggaucaugagaucaaagccagccugggcaacauagcaagaccaugucucaaaacaaaacauauacacauacacacacaugcacauacacuccaggaaaagaaaaaacacucagauguuucuggguauuaauuuuaagucagcuuuagguugccccuuauucagcaaauaacgaguguuggcuggaucacuggcacugucagaacccuggggauauuauacagaacagaacagugugucuauuaucuuuggggacuucuuucugucacccagguuauaggucucuagugugcuccuacauagauaccaaaauacccagaaaauuuacuguccaccuaccacauuuccuuuucagagcagaaaagugaaguuugauguaguuuguucuuaguauaaguagagaauuaaaugaauaauaaccuggaugugauguuagucgugguuucuuaacuuauacugaaugagcuacuguacagaaaacaaaaaaagguccugacaugcuaucugaccaaaaucggccagguaacaccuacuuagguugguguuuuagucucgugaauauaccccgucauagaugagaagauauccuuuuaucuguuucugaaaauuggaauagcauuaccugucucuuagcauauagaaccuuucugugccuaugauuucuuuaaugucacuuaacaguagauggagaguuguugauccaagcuauauaauuggccaggaccugaagacuuuuuugaauugaaaugcuuaggaaguuuucuaauaucuaacaugcagucuugaaauuugcauccugcaccgccugccugccccgcugcugggaaguuaugcuuuguauguaacagggagaauggaaauuaagcagauuugcaucuuuuguuauuuccguguauguccagugcuggaagcccuucuuuuccuaauggucacaaccuagaagcauuggcuuuucuuccauaguuuguacacuuaaguucuccuuuaauuuugcucuuuucguggagccuggcuagcuuugagcuuaggaccugccugcccuagcuuccguggugcuaggauagcaugucugcuuuaaucuguguauuuggggaucagcuaauaagcaccuauuuuauccauagggacuguaacauuuucaaaaguuguagagauuaagaugcuuaguggcuucuauauuagauaguaugguuauagagcaugccuaucuuggcagaaaguuuacuagcguggacaacaaaaguguggagcaccuuugcccagugcccagcaugagguaagccuaagaacagcagcuaagucuaaaugcugcauacguucucuuacauaugagagcuagguugaaaaacauuugcaaauaaaagaagaaguggggacuguuugagagagguaaggagggaguaacaagaaggugguaaggaaauggagaugaccaaagugggucucagugacugugugaagugcuuucuguuuggauggaugaagauggccugggaaagccaguguuuaugcaguaaguaaguacuaaggggaaaaagcucugucucacgccuaguugaguagcuuguaagagaacccuuuccuauucuauuuaaugguauccuuagacaagacacuucuauaccauuugcacaucccauaaaggaacuguggggcaugauguggguuaucuuuuugugccugcauuuccuucugcugucugggggcucccuccuaugcgauuguggcuauuugugccgaacaaaguaaauccuucccuuggcauacugcagcccuuuauagcaggaauucaugauaucauugcuuaguugcuucaaacuucaaguucucuuuccuuuccuuuucucugugacuacugcaaaggcuuccuagccaugcauaguuuucuaucauuccuacuuauccuuguuauccacuuuuaauauuggauccuuuuucuugucuuucuccuaaagcuaacagcuuguucuggaaaggacuaaaugguaaauaauuucgggcucuaugcuagguagucucuguugucagugcucagcucuuccauugaaggaugaaagcagguuuuagacaauaguaguagggugcaugagguuaaguuuuggccugcagucugcaagugugggcuccuuccugcccuagauaauguucuaaacacuucuuugugccaaaaagugucucacguuugucuuccacaauuauagacuuccauuuugaaaugugcuaacuuugccuugcuuuucuucauuagggaacacauucccaauuucuuugguuaucauugauuuuucugugaaucagcagacgaccuaggggggcuugguaagcuguggucuuucauggcuucagauguccaggaggcuaacuagacaguccaguugccuagauucugauacaauacugaggaguuagcugugucauguauucuuccauguuauucuagauaacacuuaaucaagcacucacugucagccagacacccuuuguuagauuucuaugcuuuacauauguuagguuauguaguaagccuccuacacaucaguaaagucgcuccaguguugccacuguuguauagaugaggaaacagacagggugauuaaacuggaaccuauggucacaagugagacccagaaccuggcuuugucuaaauccaaagcucuuguauauacauacuaaaauccaccccaucuaccaagcagcuuucugaucauuucuguugaagcccguggaauaggguuggugcagucaaggcacuugccaccgagccugacaaccuaggucugauccuuagggcucacauggaagcaagagguaacugaucuucauggugcaugcagauacaccuacucacccagcacacacacacacacacacacacacacacacaccacacacauacauguaaaacuguggaauacuuaguuucugccuaccuuacccaaauuucucucauuuuuguuguuguuuauuuuuauuuugagacagucucuauuauauagcuguggcugccucagaacuugcuauauagaccagacuggacuggaagucauagaaauccaccugccucugcuucccagaugcugggauuaaagacuugucuauuaugccugucaggcuuuuauaauaaauuaguguauguagagacauaucauaggcccuuguauuuucagagauuuaaauuuguagcauacauccuucugauagaaagaagacaaaaaacauuguauaaccuguggacaaauauuuuauuacauugucucucuuguguagaaaugauuugugguaaagcuggcuuuuagcuucuuuugaggguaccuccagaacacuucugagacaagcuaauuauguccuuugcuuuuucuacuguuuaaccaacaaccucuauuagucucuccaggugcuaaugggaacacuuaacaguauaguccaacuuaagcccaacguacuccaucagaugaagggacccuugagcuaaauguuuacauuuucagucaugaaaauaacaucuuuaugauauacuauaagaggauauaguacauuggguucuaaaggacauaucauagauauuuaauggguagaguccaaaagucauaugccuaugauaguauacuacaaagcagacccuauugccaaauuuaaauaggaaaauuagaauucuguacuucauguuaaucauuuuggaccuuaguauugauuaaaaguguguguaucuguugguuuguuuguuuaauuugauuaggagcuguguauugaagacaaugucugggagcuucuacuucguaauuguuggccaccaugauaauccaguuuuugaaauggaauuuuugccaccugggaaagcagaauccaaaguauguaugcaaccuuaaauuuuuuuuguuuuguuuuguuuuuguuuuuucaagacaggguuucucuguauagcccuggcuguccuggaacucacucuguagaccaggcugaccucgaacucagaaauccgccugccucugccucccaagugcugggauuaaaggcaccacuaccuggugcaaccuuaauuuuuuuuuuaauuaguuguuuuuauuuuaaagauuuauuuauuuauuuuauguauaugaguaaaccaucauugcucucuuuagacacaccagaagaaggcaucagaccccauuacagaugguuaugagccaccauguguuugcugggaauugaacucaggaccucuggaagagcagucugugcucugugcucuuaaccacugagccauuucuccagcccacaaccuuaaauuaauaagacuuuguaugucauuuuaauggcaugucauaauaguauuuucgaaaugaaauggaucaggauaaauaaaacaacugagauauagcaacaauuaaauuagauuuuaucuggaguuccauagacugauagaaaacagguaaggaaggaaugucaccaacuaugaaaggcuucuuaagcauauggaaauuguagccuaccuaucaugggccugggacaauuuuuguugccucaaaaugccauaguaguccauugugcuucagcaaaucauauuuuucaucagagcagacauagaucaguuugcaccugaggguuaaaagaaccuuacucccauguugucauccugucaucaggacuauagcaauuuauuucuguggcuuuuccagcacugcuuaaauuguuucuaucuuacugacagccaggccacaucaggaaauucuaaaagcaacagcagagguacugcuuucuuguuaucuaacuugucuugguauuaguucuuucucuggcuaccacucacuuuaaagcauuuccacaguaugugccuaauuccucaagagugaucaucgguguauaggaaggaaaaacugcuuaagagacggacacggcauauagccauuucucuaaggauucaggaauccucugaauggcauggcagcauuaggaaugcaaacauacuuuaacuguauaaggguuccuggguaacuggugaccuuccaccagccucauucugggaacaaccuccccaguaaaaagguuaugcuagugguugucauagcaaaguaucaaaacuugaguggcauagaacagaaaugcacuguagcaguuuuaagagcaaaugucugaaauuaauaccuuggcaaggccucacuccuaugaaaagguaguucucuuggccuguagcaacuuaguuccuguauucugguagccagaugucccauuuaauuuuucguuguggaggaugucagaguuucacuuuguagcccugacucucuuggaguucacgagauggcccaggauggccuccaggucauaaauccucucuguucuaaaacaccuuagugccaggguuacagguaugaggcaccgcacaccacagcaaccuuuuuuucuaaggacagcaaguucacuggauuagaggcccgcucuacuccagagugaccuugacuaacuccaucuucagugacccucuuucuaaagccacauucggaggaccaugugaguuuugagaaggacucuauauacuaguguucccaaccuuccuaaugcugcgacgguuuaauacaguuccuuguguuguagugacuccucaaccauaaacuuauuucauugcuaccuuauaacucugauuuuccuacuauuuaugaauaguaauuuaaauaucugauacagauggucuuagcugaccccugggaaaagguuuuucaaccuccaaagggguugccacccguaguuugagaaccacugcuauauaccauauagaaucucuuccauagcaggcaguuuuugaaaaacacauugagaaagagaauuccacaggaguaagacuucauccaggucaugaauuuacucucuauauuauaguaagucacucuugccuucuuuucaguuaggccaucuugcccaugaagaggacacccacaguucugaccagauuguuucugcuguuaauagagaugacaguucaaaccugggcuaagcaugaccuccuuccccaucccaggucccaaaaccauguacagcucuguucugcaagaggccuaucauaggucuucaccagggccaccacuacuaucucugcagcuucuguucaggaagccuggcugucccuuuugccuccaggccuugaggcccuauguacauggcaucccuuuguuucucuccuugauuucuacuuugguccccaccuagggaaagugcucucuuugguccacaucugcuugcacacuguguguuugucuucuaguaagacagggacuucuggaaaguaggaucugccuuauuuccuccauuaaaaguaauagucuucuucauaugaugaaauaguuguagaaaguuaguaacugccuucuaccagcauuggaaauauguuuaauaguuucuugaagacauuuauuuauuaauugguguuccuguuugugagugauagcaauaauauuuuaaauaccauaaucuuuuaugucuuaugauaauaauacaugaaauaaaugcaaagagucuuccccuaagaaaaacauguauggaguuuacagaaugaaaaccaggcaugcugguacucaccuguaguccuaacaccugggaggcugaggcagggucaggagcucaagagcauucuaggcuacauaguaaggccauaucuaaaauaagagaaacacaauacacacaaauugacggacuuuagaaugcauugcuggugguccuggcgcuguauggaaauguucaucuuucuucauuuguucuuuaggaugaucaccgucaucugaaccaguuuauagcucaugcugcucuugaccuuguggacgaaaauauguggcuuucgaacaacauguacuuaaaaacgguggacaaauuuaaugagugguuuguaucagccuuugucacugcagggcauauccuuaccuuaugguaguuugcuuucuguugcuguuauaaacacugugacuaaaaccaacuucaggaagaaaaggguuagcuuacacuucccaaguccauuauugagggaaaucugggcaggagcuuaagcagaaacugaaguagagaccacagaggaauacuguauagugggcccaccugccuauggaugguacugccgucaauaagcuuggcccuccuacaacuucaaaaggucaagcuaacacaaucucuuuucauuuauaaggcuuaaaaaaaaaacaugguguuuagagguggggggaggcgcuggagagauggcucggagauuaagagcacugacugcucuuccagagguccugaguucaaaucccagccaucuguaaugggauccaaugccuucuucuggugugucugaagacaguaacaguguacucacauacauuaacauacauacauacauacauacauacauaguuuuggggggguaucugaaccauagcaaaaucuauuuuccuuaaagucuguuuuacauucuccuuaaaauaaagcuaaguugauuuuaggcaguuuauguauugagcuuugccgucacacagcgcaguugacgugacaaaugucaaggcucucuuagcagauagagagcugcuuuaacugcuucauuucuagaaagaccacgccuuaacucucugcacauaugagauuuauuaugcuucaugaugugaggcaagaagaugggauaaagaacuucuuuacugaugucuaugaucuguauauaaagguacaguauacccuaaaaugaaaauacuuaauguuuccaaaggauagggcaggaaauagaggccaaauuaagauauaaaaagucaguuucgcuuaucauugggaauuucaucuuaguguuuucucacauguuaugaagccccuauauuaaccaaggaacugaugugguuuagcuuuauguuaaaguaaaggauuuaaacccuaaauuaaaagaaguauagggcacaguggcaaugucuguauaccagcacuuggcagaagcuugaguuugaggccagccaagcuacacaagaguuuugggagggguugggguuggaaaugacagcaacaguauugcauaacuuuuuuaaaaauggaacauaugagacauuuauguuuuacuguuuguuuacauaauccaaagggacauauagauuaauccauuuguaaugaauacaaaguagauucaagguccauguuaauguauauaggccauaucagacauacuaucguaagguuagcugcaggaacuucucagaacuaaaauacugaauuccuaagaggagccagguaaggagaugcaugccuaugaucccagcauuugggagguagaauaggaaacucaggauugcaaagccagucucagauaaaagguaaguuuaaggcagcuuuggccugcacaagaggcuaucagauaagcaggugugguagcuuacaccugaauuuuaaggcuuaggagacugaaggacuacagugaauuuaaggcuaguuagguuacagaguucaaggucaggcuagggaacagaaugagaaccugccucccagggggaggcgggagacguuuuuguuguuuauuuuuuuaaagauucuuguugcauuuuuuauuugucuauuuguggggcugggaggcucaggagggguaacacaugccaugguguacuacagccuguaggaaucaguucucuccuacuauguggguucuggagauggacgucugcuugucaaguuggcuuuaggcacugggccuguuaauuuuuugagauagucucauguagcccagccuagucaugaacucacugugcagcuaaagcuaggcuugaauuccugguccuccugaagcucccaaguucagaaauugcaccuggcuaagcuguuacaaugggcauccuucuuugugaagcccacacagaugcccuagauaugccuuacuuccugggugucucuuucucuauaacucucaugauuacacucuauaaauuccuuuuugaaauccuguucugcuucaucaaaaaaaaaaaaaagagcaaucuagcacuuucagugaaaauuaaaaaugggauucagacucuuugcuaaauuuuaagaugggaauuuccuuuagcaaccugcgauuuaucaaucacuuuccuuugauaggcucacuaauaacccuuuucuucccuaguuugcaaugaauccauuuuaugaacccaauucucccauucgaucgagugcauucgacaggaaaguccaguuucuugggaagaaacaccuuuuaagcuaaaugagaacaacucggaaaucagcugucucaucguggguaucaggaaggugugcucuguaaaucauucgaaauugccuggaaaacauccccuuaaaauuguacuuuguuuucauguugacuaucagcauuaauauuggcuugugaacugugauauguauaaacaacucuuuaccaguaguucugaacaguuuuauuuaaaaacuugagaaaacuuuucuugccgaagauaauaugaucuuaauuuauuaauucaaaagcauaugucauaguuaauauuuguuagauugauuaaagacugaaaaguucuggagacaugacugaaaugaguuauuuauacauuuagagauguccuuuuaaaaugcauaauacacugcaguaccaagaagcugaagcagaaagcccaugccaaguguuccaugcuugccuaccucugccagaggcugagaauaaccguccugcuguaacucuagacccccuagaucuauguaugcugcaccaguuacaggccuuggcaaaauguggugccucugucaccuuacauucuaguguuuccuuucucuuaguaaacuagagguuuauuugaauuuauuaguaucuguacuuggaaaauguuauaauauggauuuaguauuacuaauaaaagccuggguuacacugacauuugcacuuuaccuuuaugcuauauacagggugggagguggcagauguggccucuuguauuagaaauguugguuugauuuuacaguaguacauauguauggaaaagcaaaccagauuuucauguacacacuggaaaauuucucuccauucuaacuuuugaguaaguacuucuaaacuuucuuguauucuuuggugaaguuaucaucacucuuuuuuuuauuucuuaaauaaauauuuauauccaag

SEQ ID NO: 9829 - RNA, 22618 nt, Mus musculus
gcuccuggccuggugcuaccgccacaggccccuccccgcagcuccuggccccgcccuaaagacuuaggucccgccccugacccgggucugguuuuaccacuccagacccugccucacugccucaggccccgccccgucgccccacugucaaggccucgccccuccgucuuggccccgccccggccgcccgccauauugguucuucugccccagucgcucccucuuggaagcgcucucgacguuccggagucucuggccuucuuccugcccugguugcacccaggcguguuggcgagccgcccccaggacguccagugugugucugcaaggugagcgggggucauccuuccauuugagguccggccagagcugguuaagagcgcgcguagccugagcugagcugcuggagcggagggccgccggggcggcgggcgagccaaauuggcgcgggucaguagauugcugggcaacagggguaguuagcuuguccccaagucuccugaaaauuccuacgucaguaggaagaaagacggguuuucacauucaagcacgggaagaagaucacacacccaaccacucgggacauacacgcgcgcgcgcacacacaaacacauacacgcagaccgaccgaucggccuuacuagagaggaagagauaucccuuccaaaaacaucaucucaggaaagagauauaccccaaauacuugggaauaggaugguggaacgaugcucacgggaccaaugacauuaccuggguacacacuuacacauuagucuuuccccuaaccacacggggacacccacauacucgagaccaaaccuugcgccacagugacugacuaaugcuggggaaagcaagcuuguguuauuugaguuuggcgaccucugacauacuacccuuugacccacucaggugagagagcuuggaagauaaagccagggcaaagaccuuguaggcgguugggaacaucgucagauaucagaucuuggccgagguuucaaaaucgcguuccuuucuuccuuccaucuuagugaaaagaccagaggagacuuuuaaguacugaccaaaugguuggugaacguauuaugguucuguuuuguuuuguaaaugaugacacaucccgugaucauacuucuuuugaggaauaacuucugcaaguuuccaaauuggcacgugaccagucuuuucacagcguccucauaaaaucaacagacugaauuugguuuuuguuuuguuuugcugguacaaguuuugucuuuuuccuugcuagcaccacugcaauggaaaaucccuacacugccugaaaucucaacuagaauugaaggaaacccagggcuuucaacuaaggacuauuuaccuuuuucuuuucguucuuuuucuuccauugcuggagcccaaaccuagggucuugugcuuggcuaagaaagagcuguaccccugugcaaaauucccaacuccugucucagcuaagggacuuaaguacccugcuuuuacuuugucuuuuauuuuuauuuauuuuuauuuuuuuaaaaccuuaauagguuuuuuuaaaaaagauuuauuuaucauuguacauaaauucacuguagcugacuucagacacaccagaagagggcaucagaucucauuaugggugguugugagccaccaugugguugcugggauuugaacucaggacuuuuggaagagcagucagugcuuuuacccgcugagccaucucaccagcccuacuuugucuuuuauaaucuuaggucaaaguuaucacuacuuguguagcacuccaaguaacuuaauacauucgagugucguguuuucaugucgugcauggcagugucuucuugcuuuugggguucuucgugugcuuuguaguguuuugcuguacugaaacauuuauggcauggaggcuuacuuauuuagaacauugggggaauuuaaggauauuuguguuuuauuuucuggaagguuaaaguagacaagcaaaaaucagagcaucuauuguuggagaguaggaaaauacauuugugguggucucucuuuucuagccugauccuuuuacauuuccccuguccaacuacuuccauuuuauccuauaguacucugaaggcccgaaguucucuuaguaauagcaauuucuuuuuucuagccucccucaggauuuuuucccaauugggaagcccuacuccggcucacaugagcggauucuguuugagucaguacucugugcacccuuucguuuuuccugguguuuccaaagcagugguucuguuacagaugagaaauuugcugguacccgggaggguuagauuucguuuccaaggucaccuagggagugagggagcaguguugaaauucaaacauguuugugggcuuuuuggaguaguaguuuugcacugggaggcaauuuuauccucucaggggauauuugaaaaaauuuggagaaaaagcauuuuugguucauauuccaggucccacugggcuucuguaguucuuuaaguacaaugucauuuuacuguuuaagacagcauuuuuauuauuuuaaaagcuugcugggggaaaauucucuaagguuuaugacuaccugguaacagaaucuauuuuuuuuuuuuaaagcuugccucagcauugcugcuaugaaaaggcuggcauugaauuccugauuuugggguuacagggauguguuaccacacagaguuucagaaaauuuuuuuuuuaaagacaaaaaugacaaaaaguuuugagcuacuaggcagcucugcaguugacuuaggaaguuugucuuuucguucuucucauccacagguugcuuucguggggcacugguccagaggugcugcccggaagcugcugcuacuucuuugaagcuggcagucuagucgaaaucuuaagaccagguucuuacaugguccuacaucacaauuuauuguuuggacuacuuggcagcagaggucaggugucauuuaaugaaagaacacauccucacauagcacacaaguacaugugucgugacauuuuuuuuuucuggacacacuuagguggggugaagaacaguuguuggguucguuaaagcuuuguaguacaguugaauugggcaugugugccuuuuuauuuaucuacaucuauuucuuuauuuuguuuuuuccgaaacagguuuucucuguuguggcccuggcaguucuggaagucacccuagaccaggcugaccucaaacucccugagaucuucuugccucugccuccugagugcugggauuaaaggcauaugucaccccucccuggucgaguuuuuaaauauaguauauuaauauaauagggucucacuaugguuucagcugccuguggaccaggaggcugccuacaauucauaauccaacugaguccuucugccagugcucuugacucuugagccauuucuccagccuauguaauuuucguguugguguuuuucggccucuuuuuaccaugcuugucugagaccaggugucaguuauuacugguaggugaguguuuggcaugggggauggguguguguuaucaaaaaguguugaaacuccucaggauuuccugggaaaauucccauagucaguagguugguugguuugcgggugugauuauauuguguaagguauauaugcacauguguauuuagaggccaaagaaggauggggaguguccaguucuauauuccaccuguauugccuugagacaguuucucacugagccuggagcuaggcugguggucaauaagcuguagcaauccucccaucuccauucucugcuaaauugcuggagugaccgguguuucugggacuauagcuagcuuuuucuugucaguucuggggauucaaacucagggucuuuuugccuguaaagcaaacuuucuuauccauggagccaucucccuggcucugugucuuuggauuuugacccugccauugcacaguguuguucuuugcuaaugaauauagauuucucuaccucuaaccagaugcucuguucuauaguguguguggugguggggacacuggaugcugaauuucauaucauaccagauugcuagcacaugaagucuaacaaagguacggguuguuuuguuuuuuguuuuuuguuuuuuuuguuauuugugacaucucucuccaccaccuccaaaggucaugaggacuuggugccagggagucuugcucagucauuacuugucuugcugcucuaguguaguuaggucaccacauuucuuucuuuguagaaagauacacuacuuaaugucugcaagaguauauguaucaggugagacagcaaaucauuaacugccacguaauucugcccugggcaguuuguugguuaagcagcaggaggaaauaagccaauuagaaguggugcccagugagguuaaguugaaagcugaguagauaauaaaagcuagauaguauaagaaaauaggguuugugacuaccaggccauccacugaggccauguauuaaaggguugaugggaaaggaggagcugaagucagaaaaugccucagggaguuuggugggaaauuuggaagcaaaugaaaggucagguacugaggccggacaccuggagccaacuagguaugucuguagguguaguugggugucaggccuguggcacucccaaccugcuuugcuucaggguggcuuggcugguuagauaacuuggaggaaaaaucuguuuccuaaugugacucuugguacuguacauacuggguuguguucugguuauuuccacauucuggauuuuuccauuaccuuuuguucauuuuugaccgugaugauuucaagcuguagaaugucaguugcauuggaaacacagacaagacauggagauguagucugguugucaagucagggcuauaugagguggagggaguguguuucagaaaauguguacaagugaagcaggcaggccuggcuucauacuccauggacaggaguucccuuuugucugaggcgaaggcaucgugguugccauuguguugacgggggaugaggacaguguggaaggaaggacuccacacauucauuccaugaccgauuuuuuuguuuuaaaucuaaagaguaaagaaagaguagcagaaucguauauaaggaagggcucagguucuggugguuuggauuaggugucggguacagagguuaggauagccuuuaggaggcugucucucagaagcagcuguguuagcagaguuagcgaaaugugaaaaugccucacauuuauuucaacaucucacugaggagaacgcuuaacagauaggaguguuggaugauucuaacagguccaaaaaggccaggcuuaaauacaauuugaaaaauaguuguuuuggagcagcagacagcugccauccuuaaaaucugcauuuaauuuuuccucugugaucuugggcaaagucaucuuuacaaaguuaagucaccagaaggaaugugugcaaugcaguguugaaauugugaacucccuugagcaugguaccauacagaugccagcaucucugcucccuuuaaacauuguaagcagccugcccuagccacaguuucugaaccauaggauucgaagguguuuuccuuccauuaguguuuauagaguuaagaguucagugguaaggaaacaaggccuuacuguugguuuuaguuccccaccacucccuguaagucagucuguaaacuuuccccugggcuugcaguuggggauugcugagacuugguugcugagcugggagcagaggcugcacaggcucuccaucccuacuuugcuaccuuuucuccccacuacuuacuauaugcacuuguucaggaaguaggugugcagcgcuaggagggugccuuuucuuucccagagugcuccaacugguagccuuuaucugucuuggugguuggaaaaagugcuggagagcuaggcagggcuuguucaguucuguggccaaguuuccuuguuaguuucuucuugaguuucacaguuacacaacuagcguuaucuuuauaguuucuaaguuuuuuuguuguuacuuuugagacagggcuuuucuguguaacagagcucugacuguugcauuguagaccaggauggccuugaacucacaucacagagauugcugggaacagagguguguaccacuaugacuggcaaguuuuggugcugauuugcauuuaaaauagguuuuuuuguguguguguuugugucuuuucugauuuuguaccuuuauuuauuuauuucuuuauuuauuuuguuacuuggugggagugagacuuuugacuuuccauguuuaguuaggccuggggaugguauuuaaucuuuguuagcuuucaucuguugagcucugaagcaugggggauagugucugaucugccagugguuuuaaggggcugugucuuagauauuguaaugguuaauguugucaaguugacagaauguagaaucauuuaaaaaaugggcuucuggacauuucugcauaacuaaggugggagggguccccugccccacuugaauagcuccauuuacuuauuuauuuauuuauuuauuuauuuucugguugggauccugaacugaauaaauggagaaagggaaucuuuugcuccugauuaugauacaauaugaccagccuuuucagguuuuuguugccuugacuccccuacugugguggugaacugucuccccuugucaauuuguaauuuguaaagucuuuuccuuaaguucauuugucagagugcuuaucacaacaacacaaaaagaaacuaagacagauacuuaauagauguuauaguaagcagcagcugcuaagauagagcucuagcacuugauauuugacucaauaagccaguggcaacggguugggaaggacauagacauaauucuuaguaugcucgaaucagguauaagucaggagagauggguauuggaaggauaaauagcauucuuugauaaacugaauuugaauauugucauaauaaacggguuggaaauucuuguguggcccugaggugggggcggaugaagguggacuuuaaggaauugcugguauuuauagccagugagacgagguauggacuucaaccucaggagauuaccuucuuugagggauuguuaggaaagggagccaccuggcuaaagaaagaugaggaugugugagagaaagacgagccugcugucaguagucuuacggacuauuuuagggaauauuuucaagagggagagggguuauuucuugcccuguaauacaggccucauugcuguaauaauggggacuuaguccuaagacuugaaggaucccaccuugccucugggcaaaugugugguacuagaaagaaaguuugguaagagagccuccauuuucuucguuguuuucuauaauaugugauuaugcuucugcaguucuguguacaucuucaaggaauuugcuauuauugccacagauggaaggacuggucagauuaaaaaaaacaacaggaaaccaaaaccuucauucuuucuguucaucacuuuaggucucuguauaccugaaggcucucaugugagcagggagaagauacuggauuggcuaguggucauuuugaugaccugcugauguuucagggaauggaggaguauaauucuagagaguuaagucuggcaaggaggcagauggggaauuggcagugaaggauaaaguaaguccagguuuucugugagaagaaugcaacccaacaucucaguaggacuaaacuggggugcugcuuauggacaggugucacuugcauccaguaaagagaacuuugugaagcgcuacuugcaguaucugccauuggauuggagacaaccgcucucuauguagaacggaauugccaagccucuaauauaauugagucuuaaaacaacugcucuuucccugccccucuauuauauaucauuagucagcgaucaagagugggcucaugcucuaagucucucggugucaaagcucagguacaguguuuuagaaggcaaaaucacaaaguccauaacucaaaguuagaugagggucuggcagagcuuagugcuuauuucagacauagcaugacaauuguuuuuugcuuacagcuucuucaguuaguuuaguuuacauuaauucuuuuauuccaagacaugggaggcagagguaggcaaaucucucgaguuucagaucagccuggucuacaguuccaugccaaccaaagcuacauagugacccccugucuuaaaaagaaaguacuguaaauuaaaaacugcagauuaagugcccuuuacagguagauuuaugcuugcaccucacaaagaacaaaacuguauauccccacuucagcgguuucucaugaguagagguguucacugaaccuaucacaguuuauggccaaacguuaauacacaaaagacuccugagugaugggagaaggaggaaauagugguacugaauaaagaugaaaagucggaaagguguuaggggacacauaaaaugaucacauguaauguagaaaugagaaacagucaucgauuuuuuuuuuaauuuuuaaaaaaaugaaagcugagucucacuaugaaaccuugggcuguccagaaauucuguguugaccaggcuagccccaacucacagaggugugucuugccucugcuucccaauauguauauuaccaugcccagcuucguugaucauuuuugcgggacuucuaaaaucuucugagacaaugacaagccuuuaaucccagcauucagggaggcacaggcaggcagaucucugaguuuaaggccagccuguuguucuacagggcaaguuccaggacagccagggaaacugucuugagaaagagcaagcaaacaaacaaaaacccagacugaugacagcaguugguuacaugcacaugacaggcaugagacugagcccaucaacauuccagcuuagauggggaaggaacucagaagcaccuaccucucccacccccaaggcugaagagcuuaggcaguuaaugguugcuggaggaaggagagccacauuuuccugguaauuauccuuuccuaaguaaauaaccuauccaugcucauguaggcaauacugaguaaaugaaguaggcuucagaaaggaagggaggaaggaagaggaggcagagaagagaggccaucaggugcgcguggggcacgaucaaagugauacaugcaugugauauaaggguugaaaggaaccuagugaaaccugaggcuggacagagagcucucuugguaaagugcuuaccuuacaggcaugaggaccugaguuugagucuccaacauagucaaaaaugccagcuuuggcaauccaaaacugccaggcauuuguaaucccaacacuagggagcuagagauggaggaucccuggggcucucuggccagucaggcugguuggcuuuaggccauugagaagacccugucucacagagguauauguccuccaagaucguucugugccugcacaucugugugcauccauccauccauccauccaugcauacacgugcaccagacacaaaucugcugaaagugcuucuaaucuuuucaguaugacgcucccacauacagguuccuguuaaacuguuagacucaucugagccuugggauucuagacgguuacgggccucauguccauucaccgugcuguagaccuccauugucugauacaguagccauuaguguuaugaaaugcuuuaauuaaaaugaaguucaaauaaaauucaguuaagcagacuaaccacauuucagacguucauugaccacaugugguucacagagcauuucuagcaacacacaaagcucugaaugaucuauuuaguugcuuaguugacucuuuuguccuucuacuauaccuaacuacuauguucuuuuucaugaaaaaguaauuuuuaaaucaaauuagaugcuucauuuuccagaaagaguacuuaaagugaguuacuuaaauagagugugugcuuugucaaugaucguuugguuuggcuuauuuauggcuugauuuccauagguuguuuucuuguuuuaccuuuucuaucugugaggcauuauuuaguacugcuacuacuaaguccuuaguacuagauagucuauuucaccuagucaaucuugagacuccaaguuggccuguugugguaauuuccuuaguuuuaguuuguuuguggugguuuuguuacuuuuuugguauagagcuagcacccauuagauucccauucauuucuuccuuccuccucuccuccccucccccuucuuuuauccuuucucuuccccuccccucuccuccccuucuuucucuccuccccuccccuucccccucucauucccgccccuuucucucccccucuccuccucuccuucuccuggccucuccucuccccucaccucuuucucuccucuccccucuuccccuucuuuuuauucucucuucccccucuugacuccccuccuucccccuucccuccccuucuuucucuccccucuccucaccuuuccauuuucccuucccauuucucuccccucuccuuccccuccucuacuucuccugccuucucccuucaaucccucuccccucccccucuucccauuagaucucacuauuguaacccaggcuggccuugaacuuguuaucuaccugucuuuaccuucugaguauagggauuuauaggcaugugccaccccuuucccgucuaaagcucagcuucuuaagcuaugcaauuaauugaaaugauagcuaugcgucuaauuaggacauucagggugaaugaacgcaaaaggacuugugaauuuggggagggaaaagaaccuuccuacauuuaaaucaggagggauaaguucaauuagacauuucaggggugagagguuguaagaaguuguaagggaaccggcuggaguauguguuucugaagguuugaggaggcggcucccggaagggagucugcucacccucuagugucuaucucacuaaaggaaugugcuaguguuuaagccuggacgugccaccccuugguaauuucagucaguaguacuaauucucaugagaauuacgagaaucauuuucccauauaucuuaauggauaucaaaaauaguaagaguuuacaugauaaguauagagauagacuaauacaauuacaaaaauaauggggaauguuuuauuuuagcauuugcauuuuaccuugugcagagcauuuuacucaacuuggcagacaaaaauaggacauaugaauugucaucuugggguuucuauugcugugauaaaauaccaugaccauaaacaacuuggguugaaaacuuacucuacccaucacugcccauuuccccaucugcaucgauaccagauuaacucuccguggcgucacuuccguuuacaagucucauggcacgcuccauugcugaagggagucggggcaggaaccuggggacacaagcuggugcaaaagcuuacauacaucucauggcuugcucagccuacuuacccaggaccaccagcacaaggguugcacagccuacagugagcuggguucucccacaucaaucaagaaaacacaccacgagcuugcccacaaggccaaucuaugagggaucauuuugucauuugagguuucccucuuugaaaaugacucuagcuuaugcccgguugauaaaacuagccaccgcaugacuggaugacauagguguuguguuccucccagggaguucacacuguaacagggaaacagguaggcacaugcaacuuggagcauguaagcagaucgaaaugagcgaaggcaagaguauaaggugauugggcuggggcucugauggcugccuuguaccguugugggacagugccucuuggaccaagguuaagcccauguagagaugggaucuacugaaggcccagauagcuuugggugggaguuaguggugaguuguucagauacugggccagccuugggaaguggauagcaggaugugcuccuaacugcugagcccucucuccaaccucccuaggcgcuaaguaauuuccauuugcucagcuaaacuuuuucuuuacuuauuuuuuuaacaaaauuuugcagggcaguggugacaugccagcacuugggaagcagaggcagguagaucucuugugaguuugaggccaaccugauccacagagauacccugucuuacaaaaucauuuuucuucauuuugggagaaguugguuuuagauuuuuuuuuuggacugaaguugacaaucaagaaaaauauggaauauucuuauguguguacuacauguuugugaauagugaauguuuuuaauuagcauuuuuauuagaagacaugguagagauauugaguaguaaagccuggauugcaaguguuaggagcauggcuuaagugguuuaguuagaauuggaaguauuggagaggggugagguuuagcugcauugcuaguggguuuaagaguuaguucgacagauaccaaucaaagggguggggauggguacaagcaacaaaaacaaagggguggggaugggcacaagcaacaaaaaccuucaagucugaugguaaccgucuuacugguaccuaagaccugcugacaccauuggcagugugacagacaucauaagguauccauucuaccucuucuugugaucuuuuucaacucaugcuugguagccaauuacuuuucugggcucuaucucacugaggcuucuacugcugaaggugucccaguggcuuucuucaauccuaggguggaggcagaaauccuuccaguggcuuuugaagacccugacuacauaggauucccuaucuccagucccuguuugcuagugaacuucauucuucaucugucucagggucucccaguugugccagcaucagcguuccauggcagagccuuguauacacggcaguccauuguaucuuucucuucucaggcuuaaccuguugccccgaaccagguaaccucugccuuggagccagauauuggguaaggcugcuuccuaaggacagcgugucacuaaaauugacacgugguuggaacauaccguaacuggaaacagaugugcaggcucucauuaacacaggguaacagccuaguuucccucugguacuggaagauacuuuuuaccuuaccugaagcuuagcaguuaaacuggcuugaguuuauaggaagauguaugcaaaguccugaugguggcuggcaucacauaacugcucugugagauacuggcaggcaaggucuaggcccaacuaagggaaccucacauuuguauacuguaccccugacuuacugggggaaaugguggacagggugccuguuaauauuucaagugguuuuucaacugugaguaguuaguuauacucuguucuaugugccucucauuuuguuugaccugcuacaguugugacuuuaucuaauguuacccucggggaaagacuguguaguuugcauuguuaauguguggcacauaguaggugcuaucuaaaucugcauuggaaagcuacuuuugccuauuuuauaaaacuggaugcuucuauggagauucugagugcagcagacauuuggcucaugauacuuuuuuuuuaauuagguauuuuccucauuuacauuuccaaugcuaucccaaaagucccccauacccauccccccacucucuuacccacccacucccccuuuuuggcccugguguuccccuguacuggggcauauaaaguuugccuguccaaugggccucucuuugcagugauggccgacuaggccaucuuuugauacauaugcagcuagagacaagaguuccgggguacugguugguucauauuguuguuccaccuauacgguugcaguucccuuuaguuccuuggguacuuucucuagcuccuccauugggggcccugugauccauucaauagcugacugugagcauccacuucuguguuugcuaggccccggcauagucucacaagagacagcuauaucuggguccuuucagcaaaaucuugcuaguguaugcaauggugucagcauuuggaggcugauuaugggauggaucccuggauauggcaaucacuagaugguccauccuuucaucacagcuccaaauuuugucucuguaacuccuuccaugggugugguuuguucccaauucuaagaaggggcaaaguguccacacuuuggucuucguucgucuugaguuucauggguuuagcaaauuguaucuuauaucuuggguauccuaaguuucugggcuaauauccacuuaucagugaguacauauugugugaguuccuuugugauuggguuaccucacucaggaugaugcccucaggguccauccauuugccuaggaauuucauaaauucauuuuuuuuaauagcugaguaguacuccauuguguaaauguaccacauuuucuguagccauuccuauguugaggggcaucuggguucuuuccagcuucuggcuguuauaaauaaggaugcuaugaacauaguggagcaaguguccuucuuaccgguugggacaucuucuggauauaugcccaggaaagguauugcgggauccuccgguaguacuauguccaauuuucugagaaaccgccagacugauuuccagagugguuguacaagcuugcaaucccaccaacaauggaggaguguuccucuuucucuacauccucgccagcaucugcugucaccugaauuuuugaucuuagccauucugacuggugugagauggaauuucaggguuguuuugauuugcauuucccugaugauuaaggauguugaacauuuuuucaggugcuucucugccauuugguauuccucaggugagaauucuuuguucaguucugagccccaugauacuuuuaaauacaacacauuggauggggaugugguagagccuuuccuagcaugcaggaagcccuggauuugauucccagcaccuuauaaaacuaggcauggagccgggcaugguggugcacgccuuuaaucccagcacucuggaggcagaggcaggugaauuucugaguuugaggccagccuggucuacaaagugaguuccaggacagccagggcuacacagagaaacccugucucaaaaaaaccaaaaacaaaaaaacaacaaaaaacugggcauggagaugcauaucuauaaucuugacauuucggagguagagacaagaaguuuagaguuugaagcucaucuuuagcuaaguacugaauuugaugccacccugugcuaucugagacacugucuuauagaaaucaacagcaacaaaaccccugagcauucacaggcauacuuuauguuacaugucggcagauuagcuuaguucuguugaauuaacuuguucuuuugcagaucuugguauaaagggagcaaaugaaaaucuuacugcuuccacuagccuauuuccuuuauaaaugcaguaacugcagcaaauucucaaaaacaaaaccaaacaaacaaaaaacccagcaguuuugaaguaccccaguaguugggcuuugguauauuuuuccauauuaauagucucccaagugcugggauuaaaggcauguaccaccacugccugacgaaaagucaugucuuaaauaacuuuuuuauuacuguggggagaaaugacuaagacaacuuauaaaagaaaguacuuauuuggggauuugcuuacaguuucagauggugaguccaugaccgucaugguggggagcaugcagcaggcaggcauggcacuggagcaauagcggagagcuuacaucuugauacaaaagcagagagaaagagagagacagagacacuaacugaaauggcugggcuuuugaaaccuuaaaacccacccuccucccacaaggccaugccuccccaaaccuuaccaaacagcuguaccuacugggacuaagcauucaaacaugugagccugugggggccuguucucauugaaaccacugcagauaaggaacaugagcaaaugucggucacggggcucuauuauuguuagcugcuguuauuuuaugcuuaauccuaagugcaguauuuaaaaaaaaacaaacuuuguuuuaauugauugaauauguaaguuaaggacaucuauauguaaguuucacaaaaauacccuuuaaaacagggugaugggggauguugcuggagagaugggucauuguauaagggccccugcugcucuucucgaagaccugaguugaguuccuagcaccugugucaggugccacacaacugucuauaauucugcugugggccugguggaguuggugggauccaguuccauuuucugccgucugccaucacucacuccccaccccccacauacauaaauaguaaaacaguuuuaaaagguguguguguagccggguggugguggcacacaccuuugaucccagcacucgggaggcagaggcaggugaucucugaguucgaguucagccuggucuacagacugaguuccaggacagccaaggcuauaaagagaaacccuguuucgaaaaaccaaaaaaaaaaaaaaaaaaaaaaaguguguguuuggggugggggagaugaauuggcucuuuaaugaagggauaugcauauaauuuguuguuucuagagguuucugaaauuuaaguauuaaaaaaaauggccauuaaagaaccuguguauaauauugccccuuucagacuucauguugucauuccacagaaagucccugcacucgucuagugagccuggcacuagugaagcaccugugugcaguccuuccaacagccccuuggauguagauacugcugugcauccuguucccauacaguuucaggauauuaaguuccucaccccugggcugugccccuggccugguugguacuaggaacacacuuuuccuggcugccacucucucauucaugcauagaauuugcagggagagccuuaggccugagcaacuggggagccaaggcaaaaaaggcaagucuuuuaggcaugaaugagagucagcagggagcacauguuucuaggaucauuggugccccccucucccucaguuccucugcuuucccuguauuaucuuaguucauugucuggggcgagguucucagccauccaaaguuuggucaaguauaauucccaguauaauuuuauagcugugccuguaugugaauguuaaaaaauugugaucaagauacagaauuugaugaacggcuguuuuuagccugagauagaucauaaauagcacuuagacauuuuuaaauuaaaaauaaagauguaguugcaugcuuuuuaaaaaacauuuaauucuuuuuacacuuaaaaugaugaaaauaggcacaggccuguaauccuagauacucuggagauugagguaggagaauugaaaauucaaggccuggucuggacuacagagcagguucaaggccagcuuuggcaacuuagucccuauuucaaaacuagaagcaaugaaagggcuuggguuauauaauucauugguagagcuugccuagcauacacaaggcguuagguucaaccaguaauauagaagaaaaaucccaacaaauccacaucacuaaugugagccuuuugauuuucuuugcagauaaugaugcuugaacugaacuacuaagguaaggcucaugaccuuuguauuaugcuuuuuaaaauucagauguuuuuauuuguaggauuuagcuguauugaacuugaugaagauuauugcuuuuagauaaucuugccaacuguggaaugucaaaguucgcauauuuauuuuuagcugaauuuuaaaaguaauaugauaggcuuuuuuauuucuuuagcuuaugcuagagauaucucaaagguugaacugccuuuagaaaagaauagaggggcucagugguuaagagguuuugguucccagagcacccauguuauaagcagcucagaacugccuguaacucuagcuccagugacuauaaggcuuucuucaggccucuguggacauccacacaggucacauacacauaucuaaagaaagagaucagggaacauuuuuaugucuauaagcaugcugcgauuauguuaaugaguuggcugaaugaaguuggcuucucguaacuguuaauugggaacuaagaugguuuauauaauuauuuguaauaccauguguacuuguguacaacucuaagguuagaaccuuaugugugguaauaauguuagcaaaagcccauaugcuccaaguaggaauggcuugucugggaggccucagccaauaaaugggcaugucaaaaauauuacguggucuguggaauucacaaaugucaauuuucuuuuaaaaugucacgaaguagaaaaacccacaauuugggacaaaaaggaucaaaauaccaugauaagauaaagcaucucacaauuucuaaaacaguaugggagacaugugggucaugaucuaguuuauaaucugauuuaacaucuuuaaaauucaguaauauauaaugaaugaagccuugugucuguucagguaauuauauuacuugacuuaaaaugauaaauuugauaggcuacacuuauauacaucuguuuuccucucacacagaucauggaacuuugguguuucugucaguuaaaaacugacaagaaaacaguaauggggguuaauagggguugaugggaagggguucccaguagaggcaaugaccaagcugaagagcuuuuaagggcacagcaaugaguuugguuugggaguagaggcuguacuagcugagggagcaauguuacauauauagaaggacauguuuuuauacacacacacacacacacacacacacacacacacacacacacgacugaaagagagcugcauguccaaagugcauccaugacagccugugaaacuuggaaagccugagccgggcaguggugguacacaccuuuaaucccagcacuugggaggcagaggcagaggcaggcggauuucugaguucgaggucagccuggucuacagagugaguuccaggacagccagggcuacacagagaagccuggagcucacugcacaauaaucuacaggcaauucaacagguugggaagugucuauucuugguggcucagugucuuuaagccuuuucuaggcagcucagccacucuuuguuucuucuaagccagugguucucaaccuuccuaauguuguaaucccuuaauacagauccucauguuguggugacucccaagcauacaauucuuuaguugcuacuuuauagcuaauuuugcuguuaugaaucaugcaaauaucugauaugcagguggacuuaggcgaccccugugaggggguagcuccagugcaggagggauuaugacccucaacuugagaaccauugcucucuucuuccaggcagcuggcauaggcugagagucuuauuugcuucuuggcuuguaggagaguaaaauuauauacuuuuggggauggagggacccagugaaucugguuagcuucagggacuuccuaagcuauuuugaguuguuuacuucuugucuuaaugagcuuccugggguguuucaccucuuuguaaaugcuauacuuuuaagauucccuucaaaaugguagguuuaaauuugaaaggcaacggugacacagcauuuguggugggauagccaagucagaguugaguuuuguucuuguagccuggagaauuaaaccauugaguaauuuuaauacuuuugggugaguuucagaugauuccccuauguugaaauacagcacauagggggcacauucugaaaaacguauuauuaccugauuucagugcagugugaacauccugcagggugcuuacguaaaccuaggugggcugguuuagucacuugccagggccucuugauacagcugugaaacuggguaagcagacgauugaggcuugguuuuugguuucaaccuugugcuucccuugccacuaucuccugaaugcugggauuacagacauguaagaccacacccaauucuuaucauuuuuuuauccuguuuuccuacuaacuugauuucucacuaucacugcuguggguucuuaccagaaccuauagguagaaaugcagaauuuauaugauacauaaguuuucaauaauacuggauaccuucacauacauaaggagacaaauaaugucaauugcauugguuauaaaaauucuaguagauaaagcaauuauucuucauuucuuuacuauuuucccacuguggaagucaacaauauccacuuggaugaugaagcuaaugaauaguuuuacuuagaccucuguugucucaguauaguuagaggcuuuuaaaauguggucauuuaaauuggcugaaauuaaauggggucaguauaguucaguggaggaugucuuaaugcuuuguauauacagugcccaaucccuagcaccuaaauuaauaaugaaauguaguuccucccuuagcaacugcucagcggccauauauagccagugagugccauguuggacauuuccaucauuauguaaaaaucucucagacagugccgauguaaaaaacuuugucuuucauaacuuguaauauaaguaaaauagcagcuuguuuuuaaauauugacauuuuagauaauuuagaaaaauagaaaggugaauagaaguuauagagcaaacaggauuuaccuuagauugauaauugguuaaagaugagguuagguuuucuaccugcaagucuuguguauguuugggauuuuuuauaaugaaaguuaaagugucagguagguacagugcuaucacaucagcacgcagaaguagcuagccauuagucauaggugucagaaguaucacccgaacagacuggcuccuauaggggaggaaaguuuuuaaauccugcccuuggacuucuuuaaaggggaugcacaauauauuaauacauuuucacuuaagauugauuucauucuacugcaaacauacagguggcggcaggggaagauggcucacuugcuaaauccccuaagcaugaggaacugaguuagacucccaguaccugugugaaaugccggcuauggaaauguacuuauaaugucagcacuggugaggaugauuguggcuugcuggccaucuagccuagcaaguucaguggagcuuugggugagagaccuaaaacuuccaccauacacccccccccacauacacacacagagacagagacagagacagagagagagagagagagagagagaaaaugagaacaaaugugcauggauggcacauauuugguaaaaguuggagcuaccccaaucguggcugacacugaucugagcaacucagaauagauuucccaaugaagacagugaacuuuguacugugcuugauuuuuuuuuuuuaauuucuuaguuucuuaauuucuuagcuucuggauaccucugacuuuccuacucaauagugccuauauugaaaggaagaaaaaaggccaggaagggaguaucuccagucagugaacuggggauuaaggggcuguuggaaauuguuaaucuuauuauuuaaguagucccuuuauaaauuggaguccgagcucuauguggaucacaccaguauaauggcauguaaugguaccuuuuuauuuuuauuuuuauuuacaggauucgaaaucaaaacuuacauuauuaauaauggcaggaaaaucgucucuuuuuaaaauaauucuucuuggagaugguggaguuggcaagaguucucuuaugaacagauauguaaccaauaaauuugauucccagcucuuccacacaauagguguggaauuuuuaaauaaagaucuggagguggacggacauuuuguuaccaugcagauuugggacacagcuggccaagaacgcuuccgaagccugaggacgccauuuuaccgggguucugacuguugccugcuuacauuuagugucgaugauucacagagcuuccagaauuugagcaacuggaagaaagaguucauauauuacgcagaugugaaagagccugaaagcuuucccuuugugauuuugggcaacaagacugacauaaaagaacggcaggugucuacagaagaagcccaagccuggugcaaggacaacggcgacuauccuuacuuugaaacaagugcaaaagauuccaccaauguugcugcugccuuugaggaggcaguucgaagaauucuggccacggaagauaggucagaacaccugauucagacagacacagucaaucugcaccgaaagcccaagccaaacucaucuugcuguugauggcauuaaagggauaguuggugcauucuaaccaacacacacacacacacacagaaagguggagaaacaaauuaguaugcagaagaguucauuuacuaauaaaauucaguuaacgcauauuguugccucauuagucggugggagaagggacacucacucuggaggaaucuauuuacucaguaauggcacguuccacuuauaaauuguaauuguugucuaauguuucuuuaaauuaaaacauuagugcuaauaagaugaccaagaacugacuuuacuguaauucagacgacaaccuuggcuauucuagaaguacacuuagauuguuuugacccacaaggaaauggaaaauuacuuuuauauguguauauuuuuauguaauuagcauuguauucuuggucuaggaaaguaaauuccuacagcaguacuauuaaagauuaaaaucuaaugcauuucuuua

SEQ ID NO: 9830 - RNA, 21038 nt, Mus musculus
aaugagucugcucgucaucauucaggggccagguccugcaagcccaguucaguugggugcuuuguuuucaaaaagcaucauugauugugggccaauguugcuguucccaaaagacacaaaccaauguaaagucuuugaccuaccauugaggagacccagcccaccaggaggggcaaaacaaaucgauacaaaugacaacaaccaggaccgguuaucaccuccgaagacuuuccacagucuuggcgugggaggccugcucgaugguucucagugcucauugaaaacacacaaaauggaguguauuuuuuuuuauguuauuaaauggcaaucaaauggccuauaagagaucauaaggaaaggaagcaaguuguccuguuggcacauugccugccacauagugggcucuugggaacgcuuggcgacaugaacccaaucagcagcagagcaaggcuaaggacuuggagcucacgggcuuccguucauccuccauguuguccaacaguacaaagcagggaagcagaaggaacccggaaguauggaucagagcuugggagaggagaugguaucucuucccccgggggucucccuuuuuuuuccaguuccccaccccaccaccaccaccacauguaucccucccuuccagcaccuuucuuuagcacuccauuggcacucacuugggggaggccuagaagaagucuguggaaacuuccuucuacacaaacgucuagcugagagggcugccugagauaugaggaaaccaagcaaaccgcagcugcucgccugcaggggcacaaacacagaggccuuuagcugagccuggggccuauuucuggccucacuguuuguccucuuacaaagcauuuaccgcgcgccugccucacuuccuugccccaaaggugaggugcuggcugccuagugacagucuuccauccuggcuuucuggggcaugggacaagaaugaguucgcagaaacaaaugaauguaaaaggaacaaaaccaagcacuuggaugacugugcucuugugagaaggugcagccuggccaccccguuccccuaaguuaagaguacccucacagaauauucaaacacauccauacacagcuuccccaccuccacgaaaaauagaaagcaggucuccaaaauguaauguucugcuccauuuuacaggaaguuagcuauagaguagcugcugaaguuaggagggucuuaaugaggucucgauggcugaauaguggguaucaaagguacauacuagaacggagucugaugcacgguggcccaaggauucauuuacuuuaggauuguuucggagccacagguaccacaagaacugucugccugcccuuuaagagcacaaguuccuuuacuugcaaauaagcaggaagucccccuccuuggguagggccucugggcggugccuuucacuuccuuccaaagguguuuucauccuaaaccccaagcaccagggucaccuucuguuacuuucacaggccuacccaacugccuugggcugggcuucauggaaagugucuugaucaagaaaaauaaagacuaauuuuuaaaugcaagaaaggugaagguaaauguaaaaauaauauuuuacaucaauauaaaaguaauacuguguauuucugguacaaaugguaaguucuauaaauagaaucuccacucccuuuucccaggaucaaacuauuaguaguucuugaaauucucuuguagagagcuggugagcgguguuuagugagcccuggcugccugaguuuggaaccccaagaccugucaacaugguggaaguggagaacugacaccuggaaguaguuguccucuugccuucauaugcucaacacauacacgugugcgcacacacacacacacacacacacacaagcacauaccuguauccaugugugccuucugugucaguguuugugugagcucuugguaugugugcgugcgugcgugugcgugugugcgugcgugugcaugugugcgugugcgugugcgugugcgugugcgugugcgugugcgugugugugugugaaacauaguugcaguaguaaucaucaccauaggaacuccuacauauauggaagcuagagguugaugguugggucacuuccucaguugcugucuauccccacaggcagucucucucugaaccuggagcuuccuuacuggcuagacuggcuguccagcaagcuuccugucucuacccaccccccacccccaguagucaucaggacaauucaaaaacccuggcucccaccaauuuuccaaauccguucugguucuucuuagcuaggauuucccaaaauacugagccuguauagaggggggaauuucaaguugaggcucuccagcuaaaaccaauguugcagaaugggaugccagguucaaggaagaccccuugaauguguaaacacugcaggugggaacaaaagaaaaacuaaggaaaaguaucucccaaccuccucccuucccuccuuuguauugcuucaguaaauggaaugaauccagggccuugugaugugcugcuaugcuggaaagcacucuaccacugaguagagugaguauguaucugcagaccuuguggucuacuuuuaagauaaacaagagcaguuugugcccagcaaacagaggguuaacccagcuguugcuuuuagucucuucuaaagaaguccucaacagucccauugcucuacaauuucuucaggggaaaacgaagccgcauuagaguaguuaccaugaauguacuucguaaauaaauauuuucagagugcuuuuugacacauuucaccuuugaagauuuucccuuuugaagaauccugggaugucagcuuacagcaggauuccuuguaaggugcuaucacaggggugccuucaugcccaugcacaaucucacuaguauuggugcauggcgggagacgauuucaccaccauggagaucauaaugaauccucccauaauucccaggcaccauguaggaaauagagaaguuaaaaguuugggggcugaagagauggaucagugguguucagagcacuuguugcuuuugcagaagucaguucucagcacaaacgugguggcucccauuuuuccuuaaccccagucccggaugauccgacaacuuuuccuaaccuccuucuucaccaggcaccaggcacucauagaauacacauauauacgugcagacaaaacacccucauucauaaaauuaaaaaagagauagaucuuuauagaaaauaaaaaagcaugucucaaacuauuguagcuuuuugugaagaaauuuggcagauaacaccaucaugaagugaucaauguuauuuuuuaauauucucaguaacuaaauaaaccaaaaucacucuacucuugaucguagacaacaagaaggucacaguaucccucaugccugugguauuucugcccccaaagaaaacacacaaauuuaaucaugaggaaacaucuauuaaacaugaaucaaaagaaauuccacacaacagcuguccuauugucaaaaauauuaguaucauggaacaccaagagagcccaaggaaguucuauauuaaaacguaucaacaggauauagcaauuaaauguuugcaugauccugaauuggaagcuagaugagacaaaaacuguuagaaggacauuaucaggcaaaacuugaaugugccuguagauuagaucacaguauuguagcgcagauaauuuccuggugcacauaauuguacuggugucuaugcuguggaaugcuuuuauuguuagucaacaugcaucuagggaugggagguggggugguaaaagauuucauauucacaacuuauuugcaaaugguuuucaaaacaauacacaggcaaguagguacauaaaauggcuggcagaggaaagcagcaaaauauuaaauugggauguucuaggcaaaagggucugcagucauuaauuaucuuugaagcuuuucuguaaguuugaaauuauuucaaaugauuuuguuacauagucugguaauuccaaacaugguuuguguuauaaacaaauaaccaaccaggccucauuaccaaagcaaaccaaaccaguaaaguugcagaaagcaaaggcaaagaagccaagcagcaaaaguggcucaauggguacaggcacuugccauuaagcuugaugaccugaauuugaucccugggauugaagugauggaaggagaggauuaaccuuguggguugcccucugaccuccacacauguacucguguguaugcacccacacguacccaaaauauauacagcaacaguaaaaacgcauacguucuaccuugacaagaaguacuucuaacguauuuucauggccaaucucccuuuccuggugcuuuuagcauuuuugcgcacgagagugauaauucagugugugcucuuuuucaauuaccccucacuauaaaauuuaaaucucuuucacucaacugauuuauauccaguccccaguagguagcacauaaugaccuuuacccagcucaguccccaaugguuguuccucucucuggaaguggaagcaagagaaaccuauacccggaagguccucucugauuugccuccuuuuuaacacucuuuguuauggugauggugguuguugcuuuggaaaauuggauguagcauuuuuuguacaugacauuuuuauauauacauuguguaacaaugaaccauuuugaagcagacagcuguuguuaagugcacuuguuguguuggacaaauauuacuucuaccuaguuuuaaaccauuuuuauuguucccacaguaagccuugaaaccauuacaaggucauuucucauuccucucaacucuuagcuccugguaacuacuaauacacuuauugcuucuggauuuauugaggcuggaugcuuaguguaaauagagucauacaguauguuaucuuuguagauaacuuuuuucacauuucauguuuucaagggucuauguuguaguaugguucaagucuguauccuuuugaguaauacuggaaauugaaccccaggccuuguuacuagagugagcuauaucaccagcccuucaaucauuugagacagagucucacuauauaacccacacuggccccuugaaaucaagacugacuucaaacuugagacccuccuaucuuuacccccugaguacuaggacuauagacauauaccaccaugccuggcaucguaugguagguaauucaaugcuuaacauuugaagacuaagguuaaucuuaaaccaaguugaaucuauuagcugaggugaaauucaggaauuaaugugucuguugaguucaauuguucauuucaucuuuaccaauccauaucauauggacuuggcucuacauugugcauucugguaaguaacuuaaguggucuuuucuugugcuuuccuuuaaaaugaguaggguucauaucuauaauuucugcuuuagaugcaaagacaaaugccacagugaacuacuguagggcaagauaccucccaugggaaguaaguacagcgaugagagaaucagugagguauacagaugcuaggaaaggcccgcucucucacuaaccauauauguccaucaaugucuucacacacguaagcugagagcugcaggucacccuuagacaggaaaaaauaacauagccgaaaggaagagagcuuguaucugcgcacuauacaaacccuagggacagguaauggcugaucuaggucaucagcuucaagcguaauauuagaggcaaacugaaccuuugcauagaggggagaggcugaggcauucugugcacacagguuggcuauuacaauagcacagaauggguggaaggugaggagcccagaaaccuuccauaacuggcaauuugaacggcaaagcaggaugagacaacccaagaaccuccccccaaaccacuggaggucaugagaaguuccuuacucauagacauugaaagaccaggauuuccuggagcuguguguguguauguguuucucugugacuguguguauguaugcauauauguuugcgugugaguguacauauucaugcacacaugcuguaugcuauucacaaaagugggcaggcccagguuagcaaggcuggaccccaacuggaaaggaaaauaaaaaggugaaaaggaugacgaauuucaccaguagugguguuggugucaacagcucuacuaaagcaccucugucccauucugcaugguccccccgccccacauuccucccaaguaggccagaagugaguaaggacacaaaauaaaguucugacagccaggucaaugugugcuuggacuucauuguguuuaacuuaagaggcccauuuucauucuugaguuuucaaacauguguucuacuuuccuaaauaaucuuuuccucaaaucgccaccacuuguggccgugaaccaagaucagaaugcuucugcagcugggcaucauggguggcuguggccaggggcaaaaaggaagaggaaaugaacacaggucccauccuagaaucaggaggacaaguuaauggcaguggggacacguaggacucuauaaucuggaaggguaggauuggcuucauaauguagggggaacucuguaaagaaggaacauguugagccucugcgggaaagcaugaagaauuucaagauggcaacaguuuauuacuaugugucaggcuuuucugagugcaggguccaguccaacacacaggccacagagccccaaacaagcuaauacuuugaucagcauccuucuccacuaugaagcagccgcucacugcuuggcugcuuagacuugguuucuucaucauaaagccagagugcuacuuuuugcuaguaauauggaaauuauacucucucucucucucucucucucucucucucucucucucucuuucucucucucucucucucucucucucucauguguguguguguguguguguguguguguguguguuuaagugucuuauucuuuagguauuaucuaucucguuuuucauuuugguuguuguuauugauauuuuuguuuuguuuuguuuugagcagggucugucucggccuggaacuuguacucuagaguaaggugguuggccaguguacaccaguacucugccugccuccaccucuccaaugcagggauuuuacacaugagcaccgccacaccuggcuuuuuauguggacauugggaauuaaacucagguccucacgcuugcaaggaaagcacaggguuuaaugcaucagcccugggacauguauuucacagaaaagguuugacaagaguguggaugaaguuuagugguagagugcugccuagcaugugugaggcacagggcuggaaucauagcaccaugaggaaaaaauaaaauaaaacaacaacagcaauguaaaacaaaguuuucacacccauagcugagcauggcuuuuaauguauaaucaucuugccuccaaucccaauggcuggaaucucaagcauaugacaccacuauuugcuuauaguauuuauuauuuaauuauuuacauuucaaguaugucuguuauccacauaugugucuguuacccaggaaauccagaagucagaagaaggugucagauccccugggacuggaauuacaauucugagucaccauauggauaguuggaaucaaacccuggccuucuagaaaagcagccaggacucuuaccugcugagcugucucuccaaccaauaucuauauuuugaaguguguuauuuuuuauuuguuuugagguacugagaacuaaaccuaggacuuugcauaugcuaaguauaugcccuaaggacaagcacaguaaguuggcagauuuauagacaaaagauaugucuaugucuauauuucuagcuugucuacacagccagucugaagaccuuaggauguuagacaaacucugcauuucuuuuuuuuuuuuuugauuguauaauuuuuuuuuuauuagguauuuagcucauuuacauuuccaaugcuauaccaaaagucccccuuacccacccacccccacuccccuacccacccacucccccccuuuggcccuggcguuccccuguaccggggcacacaaagucugcguguccaaugggccucucuuuccagugguggccgacuaggccaucuuuugauacauaugcagcuagagucaagagcucagggguacugguuaguucauaauguuguuccaccuauaggguugaagaucccuuuagcuccuuggguacuuucucuagcuccuccauugggagcccugugauccauccauuagcugacugugagcauccacuucuguguuugcuaggccccggcauagucucacaagagacagcuacaucuggguccuuucgauaaaaucuugcuaguauaugcaauggugucagcguuuggaugcugauuaugggguggaucccuggauauggcagucucuacaugguccauccuuucaucucagcuccaaacuuuguuucuguaacuccguccauggguguuuuguucccacuucuaaggaggggcauaguguccacacuucagucuucauuuuucuugaguuucauguguuuaggaaauuguaucuuauaucguggguauccuagguuuugggcuaguauccacuuaucagugaguacauauugugugaguuccuuugugauuguguuaccucacucaggaugaugcucuccagguccauccauuuggcuaggaauuucauaaauucauucuuuuuaauagcugaguaguacuccauuguguagauguaccacauuuucuguauccauuccucuguugaggggcaucuggguucuuuccaguuucuggcuauuauaaauaaggcugcuaugaacauaguggagcauguguccuucuuaccaguuggggcuucuucuggauauaugcccaggagagguauugcuggauccuccgguaguacuauguccaauuuucugaggaaccgccagacugauuuccagagugguuguacaagccugcaaucccaccaacaauggaggaguguuccucuuucuccacauccucgccagcaucugcugucaccugaauuuuugaucuuagccauucucacuggugugagguggaaucucaggguuguuuugauuugcauuucccugaugauuaaggauguugaacauuuuuucaggugcuucucugccauucgguauuccucaggugagaauucuuuguucaguucugagccccauuuuuuaaggggguuauuugauuuucugagguccaccuucuugaguucuuuauauauguuggauauuaguccccuaucugauuuaggauagguaaagauccuuucccagucuguugguggucuuuuugucuuauagacagugucuuuugccuugcagaaacuuuggaguuucauuaggucccauuugucaauucucgaucuuacagcacaagccauugcuguucuguucaggaauuuuuccccugugcccauaucuucaaggcuuuuccccacuuucuccucuauaaguuucagugucucugguuuuaugugaaguuccuugauccacuuagauuugaccuuaguacaaggagauaaguauggaucgauucgcauucuucuacaugauaacaaccaguugugccagcaccaauuguugaaaaugcugucuuucuuccacuggaugguuuuggcucccuugucgaagaucaagugaccauagguguguggguucauuucugggucuucaauucuauuccauugguccacuugucugucucuauaccaguaccaugcaguuuuuaucacaauugcucuguaguaaagcuuuaggucaggcauggugauuccaccagagguucuuuuauccuugagaagaguuuuugcuauccucgguuuuuuguuauuccagaugaauuugcaaauugcuccuucuaauucguugaagaauugaguuggaauuuuaauggggauugcauugaaucuguagauugcuuuuggcaagauagccauuuuuacaauguugguccugccaauccaugagcaugggagaucuuuccaucuucugagaucuucuuuaauuucuuucuucagggacuugaaguuuuuaucauacagaucuuucacuuccuucguuagagucacgccgagauauuuuauauuauuuguggcuauugagaaggguguuguuucccuaauuucuuucucagccuguuuauucuuuguguagagaaaggccauugacuuguuugaguuaauuuuauauccagcuacuucaccgaagcuguuuaucagguuuaggaguucucuguuggaauuuuuagggucacuuauauauacuaucauaucaucugcaaaaagugauauuuugacuuccucuuuuccaauuuguauccccuugaucuccuuuuguugucgaauugcucuggcuaauacuucaaguacuauguugaaaagguagggagaaagugggcagccuugucuagucccugauuuuagugggauugcuuccagcuucucuccauuuacuuugauguuggcuacugguuugcuguagauugcuuuuaucauguuuagguauuggccuugaauuccugaucuuuccagaacuuuuaucaugaauggguguuggaucuugucaaaugcuuuuucugcaucuaacgagaugaucaugugguuuuugucuuugaguuuguuuauauaauggauuacauugauggauuuucguauauuaaaccaucccugcaucccuggaauaaaaccuacuuggucaggauggaugauugcuuuaauguguucuuggauucgguuagcgagaauuuuauuaaggauuuuugcaucgauguucauaagagaaauuggucugaaguucucuaucuuuguuggaucuuucugugguuuagguaucagaguaauaguggcuucauaaaaugaguuggguagaauaccuucuacuucuaucuugugaaaaaguuugugcagaacuggaguuagaucuucuuugaaggucugauagaacucugcacuaaacccgucugguccugggcuuuuuuuggcugggagacuauuaauaacugcuucuauuucuuuaggggauaugggacuguuuagaaggucaacuugauccugauucaacuuugguaccugguaucuguccagaaauuuguccauuucguccagguuuuccaguuuuguugaguauagccuuuuguagaaggaucugaugguguuuuggauuucuucaggaucuguuguuaugucucccuuuucauuucugauuuuguuaauuaggauuuugucccugugcccuuuagugagucuagcuaaggguuuaucuaucuuguugauuuucucaaagaaccaacuccucguuugguuaauucuuugaauaguucuucuuguuuccacuugguugauuucaccccugaguuugauuauuuccugccgucuacuccucuugggugaauuugcuuccuuuuuuucuagagcuuuuagauguguugucaagcugcuaguaugugcucucucccguuuuuucuugaaggcacucauagcuaugaguuucccucuuagaaaugcuuucauugugucccaaagguuuggguacguuguggcuucauuuucauuaaacucuaaaaagucuuuaauuucuuucuuuauuccuuccuugaccaagguaucauugagaagaguguuguucaguuuccaugugaauguuggcuuucuguuauuuauuuuguuauugaagaucagccuuagugcauggugaucugauaggauacaugggacaauuucaauauuuuugaaucuguugaggccugauuugugaccuauuauguggucaauuuuggagaagguaccaugaggugcugagaagaagguauauccuuuuguuuuaggguaaaauguucuguagauaucugucagauccauuuguuucaucacuucuguuaguuucagugugucccuguuuaguuucuguuuccaugaucuguccauuggugaaagugguguguugaagucucccacuauuauugugugaggcgcaaugugugcuuugaguuuuacuaaaguuucuuuagugaauguggcugcucuuguauuuggagcauagauauucagaauugagaguuccucuuggaggauuuuaccuuugaugagaaugaagugucccuccuugucuuuuuugaugacuuuggguuggaagucaaucuuaucagauauuaggauggcuacuccugcuuguuucuucauaccauuugcuuggaaaauuguuuuccagccuuucauucugagguagugucuaucuuuuucucugagaugaguuuccuguaagcagcaaaauguugggucuuguuuguguagccaguuuguuagucuaugucuuuuuauuggcgaguugagaccauugauguuaagagauauuaaggaaaaguaauuguugcuuccuguuauuuuaguuguuaaagguggcauucuguucuuguggcugucuucuuuuagguuuguugagggauuaccuucuuguuuuuucuagggcguuguucccguucuuguauugguuuuuuucuguuauuauccuuugaagggcuggauucguggagagauaaugcgugaauuugguuuugucguggaauacuuugguuucucccucuaugauaauugagaguuuggcuggguauaguagccugggcugcaguuuguguucucuuagugucuguauaacaucuguccaggcucuucuggcuuucauagucucuggugaaaaaucugauguaauucugauaggcuugccuuuauauguuacuugaccuuuuucccuuacugcuuuuaguauucuaucuuuauuuagugcauuugauguucugauuauuaugugucgggaggaauuucuuuucugguccagucuauuuggaguucuguaggcuucuuguauguucauaugcaucucauucuuuagauuugggaaguuuucuucaauaauuuuguugaagauguuugcuggaccuuugaguugaaaaucuucauucucauccacuccuauuauccguacguuuggucuucuuauuguguccuggauuuccuggauauuuugaguuaggaucuuuuugcauuuuccauuuucuuugauuguugugccgauguucucuauggaaucuucugcaccugagauucucucuuccaucucuuguauucuguugcugaugcucaaaucuaugguuccagauuucuuuccuaggguuucuaucucuaguguugccucgcuuugaguuuucuuuauugugucuacuucccuuuuuaggucuaguaugguuuuguucauuuccaucaccuguuuguauguuuuuuccucuuuuucuguaaggacuucuaccuguuugauuguguuuuccuguuuuucuuuaaggacuuguaacucuuuagcaguguucuccuguauuucuuuaagugauuuauuaaaguccuucuugauguccucuaccaucaucaugagauaugcuuuuaaaucuaggucuagguucucagguguguugggguucccuggacugggcgaagugggugugcuggguucuggugauggugaguggucuugguuccuguuaguaagauuccuccguuuaccuuucgccaucugguaaucucugguguuaguaguuauaguugacucuguuuagagauuguucuucuggugauucuguuaccgucuaucagcagaccugggagacagauucucuccucugaguuucagugcucagagcacucucugcuggcaagcucucuuacagggaaggugcgcagauaucuuguauuuggaccuccuccuggccgaagaagaaggcccaaaacaggaccuuucccauacacuguguuacuuuggcaguucccaggugguacagacucucaccuaagcagacuaaauuccuaaguuccuuggagucccgggaccaagauggcgaccgcugcugcuguggcuuaggucgccuccccagcccggcgggcaccuguccucugguccggaagguggccggcuguccccggccuacacagggugcugccucagcgccucugugcuucugccuguuccagaagcugucagguucucuggcgcacccucucaccuguucagacuaauuuccuaaguucggcaggucccggaccaagauggcgaccgcugcugcuguggcuuaggucgccuccccagccgggugggcaccuguccucugguccggaagguggccggcuguccccggcccacgcagggugcugccucagcgccucugugcuuccgccuguuccagaagcugucagguucucuggcgcacccucucaccuguucagacuaauuuccuaaguucggcgggucccggaccaagauggcgaccgcugcugcuguggcuuaggucgccuccccagccgggcgggcaccuguccuccgguccggaagguggccggcuguccccggcccacacagggugcugccucagccccucugugcuucugccuguuccagaggcugucagguucucuggcgcacccucucaccuguucagacuaauuuccuaaguucggcgggucccggaccaagauggcgaccgcugcugcuguggcuuaggccgccuccccagccgggugggcaccuguccucugguccggaagguggccggcuguccccggcccacgcagggugcugccucagcgccucugugcuuccgccuguuccagaagcugucagguucucuggcgcacccucucaccuguucagacuaauuuccuaaguucggugggucccggaccaagauccaaacucugcauuucaaugaggccauuucuaagguaacugcucugagucccaaccacaucacugggguuucuguaugaucuuggcuuaguggguuuguuaauuucucuauaauucccucaucuacaaagugagggaaauagcgggccuccuuaucaggucuucugggauacugcagggagagcucccaggauacagcagaaagucagaaaaugcuggcucuuaccaccgcucuuauuaugaccaugcucgcaagcaguauuauucuucagccuguuaccuuccuuccuuucaacaacauuuccugccacucucuuuccucccaugcaagucccuugccaaacucacugcccucugcaagacucaaagauucuguuuaaaccggcucuccuagcugggaggccgaguaaccacuuggaggggauguuguagaggcaaacucaagcugcagaaauuccuucagaucaagaagaggacagggcaauuagcaaugcugcacaugcacggggcagggcgcggggagcucuugauuuuguuugugcuugccgguuuuccuccacucauuuuucucacacuggcggggggugaggggggagcccuuuguuuuacuguacuggagccacaacguggagcugccaugggugagaacucuagagaaugcuggaaaaaggucucuucagugaaccuaguggcaggagucgaaggaaggagauagacuuuuaauaggauguuugcuuuagagaaaguugcuuaaauuuuaugagccucaguuucuuucguaguaaaaugaggaagucuguauccagugcauagaggaugagaacugaauccuagucuauaugcaaaggcuucagggacguacaaaaucccuccuuuguccuuuucaucuucuguuaccuagggacuccuggcuguucacagggauuuagcuucucccggguacaagggggcggggucaacuguaaggaagcgucagaaggaaagguggcaauuguaggagcccccaggggagugugggcugcaggcagguggggcagaugguaggaggcccugaacucagacaaaaagagcuggguuugaacaagcaaagagcugacagcccugcccugccaugucccuggcuccuccucuuuuuccuucugauuaguauuccggccaaaacuaaaaaaguuucagaucauaggacucauuuucauaagcucagacuucuaugggcugucgcuccaucauuggaaaugcacacaauuuuggccuaggcccacacuggaaagcaaaagaaaacaaagugccagcucgcgccacuuccuggaucccugaggcaugagcuuccacagggaggggcaacuucguuggcuuguuucucacagggugccaugaccugugagcugagagaggcagagugcuugugagguggacucuuugcuugccuuucacuggaaggccccagagaacagaauccaccaugcagcugaagggaccagggccucuggaagcuauuauuauuauuauuauuauuauuauuauuauuauuauuauuauuguaucuucacaucuuugucuuugucccuuuaauuggaauugaaaacucucaccucagugguuauugugcccaguauaugcuaaucuucuucuaaaugcuuccuucccugaagcagcaguuaucccugacaucuggaauauuaaugcuaaguagauucaacugucugagauggaaaccgguuauucaagucaucuguuaaggaacugacuucaaguacugagaaucaacugaagcagugugaugaugguuaauugagcaaauacuaucuucuaggugucaagaaacaggcugguuuaguagcauccucuugccucuaccuccugggugcuggcauuucaggcgagucaugccaggccuguuuuaugucacacuagagauugaaccuagggcuuggugcagucuaggcaaaugcucugccaaaugaguuauuuuuauuugcaaaaaaaaaaaaaaaacccacaaaauaucuaauuuucacugguaauuuauuagauaaaugauaucgucaaguauuaguuaugcagaaauauguaaugaaauauauacauuucccuuuauaagagaugaaaugccaaauuacuugagguuuuuguuaauggcaaacaagaacacauuuauucuuuucuucucaacuuucuauuuuaaauaagaagagaacacagugcucgccauugucccaagaacuugaucuucccacaacuccuacaguuccuuaucaccacuuguccacuuuacagagaagaguuaagagaagaaugaucgacaggaggacccggacacuuuuaagacaaacccucuuauuugcauuucauuuuauccggaucacccuuucuuuucuauuuuucugcccagugggcaagggaagcccguuuacagaggacucaguucccagggcaaguugcuuccucucuuacaggcugccugcucuuuuucagucagcagcuaaaauaaucugccugcuacgcuguuacgaaaguagaaaauucuagauguuuacagauuccacucuucagucuccucuggccgcauaacuucuguaagggcuaaucuuuccuaaggcaaacaggcaaccagggucaaggcgauagcauuccuuugucauaggaagacacguacacggugacagcugagugaaggaagggacacuggaauccaaugacccaccgaaauggugucaguguaacugcagcugccaagcagaagucagaaaugcacccugcaagauguguucuguguuucaacaaugcagugaacucccuccaaguggacauggggagagagaggauguguuaccagagaagugacaucuaaugcgcgcucaaacaggucuagggccccauccaaagggcagaaaggcagucucccaaguagagcauuaacuggggaaccacaugggucaccugcuccucccuacccccaucuccuuccucccaaguaaaagggaaguagaugaagaaauggggaaguccaagcugcuccagcagcggcaguuuagggucccuaauaacacuugacauuaccagagaggcaaagccucugccauaaaaaugcuuagcaaaggcuuucuggaaacaucccuccagggcacagaaaaggagaaggaauguuuuauaguucucugugucucagauauaaucccagcgaugcccuuuuaaaaauauccuacggagcuaccuccaaccaccugccacuugcaggcacaagcuugguaucuguaauuacuuuuuaguagcaagugggucccugcgacuuacggacucaggugccauuuugaaaccggcacaucucuaccugaaucguccacauguguugcagggaaaaccuucccuucaaaagcuaguucgcgcuucagcuucaauccucagauaauagagcugauggacuuguggucuuugggaauccuuggcucccauuagcaaucacuuuuaauugaugaaaauaagaaaaggaaaaugaacuuccuuauugucagucaguaacagaaguugacuuugacuuaauuuugaaggggccggcuguguucucucugaagcccccuuacaccuagcaaauguuaggcacuugacucgauugcucacggaaauuauagcaaacaauacaaaugcugcggcgcuaaaacuuuucuuuuaaaaauccacucaaggauccuuuaucgcccucucaaaucaagggggagacaagcgagggagacaaagagggccggguggggcuguccacuggucugaaagcugagucauuggaaucagaccccagcagcucuuguaugagggacaccucacccuaucuugggggcguuggcugcagacaaagccgguuucaaaguaaagaaaagccuguccccuuaggugccacucaggccauuaguuaucacgcauugaaccuuaagaacagguuugggcggcugcugcaaaaguucaugauaauaaaauagacgucaaaugggggggaaagcauuuugaaggcguuuguuccuuuucuaguuccgccaucgaugugguucaaaggcgcuggugaauggggauguggggguugggagggggucugacagccuccgaacgcccuuccggagaugcggcgcgaaggaguuaagccggacuacgagugacaucaccucauuugcauagaagcacacauaaagcggcguucgccgcgccccucccgacaauccgcagcggcuucugagcagaucagacucuccucguucgcgcagcucgcucgggugagccccagggccccuuccuucuguccuucccugccuguccagcgcaggcacuugccccucauccuccucguccuuaaagccaaguccaaggcaugguaguuucggggaauugggggggggggaugcuaaacucuuccagaugccgaguaacgggaaggggaacuugauuaagaaagagaaaaccccauaaaauugggcauucuguugcgcagcuuagaggggaauuguuuuuuuuuucuccucgacccucucuccgaaauauuuucccuugccuagcuagcuguaauuaaucagaauuagaaagauccuuuguucaaacgcucugugcuccccuuaaucgccuaauggcuucgagggcuguuaucuguggcggguuuaaccuucccggccuuuagcgugaaaauucggaagcccuugcagacgaauguaugcaaaggccgucaaaaggccccuguaugcagaucaagaugcuuuugcgagaaguggggaggcaguuuugugugccaaggcagcauuguuggacuagagagaggagaggaagcgaguagggcgguggucggcagcuggcggcgucagcucccccgccuuugugaggaggagaaagcuggaccgccuggcaucuuuuggagagcaagcccuucuagaaaacggagaugcguauugcgaccuuggcuccuuuuuaagagauuuuacuagacuuucccccacuuaaacuggaaauggcuucgaucuauccagacuuuaauuuuuucaaagcugcaauguuaacauuccgcaauggugaauuuuauuauacgggaauacucaccuuugacuauuuccaccuucguucuuugaaucuucccuuugggaauauuaagggggaagauuuuuuuccuauagaaagaggaagaucuuuagagaggacucgacaaggaaagcacacagagggagaggcaguaggauuucaggcuuugggcuuuccggcggggugggggugugcuuuuggaacugggagaggcgaggguggguggcucuuucuuagcucuggucuuggcuuuuguaccugcagcuccuuccagcaaccaugucugacaaacccgauauggcugagaucgagaaauucgauaagucgaaguugaagaaaacagaaacgcaagagaaaaauccucugccuucaaaagaaaguaagcuguucgcccccacccauuuucagaacgggcugggcgggagcagagcagagcggggagcagcggccgggaggaggaagggaggggcagcagggaggaugggggggggggcugcgggggaggagucgacaguuugaugaugaugaauauggccugcaaagguuaauuaaaaacuguuuugcagucaacaagcgccgggcucuagugauuuaauaauggaauauuucauauuccauauugugcauauacauuuauuggguaacuguacuucuguuuagcaugucuugcuuagcgaggcugcuaugugucuuucuagaauuuuuauaggguuuuuaaauggaaaucaugucauuuuauagaaugcucuaagucuccuuuuuuuuuucuuuucuucacagcaauugaacaagagaagcaagcuggcgaaucguaaugaggcgagcgccgccaauaugcacuguacauuccacgagcauugccuucuuauuuuacuucuuuuagcuguuuaacuuuguaagaugcaaagagguuggaucaaguuuaaaugacugugcugccccuuucacaucaaagaaucagaacuacugagcaggaaggccuccccugccucucccacccaucugauggucuggcuagcagagagggaaaagaacuugcauguuggugaaggaaaaagcugggugggagaugaugaaauagagaggaaaauucaagauggucaaagauguccugcaggauguaaaaugcaguuuaaucagagugccauuuuuuuuuguucaaacaauuuuaauuauuggaaugcacaauuuuuuuaauaugcaaauaaaguuuuaaaaccugauuggug

SEQ ID NO: 9831 - RNA, 2969 nt, Mus musculus
uggcaucgcaauuguuagauuuaauucuguaacaguuacccacagggauacugguguauaaaaguaucuuuuggaucaauaguucaaauguuauugaaagauagcaauuaccuuuuaaaaaaaucuguauccaauuaaacuaagucccuuuccccguggagcgugcugugccguggcugcaaacaguaggcuucuugggagguuuuauauagggguuucucuaagagaccuuggggacugaacuuucuggugaauagucuugucgcuuaucucaucuugucaccaguccaggcuucagagagguauauggaucaccauugggaagccccagggcacagugggcaagguucacauuggccagcccaucauguguauaauaccaaccuguaaaacaaggauuuaugcgauugagguccuacacaggguuaaguucaaguucccuagcugacagaagagccacaucuuuugagagagagagagagagagagagagagagagagagagagagagagagagagagagagagcaccaaguuuaaugcggaugaaucugaagagauguuaucgaagaagcaacauuuucucaacaagcgugggacaaauaugucccuaaucauggucccucaggcaugugguaggacucuguguuccugaggcuuucugcugugcuuaacccuugacccugccaaucauguacucuaauaaaucucacauucaaucggaaaaccaagugacauugauuuuccuccuuaggguuucuuugauauuccuguggauaauuuauaugcagaaccugcaguucuucaguggauucgggagaacaucacugaauggagaaacuguauuauuguuucuccagaugcuggaggagccaaaagguaccauacaagugauaccauacacaucucaccuacuacuuuccugacuucuguauuucucuaugucuuaagggagaaagcaugccuuguucgcugggggaaauaguugaguaguuaaagcuaaugucccacaagcuugaggacugaaguugggucugaagagcuuauauagaugcugaguacgcuuuacggucugucugugauuuuagccuuggaagacagggaugggggaauuccccaagcuaucuaacuagcucagcguuuaauugagaaacacugcaucaaaaaauaagguaaaagagcaaucaaagcacauuccugacauuaacuuggagccuccacaugugugugcauacaugcauaccacacaaaaacacacugacaaccuuuauagauagcaugcuuaguguguguguccccgcgcacgugugugcguguguguguaugugucuguguguguguguguguguguguguguguguguguguguguguguguguguguguguguuugcuggggauaguauuauaauguagcccugcccccaccaggaaguuugcuuuuaauuaugcaacauuuuauuuuguaaaugagcaacugaauaggucucaggcuuugccuccagaacagaaacccaucacugucccagcauuucacaucauucaugaaaauaaaacaaacacacacauacauucuauauaauaagaauuuuaauuaacacaauugacugaauuaguccuucuaaccacaaacacuugacuggagcaggcacaauagaaaccaguuuuucaaaauguauauggaacaacaagaaagggggcuaaagucugucuacauuacagauggggcuggacuguacucugguguucugggggaugugggugagaugagaaggggaaggcagcuuggccugucccaccuauucaagugccucccuaaagcaggaugcgaaaagcuaggucccuagccaauaagcagagccuuuggcugagggagaaaguagucacccaugagaaauccaaccacaaguuugugccacaggcaggugaauaugaggucucccugggguguuggacucccuggacuaagaaaauuaauacaaaauuagucugacacugcaguaccucuauggagaaagacuucuacaguuugaguugguaggguaucagucacuguaccaugugaccugucaaucugaucauccaaaaucagccagcccugagggacuaacaugcccggauuccuuguguauagauagccaccagggcacaggcagccaguacuuaggagauguagaaugacuggcaaaugaacagguuuaacgagaaacugagcgugcugccacaguggcaaccuaaggacauagcccugaguggcagugucaaccagcucuauggagagcuucaaggggcgcacgaaccacuaggggaugugguguuguggaggcaacaagaauaagauuaugcugguccuacacacugcccacacugcaaacugagccuuaggacccugagccuuggagaacuugccagcugcuaucugggaagacaaaccugguggaguggaguggaguugccaagguaggggcugccauaagaaagggaaagggaaaagagaacucuccgcaccaacuaaaguaaagagguuuauugaugggagucaaucauuugaguccaggguaaagaaugaagaucaagcuucagaacaacccaaaagggcagugaucuugggugugucucagugguggaaccuuggcagucaggcucauagcccuggauuucuucucuagcacugcauagacacauuugaguacacacauacacacacacacacacacacacacacacacacacacacucauucucauguaccuucuccucacuuguugauaucuucaucuccuugcagcccuagaaucacacuuaaaaagacuuaagaguggccaauaaaguaaucccaaugcauugcguucccugguucucagaagagcacauguguugggcucuuagcugcuguccaacagccacugguucucagcacagaagagaagaaaacagggcagguaacuggagagggacucucugacagcugc

SEQ ID NO: 9832 - RNA, 22636 nt, Mus musculus
gccuccccggccguccucccccaccgcgcgcacucugcccgccccggagccucgcccuccgccacgaugagcaaaugagcgcgagcgagggcaugaaauuucaauuccacucuggggagaaagugcugugcuucgagccugacccuaccaaggcgcgagugcuguacgaugccaaggugccgccgcggggggaacagggaggagaugcgggacuggguucgagggaugggaggcaaaggggccagcggaggacaaguggccuggaguccuggacagccaccagggcgcgccuuggccugcguggagcggcccgggacuacaggggacgcuggcgagacgugcugggcgcgcgacuucccuaacuagaaaggacccgugaugcuuccgcuuccggccgugucgcgucgcuuacgcgcgguugcuaggccaggguggcgguuugagcgcugggcgccaaucccggcgaccgguguaggaggacugucgccugaggccucugcuuuuguaacgaaucuguccuugucccacgcggcuucucgccacaugggcucaguagaggacaccuugaccaguuuccccacccacaucuucaaccugguccucaauuauucccagcugucagucccgaacccuggucaaauuuaggauuguaguccugcugggggggaagggaggggcucaagguugcucuguugcuuucuaaaggauuggugggaggcgaacagagcuaggaaagaaucgcaucucgccuguauccagcuuggucagcccaggcugagcuauaucuugcgguugucaguuuuuaaguggaggacugggcaccuaagugcuccagagcccaaagaagguaaaaauucagcgcgcugggggucggggcgagcaucgguguuuccagccaccaaggugaaguccuugguggcagagacaacucggagcagcaccagguguguuuuuagccauguuucagcagugcuguccaguggaacaccccaaggucugugcuggauuauguaucuuugguucuuccugaaacccuuaacucuguuuaccuccuauugcuaucccuccagcuugcucuaucgcuaggagauggaaggauauacguuucauuuguaccagcuaucaccuuagggaaugcauggcuauuaaggggaggggaaggguuguggaagucucuggcuagcuaggcaagacacuggacaaggcaaggcccaggugacuacaacucccagaggucucagggcuguucucucuagucugggcccuucgcuaaugacaaaucuaccgaccaaugacuucagaaguuucacccggucucaaacucaagagaccaauccuggguugguuggacggauguuuccuauuuugaggcaaccacucgggcagaagaggaaaaaaaauguugaagaauguuacgacccagcucucgaucuaaaggggggagggaugaguacuuucuuauuucuuuaagaagggacugugaucuaguucuuuuuaccaaacuuauaguaauuuucgguuugcugugccacgcgugaguaguauuuccugguuucagaucaucgauguuauuaucgggaaagacgaaaagggcagaaagauuccagaauaucugauacauuuuaaugguuggaacagaaggucagugaacuuguuacaguuagacuuaaucgccuuuguagcaagauaauuuuguaacuuuaaguuuuagaaacacuuguagaaaaguuuaauuuccugcuucugcuuuguuuggaaagcuugccuggucugaggcaugauuacuuuaaagucuguuauguuuggaugaucuaugaguaaucucuagaaaucuugguugcuguagcugaguucccuuugugcuuuauugguaaccucuuggugguuuugaaguuuuuuuuuauagcuuucuaaaaugucagcaagucuggggcacuucuucaugaugcuuuuuagcauccguuucauuuguuucaaaauacugacguuuacauccucuucuuuuucaaccaguugggauagaugggcagcugaagaacaugugcuacacgauacagaugaaaaccggagauuacagcgcaaauuggccaaaaaagcaauagcucgccuguaaguauacaaaaacuuuaauggaagugcuauauuuaguguggcuuuuuuuuuuccugguuuggauuuuuuuuuuuaaugauauaaaaguaauaugacagauuucagcaaucuuacauauuuaaaauaaacgaagcauuucuaaaguacucuaaagaaucacagacauuuucagaauaacuguuuuccacuugguaguggggaaucaccauuaugguuuguuuuuuuguuuuuguuuuuguuuuguuuguuuguuuuuuuuguuuuguuuuguuuuuugcuuuguuuuguuuuguuuucgagacaggguuucucuguguaucucuggcuguccuggaacucacuuuguagaccaggcuggccucaaauucagaaauccaccugccucugcuucccgagugcugggauuaaaggugccaccaccacccggugacaccauuauguuuuuaaaguuuaaucuucuacguauuuaagaauuauugcuuauuauguccucuguggaugccaagucccuguuugaaguuuuauuuugauuuguuugucauuuucaggagagguacaggaaaaaagaagaggcgcuguagguugccuggugucgacucugucuuaaaaagcgugccaguuaaagaaaaaucuaaaaaugacgaaaacugugaguguuuugacuuuccuuuuccuccauugacuccaucuucaugucauccucccguaucuuaggacugagagaaagagucauugcaauucuagacagggaaacaaacucaucccguccagaggcucucauuuaagacuuuuauugacuuuaggaugguaugaaaguuucuucuuccacuuucaguauacucugcaauaaaauacaugugcuaugaguacucccacaagguuagcuuuguuuccaugaguuuccccaauugucagcuccucuaagugcucuggggacauugaacgcagccagcuaugauaauucaguaagcuaggugauguucaucggucuagguguaacuccauccuaagugaaggggcagauucgugauaugcacuccguuugguuuaggcaguucacacugcagucccugugaucagucggcauggguaucagacuguagcagagccuucccaguaaccgccgucaucucugcuagcaaagcuucacagauccuuccucuuggaucauuuucuucuugagaccuccagggccuugccaccacugaugaacccaacagugaaccauaggauccuagcuggugaaacacuuucagaucauuagcuugugugauuuuuguauccauugaauuuggaguuauaauuaucaaacuaaguuucuguuccgaaagguacaguauuuguguuuaggauuuaaaauggaugcagaacuacagaccauucuucuuaaucaagugcaugugccaccuaaaaauuuuguaacuguaaggauuguccaaguguauaauaugaguuugccugauauuuuuguuuuauguagcaguaagcagcaccugucaugagagcuguggagaaaagaauggagggauaaaagaacaccgucagcgucguauuaaaguaaaggcuaaagcgguacaaaaaauguuuuuacuguagaaacuuugucuuugauauacagacacacacauacucgcacaauuauauagauauagauauagauauagauauagauauagaucuauaguaguggcaaaauuuucagguuagcaauucuuuucaaaaguauacuuuucagaccaauguugcaaguuuuccugugccauuucaagaaaagacaucuguuuaugguccuuguaugaauauaguugacucuuuauacccacagaguguuuccacaagcuauguauuuuuuuaaguacgauugugaacuauacuucauaaugacuaauuuuuaaugguacauaacagagauuggcuucugccugccccccaauugaacagaaaccccaaugguaaucauaagugaagaaggaacagaagugaaucuucaauguaguuaaugcuguggaaagacacuuuguuauguggcagaauaucacugcuuuuguuuuuuaguagcgggcauguggcaugaugugacuguugugaauaaacuagcuugguugcguagcagauucuuauuucauagcuucucucacuguucucaauaauucaaaauggaauugugauauugcagaaaaaaaagguauugucgcugcguucaagaaaggaaauggaugaaagaacaaucacuauagauauccccgauguucucaagaagcagcuagaggaugacuguuacuauaucaacaggaggaaacggguaugcaagaagaauggauuguccaggaugcugcuucuugccugcuuucauggucaaugugucaaacaccggacaggguggagggauggaugguaguuuccuuuccauacuguaaggugcuuuacaguaguccuggcuucuugcuuaacuuaacuuaagcaggaacuuaagacuuauauaccauaugauguccauuugagcccuuuagugaguuuucccgaauccugauaccuggauuucaacuacaguuacgauuuaagccagguugauagcucaugugaucacuuuaauuccagcacuugggaggcugaggcccagugaguucaaggcccgccugcuuuacauagagaauuccgggacagcuggucucagaaaguugaaaggauaaauagauuaggauggaauuaguggguuaggugcacuucucuugcauaugcuuugagaagcuuucuuuuuuuuaauagaacacuaagacugaggauuauuacuucuuuguauucaaaacaauaagacuauagugugagaguaugaucuguggaagggaagguuaucaaagaucuucaagacauacuuauuaaaaacuucuugagcaacauugacagaguuaaacugguaaaguuauagcgauucuuucuucuaauaugugucugauuauaauaggauaugaguagaucagauguuucuauuuuucuuaacaguuagugaaacuuccaugccagaccaacaucauaacaauuuuggaauccuaugugaaacauuuugcuauuaaugcagccuuuucggccaaugagaggccucgucaccaucaugccaugaugcacacgcacaugaaugugcacuacgucccagcugaaaagaagugaguaacuggagugcuucaucuuugaagucugucuuuggguuuugguuauguguuauuauugguagcuuuuuuggugcuacuguggaucgaauucagcccuuaugcaugcuaagcaagugcucuuccauuugccuguacccgcaagauuuuccuuucuaugucccaguuuagaaccagggguccuuuucucugcucaguucuguugaacucaucuuaacucaaagcugauuuguggauuauugggucgguuaucagucuaauaggaaacuauugggccuuugcugaaguguuugaucauucuacacgagaccuagcuugauugugcauuacccugcugccaagaccaccauuuucagggauaccacauaggagaccuaucuacuugaggaaacagaauaggcaaugagaacuggaucaaagguggcuucugacuggucuuuuaagaaauuaaucaauguauccaugugaguacaugugugccauggcacauauuugaaggucaaaggucaaccucugcuauaaguucucaccuuccaccuuguuugaaacagucccugucguguuuuucauugcuagguucaccauccuggcuagccucugaguuucuagagauuugcccauguugguaucuugucuccccacaggaacucugggauuaaagauuagugcacuacuauaucuagcuuuuaaaaaaauauuuauuuuaugugagaguacacugucgcugucuucagacacaccagaagagggcaucagaucccauuacaggugguuaugagccaccgugugguuccugggaauugaacucaggaccucaggaagagcagugagugcucuuaaaugcugagccaucucuccagcccuauaucuaacuuuuaaguggauuuuggggauccuaauucagauugccagacuuguacagcaaucacuuuuacccauugaucuaccuccucuccaccccgaaacaacacuuuguucucgucagaacccugcuaccccucaugauuuuacaggaccagugucagggagguagaguauugcaguuggaacagaagcccgcagcccuggcugcugggaugucucagguucuauugaaccuguucauuuguguuauauggauacauuuaaguuaauagcauaaugccugcaguuuauauuauggucuauauuccccuauuucuuuauuauuaucauugauauguuugcuuguucuuuuuguauguaagugauuaucgguuuuaaaagucugcccucagcuggauagcacccaccuuuaaucccagaacucaaggagguagaggcagauggaucucugugaauuugccauuacccuagucggcagagugaguuguacaccauccagggcuacauaaugagacccugucucaaaauaaaauaaaauaaaacaaaaaaaauaaaaauaaagauaaaucugcucuguuuaagauguauaccuuucucaugaaguuuggaaaauaucuaugacuuuacuuggucucuaaucuuuucucucucaaucuuccuaguguugaccuuuguaaggaaaugguggauggauuacgaauaaccuuugauuauacgcucccauuaguguugcucuacccauaugaacaaacccaauauaaaagggugacaucgucaaaauuuuuucuuccuauuaaggaaaguaccacgacaacuaauaggugaguuagacaacaugaacgugcaucuuaacccucaagugucagcacugaccugacucacucuuuguggaaguaucugaucugcuguuacaguggccugaaugucuaaaggaagggaaacacuguaggguguccuuacuggugucucccccgacgaccugcucccccuguuagguagaucaucauucacauucucaugguuguaaguaagcauuccaguuuagccaagcaugauggcugguaucauccuagcauccaaggagcugaagaaggaaggcugcuaugauuuugaggacaggagcucucuagagggaguucuaggcuagccaggacuacauagcaagagaaggguggguggacauaagauucccaaguaaacagcauuaucaguggauucugagcagcuguaccgucuuucagaagacaguaguuacaaggcaacaugaaccagaaggauagaaaguggaaguauggauaucacccuuagugaggcaacccaaucacaaaagaagucauuagauaugcacucacugauaaggggauauuagcccagaaacauagaacacccaagauacaauuugcaaaacacaagaaaaucaagaagagggaagaccaauggguggauacuucauuccuccuuagaauagagaacaaaauacccaugaaaggaguuacagagacaaaguuuggagcuaagaggaaaggaugaacuauccagagacuaccccacccggggauccauccuauaaucagccaccaaacccagacacuauugcacaaugccagaaagauuuugcagaagggacccuguuauagcugucucguaugaggcuaugccagugccuggcaaauauagaaguggaugcucacagucaucuauaggauggaacacagggccccccaauggaggagcuagagaaaguacccaaguugcugaagggguaugcaacccuauagguggaacaacaauaugaacuaaccaguacccucagagcucgagucucuagcugcauauguaucagaagauggccuagucggccaucaguggaaagagaggcccauugguuuugcaaacucuauaugccccaguacaggggaaugccagggccaagaagcgggaguggguggguaggggaguaggguggagggaggguauagggaacuuucgggauagcauuugaaauguauauaaagaaaauaauaaaaaauauauauauauaaaaagaaaguggaagugcaccugauauccuuugcuugaugcuaugugaucugggucagcuucuucugacucucuugucuccacauacauaguauagaaucaauggcugucucccugguggcuaggaauucaugacgucauucacaagggggcagcagccuuuggcucucagugucggguuaguucccuacuucucuuuuauuacugcuuugcuugcuccugugucuaugcaugcuuuguucucuguucuggucgggguugcaaggguggauccauccuucccuaacgucuuucccccuaauuuuccuaaggcacucugccuuguccucucucuucucuuccugaguggugugcaucaagucuagcuuggugagggaauggguuaccuggggcuaguuaggggaacauaggcuaccgguagccacaccacugcagaagagccuuccucucucuggcauugaaccuuuaaguaugcucauaaggggguggcucuugugugucugaggagcccugccacuuuucacaaggccauguuagugguuaugaagagcucauguggucaucacagcugcucccauuccaagauggcaguagugcuguccuguccagaugaccaaguuuuccagcauuaauaguaacaucuuucgguguuaaaccggcaccugcucuucucuacugcucuuuugcuaggcucuaccuccuuugucacaaauaacuuucugggcccuacauuagcuagcugccuuucuucuuccucucuuuuuuauggugcucugucucucuaacaucucuuuggcaguuucucuauuuccucccuucuacaugucacuuuugccccaggcaagaggucagcaaaacucacacaaggaccuguguugaaguccccacgaauggcuugcuucacacuugaugauucccagagucuggcauagacuuagacauacuugugcuauccucaaguccuggcaauuuuuacauuuugaagacaucguguggucaucuuauucaguagagcaguuucucuguccuggguccuguccugugugacauaggacacuuagcaguaugucuggucucuauccauuagggaacagcauaucugcccucaguugugacaggcccucaccaggcuggcacuguugucaccaaacauuggcaacugcuuucugggcuggggccaaauucugccucuccccucagagcccuuguucugacgcauggaggagaagauguuuccgucucuaauaacagcacgucuugcagaguuauggggaccucauuuauuuaggaacugcuuaagaaaaaauguaugucucaccuccucccucccaaguugauuggugaaccugccuuugggaggccuuguagaagcccucagaucuguagaggcugcuagugacacucuccuucuuucccaggagccaggaagagcugucuccuagcccgccuuuguugaauccauccacaccacagucuacagagagucagccaccuacuggugaaccagccacccccaagaggcgcaaagccgagccagaagcacugcagucucucaggcgguccacaaggcacagcaccaauugugacaggcugucugagagcagcuccuccccucagccgaagcgccggcaacaggacacaucugccagcaugccgaagcuguuucugcacuuggaaaagagugaguuugcccuaugagcgccaggccagggaaagccacuuuuuucuuuauuguuagccucccugaguauguauaaaguguguguuauucuccagaucucacccagguugcuauagagcuacuucuuugaagaagaggaaaagagccacagaaagauggaaaagcaaaugguuuggguggcucagugagaacuagcgaggcaagacucuguuucaguugauuuguuaaccucccucuuugcuacuuuugugagcuaguggacuuauuggaaucccguguuuucuauacauauucaagaugaagugugauugcuacaguuccaugccuguuuuuaaaacuuaccuugaagacuucuguuugaauaaaguguucaaaugagaugcuggguucaacagaguaugcugugaaacuccccauucaaaguaauuuuuaggauaguuagaacugugcaucugccuccacuaucaguucauauauuuucaucacagaaugaaaggaaucuguccuaccuuuaccugcccuuccccaccucccuuagaagcuaccaguuugggauauuuuauauuaauggaauaauguagcauguauguacacaauugaugaguugauggaaugaaaacugggaagguuucauuaggaaauaaaacacuuaaaaaccaauucuaaaacaugaacuaucuccaugacucccacucuagccccugguauguuuucuuggcauuaguuauuuagguaaaaaucacauguacaguuaaucaguuuuaagauguaauuuuauuuuuauguguauagaugcuuugccuucauagacgccaaggcagugccuagugcccucagaagacaagagggugucagauccccuggaacuguaauuacagaaaguugugaucuguaugugggugcugcaauugaagagcacacaguggucuuaaccucugagcugucuacccaguccaaguuaaccguuuuaaagugacuaauuuaguggcccuacuuuuuaauuuguugagcuguaauccacacaccauacaguuuuccuauuuaaaugauccaauccaaugguuuuuaauauauuagcagauaaacaucuguuucaaaacaugguuaaucccuccccacaaaaagcaccuacccacuagcagucaccccccccacccccacccccacccuuuucgagcccauggaucuuguuucuuuucucugguuugccuagucugcauguuauguagcaacggaaucauacuauguagcucuguguuggaucccuuucagcuuagcauaaccuucucaagguugacuuuuguaacauauaucaguaccaggcuaaaaauaaccuuccgggugcuaccuuuuagaagaugaaggucauauuguuaacaggagguagcuuuggagcauugauuuggauuuguggucugguguuuaucaggguucugagcgugucucugguucggucucucuguagcuuuauggguaaaugauugcaccucucucuuugucagagacaccugugcacagcagaucaucuucccccauuccucugacuccaaguaaggaugggagugcuguauuugcuggcuucgaagggagaagacccaaugaaaucaaugagguagggugcuugauguuugacuccaaggguucuuuuacccuuugugcuugcuuaaaauucuaaguucucgagguaucauguuacuuuacaagaaacagcagcaaaagauaguaagguuuaagcuugcuauuguguuccuguuuucaaaucugagaaaacuaccagaacuucuguucuacaauuauaaugacuuuuuacccuaaagaucauacaguuauuaaaauaguuguauuugcauuuuguauaauguauuaaaacuuuuauuccuuuuuuaauuagguauuuuccucauuuacauuuccaaugcuaucccaaaagucccccauacccuccuccccacuccccuacccacccacucccacuuuuuggcccuggcguuccccuguacuggggcauauaaaguuugcguguccaaugggccucucuuuccagugauggcugacuaggccaucuuuugauacauaugcagcuagaguccagagcucugggguacugguuaguucauaauguuguuccaccuauaggguugcagaucccuuuagcuccuuggguacuuucucuagcuccucuauuggggacccuguguuacauccuauagcugacugugagcauccacuucuguguuugcuaggccccggccuagucucacgagagacagcuauaucaggguccuuucagcaaaaucuugcuaguguaugcaauggugucaguguuuggaggcugauuaugggauggaucccuagauauggcagucucuagaugguccauccuuuugucucagcuccaaacguugucuuuguaacuccuuccauggguguuuuguucccaauucuaagaaggggcaaaguguccacacuuuggucuuuguucuucuucaguuucauguguuuugcaaauuguaacuuauaucuuggguauucuaaguuucugggcuaauauucacuuaucagugaguacauaucauuugaguucuuuuguaauuggguuaccucaaucaggauaaugcccuccagguccaaccauuugccuaggaauuucauaaauucauucuuuuuaauaacugaguaguacucaauuguguaaauguaccacauuuuuuguauccauuccucuguugaggggcaucuggguucuuuccagcuucuggcuauuauaaauaagguugcuaugaacauaguagagcauguguccuucauaccgguuggaacaucuucuggauauaugcacaggagagguauugcgggauccuccgguaguaccauguccauuuuucugaggaaccgccauacugauuuccagagugguuguacaagcuugcaaucucaccaacaauggaggaguguuccucuuucuccacauccucgccagcaucugcugucaccugaguuuuugaucuuagccauucugacuggugugagguggaaucucaggguuguuuugauuugcauuucccugaugacuuuuuagaguuuaaugaaaacuuuuauucuuaagagccacauuuuagguucugugggccaugugaugucaauuaagaugaaucaacuauaaagcagcuucaaacaauauauaaaugggauguguacuguguuucaauauaccauuauugugaacacugaaauauaaauacuauaugauaugcaugagcuaaaaauauucuuuuagcuuuaauaaauuauuuauaggugaccuaaaccagcagguuguucuguagugaugggguccuaagagagaggagcaggagaucagaagaugaagagagcauaauacagagaaaagaaaguuuaggaucaaguuuucuuucacagucuauuuguuaugccaagcaaguuuauuaagaacuaaauugggacagagucagcagaaagucuuguucgauggacuaaguuagagggaaguuaauuaguguugcacgaagggagcacuggguaucucaggagcauuacagaccaaacacacagcagccuugugacugauaaccauaaucccccuuguggaaaaugauggcuucgcaggaucugaagcuauuucuuuuuuuuaaacaucugauucuccuccaggaagaguaacccuaauagccaucccuuugaaagcaugccagcauuaggcuagccguuaagcccauuuacuugaaugcuuugccacuacaggcuuuguauuuaugggaaaugguauuucucucuuucuuucuuccuuccuuucuuucuuucuuuuucuuucuuucuuucuuucuuucuuucuuucuuucuuucuuucuuucuuucuuucuuucuuucuuucuuccuuccuuccuuccuuccuuccuuucuuucuuucuuucuuucuuucuuucuuucuuucuuucuuucuuucuuucuuucugggcuucugaacagucaggcaaagaccacuuccacucagaucaguacugccaucuagugguuaaugguagagcagaaugcuuugugguaaacagugaaauucagcaggcuuuugggacucaggaaucuauagugacuuuaaggacguuucagaaccucuuccacgauggguuuuaacuagggcuauuuauccaaagcacucaugccccuuucuucgaauaccaauugcggauugaauuugggaagggucuggaugaucacauggcuggcuaagaugcacuuugguucucauggagaaucucuguacuaauuacaaaugcccaucucgucccucugagcaacauucgauccagaagcaauucuaagcuuccuguguggguggcaaggguucgaugcuaaguugguaugaagaaguuagaacuggcugccacggaugagauaggaaaucuacaugaaggcuacagaagcuugaaggaggcuggggccuucuucuuggcaucccagagcacuugugaacuucuaguuuauuuuauucggguugacggugccagcauuugugauauuuugugguugggcacccuucugcuuuuucucauagaggauuuccugcaacauaaguucuucugugguaauagagcugagacauaacaaaaauggacuaggcuuuggcuugcugauggacuaagguauuucuagagaaacucaccacagaguucugaaagauagcucucaauuuuuucaaaauucccaguccaucuagcagucugaaaaucugaguaaagguagagaaacuaacucugauaugauucaacuuaguuuccaaaaugacucaaagagcaggaauugauauauucuugguaauauuuccuguuugagggaggagggcucagugcugugauagugugaaugugaagccuuuuugaacacuaggucccuagcuggugguacuguuagggaagauugugggaccuuuagaagguggagcuugcuggaggaagugcgucaccggaacugagccuuuaguuuuuauagacuggccagauuuccugcccacuuucagcuuccugacuugauguagugugagcagccagucucccaauccugccagcaugccuugcccaccaagauggaauguauccccagaagaugagcacugucgaaaauuuuaaaauccaguaucucauuaaucuaauuuuaagucguucugacccucacauuuauuuuuagaggcuugugcucacuauguagcaauauuguuucaucuuuuccauauuauuuacugucagagauuuagaagucuaucuaggagagccuccauuuggaauaaaggaagccuuuaagugauuuuuuuucuagguccugucuuggaaacuugugccugacaauuauccgccaggagaccagccaccucccccuucguacauuuauggugcacagcauuugcuccgguuauuugguaagaaucucuauucuucauguuuuuccaguuuugauuuucuuauuagcauguauuaauuacauauaauaguagcuuucacuguguauuaguuaggguuuuauugcuguuaacggucacuaugaccaaggcaacccuuauaaggacaacauuuaauuggggcuggcuuacaguuucagaaauucaauccauuaucaucaaggugggagcaaggcaguguccaggcaggcaugguccaggcagaaccaaguucuacaucuucaucugaaggcugcuagcagaauacuggcuuccaggcagcuaggaugagggucuuaaagcccacacccacagagaagcacuuacucaaacagggccacaccuucuaauagugucacuuccugggccaagcguauacaaaccaccacauuccacuuccuggcccccuuaggcuuuucaaacacaugagucuauggggguggggcauaccuaaacacagcauaaugcaaaauacauuuuaucccacuucaaaagucuccacagucuauagcaguugccacaauguuaaaagucuaaaguucaagucucuucugagauucauccaguaucuuaacuguaauccccaaagcaagacaggaaaccagcuggggaaaccccacauucugcaucucuaugucugaugucaacaucaucaucagaucuucaacuccuuuuucaucuuuguugacugcaacaacugcuuucuccugggcugguuccauuccuguuagcagcuuucaguccauuaucaccaaggcaggaacauggcagcauccagucaggcacgguguaggaggaacugagaauccuacaucuucauaugaagacugcuagcagaauacuggcuuccaggaagcuaggaugagggucuuaaagccaacaacccacagugacacaucuacuccaacaggaccauaccuucuaauagugccacucccugggcugggaauauacaaaccaucacacacugauauuuucauguguuuguagaaugcauggugaucauagaauagucacccccccuuaccucuuguccaacuauucaucuuucuguuuccaugugguguguguguguguguguguguguguguguguguguuauuagaguugcugauagguccaugguuaagaaaggaaacaagggcaauuuaccagugguuucaccauugaagaaaugucucucucuccuagcaaccauucauucauauccauggauggucaaagggaaauggggccucauggugcccucaguuauagcagccuuauauugcuuggcucuuuuuuuuuuuuuuaaaccaguugcuaguuuauggacaucuugcaaguguguaacuaauuuggaaaccugguuuccucuuuaaagaaaaugcacuggauguacuuuaguuucauagacuuaacacucuauguuuguucgguaacugauuguuuccuagaguagaugcuaauuugaguccccaaaguaggaagaguaauccagguggucccacaaugaguccugcccaauguggcauccugcugauugaaaacgcuuuuguuuuuaauccagugaaacuuccagaaauccuugggaagauguccuucucugagaagaaucugaaggcuuuacugaagcacuuugaucucuuucugagguauuuuuauuaccuugucacaccuaccgccacaggcaaacuugugacuuucugaggcuuaaguggaagguggaagguggaaguggaaguggaaggugguauuuuccauauguucugacugaauagaguaagauaugauauaaagggauuucuuuuucauucuuuuuuuuuuuuuuuuuuugguuugcuuguugguuuuaugucuauuuuauccuucauuucuccaguuucugggucaagaauacugaggugucacuccaauaauccagcuggauaauccuguaagcagaaaaugaauuuucugacauagaaauacacugacauuaauuuuacauuuaucaggagaacuguaaacauuggccucuuaugacguguguacauaaauuaacuuaaauauuagccuagaaugauaaucaacaagucugaguaugugcuggcauuuuugaauucagagaaagguguugaauucuucccuugauauagcuagucauuuuuuuguguaauagaauauuugacucaugaugcccaucuucaugccauuggucacuuaguccuucucugcuauccagaugucuguuaauuacauccuuaccuuauccuucaaggcuggucuucaccuugccccacucaggucugccuagcuacuugaccugaaagggagccguuuucuuucuacugggccccauucugacugaucuaggagucgcgagaguagaguacucuacccagaaauaaucagucuuaaaguuugaaaagguguuuuuccaucagaauuuugaaugacauguccuugaauauaacuauacuuucaguaugucacugaaaacugguuuuauaaauauucucuucccucccaugugccccuuucagacaaacucacaauuguguuuaaccuaacuguuuguguacuaaaagcaaauagcacuaagcaugugugaagagacugcagguuaauguagggaagccuccagacuuugaaguauuccuuauacaaagcagaaguuaggacuguaggaaauaacauagguuuuauaaauaaaacucagaguaaauaaaaauauccuuuuuauauaaaaaaguagacauugguagcaauuagaaucaaggaacacaacagugaccuuuaagaaaguacaaacagaaaaaaaaaaaguacuuagcugucaagugauuuuugacgugguuucuuauuuagagagaugugacaauuuaagagauuuggacagguuggagguagcagggugauucaugguagauuuuacagcaugcuucuccuaguccaaguccucuuggacuuuauuuugcuuucuuucuuguggaucuguuugcuuuguuuuguuguuuuggcuuuuuuuuggggggggagggguuagaguaucauaacauaguuccagauagccauaaauaguggucuucccaccucagcuucccaaaugcuugaaccacaggcauaagcuacucugccugccucuggccugaagucccuucaucagcauauugcaggaucuuuagcgacucaucacauuauaacagccauuuucagacauacuggucuuucgacaggugauacucucacccagacuuguaauuaaccucuuaguaugcaaagauugguauugguuauuuuguucagguuugguguaacuuagucuguauaauuagccuugugaauuuuuuaaguggcauugaguuugucauguauuguuuuuauaguuuggaaaacaggaaaggauuuauugagguuauuuuucacaaaugcaugcauauaaucaguucugcaacccugaugaugaagagauucacaugaauagugaucgacagaagccgcuuuaaugaguguuguggaaguaaucaauagaaucauguuuucuuucuaguacaaaaaguguugaaauguuuucacaguucauuggcugacagcuaauauuuagcuucaggguguucaguucuuaauaugaugcucauuggugccuuuuuaauuauucuuucuauagguuuuuagcagaauaccaugaugacuucuucccggagucggcuuaugucgcugccugugaggcacacuacagcaccaagaaccccagggcaauuuauuaaacuuuugaugguucuguaaaaacaacugcacuauguggcuuuauacuuuaggucccaggugaaguguuaaugagaugcuagaccuauccuggggguacucugacagaaacaggcucugguuuuuuuuuugaguucgucacauucuauuauuucuguuaagaauuauuuucugagcucaccauggugguccuugccuauggggagggagucgauuuaauuaauuaauucaucauuuuuuuaaaaaaaauguacugauuacuuccugggugccugaacauauuccaaaguaacacugcuacacaagcugugugugcuagcaggcuaaaaacagccauagcugucuucauagggauauguccaugaacguauacuuagguuaaacauuauucugguagacagcgcaggugguuguuagcaaggaccauacuguuugauuacuuguuaauguuaaacaaaaaugguuuugaaaacuguuuucuguucaacagaucuuagucagugcuuggaagccgcaaagcacucucaaaguauuucugagggaauugauauggguggcaaaagagaacuuacagcuaugcauugcuuguagcaguucccuuucucagaaacauuauuuuuguugcucuaaauaaagcauugccugucuuguuugagauuuuacagccauacucugcuauguaauguuauaguuccuuuucuaugaaauguuauuuugggugaucuaaauaaagcuuugccaguuuuguuugaaagaagcaagaggaguuuugcucuggccuuuccugguucuuuuuacugcagggcaacuagucggguaaccucuucacucccaacuuuuguuuccauuuguuugccccuuguacguuuuuguccuucccuuuuugguuuggccucucugugcaucgugacuauuaguaguuaugagaagucaccgugacucugugccaacuuguggcuggucuguggguccugauaggucaaaugcagaucuacccuuccccaaguuggccagcugaugugaucuguagucauccuuuuaauccuccucucuauuucucccucucucucucucucucucucucucucucuuucucuauuucuuucucucgcugucucucucucucucuccucuaugguuuagagagcucuaaaggccuggaaaggauaccgaagccaugaaagcauuagauaaagcacuucucuuacuguuuagcucaguugacuuuaauuuccgaaggccacuggucaugaacaacaggagccucaaggacuuuugacucaaauggucccauuaaagugccuugugcaucacugacuacuaagauucacuaccuccagaucagcuaaagaaggcaucuucccuucugcauuuguuuaguugcuuacacagauucagguuggugggaacugauuggaacggccuucacguucuugguaggugugauuuuuaauuuuaauugucaauguaauggauugagaaucacuguggaaacacacuucugggugugucuaugauacuguuucagaaaaguuugaacugaagaggaaagacccgucuugacuauggccaucaccauuccguggacugggaucucagacccagugaaaagaagaaauuaaguaguaucucagaauucaccuuucucugcuuccugacaacauuaccaauggguucauguuccugcugccaugcuucucugccaugagggacuggaccaucaaacugggaggcaaaauaaacccuuuucucagguauuuucucacagcaaccacaaaaguggcucauaauggaacauugguguugagaaguggggcuguuguggcuaagccugaccaugugggacauaggcauuuggaacugguuuauagcugagaguuuggaacuuugagcuagagaagccuuagagugcuauaaauagaguuuaguaggcuauucuggugguguuuuggaaaacuagaaugccaagacaaacguggauaguggagaucuggcucacagggguuuggagagaaaaagaguauugaaaauugagcuacaggccauuugugugauaaccuggcaaaaaaaucugguaucaggccaugccauuagugccauguccuaggaacuggagugaggcuagauucuaaagcaguggacucauucccuugguggaagaaaucugaagaaagcuuagcguucaggcuguguaauguuuacugacuacugcugucauccaggucuccagugagaaauagcacaaaugagacaaaagaagacagaugugucaguuuggcgggggaagggauggauuuaaagguguaggcaaggcagauccagagaaagcagcaguacuuguuaaaagacauuagcaacauuaaagagaaaccuugugcucuguauuagauauuagugaagguuccuuaaagauaagaccucacccccaaaaacccccuauuuugucaaaauaugaauucauuugaaaggagaaaucguaaagugcugaugguguuuucugcuucuugaaagcaguuaccuaggaaaaccuuuccccaugguuggcacacaggccaauauacuuguaggcuaagggacccaggucacagcagaacuuuguaguaucacucccaugguacaggugugaaagauguagguguggaggagucauggagacuugcacuagaguuccagaaagcacugagaccaggcaaugugucgcuugguuggagucucuguaaacuagcccugagaggcuacuaugugaacauguuaaagugaagucuaaguugcaguauggaucccaggauguugaagguaccagaacugugggucaucgccugaggaaagccccaugcauggagccgugucagccccagagagaaguugcugcaaauggcagcgcuggagaucugggacuacccaagcccuuggaaauccauaggaguccaucaugagcuccagaugcgggccauagagcugcaggaucugauguuugcccugcugggugucggucuuucuuuggacacacccuugcuugcuguaauucccacucuuccuguugggaaugggaguuuuucuucuuugccauuguuuauugagacauuguuaguuguuuuugauuuuauagauguucacaaauaagagauugccuugagucucagagaagacauugaacugcuuaacacugcugggacugcuaaagacuauggagaguuuuagagagggacuaaauguauuuugaauugugagaugaaaaugagaauuugggggccagagguggaaugcuaugguguagugguguguuugggugucagguuggcugggguagacuagagaugcuugauuuugauuauuaacuuggguggaaucagaaucacccuggaaacaugccuuuggauaugucucuaugaaguuuaacugaagagggaagacccacccuaaauguggaugacacuauuuuaggacuuggggucuuaaacugaaugaaaaggacaaagugagcggaaaaucaaaauucgucucucuuugcuuccuaacugucagucuugcugccgugacuuccccuaccauauggaaugcuucucuucaaacuguaagccaaaauaaauguuuccucccuua

SEQ ID NO: 9833 - RNA, 8909 nt, Mus musculus
cugcauuuaguaaagauaaauuuuuaucucaaaaauuaaguaacuacaaaaaucacucuaagaaguuucagaaccuuuuaacugucagcuuuauuuaaaaaauacaaauauuuucacauguuagauuuuuaaagcaucauacaacaaagaaaucuacgucaaauaacucaaaaacacaaauucuguccacuaaauguuacaguauuuaagauaaauuaaauauuuuucauauuaucaacauuuaagaaaaagcuauuucuaagguguugcuauaauuaaaauaaaaacaaccaguuuucuuuucuuuuucuuuuguuuuuuuagagagaggauuuuucuggcugucauggaacucacucuguagaccaggcuagucucaaacucagagaucuauggaaugcugggguuaaaggcuugugcuacuacugcccagcaaaacaaccaguuuucaacagcaaacucagcacaugcuuaaaacaucaaaaugauggugaauuggugcaaacauuucauaucugaaaaaaaaugcacuucuugugaauucuaacacuuagccaaauauaaucuuauucgucaaagaaacacuucuggcacugugauuggagcccggcucucaagguuuacauuacacgacugguggcaagcuccaaguaggaagagggaaugggaugagauaagauaauuugucaucuucuagggauggugugaucagcuuuucauugauaguuacauauugggacagaauugaaaaaacaaguauuuugaaauuuuuauguaucaaguugaaauuucuaucagggucaaaucugaaaucacauuuaaacauagacauaucagucuugcagacuucauucgguauauacuuguauauuuuguucagaccaaagggauuuuagaaauauuaguuacuuuuaaaacaagaacaagugcuucuuauuuauaaugaauauaguuaaauuauuuggcagguaaaagcaucacacacuuucagguuuuauaucucaaauacuccugaggaaacaguaagaauaaaaacaacuuuuuaugcuuuuaaaaccucuuuuucagagauuguuaagaugucuaaagaaaauaacaugaaauacuggacuuagugggaaaacuaaggaacuuauaccaaauagggaaaaaaauuaaacugaccuaucaucugcaauggaaaaugugauucaaaauuuaaaggagcauggcaucuuuguuaaauacaagaucaaauaugaucacucacucgaaaaguacccucaaugacauuaugagugcauuuaguuuggggaaaauaguuuuaacagcuuucucaggaaaaaaguuucacuuuuuucauaacaaacaaaauaacaguuacgaaguccagcgccaccaagcaaccuucauucugucccauacugcagagaaugaaucaaaggcaggacgcacauccaggauagugaacugguacuccuuguucaccucaccaccaucauaguaaucaaucacauaucuaacuucugugccacaacgauugaugauccagucauggcggucaaaaggcaauucauaccuguaaugaaaacaguuugcuaaaaugcaggucuguauucugucugucuuggugguagcagaaagacagagugaaaaacagcacauacucauuugcaaauaucuagcagaggagaugagccuuagucaaucaguccaugguguuuagagaauauggugauuaagaacuaugaugaauccaugucuauaaaggaauagguucaugguaaagagggccaggccaggcuagguagaaagcuggagaaaucaaauguacuuaauaguccuauuacacuauaagacaagggaggaguaaggcaagacaaagagcacaagaggaguaaaaagacaguucugaagacaccaaaaaaaaagaacaauucaauccuuccagagugaagcaugaaaccagcaacccaaccuuuauaauucugcccaucuaugaguaaacucaaggauaugaaagaaacauaggcuggauacuggagauguggaagauggaauugcuuuuccuacacuguuuuaggugauaggaaugcuaaccauggcuuaaggaauaucaacagcaguucuacacugacacuuaccccauccaggaacgaauucuugcucuuggugaauacucucuugcuuuaccuccaaaucggaccaacgaugggccacaaggacacucacugaaaaugcccaaauaagaauagucuauuaaaaacauuuucuuucauuugauaggaugauauuuuuguuuuugaguaaagucuucuuuucuacauuuauuuguuauacuaucacauuuacagagaauaacuucuaacaaaguucaaauaaauccuauuuguuagagaccuuuuucuuuccuuucggauuaugugugucucuuuguaggcgucugcuuggcuuucuugccagauucaggaagcaagaccuucucauuugggacaaggacacaggcauacucucagagaaaaagugcuauauacuguguaucuucuuucucuuuugcaaaaagcacuuaguguuucugcagagaaacaacagaaacugcuauauagucagcccucugagucuaugagcuccauuuucacagauucaaccaacuguacacuguaaggacuuggacaaacacuguagcugaggacugggguauauagcucaguugguaugguacuuuccugccauacauaaagcucuggguuccaugcuuaguaccacaaaaaucaaguauugugacguacauauguagcuuuaacacuuagaaggugaagguaagggagaucacaaguucaagguuaucuuuagguuauucagggguuguuuuugagacaacacuguaucaaaaacaaagugguaacaaacguaaaacacaaaacucugcacuugcacugagcauaucugauuuuuauuucauuucauuguuccuuaaguaaaacaguauaucgaauauucacaaaacauuuauacuguuuuuagucauuauaagugacugucuaaaauauguaggaagauguacacauacuguaugcaaaugcaaugaaauuauaauaugaggcacuuucaguaucccuggcuuuuguuacccuugauguccuagaacaaucaaagaauauugugggaggacuuuauugcuucauuagaaaccauuagcagucuuaacuggaaaaaauaaugggggcugacuccaaggaacuaacuguaaguaguauugaacuugcuuuuuuaauuaaccugaacacugguaggauccuaauuaaagaccuuaggggacugucuucuacuggcaccaggaacaaggaggcuaccccugaaagacacaaaccaauugcucuuauggacuggaagacuggcucauuaagacaggagccacuaucuugacagcugcuucauaagacaagcuauauuccuauuauguaagggagaaaagauuccauauccaagaguacaacagaaacauuagugaagucuuuuaggaccuagcuaauuuugccagaaaucugcaaaaauaaccagugguguugaaacuggcaaaaugaaauugccugcugcucuuaauucuuugcuuuuaaaaucacacuacaaguuggccagccaggucuuucuucuaggucagggauuacugaaaggaaaaguacacccauccuauaccuacaauccagcuagugacacucaaguagugcuaauacggaaauguucaaugcaaauaccaaaaccagaagaugaacuuaaaaauaaaucaguguaguuuuucuucaagaagcuuacuccucacgcacuggaagaaauuugaaauguaaaccagauggugauaggaccuaguucuuuauaaggauacuccuuccucauccaccucuggaagaggagauguaaaaccaguaaugucacaucacuccauaaaccaaaccugggacaggcguccuguaagggagccuagcauuuagaguggcaacaaaccugccaggugaugcgaacaaacacuugcucuuucaacuggccuauucucuuugagaaaagggacccaaugugaagacagaucuuuaaagucaauccuuacagggauuccaaauccugcugaaggaacaaguuuuaaaagagcuuaaacauacuuacugagcaugaagggcuucccauuuuaaaaucuccuuccacgcuugcucauuauucugauugugaauucuaaugauauuguacauaucuuucugacuaauaucaucaucuuuccacuuccaccuaagaaagaacauguaguaaaacuugacaaauauuauugauuaaagucaaaaaguuaauccauacauagauauacauuuuuauaaaagcuuacauacacuaaaauuagaaauugaagguucauguuaaucuaguuucacggaauccccaaaagccauccuuauacaaccaucuauuuuuaaggugguauuuagaagcacugagaaauaauuugccaauuuuuccuagucauuuuauguguuuuguuuuuuuuauuucuaaaaauaaaaaugcggugagauacagguaaaucucauccaaucaguuauaggucuaaguauuaacaaaagggcugcuguccuuuccacaaucaaacacaauuccuacauguuugcuggagcuauaacauuaggcaucaccuaauuuucaaccagaacuuaaacaucaggucuuucuggauuucaagcuucccaauuuucauucaggccaggacuucuacugguuccuggggucucagaguggcuacucaaaucaguggccacuugcuggcugcagcucuugggacuugcugcugacuuaaaugauaaugggaagcacuuucuuauaacaaauguuuucccgaucaccccucaaccccaugcccuguuaguuccauuuguuucuagaaaauccuuaccuuaaauacuggucuugaacuuacauucugauaaauuaauauucuauuauaaacuguuuaagucacuaaagaaauacuuuacauuuuggaggcuaaacaaaagcucuuuaacauuuaauucugagguaaauguggcaaggaaauuaucuucuaaauaauguucacucacccuuuccguaacauggcauuccagaacaucuguucagaaggguaaacccacuuuuucucagagucagcucuuggaauugaugacuccucucuugagguagacaaaguaaauggcugaucuggggauggugucugauuaggugguggcaucuauagaauaucaguggauugugucugaauguuagcacuauggucuaaacuauaaaauaguacacccuggaaagcaauucuccauacaagaagcccaaguucccauucaaucaaugacaccaguguuuuacaccucugcuauuuuggucauaccacuuuuuuguugcugcuccaagaaaacaaucagcaagaagggguuuaggggaagauuuauucuagcuuuuagucugaggagacacauggccaugguagagaaugcacagguacaaaaaugcccuggcaagacaugaggguggauuaccagguuugaaggaucgaggcucuccuuauccuuagcucuagcaccaguaacagggcauuccacauaaucauaggcccggucuuggugagcaggcacagugugugcuuugcucucacuggucaggucagauguugcugcagucacuggacagccugaaauuaucaaguauuaaaacacuguuacugcuaaaugccauaucauaccauacuaagauacagcggaagggguccucuuaguggggaccuuaaagagcuaaaguucggaccaacacaacuggaaaacuaaauuucuucuacuucaagauagcaugaacuaagcuacuuaacuuucuaaaauccuaaaaauaagaugcuauaaauggacuuucccuuuaaaagaaaaaaaaaagagaaaaaaacaaacaaacaaaaaaaaaaccccaaaaaaaacaaagggagaacuggccauacuucacaaggucucucucugacuuccagccauuaguuccauacaaguccagccccaaugagguagcagccacuaucuaaguaagcaucuauuguuaaucuauuccuucaaaaaaagcagauuuuauauacacucaaagaaaaauguaaaucccacuaugcucaugguuuuuuccagaacucaaguaagccaccaaaaauuuaccacucaucugaggugcuaguccuuguaagcagauaaagugcaccaagaaaaggcaauuuuuaaagaaaauggcccaugauagucuccuugagucaaucccaaguuaaugcccaagcuccuaggguacuaauccaggcagguguggagaccaagaagccggucuaagcagcaggugaaugggaagguacuuaaagaucugugucccagaauaaaaagccacuucuguuaugaaauccuuccuuuuuccagggaccaagaggaaauuaugaauaucaugaauacuauuauauagaaagacaaauuucuauuuacuccuuuggccucuucuaccaggccuuauucccaaaacugcacgcagcuguucacuuuaggagcgagaacacagcugcucuaucucccucugcaucauuaaaagcaccaaucuuccuagagcauccaucccagauggcuauuagaaagaaaacagcguuacaguuuccacaucauauaaccaggaagcccuuuagucuccuacaaacacucacauucuuacuaaugcaaauaaaccaggaugacaagucuuuaaaauagauaaaauauaaaucaugcagagaacuacuugaggaaagaagcucagagcaaagacacacgugcuuugucugauuugucucaacuucuaggagaaauacuaggagaccaugggaucuguccuuguccaaggucacagaauuuucaccaacuuugccacuuacuagcuacaugacuugaaguacauaaauuacucugagcuuuaguuucuuuccuuggcuauaaaacagucacacugguuuauagacaugauaauguaaacucuccugggcaaagaauuuuugucuacuauaucuacuucucucucagugaagaaacaaaacccagcaaugcuugucacaggauaagugcugaccucuuggagaaaguuggcucgaggagagaaagaggaauggugacacuggaagcaugaggacccaacaacaugcacauucaguaagcauacaacacugucccggucucaacugucuacagcagacaugcacucauuaaagaacuguuuuguuuccagccuagcacugacauaaugcucuauaaauucacuuggugaaggcugauuuugaccuagaugaagaccuuaacagauaugggaguaguguauuucaaacagcuacaccgagguuuauucagcucuggcacccuuacuauuuauggaccaaagacuccaugucugaggcuguaugaugucuauuuagcacuaucuaauaccaccccagucuaugucagcagaaccauuuccucucaguugugagaaccaaaauauguauucaaugauggcucuuuacaugcauagcugaaagccacugauguaggcacugguaaacuuuggaaagacaaggcugauuuaaggaaaaauugcauagaugacagacugugagauauaaaaaaaauuguuuaugauaauaucuagugagcagccaaauuggaccagccccagagugccuuagucccgcuuugcaagccucacuaccaagcuacaacucuagaacuguggcucucagccuguggguugaccccucuggcaacgcacuaucuccaacaauauuuccaugacgagucagaacagaagcaaacuuacaguaaugacguugaaaggaaaauaauguugugguugagucaccacaacgugcagaacugggucaaaggguccagcauuaggaagguuugagaaccaccgcucuagaaucacuagcuuucuuuuaauuuucgagacaggcaaguuaccuuuccuuugcccuuuaugcaucgggcauccugaagguggugaagcuggcugaccaucugaagcauucgaggcguuuacugcaguagcaggagaagaugcugaggcacccauggcuggaaucacaggggucacucccaaucuaaaauacccagcugccaaagcaagaaaucagauuaaaacguggaggcuaaacaguugauauccccuuguuauucugauccuggcuggcccuggcuuuuuuucaccaucccuugggagaguaagagguagggcacugguucgggggugggggugggggguggugaggggacacuuugaaaacagugccuccauugggaaaauaccuugaagccuaugccaccauuuggggacccgugccagagucuggaaacuuguaagaugcaaccacgucgugaagacggguguagucuugauggugggguccaagggaaaauacacugaacuagccucgaacccguguucccaguagggcaggcgccucagggaaaauaggaagguuaaaaaaaaaaaagucaccaaaacgggaggcaaggagcggcgaagggcaggaagccaccaguguugccuucccgucuaugcgcgucccaccggcaccgcggucugcacagugcaccggcuccagccggacccggacgccguccuguccccaagucaccucgccgacugucccgcgccgcgcggccccgagcgcgucaaccugcccagccgaacucacucggcagccgccggcuccagccgaacccgggcgccgcccugcccccaagucuccgcuccgacuugucccgcgcggcgcggccgcgagcgcgucgaaccgcccagccgaagucgcucggcugcacccgcgguuuuuccucacgcggggucaccgcuaacguccggucacagccggcguucucgggcgccguuacuuccug

SEQ ID NO: 9834 - RNA, 8909 nt, Mus musculus
caggaaguaacggcgcccgagaacgccggcugugaccggacguuagcggugaccccgcgugaggaaaaaccgcgggugcagccgagcgacuucggcugggcgguucgacgcgcucgcggccgcgccgcgcgggacaagucggagcggagacuugggggcagggcggcgcccggguucggcuggagccggcggcugccgagugaguucggcugggcagguugacgcgcucggggccgcgcggcgcgggacagucggcgaggugacuuggggacaggacggcguccggguccggcuggagccggugcacugugcagaccgcggugccggugggacgcgcauagacgggaaggcaacacugguggcuuccugcccuucgccgcuccuugccucccguuuuggugacuuuuuuuuuuuuaaccuuccuauuuucccugaggcgccugcccuacugggaacacggguucgaggcuaguucaguguauuuucccuuggaccccaccaucaagacuacacccgucuucacgacgugguugcaucuuacaaguuuccagacucuggcacggguccccaaaugguggcauaggcuucaagguauuuucccaauggaggcacuguuuucaaaguguccccucaccaccccccacccccacccccgaaccagugcccuaccucuuacucucccaagggauggugaaaaaaagccagggccagccaggaucagaauaacaaggggauaucaacuguuuagccuccacguuuuaaucugauuucuugcuuuggcagcuggguauuuuagauugggagugaccccugugauuccagccaugggugccucagcaucuucuccugcuacugcaguaaacgccucgaaugcuucagauggucagccagcuucaccaccuucaggaugcccgaugcauaaagggcaaaggaaagguaacuugccugucucgaaaauuaaaagaaagcuagugauucuagagcggugguucucaaaccuuccuaaugcuggacccuuugacccaguucugcacguuguggugacucaaccacaacauuauuuuccuuucaacgucauuacuguaaguuugcuucuguucugacucgucauggaaauauuguuggagauagugcguugccagaggggucaacccacaggcugagagccacaguucuagaguuguagcuugguagugaggcuugcaaagcgggacuaaggcacucuggggcugguccaauuuggcugcucacuagauauuaucauaaacaauuuuuuuuauaucucacagucugucaucuaugcaauuuuuccuuaaaucagccuugucuuuccaaaguuuaccagugccuacaucaguggcuuucagcuaugcauguaaagagccaucauugaauacauauuuugguucucacaacugagaggaaaugguucugcugacauagacuggggugguauuagauagugcuaaauagacaucauacagccucagacauggagucuuugguccauaaauaguaagggugccagagcugaauaaaccucgguguagcuguuugaaauacacuacucccauaucuguuaaggucuucaucuaggucaaaaucagccuucaccaagugaauuuauagagcauuaugucagugcuaggcuggaaacaaaacaguucuuuaaugagugcaugucugcuguagacaguugagaccgggacaguguuguaugcuuacugaaugugcauguuguuggguccucaugcuuccagugucaccauuccucuuucucuccucgagccaacuuucuccaagaggucagcacuuauccugugacaagcauugcuggguuuuguuucuucacugagagagaaguagauauaguagacaaaaauucuuugcccaggagaguuuacauuaucaugucuauaaaccagugugacuguuuuauagccaaggaaagaaacuaaagcucagaguaauuuauguacuucaagucauguagcuaguaaguggcaaaguuggugaaaauucugugaccuuggacaaggacagaucccauggucuccuaguauuucuccuagaaguugagacaaaucagacaaagcacgugugucuuugcucugagcuucuuuccucaaguaguucucugcaugauuuauauuuuaucuauuuuaaagacuugucauccugguuuauuugcauuaguaagaaugugaguguuuguaggagacuaaagggcuuccugguuauaugauguggaaacuguaacgcuguuuucuuucuaauagccaucugggauggaugcucuaggaagauuggugcuuuuaaugaugcagagggagauagagcagcuguguucucgcuccuaaagugaacagcugcgugcaguuuugggaauaaggccugguagaagaggccaaaggaguaaauagaaauuugucuuucuauauaauaguauucaugauauucauaauuuccucuuggucccuggaaaaaggaaggauuucauaacagaaguggcuuuuuauucugggacacagaucuuuaaguaccuucccauucaccugcugcuuagaccggcuucuuggucuccacaccugccuggauuaguacccuaggagcuugggcauuaacuugggauugacucaaggagacuaucaugggccauuuucuuuaaaaauugccuuuucuuggugcacuuuaucugcuuacaaggacuagcaccucagaugagugguaaauuuuugguggcuuacuugaguucuggaaaaaaccaugagcauagugggauuuacauuuuucuuugaguguauauaaaaucugcuuuuuuugaaggaauagauuaacaauagaugcuuacuuagauaguggcugcuaccucauuggggcuggacuuguauggaacuaauggcuggaagucagagagagaccuugugaaguauggccaguucucccuuuguuuuuuuugggguuuuuuuuuuguuuguuuguuuuuuucucuuuuuuuuuucuuuuaaagggaaaguccauuuauagcaucuuauuuuuaggauuuuagaaaguuaaguagcuuaguucaugcuaucuugaaguagaagaaauuuaguuuuccaguuguguugguccgaacuuuagcucuuuaagguccccacuaagaggaccccuuccgcuguaucuuaguaugguaugauauggcauuuagcaguaacaguguuuuaauacuugauaauuucaggcuguccagugacugcagcaacaucugaccugaccagugagagcaaagcacacacugugccugcucaccaagaccgggccuaugauuauguggaaugcccuguuacuggugcuagagcuaaggauaaggagagccucgauccuucaaaccugguaauccacccucaugucuugccagggcauuuuuguaccugugcauucucuaccauggccaugugucuccucagacuaaaagcuagaauaaaucuuccccuaaaccccuucuugcugauuguuuucuuggagcagcaacaaaaaagugguaugaccaaaauagcagagguguaaaacacuggugucauugauugaaugggaacuugggcuucuuguauggagaauugcuuuccaggguguacuauuuuauaguuuagaccauagugcuaacauucagacacaauccacugauauucuauagaugccaccaccuaaucagacaccauccccagaucagccauuuacuuugucuaccucaagagaggagucaucaauuccaagagcugacucugagaaaaaguggguuuacccuucugaacagauguucuggaaugccauguuacggaaagggugagugaacauuauuuagaagauaauuuccuugccacauuuaccucagaauuaaauguuaaagagcuuuuguuuagccuccaaaauguaaaguauuucuuuagugacuuaaacaguuuauaauagaauauuaauuuaucagaauguaaguucaagaccaguauuuaagguaaggauuuucuagaaacaaauggaacuaacagggcaugggguugaggggugaucgggaaaacauuuguuauaagaaagugcuucccauuaucauuuaagucagcagcaagucccaagagcugcagccagcaaguggccacugauuugaguagccacucugagaccccaggaaccaguagaaguccuggccugaaugaaaauugggaagcuugaaauccagaaagaccugauguuuaaguucugguugaaaauuaggugaugccuaauguuauagcuccagcaaacauguaggaauuguguuugauuguggaaaggacagcagcccuuuuguuaauacuuagaccuauaacugauuggaugagauuuaccuguaucucaccgcauuuuuauuuuuagaaauaaaaaaaacaaaacacauaaaaugacuaggaaaaauuggcaaauuauuucucagugcuucuaaauaccaccuuaaaaauagaugguuguauaaggauggcuuuuggggauuccgugaaacuagauuaacaugaaccuucaauuucuaauuuuaguguauguaagcuuuuauaaaaauguauaucuauguauggauuaacuuuuugacuuuaaucaauaauauuugucaaguuuuacuacauguucuuucuuagguggaaguggaaagaugaugauauuagucagaaagauauguacaauaucauuagaauucacaaucagaauaaugagcaagcguggaaggagauuuuaaaaugggaagcccuucaugcucaguaaguauguuuaagcucuuuuaaaacuuguuccuucagcaggauuuggaaucccuguaaggauugacuuuaaagaucugucuucacauugggucccuuuucucaaagagaauaggccaguugaaagagcaaguguuuguucgcaucaccuggcagguuuguugccacucuaaaugcuaggcucccuuacaggacgccugucccagguuugguuuauggagugaugugacauuacugguuuuacaucuccucuuccagagguggaugaggaaggaguauccuuauaaagaacuagguccuaucaccaucugguuuacauuucaaauuucuuccagugcgugaggaguaagcuucuugaagaaaaacuacacugauuuauuuuuaaguucaucuucugguuuugguauuugcauugaacauuuccguauuagcacuacuugagugucacuagcuggauuguagguauaggauggguguacuuuuccuuucaguaaucccugaccuagaagaaagaccuggcuggccaacuuguagugugauuuuaaaagcaaagaauuaagagcagcaggcaauuucauuuugccaguuucaacaccacugguuauuuuugcagauuucuggcaaaauuagcuagguccuaaaagacuucacuaauguuucuguuguacucuuggauauggaaucuuuucucccuuacauaauaggaauauagcuugucuuaugaagcagcugucaagauaguggcuccugucuuaaugagccagucuuccaguccauaagagcaauugguuugugucuuucagggguagccuccuuguuccuggugccaguagaagacaguccccuaaggucuuuaauuaggauccuaccaguguucagguuaauuaaaaaagcaaguucaauacuacuuacaguuaguuccuuggagucagcccccauuauuuuuuccaguuaagacugcuaaugguuucuaaugaagcaauaaaguccucccacaauauucuuugauuguucuaggacaucaaggguaacaaaagccagggauacugaaagugccucauauuauaauuucauugcauuugcauacaguauguguacaucuuccuacauauuuuagacagucacuuauaaugacuaaaaacaguauaaauguuuugugaauauucgauauacuguuuuacuuaaggaacaaugaaaugaaauaaaaaucagauaugcucagugcaagugcagaguuuuguguuuuacguuuguuaccacuuuguuuuugauacaguguugucucaaaaacaaccccugaauaaccuaaagauaaccuugaacuugugaucucccuuaccuucaccuucuaaguguuaaagcuacauauguacgucacaauacuugauuuuugugguacuaagcauggaacccagagcuuuauguauggcaggaaaguaccauaccaacugagcuauauaccccaguccucagcuacaguguuuguccaaguccuuacaguguacaguugguugaaucugugaaaauggagcucauagacucagagggcugacuauauagcaguuucuguuguuucucugcagaaacacuaagugcuuuuugcaaaagagaaagaagauacacaguauauagcacuuuuucucugagaguaugccuguguccuugucccaaaugagaaggucuugcuuccugaaucuggcaagaaagccaagcagacgccuacaaagagacacacauaauccgaaaggaaagaaaaaggucucuaacaaauaggauuuauuugaacuuuguuagaaguuauucucuguaaaugugauaguauaacaaauaaauguagaaaagaagacuuuacucaaaaacaaaaauaucauccuaucaaaugaaagaaaauguuuuuaauagacuauucuuauuugggcauuuucagugaguguccuuguggcccaucguugguccgauuuggagguaaagcaagagaguauucaccaagagcaagaauucguuccuggaugggguaagugucaguguagaacugcuguugauauuccuuaagccaugguuagcauuccuaucaccuaaaacaguguaggaaaagcaauuccaucuuccacaucuccaguauccagccuauguuucuuucauauccuugaguuuacucauagaugggcagaauuauaaagguuggguugcugguuucaugcuucacucuggaaggauugaauuguucuuuuuuuuuggugucuucagaacugucuuuuuacuccucuugugcucuuugucuugccuuacuccucccuugucuuauaguguaauaggacuauuaaguacauuugauuucuccagcuuucuaccuagccuggccuggcccucuuuaccaugaaccuauuccuuuauagacauggauucaucauaguucuuaaucaccauauucucuaaacaccauggacugauugacuaaggcucaucuccucugcuagauauuugcaaaugaguaugugcuguuuuucacucugucuuucugcuaccaccaagacagacagaauacagaccugcauuuuagcaaacuguuuucauuacagguaugaauugccuuuugaccgccaugacuggaucaucaaucguuguggcacagaaguuagauaugugauugauuacuaugaugguggugaggugaacaaggaguaccaguucacuauccuggaugugcguccugccuuugauucauucucugcaguaugggacagaaugaagguugcuugguggcgcuggacuucguaacuguuauuuuguuuguuaugaaaaaagugaaacuuuuuuccugagaaagcuguuaaaacuauuuuccccaaacuaaaugcacucauaaugucauugaggguacuuuucgagugagugaucauauuugaucuuguauuuaacaaagaugccaugcuccuuuaaauuuugaaucacauuuuccauugcagaugauaggucaguuuaauuuuuuucccuauuugguauaaguuccuuaguuuucccacuaaguccaguauuucauguuauuuucuuuagacaucuuaacaaucucugaaaaagagguuuuaaaagcauaaaaaguuguuuuuauucuuacuguuuccucaggaguauuugagauauaaaaccugaaagugugugaugcuuuuaccugccaaauaauuuaacuauauucauuauaaauaagaagcacuuguucuuguuuuaaaaguaacuaauauuucuaaaaucccuuuggucugaacaaaauauacaaguauauaccgaaugaagucugcaagacugauaugucuauguuuaaaugugauuucagauuugacccugauagaaauuucaacuugauacauaaaaauuucaaaauacuuguuuuuucaauucugucccaauauguaacuaucaaugaaaagcugaucacaccaucccuagaagaugacaaauuaucuuaucucaucccauucccucuuccuacuuggagcuugccaccagucguguaauguaaaccuugagagccgggcuccaaucacagugccagaaguguuucuuugacgaauaagauuauauuuggcuaaguguuagaauucacaagaagugcauuuuuuuucagauaugaaauguuugcaccaauucaccaucauuuugauguuuuaagcaugugcugaguuugcuguugaaaacugguuguuuugcugggcaguaguagcacaagccuuuaaccccagcauuccauagaucucugaguuugagacuagccuggucuacagagugaguuccaugacagccagaaaaauccucucucuaaaaaaacaaaagaaaaagaaaagaaaacugguuguuuuuauuuuaauuauagcaacaccuuagaaauagcuuuuucuuaaauguugauaauaugaaaaauauuuaauuuaucuuaaauacuguaacauuuaguggacagaauuuguguuuuugaguuauuugacguagauuucuuuguuguaugaugcuuuaaaaaucuaacaugugaaaauauuuguauuuuuuaaauaaagcugacaguuaaaagguucugaaacuucuuagagugauuuuuguaguuacuuaauuuuugagauaaaaauuuaucuuuacuaaaugcag

SEQ ID NO: 9835 - RNA, 1145 nt, Mus musculus
guagcacgcugagcaguauuuuauugaucaagccgcauaaaaagccagaaagcucuccguuuuccaauguucaauguccaaauaaucugccauucugcagacguggccugugacggcaccugucuccucggcuccgcaggucuguguaacucggcggacagcuggaugaucgugcccaacaucaagcagaaccacuacaccgugcacggccugcaaaguggcaccaaguauaucuucacggugaaggccaucaaccaggcgggcagccguagcagcgagcccggaaagcugaagaccaacagugagugcuguggacucggcugagcugccagcuuacacugccucagaaaaucacucacagucaucccccugccucagaaaaucacucacagucaucccccugucucacauggucacucagggucaucccccugccucagaaaaucacucacagucaucccccugucucacauggucacucagggucaucccccugccucagaaaaucacucacagucaucccccugccucagaaaaucacuuacacucaucccccugucucacauggucacucagggucaucccccugcuucagaaaaucacucacagucaucccccugucucacauggucacucagggucaucccccugcuucagaaaaucacucacagucauccccaugucucacauggucacucagggucaucccccugccucagaaaaucacucacagucaucccccugccucacauggucacucagggucaucccccugccucagaaaaucacucacagucaucccccugccucacacggucacucagggucaucccccugcuucaguagcagugagcccggaaagcugaagaccaacagugagugcugugaacucggcugagcugccaucucacggcugcuugccuuuggggcugaggcugcuccccaccuuucuuuuacguuuuccguccugggccucacugacagccucacacaagugaaucaaggaccaaugugaaacacugagguucccagcagccgcaucgagguucucaauuggggccuucgggucccagauccguccccgcgaggcagagaaccgggggugcacuugcgcguuucucgccaccggguggccccggagaucg

SEQ ID NO: 9836 - RNA, 1145 nt, Mus musculus
cgaucuccggggccacccgguggcgagaaacgcgcaagugcacccccgguucucugccucgcggggacggaucugggacccgaaggccccaauugagaaccucgaugcggcugcugggaaccucaguguuucacauugguccuugauucacuugugugaggcugucagugaggcccaggacggaaaacguaaaagaaagguggggagcagccucagccccaaaggcaagcagccgugagauggcagcucagccgaguucacagcacucacuguuggucuucagcuuuccgggcucacugcuacugaagcagggggaugacccugagugaccgugugaggcagggggaugacugugagugauuuucugaggcagggggaugacccugagugaccaugugaggcagggggaugacugugagugauuuucugaggcagggggaugacccugagugaccaugugagacauggggaugacugugagugauuuucugaagcagggggaugacccugagugaccaugugagacagggggaugacugugagugauuuucugaagcagggggaugacccugagugaccaugugagacagggggaugaguguaagugauuuucugaggcagggggaugacugugagugauuuucugaggcagggggaugacccugagugaccaugugagacagggggaugacugugagugauuuucugaggcagggggaugacccugagugaccaugugagacagggggaugacugugagugauuuucugaggcagggggaugacugugagugauuuucugaggcaguguaagcuggcagcucagccgaguccacagcacucacuguuggucuucagcuuuccgggcucgcugcuacggcugcccgccugguugauggccuucaccgugaagauauacuuggugccacuuugcaggccgugcacgguguagugguucugcuugauguugggcacgaucauccagcuguccgccgaguuacacagaccugcggagccgaggagacaggugccgucacaggccacgucugcagaauggcagauuauuuggacauugaacauuggaaaacggagagcuuucuggcuuuuuaugcggcuugaucaauaaaauacugcucagcgugcuac

SEQ ID NO: 9837 - RNA, 2501 nt, Mus musculus
uuaccagaacucucugugggaaccaggaugccugaaauugcaugcuguaagucgguugggugcuccggacuagcgauggcuccauacagaacgaagcucaguuccuccucugugaaguugaagccgcaaaacggcagcuuccccucuugauucaagguuugggggacagauauugacugggacgacuuaauuccaucagguaguagggaagcaauuaccggggauggcagaaguaaauuuucagcuucccaccucugaccacugauuuggccaccgccgccgccgaggaccaaauuuugguugcuggaaccgcugcuccuaugcucagugcugucuagaaaucgugguacuucgggagugaauugaggaauucgguuccauggugacaauuuguaccagggcagauuguagagcggcucgcucugaacagccagacccggguucaacaagggagcagucauccgaaaagcaucaagaggggccaucgccugggacucaagcacugcagcugccaguuuccaagguugaaacuccuccucggugguggcgagguuccuaaagugacuguagccuggggcaugcgcguaguagguagucagguggugaggguugcucuggggcagguaguucgccuuguccugggacugggucucaccagagggcgguaaggccaucgcaagcugaguuuugcggaucugugggaaaccgagcuggcugagugagggguccuaggugaucuuaacuacuucccuccaccccaucaaagucaaugaacaaaguucccaauucgaucccgccaauccuagcucgaaaaaaguaacacaaaaggcacaaacucccacaccaaaccgaacuaaaaagccaaacgucucaaaccucuaacgaaaaucugccuuggugucacccgacugaaaggugcuggcucaggucgccuucucuuuugcucccuaaaccaccuugacuaaggaaugccggugacccccgcucccaagcccucaacccggcuccuacaaaacggguuucaauuccgucucucuuaauuaucagcccaacaaaacgaaccacccgccuaggucucuacgagcgucuuuuuuuuuuuuuuuuuaauauaauuuuuuuagccaagcuacuagggcacgacccugcaccgguuucggagcaggcaguggcuucaggcgcucuugaguaugcagccgagauaggagaagugugcgcucucggugggacagugcagaagggguucugagucgacucggcaccccaaggaguuuagcgaaacgucagcgaccccggcggucccaacagcaccgaggggagcggagcgguauucguccucccucuagagacccacgcccagcgccccuucccgccacaucuccaaucucuuggcaacccuagccaucucaaccuaggucgccucuggagacuccgggaugacaagucccaagccaggcagcagagagaugucucgguugucgccgaccuggccgcggcggcccuggcccccgaaaugcuucuuucucaguagccacacagcagggcuaaggagugaagacccguaggguccgaggauuuuaagaucagggaucaauguguccaauaaggaaaacaacccgggucgugacucagauguuaaagaacauagggucagggggcgaggucagccaccacacaggccucuccgucuaucucccccugagccccgaacagcgcaggcucuaacucccaagacaagcgacuccggagguggaaagccaaaauccaauuacgaaguuuaaaacaaaaacaaagccaaaaacaacuaacuaaguaaaacaaagaaaaaacaaaaacaaccaaacaacugcaaaacgaauuuugaaagcgauuacagagcacuguucccagccgugcuggaagccuguagccuucgggguaggucccuccagcgggccaaagaccuaccuaccucaggccaaggcuagggcggcacccgcugggucucgggacccuagacuucugaaacccccgaaggcugugcaggcuuuaagagggagggugcagauccggccucaggguacuuggagagggaggcaguagaagagaucaggccuguggagguccccugauagucuucuccccgcccaccacacucauuggcgagcgcuuggauuccuccccagguccccagagaucacccacuuaaccuaacaguucucuugaccguucccuggaauccugugaagugcgauugcccaucuugcacaggcagguguuguuguuguuguuguugauucagucuagcaacgucaggaaaucauaguguggcaaauguugcccaaggccagagcguagcaaaugcuaaccaguguucaccuucuguguguaaacgcacacgugcacacaugcacacaccacacacgcacacaaacccagaagugucggcgugagaacuaaacaaguguuacccuggggacccaauaaauucuucugugcccucacacacacuacacccuaaaagg

SEQ ID NO: 9838 - RNA, 2501 nt, Mus musculus
ccuuuuaggguguagugugugugagggcacagaagaauuuauuggguccccaggguaacacuuguuuaguucucacgccgacacuucuggguuugugugcguguguggugugugcaugugugcacgugugcguuuacacacagaaggugaacacugguuagcauuugcuacgcucuggccuugggcaacauuugccacacuaugauuuccugacguugcuagacugaaucaacaacaacaacaacaacaccugccugugcaagaugggcaaucgcacuucacaggauuccagggaacggucaagagaacuguuagguuaagugggugaucucuggggaccuggggaggaauccaagcgcucgccaaugaguguggugggcggggagaagacuaucaggggaccuccacaggccugaucucuucuacugccucccucuccaaguacccugaggccggaucugcacccucccucuuaaagccugcacagccuucggggguuucagaagucuagggucccgagacccagcgggugccgcccuagccuuggccugagguagguaggucuuuggcccgcuggagggaccuaccccgaaggcuacaggcuuccagcacggcugggaacagugcucuguaaucgcuuucaaaauucguuuugcaguuguuugguuguuuuuguuuuuucuuuguuuuacuuaguuaguuguuuuuggcuuuguuuuuguuuuaaacuucguaauuggauuuuggcuuuccaccuccggagucgcuugucuugggaguuagagccugcgcuguucggggcucagggggagauagacggagaggccugugugguggcugaccucgcccccugacccuauguucuuuaacaucugagucacgacccggguuguuuuccuuauuggacacauugaucccugaucuuaaaauccucggacccuacgggucuucacuccuuagcccugcuguguggcuacugagaaagaagcauuucgggggccagggccgccgcggccaggucggcgacaaccgagacaucucucugcugccuggcuugggacuugucaucccggagucuccagaggcgaccuagguugagauggcuaggguugccaagagauuggagauguggcgggaaggggcgcugggcgugggucucuagagggaggacgaauaccgcuccgcuccccucggugcuguugggaccgccggggucgcugacguuucgcuaaacuccuuggggugccgagucgacucagaaccccuucugcacugucccaccgagagcgcacacuucuccuaucucggcugcauacucaagagcgccugaagccacugccugcuccgaaaccggugcagggucgugcccuaguagcuuggcuaaaaaaauuauauuaaaaaaaaaaaaaaaaagacgcucguagagaccuaggcgggugguucguuuuguugggcugauaauuaagagagacggaauugaaacccguuuuguaggagccggguugagggcuugggagcgggggucaccggcauuccuuagucaaggugguuuagggagcaaaagagaaggcgaccugagccagcaccuuucagucgggugacaccaaggcagauuuucguuagagguuugagacguuuggcuuuuuaguucgguuuggugugggaguuugugccuuuuguguuacuuuuuucgagcuaggauuggcgggaucgaauugggaacuuuguucauugacuuugaugggguggagggaaguaguuaagaucaccuaggaccccucacucagccagcucgguuucccacagauccgcaaaacucagcuugcgauggccuuaccgcccucuggugagacccagucccaggacaaggcgaacuaccugccccagagcaacccucaccaccugacuaccuacuacgcgcaugccccaggcuacagucacuuuaggaaccucgccaccaccgaggaggaguuucaaccuuggaaacuggcagcugcagugcuugagucccaggcgauggccccucuugaugcuuuucggaugacugcucccuuguugaacccgggucuggcuguucagagcgagccgcucuacaaucugcccugguacaaauugucaccauggaaccgaauuccucaauucacucccgaaguaccacgauuucuagacagcacugagcauaggagcagcgguuccagcaaccaaaauuugguccucggcggcggcgguggccaaaucaguggucagaggugggaagcugaaaauuuacuucugccauccccgguaauugcuucccuacuaccugauggaauuaagucgucccagucaauaucugucccccaaaccuugaaucaagaggggaagcugccguuuugcggcuucaacuucacagaggaggaacugagcuucguucuguauggagccaucgcuaguccggagcacccaaccgacuuacagcaugcaauuucaggcauccugguucccacagagaguucugguaa

SEQ ID NO: 9839 - RNA, 2501 nt, Mus musculus
cucguucacuuccucuuugcacgguccaucuuguggcuuucacucagucuacaugacauauguagacaugggcauuuugggcauuaggccuggaccacagacuuucuagauuggccucugguaggcuaacaguacuuacuguguaaaguuggaaaggauggaaccggccaggaccacuucagguaaaagccagaagcacuuuauuuaaccccacccagucuuuggcaagcuacaaagagcgggcaguuuuucuaagacucuaguuuugccucuagggaaaccaacagacaugcgacagcaguugauucuugaguuucuuacaucagccccuagcugcaaagugggcgcacacuacaacucccagacguccucgggucuaagggggcggagucugcuccgcucuagaaaauaggauucaccaaugggcgcccagagcgcugggggggggcggguccaugggcggguccgcgggggaggaggcagucgagcggcgccgguagucagucgcgccgagagcgcugggacaggacggcugugcguguagagggucucugcauagcgacgcgcgcucucgcugggccauggguaagcggcuggcgggcggcgccggggucagagggcuggggucccagagcgaucguggcucucaggguaacccgaaugucugcgugcucucuucucguggaaagucggggcggccaggggcuucccaggcguuuaucucgaaacucuccucuccgagucuggacugaaauucacugagccgcccacacuuccugcugcgguuucaaucucgagcugcucugggcccauuuguugugacagcugucagcagcagcuucucggccgcgggccccucccugccccgugccagcccagcgcuucgcuucucagaaaccgaggcgcccgggccgcgcgcagcgcuucccacugcggccgcgauuccugaaagugacugcgcggguuuugaagaaauugcucaaugcgcuuugaagaaucaacgguuccucuuuucugccaagggacaugcugaugguuugacggucacacgcuucagauccccugcuccuucucucuucucuuuccuuuuucuuuuuguuucuuuuucuuuccaacccccagcaggaaagacgguuucuuuuuacccgccugaucuucugaguuucccucuuuucccucgggucucuucaaagggacagggugauggcccuggacuggggguguuuaguggaccgagggcagaagcucaggcugccagagugcgacgaacaaguuuggcuuugcucuuauugcgaacuaggggcacaaccacaccaccgaucuguggcccuuugcacucacuacccaggcguugcucccuggccggggucacaucccacaccuaacccacaggcacaguggggccaaccguaggccgggaaggccucaaauuaaucccaaauugugcugcucaggcuguauccccuaguuugcagagucuuucauuucagaugaguguaacaggugcuccuugccccgccccgcgggcacugcugggaauugaugcaaaucuaaggaucucagugucuaaagaggauggaugccugggcaggggagggugaggaauguuaagcuagagggucugucucuacagcaguuaguguccuaaaugacugcuuggccuagaacuugaagugacagaggcagaauggccuagaauuauauaccccaccccgucuucuauuacagagaaacugaggcauagagacagacuaaggucugacagugagggaggaccaggcuucaaaaacuccuugcucuuucucuucuuuccuaguggccuuccgcugcccucggugggaagcugaucuguaaugaucuagauugccucuuggacgaguguagcaggcaccgugcuagggugaggagaggaggagaaaggaaaagugagguccggaaguucccuguguagggguuuuggccuucuguugagucaaccucugcagcuuguuucagcauagguggggugggaaaaccggaaaugauacauagagagagcaauuuucaucaaacguauggaugaaggguggggcggugaagacucaguccucccaggaguaggaucucuugggcucucucagggcaguuggagucuggaaucucauaccuggugccccuacaccccucucugccuuuaugcagccccuaggacucucagcuugucucuagccgcuaacagagcuuggcagaggugcugagggugggcuguggcuggugcuguguccuggauccucagacuccuguccagcuguccucaaggcuggcucuugguaggacugucccccccccccccccaaacugccuacuggagcaagcccaaggaggagaaugccaggcaguuggcuucugccauagaguggacugaccgcuucaaaggcugucuuuguuuccucuccagcuugagcuaagugaaacuuaagccaacaaccucaggcaaggggguggggcugugucuacugguu

SEQ ID NO: 9840 - RNA, 2501 nt, Mus musculus
aaccaguagacacagccccacccccuugccugagguuguuggcuuaaguuucacuuagcucaagcuggagaggaaacaaagacagccuuugaagcggucaguccacucuauggcagaagccaacugccuggcauucuccuccuugggcuugcuccaguaggcaguuugggggggggggggggacaguccuaccaagagccagccuugaggacagcuggacaggagucugaggauccaggacacagcaccagccacagcccacccucagcaccucugccaagcucuguuagcggcuagagacaagcugagaguccuaggggcugcauaaaggcagagagggguguaggggcaccagguaugagauuccagacuccaacugcccugagagagcccaagagauccuacuccugggaggacugagucuucaccgccccacccuucauccauacguuugaugaaaauugcucucucuauguaucauuuccgguuuucccaccccaccuaugcugaaacaagcugcagagguugacucaacagaaggccaaaaccccuacacagggaacuuccggaccucacuuuuccuuucuccuccucuccucacccuagcacggugccugcuacacucguccaagaggcaaucuagaucauuacagaucagcuucccaccgagggcagcggaaggccacuaggaaagaagagaaagagcaaggaguuuuugaagccugguccucccucacugucagaccuuagucugucucuaugccucaguuucucuguaauagaagacggggugggguauauaauucuaggccauucugccucugucacuucaaguucuaggccaagcagucauuuaggacacuaacugcuguagagacagacccucuagcuuaacauuccucacccuccccugcccaggcauccauccucuuuagacacugagauccuuagauuugcaucaauucccagcagugcccgcggggcggggcaaggagcaccuguuacacucaucugaaaugaaagacucugcaaacuaggggauacagccugagcagcacaauuugggauuaauuugaggccuucccggccuacgguuggccccacugugccuguggguuaggugugggaugugaccccggccagggagcaacgccuggguagugagugcaaagggccacagaucgguggugugguugugccccuaguucgcaauaagagcaaagccaaacuuguucgucgcacucuggcagccugagcuucugcccucgguccacuaaacacccccaguccagggccaucacccugucccuuugaagagacccgagggaaaagagggaaacucagaagaucaggcggguaaaaagaaaccgucuuuccugcuggggguuggaaagaaaaagaaacaaaaagaaaaaggaaagagaagagagaaggagcaggggaucugaagcgugugaccgucaaaccaucagcaugucccuuggcagaaaagaggaaccguugauucuucaaagcgcauugagcaauuucuucaaaacccgcgcagucacuuucaggaaucgcggccgcagugggaagcgcugcgcgcggcccgggcgccucgguuucugagaagcgaagcgcugggcuggcacggggcagggaggggcccgcggccgagaagcugcugcugacagcugucacaacaaaugggcccagagcagcucgagauugaaaccgcagcaggaagugugggcggcucagugaauuucaguccagacucggagaggagaguuucgagauaaacgccugggaagccccuggccgccccgacuuuccacgagaagagagcacgcagacauucggguuacccugagagccacgaucgcucugggaccccagcccucugaccccggcgccgcccgccagccgcuuacccauggcccagcgagagcgcgcgucgcuaugcagagacccucuacacgcacagccguccugucccagcgcucucggcgcgacugacuaccggcgccgcucgacugccuccucccccgcggacccgcccauggacccgcccccccccagcgcucugggcgcccauuggugaauccuauuuucuagagcggagcagacuccgcccccuuagacccgaggacgucugggaguuguagugugcgcccacuuugcagcuaggggcugauguaagaaacucaagaaucaacugcugucgcaugucuguugguuucccuagaggcaaaacuagagucuuagaaaaacugcccgcucuuuguagcuugccaaagacugggugggguuaaauaaagugcuucuggcuuuuaccugaagugguccuggccgguuccauccuuuccaacuuuacacaguaaguacuguuagccuaccagaggccaaucuagaaagucugugguccaggccuaaugcccaaaaugcccaugucuacauaugucauguagacugagugaaagccacaagauggaccgugcaaagaggaagugaacgag

SEQ ID NO: 9841 - RNA, 2501 nt, Mus musculus
aggcuaaaggcugacugugugugucgccgccacgcuuugcugccucugggaacacagagcugagccgcggacuggcucccuacgccaaacgcgguccgccacccaacuccuucuguaacgccauugcagguggcauuguguuggauucugaguguguagcaucugagucucggaauuuaggggaaacaagaauuucccgggcuccgcggaguuucccuccggcagaggcagcgcgcccugaagggagggcgcuccuugcuccgggugugacacacccgcagccccgcacgaaggugcguggggcgggagggaggugcggacugggagaggggcggcaggguugcguggcaccuuaacuuugaucgcgcggccgcggggcugcgagccaccgccgccccgcccgagcugggugccgcgguccucggcucugcgccgcgcgucuccgcggcugccucuuuaaucaggaacacagaaggggcgggcccugagcgggcgcguaaucggaucgcucugccgcggcucugacauccacaugcugcucggccugaaaaggcgaggggggagccggaggggaggcagaggaggcgagcaaggcaccagccugcagcccgcccccggcacauccucugaagcacagacacucggccgggcgcugggcgagguggaggugagggcgggcgccagcgaacucggagagccgcucgcacacucgcgggcgaucccagccgccgcacccgcagcaacaccagcagcaccggccgcagcagcuuccugccucgcacuccccuccagagacuggccaagcggguguaaccgccgggggaggcuccagcuuaggggaacccagaaaggacaagagccggacgucugacugcuuaccacuccgccuguccagcggucggugccucugcccgcgugugugucccgggugccgggggaccugugucaguuagcgcuucugagaucacacagcugccuaggggccgugugaugcccagggcaauucuuggcuuugauuuuuauuauuauuacuauuauuuugcguucagcuuucgggaaacccucgugauguuguaggauaaaggaaaugacacuuugaggaacuggagagaacauacacgcguuuggguuugaagaggaaaccggucuccgcuuccuuagcuugcucccucuuugcugauuucaagagcuaucuccuagugagguggagauauuccagcaagaauaaaggugaagacagacugacugccaggacccaggaggaaaacguugaucguuagagaccuuugcagaagacaccaccaggaagaaaauuagagaggaaaaacacaaagacauaauuauaggagaucccacaaaccuagccccggagagagccucucugucaaaaauggauauguuuccucuuaccuggguuuucuuagcucuguacuuuucaggacacgaagugagaagccagcaagguaagcccuucaaaguuuuucuauucauuuuuacacgguuuccccuuuaaaggcgacagcuaauggagagaagccacugagaagcgcucaugaggaggcucccucaauacucaaucauuuaaagggagaucucagcggccuucuuuacaccaccagggcugcuaaacccaacuuuucucucuugcaaagggaguguguguguguguguguguguguguguguguguguguguguuuuguaacagaauuuggcgguguucagaugucacauauggacugaaucaaagguuuaaaaauacuacaaagccuuugcauuacaguuuuggggauuuuuuuuuccucccugucuugaagcagaacacaucucccuugaguuuccucaaccuagccagugaaauauaaaucauuugcauucccuccacuuagcuacauugagcaauguuagcugaagggcuugggaaaaaaaaaaaaaagcaagagucuagcuuugcuuuucagauguguggauucuuugcagacuggguggauacaucucagaaccagagggcugaagcuggugaagcaagccagcuugugaccgagaugggagcuuucccgugggcaguugaugguccccacucucucccgaauccguguguuuucugggaaagcgaaucauguucuuuaaauuuuuuucuuaaaagauaaaacaaacuguaugacccucggcagucucuccucuugugaagugguuagaaacuuuugaguggaauuuauucucaagcacugccaaaaaggguguguggacacgggcugcagagauaggcacagcagggccuaggagaggccgggggccagcucuuguggauugcgacaagggcuaccucucugaaaacaggucucuggucucugggaaugcgguucuuccacccugggacugcuucugggggugcuucccucugcucuaagacagugucuggaaccugaaaaaaaacuauuagccuauuagcguuugcuccuacaggugacuggggauaggguaccaucuaccaaggaaaug

SEQ ID NO: 9842 - RNA, 2501 nt, Mus musculus
cauuuccuugguagaugguacccuauccccagucaccuguaggagcaaacgcuaauaggcuaauaguuuuuuuucagguuccagacacugucuuagagcagagggaagcacccccagaagcagucccaggguggaagaaccgcauucccagagaccagagaccuguuuucagagagguagcccuugucgcaauccacaagagcuggcccccggccucuccuaggcccugcugugccuaucucugcagcccguguccacacacccuuuuuggcagugcuugagaauaaauuccacucaaaaguuucuaaccacuucacaagaggagagacugccgagggucauacaguuuguuuuaucuuuuaagaaaaaaauuuaaagaacaugauucgcuuucccagaaaacacacggauucgggagagaguggggaccaucaacugcccacgggaaagcucccaucucggucacaagcuggcuugcuucaccagcuucagcccucugguucugagauguauccacccagucugcaaagaauccacacaucugaaaagcaaagcuagacucuugcuuuuuuuuuuuuuucccaagcccuucagcuaacauugcucaauguagcuaaguggagggaaugcaaaugauuuauauuucacuggcuagguugaggaaacucaagggagauguguucugcuucaagacagggaggaaaaaaaaauccccaaaacuguaaugcaaaggcuuuguaguauuuuuaaaccuuugauucaguccauaugugacaucugaacaccgccaaauucuguuacaaaacacacacacacacacacacacacacacacacacacacacacucccuuugcaagagagaaaaguuggguuuagcagcccuggugguguaaagaaggccgcugagaucucccuuuaaaugauugaguauugagggagccuccucaugagcgcuucucaguggcuucucuccauuagcugucgccuuuaaaggggaaaccguguaaaaaugaauagaaaaacuuugaagggcuuaccuugcuggcuucucacuucguguccugaaaaguacagagcuaagaaaacccagguaagaggaaacauauccauuuuugacagagaggcucucuccggggcuagguuugugggaucuccuauaauuaugucuuuguguuuuuccucucuaauuuucuuccugguggugucuucugcaaaggucucuaacgaucaacguuuuccuccuggguccuggcagucagucugucuucaccuuuauucuugcuggaauaucuccaccucacuaggagauagcucuugaaaucagcaaagagggagcaagcuaaggaagcggagaccgguuuccucuucaaacccaaacgcguguauguucucuccaguuccucaaagugucauuuccuuuauccuacaacaucacgaggguuucccgaaagcugaacgcaaaauaauaguaauaauaauaaaaaucaaagccaagaauugcccugggcaucacacggccccuaggcagcugugugaucucagaagcgcuaacugacacaggucccccggcacccgggacacacacgcgggcagaggcaccgaccgcuggacaggcggagugguaagcagucagacguccggcucuuguccuuucuggguuccccuaagcuggagccucccccggcgguuacacccgcuuggccagucucuggaggggagugcgaggcaggaagcugcugcggccggugcugcugguguugcugcgggugcggcggcugggaucgcccgcgagugugcgagcggcucuccgaguucgcuggcgcccgcccucaccuccaccucgcccagcgcccggccgagugucugugcuucagaggaugugccgggggcgggcugcaggcuggugccuugcucgccuccucugccuccccuccggcuccccccucgccuuuucaggccgagcagcauguggaugucagagccgcggcagagcgauccgauuacgcgcccgcucagggcccgccccuucuguguuccugauuaaagaggcagccgcggagacgcgcggcgcagagccgaggaccgcggcacccagcucgggcggggcggcgguggcucgcagccccgcggccgcgcgaucaaaguuaaggugccacgcaacccugccgccccucucccaguccgcaccucccucccgccccacgcaccuucgugcggggcugcgggugugucacacccggagcaaggagcgcccucccuucagggcgcgcugccucugccggagggaaacuccgcggagcccgggaaauucuuguuuccccuaaauuccgagacucagaugcuacacacucagaauccaacacaaugccaccugcaauggcguuacagaaggaguuggguggcggaccgcguuuggcguagggagccaguccgcggcucagcucuguguucccagaggcagcaaagcguggcggcgacacacacagucagccuuuagccu

SEQ ID NO: 9843 - RNA, 2501 nt, Mus musculus
ugggaacuugaggaugucuucacccccacaucccucuucaccucucaaaccuguguccaucuuuuuaucuuaacuaaaaucugaauuuaggaggggaaaaaaaaccauuagauucagggacgaacauucagcacagaacaccaaacucuuucagcucauaccccacgcccuaccccagcccucccgaaguauucuuucucuuccugggaggaaaaaagagagacguuuuacagucuaauauguuucaucgaucauaaucaaucauaucaauucaaaagcagcaaguguacgugugggugagcucucaauaccuccacccaaaagacauuaguugucaagugggggggggggauguacgcgcguacgcgcgcgcgcgcgcuccugagcaaauaggaauagagugagagauaaauuuagaggcacugagaugggggcggaggggugaggcuuggagggaucaagguagaauuagcuuuaaagauggaacgcaucuucagauuccaauuaaaaugaccuuuuaacagaaaggauuuucuaaaguuuagggagaaaaguacgggguugggguggagaagggaguugauaauuuaaccuguucuuuuucagagaggauucucuugggauuuggacuuugagacucaaaaggagcucagagucagaauugccacgaguuaggagugggggagggucggguugggguggagaugaaguguaaacugguagagacgguuagacagccgccuaggauagcuugcucugccagggauucaagugugaggugcaaggacccaccccaucuacucucaggagcuacuagggucuaagccacuugcugcgcgcgcaaagcgcgcggguucccaaucgguccccgguccccacccauccaaggugccucccuccccagcuccugugccgugcaacugaaaccccaguagcgcucaccuaucuugguuugcucgccguagcucuuuucguugaggcaaaccccgcggccgugcagcagggcgugcagcggcuucuccucauccugccgggggaggcagcgcaaacccugggcgcagcgcuccguguagacgccacacgacugucccuccgccagggcgcaagucaugcagcagccacagccgggcucuuugaccagcucacagcccagagggcuggggggacacauggacagagcuuucucgucgcaggguucacagugcacgaaagaacccaggccuugagccgguacggcauaggcggccagcagcaggaggaccacgcugaucaccauuuucucggagucuggcuuuaccucggggcggggcaggagagcgagaguguguggagaaagagggagccuggagauuuuuuuccuuuuaaaucucuugcagguagagcaggugcucucccccaaacacuugcaaaauaugaggcaaggaggauucagaugccugcacgcaagucccaauugcgaggauuaaagacuugcaacagguugggggugaaaaaaagaggcgcgccaggugcacgcagagcgagcggagaccguagaaacccccaggcgggaucgggucagaauuggggguggugguggagagaaccacagaauugcucacuccaaagcaacagaaauaauuagcuuggaggccuugaaaagggaggaggugaagaaaaaaauggauugggcuuaauuuuccccccuuugcuuaaaaucuaaaacgcaaccccacuccgcucggucucagcggccagcugcgcugcugccgcagaacagguaagaggcgucggcggcugacaacaagaucgggaaaauguugaaaucgaggggggaaaaagggcaaaaacccagaccucaccaaaccuggaccccaacaccugcucugucaccaccucuucgaaacccgcagguucugcgugaaguccggagaagggugcagaccgaggggggggguaacaaaaaggaacaaaaagggggaaaaaagcccaaacagcuuugcagcucuuuccuagcucuuuuagaaguuuccaaagagacugcgggcucuggucgagcaggcgcuuuuaaauagacggccccuggcugccagccaguuguagcugcaauuugagcuccccaacacccaacccaugcaaggaugccaaggagcuuugcagcgcaaacucacacgggguggggguggggaagagaggccuucuagacacgggggcuccccuucgcucccuacacagagcccuccuccucacggaauguacggaaagggcuuuggggggggggcgaagacaggcgagcuacagaggagaguagggagaagguggagggaggaguggauggcaguacucuucagaagcugggugaauacaauggagcgagucuguuuuccgacaacuagcccggacacuggcuguuaggagucacauuuucuuauuagccguguauacccugcccaagaaguccuuuccaacuuuagaaaaaaaagugucuaagagaccacugaagguuugucugucuguguguu

SEQ ID NO: 9844 - RNA, 2501 nt, Mus musculus
aacacacagacagacaaaccuucaguggucucuuagacacuuuuuuuucuaaaguuggaaaggacuucuugggcaggguauacacggcuaauaagaaaaugugacuccuaacagccaguguccgggcuaguugucggaaaacagacucgcuccauuguauucacccagcuucugaagaguacugccauccacuccucccuccaccuucucccuacucuccucuguagcucgccugucuucgccccccccccaaagcccuuuccguacauuccgugaggaggagggcucuguguagggagcgaaggggagcccccgugucuagaaggccucucuuccccacccccaccccgugugaguuugcgcugcaaagcuccuuggcauccuugcauggguuggguguuggggagcucaaauugcagcuacaacuggcuggcagccaggggccgucuauuuaaaagcgccugcucgaccagagcccgcagucucuuuggaaacuucuaaaagagcuaggaaagagcugcaaagcuguuugggcuuuuuucccccuuuuuguuccuuuuuguuacccccccccucggucugcacccuucuccggacuucacgcagaaccugcggguuucgaagagguggugacagagcagguguugggguccagguuuggugaggucuggguuuuugcccuuuuuccccccucgauuucaacauuuucccgaucuuguugucagccgccgacgccucuuaccuguucugcggcagcagcgcagcuggccgcugagaccgagcggagugggguugcguuuuagauuuuaagcaaaggggggaaaauuaagcccaauccauuuuuuucuucaccuccucccuuuucaaggccuccaagcuaauuauuucuguugcuuuggagugagcaauucugugguucucuccaccaccacccccaauucugacccgaucccgccuggggguuucuacggucuccgcucgcucugcgugcaccuggcgcgccucuuuuuuucacccccaaccuguugcaagucuuuaauccucgcaauugggacuugcgugcaggcaucugaauccuccuugccucauauuuugcaaguguuugggggagagcaccugcucuaccugcaagagauuuaaaaggaaaaaaaucuccaggcucccucuuucuccacacacucucgcucuccugccccgccccgagguaaagccagacuccgagaaaauggugaucagcgugguccuccugcugcuggccgccuaugccguaccggcucaaggccuggguucuuucgugcacugugaacccugcgacgagaaagcucuguccauguguccccccagcccucugggcugugagcuggucaaagagcccggcuguggcugcugcaugacuugcgcccuggcggagggacagucguguggcgucuacacggagcgcugcgcccaggguuugcgcugccucccccggcaggaugaggagaagccgcugcacgcccugcugcacggccgcgggguuugccucaacgaaaagagcuacggcgagcaaaccaagauaggugagcgcuacugggguuucaguugcacggcacaggagcuggggagggaggcaccuuggauggguggggaccggggaccgauugggaacccgcgcgcuuugcgcgcgcagcaaguggcuuagacccuaguagcuccugagaguagaugggguggguccuugcaccucacacuugaaucccuggcagagcaagcuauccuaggcggcugucuaaccgucucuaccaguuuacacuucaucuccaccccaacccgacccucccccacuccuaacucguggcaauucugacucugagcuccuuuugagucucaaaguccaaaucccaagagaauccucucugaaaaagaacagguuaaauuaucaacucccuucuccaccccaaccccguacuuuucucccuaaacuuuagaaaauccuuucuguuaaaaggucauuuuaauuggaaucugaagaugcguuccaucuuuaaagcuaauucuaccuugaucccuccaagccucaccccuccgcccccaucucagugccucuaaauuuaucucucacucuauuccuauuugcucaggagcgcgcgcgcgcgcguacgcgcguacaucccccccccccacuugacaacuaaugucuuuuggguggagguauugagagcucacccacacguacacuugcugcuuuugaauugauaugauugauuaugaucgaugaaacauauuagacuguaaaacgucucucuuuuuuccucccaggaagagaaagaauacuucgggagggcugggguagggcgugggguaugagcugaaagaguuugguguucugugcugaauguucgucccugaaucuaaugguuuuuuuuccccuccuaaauucagauuuuaguuaagauaaaaagauggacacagguuugagaggugaagagggaugugggggugaagacauccucaaguuccca

SEQ ID NO: 9845 - RNA, 2499 nt, Mus musculus
acuacaugugguugcugagacuugaacucaggaccucugaaagagcaaucagugcucuuaacugcugagccaucucuccagcccaacacuuguuuuucuauuaaguuacucauguuucucuuuccccaauguuuauuugagaaguaugccuuauuuacuugagaaacauguaacauguauacuuagaaaacuaaauuucugcccuauaaaucacaagaggcagcagaacuugggcuauagcucugugguagaaugccugcagagcauacacaaagcccuaaaaauaagugacugcaauuuaugagcuguuuuuacucaugugggcuaaaagaauuugaaacauggccugcauugucaaaccaaguaccaaccaagcuaguuauaaugagacacagugcagcucagagggcaaaccuccaggcauuugggugacuaugacaacccaguccuccaaguuuccacuugcucagucacacacacacaccaccaccaccaccaccaccaccaccaccaccaucaccagucuaaccugccacagggcuggagagcuccuccaggcugcagucugucuccaagucccagccauaauagagucuccuucggauucgagcacuuagcuuuugguguccuggaaggaccugaaacagggccaggaguaguggagggugaagggcagggaagguuugguggaaauccuggguacugacccgggccuauacucuacccagcccagaguucccaagaucauuuguuaauggcagccuagucuuguccacagugggagaaagacaauaagcccgcuucugacaucacugagggcucccaauagaagacuagacaacuagaaaccagaugggaccccagucuaaucacuagcaguuccccucuuauaaccugaggcuuugccuucaggcccaaguggcauugcucucaacaauagcccacuccagggcauaacaaguaagagagcucccauuccgcucgggucuggaggagaacgccugggaguucugacucccagaggcagagaacaggcggaccucucaccaugaagucuuggaaaccggugagggagaaggcgccuucuucguccagcaggagcccagucagguccaucgcacugucagccgccacccugcgaagguggagggaaagggaaggaaucguaagugaccccagagccgugcucacccguuggcccaccucucccgaaagggccaccgcccgacugcgcgcagccuccucccuucucgcaggcggccgugggacgccucuuccuguuccgcgugcgacugggccucccggcgcccgacgacaggcgcggcgcucaccaggcgaaccaggagguacgagggccagcaguguucucagcccgugccgcguucgcuaggcguuuauaagcugcgggagugagugucaccgacgagucugcgcgcccggcaggaagugccuccugccuugcccaaccugagagcuccgggucuccggagcuaugagcaccgggggcaauuguaauacgguucccaggggaccgcgacacaccaagggugaacgcgcugaccaggcuuuguagucgugguacagauaguaacgagccuaacacaaaggcaacgcggcgaguuguuuccuggguuuuagggaagacgcacucaaucagcaaugcccaggaaagaugaacaagaaacuuaccguaggugggagaacugugaacaaggugggagggaaucuguugaaucuuuaugccccuuagaaguuugaaacuguaacacucgaauacauacuguauucuguaugguuacuccagcaauuaaaugaucucaaaagauauaaagccucaauguacgauguuaaacaggucuccccaaagcaaacagcgccuggauguuuuauuuccaaacacuccuuccacacaauuugcggcugagagauuuugggaagagagagggccgacgcuccaagaaggaagaaacaacuuuucgaaguuggugaagcugcuuugaagucauuaaagucacgcgcugguguuuguuuauccgcugaggggaggggacuggaggcgaagaggguugaguaauggggauggcaccgcccuucccgaucccaagcagauuguagucaagauccugggggccugaaagcccacucacugccucugggcagugccucacgcgacaaagaggucuccagccgcccuguaaacaccgggagaagaccucaggccucgcagccucaacgcccgccccggaucaccccuccagcacccuggaagcacaccuucgugggugcaggaucacgacagcggccaacgcgcacgcgcgggcgucccauccgggcuguuagggcacgucacguggcaucgcgcuucaucacgugacgcuugaccgcagguuuuuuugcucgcccgugcgugcgcccccuuccgucugacgcgcccccggcggcggccgcgcagcccuggcuccucgcgggcucgggcagcggcugcggcgcggugauggc

SEQ ID NO: 9846 - RNA, 2499 nt, Mus musculus
gccaucaccgcgccgcagccgcugcccgagcccgcgaggagccagggcugcgcggccgccgccgggggcgcgucagacggaagggggcgcacgcacgggcgagcaaaaaaaccugcggucaagcgucacgugaugaagcgcgaugccacgugacgugcccuaacagcccggaugggacgcccgcgcgugcgcguuggccgcugucgugauccugcacccacgaaggugugcuuccagggugcuggaggggugauccggggcgggcguugaggcugcgaggccugaggucuucucccgguguuuacagggcggcuggagaccucuuugucgcgugaggcacugcccagaggcagugagugggcuuucaggcccccaggaucuugacuacaaucugcuugggaucgggaagggcggugccauccccauuacucaacccucuucgccuccaguccccuccccucagcggauaaacaaacaccagcgcgugacuuuaaugacuucaaagcagcuucaccaacuucgaaaaguuguuucuuccuucuuggagcgucggcccucucucuucccaaaaucucucagccgcaaauuguguggaaggaguguuuggaaauaaaacauccaggcgcuguuugcuuuggggagaccuguuuaacaucguacauugaggcuuuauaucuuuugagaucauuuaauugcuggaguaaccauacagaauacaguauguauucgaguguuacaguuucaaacuucuaaggggcauaaagauucaacagauucccucccaccuuguucacaguucucccaccuacgguaaguuucuuguucaucuuuccugggcauugcugauugagugcgucuucccuaaaacccaggaaacaacucgccgcguugccuuuguguuaggcucguuacuaucuguaccacgacuacaaagccuggucagcgcguucacccuuggugugucgcgguccccugggaaccguauuacaauugcccccggugcucauagcuccggagacccggagcucucagguugggcaaggcaggaggcacuuccugccgggcgcgcagacucgucggugacacucacucccgcagcuuauaaacgccuagcgaacgcggcacgggcugagaacacugcuggcccucguaccuccugguucgccuggugagcgccgcgccugucgucgggcgccgggaggcccagucgcacgcggaacaggaagaggcgucccacggccgccugcgagaagggaggaggcugcgcgcagucgggcgguggcccuuucgggagaggugggccaacgggugagcacggcucuggggucacuuacgauuccuucccuuucccuccaccuucgcaggguggcggcugacagugcgauggaccugacugggcuccugcuggacgaagaaggcgccuucucccucaccgguuuccaagacuucauggugagagguccgccuguucucugccucugggagucagaacucccaggcguucuccuccagacccgagcggaaugggagcucucuuacuuguuaugcccuggagugggcuauuguugagagcaaugccacuugggccugaaggcaaagccucagguuauaagaggggaacugcuagugauuagacuggggucccaucugguuucuaguugucuagucuucuauugggagcccucagugaugucagaagcgggcuuauugucuuucucccacuguggacaagacuaggcugccauuaacaaaugaucuugggaacucugggcuggguagaguauaggcccgggucaguacccaggauuuccaccaaaccuucccugcccuucacccuccacuacuccuggcccuguuucagguccuuccaggacaccaaaagcuaagugcucgaauccgaaggagacucuauuauggcugggacuuggagacagacugcagccuggaggagcucuccagcccuguggcagguuagacuggugauggugguggugguggugguggugguggugguggugugugugugugacugagcaaguggaaacuuggaggacuggguugucauagucacccaaaugccuggagguuugcccucugagcugcacugugucucauuauaacuagcuugguugguacuugguuugacaaugcaggccauguuucaaauucuuuuagcccacaugaguaaaaacagcucauaaauugcagucacuuauuuuuagggcuuuguguaugcucugcaggcauucuaccacagagcuauagcccaaguucugcugccucuugugauuuauagggcagaaauuuaguuuucuaaguauacauguuacauguuucucaaguaaauaaggcauacuucucaaauaaacauuggggaaagagaaacaugaguaacuuaauagaaaaacaaguguugggcuggagagauggcucagcaguuaagagcacugauugcucuuucagagguccugaguucaagucucagcaaccacauguagu

SEQ ID NO: 9847 - RNA, 2501 nt, Mus musculus
gugaagguaguaggguggugguguagugagcacaggaccugcugggagcugaaaauccaccagaacuccaggcuuugggucuuggugcuuaccagcuguuacggaggugcugggagaggccauugguccggucugcucaccuccacuggggccugucucuccaugugccucucaucucuggaccuuuccucuuccucuccaaccagccuagugagacuagggcgcuggggcccgaagaaaggaagcgggccuaagcccagggguaauucgacucccccagauuucacaagcugggggcggggaagggggcgacacaccgugggggaggagauucuuuuaggccagcucuggcgaugggggcacugggagagagaggagccacauggaguccaaauccccuccucugcugcccccucccuccacugcucauucgcaacccgagccgggggcccuaaaaauagucccugaggcgcaaucgccggccgcccuggugaccuucugcacaggccgaaagcgggcgggcagcaggaaggccggccgccggccccauaggacucaucucuuaaggcaccauacccccuagggcgucccccuggccucccaauucuagcguccccugccccucuaguccagcucgcagaggccaugcagaaagcccggggcacgcgaggcgaggacgccggcacgagggcaccuccuagccccggggugcccccgaagagagccaaggugggggccggcagagggguccucgucaccggggauggggccggggcgccggucuuccugcggccccugaagaacgcggcggugugugcgggcagugauguaaggcugcggguaguagugagcgggacaccccagccuagccucagcugguuccgggaugggcagcuccugccuccaccggccccagagcccagcugccuguggcugcggagcugcggggcucaggacgccggcguguacagcugcagcgcccagaaugagcggggccaggccuccugugaggcagugcucacagugcuggaggucagagguaaugcggagguggggccuaccuggcagggcuggggucacaagggguagagacagcugcccaggccaugcgaugcagguugcagucccucaccaucuucccaggugucccguuuucccugaugggccccuucugaagggcagaucaacagggaaaggcaggagaguguaucaagguagauagagaugcuucucauaagaaggucagaggucaacggucagcaguuggugggucuagccugagacccacacagaccucucggucaauagugcaaaaacucuccuaauccaauagagagaaaccuucuggagagaaaugcccucgucugcuccagugacagacuugagaccuggugaccagccccucucaguauguguguguguugucuuaaagacaggccaguucuccuguuccagaccaugugggaggagauggcuauggcuagaccuucucucuucaugaucaacacugggacaagaaugguguggucagaacuaggcaaagcagaaggggucagauguguaugagcaggacccagaugugagaaguggcuguuugagaauccguguguguguguguguguguguguguguguguguguguguguguguguguguguguuugaggcauucugaguugugggaggcucuggacucucaugggguuaauacaaacacacagcccuaggguagauguggcuaguguugaaagccugugaaucauguaucucuauugagguuuccauaugaguguucagaggacacggaagggggaugcuuugggcuggugccuuggcucuugggaagaugggauucuaggcugauagacugaggcagaagaggaggagcaggagccucggucuuguaguugguccuguuggagcugguggggaugucagaccagcuagauuguccuggggucaauguggggguuuuguucaguuucugagccaaacgguucucuaaacuaaaaacagucuuggaccuaccaaacuuugaaaaaaauggaacucugagggaguagguuucauuuaggggagauggcaaagggcuaggggguaggggggcuguuuugaucauuuucuuuuucuuuuaaauuuauuuuuauuuauauuauacuguagcugucuucagacacucaccagaagagugcaucagaugguugugagccaccaugugguugcugggaauugaacucaggaccccuggaagagcagucagugcucuuaacugacugagccaucucuccagcccuuggucauuuucuagagagacaucucauuccauuccaugguacaauauaagggucaaucuuugagaucuggggaggaaguccagggauaaaagaccuuggcagguggaggggaaugaagguugcguuggaaugcaauaggagauggaaggggggcauugucucuaucagugucuucucuccccagcgucacccugcccauuuccuacag

SEQ ID NO: 9848 - RNA, 2501 nt, Mus musculus
cuguaggaaaugggcagggugacgcuggggagagaagacacugauagagacaaugccccccuuccaucuccuauugcauuccaacgcaaccuucauuccccuccaccugccaaggucuuuuaucccuggacuuccuccccagaucucaaagauugacccuuauauuguaccauggaauggaaugagaugucucucuagaaaaugaccaagggcuggagagauggcucagucaguuaagagcacugacugcucuuccagggguccugaguucaauucccagcaaccacaugguggcucacaaccaucugaugcacucuucuggugagugucugaagacagcuacaguauaauauaaauaaaaauaaauuuaaaagaaaaagaaaaugaucaaaacagccccccuacccccuagcccuuugccaucuccccuaaaugaaaccuacucccucagaguuccauuuuuuucaaaguuugguagguccaagacuguuuuuaguuuagagaaccguuuggcucagaaacugaacaaaacccccacauugaccccaggacaaucuagcuggucugacauccccaccagcuccaacaggaccaacuacaagaccgaggcuccugcuccuccucuucugccucagucuaucagccuagaaucccaucuucccaagagccaaggcaccagcccaaagcaucccccuuccguguccucugaacacucauauggaaaccucaauagagauacaugauucacaggcuuucaacacuagccacaucuacccuagggcuguguguuuguauuaaccccaugagaguccagagccucccacaacucagaaugccucaaacacacacacacacacacacacacacacacacacacacacacacacacacacacacggauucucaaacagccacuucucacaucuggguccugcucauacacaucugaccccuucugcuuugccuaguucugaccacaccauucuugucccaguguugaucaugaagagagaaggucuagccauagccaucuccucccacauggucuggaacaggagaacuggccugucuuuaagacaacacacacacauacugagaggggcuggucaccaggucucaagucugucacuggagcagacgagggcauuucucuccagaagguuucucucuauuggauuaggagaguuuuugcacuauugaccgagaggucugugugggucucaggcuagacccaccaacugcugaccguugaccucugaccuucuuaugagaagcaucucuaucuaccuugauacacucuccugccuuucccuguugaucugcccuucagaaggggcccaucagggaaaacgggacaccugggaagauggugagggacugcaaccugcaucgcauggccugggcagcugucucuaccccuugugaccccagcccugccagguaggccccaccuccgcauuaccucugaccuccagcacugugagcacugccucacaggaggccuggccccgcucauucugggcgcugcagcuguacacgccggcguccugagccccgcagcuccgcagccacaggcagcugggcucuggggccgguggaggcaggagcugcccaucccggaaccagcugaggcuaggcuggggugucccgcucacuacuacccgcagccuuacaucacugcccgcacacaccgccgcguucuucaggggccgcaggaagaccggcgccccggccccauccccggugacgaggaccccucugccggcccccaccuuggcucucuucgggggcaccccggggcuaggaggugcccucgugccggcguccucgccucgcgugccccgggcuuucugcauggccucugcgagcuggacuagaggggcaggggacgcuagaauugggaggccagggggacgcccuaggggguauggugccuuaagagaugaguccuauggggccggcggccggccuuccugcugcccgcccgcuuucggccugugcagaaggucaccagggcggccggcgauugcgccucagggacuauuuuuagggcccccggcucggguugcgaaugagcaguggagggagggggcagcagaggaggggauuuggacuccauguggcuccucucucucccagugcccccaucgccagagcuggccuaaaagaaucuccucccccacggugugucgcccccuuccccgcccccagcuugugaaaucugggggagucgaauuaccccugggcuuaggcccgcuuccuuucuucgggccccagcgcccuagucucacuaggcugguuggagaggaagaggaaagguccagagaugagaggcacauggagagacaggccccaguggaggugagcagaccggaccaauggccucucccagcaccuccguaacagcugguaagcaccaagacccaaagccuggaguucugguggauuuucagcucccagcagguccugugcucacuacaccaccacccuacuaccuucac

SEQ ID NO: 9849 - RNA, 2501 nt, Mus musculus
ggguaaaagggagaaaaggaaacgugacaggaauaaaaagcaacaaaaugaauuaauuuuuaagggaaggaggggcaagggggugcagcgccccccccgcgccccccccccgcuuucaacauuagccuacgguuccaucgagcgccuuuuuuuuuuuuuuuuuuuuuggucuagggcgcccagucuugcuucccaaagaaaaaaagaggggaaauuaaagguaaagaaaaaaaaaaaaaaagaauccuaacucuaacuaccucuaggucuggggcgagagaggucucuggggacacuuaacaaguguguaaaguaaguagccauagccaggagaaugcgagguacgcgguuccgcucagaggaaaagccccgggaacugccgaggugcuaaaucgaagccacaaccccuggaaugugacggaguaggggagagaccacucuucuacccccacuguccccuccuccgccccggcacugccugugggcagguguacgacaagguccaaaccucugccuggagagcuccggguacccucugucuagccaagccuaaguugguuuuuggcucccuccuucggaacagaaaaaaugauaguggauugcacaggaauagcuagauggacugaugccuggggagacggaggcuggcuggcuggauggauagauagauggauguacggagugggaagaaucgaugagacagaugcacagcuaaugcgcgcagguuggaacacgaacacaggccggagcccacguucacacacugugcgcacucgcuuacccggcacaaaacguccagguuccugcagacacccgcgccaggcacacauuugcccucaaacacacacacacacacacacacacacacacacacacacacacacacacacacacgagaggagggggagagagacagacagagauagagagacagggacacauaaggacagaaauagacacagagaguguuccuuucccccuaggcccaucacaaacuaaauggucaccaccucuccccucaccucggacagaaaaacagacaaacaauccuuccagaacgucgcaauagacaaacagaaaacggcacacgaaugggucccgucggucaugccuguccuucuagacuaguccaguaccccauacuggagagagaagcuuacagugggguauguuuaauucgcugacugguccccuaguuuugcuggaugagcuaaggaucugggguaggggagagguaggccugagauugcaaccuccagggugcgcggcccgauggagaaaaaggugucugaggcccggugcuagaaaucaggucaccggcgcccgacaagcggcgccaccaccgcugcgcgcuccggagaccaagcagccgggucccgggaagcgcugcgcugggaaaacuuugcaaaaacccgggcucgcaaggcuuggacaagaggccgggcgcucugcgcucuacguuuggguuucccuucucgccugugcugcugauguagaggacuuugcucacacguuuuuuuguuuuguuuucaaaucccgguguauccccucggggcgccuugagccggcccugcaggcggaugcugauaaacuuuggccuuucgcuacaaacuugggcagaguggcagcuugcaucggucacccuucucaguucagacagccugauccuccucaguccccacuuaagaggauccccucuguucggcacucuucuccggagugggaacgcgaggcucaugccgcgcucuccaccccccgccccccacccuaacugguucugagcuccagaagaccauucaucagugaaucacccccuccgggucccggaccgcauaagggcugccgggcucuuaccuucauucgcgggguauacccuagaaccggugacagcgucgcaaauuccaaagagaaacgaaaagaggaugaaauagaaaaucccagccaugguucgccggugccaacgcugcuccugccgcuucuaucccaguggaauaaaugcuuaaguuaggagugcagcagucugaagacauugccaagagggugggaccggcccgugacguacacccgccaguccagagcucgugaccaauagcagugcagaaccagcgccacguccccacccccacggugcagagcccacccccgaggucccgcccccuccagccuccgcagggcucaaggucucccgaggcuggcuucccagcagugaugggucugugcccccacgagaggccccagaccuugucucgauccuuggggaucgaucccuuggacggcagagggaacuucgagagacuccgaaaggacgguggggaaggccagaaaacguuggcauuccccgcccggccccaaguccggaggugugcgagggagaaaagacuccuguugagaugaaauaagucugaaguugaccugcaccuuggcucuugccccuugccgaggucgucgggucucuguacuguccaccccagcuaaggucgggcgcucucugcugcacgcag

SEQ ID NO: 9850 - RNA, 2501 nt, Mus musculus
cugcgugcagcagagagcgcccgaccuuagcugggguggacaguacagagacccgacgaccucggcaaggggcaagagccaaggugcaggucaacuucagacuuauuucaucucaacaggagucuuuucucccucgcacaccuccggacuuggggccgggcggggaaugccaacguuuucuggccuuccccaccguccuuucggagucucucgaaguucccucugccguccaagggaucgauccccaaggaucgagacaaggucuggggccucucgugggggcacagacccaucacugcugggaagccagccucgggagaccuugagcccugcggaggcuggagggggcgggaccucgggggugggcucugcaccguggggguggggacguggcgcugguucugcacugcuauuggucacgagcucuggacuggcggguguacgucacgggccggucccacccucuuggcaaugucuucagacugcugcacuccuaacuuaagcauuuauuccacugggauagaagcggcaggagcagcguuggcaccggcgaaccauggcugggauuuucuauuucauccucuuuucguuucucuuuggaauuugcgacgcugucaccgguucuaggguauaccccgcgaaugaagguaagagcccggcagcccuuaugcgguccgggacccggagggggugauucacugaugaauggucuucuggagcucagaaccaguuaggguggggggcgggggguggagagcgcggcaugagccucgcguucccacuccggagaagagugccgaacagaggggauccucuuaaguggggacugaggaggaucaggcugucugaacugagaagggugaccgaugcaagcugccacucugcccaaguuuguagcgaaaggccaaaguuuaucagcauccgccugcagggccggcucaaggcgccccgaggggauacaccgggauuugaaaacaaaacaaaaaaacgugugagcaaaguccucuacaucagcagcacaggcgagaagggaaacccaaacguagagcgcagagcgcccggccucuuguccaagccuugcgagcccggguuuuugcaaaguuuucccagcgcagcgcuucccgggacccggcugcuuggucuccggagcgcgcagcggugguggcgccgcuugucgggcgccggugaccugauuucuagcaccgggccucagacaccuuuuucuccaucgggccgcgcacccuggagguugcaaucucaggccuaccucuccccuaccccagauccuuagcucauccagcaaaacuaggggaccagucagcgaauuaaacauaccccacuguaagcuucucucuccaguaugggguacuggacuagucuagaaggacaggcaugaccgacgggacccauucgugugccguuuucuguuugucuauugcgacguucuggaaggauuguuugucuguuuuucuguccgaggugaggggagagguggugaccauuuaguuugugaugggccuagggggaaaggaacacucucugugucuauuucuguccuuaugugucccugucucucuaucucugucugucucucucccccuccucucguguguguguguguguguguguguguguguguguguguguguguguguguguguuugagggcaaaugugugccuggcgcgggugucugcaggaaccuggacguuuugugccggguaagcgagugcgcacagugugugaacgugggcuccggccuguguucguguuccaaccugcgcgcauuagcugugcaucugucucaucgauucuucccacuccguacauccaucuaucuauccauccagccagccagccuccgucuccccaggcaucaguccaucuagcuauuccugugcaauccacuaucauuuuuucuguuccgaaggagggagccaaaaaccaacuuaggcuuggcuagacagaggguacccggagcucuccaggcagagguuuggaccuugucguacaccugcccacaggcagugccggggcggaggaggggacaguggggguagaagaguggucucuccccuacuccgucacauuccagggguuguggcuucgauuuagcaccucggcaguucccggggcuuuuccucugagcggaaccgcguaccucgcauucuccuggcuauggcuacuuacuuuacacacuuguuaaguguccccagagaccucucucgccccagaccuagagguaguuagaguuaggauucuuuuuuuuuuuuuuucuuuaccuuuaauuuccccucuuuuuuucuuugggaagcaagacugggcgcccuagaccaaaaaaaaaaaaaaaaaaaaaggcgcucgauggaaccguaggcuaauguugaaagcggggggggggcgcggggggggcgcugcacccccuugccccuccuucccuuaaaaauuaauucauuuuguugcuuuuuauuccugucacguuuccuuuucucccuuuuaccc

SEQ ID NO: 9851 - RNA, 2501 nt, Mus musculus
uauccagggucucucaaaaaaaaaaaaaaaaaaauccagagcuuagccaauauggcucaucuugccggccagcaugcucuggggaccucgugucucugaggacuaucucacacaccagaccuuuagguuucuggggauucuggggaugcuugccuaguaagcacugaaaacccuaggccauuucguguagucugaauuuaugauaaugugcuuagguccuaugaccucuuuggagagaauuacaaagcauggcaucuaaaaccuauuccgauccauuuugcuuccaugccuuaugaagucuuccuaaauaacacugaagugagguagauuauucuguguuguauucucuaaaggcaacaucuucugcgaggucuaggaagcacccaacugugguauagaauggacucuauugcauauauauauacaaccaaggagcuuguauauccuucaaaaggcacuucucacuuccagcaucuuccacuguuguagaacaaacuuaggcacuaaccagccaaauguugagaccuugacugauaaacauaaccccaaaccuucagagagagcacuauccuaggaauccuccuuuuugcccauugaagugaauuucagacuucuacaaaacaugggaagaauaagugugauauacacacuaccaaguucgugguaauuuguugcagcaauaacaagaauauacuuaagucuacuuucuucaguuuagcugcuuaguuuuagccuuucauuuaaacaguagucaacuguuccuaugucagcaugacuuuagguaaacuaaaagccacucuuuucaacuuagcuaucuuaaacgaaagacucaauauaugcccaucuuucaccuuggugcgcauguggggaaguggagcuauaaaguucaaggaaagcucugagucgaauguucaacaaaauggagauugugugguuuuagguguugugaacaguguuuccuagcacuagaacauaacaguggucugccucaggauuaaguuuaauaagugccaaaggcauacagauauuuacaacaggcauaaagaccaagagagauccuaucccugcgaucccaacaauaacaagaggcaccgacaugagcugcauauaaugucuggaauacaguuguucugaaaguagaguucccuugaaaacgcguuuaaacaaaaaaguccugauaguccuuaaaagacacuuuagucuuuacugaguauugaugcgaagcagcugcucuuugccauuaauuaucagggacuuuaacucuccaucuucuuccacuuccacccuuucuugaccauucucaacgauucucuugguggugauuuuuuugccauuaauuauuucgguggagguugacaccgacuuguaguugccugccgccccaccgccgcaagacauggagaaagaagaaaggcccgaguuuccuggagaaccgaaggaugugaauccaguaucuaacgaagcgaagccacccccaaauccugggaauucgguaaaggagguagagaaggguacagccccucggcuucugcuuccacgggugcuccuccgauccccaaaaaaguucucaagggggucucccccgaagaagucgaaggagaaagggucguggcccccgaagaacucccugaagaccuccgcggggucucggaaggagaagacguacuggaaggcaucguggaacgggcugcccgccgcgccgccuccgcccaccucgcccacuucgccgcagcggucguacaccucgcgcuugcggacguccgauaagaccucguaggccugcgccaccugcuugaaccgccucucggccuccuccuugugcucgggguucuuguccgggugccacuugagcgcaagcuugcgguacgccuugcggauggccucggcugaggccugccgcggcacgcccagcaccucguaguaguccaccauggcggcuggccggcccgcggccucggcgcuggagcggcgguggcagcugcugaacgcccgccuaccggccggcgccacacucccuugugacgcaaacgucucucauuggcggaggcgggcggugccucagccuaucagaauggagggcccagggauccguugugcucccagagaugcucagugacgcuuaaagacaggaccgagucuaguauccuugcaguggugauuggguuguccuaugguagggcgaacaaaggacgacuuaggggagagaggcuuugacucuggcugcuauagaaaaguacuauuucacccuuccccgcaccuucgccuucucucuaccucuccuuuuuuucacucuucuccuuucccucuucuccugaugcugcucgcccuucucuccccggcuguguagcucagacuggccuuaaacuugcaguaaugcccugcugccucagcaucgugcauuguggcacaagugugccucacaaaacuggauuuuuuaaauggauuuuugugcccugccccaagcugucuuuucgucagccaggcaggaaauuaggaagguu

SEQ ID NO: 9852 - RNA, 2501 nt, Mus musculus
aaccuuccuaauuuccugccuggcugacgaaaagacagcuuggggcagggcacaaaaauccauuuaaaaaauccaguuuugugaggcacacuugugccacaaugcacgaugcugaggcagcagggcauuacugcaaguuuaaggccagucugagcuacacagccggggagagaagggcgagcagcaucaggagaagagggaaaggagaagagugaaaaaaaggagagguagagagaaggcgaaggugcggggaagggugaaauaguacuuuucuauagcagccagagucaaagccucucuccccuaagucguccuuuguucgcccuaccauaggacaacccaaucaccacugcaaggauacuagacucgguccugucuuuaagcgucacugagcaucucugggagcacaacggaucccugggcccuccauucugauaggcugaggcaccgcccgccuccgccaaugagagacguuugcgucacaagggaguguggcgccggccgguaggcgggcguucagcagcugccaccgccgcuccagcgccgaggccgcgggccggccagccgccaugguggacuacuacgaggugcugggcgugccgcggcaggccucagccgaggccauccgcaaggcguaccgcaagcuugcgcucaaguggcacccggacaagaaccccgagcacaaggaggaggccgagaggcgguucaagcagguggcgcaggccuacgaggucuuaucggacguccgcaagcgcgagguguacgaccgcugcggcgaagugggcgaggugggcggaggcggcgcggcgggcagcccguuccacgaugccuuccaguacgucuucuccuuccgagaccccgcggaggucuucagggaguucuucgggggccacgacccuuucuccuucgacuucuucgggggagacccccuugagaacuuuuuuggggaucggaggagcacccguggaagcagaagccgaggggcuguacccuucucuaccuccuuuaccgaauucccaggauuuggggguggcuucgcuucguuagauacuggauucacauccuucgguucuccaggaaacucgggccuuucuucuuucuccaugucuugcggcgguggggcggcaggcaacuacaagucggugucaaccuccaccgaaauaauuaauggcaaaaaaaucaccaccaagagaaucguugagaauggucaagaaaggguggaaguggaagaagauggagaguuaaagucccugauaauuaauggcaaagagcagcugcuucgcaucaauacucaguaaagacuaaagugucuuuuaaggacuaucaggacuuuuuuguuuaaacgcguuuucaagggaacucuacuuucagaacaacuguauuccagacauuauaugcagcucaugucggugccucuuguuauuguugggaucgcagggauaggaucucucuuggucuuuaugccuguuguaaauaucuguaugccuuuggcacuuauuaaacuuaauccugaggcagaccacuguuauguucuagugcuaggaaacacuguucacaacaccuaaaaccacacaaucuccauuuuguugaacauucgacucagagcuuuccuugaacuuuauagcuccacuuccccacaugcgcaccaaggugaaagaugggcauauauugagucuuucguuuaagauagcuaaguugaaaagaguggcuuuuaguuuaccuaaagucaugcugacauaggaacaguugacuacuguuuaaaugaaaggcuaaaacuaagcagcuaaacugaagaaaguagacuuaaguauauucuuguuauugcugcaacaaauuaccacgaacuugguaguguguauaucacacuuauucuucccauguuuuguagaagucugaaauucacuucaaugggcaaaaaggaggauuccuaggauagugcucucucugaagguuugggguuauguuuaucagucaaggucucaacauuuggcugguuagugccuaaguuuguucuacaacaguggaagaugcuggaagugagaagugccuuuugaaggauauacaagcuccuugguuguauauauauaugcaauagaguccauucuauaccacaguugggugcuuccuagaccucgcagaagauguugccuuuagagaauacaacacagaauaaucuaccucacuucaguguuauuuaggaagacuucauaaggcauggaagcaaaauggaucggaauagguuuuagaugccaugcuuuguaauucucuccaaagaggucauaggaccuaagcacauuaucauaaauucagacuacacgaaauggccuaggguuuucagugcuuacuaggcaagcauccccagaauccccagaaaccuaaaggucuggugugugagauaguccucagagacacgagguccccagagcaugcuggccggcaagaugagccauauuggcuaagcucuggauuuuuuuuuuuuuuuuuuugagagacccuggaua

SEQ ID NO: 9853 - RNA, 2501 nt, Mus musculus
auuuugaacacugccuuccccagucccuucccacuugggcaccucaccccuaucuccccccagcagauugucuuucuaccacauuaacacauugcgauuuccuggccuuugaggaaggggguggggggagcgugagaaaaagcucaaaggagaggaggagacaguagaggcgacggcccuuugcccagaaccaucacucaaggggcugccaugucucccgcucacccucccagccucuaacagcuuaaguaucaggaugcugcucggaccugaggcccaagagaauauccccuuuguuucccugggguccaggacuguuugaagaccaagggggaguucaugauccuccccaccaccaucugaacaacuaaaauuaagugagccucaauuucacagcagaugugagugguguagggccgaugccagcccgcagcuuucuugagacauaucauuugugucuccuuaggagaaguuuuccacccuagaguuccuagugcgugcauguacacacacacacacacacacacacacacacagagagagagagagagagagagagagagagagagagagagagagagagagagagucucgcaggaaucugauucucuuggaugaacagagaacccagugaagauauuugagucuggacucuauuggguacauaugcaacugaaaaaagaaaaaaaccagcccaauaaggccucucuuuaagguugcaacacaccaaggacccucaauaaucacagcgugugugugugugugugugugugugugugugugugugugugugugccaaacacgccaccagauguguggccuggaguagcuagcaggagagcucuaaacgccuccuuuccccaggauccugcuuguugcuuggcguuaaaugccccauuggaaagcuccggugggcaucaccgcaacuccuccagcuauucccgcagaggucgggcgggggcgcggccucgucccccgggucucggcgggaacccggagcuggcccgcccccacucccucccguccccgcguuccggcugcgcgcgccgccgacucaccgagcgacgccugcaccgcuucggccgcagagaaagcgagcagcgagcccuccuuggccaagaaggcuuugccgucuuccgcauccgcuuggagcgccucggcuuugucgaaguugccgccuccgggcaguggcuguggagcgaacuugcgggcagccgccgccucuuggugcuggggcgacgcagagaagccgccgggcagaguggccaugagcguggaggugagcgccaugcccugcgccaggcuggagcagaagccggugggcaggcuggggaucugguggugagggugcgcgggcggcagagcgggcugcagcgcugccuggggcagcgcgggaggcgguggcggcgguggcggcagcaccaccggccgguagggcaugaacaugggguagccgguguagacgaaauggccgggacugggcugcggcgggcugccgaucagcgagucuaugcugaaggcgguacuacuccccagcgggcgcugcaucaucaucagcgacggcgggaacgcugcgcucauagacgcguucgggagaagccagggagagacgaaaaguccccgugucccgccgccgccuggaagcccuccggacgcugggaguaccaccgggaacuccgggcaggggcugagcggugcccagagcgcagacgccgccgccgccccucagugcaggacccgcagcauacccggccugcacgggugcagccaccgagcgcgaugaggccgugcgcccgggauggagagggcgccggggaccucgcguucgccggaaccgcucccggcugcuagcccgucggaacgcgcgcgcuucgcgucugcaggucucggcccagcuaccagcagugcgugcguccguccgucuguccguccugcaguccgucgucucccacgggcggcuggggagcgcgcgaagccggcgcacuugucucuggcgggcgccgccagcaccuuuaaaucgcgcuccucuuucucauucacauuuugccagcugcccagcggagcucgugucacgugggaccgagcaccaacuccuauuugcuauucaggggaaggcggggcgaaauuagggcuccgcccccuucacccaggcgggccgcaaaugggcuaccggcgccacgguuggagcgugcuggccugggagcuggagccuuugcaccgcgcggagcaaacuuaagagggacccuugcuaccuacccgacucagacccuagagucccuggcaucccuguggaggccucaugagaggcggcuuggaacuggcacccgccaccgaugggccgggaguguuuuacuacagcagaacccugugugaugcucaccuuaaccaggggcgcucugguugugccaaggguccgggcaaggucuccggauagcguuuaaggucuugccucugcaggucugcucccagaggugcgccugggccugucagcccuugcucac

SEQ ID NO: 9854 - RNA, 2501 nt, Mus musculus
gugagcaagggcugacaggcccaggcgcaccucugggagcagaccugcagaggcaagaccuuaaacgcuauccggagaccuugcccggacccuuggcacaaccagagcgccccugguuaaggugagcaucacacaggguucugcuguaguaaaacacucccggcccaucgguggcgggugccaguuccaagccgccucucaugaggccuccacagggaugccagggacucuagggucugagucggguagguagcaagggucccucuuaaguuugcuccgcgcggugcaaaggcuccagcucccaggccagcacgcuccaaccguggcgccgguagcccauuugcggcccgccugggugaagggggcggagcccuaauuucgccccgccuuccccugaauagcaaauaggaguuggugcucggucccacgugacacgagcuccgcugggcagcuggcaaaaugugaaugagaaagaggagcgcgauuuaaaggugcuggcggcgcccgccagagacaagugcgccggcuucgcgcgcuccccagccgcccgugggagacgacggacugcaggacggacagacggacggacgcacgcacugcugguagcugggccgagaccugcagacgcgaagcgcgcgcguuccgacgggcuagcagccgggagcgguuccggcgaacgcgagguccccggcgcccucuccaucccgggcgcacggccucaucgcgcucgguggcugcacccgugcaggccggguaugcugcggguccugcacugaggggcggcggcggcgucugcgcucugggcaccgcucagccccugcccggaguucccggugguacucccagcguccggagggcuuccaggcggcggcgggacacggggacuuuucgucucucccuggcuucucccgaacgcgucuaugagcgcagcguucccgccgucgcugaugaugaugcagcgcccgcuggggaguaguaccgccuucagcauagacucgcugaucggcagcccgccgcagcccagucccggccauuucgucuacaccggcuaccccauguucaugcccuaccggccgguggugcugccgccaccgccgccaccgccucccgcgcugccccaggcagcgcugcagcccgcucugccgcccgcgcacccucaccaccagauccccagccugcccaccggcuucugcuccagccuggcgcagggcauggcgcucaccuccacgcucauggccacucugcccggcggcuucucugcgucgccccagcaccaagaggcggcggcugcccgcaaguucgcuccacagccacugcccggaggcggcaacuucgacaaagccgaggcgcuccaagcggaugcggaagacggcaaagccuucuuggccaaggagggcucgcugcucgcuuucucugcggccgaagcggugcaggcgucgcucggugagucggcggcgcgcgcagccggaacgcggggacgggagggagugggggcgggccagcuccggguucccgccgagacccgggggacgaggccgcgcccccgcccgaccucugcgggaauagcuggaggaguugcggugaugcccaccggagcuuuccaauggggcauuuaacgccaagcaacaagcaggauccuggggaaaggaggcguuuagagcucuccugcuagcuacuccaggccacacaucugguggcguguuuggcacacacacacacacacacacacacacacacacacacacacacacgcugugauuauugaggguccuugguguguugcaaccuuaaagagaggccuuauugggcugguuuuuuucuuuuuucaguugcauauguacccaauagaguccagacucaaauaucuucacuggguucucuguucauccaagagaaucagauuccugcgagacucucucucucucucucucucucucucucucucucucucucucucucucucucuguguguguguguguguguguguguguguguacaugcacgcacuaggaacucuaggguggaaaacuucuccuaaggagacacaaaugauaugucucaagaaagcugcgggcuggcaucggcccuacaccacucacaucugcugugaaauugaggcucacuuaauuuuaguuguucagauggugguggggaggaucaugaacucccccuuggucuucaaacaguccuggaccccagggaaacaaaggggauauucucuugggccucagguccgagcagcauccugauacuuaagcuguuagaggcugggagggugagcgggagacauggcagccccuugagugaugguucugggcaaagggccgucgccucuacugucuccuccucuccuuugagcuuuuucucacgcuccccccacccccuuccucaaaggccaggaaaucgcaauguguuaaugugguagaaagacaaucugcuggggggagauaggggugaggugcccaagugggaagggacuggggaaggcaguguucaaaau

SEQ ID NO: 9855 - RNA, 2501 nt, Mus musculus
gucguggcacucugccugcacagcuccacucacugcgggcaggaucgcguugcagacgccggaggucucagugcgcgccccaagaggcucccagcugcguccuugguccacggagcacaucugggcuuggacuugccuccuccaccccucgcagagacccugaacccuggcagggccaaaucugcuccaggagacucagacaaaggcaggcaccguugaacuuagaggucagcaccgcugauuagcggcccgcgccugggguaggagcgcaggcugagcgcgcggaucuggccuccgagaugcgggccacagucagggccgaaaaaagcggagacaaaacugaaagugccgcccgggggggggggggggggcgggggcggccggcgaaggccccagaauuuguccugccccuggccacgguggccaaucagcgcgccgcccucgcuccugacagcuauuuagcaacccagccgggauagaguuuccaaaaaaguuagaauaacuuccucucccggagaccucgguuuugcacaagccggccucgaaaucagagccuuugagagcgacccgggagccugugcucggcggccgcgggcuuggccaguggcgugcgcucggcgccccccagccccacgcgcgccgggcgggcgccauggaggagggcuccagcucgccggugucccccguggacagucugggcaccagugaggaagagcuggagaggcagcccaagcgcuucggccggaagcggcgcuacagcaagaaaucgagcgaagauggcagcccgaccccggguaagcgcggcaagaagggcagcccgagcgcgcagucuuucgaggagcugcagagccagcgcauccuggccaacgugcgcgagcgccagcgcacccagucgcucaacgaggccuucgccgcgcugcgcaagaucauccccacgcuccccucugacaagcucagcaagauccagacgcucaagcuggccgccagguacauagacuuccucuaccagguucuccagagcgacgagauggacaauaagaugaccagcugcagcuacguggcucacgagcgucucagcuacgccuucuccguguggcgcauggagggcgcgugguccauguccgccucccacuagcgccgcgccgugccauccaccuccggagccgcaagccaggguaggugcugcguguggugggcauccacgacgcacgggugggugggcggacgggccaguguaucucuccucgugaagguaccucaggcaaccgcacagggauggggugagcuuccucacccugcaaggguuggcgcgaccugagaaaacucuccuaccccgggggcacgcccaaggucuuuugccaaggguauccguucggaauccacccgccugugguuccccaucaggguccaaauacacuuauuggacaaauggucacuuuucauuuuugguggauggguaucugugggugacucuguggggagcgguugucaaaacgucuuccuuaggccagcggaggccaggagaugcgaugcccgcuggguuguggccgaccuguugccucgcgcucauucuauggagcugaggagcccacgcgugguacagacaauccgcucuuucugauccgcaguuccggcccgcgccuuggaugcuagggcguucaagcccuagccggcucaguacguaagaugaugcuggccccuggcgcggcagagagguuucuguucagcgcuggggcuccagguucacagaggagcaaaucucugggcgccaagaaugcaguagacccuugucgccccaaaaguauggaacccucaagcgcccaggccuggguggauguagcggcuuggagucucuggcugccugcaagcagguggaucguauuuagaguugugugcuuaaguaccaccauccuugaacuuggaaagacacagaggcaagggauucaggcuggguaacaggucugagugugcgguggguguggaugaagaagcagugugagcagggccuugccugggaagaaggcagcucagcacagcugagcaccggauugguguuucagagagcguuuaucauguccugcacccgcugcuuagcagacacaucccaaauccccaggcagccccaggggcaguauccugcaggcucugcuucccugaggccuugcuuagaucuucgaggggagcgugguauagaaaauucuucccacuuaauuuuccuucguuuuucaugcaucuuguguguuuuuuuuuaaaugaaagucuccgcuuaacacagaaagaauuuggauuaaucaagauuaacaugauuauccauugucccaaacaucuauuuacacuuuuauaauuuuauaauaucuugaaaguugcugcuguggccacaaaauguuggucucauacaguggguuuguuuucuuucuuccuuuccuuucuuacccucuuucuuucuuuuuuuuaaaauccuuuauuucuaucaucaaaaaaauguuuucaugaaauaaccu

SEQ ID NO: 9856 - RNA, 2501 nt, Mus musculus
agguuauuucaugaaaacauuuuuuugaugauagaaauaaaggauuuuaaaaaaaagaaagaaagaggguaagaaaggaaaggaagaaagaaaacaaacccacuguaugagaccaacauuuuguggccacagcagcaacuuucaagauauuauaaaauuauaaaaguguaaauagauguuugggacaauggauaaucauguuaaucuugauuaauccaaauucuuucuguguuaagcggagacuuucauuuaaaaaaaaacacacaagaugcaugaaaaacgaaggaaaauuaagugggaagaauuuucuauaccacgcuccccucgaagaucuaagcaaggccucagggaagcagagccugcaggauacugccccuggggcugccuggggauuugggaugugucugcuaagcagcgggugcaggacaugauaaacgcucucugaaacaccaauccggugcucagcugugcugagcugccuucuucccaggcaaggcccugcucacacugcuucuucauccacacccaccgcacacucagaccuguuacccagccugaaucccuugccucugugucuuuccaaguucaaggauggugguacuuaagcacacaacucuaaauacgauccaccugcuugcaggcagccagagacuccaagccgcuacauccacccaggccugggcgcuugaggguuccauacuuuuggggcgacaagggucuacugcauucuuggcgcccagagauuugcuccucugugaaccuggagccccagcgcugaacagaaaccucucugccgcgccaggggccagcaucaucuuacguacugagccggcuagggcuugaacgcccuagcauccaaggcgcgggccggaacugcggaucagaaagagcggauugucuguaccacgcgugggcuccucagcuccauagaaugagcgcgaggcaacaggucggccacaacccagcgggcaucgcaucuccuggccuccgcuggccuaaggaagacguuuugacaaccgcuccccacagagucacccacagauacccauccaccaaaaaugaaaagugaccauuuguccaauaaguguauuuggacccugauggggaaccacaggcggguggauuccgaacggauacccuuggcaaaagaccuugggcgugcccccgggguaggagaguuuucucaggucgcgccaacccuugcagggugaggaagcucaccccaucccugugcgguugccugagguaccuucacgaggagagauacacuggcccguccgcccacccacccgugcgucguggaugcccaccacacgcagcaccuacccuggcuugcggcuccggagguggauggcacggcgcggcgcuagugggaggcggacauggaccacgcgcccuccaugcgccacacggagaaggcguagcugagacgcucgugagccacguagcugcagcuggucaucuuauuguccaucucgucgcucuggagaaccugguagaggaagucuauguaccuggcggccagcuugagcgucuggaucuugcugagcuugucagaggggagcguggggaugaucuugcgcagcgcggcgaaggccucguugagcgacugggugcgcuggcgcucgcgcacguuggccaggaugcgcuggcucugcagcuccucgaaagacugcgcgcucgggcugcccuucuugccgcgcuuacccggggucgggcugccaucuucgcucgauuucuugcuguagcgccgcuuccggccgaagcgcuugggcugccucuccagcucuuccucacuggugcccagacuguccacgggggacaccggcgagcuggagcccuccuccauggcgcccgcccggcgcgcguggggcuggggggcgccgagcgcacgccacuggccaagcccgcggccgccgagcacaggcucccgggucgcucucaaaggcucugauuucgaggccggcuugugcaaaaccgaggucuccgggagaggaaguuauucuaacuuuuuuggaaacucuaucccggcuggguugcuaaauagcugucaggagcgagggcggcgcgcugauuggccaccguggccaggggcaggacaaauucuggggccuucgccggccgcccccgcccccccccccccccccgggcggcacuuucaguuuugucuccgcuuuuuucggcccugacuguggcccgcaucucggaggccagauccgcgcgcucagccugcgcuccuaccccaggcgcgggccgcuaaucagcggugcugaccucuaaguucaacggugccugccuuugucugagucuccuggagcagauuuggcccugccaggguucagggucucugcgagggguggaggaggcaaguccaagcccagaugugcuccguggaccaaggacgcagcugggagccucuuggggcgcgcacugagaccuccggcgucugcaacgcgauccugcccgcagugaguggagcugugcaggcagagugccacgac

SEQ ID NO: 9857 - RNA, 2501 nt, Mus musculus
aguaguagaagcgcuaagagagcaagccgguaaggugaaggauggaaaggagcaaagagaugccgaauucggcugggggcggggaagcuccugauuggccagcggaggacgugaugucacguccggcgagggaagcccugccucagcugccccccccccccgcccugcccccgcccccacagguggugccgccgcccugggugcugggcugggggggacaccuuaggggaccccggacucggccuuugcacuccaggcucuccccgccgccucccaucucacccaggcaacggagcacaucgccugggcugagagaacauucccuccucucccuccggagagcgaaggggcgcccggugcgccccgaucgugccccgccucgccccgccccgccccgcccgggcgcuccccucuucccgcccgcgcuccccgccccucccugccccucuccgcggccgccguggggccgggcgggcggcgggggaggcgccgagccggggcugcgcguucgcccgccgcgcucuaggcggcccgacugagcggccggaccucgcgccucgcgccuagcuccccgcgccgcagccgcagccggcuuuuguugucuccgccuccucgacugccaccgccucuggaccacgagcgucgcgcgcugggaccuuggcucugcccuucgcgcacacugggcugagcgggccggccgggaccgagggaggcgcgcaccggcggccagggagccucgggccccgccauggaacuccggacccgaggcugguggcugcugugcgcggccgccgcgcuggucgucugcgcccgcggggaccccgccagcaagagccggagcugcagcgaaguccgccagaucuacggggcuaagggcuuuagccugagcgaugugccucaggcagagaucucgggugaguaagggcgcugcguccgggggcaccggacccuagcacucgggaggucugaucugggccccuacccgcgccgcagcuagccccgggcgccagaacccgccgccuggacuuggaguggccuccugcuccucaacuggucuauaccccacggcccucgcccccgagcuccgauccgcucuguugcugcccaguucccagccacuacgcucuagagucccuuccccauagcaaucugcgcucccuuuggguuaggguuguugcugggcgucuuugguccccggcuuggcccacugugcuggcggggcagcaaucccagcuccgggacagcgugccugccgcccuugcggcgaagcaagcgguagcucugggacggucuauugggucgcauaucccgguugcagugggcuaggaacuucucuaugcggaucucucccagaggcgucaaggguucugcuuaggaauuuacgcggauccacagcaggagccgccuaggugggauuuaugggggagauccuacacuucaagccuggguucuaaggaaaugugagcccgcugcgcgauucaggggaccccagggcucgaggggauuccuaccuaggaacuugugcccgccagcgccccuauccuagcacacucguggucugaccgggcgcuccgggccgccuggagcugcgagcccagcugcagguggucggcgucuuggaucccgcccaggggccuugucaucucuuuguaagaagagcggcccuccuggcggcggccucggcccugcagcugcugagagcagcccuuccccucccuucccuucccugcugccucaggagcucugggaaccgaaucuuuaugagcuuggagugccuaugcaaugucccaaggaccucccaagccccaggcuuugcucuuaaauguguggggagcuuuccuggauaaguguaacaccagggccuuggugagcagggaauuccugcugugggauucuucugaaacugagggggcuugcagacuagagaccaaacucaacuggugucguaggcacucugaaugaggaaaguaagaguauugcccagagggguggccuguggccccaacuugcuugggaauggcaguagauagccagccauggagaacccuguuucuggggagagacagaacccacaagacacauuguguggccugagucucuugacuaucucccucucaaaugcccucagaacaggccuuucuaugccucucucuacauacagcccugccauugccaaagccaccuccuacaguucucugggcacugucacccggugccuggcagcagcagguauaguuugguugguacccugcucacucuacccaccuccaaacacacagaaauaggaacauauacccugacauccuuguguaucucuuaucccugccagacguacccugcuccgcacacauaccagccugaggccuuccagccuacaucuuaccuuggcauggauaugccacccaucuuaaugccuucuuggagaccuucuugagcuuguacccacccacagcuacugugcccgaguaggcagggacuggcaauguaggcagugacaaggg

SEQ ID NO: 9858 - RNA, 2501 nt, Mus musculus
cccuugucacugccuacauugccagucccugccuacucgggcacaguagcuguggguggguacaagcucaagaaggucuccaagaaggcauuaagauggguggcauauccaugccaagguaagauguaggcuggaaggccucaggcugguaugugugcggagcaggguacgucuggcagggauaagagauacacaaggaugucaggguauauguuccuauuucuguguguuuggagguggguagagugagcaggguaccaaccaaacuauaccugcugcugccaggcaccgggugacagugcccagagaacuguaggagguggcuuuggcaauggcagggcuguauguagagagaggcauagaaaggccuguucugagggcauuugagagggagauagucaagagacucaggccacacaaugugucuuguggguucugucucuccccagaaacaggguucuccauggcuggcuaucuacugccauucccaagcaaguuggggccacaggccaccccucugggcaauacucuuacuuuccucauucagagugccuacgacaccaguugaguuuggucucuagucugcaagcccccucaguuucagaagaaucccacagcaggaauucccugcucaccaaggcccugguguuacacuuauccaggaaagcuccccacacauuuaagagcaaagccuggggcuugggagguccuugggacauugcauaggcacuccaagcucauaaagauucgguucccagagcuccugaggcagcagggaagggaagggaggggaagggcugcucucagcagcugcagggccgaggccgccgccaggagggccgcucuucuuacaaagagaugacaaggccccugggcgggauccaagacgccgaccaccugcagcugggcucgcagcuccaggcggcccggagcgcccggucagaccacgagugugcuaggauaggggcgcuggcgggcacaaguuccuagguaggaauccccucgagcccugggguccccugaaucgcgcagcgggcucacauuuccuuagaacccaggcuugaaguguaggaucucccccauaaaucccaccuaggcggcuccugcuguggauccgcguaaauuccuaagcagaacccuugacgccucugggagagauccgcauagagaaguuccuagcccacugcaaccgggauaugcgacccaauagaccgucccagagcuaccgcuugcuucgccgcaagggcggcaggcacgcugucccggagcugggauugcugccccgccagcacagugggccaagccggggaccaaagacgcccagcaacaacccuaacccaaagggagcgcagauugcuauggggaagggacucuagagcguaguggcugggaacugggcagcaacagagcggaucggagcucgggggcgagggccgugggguauagaccaguugaggagcaggaggccacuccaaguccaggcggcggguucuggcgcccggggcuagcugcggcgcggguaggggcccagaucagaccucccgagugcuaggguccggugcccccggacgcagcgcccuuacucacccgagaucucugccugaggcacaucgcucaggcuaaagcccuuagccccguagaucuggcggacuucgcugcagcuccggcucuugcuggcgggguccccgcgggcgcagacgaccagcgcggcggccgcgcacagcagccaccagccucggguccggaguuccauggcggggcccgaggcucccuggccgccggugcgcgccucccucggucccggccggcccgcucagcccagugugcgcgaagggcagagccaaggucccagcgcgcgacgcucgugguccagaggcgguggcagucgaggaggcggagacaacaaaagccggcugcggcugcggcgcggggagcuaggcgcgaggcgcgagguccggccgcucagucgggccgccuagagcgcggcgggcgaacgcgcagccccggcucggcgccucccccgccgcccgcccggccccacggcggccgcggagaggggcagggaggggcggggagcgcgggcgggaagaggggagcgcccgggcggggcggggcggggcgaggcggggcacgaucggggcgcaccgggcgccccuucgcucuccggagggagaggagggaauguucucucagcccaggcgaugugcuccguugccugggugagaugggaggcggcggggagagccuggagugcaaaggccgaguccgggguccccuaaggugucccccccagcccagcacccagggcggcggcaccaccugugggggcgggggcagggcggggggggggggcagcugaggcagggcuucccucgccggacgugacaucacguccuccgcuggccaaucaggagcuuccccgcccccagccgaauucggcaucucuuugcuccuuuccauccuucaccuuaccggcuugcucucuuagcgcuucuacuacu

SEQ ID NO: 9859 - RNA, 2501 nt, Mus musculus
agggguggggagagagagacugcucggugcuuacagauaacccgcaaugcuacagaauuaagcccagccugagaguauccaucuuucuucaaugugagauguuugaaucuugcgaggcaaagguaauucucacaccccagaauuaaagugagaggcuuuucuggcuuucugaugaugccauccacucuccugucucuaaggcuaucggguucugugggaacagggaaaggaccugcaacccgggugcagaacucguuccaagcuggagcggcuccaguuccgcacacagcaucucugcuguuucucugggaaaucuguuuccaugucauccuguuucacacgcuacaauucggaaucucuaagcaagagauccuguaucccaacgcgaaaccggaauauaaagauguucaggagguacuaagaauaggacagaaaccugccagaacuaaaauaauauaagcacucuacagucgacagaugaaagcuuccaagaaaaaaggaaaaaaaaaugaauagagguguacagagucggcugccugagaaaagaccgugcugcagagacccccaaauccgccagcaacgguuucagcagcaccguugauaguuuucgaggggggccaauuaagaagcagcaagaaaggggaaugguguagaugcggucgucuucgcaaagaacccaagcugaaggccgcuagagcaggauggggaaggagagccaggugggggaaugagggaucccuaacguucgacgcagccccacuaaggagacagugguuguaagcgggagauggugaugccuuccaggggacgcaccggguacaaggccagcguccaaggaaggacucagagcuggacacacucucuccaggaaguaucagcgcggauagcaucugugcagaucagguugguagccagaccccaaacauccuaaccucucugccagcacccucacacuauggggcggugaccgcugugacccaggauccagggagcuucggccccacgcacguccagaggcuaaggggacccuagcugucacccuaccgggugcucugccacuaaccaaaaaaauuaauuaauaauaauaauaacuuuccccggguggcugggcuugcgcagcgggaugcuuuggaacccacaucucccagcaccgagaggaaucccuuggucccccguaagacacuaagaacccugucugcaaacuuuucccgcgagcaccggagaaggcuggccuaagcacccuccgagaucggaaaacugaaagaggcucucgggaggcaccgcugcccgacccucauggaucccgaaagguggaauagucgcuuccgcucuuugcaccaagcuccgcaaauaggggacagguggcuugagaggggcggagaggaaggagcgcggggcggugguagcucaccucggucuuccaacccgucgcugaacuggccgcucucgcugauccguggcugccuuuccucaucagacugcacagaggagcucaucggagccgggcugggggcgggggcggcggucgagggcgcguggccccgcgguggcggccgcgggacuccggggccaggggggcugcggcgcucgcugcccagagccggcuccauggcgccggggcugcagaucccccgaggcgaagccgaccacgauggagacacgaaguccaaagugccagagaccgagggcaccgagagagagcuucgcccguaccgcggugagcggcagguccgccgcuagcacaccgaguggcggaggcuggugccgcgcugucgccgcugcgcuccgcccccgggggcaggugcgggcggcagggacccgccccgaggcgcuaagcccgggcacugguaucgaugcacccaggcgaguggagagggagggccccggacgguccagacgcguggaagcugagggaacuguuagggggcguggggaccagccugcggguagcgcagggcugggugagggcgugacggaggacgcgccccccacucacgucgcggauuggugcccaggagggacccuuccacccuaauuacucugcaguccucggagccuguggccgcgcgugggcaggagagagggcaucgcagcucauccggccuuuuuucucucccggagccacacaggcuacaaggauugcaccuuguccccgccugcccaagcaggcaccaggauucaccuguuccccagccucuggaucugcugcccuuaaauggcuuuaacucucaucucaguuucucucuugcaccaacuuagauugaggugcugcuggaaccguggcuugucccccccucccccagaccucccauuacgacuauccuugggccuuucccauccaucugucaaccucucuaagcguucaggauccguccccuugcugcggaugcucaccccuguucuucaucucugaccauaacaacuucccacacuugggcagugagccuggucuccccagcgaagcugcaaccugguccacagggccggcuggggaagaccca

SEQ ID NO: 9860 - RNA, 2501 nt, Mus musculus
ugggucuuccccagccggcccuguggaccagguugcagcuucgcuggggagaccaggcucacugcccaagugugggaaguuguuauggucagagaugaagaacaggggugagcauccgcagcaaggggacggauccugaacgcuuagagagguugacagauggaugggaaaggcccaaggauagucguaaugggaggucugggggagggggggacaagccacgguuccagcagcaccucaaucuaaguuggugcaagagagaaacugagaugagaguuaaagccauuuaagggcagcagauccagaggcuggggaacaggugaauccuggugccugcuugggcaggcggggacaaggugcaauccuuguagccuguguggcuccgggagagaaaaaaggccggaugagcugcgaugcccucucuccugcccacgcgcggccacaggcuccgaggacugcagaguaauuaggguggaagggucccuccugggcaccaauccgcgacgugaguggggggcgcguccuccgucacgcccucacccagcccugcgcuacccgcaggcugguccccacgcccccuaacaguucccucagcuuccacgcgucuggaccguccggggcccucccucuccacucgccugggugcaucgauaccagugcccgggcuuagcgccucggggcgggucccugccgcccgcaccugcccccgggggcggagcgcagcggcgacagcgcggcaccagccuccgccacucggugugcuagcggcggaccugccgcucaccgcgguacgggcgaagcucucucucggugcccucggucucuggcacuuuggacuucgugucuccaucguggucggcuucgccucgggggaucugcagccccggcgccauggagccggcucugggcagcgagcgccgcagccccccuggccccggagucccgcggccgccaccgcggggccacgcgcccucgaccgccgcccccgcccccagcccggcuccgaugagcuccucugugcagucugaugaggaaaggcagccacggaucagcgagagcggccaguucagcgacggguuggaagaccgaggugagcuaccaccgccccgcgcuccuuccucuccgccccucucaagccaccuguccccuauuugcggagcuuggugcaaagagcggaagcgacuauuccaccuuucgggauccaugagggucgggcagcggugccucccgagagccucuuucaguuuuccgaucucggagggugcuuaggccagccuucuccggugcucgcgggaaaaguuugcagacaggguucuuagugucuuacgggggaccaagggauuccucucggugcugggagauguggguuccaaagcaucccgcugcgcaagcccagccacccggggaaaguuauuauuauuauuaauuaauuuuuuugguuaguggcagagcacccgguagggugacagcuaggguccccuuagccucuggacgugcguggggccgaagcucccuggauccugggucacagcggucaccgccccauagugugagggugcuggcagagagguuaggauguuuggggucuggcuaccaaccugaucugcacagaugcuauccgcgcugauacuuccuggagagaguguguccagcucugaguccuuccuuggacgcuggccuuguacccggugcguccccuggaaggcaucaccaucucccgcuuacaaccacugucuccuuaguggggcugcgucgaacguuagggaucccucauucccccaccuggcucuccuuccccauccugcucuagcggccuucagcuuggguucuuugcgaagacgaccgcaucuacaccauuccccuuucuugcugcuucuuaauuggccccccucgaaaacuaucaacggugcugcugaaaccguugcuggcggauuugggggucucugcagcacggucuuuucucaggcagccgacucuguacaccucuauucauuuuuuuuuccuuuuuucuuggaagcuuucaucugucgacuguagagugcuuauauuauuuuaguucuggcagguuucuguccuauucuuaguaccuccugaacaucuuuauauuccgguuucgcguugggauacaggaucucuugcuuagagauuccgaauuguagcgugugaaacaggaugacauggaaacagauuucccagagaaacagcagagaugcugugugcggaacuggagccgcuccagcuuggaacgaguucugcacccggguugcagguccuuucccuguucccacagaacccgauagccuuagagacaggagaguggauggcaucaucagaaagccagaaaagccucucacuuuaauucuggggugugagaauuaccuuugccucgcaagauucaaacaucucacauugaagaaagauggauacucucaggcugggcuuaauucuguagcauugcggguuaucuguaagcaccgagcagucucucucuccccaccccu

SEQ ID NO: 9861 - RNA, 2501 nt, Mus musculus
gcgggcugcgggacgagggcuggagggaggcggcccgcgggggucugccccaccgcagggggcgccggaggugcggggaguucccggaggagccggcgauggccccugcgagccccggagggcgcgaggcuuuggaggugguuugugcggccagggagcaagcgggagaggggcgggggcgaggcgaagucugucuaaaugccaguucccugaaguucagcgcgucgguugucauuucaucccuuaaugcauauuuaugccaugccgaaauaggcuucauaauuaacuccuggagucauccgcagagguuaaagggaccccgaagauuugugcauugauuggguacccaggcagugugugugugcauguguguguguguguguguguguguguacgcgcgcgcgccccgugcgaacccauugagaagaauaauuauuuuucuccgcuggaagcuacagccgagaaucagaccgggagggaagagagagguuggagagggagagggaaagagggagacaaaggaagugagugcaagagaggagccggcucagcauccgaacugugaguacagagcggaaacaggcagaaagugcugggagucggcgaccccucugcgggccggguuggggggccgggaaccgccaaggacuggcgucucugcuuugggcugggcagggcuccuccagcuccggcaagcucaccugaaagccagaucugccccgcugcugccugcgccaaccacuguccuggcuaggcaaaaacgaagccccccauccaggcuccacugccuuuguuccuucuaaaggguuucacagccagugcgcuucaggagggaaugugagggagcuagcucucuaaaagcuugggucuaccuccccuggcuuagugaaagccacucugagugcuucccucuuuccuucgccgccugguggaaugagaugaaggggcucuaacugaggcagggaacaggacuuuguggcaccugugcauucggcccauagaagggagaaacagcggugucugguaccccaggagcagagagagguccuggaagcccuugugcaagaggcggggaggagccaugaccagugcaaaaccaccaacucccgcaaaugugaggcaaauauauacccgggaggagggguagaccagcuucuucauucucccuccaauccuuuccagucacuguggcuucgggguuugauaggaccucugggcuuugagcuuucucccaccccucuucccccucgggggcccuugcauaccuaacaagguccgcagagaggccacccaggaggaggaacccuggcgaggauagaggcccagcaaggcagccuuggcgaaaauagauacucccccucuugagaaagggucccugaacauggauagaguacccuuaaaggaaggccccugccuccccagagcugaucaggagagggcgccugggggcuagagggagagcccuucuucccagcccacauuccacaaccucccuuuggaagcacggguguucagccuucauuagcugacucuucucuccuggucugauucaaucuucccuggugaauuuucaaaggugcuuuccucugccagugagcaacuuagcucagggcuaacuuagcagcggaagucagcuccuuggugccuagguucucuauugagagaaaaaggacugucccuccaagaaguccccagggugccaguuuaucgaccuguaagggugccccaucagaggcaggccuaaggcuggaaacaguuuuugcuuuucaaaagguccaguuccaucaaagcugugacagauacuggcucuucuccacacccuccucagacucuagacacagcuuccuccgugggguuacuggguaccuccuccugcuuccacucucuugccauacauaaccggguaugauuacccaggaggcaggcuucagaagccagguccgugaugaggacacagaggccugagaguagauauggcuaugucuaacccugucccuuggagucaugucauaagacuuauggauggagcccuccagcaguucuggcuuacagugguuugucccccacuggacugccagcaugaguccuaucccagggucuugcacagugucugaccaugagcuuaaugcaaacucacugaaggggcagcugucccuguccucaccaucuuuugaggguuaggggacauggcugaaagggcaggacuaggccugggcagacaugagaaccuuuugauuuuauucaugauauucucgggcaaacugcaugcaaauuugccaguggcccauuauccuauuuuucuuuagccacaugguugacugagaaccagaacuguaaccuggguucugugcucaggaagccugaacucuggugacguaagcuccuugaacucuuucuccuaucaaccagccaacaggcucaguagggcuuagagagcugauugcacuaaggccggagagaccugucccucuggcuuccacccugcagucuccucagggcuu

SEQ ID NO: 9862 - RNA, 2501 nt, Mus musculus
aagcccugaggagacugcaggguggaagccagagggacaggucucuccggccuuagugcaaucagcucucuaagcccuacugagccuguuggcugguugauaggagaaagaguucaaggagcuuacgucaccagaguucaggcuuccugagcacagaacccagguuacaguucugguucucagucaaccauguggcuaaagaaaaauaggauaaugggccacuggcaaauuugcaugcaguuugcccgagaauaucaugaauaaaaucaaaagguucucaugucugcccaggccuaguccugcccuuucagccauguccccuaacccucaaaagauggugaggacagggacagcugccccuucagugaguuugcauuaagcucauggucagacacugugcaagacccugggauaggacucaugcuggcaguccagugggggacaaaccacuguaagccagaacugcuggagggcuccauccauaagucuuaugacaugacuccaagggacaggguuagacauagccauaucuacucucaggccucuguguccucaucacggaccuggcuucugaagccugccuccuggguaaucauacccgguuauguauggcaagagaguggaagcaggaggagguacccaguaaccccacggaggaagcugugucuagagucugaggaggguguggagaagagccaguaucugucacagcuuugauggaacuggaccuuuugaaaagcaaaaacuguuuccagccuuaggccugccucugauggggcacccuuacaggucgauaaacuggcacccuggggacuucuuggagggacaguccuuuuucucucaauagagaaccuaggcaccaaggagcugacuuccgcugcuaaguuagcccugagcuaaguugcucacuggcagaggaaagcaccuuugaaaauucaccagggaagauugaaucagaccaggagagaagagucagcuaaugaaggcugaacacccgugcuuccaaagggagguuguggaaugugggcugggaagaagggcucucccucuagcccccaggcgcccucuccugaucagcucuggggaggcaggggccuuccuuuaaggguacucuauccauguucagggacccuuucucaagagggggaguaucuauuuucgccaaggcugccuugcugggccucuauccucgccaggguuccuccuccuggguggccucucugcggaccuuguuagguaugcaagggcccccgagggggaagaggggugggagaaagcucaaagcccagagguccuaucaaaccccgaagccacagugacuggaaaggauuggagggagaaugaagaagcuggucuaccccuccucccggguauauauuugccucacauuugcgggaguuggugguuuugcacuggucauggcuccuccccgccucuugcacaagggcuuccaggaccucucucugcuccugggguaccagacaccgcuguuucucccuucuaugggccgaaugcacaggugccacaaaguccuguucccugccucaguuagagccccuucaucucauuccaccaggcggcgaaggaaagagggaagcacucagaguggcuuucacuaagccaggggagguagacccaagcuuuuagagagcuagcucccucacauucccuccugaagcgcacuggcugugaaacccuuuagaaggaacaaaggcaguggagccuggauggggggcuucguuuuugccuagccaggacagugguuggcgcaggcagcagcggggcagaucuggcuuucaggugagcuugccggagcuggaggagcccugcccagcccaaagcagagacgccaguccuuggcgguucccggccccccaacccggcccgcagaggggucgccgacucccagcacuuucugccuguuuccgcucuguacucacaguucggaugcugagccggcuccucucuugcacucacuuccuuugucucccucuuucccucucccucuccaaccucucucuucccucccggucugauucucggcuguagcuuccagcggagaaaaauaauuauucuucucaauggguucgcacggggcgcgcgcgcguacacacacacacacacacacacacacaugcacacacacacugccuggguacccaaucaaugcacaaaucuucggggucccuuuaaccucugcggaugacuccaggaguuaauuaugaagccuauuucggcauggcauaaauaugcauuaagggaugaaaugacaaccgacgcgcugaacuucagggaacuggcauuuagacagacuucgccucgcccccgccccucucccgcuugcucccuggccgcacaaaccaccuccaaagccucgcgcccuccggggcucgcaggggccaucgccggcuccuccgggaacuccccgcaccuccggcgcccccugcgguggggcagacccccgcgggccgccucccuccagcccucgucccgcagcccgc

SEQ ID NO: 9863 - RNA, 2501 nt, Mus musculus
aacuagcccucugggcucagcaggacagcgcggaggguggaguuggcugguacagaaacauuugccgaacaagugagcuaaacagugccuucuggaagccagcuuggucugguccgagaagcagcagcacccuggguccuggugugccacccucugcauguccucaucucucuccugaagcuuuucucuccuccuuucccaguccgguggaacccagaucauucacaagccuauacuggcugucccuugucuugccagcccuuccaaauguuccagucccacuccaggcccgaccucaccugcucccucagacucucugguugcagaggcuccaggucccugcacugaggucaugggcacugucaggaugguaauucucugacacccagccccuccuguuucucucacugcagcucugcugaacauccccauacagagcccaggaaggcacuuugggcugggauccaaaugcccggagaauaccuggcugacuaggaggcuuaugugugcugacuuucaucuucucuugcucauccccaagccccacacaggguugcacagaguaccuugggcugcuaugaacucaccggagagggaucuugacucggagguaccgauccacagcaauagcaagcagagccaggauggagcucugggugaggaugaggacaggacaggccaccaugaggcagguguggaaguaggucuguggcccaauguugauaaggauggccagugggaugaccagggcgccaacagccacaucagcuaccgccagggauacgaugaagcagaagguagcaucgcgaagugccugguucaccuucacagcccaaaucaccaguacauuuccgggcacagagaccaaggcaaugagcaccucgaugccaauguaggcagccuggaaggccgagauguacggcggcauggugggcaggagcugggcacaucagcagacaggcgcccuggggcgcgaggccagcaccuguggucaggaagccugcgguggggaugccagccugggaaggagggggacauaggcagcccugcgaagaugugccccaguaaagugaugcagugccugcccaagcuggccagacacucaggcucacuaucugcuuaaccucuguccccuccccuuguccuuagagguuccauucagcaacuuaaaauagcagcacucacuccaccacugguuuuuguaucaggugugagguggcucccuguacacuuacuccacaaggauccccugugaauccacagugcccacagguguccgccgacccggaggcaaggagcucaccauccugccugccaaccgguagggggucccaaaggcguugcccuaaguuccccgggcggcuuuccggagccgcgccgggcaggguuggguucugggcaccgcgcgcgcaucggcucaucguucuccaggcucccgccgcugcgcucccagcccggccuuucaagcaaucacaugguguggcagaggcucagccccggacgccuuuaaagagguagugccccuguuucguaccugggacuggauggcaggcgugauucugagggacuaagcccaggaccuggcggguccaccggcucccauuccccgcgugcgcgcacgccuacccugugcccacccaccugggacgccgcuggugcccgauucuuaacagaagccugguccagcuccagcucugcccagaauccuuacccaucgacugccccaagggggacaccccagucauuucauccaccccuuuccugcacacucaugaugcacgaacugagccacagacuuacccaaggucacaccaaagcuggcagagcgccuggccaccugaacugucuagccaaguauccccagaccucaaaaccuugggcagucgcucccucagaggaugccaggggaacccagggcuagccaguuauguccaaggggugguagccagccgagacuccacucuggcgccggcgccuucgucgcccccggcgcgggagcugagugacaaucgggcuccgcacaccgggagggggagggggcgggggcgggggcggcggcggcacccgcgggccccucccucgucgcccuccgucuccuccccuacccccuccucuaaacaaaggaagugauucagugugagaaaagcugggaaaacgugagcgucucgaauggugugauguauggauccggccucgggacagggacaguaccgaggugccgauucccguguucccucuuucccuuacucccucccucccuucucaaugcagcaggcggacagcccaagcccuaaucaccugcgggacucaagagggccccucucuggucucccaccgccaccaaccauuggcaucugggcgccuccccuaaucuuaaaaccuacucucuucaggaaagcagucccagcacugucaggagcgcacaggcuucccgcacacacguuacuuugcaggcagucuccugagucauagcccuuucucauccaucgcucagagugcuu

SEQ ID NO: 9864 - RNA, 2501 nt, Mus musculus
aagcacucugagcgauggaugagaaagggcuaugacucaggagacugccugcaaaguaacgugugugcgggaagccugugcgcuccugacagugcugggacugcuuuccugaagagaguagguuuuaagauuaggggaggcgcccagaugccaaugguugguggcggugggagaccagagaggggcccucuugagucccgcaggugauuagggcuugggcuguccgccugcugcauugagaagggagggagggaguaagggaaagagggaacacgggaaucggcaccucgguacugucccugucccgaggccggauccauacaucacaccauucgagacgcucacguuuucccagcuuuucucacacugaaucacuuccuuuguuuagaggaggggguaggggaggagacggagggcgacgagggaggggcccgcgggugccgccgccgcccccgcccccgcccccucccccucccggugugcggagcccgauugucacucagcucccgcgccgggggcgacgaaggcgccggcgccagaguggagucucggcuggcuaccaccccuuggacauaacuggcuagcccuggguuccccuggcauccucugagggagcgacugcccaagguuuugaggucuggggauacuuggcuagacaguucagguggccaggcgcucugccagcuuuggugugaccuuggguaagucuguggcucaguucgugcaucaugagugugcaggaaagggguggaugaaaugacuggggugucccccuuggggcagucgauggguaaggauucugggcagagcuggagcuggaccaggcuucuguuaagaaucgggcaccagcggcgucccaggugggugggcacaggguaggcgugcgcgcacgcggggaaugggagccgguggacccgccagguccugggcuuagucccucagaaucacgccugccauccagucccagguacgaaacaggggcacuaccucuuuaaaggcguccggggcugagccucugccacaccaugugauugcuugaaaggccgggcugggagcgcagcggcgggagccuggagaacgaugagccgaugcgcgcgcggugcccagaacccaacccugcccggcgcggcuccggaaagccgcccggggaacuuagggcaacgccuuugggacccccuaccgguuggcaggcaggauggugagcuccuugccuccgggucggcggacaccugugggcacuguggauucacaggggauccuuguggaguaaguguacagggagccaccucacaccugauacaaaaaccagugguggagugagugcugcuauuuuaaguugcugaauggaaccucuaaggacaaggggaggggacagagguuaagcagauagugagccugagugucuggccagcuugggcaggcacugcaucacuuuacuggggcacaucuucgcagggcugccuaugucccccuccuucccaggcuggcauccccaccgcaggcuuccugaccacaggugcuggccucgcgccccagggcgccugucugcugaugugcccagcuccugcccaccaugccgccguacaucucggccuuccaggcugccuacauuggcaucgaggugcucauugccuuggucucugugcccggaaauguacuggugauuugggcugugaaggugaaccaggcacuucgcgaugcuaccuucugcuucaucguaucccuggcgguagcugauguggcuguuggcgcccuggucaucccacuggccauccuuaucaacauugggccacagaccuacuuccacaccugccucaugguggccuguccuguccucauccucacccagagcuccauccuggcucugcuugcuauugcuguggaucgguaccuccgagucaagaucccucuccggugaguucauagcagcccaagguacucugugcaacccuguguggggcuuggggaugagcaagagaagaugaaagucagcacacauaagccuccuagucagccagguauucuccgggcauuuggaucccagcccaaagugccuuccugggcucuguauggggauguucagcagagcugcagugagagaaacaggaggggcugggugucagagaauuaccauccugacagugcccaugaccucagugcagggaccuggagccucugcaaccagagagucugagggagcaggugaggucgggccuggagugggacuggaacauuuggaagggcuggcaagacaagggacagccaguauaggcuugugaaugaucuggguuccaccggacugggaaaggaggagagaaaagcuucaggagagagaugaggacaugcagaggguggcacaccaggacccagggugcugcugcuucucggaccagaccaagcuggcuuccagaaggcacuguuuagcucacuuguucggcaaauguuucuguaccagccaacuccacccuccgcgcuguccugcugagcccagagggcuaguu

SEQ ID NO: 9865 - RNA, 2501 nt, Mus musculus
uuaaauuaaccgguagcugugugcgugcucugagcagcgagcacgucagacugcgccccaguggggagaggugaggggauucccuuaguuaggaccuuagaucccgggaggggaagcugugacacucuugagcuuuuaggcccccacuggaugcgcgacugggaggaaaccggagaccccaaagagcgccagacuaggcgcagacucagcgaaccacagggcgccuggagggauggagagggcggugcagcucucuuggcaccaccuggggcagccaagggcagcuucccggcuuccuucgucucucauuugcguggguaaaagccugccgcugcgguucuugcgcaacucacugaagcagagagggggaaaaguugguggggguuggggaaagccuaagcggaaagacagagucaccacuacgucacguggaguccgcuuuacagacuuaaaagcaagguucuccccauuagcagccaguugucaaacugcgagcuaagagcuucaggagucagucaggacucugcucacgaaggaacucagcacugcauccugccagcuccaccgccaccacuacugccaccuccgcugccaccucugcgaugcucuuccgagcugugcugcucugcgcugcccuggggcucagccaggcaggugaguugcgccccgaggcgcccugggacuccucaggcucagacccccuuucuagcagugugggccuggcuguguauuggcaaagagccuggacugcuuaaguccugaggaacugcaacccacuuucagguuucuuauuugcuaaaaaccaauagucuuaauggcuuacagguugucauuaugguaagacaaucugaucaauacuugugaaaagcauagaugugggcaacugaacaagaguggcugcuuugaauaccuguuagaguuuuucuauccacagaaaaauccagaauacauuuuuaaaaauauauuuaaaaugcuaaaacuugacuguuuuaauuuuauuuucuuuacacuaaauuuugacuauugcacuaggucgauccauuuuaauauuuaaagggaugcuuaauaauucuagucuguguguccgaguuauuuuaaaaauguugguaaugugaacuaugaaguuagguccucuguguuucuugcuuaagaauacaaaguugcuugcuauuuccauaaacaguugauaagacagacuuaauuaaaauaaugaccuuuuuaaaucugggucuaccuauguauuugucaaacuuaucauuguaaaguugacccauagugacagaauuaaauccuuaaguuaagaugagaacaaccaagaguaacugacaggauaucuuauuuuuuuaauguagcaaauccuugcuguuccaauccaugucaaaaccguggggaauguaugagcacaggauuugaccaguauaagugugacuguacccggacuggauucuauggugaaaacuguacuacacguaaguuuuuccugggguaucuuccuuuggaauguggccacauguguaaccaucauucuguagauuuguguccuaugggggaggggccugcucauucuuccuccugcuuugucucucuccagcugaauuucugacaagaaucaaauuacugcugaagcccaccccaaacacagugcacuacauccugacccacuucaagggagucuggaacauugugaacaacauccccuuccugcgaaguuuaaucaugaaauaugugcugacauguaaguacaacccucccuuguuuuccagcauccuccaacacaacuaggcacuagaaacccaaccccaagaacuauccugaccuuuucaaagggcuugaaguauaccuuuucuaaucuguuuuuccccugaaaugucuaaaauacagucaugaaaaccuguagucucuauucuaguuuugaccccuguccuucauucguguggaggaagugugguucacuuguucauugaauaaauacccauggcucacagaauuguucggaacacauagaauuguucugaaccuuugaaacaaaugguugacuaggguuugggucagaagagaaaaauagcugucuguaguuauuggugagggccaugcccaaaugucucugucaucagcuauggaacagggaguggguagaaacugaaaagucaagacuacuggagcagaauguccuguguaaaauuuaagcuuuauugaagaugcauuuucagugcucuuuaaaguucagccauuguacagcaggguaucuuugucugaaggaaaucuagucucuguacuugcuacauuguacaaugauaauugauaugcccuuguuguuguuguuguuuuucauaugaggaccaaugauuuuuuuuucuuuaaaauuucagccagaucauauuugauugacaguccaccuacuuacaaugugcacuaugguuacaaaagcugggaagccuucuccaaccucuccuacuacaccagggcccuuccucccguagcagaugacugcccaacuccca

SEQ ID NO: 9866 - RNA, 2501 nt, Mus musculus
ugggaguugggcagucaucugcuacgggaggaagggcccugguguaguaggagagguuggagaaggcuucccagcuuuuguaaccauagugcacauuguaaguagguggacugucaaucaaauaugaucuggcugaaauuuuaaagaaaaaaaaaucauugguccucauaugaaaaacaacaacaacaacaagggcauaucaauuaucauuguacaauguagcaaguacagagacuagauuuccuucagacaaagauacccugcuguacaauggcugaacuuuaaagagcacugaaaaugcaucuucaauaaagcuuaaauuuuacacaggacauucugcuccaguagucuugacuuuucaguuucuacccacucccuguuccauagcugaugacagagacauuugggcauggcccucaccaauaacuacagacagcuauuuuucucuucugacccaaacccuagucaaccauuuguuucaaagguucagaacaauucuauguguuccgaacaauucugugagccauggguauuuauucaaugaacaagugaaccacacuuccuccacacgaaugaaggacaggggucaaaacuagaauagagacuacagguuuucaugacuguauuuuagacauuucaggggaaaaacagauuagaaaagguauacuucaagcccuuugaaaaggucaggauaguucuugggguuggguuucuagugccuaguuguguuggaggaugcuggaaaacaagggaggguuguacuuacaugucagcacauauuucaugauuaaacuucgcaggaaggggauguuguucacaauguuccagacucccuugaagugggucaggauguagugcacuguguuuggggugggcuucagcaguaauuugauucuugucagaaauucagcuggagagagacaaagcaggaggaagaaugagcaggccccucccccauaggacacaaaucuacagaaugaugguuacacauguggccacauuccaaaggaagauaccccaggaaaaacuuacguguaguacaguuuucaccauagaauccaguccggguacagucacacuuauacuggucaaauccugugcucauacauuccccacgguuuugacauggauuggaacagcaaggauuugcuacauuaaaaaaauaagauauccugucaguuacucuugguuguucucaucuuaacuuaaggauuuaauucugucacuaugggucaacuuuacaaugauaaguuugacaaauacauagguagacccagauuuaaaaaggucauuauuuuaauuaagucugucuuaucaacuguuuauggaaauagcaagcaacuuuguauucuuaagcaagaaacacagaggaccuaacuucauaguucacauuaccaacauuuuuaaaauaacucggacacacagacuagaauuauuaagcaucccuuuaaauauuaaaauggaucgaccuagugcaauagucaaaauuuaguguaaagaaaauaaaauuaaaacagucaaguuuuagcauuuuaaauauauuuuuaaaaauguauucuggauuuuucuguggauagaaaaacucuaacagguauucaaagcagccacucuuguucaguugcccacaucuaugcuuuucacaaguauugaucagauugucuuaccauaaugacaaccuguaagccauuaagacuauugguuuuuagcaaauaagaaaccugaaaguggguugcaguuccucaggacuuaagcaguccaggcucuuugccaauacacagccaggcccacacugcuagaaagggggucugagccugaggagucccagggcgccucggggcgcaacucaccugccuggcugagccccagggcagcgcagagcagcacagcucggaagagcaucgcagagguggcagcggagguggcaguagugguggcgguggagcuggcaggaugcagugcugaguuccuucgugagcagaguccugacugacuccugaagcucuuagcucgcaguuugacaacuggcugcuaauggggagaaccuugcuuuuaagucuguaaagcggacuccacgugacguaguggugacucugucuuuccgcuuaggcuuuccccaacccccaccaacuuuucccccucucugcuucagugaguugcgcaagaaccgcagcggcaggcuuuuacccacgcaaaugagagacgaaggaagccgggaagcugcccuuggcugccccagguggugccaagagagcugcaccgcccucuccaucccuccaggcgcccugugguucgcugagucugcgccuagucuggcgcucuuuggggucuccgguuuccucccagucgcgcauccagugggggccuaaaagcucaagagugucacagcuuccccucccgggaucuaagguccuaacuaagggaauccccucaccucuccccacuggggcgcagucugacgugcucgcugcucagagcacgcacacagcuaccgguuaauuuaa

SEQ ID NO: 9867 - RNA, 2501 nt, Mus musculus
caccuucgaagaccaugggaugguaccuguucugaccugagagagagugcaguauaguggugauguacuuuuucuuggaaugcaccccaugcgccuguccuccgugaacucuccacccccuaccaaaccucuccugucacuuuugaauuguuuuccugcuuuuacuagaggucggcgucucucucucucucucucucucucucucucucucucucucucucucucucucucucucucucggcguaugucuggucuucaagccuuccucuucuccuggcaccccaagucuccgaccuuggggguggggacagccccgugcgcuugagaugaggcccugggggcuaccagucgugccccaccccuucagacuccccucgcugccuccucccucccaacgcccagccccacucucuuauuggucggcgacguucguccccgccccgccccacggggauaaaagccuuaguagccaccggcccggcgcgugccgcucuccagaccucuucugcgcagccugguacuugcuacucgcuuuucccucuucgcccuccgguccgccaccauccucuccacgacgugcuguccugcguccgcaaccaugugccgcacccuagccaccuuccccaacaccugccuggagagguaagaggauuuuuuuuuuuuuuuuagcaguccggacgaccaagucccgaauccacuaacccucagccuugggaacgcggggaaacggggacagccgggcagaacuuguugugcuauaaagaccccaaaguguuaagaccuaucagggcauagcccaagugcugccuuuguggccuagaacuugaagacuccaaugagagaagcgcuuagggccuugggaauggucaagugucccagguuucuugggacugaacucuggguggugguguuaguugggaggcccuccuuccccaacuucucggugcuggcaaacaaacagaauccuuacaccuugaugguuuuucuuucagagccaaagaguucaagacgcggcugggaaucuuucuucauaaaucagagcugagcuccgauacuggggguauuagcaaauucgagugggccaguaagcauaacaaagagagguaaguccuauugucuguccagcccuggggcuuuagaggggagaaggccugaaagggaaaauaggagcagacuagcuaggugcccgaaaccucucucuggagauuugagugagacuuuacugcuguccuguggcugcggagccccauuguggaggugguagaguccagguuugccacccccagcagaugcccgcgugcaggacaugcaucccuguuucucugaggauguuguaacacucgaauacagggcuagggcagggucugcaucugucuagagcacucugccuagaagccaccuuuuauggaacgccaggcgugaugcuaggcuuugggguuguaaguaaauagagagacucucucagccuccugcuucauuggagaggugugcaaaccaaaguugagaaucuugggacuagaauccauuuaguuacagaagaaggcgguguuagggauacugacugaggacuaaaggguuccuggcaacgguugcuggaugcccaggugccccuuacauaaccuguuucaugggagcuugagagguuaguuuugacaaccaauaacuucagccuaggaugcuuuuguuuguugauuaaaaaauauucauuuaaaaaucucugcuccccccaucucccccccccccccacagaagcuucucagaagauguacugggauggagagagucuuucgauuugcugcugaacaguaaaaguaaguaggacccuguugucugucugugaaaggcacgugugugcucaugugcuuggagauugucccagcaaggcugaaaaaacacggggccaaauaauaguaguaguaauaauaaccccaguccuccagugugccagccucuguucggaacacaaagacagagccuuguucaggaaaauuacauucuaaaaauagagccauuaacgccaauugcugucuuuucgucuuuucuucgcagcuguccccuagucugaccugucuccuuucuccccuuaccacagaugggguggcugccuuccaugccuuccuaaagacggaauucagugaggagaaccuggaguucugguuggccugcgaggaguucaagaagauccgaucagccaccaaacuggcguccagggcucaccacaucuuugacgaguacauccgcagcgaagccccuaaagaggucagugucccagugccccagcacucggcuccggccuugacuccuccagacccugucuguuccuuuccaacugaaaaccgaggucaaugagggaagaguuagcuuugcagugcaguagucugcacgguuggagaaggguagggagucaguggcuggacacuaaacuuugcaacacaaaguguuauauauagcacagggacggcaagaauuuuuuugggggggagggguucuucucuccauac

SEQ ID NO: 9868 - RNA, 2501 nt, Mus musculus
guauggagagaagaaccccucccccccaaaaaaauucuugccgucccugugcuauauauaacacuuuguguugcaaaguuuaguguccagccacugacucccuacccuucuccaaccgugcagacuacugcacugcaaagcuaacucuucccucauugaccucgguuuucaguuggaaaggaacagacagggucuggaggagucaaggccggagccgagugcuggggcacugggacacugaccucuuuaggggcuucgcugcggauguacucgucaaagauguggugagcccuggacgccaguuugguggcugaucggaucuucuugaacuccucgcaggccaaccagaacuccagguucuccucacugaauuccgucuuuaggaaggcauggaaggcagccaccccaucugugguaaggggagaaaggagacaggucagacuaggggacagcugcgaagaaaagacgaaaagacagcaauuggcguuaauggcucuauuuuuagaauguaauuuuccugaacaaggcucugucuuuguguuccgaacagaggcuggcacacuggaggacugggguuauuauuacuacuacuauuauuuggccccguguuuuuucagccuugcugggacaaucuccaagcacaugagcacacacgugccuuucacagacagacaacaggguccuacuuacuuuuacuguucagcagcaaaucgaaagacucucuccaucccaguacaucuucugagaagcuucugugggggggggggggagauggggggagcagagauuuuuaaaugaauauuuuuuaaucaacaaacaaaagcauccuaggcugaaguuauugguugucaaaacuaaccucucaagcucccaugaaacagguuauguaaggggcaccugggcauccagcaaccguugccaggaacccuuuaguccucagucaguaucccuaacaccgccuucuucuguaacuaaauggauucuagucccaagauucucaacuuugguuugcacaccucuccaaugaagcaggaggcugagagagucucucuauuuacuuacaaccccaaagccuagcaucacgccuggcguuccauaaaagguggcuucuaggcagagugcucuagacagaugcagacccugcccuagcccuguauucgaguguuacaacauccucagagaaacagggaugcauguccugcacgcgggcaucugcuggggguggcaaaccuggacucuaccaccuccacaauggggcuccgcagccacaggacagcaguaaagucucacucaaaucuccagagagagguuucgggcaccuagcuagucugcuccuauuuucccuuucaggccuucuccccucuaaagccccagggcuggacagacaauaggacuuaccucucuuuguuaugcuuacuggcccacucgaauuugcuaauacccccaguaucggagcucagcucugauuuaugaagaaagauucccagccgcgucuugaacucuuuggcucugaaagaaaaaccaucaagguguaaggauucuguuuguuugccagcaccgagaaguuggggaaggagggccucccaacuaacaccaccacccagaguucagucccaagaaaccugggacacuugaccauucccaaggcccuaagcgcuucucucauuggagucuucaaguucuaggccacaaaggcagcacuugggcuaugcccugauaggucuuaacacuuuggggucuuuauagcacaacaaguucugcccggcuguccccguuuccccgcguucccaaggcugaggguuaguggauucgggacuuggucguccggacugcuaaaaaaaaaaaaaaaauccucuuaccucuccaggcagguguuggggaagguggcuagggugcggcacaugguugcggacgcaggacagcacgucguggagaggaugguggcggaccggagggcgaagagggaaaagcgaguagcaaguaccaggcugcgcagaagaggucuggagagcggcacgcgccgggccgguggcuacuaaggcuuuuauccccguggggcggggcggggacgaacgucgccgaccaauaagagaguggggcugggcguugggagggaggaggcagcgaggggagucugaagggguggggcacgacugguagcccccagggccucaucucaagcgcacggggcuguccccacccccaaggucggagacuuggggugccaggagaagaggaaggcuugaagaccagacauacgccgagagagagagagagagagagagagagagagagagagagagagagagagagagagagagagacgccgaccucuaguaaaagcaggaaaacaauucaaaagugacaggagagguuugguaggggguggagaguucacggaggacaggcgcauggggugcauuccaagaaaaaguacaucaccacuauacugcacucucucucaggucagaacagguaccaucccauggucuucgaaggug

SEQ ID NO: 9869 - RNA, 2501 nt, Mus musculus
acuaacaaaguggcuuuaucugaagacucuucugggccaggaauuuuuaaguuccugcaugucgguauuucuguacuguacuacauauaggcuugcuugcuaacagucaguaaacagaaaagagcacacagaaaacucacguucucuuagaugccaggcaagcauacucaaagacauuaaaaaggaggugugugcgugcaugcaggcagcuuuuuucuagcacugugacuuaggaaguugcuuaauuucuucuagaccucauuuaucugucuguaaaucaaacaagcaaaacaaauaucucuuuagggcaaauucgcacucuucacagagcagaucacaggacacggugaacagaccauaugcuucuggaaacuggguugcacuggagccacgcccccucuugccugcucaucucugauuggcuuucucggaggggcggaacaacgggcaggcaauaguuaccccggcagaguuuggucggugggcagggacuccgcagucagcgucauggcugcccgugcuccugagcucgcgcguucccugcuugcugcccuucuggcgcccgcgcugguggcacuacuggugucgccggccucgggucgcggaggccgggaccacggggacugggacguggacaggcgauugccuccgcugccaccccgcgaagacgggccgcgcguggcccgcuucgugacucacgucucagacuggggcucgcuggccacuaucuccacaauaaaggaggugcgcggcuggcccuucgcggacaucaucucaaucagugacgguccuccgggagaaggcacgggcgagcccuacauguaccugaguccacugcagcaagccgugagcgaccugcaggugagcgggagcgcggcgcgguuucccagacccggcagagcaggaaaccagcgucuccaguuuagcucgcuggggagagcgugggucuuagagauaagacuuuugaacccagcucacaugacugucucuucuggccugcgcuggcuaggcggagguuguagcaucccagauguuggggaacuaccaggaaguuccuacuuacccuguuacuggucuaagcgcuugggguaaauucuuugccaguaccuggagcacuucacacccuucagauagucaggcguccucuuuaggcgcugucucugcauaaacugcacucuugugaucuaaaggcauacagauuguuggauaguuuagcguuuggcuuaugugacuucggagauucucuucccuaccuuuaccuaucagcagugggaaacuacuacacagcauuauaguugacugcggaccuggcucugcuuacagcucagguggaaacagccugggagggaaaggccacacaggagcccagaaaugaagccugacucgguggagggucuguggcaaaacugagaaagcuuggugucgugguaaacagugagccaagagacgccgacgcuuuaaccaagcccuugccaugguaugugccuagggcuuuucgguuccaccuguuuucauucauugucucuuguaguaacucuuagaaacaggcauggcuauuccggguuuacagaugaagacaugagguuaaguaauuugcgcaaagccagggggccaacccuaguucaccucagacccacuugucuucaaagcacaggccacaggacugggacccaugugcuagaauagaagagacccguuuucuucagccuccacagaguucuguauuguucuaaacaaauuuaaauuagcuacugccuuuuaaaacugcaauccuaggggcuagggaaauagcccaguugguaaaauacuugccauguaggcgcgaggaccuguauuugguccucaguacccaucuugacagcuugcacgcacaugugauccuacacuggcucaacggcuugcacacacuugcacacacgugugaucuugcacuggccagguggcuagcucccuggccugccagccaagcggagucagugagcuucagaccgcagggagagagagccuggcucaaaaagccaguuggauggcuccagcuucugaggagugaccuccaaaacugaccucuggccacaccauacacucauuaauacccaaugcaccuguggugcaccugcacucugcacgcgugcgcacacacacgcaggauaaaauuuuagagaacaaagucuauugauuugcucuuuaaguuucuaacucuucuugaaaagguuaaagaccuagcagcacugggaguggggguggggcuauauuuuucugagagacaaaaguaauagaagccgcugucccucccagccagauauauugaccccaacucgccccuuuuuuuaaccagcccguuucacuucucuagaaucugcuauucacccguucucucuaccccagagguggcacucaagugaccugcguagcacuugcagagaaguuuuaaaaugcacuaccaagccacuuuauucuagaacaaugcccccuacucccucaaacccucacuggugauccua

SEQ ID NO: 9870 - RNA, 2501 nt, Mus musculus
uaggaucaccagugaggguuugagggaguagggggcauuguucuagaauaaaguggcuugguagugcauuuuaaaacuucucugcaagugcuacgcaggucacuugagugccaccucugggguagagagaacgggugaauagcagauucuagagaagugaaacgggcugguuaaaaaaaggggcgaguuggggucaauauaucuggcugggagggacagcggcuucuauuacuuuugucucucagaaaaauauagccccacccccacucccagugcugcuaggucuuuaaccuuuucaagaagaguuagaaacuuaaagagcaaaucaauagacuuuguucucuaaaauuuuauccugcgugugugugcgcacgcgugcagagugcaggugcaccacaggugcauuggguauuaaugaguguaugguguggccagaggucaguuuuggaggucacuccucagaagcuggagccauccaacuggcuuuuugagccaggcucucucucccugcggucugaagcucacugacuccgcuuggcuggcaggccagggagcuagccaccuggccagugcaagaucacacgugugugcaagugugugcaagccguugagccaguguaggaucacaugugcgugcaagcugucaagauggguacugaggaccaaauacagguccucgcgccuacauggcaaguauuuuaccaacugggcuauuucccuagccccuaggauugcaguuuuaaaaggcaguagcuaauuuaaauuuguuuagaacaauacagaacucuguggaggcugaagaaaacgggucucuucuauucuagcacaugggucccaguccuguggccugugcuuugaagacaagugggucugaggugaacuaggguuggcccccuggcuuugcgcaaauuacuuaaccucaugucuucaucuguaaacccggaauagccaugccuguuucuaagaguuacuacaagagacaaugaaugaaaacagguggaaccgaaaagcccuaggcacauaccauggcaagggcuugguuaaagcgucggcgucucuuggcucacuguuuaccacgacaccaagcuuucucaguuuugccacagacccuccaccgagucaggcuucauuucugggcuccuguguggccuuucccucccaggcuguuuccaccugagcuguaagcagagccagguccgcagucaacuauaaugcuguguaguaguuucccacugcugauagguaaagguagggaagagaaucuccgaagucacauaagccaaacgcuaaacuauccaacaaucuguaugccuuuagaucacaagagugcaguuuaugcagagacagcgccuaaagaggacgccugacuaucugaagggugugaagugcuccagguacuggcaaagaauuuaccccaagcgcuuagaccaguaacaggguaaguaggaacuuccugguaguuccccaacaucugggaugcuacaaccuccgccuagccagcgcaggccagaagagacagucaugugagcuggguucaaaagucuuaucucuaagacccacgcucuccccagcgagcuaaacuggagacgcugguuuccugcucugccgggucugggaaaccgcgccgcgcucccgcucaccugcaggucgcucacggcuugcugcaguggacucagguacauguagggcucgcccgugccuucucccggaggaccgucacugauugagaugauguccgcgaagggccagccgcgcaccuccuuuauuguggagauaguggccagcgagccccagucugagacgugagucacgaagcgggccacgcgcggcccgucuucgcgggguggcagcggaggcaaucgccuguccacgucccaguccccguggucccggccuccgcgacccgaggccggcgacaccaguagugccaccagcgcgggcgccagaagggcagcaagcagggaacgcgcgagcucaggagcacgggcagccaugacgcugacugcggagucccugcccaccgaccaaacucugccgggguaacuauugccugcccguuguuccgccccuccgagaaagccaaucagagaugagcaggcaagagggggcguggcuccagugcaacccaguuuccagaagcauauggucuguucaccguguccugugaucugcucugugaagagugcgaauuugcccuaaagagauauuuguuuugcuuguuugauuuacagacagauaaaugaggucuagaagaaauuaagcaacuuccuaagucacagugcuagaaaaaagcugccugcaugcacgcacacaccuccuuuuuaaugucuuugaguaugcuugccuggcaucuaagagaacgugaguuuucugugugcucuuuucuguuuacugacuguuagcaagcaagccuauauguaguacaguacagaaauaccgacaugcaggaacuuaaaaauuccuggcccagaagagucuucagauaaagccacuuuguuagu

SEQ ID NO: 9871 - RNA, 2501 nt, Mus musculus
uuugcacaccugggaagcaagucaguuggagagcccagguguugauugacaucugguucucuccaggguuuagaagcagugauggacaagacuacaggugcacauuccagacacugggagcaggcauccagcagagaacgugagaccuccgcgucgucuccaggacccaccuuccaucccaugcugggauugaauuuagggcuucacgugugcagggccggugcugcucuaccacugagcuauuaccaccccuguccugaauguccuaauuggucagacacccuuaagucaauggugaaguauauggcuaacagacagcggugaccagauguucucaguccagacaggcuuuuguguccuuucuagacagccccuccucaggacucaggggcuuguuucaugcugagcucccaggaggucccaggggugugaccucucuucuuccucccugccccccaccccaggaccagcuauaaagcuguuccguaccguaccauuccuccgcagacucaagacccuuucaggacaccucagggacacacacauccaaggcuccucuucccggacagcaccaugccauuccuguggcucugcugggcacucugggcacugucgcugguuagccucagggaagcccugaccggagagcagauccugggcagccugcugcaacagcugcagcucgaucaaccgccaguccuggacaaggcugauguggaagggauggucauccccucgcacgugaggacucaguauguggcccugcuacaacacagccaugccagccgcucccgaggcaagagguucagccagaaccuucgaggugagcccuccccuguuguccuuggucucuaggaaaggccggcugaucaugccuuccuuccaccugugguguguauggacccuugccuuguggugcucagagucagucauggggguggggggcacagggugaggcggauguuagaggggagaagaucugggagggugggcacuggggaucuggcugugcacugaaggagucucaggaugggaaaagcggggcugugcuugcugguaaauuaaggagcagagaagagggaggagaguggaagaaaacagaaccccuggagcagucagggccagguagaacuuccuggggucacugccuggacgaguggcugacuaugucuugccauggacagagaacaguggcuggguagaggcagcccugggugacagaauuugggagagagagagagagagagagagagagagagagauugagagagagaacagguauccagcugucaaguagcaaaggccuguguggugguguagcauuuuccagcuggaagcagcccucaugggcacagccacauccauaaacuuacuguccugugguaccuaggccuggagauagaaggaugcugguucugaacaggcaggcaagggagaugucugcugaggauagguguggcuggccucucagguaaccaaccacucugcuaucccagagagugagcacacuggcuggagccauuuaggaaggugacaacucccugaacacuugccccaggguucagcaguccugacaaggauauucacagacuccuguuccacugaacggaaccccucacaaaugcaucugucucuuaagaaaggcaccucgggcugggcuucuuuucucuagucucugcagccugauucuguauuccucccccaauccucuccuaaaaccuuccagaaagaagccagcauugccacgcucuggaaccccuccagcuccuuucuugcacaggguuccaaagucaccacuaagugugcaagaguuagcauucagggccucauugcaaacuuuauaauuccugaguagaaagaaagacuucuuuuucauguuguucaugggcuuccugcuuacaacucucccugaggauuuuuaaggaaucuuggccauuggucuugggucuugccacccuggaaguuaucugguacuuguagaggcccggcugacucuguccuuguccacagagguggcaggcagguuccuggugucagagaccuccacucaccugcuaguguucggaauggagcagcggcugccgccuaacagcgagcuggugcaggcugugcugcggcuguuccaggagccugugcccagaacagcucuccggaggcaaaagaggcuguccccacacagugcccgggcucgggucaccauugaauggcugcgcuuccgcgacgacggcuccaaccgcacugcccuuaucgauucuagguauagucucucucucucucucucucucucucucucucucucucucucucucucucucucucucucucgagaguugggaagugagggacucgcccaugcagggggaggggagcagcagaugauagggguguguaccagacgggacagacuccuccuccagggccucccuaacagccugccaguccccucgccugacgcgcacugcugugucucaggcucguguccauccacgagagcggcugga

SEQ ID NO: 9872 - RNA, 2501 nt, Mus musculus
uccagccgcucucguggauggacacgagccugagacacagcagugcgcgucaggcgaggggacuggcaggcuguuagggaggcccuggaggaggagucugucccgucugguacacaccccuaucaucugcugcuccccucccccugcaugggcgagucccucacuucccaacucucgagagagagagagagagagagagagagagagagagagagagagagagagagagagagagagacuauaccuagaaucgauaagggcagugcgguuggagccgucgucgcggaagcgcagccauucaauggugacccgagcccgggcacuguguggggacagccucuuuugccuccggagagcuguucugggcacaggcuccuggaacagccgcagcacagccugcaccagcucgcuguuaggcggcagccgcugcuccauuccgaacacuagcaggugaguggaggucucugacaccaggaaccugccugccaccucuguggacaaggacagagucagccgggccucuacaaguaccagauaacuuccaggguggcaagacccaagaccaauggccaagauuccuuaaaaauccucagggagaguuguaagcaggaagcccaugaacaacaugaaaaagaagucuuucuuucuacucaggaauuauaaaguuugcaaugaggcccugaaugcuaacucuugcacacuuaguggugacuuuggaacccugugcaagaaaggagcuggagggguuccagagcguggcaaugcuggcuucuuucuggaagguuuuaggagaggauugggggaggaauacagaaucaggcugcagagacuagagaaaagaagcccagcccgaggugccuuucuuaagagacagaugcauuugugagggguuccguucaguggaacaggagucugugaauauccuugucaggacugcugaacccuggggcaaguguucagggaguugucaccuuccuaaauggcuccagccagugugcucacucucugggauagcagagugguugguuaccugagaggccagccacaccuauccucagcagacaucucccuugccugccuguucagaaccagcauccuucuaucuccaggccuagguaccacaggacaguaaguuuauggauguggcugugcccaugagggcugcuuccagcuggaaaaugcuacaccaccacacaggccuuugcuacuugacagcuggauaccuguucucucucucaaucucucucucucucucucucucucucucucucucccaaauucugucacccagggcugccucuacccagccacuguucucuguccauggcaagacauagucagccacucguccaggcagugaccccaggaaguucuaccuggcccugacugcuccagggguucuguuuucuuccacucuccucccucuucucugcuccuuaauuuaccagcaagcacagccccgcuuuucccauccugagacuccuucagugcacagccagauccccagugcccacccucccagaucuucuccccucuaacauccgccucacccugugccccccacccccaugacugacucugagcaccacaaggcaaggguccauacacaccacagguggaaggaaggcaugaucagccggccuuuccuagagaccaaggacaacaggggagggcucaccucgaagguucuggcugaaccucuugccucgggagcggcuggcauggcuguguuguagcagggccacauacugaguccucacgugcgaggggaugaccaucccuuccacaucagccuuguccaggacuggcgguugaucgagcugcagcuguugcagcaggcugcccaggaucugcucuccggucagggcuucccugaggcuaaccagcgacagugcccagagugcccagcagagccacaggaauggcauggugcuguccgggaagaggagccuuggaugugugugucccugagguguccugaaagggucuugagucugcggaggaaugguacgguacggaacagcuuuauagcugguccugggguggggggcagggaggaagaagagaggucacaccccugggaccuccugggagcucagcaugaaacaagccccugaguccugaggaggggcugucuagaaaggacacaaaagccugucuggacugagaacaucuggucaccgcugucuguuagccauauacuucaccauugacuuaagggugucugaccaauuaggacauucaggacaggggugguaauagcucagugguagagcagcaccggcccugcacacgugaagcccuaaauucaaucccagcaugggauggaagguggguccuggagacgacgcggaggucucacguucucugcuggaugccugcucccagugucuggaaugugcaccuguagucuuguccaucacugcuucuaaacccuggagagaaccagaugucaaucaacaccugggcucuccaacugacuugcuucccaggugugcaaa

SEQ ID NO: 9873 - RNA, 2501 nt, Mus musculus
uuuguaacuuucaaggucccggcucucuuaugcggcgggacugggaacaggguagguccacugcgcccugguguucccccgcccugaaauccaacugggccagcuuagaauuuccuggggacauucaaucacgaacauuugcagaugcucuccaacgccgcaacuauccuaggcacggcccagugcccucucaguggggaugugcuagggcacaaaggaaaggcaguucggagacguccucucccagccuugugggcguuagcuggucuggucccgccccuagaccuccgugaggacggccacgcguggaccagcguuagagaaccacauugggguucacugcccggcgcacagagcucgagguccugcuggggccggcgcgagcgaagaguccaaauuagguaacgcguggacacaguucugcgcaugugcaagaggagccggaguuucacuuuguaacuuuuaaguggugcggacgccaccccgccucgccagguacggacugaccacucccccgggcgcgcgcgccgcgccgccgccgcagguaaagugggaaggggagcagagauggggagguugcggccagccccucccaggacgcgccggcccggguccucgcggggcggggcgccucgggucgcuuuccccggggacugucuggugacaguagcgggguagguggcuggagagugccaaucaagccccgcgccgcugggacuuccugacagcucuuggcugcguggcggauccuucccuccaccuccucggcgggcuuuggaguuuguuuguggagucggaucuccccgccuaacccgaagggcagcgucggagcccucuuuucuuuaauuccuuacgaggcuagacccggcuugggcgggcuucguacuguccgggugaccacucccuccugcccggguagcaccggguggaggaaaacuggggacuugggaaagggcgggagggggagggaagagcugagacggcaaagaaaccacauccgacaacaacuuacccagaccugauaagccuggcuaccugacaccucgggugagguggaguugcugucuuucugucccaaacaggagccaacagcuuguagggacuuuugcaaaaggccugggaacauauuuucucuccugaagcuuuggcugggucccagagccugcccuguugagaguuuggggugccaaugauaugguggagugcugagcguuugcguguacgaauauucacuggaugugggaugguggcuauugcuaaguguguaccuaggcagggauccugagaccacagugucuaauugcuguuuuuaaggcccccucgcuccucguagugaugcgguuggaauacagccuuuugccuugcacauucuaggcgugcacuuggcuuugagcagcauuuccaucccuuagggacuuguuugauuucuucccuacacacacccagagccuucucucucuggcuuggcugccccuuggugggugugcucccaucugcccucucagagcguguuccuuugggaaggcaagaacggacuggcucauugaaagccuagagaauguuucuguagcagccucugacucugcugcugcugggugggcacagguugcuccgacuggaggagagggucucggacuguggcuucugaucccucucacuugucaagccuuucuuguuugcucugcgguauuugauuucccugauucuagcccacaggggauauugaggcagagaagcagcccuuaugucugcaugaggcagaauaggcuaccugguugaggaggcccuuaggccuucuguuuugcuuuugaggcagggucuuacuauguagccacggauggccuagaacucacagagauccaccugccucugccuccugaauguugggguaaauggguggguaccacaacacucucccuuccuuaguucuuaccaaacuuuguagauucucuugggaaaccuguuuggcaagagaaaaaugacuuaggaguguggcuuggccacuaggggaaggcagccacaguuacccuccuggggucaaggcuucucuguuccuccaggccucugaaagagcaacauuggugagucaccuuuccuacccacccagcacuacccguaccccccuuccuugggacagcacucccucugugagcauuuaugaggauauuuuuccuuuucuuuuccaagccuucuuucuuugcucuaggguggcccauuucccccaguucuagcuuuaggggaucuuugggugcugcagcagcccucuggauguucauaggaaaccuuggcuugguaugccaccucaagcccagagccacugugcuucugagggagagaggcccuccugaccuuggcaggaccuggguuccauuggacaagagacgagccauccugcugggugaagagaaaggaacaggguggcgcagacgaacccggggagguggcggagagcuuguucuaggaguuuagaugcaaagccagguagcaagaaacucaguggg

SEQ ID NO: 9874 - RNA, 2501 nt, Mus musculus
cccacugaguuucuugcuaccuggcuuugcaucuaaacuccuagaacaagcucuccgccaccuccccggguucgucugcgccacccuguuccuuucucuucacccagcaggauggcucgucucuuguccaauggaacccagguccugccaaggucaggagggccucucucccucagaagcacaguggcucugggcuugagguggcauaccaagccaagguuuccuaugaacauccagagggcugcugcagcacccaaagauccccuaaagcuagaacugggggaaaugggccacccuagagcaaagaaagaaggcuuggaaaagaaaaggaaaaauauccucauaaaugcucacagagggagugcugucccaaggaagggggguacggguagugcuggguggguaggaaaggugacucaccaauguugcucuuucagaggccuggaggaacagagaagccuugaccccaggaggguaacuguggcugccuuccccuaguggccaagccacacuccuaagucauuuuucucuugccaaacagguuucccaagagaaucuacaaaguuugguaagaacuaaggaagggagaguguugugguacccacccauuuaccccaacauucaggaggcagaggcagguggaucucugugaguucuaggccauccguggcuacauaguaagacccugccucaaaagcaaaacagaaggccuaagggccuccucaaccagguagccuauucugccucaugcagacauaagggcugcuucucugccucaauauccccugugggcuagaaucagggaaaucaaauaccgcagagcaaacaagaaaggcuugacaagugagagggaucagaagccacaguccgagacccucuccuccagucggagcaaccugugcccacccagcagcagcagagucagaggcugcuacagaaacauucucuaggcuuucaaugagccaguccguucuugccuucccaaaggaacacgcucugagagggcagaugggagcacacccaccaaggggcagccaagccagagagagaaggcucuggguguguguagggaagaaaucaaacaagucccuaagggauggaaaugcugcucaaagccaagugcacgccuagaaugugcaaggcaaaaggcuguauuccaaccgcaucacuacgaggagcgagggggccuuaaaaacagcaauuagacacuguggucucaggaucccugccuagguacacacuuagcaauagccaccaucccacauccagugaauauucguacacgcaaacgcucagcacuccaccauaucauuggcaccccaaacucucaacagggcaggcucugggacccagccaaagcuucaggagagaaaauauguucccaggccuuuugcaaaagucccuacaagcuguuggcuccuguuugggacagaaagacagcaacuccaccucacccgaggugucagguagccaggcuuaucaggucuggguaaguuguugucggaugugguuucuuugccgucucagcucuucccucccccucccgcccuuucccaaguccccaguuuuccuccacccggugcuacccgggcaggagggaguggucacccggacaguacgaagcccgcccaagccgggucuagccucguaaggaauuaaagaaaagagggcuccgacgcugcccuucggguuaggcggggagauccgacuccacaaacaaacuccaaagcccgccgaggagguggagggaaggauccgccacgcagccaagagcugucaggaagucccagcggcgcggggcuugauuggcacucuccagccaccuaccccgcuacugucaccagacaguccccggggaaagcgacccgaggcgccccgccccgcgaggacccgggccggcgcguccugggaggggcuggccgcaaccuccccaucucugcuccccuucccacuuuaccugcggcggcggcgcggcgcgcgcgcccgggggaguggucaguccguaccuggcgaggcgggguggcguccgcaccacuuaaaaguuacaaagugaaacuccggcuccucuugcacaugcgcagaacuguguccacgcguuaccuaauuuggacucuucgcucgcgccggccccagcaggaccucgagcucugugcgccgggcagugaaccccaaugugguucucuaacgcugguccacgcguggccguccucacggaggucuaggggcgggaccagaccagcuaacgcccacaaggcugggagaggacgucuccgaacugccuuuccuuugugcccuagcacauccccacugagagggcacugggccgugccuaggauaguugcggcguuggagagcaucugcaaauguucgugauugaauguccccaggaaauucuaagcuggcccaguuggauuucagggcgggggaacaccagggcgcaguggaccuacccuguucccagucccgccgcauaagagagccgggaccuugaaaguuacaaa

SEQ ID NO: 9875 - RNA, 2501 nt, Mus musculus
guuucucucauaggacuuaggaggcuccuaccccaacuuuccacacuaccgcuggccuuugcggcacuggcugaauuuuucuaccuggaaaugugucuuggaauugaugcugaacagaauuucuuggguuggagcuuaaggggcugaggauggcagacgccucgcuaaugggaucuagagaugcgaagaacugucccgcugaaggcugcaggccagcuagaugcaccccugcaggccgcccaccgguuagcagcgaugugagaucuggguagggggaaagaagagucggucacaaacucauacugugggcagauuuguuccuccuuucccuucucccccuuugaaccuacuaaacucaaaauggacccuuucuccaacagcuacggaagaguggggccugaauugccccagagugugugucaggcauggccgguacaccccauaauaaggaaaggcuugucauaaaauguugcuaaaguggucauuucggacgccuuccagaaauucuacaaaccccuaauuuacacccuucagcccccccccccccccgccuuccuucaggagcuuagacuggccgguuugcuuccccgcaauucuuaagaaauacuggaaaucaaauaaaugcaaaguguccccacgcugagauuuccuugucagaaagaucuaggucguucugcagauauuucauucaaaagauggauaauacacacuuuugcaaaacuuugcagcaaccagaguauggucauccguuucuaugcuguuuaagcaacacgaagauauguuuuuaaacaugggauagcugacuuuuacaugucacuaaguuuuccuucauuucguuuucuucgcccucauucuaccguucuguccuuaaaaauaaacgcaccccaaauccuccugacaucaggccccucaugggugguggugaggccugaggccuuccagcgauacguaccucucagaguguugccuuccuuaacuuuugggucaaauuccgcagacaaaauucgaucgauaccaaauuugaggucuuugcuggagggggcaggggcggagccgcuauggugggggaccacccgcguccccgaagucgguggcugcagggagaccgcccgggguggaggcgggggcugcugcugcgguugcuguugcugcguuggugauugcugcgggagaugcugguggaaggcggcagagagcggagacagccgcugagggaagccagccgggacuucugagggcgccaccaccggggugggacggagcggggaucuggcggcagcuuggaaggaggcgugcgggugcacggagcccaagugugcggugagggcugccgaggcccccaccagucccucugcagcgggccccggcuccccgacgccggcgugcaggauguccgcgaugcagaaagaggguuucuugacagcggcuggguccagggcgaaggagcagccgcccgggcccgccgaggagcaguaggcggcugaccagagacuaaaguuggaagcauagaagggagccaggccggcugcgaacauccuggcaggaucccggcgggguccugggugaguggggaagugggugggcgcucgggcagaggcggugucccagccgagcccgagcugcuuucgguucuucgcccgcccugaagcggagggccaaccggggagcccuagcgccaccgagggacgaggcgagggcccgaucgccgcccgccacggccugggccccuggcuuggcuugaaaggcggcgcggcgggcgcgcuccccgccggguggauggaggcgaucgccaggcgcuggggcgacaaggcgagcgcggccucgcucugcuacuccgcagaagccggggagacagggacccgacaccgaaagaaaaacccaaacagcuaagcccuaagagcuaaauuuaaaacaacaauaaugauccguuaguuuaaaaaaaaaaaaaaaaaaaaaaaaggaaaaaaauuaaaaaaaaaaaaaaaacuccucucuaaaaacucccaaaguuuuggcaggagcuuucgagucagaccccggguaggaccuugauccgugcgcucauuggacgucuucgugaccaaugggacuccggaguggaggggaauugggaaagaggggggcguggccgagcucggccacgcccuggccacgccaaaguguuuucugcggcagcgugggcuaagcugaguacugagcgucucugggagccgcuugggggucgagacuccucgggccucuggcucuccucuguccccugcagcucggggacccgccagcggcagagccucggagccggucuccggaauuuuccuggagcugcggaggagggggaucacugaggcucccguacucugcuguaguacacccccaaccuccaccccagcagaccacgcuggcgguccgcaggcugucccuuccguauuccgcucucaugcgacuuuccuucucucugcuuuuacccaggugcuuuuaucacaaguccuagguaaaggccccau

SEQ ID NO: 9876 - RNA, 2501 nt, Mus musculus
auggggccuuuaccuaggacuugugauaaaagcaccuggguaaaagcagagagaaggaaagucgcaugagagcggaauacggaagggacagccugcggaccgccagcguggucugcugggguggagguuggggguguacuacagcagaguacgggagccucagugaucccccuccuccgcagcuccaggaaaauuccggagaccggcuccgaggcucugccgcuggcggguccccgagcugcaggggacagaggagagccagaggcccgaggagucucgacccccaagcggcucccagagacgcucaguacucagcuuagcccacgcugccgcagaaaacacuuuggcguggccagggcguggccgagcucggccacgccccccucuuucccaauuccccuccacuccggagucccauuggucacgaagacguccaaugagcgcacggaucaagguccuacccggggucugacucgaaagcuccugccaaaacuuugggaguuuuuagagaggaguuuuuuuuuuuuuuuuaauuuuuuuccuuuuuuuuuuuuuuuuuuuuuuuuaaacuaacggaucauuauuguuguuuuaaauuuagcucuuagggcuuagcuguuuggguuuuucuuucggugucgggucccugucuccccggcuucugcggaguagcagagcgaggccgcgcucgccuugucgccccagcgccuggcgaucgccuccauccacccggcggggagcgcgcccgccgcgccgccuuucaagccaagccaggggcccaggccguggcgggcggcgaucgggcccucgccucgucccucgguggcgcuagggcuccccgguuggcccuccgcuucagggcgggcgaagaaccgaaagcagcucgggcucggcugggacaccgccucugcccgagcgcccacccacuuccccacucacccaggaccccgccgggauccugccaggauguucgcagccggccuggcucccuucuaugcuuccaacuuuagucucuggucagccgccuacugcuccucggcgggcccgggcggcugcuccuucgcccuggacccagccgcugucaagaaacccucuuucugcaucgcggacauccugcacgccggcgucggggagccggggcccgcugcagagggacuggugggggccucggcagcccucaccgcacacuugggcuccgugcacccgcacgccuccuuccaagcugccgccagauccccgcuccgucccaccccggugguggcgcccucagaagucccggcuggcuucccucagcggcugucuccgcucucugccgccuuccaccagcaucucccgcagcaaucaccaacgcagcaacagcaaccgcagcagcagcccccgccuccaccccgggcggucucccugcagccaccgacuucggggacgcggguggucccccaccauagcggcuccgccccugcccccuccagcaaagaccucaaauuugguaucgaucgaauuuugucugcggaauuugacccaaaaguuaaggaaggcaacacucugagagguacguaucgcuggaaggccucaggccucaccaccacccaugaggggccugaugucaggaggauuuggggugcguuuauuuuuaaggacagaacgguagaaugagggcgaagaaaacgaaaugaaggaaaacuuagugacauguaaaagucagcuaucccauguuuaaaaacauaucuucguguugcuuaaacagcauagaaacggaugaccauacucugguugcugcaaaguuuugcaaaaguguguauuauccaucuuuugaaugaaauaucugcagaacgaccuagaucuuucugacaaggaaaucucagcguggggacacuuugcauuuauuugauuuccaguauuucuuaagaauugcggggaagcaaaccggccagucuaagcuccugaaggaaggcgggggggggggggggcugaaggguguaaauuagggguuuguagaauuucuggaaggcguccgaaaugaccacuuuagcaacauuuuaugacaagccuuuccuuauuaugggguguaccggccaugccugacacacacucuggggcaauucaggccccacucuuccguagcuguuggagaaaggguccauuuugaguuuaguagguucaaagggggagaagggaaaggaggaacaaaucugcccacaguaugaguuugugaccgacucuucuuucccccuacccagaucucacaucgcugcuaaccggugggcggccugcaggggugcaucuagcuggccugcagccuucagcgggacaguucuucgcaucucuagaucccauuagcgaggcgucugccauccucagccccuuaagcuccaacccaagaaauucuguucagcaucaauuccaagacacauuuccagguagaaaaauucagccagugccgcaaaggccagcgguaguguggaaaguugggguaggagccuccuaaguccuaugagagaaac

SEQ ID NO: 9877 - RNA, 2501 nt, Mus musculus
ccaggugcacauggucaagugcaguuuguuggagucaguuuuggaagguucuggggauugaacucaggugauucgguuuggccgugagcagccuuacccacagagccagaucuugggcucugauuuucuugccuccucucccaaaguucugggauugcagguguguaccacuauuccuuguuuauauaccucaagaguuccaaccaggacuucaggcaugcuaggccagcacccaaccacugagccccagcccagccuucuauuucauuuguuuguuuguuuauagacaggguuucuguguguagcccuggcugucccggaacuugcugucagagaugaucagacugcuuaugccuccccagugaugggauuuaaggugugcgccaccacugaccgacugacuuagucuuagaauagccauccuaacgagcggagucuaguaccucaguuucagccaggaugagcucuuguuaauaggaucuugucauacagcccaggcuggccuuguauuaucaaccauccugucccuuccuccagaguaucugggauuacagcuguggguuuccuagcuuuuacuucauauugaagccuuggcuucuuuccugcccaguguccaugucagggcgauuugaaagcgucgcugucuuaauuugccucgcccagauaaguaaucgcuaauacacugcuaagaagugagggaccagggugccccagcucugccaccucucccuggggguggggguggcuaucuccccucccacuauuuguaccucuaguguaugcacaaugccuggcacagaguggucacccccaaaacaucucuaaaugccagcuaccaacuaagaaaccuguguccucuauucacuuucagauggcuuccuuacucccaaaagcccuacuucacuucaacaacgcauguuaucauugccugcuugugaggaagcuccggucauaucauucagaaugauaaacuaaacuccuggcaagggaccgaaugucucggguaugaugaaggucacccacugaagacuaccuggacaauaauuccgagaguucagaggacuuuggucagaacaaacacaagcaaugaguuuugugauuccccuccacuccaacucccucccuagcccugucuaggucagagcaccuagaaaccauaaucaugugcccugaaaacgaaacucauucgguuccccauccauccuuccuuuggcucucccaccaaaguaaaaaggcaggccgaagaacaucugaagucccggggugcagagauuguugaucagagaagggggagggguaacagguucuagguauguacuggcugaguuagcaggccccgcgcggguuaaccccggggucuaggacugaaucaccuaauauucuccuguggcggggugccccagagagagugcgggaaauagguggaccuagacugcaacuucgcagcuggguccggggcucaagucaacuaaccucaccauggcuucagcauuaccaucagcuccaacugggagcaaggguccugcccgcgcgcucagcuacacacccuccuagugauggucccggaggccagcggggaugcgggcacaacuccacccagcgcgacucccgguucugucuggaucagggcggccgggccguggggaccuaccuugccguacuucuucaguuuucgccgguaccucuucuugggcuugucgccuggcgcgggcuccuccagggagucguagcgcucaggcagcgcagccaggugcacccugcgugcgcucggaguccccgcgcgccgcccgcccucuucgcgcucacaguccgggcucgccggguccucguccucgcccuccaggugcuccacgauggcaucugucuccucgucaccggcgcggcgcgaucgccccaggggccuucggcccacuaagcugcucgccgccuugcuucggagccgggcgcccaccgucaugaugccgccgagcucuggagaagggcccaggcuaugaggcaaccuuugcuccacgcuccgcccggcuccugccccugcggaccgccccggcccugugcgcuccgggaaccagaggucgcagcacacccaugcggugggguccaggauuacgggggcagacguaaaaggcuuuccggagaacccugcagcagaaaccauugcucaggguaggcaaguucagcuguacugggaacagacuccaaacaacagaccuacuacgggugcgggcauuuaaaacuagcagggugugguggcacacaccuuuaaucccugcguuuaaucccaggcugaggcugguggaucucugaguucaaggcucacuuugguucacagagcaaguuccaggauagccaaggcuacaaaauaacaaacaaacaaaugguagagaugguauuggugaagauuccucagugcugguguggacauguugacagggucaugaaaauauuauauucagaccuggggauguagcucaguugggagaaugcuaccuaggcaugcccga

SEQ ID NO: 9878 - RNA, 2501 nt, Mus musculus
ucgggcaugccuagguagcauucucccaacugagcuacauccccaggucugaauauaauauuuucaugacccugucaacauguccacaccagcacugaggaaucuucaccaauaccaucucuaccauuuguuuguuuguuauuuuguagccuuggcuauccuggaacuugcucugugaaccaaagugagccuugaacucagagauccaccagccucagccugggauuaaacgcagggauuaaaggugugugccaccacacccugcuaguuuuaaaugcccgcacccguaguaggucuguuguuuggagucuguucccaguacagcugaacuugccuacccugagcaaugguuucugcugcaggguucuccggaaagccuuuuacgucugcccccguaauccuggaccccaccgcaugggugugcugcgaccucugguucccggagcgcacagggccggggcgguccgcaggggcaggagccgggcggagcguggagcaaagguugccucauagccugggcccuucuccagagcucggcggcaucaugacggugggcgcccggcuccgaagcaaggcggcgagcagcuuagugggccgaaggccccuggggcgaucgcgccgcgccggugacgaggagacagaugccaucguggagcaccuggagggcgaggacgaggacccggcgagcccggacugugagcgcgaagagggcgggcggcgcgcggggacuccgagcgcacgcagggugcaccuggcugcgcugccugagcgcuacgacucccuggaggagcccgcgccaggcgacaagcccaagaagagguaccggcgaaaacugaagaaguacggcaagguagguccccacggcccggccgcccugauccagacagaaccgggagucgcgcuggguggaguugugcccgcauccccgcuggccuccgggaccaucacuaggaggguguguagcugagcgcgcgggcaggacccuugcucccaguuggagcugaugguaaugcugaagccauggugagguuaguugacuugagccccggacccagcugcgaaguugcagucuagguccaccuauuucccgcacucucucuggggcaccccgccacaggagaauauuaggugauucaguccuagaccccgggguuaacccgcgcggggccugcuaacucagccaguacauaccuagaaccuguuaccccucccccuucucugaucaacaaucucugcaccccgggacuucagauguucuucggccugccuuuuuacuuuggugggagagccaaaggaaggauggauggggaaccgaaugaguuucguuuucagggcacaugauuaugguuucuaggugcucugaccuagacagggcuagggagggaguuggaguggaggggaaucacaaaacucauugcuuguguuuguucugaccaaaguccucugaacucucggaauuauuguccagguagucuucagugggugaccuucaucauacccgagacauucggucccuugccaggaguuuaguuuaucauucugaaugauaugaccggagcuuccucacaagcaggcaaugauaacaugcguuguugaagugaaguagggcuuuugggaguaaggaagccaucugaaagugaauagaggacacagguuucuuaguugguagcuggcauuuagagauguuuugggggugaccacucugugccaggcauugugcauacacuagagguacaaauagugggaggggagauagccacccccacccccagggagagguggcagagcuggggcacccuggucccucacuucuuagcaguguauuagcgauuacuuaucugggcgaggcaaauuaagacagcgacgcuuucaaaucgcccugacauggacacugggcaggaaagaagccaaggcuucaauaugaaguaaaagcuaggaaacccacagcuguaaucccagauacucuggaggaagggacaggaugguugauaauacaaggccagccugggcuguaugacaagauccuauuaacaagagcucauccuggcugaaacugagguacuagacuccgcucguuaggauggcuauucuaagacuaagucagucggucagugguggcgcacaccuuaaaucccaucacuggggaggcauaagcagucugaucaucucugacagcaaguuccgggacagccagggcuacacacagaaacccugucuauaaacaaacaaacaaaugaaauagaaggcugggcuggggcucagugguugggugcuggccuagcaugccugaaguccugguuggaacucuugagguauauaaacaaggaauagugguacacaccugcaaucccagaacuuugggagaggaggcaagaaaaucagagcccaagaucuggcucuguggguaaggcugcucacggccaaaccgaaucaccugaguucaauccccagaaccuuccaaaacugacuccaacaaacugcacuugaccaugugcaccugg

SEQ ID NO: 9879 - RNA, 2501 nt, Mus musculus
ggacagaauaaacucccugccuagcaaaguaauaaaacacgaugaagcaggaagcagagaacauccuccacuuccccaaggacacacacagccuucuggccugcaggcuugcaugcucagcugucgccagccaggaccgggacugacugcugccaugucucugggauaugugauuccugcaccucucaggaguccugcucagcaaacgggaucccugggguccagggaagccaccuccauggccacacuccagguuuucauuuuauauaacacgacacucccaccagagaacaugucucucuguaaccauauccuuggccacugagcucaguugcucccuggcugcucucccgaguaaaaaagagagggucacuuggugucucccuuuacuccagagacuaauucauccaguguccuggaaagucccuuuaagccacagccaaaugcuucauuggcgccagauuaagcugguaagggacaggucacuguucucuguaagcuucagagguaaaaaucaaaaaucacugucauaaaaggauaggaagagugugaugaugaagaugaagaugguuagcaaaaacucuaggaaugauucacacugagaagucuggcugauugauuacaaauucacuccauaagucauuugcuagggagaccuggggguggggggggagguaaaacacucacggagggcagauaggguggacccugggguucuaugcuuucuuggagugguugguguugaccuggugacauuagcuuuugaugaagauauuacaggagcugaauacauaauggauuuggcucagcccaaccucagagcuuagccagcaagcccccugccugcuccucuuggcagcagaacaggacucaguagcuggacacgaggucucuucucccugcccugccaaggaugggcugagcaggucccaucccugccaacccgcccaucccaucccacccuuuccagcgaagccacugaccuuagccaggaaggcagcguuucugauggcgccuaccaucucucccccucugggguggaccuuggcaacgugcagccacauccgcucccagguguggcuaucgaucgggaacccgcucuuguucacguggaacagcaccccgccgucuuuguccuccuccucggagcccccgcugguggcgaggcucacgggccgcgcguggcugcuccgggaucgggugccuuuggugauuuuggggugggggcagcggugagugucggcggcagagccggucaugaugaggggcacacggcaagggggcggaggacgccggcacgccggggaucagggccccgcgggagguugggguggccuuuaacucucgcggccguaggacacacgaagggaaccccgcucaccgaccgggccugaaagcaguggaaacagcagacacugcagcucaauaagacaggcauggggguucccgccucgcugccccagacccacccuucaggacuaacgcgagcuuccagccccgccgauuaccuagcaaggcggcuggaaagacgccacgaagccucacacccagcugcacucggggauggggaggcaugcaaggagcgcggggugaggaggggacgggguaggaaaaagcaagacagcuguguagcaagaagacucgaggguccccuccagcuucacgcaucccuggguccccagaugugguggacugccacggucccacagcgagcgggcacgugagcgcccgggguuggcgcgagggagccgcagcagccucugcuuguuagggaggccuggcgucuucccggaagccccccgaacccuggcgcgagaggggcggcuccagccgggguucccgggcaagcgcagcgccgcccccuucccgcgggucccgcgcgggcaccgcgaguggcagcugcgggccgccacgacgcgcgcggggcccggggacccaccucgggccggccucauugcugcagaaggcuguugggguugaggcggucgucgccucauuccaugucccauucucgaauguuauucugugacauauaacugagucacccgggcagccgccgauguuccgaaugcggccauuggacaccgcaacaaagaggggcgggucccgagcuugggacucuacaacccggagcucugcgucucugcgauugguuccaggguucccgggcgggaggggauacgaguuagggaagcugggcugccacgcgaaauccgaugcugcaguauccugggagccccgcggagcuggagcgacuguccagggacuaagauccaguuucccucgggcagaggcgcagcagcuaagcuccggagaugagauaaggaaguagugggccugguggagcaguguuggucgaggagcugggcacagugacuacacagggcucuggguggcucuaggaaaggccaacuuuaauacuuauuuaaauucuccauuacaaguuucuccccagauuaacaaguguguacagcccugaauccucuauuaguagaugugga

SEQ ID NO: 9880 - RNA, 2501 nt, Mus musculus
uccacaucuacuaauagaggauucagggcuguacacacuuguuaaucuggggagaaacuuguaauggagaauuuaaauaaguauuaaaguuggccuuuccuagagccacccagagcccuguguagucacugugcccagcuccucgaccaacacugcuccaccaggcccacuacuuccuuaucucaucuccggagcuuagcugcugcgccucugcccgagggaaacuggaucuuagucccuggacagucgcuccagcuccgcggggcucccaggauacugcagcaucggauuucgcguggcagcccagcuucccuaacucguauccccucccgcccgggaacccuggaaccaaucgcagagacgcagagcuccggguuguagagucccaagcucgggacccgccccucuuuguugcgguguccaauggccgcauucggaacaucggcggcugcccgggugacucaguuauaugucacagaauaacauucgagaaugggacauggaaugaggcgacgaccgccucaaccccaacagccuucugcagcaaugaggccggcccgagguggguccccgggccccgcgcgcgucguggcggcccgcagcugccacucgcggugcccgcgcgggacccgcgggaagggggcggcgcugcgcuugcccgggaaccccggcuggagccgccccucucgcgccaggguucggggggcuuccgggaagacgccaggccucccuaacaagcagaggcugcugcggcucccucgcgccaaccccgggcgcucacgugcccgcucgcugugggaccguggcaguccaccacaucuggggacccagggaugcgugaagcuggaggggacccucgagucuucuugcuacacagcugucuugcuuuuuccuaccccguccccuccucaccccgcgcuccuugcaugccuccccauccccgagugcagcugggugugaggcuucguggcgucuuuccagccgccuugcuagguaaucggcggggcuggaagcucgcguuaguccugaagggugggucuggggcagcgaggcgggaacccccaugccugucuuauugagcugcagugucugcuguuuccacugcuuucaggcccggucggugagcgggguucccuucguguguccuacggccgcgagaguuaaaggccaccccaaccucccgcggggcccugauccccggcgugccggcguccuccgcccccuugccgugugccccucaucaugaccggcucugccgccgacacucaccgcugcccccaccccaaaaucaccaaaggcacccgaucccggagcagccacgcgcggcccgugagccucgccaccagcgggggcuccgaggaggaggacaaagacggcggggugcuguuccacgugaacaagagcggguucccgaucgauagccacaccugggagcggauguggcugcacguugccaagguccaccccagagggggagagaugguaggcgccaucagaaacgcugccuuccuggcuaaggucaguggcuucgcuggaaagggugggaugggaugggcggguuggcagggaugggaccugcucagcccauccuuggcagggcagggagaagagaccucguguccagcuacugaguccuguucugcugccaagaggagcaggcagggggcuugcuggcuaagcucugagguugggcugagccaaauccauuauguauucagcuccuguaauaucuucaucaaaagcuaaugucaccaggucaacaccaaccacuccaagaaagcauagaaccccaggguccacccuaucugcccuccgugaguguuuuaccuccccccccacccccaggucucccuagcaaaugacuuauggagugaauuuguaaucaaucagccagacuucucagugugaaucauuccuagaguuuuugcuaaccaucuucaucuucaucaucacacucuuccuauccuuuuaugacagugauuuuugauuuuuaccucugaagcuuacagagaacagugaccugucccuuaccagcuuaaucuggcgccaaugaagcauuuggcuguggcuuaaagggacuuuccaggacacuggaugaauuagucucuggaguaaagggagacaccaagugacccucucuuuuuuacucgggagagcagccagggagcaacugagcucaguggccaaggauaugguuacagagagacauguucucuggugggagugucguguuauauaaaaugaaaaccuggaguguggccauggagguggcuucccuggaccccagggaucccguuugcugagcaggacuccugagaggugcaggaaucacauaucccagagacauggcagcagucagucccgguccuggcuggcgacagcugagcaugcaagccugcaggccagaaggcuguguguguccuuggggaaguggaggauguucucugcuuccugcuucaucguguuuuauuacuuugcuaggcagggaguuuauucugucc

SEQ ID NO: 9881 - RNA, 2501 nt, Mus musculus
uaguucaauagaucaaccaaauaagcaaccacagagagagcugccugccaggggggcaacugagggcugaagagacccauaccuggcaccccucauagaggaggcucugacagaaugaagaccagaagaaacuggugugccaagaagggauuuagauagccacaggugcugggcaaugccuucuucacucugggaaccuggucagcagccucugaaaccucuugauagaagcaacagcaacccccaccccagccccacccgcuccaagcaagagccuguaugugguaacauuaucccauaacaaaugcaacaugcaaaacaugugcucccuucuuggugacacaugccuguaaucucagcacuuggggaccgaggcuagaagacugccauaaguuuaaagcaagccccaguuacauagggagacuuugucucaaaagaguggaacaacaggaggggagaauaaaccuuuuaaauaaucgggcuuggcaacuccuuuaauuuauaagaaagcucgugagcuacaugauuaaaucaaauaaaauggcuaagaggaaaauacagaaaugggaguugaaaaugagcauggggucgaagcagggaaucaauccaacgggagagagcuaggagacagagauguaagagaggcccccuuuccuguccugucucagagaccggcuaggaacgcugggugggggagccuccacacugaacaucccucccuggcuccuuuuacuuuaauuauuuuagucuagaaacaaaucugucaaaagcuggcuaucugaagcacacagcgcacagaaaggugcugggcgugugggccuguaauuucagcacuugggaggcugaggcaggaggauuggccggaguuuuuaugggcagucuggauuacagagugagacucugucacgagaauacaaacaaccccccccccgcacgcccccccccccaaguacaagugguuccacacccuggucccuccacccgcuugauccgauuccuucgcuucccuuccaauacauaaagaaacucaagggccgguuaaaagucagccagagcacagcaagucacaacagcgagugaggcuggaagugacgucucaaaccuagcgguccgaaguuagcuggugcggagaccucucggccuucagccccgggacagcgccacaccagggcucgccgccuccaaacuuauccuaacacacuuucgcucacagcgcucuacgcggucaugcugcccagaucucugcuccggggagcgcaaggcgaccuccagcggcugugccggaccuccguucgagcguccggucuucauucauuuagcucgauaccgggagcagcgcuucaacaagccgcggccacugcgccucuacgcggacuuaggagggacccgcuccgaguccaggguccgggacaagaagugauggauggaagaggggaccccgaucgccagagugugagucaccuccgcgcaccagcacccaccuuccacccagacgaccucuccuaguugcaaacugagagcgcaacuccuccgucccugggcaucuuucacgccucgagucaaaagagaaaguucguucuuucacuuuaccagaaacuuuuuaccagcuaagaacggcagcggcaaagagcggcucagccgagcgacuguggcacggacacuagggcuucagucuccgguggcgcaagggucccgggacuggucaccagaggggaacuuagggugaggagggcagcgcuccucgguguggcucuaacucaccuccagucuucgcucggggcggccaggguccagagagcggccagaggcggguggucugucccgccggcgggcgagcgccaaggacucugccggagcgcggguuagccgauuggcuccacuggggaagcaccgugcgcggcgucucgcugagugagacuguggcugggagcgcguugcaucaccccuuuuaaagcccucgcguuggcagggagcccgcuuaacuccagguuaccaaucccaggcugacguaaugcuauuaauagcuuccagggagaacuggccagaggaggggugaaggagggacgggggcggggcaaaagguggguggagaccgcggacuuggugaugcaagugcgagaaggggcggucacggcgcguccugcguuccucgcacgcccgggacacacacacccgcccgcccucuaucuccuuaucaggcugggagccgcccgggcgcaccgccagaugugcguauucgccgcugcguguuccaggcaugagccaauggugcccaagccagcggcaugacuccaccgcccuggcaucucucccuccgcuagguuggggaagggggggugguggugcugggaggcggauccuggcaguggcccagacuaggugaggcugggaagcgggcacgaccuuucucuaaaauguguggucauuuuucuaaaacuucaggaaaaugugccuucuuugaccagcggccuagccuaaggagggggcggggaagggauagc

SEQ ID NO: 9882 - RNA, 2501 nt, Mus musculus
gcuaucccuuccccgcccccuccuuaggcuaggccgcuggucaaagaaggcacauuuuccugaaguuuuagaaaaaugaccacacauuuuagagaaaggucgugcccgcuucccagccucaccuagucugggccacugccaggauccgccucccagcaccaccacccccccuuccccaaccuagcggagggagagaugccagggcgguggagucaugccgcuggcuugggcaccauuggcucaugccuggaacacgcagcggcgaauacgcacaucuggcggugcgcccgggcggcucccagccugauaaggagauagagggcgggcgggugugugugucccgggcgugcgaggaacgcaggacgcgccgugaccgccccuucucgcacuugcaucaccaaguccgcggucuccacccaccuuuugccccgcccccgucccuccuucaccccuccucuggccaguucucccuggaagcuauuaauagcauuacgucagccugggauugguaaccuggaguuaagcgggcucccugccaacgcgagggcuuuaaaaggggugaugcaacgcgcucccagccacagucucacucagcgagacgccgcgcacggugcuuccccaguggagccaaucggcuaacccgcgcuccggcagaguccuuggcgcucgcccgccggcgggacagaccacccgccucuggccgcucucuggacccuggccgccccgagcgaagacuggaggugaguuagagccacaccgaggagcgcugcccuccucacccuaaguuccccucuggugaccagucccgggacccuugcgccaccggagacugaagcccuaguguccgugccacagucgcucggcugagccgcucuuugccgcugccguucuuagcugguaaaaaguuucugguaaagugaaagaacgaacuuucucuuuugacucgaggcgugaaagaugcccagggacggaggaguugcgcucucaguuugcaacuaggagaggucgucuggguggaaggugggugcuggugcgcggaggugacucacacucuggcgaucgggguccccucuuccauccaucacuucuugucccggacccuggacucggagcgggucccuccuaaguccgcguagaggcgcaguggccgcggcuuguugaagcgcugcucccgguaucgagcuaaaugaaugaagaccggacgcucgaacggagguccggcacagccgcuggaggucgccuugcgcuccccggagcagagaucugggcagcaugaccgcguagagcgcugugagcgaaaguguguuaggauaaguuuggaggcggcgagcccugguguggcgcugucccggggcugaaggccgagaggucuccgcaccagcuaacuucggaccgcuagguuugagacgucacuuccagccucacucgcuguugugacuugcugugcucuggcugacuuuuaaccggcccuugaguuucuuuauguauuggaagggaagcgaaggaaucggaucaagcggguggagggaccaggguguggaaccacuuguacuugggggggggggcgugcgggggggggguuguuuguauucucgugacagagucucacucuguaauccagacugcccauaaaaacuccggccaauccuccugccucagccucccaagugcugaaauuacaggcccacacgcccagcaccuuucugugcgcugugugcuucagauagccagcuuuugacagauuuguuucuagacuaaaauaauuaaaguaaaaggagccagggagggauguucaguguggaggcucccccacccagcguuccuagccggucucugagacaggacaggaaagggggccucucuuacaucucugucuccuagcucucucccguuggauugauucccugcuucgaccccaugcucauuuucaacucccauuucuguauuuuccucuuagccauuuuauuugauuuaaucauguagcucacgagcuuucuuauaaauuaaaggaguugccaagcccgauuauuuaaaagguuuauucuccccuccuguuguuccacucuuuugagacaaagucucccuauguaacuggggcuugcuuuaaacuuauggcagucuucuagccucgguccccaagugcugagauuacaggcaugugucaccaagaagggagcacauguuuugcauguugcauuuguuaugggauaauguuaccacauacaggcucuugcuuggagcggguggggcugggguggggguugcuguugcuucuaucaagagguuucagaggcugcugaccagguucccagagugaagaaggcauugcccagcaccuguggcuaucuaaaucccuucuuggcacaccaguuucuucuggucuucauucugucagagccuccucuaugaggggugccagguaugggucucuucagcccucaguugccccccuggcaggcagcucucucugugguugcuuauuugguugaucuauugaacua

SEQ ID NO: 9883 - RNA, 2501 nt, Mus musculus
caacaacuucaaaccucuuuugacagcucguuggcuuucuagaauuuguaggguagagaaauuugcuguuccgaaauccgacaccccaucucaagcccaucaguaauauaugucccuccacacucaccccuagcucacaggugaagagaaaggaggggaggcuuugcuuggugacaggugacgccacgcgaggggauggggugcucucaucacucugauccccucccgaagccuagccagcuggcuuaccaggccccaagacaugagucccuagacccugguacaaccuuucugggcccuugacuacugacagugucuggugguccaaacugagcgagcagaacgccugcagagccguagcucugccggguucuuggguggaccagcuaggguauucggucugcgcgggcggggcgcgugggcggggaggggguuaacgcggccucuaugauaaugagcugagcgguaauauaggaggccggcugagggcgccgccaccggagcugagcugagccgcgcugcgcgcagcacuguccgcgcagagccgagugggggcggcuggagcagcugcugggauccuucagcugaagacgagcgaucagaucugguggacccgugagccguggagccgcggggagcuuaugggcccggucgcagacagagcuggcagcgguuccuggaggaaauagggccgagcaagccaggagcagaagggaaggaagcgcgggaucgcugaugucagagcagcccggaaagucgugcuggagaaaacugaagacacccggcuuugagccgccccggagggacccugcgggaccccacgccccuucacaaccgggucccugcgcacaagcgacugggacgaagacgcgaggaaccauucgggggccaccccaggaauacaggcaagcggccggcgcgggccgaggauuuuaaugauccuggguuacauguggaacuggcugccagugugacucccgucaggcaggacugggcgcacgcugcccugggcaaccgccaguugagcggacgaagaggggacgcagggacagacagacacugccgagcuggguaagcagcgcccuccgcccuuuccccgagcgcgcucccgcggcgguuccuccggcgcagccuccucagguccccuuggggucccggccccggccccggcuugguuguggcggcgaguauacgcgcgugauccgccacuuucgcagcugcagucuccuguccaggcuuccgggccauagacuccagcggcucuggugguuccggcgcuccguggcgcgcuuauagcgcgcaccugccggcugucugcagcucuggggagcgccugagcgacgaggucgucccaggguuggagcccagagagggccuccguggcacuagcaagauagccuggagcgacuauggccggaggccgguuggggggcguucaccaggcaguguagucccggguggccgcuggcuguuccagugguucaguagacugggaaucaccgggaaggagaaggcauccuuugcgugcguuccgggaaucugugagaacgguuuggaagcacuguaguuaaguguuccuguccccaucccccauggcauagugcccagcuggggccagcccccuugguuugagcaacaguggugcugguugaagugggaguuuguccagaguccaagaggcuccuuaaagcucauuucccuccauguacucuuuuuugcccuaccucacgaagugauaggaucuuagaaaauuccaguuucuuuuacucauagguagucuucguaaauguucaucuugagcuguaugucaaaagcugaaaaugucauuccuagggcccucaaaaaugcccaccuguuuaacaugacccuugcccuaggaagggcuaucucuucaaauagcucaaguagagauaagagggagaaaaagcuggggggagggagggggugcaacuugggagaacaggucagucccuaccaucuggaaaggagaguaguuguugagggcaagaauguucagugaagauccaagaucacagacagauuaacucucuagccacucauaugcacaacagacagagguggauggcuuuggggagugaggcuaccagaugucucugaaggccaucugugggggauuagacauuuugagacacagccauccuugcaguggaccaggucuguacaguugaguaucugggcuagaacacagacaauacugagauggcugcuuucaacagaccuggagucagguucagcucucugcaauuccacacaauagcaggccugucauacucagucucuuuccagaucuugaaacuucauucuucgcucugggcugacuaugaauguuggggcuuuccaguaagaacccgugcuccuagaggagcuuaacccuggcuggaggaauucagcuguuccuaauugaaaugcacaacuuucuguguaaucacccuggaaaacuccuacaguugcaagcagcccuccauccgcugaccuccagg

SEQ ID NO: 9884 - RNA, 2501 nt, Mus musculus
ccuggaggucagcggauggagggcugcuugcaacuguaggaguuuuccagggugauuacacagaaaguugugcauuucaauuaggaacagcugaauuccuccagccaggguuaagcuccucuaggagcacggguucuuacuggaaagccccaacauucauagucagcccagagcgaagaaugaaguuucaagaucuggaaagagacugaguaugacaggccugcuauuguguggaauugcagagagcugaaccugacuccaggucuguugaaagcagccaucucaguauugucuguguucuagcccagauacucaacuguacagaccugguccacugcaaggauggcugugucucaaaaugucuaaucccccacagauggccuucagagacaucugguagccucacuccccaaagccauccaccucugucuguugugcauaugaguggcuagagaguuaaucugucugugaucuuggaucuucacugaacauucuugcccucaacaacuacucuccuuuccagaugguagggacugaccuguucucccaaguugcacccccucccuccccccagcuuuuucucccucuuaucucuacuugagcuauuugaagagauagcccuuccuagggcaagggucauguuaaacaggugggcauuuuugagggcccuaggaaugacauuuucagcuuuugacauacagcucaagaugaacauuuacgaagacuaccuaugaguaaaagaaacuggaauuuucuaagauccuaucacuucgugagguagggcaaaaaagaguacauggagggaaaugagcuuuaaggagccucuuggacucuggacaaacucccacuucaaccagcaccacuguugcucaaaccaagggggcuggccccagcugggcacuaugccaugggggauggggacaggaacacuuaacuacagugcuuccaaaccguucucacagauucccggaacgcacgcaaaggaugccuucuccuucccggugauucccagucuacugaaccacuggaacagccagcggccacccgggacuacacugccuggugaacgccccccaaccggccuccggccauagucgcuccaggcuaucuugcuagugccacggaggcccucucugggcuccaacccugggacgaccucgucgcucaggcgcuccccagagcugcagacagccggcaggugcgcgcuauaagcgcgccacggagcgccggaaccaccagagccgcuggagucuauggcccggaagccuggacaggagacugcagcugcgaaaguggcggaucacgcgcguauacucgccgccacaaccaagccggggccggggccgggaccccaaggggaccugaggaggcugcgccggaggaaccgccgcgggagcgcgcucggggaaagggcggagggcgcugcuuacccagcucggcagugucugucugucccugcguccccucuucguccgcucaacuggcgguugcccagggcagcgugcgcccaguccugccugacgggagucacacuggcagccaguuccacauguaacccaggaucauuaaaauccucggcccgcgccggccgcuugccuguauuccugggguggcccccgaaugguuccucgcgucuucgucccagucgcuugugcgcagggacccgguugugaaggggcguggggucccgcagggucccuccggggcggcucaaagccgggugucuucaguuuucuccagcacgacuuuccgggcugcucugacaucagcgaucccgcgcuuccuucccuucugcuccuggcuugcucggcccuauuuccuccaggaaccgcugccagcucugucugcgaccgggcccauaagcuccccgcggcuccacggcucacggguccaccagaucugaucgcucgucuucagcugaaggaucccagcagcugcuccagccgcccccacucggcucugcgcggacagugcugcgcgcagcgcggcucagcucagcuccgguggcggcgcccucagccggccuccuauauuaccgcucagcucauuaucauagaggccgcguuaacccccuccccgcccacgcgccccgcccgcgcagaccgaauacccuagcugguccacccaagaacccggcagagcuacggcucugcaggcguucugcucgcucaguuuggaccaccagacacugucaguagucaagggcccagaaagguuguaccagggucuagggacucaugucuuggggccugguaagccagcuggcuaggcuucgggaggggaucagagugaugagagcaccccauccccucgcguggcgucaccugucaccaagcaaagccuccccuccuuucucuucaccugugagcuaggggugaguguggagggacauauauuacugaugggcuugagauggggugucggauuucggaacagcaaauuucucuacccuacaaauucuagaaagccaacgagcugucaaaagagguuugaaguuguug

SEQ ID NO: 9885 - RNA, 2501 nt, Mus musculus
uuucaaacgaagggugacucauacacacaguguguuuagccuucacuuaaaauacacaauguuaaggcggucaugaguuguccaagccccauacucucugguaggguaaccuuuaaacucggagcgcaaaucuacacccuuauugaucuuucaauccaguauccgccucaccauuugacauucuagucaaccauuaagaacaauacugaaacuaaaaucuuaagcgagaggaagggggggagaucaagagagauggagaauucucuugaacgccaaggguuaagguucuuuuuuuuuuuuaugcaggaaguuguauaguaaauaacauuaggucugaucuaccucauuuccacuuaacugcuaaucugcacacaacccaagcaaagagcgccccauccgcagaaaugucuguuugaaaugucuguuugaaaccuggcggcucuaggguagaggaugccugcuggccaaaggggcuaugucauaggcgccaaggcuaacucugagaagggagaccugagcagaucucaggucugagcuagcuaagaaaaaccucccaccuucuuuccuuaaaauaaaaaaaaaaaaaaacaaacaauguauuuuugcugguuuaggugcauaaacauacaucuggggaguguuaagagucuccugucucgaccacacaagguuggguuucuuucuuuuucucuucuuuacacaccucagaacuccccuaaauuuuucaaggugaaugguuagggggaggcggcaacuggaaacacuccuacuuaaaaagaaacuuugauguagccuaaaucuuugaggagccugaagaaacuccaguaggccggaggagaaaagucggccaggauugcugguaaguaaacuaaaagcaaagacguaggaaaauucuguguagccgggagucuaagcaaacccgacuucucuucagcuuaaggcuuuccucucccuggaccguggcaaccaccagagucucuuccucacaccaccgguagguaggacgccuaaaacucaaaugcacuagcuuuugaggguggagagcaaaaggaaauagaaagaaaugcacguauuugggccuuuucugaaaauauaaauggagaaacaaaacgcaaggcucuggcgaaagaccccuucaccggcuaacaagaagcuggaaguccuucgggggagcccaguuccaggccggccuggcccgcacugcugcccggccugaaaggcucggcgccugcaggcagcgcuugagauuucucccuggcugcaaaaucuacaaccucguguggaccaggacugcauuucggcgcuugccaggugagugugccuggccccaaggacaccggcaaagagaggugccugcuacgugcgcucuuuuauuuaaaaaagaaaaaaagaagaacucucccaaccagcgacacugcuuccucgcccauuuccgggcccccgauacuuuuuuuaaaugaacuaguaacacacuuaggagcuuuggcuugcucugcccagccagggucucuggcggucucguggacccaggaaaacaaacgcggauccaaaagguuccagcgccaagguggacucaccguggugggucggaggauaccucugcaccguagcccugacggaguuuccguaguaggacgggacgugguugccuugaccaucgauguuaaaaaguacguccaccucuuccgucagcggauacugagcuuccauguacgaauggccgaggcccggguggugcgugucugggugcugaccguugaggaccgcggggugaugguggcucacccagcgcggcugguccgcagucaccuccauguccucggcugugcucgcgcccucucgcccggcccggaacccucgcggguagagggagggcugucggccugggagguccgcggacuccugccgucggaggcccaggagaggggucguuuaaugguuuguuugcaguuaaggguauagaaaaggagagcaaaaaggaggguuuagggaggaaagaaaaaucuuugcgggauaguuuagcaaaagaaaggaagggaaagaagaaaaagaaaagaaugagggcgauccccccccccaaaaaaaaagcagacacggaggaauaaaggggucaaaaaaaaaaaaaaaaaaaggagggagagaggaauccgagugugaccacacugcacacugauuccuuggcgcucagagacgguugcucuuccgaucaccugcaagggagagaaagagagaccugaaugagguguaagaacuuuuaacaccugaaauucuggagggcacuaggucuucgcaagcuuccugcagggccgacucacccgggacgugcacacgcacgcgaagacccggagggaaagaagccaagcuccgcagcacaccuccgacagccaggcucgcaggagcccaggacugacuaagcaauuaaaacuuggggacaaguccucccuggaggacaccggccccaggaucuuuccaaccacuacaaauccuccaaaaggagaaag

SEQ ID NO: 9886 - RNA, 2501 nt, Mus musculus
cuuucuccuuuuggaggauuuguagugguuggaaagauccuggggccgguguccuccagggaggacuuguccccaaguuuuaauugcuuagucaguccugggcuccugcgagccuggcugucggaggugugcugcggagcuuggcuucuuucccuccgggucuucgcgugcgugugcacgucccgggugagucggcccugcaggaagcuugcgaagaccuagugcccuccagaauuucagguguuaaaaguucuuacaccucauucaggucucucuuucucucccuugcaggugaucggaagagcaaccgucucugagcgccaaggaaucagugugcaguguggucacacucggauuccucucucccuccuuuuuuuuuuuuuuuuuuugaccccuuuauuccuccgugucugcuuuuuuuuuggggggggggaucgcccucauucuuuucuuuuucuucuuucccuuccuuucuuuugcuaaacuaucccgcaaagauuuuucuuuccucccuaaacccuccuuuuugcucuccuuuucuauacccuuaacugcaaacaaaccauuaaacgaccccucuccugggccuccgacggcaggaguccgcggaccucccaggccgacagcccucccucuacccgcgaggguuccgggccgggcgagagggcgcgagcacagccgaggacauggaggugacugcggaccagccgcgcugggugagccaccaucaccccgcgguccucaacggucagcacccagacacgcaccacccgggccucggccauucguacauggaagcucaguauccgcugacggaagagguggacguacuuuuuaacaucgauggucaaggcaaccacgucccguccuacuacggaaacuccgucagggcuacggugcagagguauccuccgacccaccacggugaguccaccuuggcgcuggaaccuuuuggauccgcguuuguuuuccuggguccacgagaccgccagagacccuggcugggcagagcaagccaaagcuccuaaguguguuacuaguucauuuaaaaaaaguaucgggggcccggaaaugggcgaggaagcagugucgcugguugggagaguucuucuuuuuuucuuuuuuaaauaaaagagcgcacguagcaggcaccucucuuugccgguguccuuggggccaggcacacucaccuggcaagcgccgaaaugcaguccugguccacacgagguuguagauuuugcagccagggagaaaucucaagcgcugccugcaggcgccgagccuuucaggccgggcagcagugcgggccaggccggccuggaacugggcucccccgaaggacuuccagcuucuuguuagccggugaaggggucuuucgccagagccuugcguuuuguuucuccauuuauauuuucagaaaaggcccaaauacgugcauuucuuucuauuuccuuuugcucuccacccucaaaagcuagugcauuugaguuuuaggcguccuaccuaccgguggugugaggaagagacucuggugguugccacgguccagggagaggaaagccuuaagcugaagagaagucggguuugcuuagacucccggcuacacagaauuuuccuacgucuuugcuuuuaguuuacuuaccagcaauccuggccgacuuuucuccuccggccuacuggaguuucuucaggcuccucaaagauuuaggcuacaucaaaguuucuuuuuaaguaggaguguuuccaguugccgccucccccuaaccauucaccuugaaaaauuuaggggaguucugagguguguaaagaagagaaaaagaaagaaacccaaccuuguguggucgagacaggagacucuuaacacuccccagauguauguuuaugcaccuaaaccagcaaaaauacauuguuuguuuuuuuuuuuuuuuauuuuaaggaaagaaggugggagguuuuucuuagcuagcucagaccugagaucugcucaggucucccuucucagaguuagccuuggcgccuaugacauagccccuuuggccagcaggcauccucuacccuagagccgccagguuucaaacagacauuucaaacagacauuucugcggauggggcgcucuuugcuuggguugugugcagauuagcaguuaaguggaaaugagguagaucagaccuaauguuauuuacuauacaacuuccugcauaaaaaaaaaaaagaaccuuaacccuuggcguucaagagaauucuccaucucucuugaucucccccccuuccucucgcuuaagauuuuaguuucaguauuguucuuaaugguugacuagaaugucaaauggugaggcggauacuggauugaaagaucaauaaggguguagauuugcgcuccgaguuuaaagguuacccuaccagagaguauggggcuuggacaacucaugaccgccuuaacauuguguauuuuaagugaaggcuaaacacacuguguguaugagucacccuucguuugaaa

SEQ ID NO: 9887 - RNA, 2501 nt, Mus musculus
gggcaaauggguguucggguacgcuugcggugugaacuuucuacggaucacuuguggagggaguugaaggaaaggagggaagggaaccgccccagggguccucguggcgagguccgugcucacugggggaggugucuaccuaugccugggcggggggaggggggagaggcggggggaggcgggggggggcggugggcggggggagagugucaccuugugggcgggagaaggagucuaccacgaagagcaggcuaauuggcucgagacauuuugcgagcauuggaaaaaggucguugaaggaguucgcucuacagagaaagagagaaaucuuaaaaaagagugccgggcaugcgcauagagaggaugccauauuggaaugaggcuguagugggagcuggaggacccgagcgggcgcgcuagggaggcggcggguagagagcgagcgagcaagagagggcgggugagccggacccgcgcccacuccggucgcccccgggggccagguuccaccauuccuggcaggacaaacuuaaucagguaggacgccgccccagacacgguccccucguccaacccggcccgcgagcagaucucuggcccgcagguugagugugccgaaaggcgucuuuuuuuuuuuuuuuuuuuuuuucccaguuuaguuuuuuuuuuuuaaagaaggaagcucgagccagucuggguggaggggggaggcgggggguuggggaggaaggaggagaaaaaccgaagcgcagaggcuggagaggaaaugagaagcacuugagcgaagccucuaacuccucucugcgcucuggguugucauuuuuucucauuccccacccccuuccccccgacucccggcucugaaaagccaggccuugcgggagucuguccggaguugcaaagugaccucguccuccuccgggugcagucuguucccuccccgccgcccaccuuccucguuuaugcacucgcuuuagcggcgcagccuccucugccaccuaccccggguucccgcgucuccucggagccggggucucccucuuuuggugugcauugggggggggggggggcuaggagguuguagagaggaaagugauggcguggagagaauuggaaagcagcaagggugggguaggggcuguucccaaaaaucgcgcagacguuuggaaucgccggauuggaaacauuugccuugugcagcggaauugaaauugucaauaguaguuucggagcgagcucuagcaaggacgaccuuuuuguucauuuuuaucacccuuugaaguaauauccugucacuuggggcuuucuuguguacacucauccugccccuuuucagaaugucuaacaggaucgagcucuggaguuuauuuauuuauuuuuaugugcgugugucuuggugaaauccucuuuaaaaaaaaaaagcaacggcaggaacugcuggauguguuguuuuuuuuuuuuuuuuaaauuuuuaccuggagcggcugaacgggauuaggcugggaaagggagaacauuugaggggugggaagcgauugguuuucuguggccggacacagguccccagcccagucaauacuuguguuuucuuggaagcgcuacagcagcggggaaggagucuuuagacaccgugccaguuccaauauggcgggcuaagguggcuuuuaaaaacugaaaauaaagguuuugaggugggaaaaaacccaacugaaguggccacgccuuaguuucuacucucuuugguuacuccaggagcugcuuuagcgaauuaaauaggaaaaaagagguggggcgagguauuccaguuuuuuccgugguuuaucuguacgaaguccauugcuagaggaucuaggguggaggguugccucgggccagaacgaggguauccaagcgcaacugccuggugugugugcuuguggggucguguacaaacucugcacgugcagucggucgcuaggguguguuuaaagaagcccccucccccacgccaacgugcguacgagucucggaaccagacucugccacgaucugacgugacaaacugcugacacgaggugcaucauccacgagggcagagggaaugauuaauuucccuuuucuaggggacguguuuucuuucuuccucagcguugaauccugcguggaaugggcggagcgaguaggugcuuauuauuauuauuaaagagacuaacuguccaggguacucgguucaaucgggagggcugcgugcagccaaugggauuuugugugcuggcgagauuaggucugaggcacauuuagugauuggcccuuguuuugcugcacucuccgcaaaggugagugguagggggccuagugggggaagugcagaccucccaggaaaaggcaaacaaggucaagccuuagaguugccaggucacuuucgauuuucccguucuaagcaaggugagggcuggggagugcauuuuaggaaggaauugucccuugcccaguuuggccacccacuggacugcugugagugg

SEQ ID NO: 9888 - RNA, 2501 nt, Mus musculus
ccacucacagcaguccaguggguggccaaacugggcaagggacaauuccuuccuaaaaugcacuccccagcccucaccuugcuuagaacgggaaaaucgaaagugaccuggcaacucuaaggcuugaccuuguuugccuuuuccugggaggucugcacuucccccacuaggcccccuaccacucaccuuugcggagagugcagcaaaacaagggccaaucacuaaaugugccucagaccuaaucucgccagcacacaaaaucccauuggcugcacgcagcccucccgauugaaccgaguacccuggacaguuagucucuuuaauaauaauaauaagcaccuacucgcuccgcccauuccacgcaggauucaacgcugaggaagaaagaaaacacguccccuagaaaagggaaauuaaucauucccucugcccucguggaugaugcaccucgugucagcaguuugucacgucagaucguggcagagucugguuccgagacucguacgcacguuggcgugggggagggggcuucuuuaaacacacccuagcgaccgacugcacgugcagaguuuguacacgaccccacaagcacacacaccaggcaguugcgcuuggauacccucguucuggcccgaggcaacccuccacccuagauccucuagcaauggacuucguacagauaaaccacggaaaaaacuggaauaccucgccccaccucuuuuuuccuauuuaauucgcuaaagcagcuccuggaguaaccaaagagaguagaaacuaaggcguggccacuucaguuggguuuuuucccaccucaaaaccuuuauuuucaguuuuuaaaagccaccuuagcccgccauauuggaacuggcacggugucuaaagacuccuuccccgcugcuguagcgcuuccaagaaaacacaaguauugacugggcuggggaccuguguccggccacagaaaaccaaucgcuucccaccccucaaauguucucccuuucccagccuaaucccguucagccgcuccagguaaaaauuuaaaaaaaaaaaaaaaacaacacauccagcaguuccugccguugcuuuuuuuuuuuaaagaggauuucaccaagacacacgcacauaaaaauaaauaaauaaacuccagagcucgauccuguuagacauucugaaaaggggcaggaugaguguacacaagaaagccccaagugacaggauauuacuucaaagggugauaaaaaugaacaaaaaggucguccuugcuagagcucgcuccgaaacuacuauugacaauuucaauuccgcugcacaaggcaaauguuuccaauccggcgauuccaaacgucugcgcgauuuuugggaacagccccuaccccacccuugcugcuuuccaauucucuccacgccaucacuuuccucucuacaaccuccuagcccccccccccccccaaugcacaccaaaagagggagaccccggcuccgaggagacgcgggaacccgggguagguggcagaggaggcugcgccgcuaaagcgagugcauaaacgaggaaggugggcggcggggagggaacagacugcacccggaggaggacgaggucacuuugcaacuccggacagacucccgcaaggccuggcuuuucagagccgggagucggggggaaggggguggggaaugagaaaaaaugacaacccagagcgcagagaggaguuagaggcuucgcucaagugcuucucauuuccucuccagccucugcgcuucgguuuuucuccuccuuccuccccaaccccccgccuccccccuccacccagacuggcucgagcuuccuucuuuaaaaaaaaaaaacuaaacugggaaaaaaaaaaaaaaaaaaaaaaagacgccuuucggcacacucaaccugcgggccagagaucugcucgcgggccggguuggacgaggggaccgugucuggggcggcguccuaccugauuaaguuuguccugccaggaaugguggaaccuggcccccgggggcgaccggagugggcgcggguccggcucacccgcccucucuugcucgcucgcucucuacccgccgccucccuagcgcgcccgcucggguccuccagcucccacuacagccucauuccaauauggcauccucucuaugcgcaugcccggcacucuuuuuuaagauuucucucuuucucuguagagcgaacuccuucaacgaccuuuuuccaaugcucgcaaaaugucucgagccaauuagccugcucuucgugguagacuccuucucccgcccacaaggugacacucuccccccgcccaccgcccccccccgccuccccccgccucuccccccuccccccgcccaggcauagguagacaccucccccagugagcacggaccucgccacgaggaccccuggggcgguucccuucccuccuuuccuucaacucccuccacaagugauccguagaaaguucacaccgcaagcguacccgaacacccauuugccc

SEQ ID NO: 9889 - RNA, 2501 nt, Mus musculus
ggaaggaaggaaggaaaagaaagaaagaaagaaagaaagaaagaaagaaagaaagaaagaaagaaagaaagaaagaaagaaagaaagaaagaaagcccuaaaggugcucaguagaaaauugcgucuagauaauaucugaauuuucaggggaccaaagaccuagagcacgccggcccuugauaagucaaaauuacugcgugaaacgagguaucuugaaggugaugacagggacgcgggaucuuucuucuuguuggucaguaagcaaaguguagggcucaggaacucagcuagcacaguuggcuaccaguacgaaggccucaccaccgggugccugcuacuuggacugugcagaaggucugauuacacuuuuagguaguuagaaguguauuuucucccugcggcuacaagaacaaagaugcuucgguuuugcacugacuugacucuaacaaaggcaaaguaguccuggcccgcacugcaagccaguguuccuuguggcaccaccuaccagcucugaagagcagguccugauucaggcucauaugaggcuauuuugcagccaaugcaaagccaggcaaggcagcugugaucaaguaggcuaggauuaggaagggccucugccgcgcugcccuggagauaguggguggugaaagggcugagcucugacccggcaacuucccggaccacuuucuuguuccuuuuccuacuccaagaguggggguuccuguguuugcaugccagcugcuauacuguuacaguguaaaugcaacuuuuucuguucccagcaguucuuccuuuggaaacuaacuggaguguaaagugacuauugaguuucaccgcccaaagccucucaaaggccaugccauuacaugcgcgcggcagagugcugucugagcccugggcagccuugucugagacucgcucuugggguccuuccauccuccccggaaugcuggucuaucuccucugaaucuggagcccugacacgcccauuucgggcuucugaaaccuucuacauucucagaaaaaggcuggaagcgacucuaaacugcagauaaugccacagaccagggauucccggccugcuguaagacaguugcugcaaguucacgaguuggccccggggccaagaucccaguuucucgccccucgaggguuaugcucucaauugcacgcgccgagcacgguucuggcacccuaaaacuaccuugucugggcugcaaggcgcucuccucugcguaugacccccgccuuuccagcaugucacagagucccccucgcuuuagcccggggagccggguugccgcacccuuccuccgcgggcucccacccccauuuccggggucuccucccucuugucagcaccuucuccgcccuccccacugccugcccgcgcucaccugguuguuuuugcagagaucagcccacaugcuggugccguccccuccgcgcaucaggacgugguaggugaagaaguagauacccgguauggagcaggugaacuugcccguggugggaucauagugguuuccgagauugguuaccacgucgucgaacuugagcaccucguagccuucgugcugccguuugaggccagcguaaaaggcgaucuugggcaccgugcuauagguggcugcacugauagccccggccgcguucaggccgggcgccccaggcgggccgggcaagccuuggcgacccggcucucccuucucgcccgggggccccacggggcccggcgguccgggcucucccgggggcccacgcgggccugccuuccccggccuaccggccucgccuuugggacccuggaugaaagugggcagggacugcauaaggccccgguccggaguggcggcggugcugggagccuuggugcccccauaggggucgcagaccaugcggcaggugcccagcaucucguagugagccgacgugccggccgagcucaccagcaccgggaugaggaugaccagcagaagcaccaucaccacccccagcgccccggcggcgaucaggcgccuccugcugcccacgagccggcucagcgcgggccgauccucuugucugcuuuuggacaaaauuuugaagguugggcggggaccucuucagagccgaaaacaaucccccuucgaaccccaacuccccugggcgggcgcgcgccggucgcucuugaccggcuccugcucccccccgcugaggcugcggcuagggagggagcuggggcgccaagugacuugaacugaagucccgagcuggggguggggguuggggggaggggugcucagggcgcccucucgccuccugccagccccuucgcaccuguggcugcggcgggugccggagcggccacccggagggcaaagccagcugccgccugcugcgcucguccggagcagcucacacuuuuaugccgcugcugcccgugaucgacuuuuccuuuuuugcagacugcgccaguucucaccaacuuucugucugaaguugcccuuuuuuuuuuuucu

SEQ ID NO: 9890 - RNA, 2501 nt, Mus musculus
agaaaaaaaaaaaagggcaacuucagacagaaaguuggugagaacuggcgcagucugcaaaaaaggaaaagucgaucacgggcagcagcggcauaaaagugugagcugcuccggacgagcgcagcaggcggcagcuggcuuugcccuccggguggccgcuccggcacccgccgcagccacaggugcgaaggggcuggcaggaggcgagagggcgcccugagcaccccuccccccaacccccacccccagcucgggacuucaguucaagucacuuggcgccccagcucccucccuagccgcagccucagcgggggggagcaggagccggucaagagcgaccggcgcgcgcccgcccaggggaguugggguucgaagggggauuguuuucggcucugaagagguccccgcccaaccuucaaaauuuuguccaaaagcagacaagaggaucggcccgcgcugagccggcucgugggcagcaggaggcgccugaucgccgccggggcgcuggggguggugauggugcuucugcuggucauccucaucccggugcuggugagcucggccggcacgucggcucacuacgagaugcugggcaccugccgcauggucugcgaccccuaugggggcaccaaggcucccagcaccgccgccacuccggaccggggccuuaugcagucccugcccacuuucauccagggucccaaaggcgaggccgguaggccggggaaggcaggcccgcgugggcccccgggagagcccggaccgccgggccccguggggcccccgggcgagaagggagagccgggucgccaaggcuugcccggcccgccuggggcgcccggccugaacgcggccggggcuaucagugcagccaccuauagcacggugcccaagaucgccuuuuacgcuggccucaaacggcagcacgaaggcuacgaggugcucaaguucgacgacgugguaaccaaucucggaaaccacuaugaucccaccacgggcaaguucaccugcuccauaccggguaucuacuucuucaccuaccacguccugaugcgcggaggggacggcaccagcaugugggcugaucucugcaaaaacaaccaggugagcgcgggcaggcaguggggagggcggagaaggugcugacaagagggaggagaccccggaaaugggggugggagcccgcggaggaagggugcggcaacccggcuccccgggcuaaagcgagggggacucugugacaugcuggaaaggcgggggucauacgcagaggagagcgccuugcagcccagacaagguaguuuuagggugccagaaccgugcucggcgcgugcaauugagagcauaacccucgaggggcgagaaacugggaucuuggccccggggccaacucgugaacuugcagcaacugucuuacagcaggccgggaaucccuggucuguggcauuaucugcaguuuagagucgcuuccagccuuuuucugagaauguagaagguuucagaagcccgaaaugggcgugucagggcuccagauucagaggagauagaccagcauuccggggaggauggaaggaccccaagagcgagucucagacaaggcugcccagggcucagacagcacucugccgcgcgcauguaauggcauggccuuugagaggcuuugggcggugaaacucaauagucacuuuacacuccaguuaguuuccaaaggaagaacugcugggaacagaaaaaguugcauuuacacuguaacaguauagcagcuggcaugcaaacacaggaacccccacucuuggaguaggaaaaggaacaagaaagugguccgggaaguugccgggucagagcucagcccuuucaccacccacuaucuccagggcagcgcggcagaggcccuuccuaauccuagccuacuugaucacagcugccuugccuggcuuugcauuggcugcaaaauagccucauaugagccugaaucaggaccugcucuucagagcugguagguggugccacaaggaacacuggcuugcagugcgggccaggacuacuuugccuuuguuagagucaagucagugcaaaaccgaagcaucuuuguucuuguagccgcagggagaaaauacacuucuaacuaccuaaaaguguaaucagaccuucugcacaguccaaguagcaggcacccgguggugaggccuucguacugguagccaacugugcuagcugaguuccugagcccuacacuuugcuuacugaccaacaagaagaaagaucccgcgucccugucaucaccuucaagauaccucguuucacgcaguaauuuugacuuaucaagggccggcgugcucuaggucuuugguccccugaaaauucagauauuaucuagacgcaauuuucuacugagcaccuuuagggcuuucuuucuuucuuucuuucuuucuuucuuucuuucuuucuuucuuucuuucuuucuuucuuucuuucuuucuuucuuuuccuuccuuccuucc

SEQ ID NO: 9891 - RNA, 2501 nt, Mus musculus
agaacucuccacacuuccccaacaaucacaagaacgguuauucucaaaguugguuuaaaacuucggacaaugaaugagcuuagcgcucuuggagucuggagucaaucucaacuaacgguuuuccugaaccgcuagacgaucucacccucagggcuccaugagucauauccacugacucagcgaccccaccccguccccugggcuuuacuccagaggcaguggcuccuaauccucucuaguugaacugaguccguuagaucaggggauaugaccacgucaaacaagcccucugcaaaggucuugagccagauaucuugggcugugugcuucuccacccccaaucucgggcccucuuuguuucucucuccccggcuuccgaucugcaggacugcuuuugcaggcucuuccugcuccuccgcucucggaucuccccacccacccagucccagaagaccgcagaucugcgacugcgaccacgccccuccuaccagcgcgccuagucccacgccccuuuggcccagugccagggaucgcuuuacucaacuuuccagagccccccuuccuucccccaugaauccuucccgcgaucccuucuuucucagcacccaagggugaguagagaguucgggugaucaccaggaaagccccugaaaggccuagcacuuccaauuaguaacaggacugugcuugauacccuacagcccuggaggaaggcucgaggggagcucccucccccaccccccuuccucacuucuuuccggguccccauuggcuggcucgcucggcggcuaggauggcagugggaggggacccucuuuccuaacaguguuauaaaagcagcgcccuuggcguuguccaguccucugccacucuugcuccgggaccccagagaccccagcgcuccuacgauucacagccaccgcgcccucauucccuuguugcaguuuuuccagccgcagcaagccagcccaccuucgaagccaugucuaccaggucuguguccucguccuccuaccgcaggauguucgguggcuccggcacaucgagccggcccagcuccaaccggagcuaugugaccacguccacacgcaccuacagucugggcagcgcacugcgccccagcacuagccgcagccucuauuccucaucccccgguggcgccuaugugacccgguccucggcagugcgccugcggagcagcgugccgggcgugcggcugcuucaagacucgguggacuucucgcuggccgacgccaucaacacugaguucaagaacacccgcaccaacgagaagguagaacugcaggagcugaaugaccgcuuugccaacuacaucgacaaggugcgcuuccucgagcagcagaacaaaauccugcuggcugagcucgagcagcucaagggccagggcaagucgcgccugggcgaccuguacgaggaggagaugcgggagcugcgccggcagguggaucagcucaccaacgacaaggcccgugucgagguggagcgggacaaccuggccgaggacaucaugcggcugcgagagaaguaaggccugaccuacgcgagugguggggugugggagggaggggaguccugggccuugcacuggggcugccacgcccuuggggauguggcugggguggcgguugucuggaggauagcagaggaagcgggccccacccugaaccuaaacuuugcagugaacauuucucuuuucgccucacucaagcacuuccauugaacuuuuuagaaaguuucuuagguccuucuucugggcuuacaguuaccagacaggaggaaagaaugggugugaaggguuccagacaaagagauggcaaaggcaucugggauauugggacaggggauuggcuguaauuguaagggaagggcagugauugucuuuuccagugugccccaacuccagcuaacaccugcagagagcugccaccucgacaaguugcaguaacuacuguggguggaggugucacagcagcucuggacucaaggcuuggcggcauuugugguuggguguggccgccccgccccuggcgguuuuccaguuccccuuugauuaaugugcugcugcuucagauugcaggaggagaugcuccagagagaggaagccgaaagcacccugcagucauucagacagguuuguagacuucuuuuucacaugcagccagcagcccaauggagccaacccgcgagcgguucuaaaaguuacuucccuuagguuuuaaaaggugcagaacuucacgucugcuuguaaagcccccuggcggcggaaagcgcacagauugaaaaacuccacuauuuagggcagucuuuggaacaugaaggcuuuauuuucugcuucguuuccagauuuuucugaucccccacacccccgaaacauuucuccuuucguuuuuugaaacauaucgacauucggauauugaaugguuacaauuugauuacauuguggauugugaaggugaaauuggcuaacuuucacaagguca

SEQ ID NO: 9892 - RNA, 2501 nt, Mus musculus
ugaccuugugaaaguuagccaauuucaccuucacaauccacaauguaaucaaauuguaaccauucaauauccgaaugucgauauguuucaaaaaacgaaaggagaaauguuucgggggugugggggaucagaaaaaucuggaaacgaagcagaaaauaaagccuucauguuccaaagacugcccuaaauaguggaguuuuucaaucugugcgcuuuccgccgccagggggcuuuacaagcagacgugaaguucugcaccuuuuaaaaccuaagggaaguaacuuuuagaaccgcucgcggguuggcuccauugggcugcuggcugcaugugaaaaagaagucuacaaaccugucugaaugacugcagggugcuuucggcuuccucucucuggagcaucuccuccugcaaucugaagcagcagcacauuaaucaaaggggaacuggaaaaccgccaggggcggggcggccacacccaaccacaaaugccgccaagccuugaguccagagcugcugugacaccuccacccacaguaguuacugcaacuugucgagguggcagcucucugcagguguuagcuggaguuggggcacacuggaaaagacaaucacugcccuucccuuacaauuacagccaauccccugucccaauaucccagaugccuuugccaucucuuugucuggaacccuucacacccauucuuuccuccugucugguaacuguaagcccagaagaaggaccuaagaaacuuucuaaaaaguucaauggaagugcuugagugaggcgaaaagagaaauguucacugcaaaguuuagguucaggguggggcccgcuuccucugcuauccuccagacaaccgccaccccagccacauccccaagggcguggcagccccagugcaaggcccaggacuccccucccucccacaccccaccacucgcguaggucaggccuuacuucucucgcagccgcaugauguccucggccagguugucccgcuccaccucgacacgggccuugucguuggugagcugauccaccugccggcgcagcucccgcaucuccuccucguacaggucgcccaggcgcgacuugcccuggcccuugagcugcucgagcucagccagcaggauuuuguucugcugcucgaggaagcgcaccuugucgauguaguuggcaaagcggucauucagcuccugcaguucuaccuucucguuggugcggguguucuugaacucaguguugauggcgucggccagcgagaaguccaccgagucuugaagcagccgcacgcccggcacgcugcuccgcaggcgcacugccgaggaccgggucacauaggcgccaccgggggaugaggaauagaggcugcggcuagugcuggggcgcagugcgcugcccagacuguaggugcguguggacguggucacauagcuccgguuggagcugggccggcucgaugugccggagccaccgaacauccugcgguaggaggacgaggacacagaccugguagacauggcuucgaaggugggcuggcuugcugcggcuggaaaaacugcaacaagggaaugagggcgcgguggcugugaaucguaggagcgcuggggucucuggggucccggagcaagaguggcagaggacuggacaacgccaagggcgcugcuuuuauaacacuguuaggaaagaggguccccucccacugccauccuagccgccgagcgagccagccaauggggacccggaaagaagugaggaaggggggugggggagggagcuccccucgagccuuccuccagggcuguaggguaucaagcacaguccuguuacuaauuggaagugcuaggccuuucaggggcuuuccuggugaucacccgaacucucuacucacccuugggugcugagaaagaagggaucgcgggaaggauucaugggggaaggaaggggggcucuggaaaguugaguaaagcgaucccuggcacugggccaaaggggcgugggacuaggcgcgcugguaggaggggcguggucgcagucgcagaucugcggucuucugggacuggguggguggggagauccgagagcggaggagcaggaagagccugcaaaagcaguccugcagaucggaagccggggagagagaaacaaagagggcccgagauuggggguggagaagcacacagcccaagauaucuggcucaagaccuuugcagagggcuuguuugacguggucauauccccugaucuaacggacucaguucaacuagagaggauuaggagccacugccucuggaguaaagcccaggggacgggguggggucgcugagucaguggauaugacucauggagcccugagggugagaucgucuagcgguucaggaaaaccguuaguugagauugacuccagacuccaagagcgcuaagcucauucauuguccgaaguuuuaaaccaacuuugagaauaaccguucuugugauuguuggggaaguguggagaguucu

SEQ ID NO: 9893 - RNA, 2501 nt, Mus musculus
cgcucuugccugaagauguuucuuuucccggguuucggcaucacuucuguugcgcaugcucaacuggccaggaagaacgacgcugcuacaggauccuucugcacacguuuauucaguccuguuucuucuuguuuauaucucccuuguuuauaucucccuuguuuuuauaucucccuuguuuuuauaucucccuuguuuuuauaucucccuuguuuuuauaucucccuuguuuuuauaucucccuuguuuuuauaucucccuuguuuuuauaucucccccgaacccugggccucucacucuuuuauacucucaguucccauccacgcacagcaggccacgcccccucgccagucacgaggcuucagcuaaucagggcagcaggggcaaaucuccaccaaauuggauucaccuguauccugguacaccugcgcagcacucaagauguuugugucuuauaugaggaagucaggugcaagucauaugacuuagcuacagucccuggcaccuuugggacugccgccacacccgcuccccacauaggagcggaaccuggaacuccuugaggaaagguagguucccgauguuuaacuaagaccuguucaaccugaacaguucuauuuaaccgagaggcguuuccuucugaacccacucguucuaaaucaauccauaaacacauccaaucauuuccauaaacagauuagcugugaauuacaugcugggcucuggaaagaggaucuuaauggcaaaccagccucacccaccaccuucacaccuuuucauuccaauccuggagucauaaccaccaucugcuagagcuuaauuucaagauuaugggagguggguacccuccgguugacaccugaaugaucccccgaauugcagagguuuggaucuggccccaccuuccaucuugacacacugcuggguuuuucucgcauaucaagugaaggcagagggcacucuggcugcuggcuucugcagagucgcgcuccacauucuaaguuccaauuguauucacuugcguuacuuugcauuuugguugcccugaagaguuaguucucugccguuuugaaaacaaaacucauugaagugcuaauaggcagugcagaauggucucucgagcugcaugcuggggucuuccuacacccggacucacaggccagacuccuuguggcuagccgaaguggggacucgguaggaggcaggcuuccgggccaaaaacccaggagagagugggaagggaggaguuacugggaacucuggaugaaggagugauuuuaguaggguuuucgugagaugggguggagagaggaggcuuggaugcgaagaagccagcgaucuccgcccgcaggaggaacaaagccuuggccguucucaccccaacgcaauucagcuaaaggggugggagguggaagugaaggggugcaacgaagggaggagaggggaggggcgcgagcuaagggagcccgaauccagaguucgcauuuaccacgacgccucgccuagagucuggcgccuucucacugcucccggccacgucucucgcggggaacgcuggacagacagacgcccggaggaugcgugggcgugggcggggggguggggugggggagaauguggcugggcccgccccgcccccagccugcgggcgggaaagcugggacuagagucgagccucauucccaaagcggcgcgggagcagcuguggagcagcgccugaugcaccugagcgcgcuccggggagcgucccuggcuuaccgccccccaacccccgccugccccuuugccgacucugcagcccgcggggauaugggacaggccugcgauucguucaggagaaaaagcaguccccuguuauuugccuucucaaagcccaucgcugcagcccccaggccagcaaucuccaagacuccucccugccagauuuuaaaugcacauuugucccaagucaaugcauuaaaaagagucagugcagugcguucucgagcauuggaagugggccggaguaucccggaggacuucagagcuuggcguccugccaggaguuggaaagcuccacgauccgagccggcauuuccucugaccaaacccuagugauccgauggguccagggcagggacauuuuacaaaauacuguaucagauuuaccacuugacucuaauugucucagguuguagcuaaaggcaauuauucuacucugauuaggaagccuuguuuuaugaaucuguuguuaaaccaaccccuaauuccagcuuucuaauagcccagcgcccugguucuuuguucuuuccucuaagguccugcuuucugguuauauauccuuggucucccauaucaugccagagccugcacucagcacacuuuggguuuaaaggccucacauuaguucucuugacuaugucuucuccaaaagauuuuugcuaggauaguguguaguucagugauagagcauuugccuaggaugugaaaagccacgggguuucuaaacauagcaacacaca

SEQ ID NO: 9894 - RNA, 2501 nt, Mus musculus
uguguguugcuauguuuagaaaccccguggcuuuucacauccuaggcaaaugcucuaucacugaacuacacacuauccuagcaaaaaucuuuuggagaagacauagucaagagaacuaaugugaggccuuuaaacccaaagugugcugagugcaggcucuggcaugauaugggagaccaaggauauauaaccagaaagcaggaccuuagaggaaagaacaaagaaccagggcgcugggcuauuagaaagcuggaauuagggguugguuuaacaacagauucauaaaacaaggcuuccuaaucagaguagaauaauugccuuuagcuacaaccugagacaauuagagucaagugguaaaucugauacaguauuuuguaaaaugucccugcccuggacccaucggaucacuaggguuuggucagaggaaaugccggcucggaucguggagcuuuccaacuccuggcaggacgccaagcucugaaguccuccgggauacuccggcccacuuccaaugcucgagaacgcacugcacugacucuuuuuaaugcauugacuugggacaaaugugcauuuaaaaucuggcagggaggagucuuggagauugcuggccugggggcugcagcgaugggcuuugagaaggcaaauaacaggggacugcuuuuucuccugaacgaaucgcaggccugucccauauccccgcgggcugcagagucggcaaaggggcaggcggggguuggggggcgguaagccagggacgcuccccggagcgcgcucaggugcaucaggcgcugcuccacagcugcucccgcgccgcuuugggaaugaggcucgacucuagucccagcuuucccgcccgcaggcugggggcggggcgggcccagccacauucucccccaccccacccccccgcccacgcccacgcauccuccgggcgucugucuguccagcguuccccgcgagagacguggccgggagcagugagaaggcgccagacucuaggcgaggcgucgugguaaaugcgaacucuggauucgggcucccuuagcucgcgccccuccccucuccucccuucguugcaccccuucacuuccaccucccaccccuuuagcugaauugcguuggggugagaacggccaaggcuuuguuccuccugcgggcggagaucgcuggcuucuucgcauccaagccuccucucuccaccccaucucacgaaaacccuacuaaaaucacuccuucauccagaguucccaguaacuccucccuucccacucucuccuggguuuuuggcccggaagccugccuccuaccgaguccccacuucggcuagccacaaggagucuggccugugaguccggguguaggaagaccccagcaugcagcucgagagaccauucugcacugccuauuagcacuucaaugaguuuuguuuucaaaacggcagagaacuaacucuucagggcaaccaaaaugcaaaguaacgcaagugaauacaauuggaacuuagaauguggagcgcgacucugcagaagccagcagccagagugcccucugccuucacuugauaugcgagaaaaacccagcagugugucaagauggaagguggggccagauccaaaccucugcaauucgggggaucauucaggugucaaccggaggguacccaccucccauaaucuugaaauuaagcucuagcagauggugguuaugacuccaggauuggaaugaaaaggugugaagguggugggugaggcugguuugccauuaagauccucuuuccagagcccagcauguaauucacagcuaaucuguuuauggaaaugauuggauguguuuauggauugauuuagaacgaguggguucagaaggaaacgccucucgguuaaauagaacuguucagguugaacaggucuuaguuaaacaucgggaaccuaccuuuccucaaggaguuccagguuccgcuccuauguggggagcggguguggcggcagucccaaaggugccagggacuguagcuaagucauaugacuugcaccugacuuccucauauaagacacaaacaucuugagugcugcgcagguguaccaggauacaggugaauccaauuugguggagauuugccccugcugcccugauuagcugaagccucgugacuggcgagggggcguggccugcugugcguggaugggaacugagaguauaaaagagugagaggcccaggguucgggggagauauaaaaacaagggagauauaaaaacaagggagauauaaaaacaagggagauauaaaaacaagggagauauaaaaacaagggagauauaaaaacaagggagauauaaaaacaagggagauauaaacaagggagauauaaacaagaagaaacaggacugaauaaacgugugcagaaggauccuguagcagcgucguucuuccuggccaguugagcaugcgcaacagaagugaugccgaaacccgggaaaagaaacaucuucaggcaagagcg

SEQ ID NO: 9895 - RNA, 2501 nt, Mus musculus
uccuuggcaagccagguuuaaucauucucuuaaccaaaaacaaggaagagaauuugauaauuugccuaaaaaaugagcagaugcuaagaaggacacauuuccauccuacguucccuccuccccaguuucagucagaaaugaaaacuacucucuucucccucuuuuccaggcaaaagaaagggcugauuuuacuaagcaagcaagaugccaacagccuccuccuccucaguaguccaaguuuccuucgcuuucaaccaccaaaagcgccacuucuccccuauuucccacccacuccuugccaccccugaagguuuccgagucaucagggaacacgagugggugaaaacagcgccgccgccuccuccuccgccuccucagugcgccucggguucagcacuggacagcucccgccccagccaacaaauggcagucagcugauugacagaggcgccgaccaaacagggcacaagacgacuugaagccgcccuacaaggguuugguugcggccaagcugucucuuuaaacugcuuucaucugagagcagagaaaggcagcgcugugguuuguggccaaaccuaaaggcucuaguuaaucagcugccuggcugucuggacugcagacacacgaacgucuucaaagaaaaccuugguuccuugggacucgccgcugagcucgcggcuuggaucugugugcgcgcuuccaucuccgggcgaagcggucgaggaggggccagaacugggaggcgggaacgaccugccaagggugagaugauggagcagcaucuuugguggccgcgguggcaacaucagcugcaucagcagcaucagcaucagcucuugaacacaccucaaugagagcggcgguggaagcggcugagcagaaagacguaagcgggcuaacuauagcugcuggggauguaaccuguuuggcucaaggcugcgaggugcguaaucccgagccgacccauuguggagccgggcgcagccagcauugccacaggugauuuggucugugacggcagcugagccagcugggccaauuucaaaacauucuuauuuuaaaguccaucuggacugggcgccaccuggagaagaaggaagccuccccucaaaagucuuacugaugauaaauugaggaccaaaauuuacaaagugacuccuccgguuaucgccucucuucuaugcuagacagaugggagccauggcuuacucuuuacucuucugccuccugcucgcucaucugggauugggagagguuggugccagccucgacccuccgggacggccagauuccccucgagagaggacuccgagggggaagcagcauggucagcagcugccgcgagccucugccccagaccccucuauucccuggagccgcuccacugacggcaccaucuuggcacaaaaacuagccgaggaggugcccguggacguggccucuuaccucuacacuggggacuuccaccagcugaagagagccaacugcucaggccgcuacgaguuggcuggccugccgggaaagucaccgucccuagccagcucccauccuuccuugcacggggcgcuggacacucugacacacgccaccaacuuccucaacaugauguugcagagcaauaagucucgggaacagaccgugcaggaugaccugcagugguaccaggcucuggugcgaagucuccuggagggugagcccagcaucucccgggcggccaucaccuucagcaccgagucgcuguccacgcccgccccgcaggucuuccuccaggccacccgcgaggagagucgcauccugcugcaggaccuguccuccuccgcucaccaccuggcuaacgccacucuagagaccgagugguuccaugggcuucggcgaaaguggaggccccacuugcaccgccguggcuccaaucaggggccacggggccuaggccacagcuggcggcgcagggaugggcuuggaggggacaggagccacgucaagugguccccaccuuaucuggagugcgagaaugggaguuacaagccuggguggcuggucacgcucucugcugccuucuacgggcuucaaccuaaccuggucccggaauucagguagggagaggguuggaaagggcacacgcagagucauccuuugguuuuguaaauggccauccuggggaagcacacuugucugccagugagacuuuaagucuucagccuuggaacugaacuucagacuaagggaugcggaggcaagcucguguggggaggggugagaagugcccgggucugucuacuuuaggcacucauggaaagccuuuccuugcugugcaguggugguggcggagggucaggggacauagcaauuggccccaauccuuccauagcauagggggagaagauuaauggugguguccccgaacuuugggcccaucagacagagucaagagcaccaggugugugugugugugugugugugugugugugugugugugugugugugugugugagagagagaga

SEQ ID NO: 9896 - RNA, 2501 nt, Mus musculus
ucucucucucucacacacacacacacacacacacacacacacacacacacacacacacacacaccuggugcucuugacucugucugaugggcccaaaguucggggacaccaccauuaaucuucucccccuaugcuauggaaggauuggggccaauugcuauguccccugacccuccgccaccaccacugcacagcaaggaaaggcuuuccaugagugccuaaaguagacagacccgggcacuucucaccccuccccacacgagcuugccuccgcaucccuuagucugaaguucaguuccaaggcugaagacuuaaagucucacuggcagacaagugugcuuccccaggauggccauuuacaaaaccaaaggaugacucugcgugugcccuuuccaacccucucccuaccugaauuccgggaccagguuagguugaagcccguagaaggcagcagagagcgugaccagccacccaggcuuguaacucccauucucgcacuccagauaagguggggaccacuugacguggcuccuguccccuccaagcccaucccugcgccgccagcuguggccuaggccccguggccccugauuggagccacggcggugcaaguggggccuccacuuucgccgaagcccauggaaccacucggucucuagaguggcguuagccagguggugagcggaggaggacagguccugcagcaggaugcgacucuccucgcggguggccuggaggaagaccugcggggcgggcguggacagcgacucggugcugaaggugauggccgcccgggagaugcugggcucacccuccaggagacuucgcaccagagccugguaccacugcaggucauccugcacggucuguucccgagacuuauugcucugcaacaucauguugaggaaguugguggcgugugucagaguguccagcgccccgugcaaggaaggaugggagcuggcuagggacggugacuuucccggcaggccagccaacucguagcggccugagcaguuggcucucuucagcugguggaaguccccaguguagagguaagaggccacguccacgggcaccuccucggcuaguuuuugugccaagauggugccgucaguggagcggcuccagggaauagaggggucuggggcagaggcucgcggcagcugcugaccaugcugcuucccccucggaguccucucucgaggggaaucuggccgucccggagggucgaggcuggcaccaaccucucccaaucccagaugagcgagcaggaggcagaagaguaaagaguaagccauggcucccaucugucuagcauagaagagaggcgauaaccggaggagucacuuuguaaauuuugguccucaauuuaucaucaguaagacuuuugaggggaggcuuccuucuucuccagguggcgcccaguccagauggacuuuaaaauaagaauguuuugaaauuggcccagcuggcucagcugccgucacagaccaaaucaccuguggcaaugcuggcugcgcccggcuccacaaugggucggcucgggauuacgcaccucgcagccuugagccaaacagguuacauccccagcagcuauaguuagcccgcuuacgucuuucugcucagccgcuuccaccgccgcucucauugagguguguucaagagcugaugcugaugcugcugaugcagcugauguugccaccgcggccaccaaagaugcugcuccaucaucucacccuuggcaggucguucccgccucccaguucuggccccuccucgaccgcuucgcccggagauggaagcgcgcacacagauccaagccgcgagcucagcggcgagucccaaggaaccaagguuuucuuugaagacguucgugugucugcaguccagacagccaggcagcugauuaacuagagccuuuagguuuggccacaaaccacagcgcugccuuucucugcucucagaugaaagcaguuuaaagagacagcuuggccgcaaccaaacccuuguagggcggcuucaagucgucuugugcccuguuuggucggcgccucugucaaucagcugacugccauuuguuggcuggggcgggagcuguccagugcugaacccgaggcgcacugaggaggcggaggaggaggcggcggcgcuguuuucacccacucguguucccugaugacucggaaaccuucagggguggcaaggagugggugggaaauaggggagaaguggcgcuuuuggugguugaaagcgaaggaaacuuggacuacugaggaggaggaggcuguuggcaucuugcuugcuuaguaaaaucagcccuuucuuuugccuggaaaagagggagaagagaguaguuuucauuucugacugaaacuggggaggagggaacguaggauggaaauguguccuucuuagcaucugcucauuuuuuaggcaaauuaucaaauucucuuccuuguuuuugguuaagagaaugauuaaaccuggcuugccaagga

SEQ ID NO: 9897 - RNA, 2501 nt, Mus musculus
cugaggccagugcccuuuccacuggcucuguccucaaggguugccagggcuugaagcaacgucuuuccuacacucccucccucuuuugccuuagaugcguuuuccuccuacacuuccaggucuuucccucugugguuaggcuccaucaccuguuauauuuucaccaaacuuccagagacugggauccuuuuaggaucugugggguccuuuugcugaguaggaaugggauugugucugggguauggagcaaggcacugcuggcugcauuguaugcagaacugguggcuuugaucguguucuuuaggucucaguggggaggccaauggucacaucagcucuauucugggcucaaggccaagccaagacuggagcucuggacaggugguuggcagugcugggcauuggcucucugccuagcccccgcccaaguugaggaaccagcagagggacagaaacuguuguguuagggcaggagaguuaauacuugugcaggugaggcugagacggcuuuggggcaccuugacuccaaagcccgaagccgcacaugcgggguucuuuuuucucgcggcuuccgccgcaacucucucugcugcugcugcugucguugaggcgagucuggacccaggaggauauuggaacugccccuucuaaauccccgguggcccccgaaugccccgaggcauguucauguucacuaggcggcaaggccaauugcuccgcacucgcgcugccugcgguaccagcggaccugagcuggcaaguacgcucacugcugcuggaucacaaucgcgugagcgcgcugccuccgggugccuucgccaaugcaggcgcgcugcuauaccuagaucugagggagaaccggcuucggucggugcacgcacgagcuuucuggggucugggaguguugcaauggcuggaccugagcuccaaccagcuggaaacucugccuccuggcaccuucgcgccgcugcgcgcgcuuaguuuccucucccuagcggguaaccggcuggcacuccuggagccuucgauccugggcccgcuuccauuacugcgagugcucagccugcaggacaauucacuaucggcaaucgaggcggguuugcugaauaacuugccugcccucgauguguugcgcuugcauggcaaccccuggacgugcaacugugcgcugcguccccuuugcacuuggcugcguaagcacccgcguccagccucaggugagccaucuggggcgcaggacggauaauguuuggugcaauugcugccaucugacgccgcuccugugucccgcagaaacugagacccugcucugcgugucuccaagacuccagacgcucagccuacugacagcuuuuccggaugccgccuucaaacagugcacucagucacuagcagcgcgagaccuggcgguggucuacgcucucgggccggucucuuuccuugcuaguuuggccaucugccuggcauugggcuccgugcucacugcuuguggugcacggcgccgccgccgccgccgcaccacggugcgccacuuacuaaggagacagcuagaccccgagggcccacccucccuggaggaugcugggagcccuguaacagcagcuauccaagccuaaggggacugcagguuguuucuagugcuccugaagugccuccguacuuugagaacucuccccaaaucccugauccucccuucacauucccuguaggcgucaacaauagacaaaacccggaaauuuucugacauuccuuuaggcaucaccacugaauaccgggauuaggggugguuaugcgcgcccggugucccuggggcagaggggcagcgcgcugcugcgccccaguggcucggggaaggcacgcgcuuggacacugggagagcuagucauguacaagguugggugagugacaccggacugggaggcggauggcacucccuggugcccaaggugcggggcuccucucaagccagcgucugaggaagccuauuguggcugcagacagaagagaaggcucagcccucuuggagucuggagcccuagacaucugggagccagagagcaccccugggaagcgcugccacuagggcagugaaggcuagcccugggaaaggucggagccagcccagugaauggggugggaagggucgugggaggauugugcagcaggagagaaagagagauagagguggaagucagguugcagagagcaggcgcuggaggagggguggagggugaccuagcaagcuggggccaugggcccccacuguagcuugggguaguggcuggaggaaggauggggcugccauuucugcuccaggcuccuccgaccggggccacuuaggccccucaccccacugcucagagaccucagggcccugccucugccggagcgcccuguggcccugcccagccggcucagcucuggcccauccucagccgcucugguccgcaccuugguccugcaggggcugcccgccaggcagcagagcaggaggacgggag

SEQ ID NO: 9898 - RNA, 2501 nt, Mus musculus
cucccguccuccugcucugcugccuggcgggcagccccugcaggaccaaggugcggaccagagcggcugaggaugggccagagcugagccggcugggcagggccacagggcgcuccggcagaggcagggcccugaggucucugagcaguggggugaggggccuaaguggccccggucggaggagccuggagcagaaauggcagccccauccuuccuccagccacuaccccaagcuacagugggggcccauggccccagcuugcuaggucacccuccaccccuccuccagcgccugcucucugcaaccugacuuccaccucuaucucucuuucucuccugcugcacaauccucccacgacccuucccaccccauucacugggcuggcuccgaccuuucccagggcuagccuucacugcccuaguggcagcgcuucccaggggugcucucuggcucccagaugucuagggcuccagacuccaagagggcugagccuucucuucugucugcagccacaauaggcuuccucagacgcuggcuugagaggagccccgcaccuugggcaccagggagugccauccgccucccaguccggugucacucacccaaccuuguacaugacuagcucucccaguguccaagcgcgugccuuccccgagccacuggggcgcagcagcgcgcugccccucugccccagggacaccgggcgcgcauaaccaccccuaaucccgguauucaguggugaugccuaaaggaaugucagaaaauuuccggguuuugucuauuguugacgccuacagggaaugugaagggaggaucagggauuuggggagaguucucaaaguacggaggcacuucaggagcacuagaaacaaccugcaguccccuuaggcuuggauagcugcuguuacagggcucccagcauccuccagggagggugggcccucggggucuagcugucuccuuaguaaguggcgcaccguggugcggcggcggcggcggcgccgugcaccacaagcagugagcacggagcccaaugccaggcagauggccaaacuagcaaggaaagagaccggcccgagagcguagaccaccgccaggucucgcgcugcuagugacugagugcacuguuugaaggcggcauccggaaaagcugucaguaggcugagcgucuggagucuuggagacacgcagagcagggucucaguuucugcgggacacaggagcggcgucagauggcagcaauugcaccaaacauuauccguccugcgccccagauggcucaccugaggcuggacgcgggugcuuacgcagccaagugcaaaggggacgcagcgcacaguugcacguccagggguugccaugcaagcgcaacacaucgagggcaggcaaguuauucagcaaacccgccucgauugccgauagugaauuguccugcaggcugagcacucgcaguaauggaagcgggcccaggaucgaaggcuccaggagugccagccgguuacccgcuagggagaggaaacuaagcgcgcgcagcggcgcgaaggugccaggaggcagaguuuccagcugguuggagcucagguccagccauugcaacacucccagaccccagaaagcucgugcgugcaccgaccgaagccgguucucccucagaucuagguauagcagcgcgccugcauuggcgaaggcacccggaggcagcgcgcucacgcgauugugauccagcagcagugagcguacuugccagcucagguccgcugguaccgcaggcagcgcgagugcggagcaauuggccuugccgccuagugaacaugaacaugccucggggcauucgggggccaccggggauuuagaaggggcaguuccaauauccuccuggguccagacucgccucaacgacagcagcagcagcagagagaguugcggcggaagccgcgagaaaaaagaaccccgcaugugcggcuucgggcuuuggagucaaggugccccaaagccgucucagccucaccugcacaaguauuaacucuccugcccuaacacaacaguuucugucccucugcugguuccucaacuugggcgggggcuaggcagagagccaaugcccagcacugccaaccaccuguccagagcuccagucuuggcuuggccuugagcccagaauagagcugaugugaccauuggccuccccacugagaccuaaagaacacgaucaaagccaccaguucugcauacaaugcagccagcagugccuugcuccauaccccagacacaaucccauuccuacucagcaaaaggaccccacagauccuaaaaggaucccagucucuggaaguuuggugaaaauauaacaggugauggagccuaaccacagagggaaagaccuggaaguguaggaggaaaacgcaucuaaggcaaaagagggagggaguguaggaaagacguugcuucaagcccuggcaacccuugaggacagagccaguggaaagggcacuggccucag

SEQ ID NO: 9899 - RNA, 2501 nt, Mus musculus
ggugaggcuggggcaaaggccccagccagccuggcggcacaaacaggaaggacagcaggcucuggcagccagaagccuguggccccaagcuggcaggauggcccccuuccugcaggucccccacagccuucuggguuccugacacgagagaagagguggggcggggugaagugaacucugaagccaaaaugugacucuccuggggucaccagcuuggggagaggugaagaaagaugccggggcggaaacaaaggggcagauaucacuaugguuaucuuacuaagcacagaguaacugaaaaagcaaggguaccgcugcccaccucgugcccaccuuacguuauaccucaaaccagcuagauaguuucugauggcacccauacccucccuuccccuuuaggcauugcgcaagcucuccaccacaaucuggaaguuauacccugcgaggggaugggcagggcacuucugaggugccaaucagccugcacucgccucugcccuggccauggcacugcugucaguuucuugguaccugucucaacagcagccuugucacgugagacuauggcuggcggugggggugggggcaggaauccuagaagcacaggagugacauagggucgggucgggcagagcgaaguguaggaagugauccccaaagggaugcuggggacgaucuggccaacacuguccucccauucaaaacucccagucuggagcucugggacauggacaagccaggccugcuauucuccauacagggcuccauagugucuggcucagcagagugggggaucugguggggauggaggaagcuuagcuaaaagcuuuguauaggcugaagcucugagugacccugcugggccacccuacccuggucugggcugggucauugcauccccagauuggaaggcuuggugagauggagaggaaccuuggcuacaagcuauagcuuugcccaccagagccugcuggaggggaaucaaacaagccuggaccugaggcugggacuagcuuuccuguuucuggaguggaugccaacccccugcccaccagccugccuguccacgccagggacacacagacuccuucccuuuccagacuggaaagcccccuccugggagagcaggaaggaagcaaccugcaacucuuccagcccuggaccuugggcugaaccuacaguucaagguuuguaugcucacaggucuuggcagggaaagauaagaauccccagggcacccucccccccgccccccaguccacugcagguagcuccugggucugcccuucagggcaagugcugacgcuccaucagacugugauggggcccuuuucugaggaugacaauucugagaacaaggcauuuuucuagagguggcagaacagcauuuugugaugcccgaggaucugggagcacagguccagcuuaaugagggauuggaggaaguggguaucaucauuacagggaggggccucuguggccuccugggaaaaugcaguugcucucuuuggguggccugggguuguguggugggcagaggacggaggugcucauugggggaagggaucacuucugcucagagugcucgcaagggccuuuccuuuuccugaaggcaagcaggccuccuccuccuccucuuccuccuucuccucuuccuccucuuucuccauaugccuagcuggucauuucuagggaccagcaugguugggaagggggccuugucuuggccuuccucuugucucaauucccucuuugagcagaagacggggugggugggguaggguuggauagugguugaugccaaagauugaagggguagggcggggcagaagugggaaggucccuggcuuccucaccuugguagauggugaggagccccagagguugagcugagcagcagcugugauuucagggugccucuguuggagaggcugcugugauuugaaaaucuucuuuccuuggugacaauuccagaaggcuccagaugaauuguauuggugagugccuggcccuuaagcagucccagcuggggaugauggggauuuaugggugucccugagccuagggugacagggccucuccuuuuuuuuuuauucugcuucaggguaccaccccaccaggaggcugcgggccuggggcggccuagcuggaggagcaacauucaugguaauuugguuuuucuggcuguggggaucagcuccuggaagugccccugugccucaguccacacucaccauccuuaucuggcacuggccuuucaccaaccggccgccagagcuaccuggugacaccugcacucgcuauggcauggccagcugccgucugagugcuaaccggagccugcuagccagugcugaugcuguggucuuccaccaccgugagcugcaaacccggcaaucucuccuaccccuggaccagaggccacacggacagccuugggucugggccuccauggaaucgcccaguaauacccauggucuccaucgcuuccggggcaucuu

SEQ ID NO: 9900 - RNA, 2501 nt, Mus musculus
aagaugccccggaagcgauggagaccauggguauuacugggcgauuccauggaggcccagacccaaggcuguccguguggccucugguccagggguaggagagauugccggguuugcagcucacggugguggaagaccacagcaucagcacuggcuagcaggcuccgguuagcacucagacggcagcuggccaugccauagcgagugcaggugucaccagguagcucuggcggccgguuggugaaaggccagugccagauaaggauggugaguguggacugaggcacaggggcacuuccaggagcugauccccacagccagaaaaaccaaauuaccaugaauguugcuccuccagcuaggccgccccaggcccgcagccuccugguggggugguacccugaagcagaauaaaaaaaaaaggagaggcccugucacccuaggcucagggacacccauaaauccccaucauccccagcugggacugcuuaagggccaggcacucaccaauacaauucaucuggagccuucuggaauugucaccaaggaaagaagauuuucaaaucacagcagccucuccaacagaggcacccugaaaucacagcugcugcucagcucaaccucuggggcuccucaccaucuaccaaggugaggaagccagggaccuucccacuucugccccgcccuaccccuucaaucuuuggcaucaaccacuauccaacccuaccccacccaccccgucuucugcucaaagagggaauugagacaagaggaaggccaagacaaggcccccuucccaaccaugcuggucccuagaaaugaccagcuaggcauauggagaaagaggaggaagaggagaaggaggaagaggaggaggaggaggccugcuugccuucaggaaaaggaaaggcccuugcgagcacucugagcagaagugaucccuucccccaaugagcaccuccguccucugcccaccacacaaccccaggccacccaaagagagcaacugcauuuucccaggaggccacagaggccccucccuguaaugaugauacccacuuccuccaaucccucauuaagcuggaccugugcucccagauccucgggcaucacaaaaugcuguucugccaccucuagaaaaaugccuuguucucagaauugucauccucagaaaagggccccaucacagucugauggagcgucagcacuugcccugaagggcagacccaggagcuaccugcaguggacuggggggcgggggggagggugcccuggggauucuuaucuuucccugccaagaccugugagcauacaaaccuugaacuguagguucagcccaagguccagggcuggaagaguugcagguugcuuccuuccugcucucccaggagggggcuuuccagucuggaaagggaaggagucugugugucccuggcguggacaggcaggcuggugggcaggggguuggcauccacuccagaaacaggaaagcuagucccagccucagguccaggcuuguuugauuccccuccagcaggcucuggugggcaaagcuauagcuuguagccaagguuccucuccaucucaccaagccuuccaaucuggggaugcaaugacccagcccagaccaggguaggguggcccagcagggucacucagagcuucagccuauacaaagcuuuuagcuaagcuuccuccauccccaccagaucccccacucugcugagccagacacuauggagcccuguauggagaauagcaggccuggcuuguccaugucccagagcuccagacugggaguuuugaaugggaggacaguguuggccagaucguccccagcaucccuuuggggaucacuuccuacacuucgcucugcccgacccgacccuaugucacuccugugcuucuaggauuccugcccccacccccaccgccagccauagucucacgugacaaggcugcuguugagacagguaccaagaaacugacagcagugccauggccagggcagaggcgagugcaggcugauuggcaccucagaagugcccugcccauccccucgcaggguauaacuuccagauugugguggagagcuugcgcaaugccuaaaggggaagggaggguaugggugccaucagaaacuaucuagcugguuugagguauaacguaaggugggcacgaggugggcagcgguacccuugcuuuuucaguuacucugugcuuaguaagauaaccauagugauaucugccccuuuguuuccgccccggcaucuuucuucaccucuccccaagcuggugaccccaggagagucacauuuuggcuucagaguucacuucaccccgccccaccucuucucucgugucaggaacccagaaggcugugggggaccugcaggaagggggccauccugccagcuuggggccacaggcuucuggcugccagagccugcuguccuuccuguuugugccgccaggcuggcuggggccuuugccccagccucacc

SEQ ID NO: 9901 - RNA, 2501 nt, Mus musculus
aggcuccggggccugggcuggcgaccgugagucgaugaccaggucagugaugagcucguccagcugcucgaggcugcgcuggcggcuugaagcaggacccucagggaccguggauacgggcugccguggucggccuccaggcaauucccagcccuuggcagucgggcgauccacugagcgcaggucguugucugugaugguaaucucuggcgugacguaccaguugcggcccaggcucucucccgcgcggcccuucucugucagcgacgucucggacagcgacagugcugcauagcgucugggugagguggacaaauucacuacgacugguggacgccgaccuucaggggaugaaccccucguaucccgaaccucgcgucccaggagguucucauagcugcggccgcguccuagaggaucuucacgacgaggaccaggagcuaggauguugucccaggaucgagaguaguggcggcuaucgguggccagccggggugggcuugugccggugccgccgugccacgaggccaacagugguccaggggcgggaggcggcauuaccugaagggugcgguaaggccucggaccccagucagcccagggugggcugcugcgcgggugcggguaaguccgagccaguacaucgcguucucgguaccucccaaaguccucgguguagaaagugcgggcuccagggugcgcccggggcucuucugggacauaccggggaacgaaaggcauaccguaggcucgaguugucuccccguaguaggagcgggaggggggcuccuggaucgggaaggugcguacuucgccagcauaguagcugcccccacgccuuggacugggucuaggggguucuucggacaaguagggccuggaacaguagccaucaaagggaaggccggggcuugugguaaagcugccugcguagcccucuggcuccucgguguagaagaauugggugggaccuggaggcguugugaaggguugacugcggugcuccaaguagucccggggcccaggcaguggcccgucacaguacagaguucuggggucaguacaguacaagucacuggggguaggagugcgugacagggccacguggcgagggccgggaacugugaggccauggaacuguggagcugugcgagcccaggacgucgucucucuaggugcgcaagaucgcgagcuucgggcggcgugcugcagcacugccucguccggcuugauguccaaacggcagcggacaugggggacagguccagagggugguuccgguggugcgcagcggccugggguggcgcauagaggcgcgaugcguccggggccuccccgcuguggcuggagcuugauggggugcagcucauuagcgagagcucucagcgcaggauacgagggcucccggcgcggcgaccccuccacccgcacugcacgcugggcuucccgaccucugcguugcaguacgggcggcgaagcuggagcagucgccaggccuugggacgcacggggcgcgcucuuggaacgggugcggcgccgaggcucgcugucucugggucgggcgcgcgguggcgcagguucaggagguggcggcucugggugugucuccauggugggcucguccagugccucuaagaagucaaaacuacggcaguggcgcuuguugaaaggcgugggcgcagcaggccgggccacggaucgcucacauggcuggcguuuggacgugagcccuggguccaccaccuugauguccugguacacggucgacaccagcaaguccggcggguccgugcgggucaucuuaaaagacguccccaggcuggcagcuccagucacacggccuuucggggauuuugcccugggaggagauaccggucagggcagccuccucugcaccccaagcccuuuaccccaccccaccccacgugcugguccggcuuaccuggggcauaggggauggugcagccuuggcugcaggucauggucaaggcuucuggugcugccuccaugccuauguuagauguaccugcaggagaaagcucacaguccaugcgaccugugggguagaugggccaggagaauuuaggcuacuguggaccuucuuuguagagggaacuccugaguuaaaccugccaggcauucucucccccuacuagggucgguugggcaggcuuagguagaucaaagcgggacgugaucucagcacuacugcccucuggugccuacaguuggaacgaugcacuuuuagauuuccuuacagguagacccucugauaaugcagagucccaggugagucaaugaaugguuccugccugccgacuaggcugggcagagaacucuucuccuagcacucaaguccuuuuuaacuaagcguaaguccccucaacucgaugagguccuaggcagaggaaugaucccagaguuuucuugggucucaaaucccucuuccuuuugcauaaaucuuggaccccaguugcuugaaugaaacccaccaagcuugc

SEQ ID NO: 9902 - RNA, 2501 nt, Mus musculus
gcaagcuugguggguuucauucaagcaacugggguccaagauuuaugcaaaaggaagagggauuugagacccaagaaaacucugggaucauuccucugccuaggaccucaucgaguugaggggacuuacgcuuaguuaaaaaggacuugagugcuaggagaagaguucucugcccagccuagucggcaggcaggaaccauucauugacucaccugggacucugcauuaucagagggucuaccuguaaggaaaucuaaaagugcaucguuccaacuguaggcaccagagggcaguagugcugagaucacgucccgcuuugaucuaccuaagccugcccaaccgacccuaguagggggagagaaugccuggcagguuuaacucaggaguucccucuacaaagaagguccacaguagccuaaauucuccuggcccaucuaccccacaggucgcauggacugugagcuuucuccugcagguacaucuaacauaggcauggaggcagcaccagaagccuugaccaugaccugcagccaaggcugcaccauccccuaugccccagguaagccggaccagcacgugggguggggugggguaaagggcuuggggugcagaggaggcugcccugaccgguaucuccucccagggcaaaauccccgaaaggccgugugacuggagcugccagccuggggacgucuuuuaagaugacccgcacggacccgccggacuugcuggugucgaccguguaccaggacaucaaggugguggacccagggcucacguccaaacgccagccaugugagcgauccguggcccggccugcugcgcccacgccuuucaacaagcgccacugccguaguuuugacuucuuagaggcacuggacgagcccaccauggagacacacccagagccgccaccuccugaaccugcgccaccgcgcgcccgacccagagacagcgagccucggcgccgcacccguuccaagagcgcgccccgugcgucccaaggccuggcgacugcuccagcuucgccgcccguacugcaacgcagaggucgggaagcccagcgugcagugcggguggaggggucgccgcgccgggagcccucguauccugcgcugagagcucucgcuaaugagcugcaccccaucaagcuccagccacagcggggaggccccggacgcaucgcgccucuaugcgccaccccaggccgcugcgcaccaccggaaccacccucuggaccugucccccauguccgcugccguuuggacaucaagccggacgaggcagugcugcagcacgccgcccgaagcucgcgaucuugcgcaccuagagagacgacguccugggcucgcacagcuccacaguuccauggccucacaguucccggcccucgccacguggcccugucacgcacuccuacccccagugacuuguacuguacugaccccagaacucuguacugugacgggccacugccugggccccgggacuacuuggagcaccgcagucaacccuucacaacgccuccaggucccacccaauucuucuacaccgaggagccagagggcuacgcaggcagcuuuaccacaagccccggccuucccuuugauggcuacuguuccaggcccuacuuguccgaagaacccccuagacccaguccaaggcgugggggcagcuacuaugcuggcgaaguacgcaccuucccgauccaggagccccccucccgcuccuacuacggggagacaacucgagccuacgguaugccuuucguuccccgguaugucccagaagagccccgggcgcacccuggagcccgcacuuucuacaccgaggacuuugggagguaccgagaacgcgauguacuggcucggacuuacccgcacccgcgcagcagcccacccugggcugacugggguccgaggccuuaccgcacccuucagguaaugccgccucccgccccuggaccacuguuggccucguggcacggcggcaccggcacaagcccaccccggcuggccaccgauagccgccacuacucucgauccugggacaacauccuagcuccugguccucgucgugaagauccucuaggacgcggccgcagcuaugagaaccuccugggacgcgagguucgggauacgagggguucauccccugaaggucggcguccaccagucguagugaauuuguccaccucacccagacgcuaugcagcacugucgcuguccgagacgucgcugacagagaagggccgcgcgggagagagccugggccgcaacugguacgucacgccagagauuaccaucacagacaacgaccugcgcucaguggaucgcccgacugccaagggcugggaauugccuggaggccgaccacggcagcccguauccacggucccugaggguccugcuucaagccgccagcgcagccucgagcagcuggacgagcucaucacugaccuggucaucgacucacggucgccagcccaggccccggagccu

SEQ ID NO: 9903 - RNA, 2501 nt, Mus musculus
aaagaacgggggcgccggccccgucccacguccgcucccgccccgggccagccccuuccucgccgcgacucgcccgcuauccccacccccucgcccucggcgcccagugggaggcggggaccggccuugcugagcggggcgccgggcucugauuugcugcgggcguugggggcgguggggggugggggaauccacagccuccgcguugucugccagcagcgagggagggagggaaaggggggaaaagugcucagcgccgaaggcgagguccgcacuccugguccccgcggcuggcgcaggaccucacuccagcggagcgcccacggggagcgggucgcggggcagcagcggugaggaggccacgagacuagaaggaggaggacagggagugcgcgagcagccagcgagggggucccggccgucccgggccacagucgaucccugcgccgugggcgagcgcgcccgcugccucuuccagaacagccaccgccgcgggggagaucgggcgggugccgagcuuccuaugacucccugaaguugucgugcuccccuagcguccgccacccgggacgugucucugguccccgugcaucgugugcgucucccgcuccccggcccgcgcaccccgccggcauggacguacacacccgcuggaaagcugcgcgcccaggcgcccugcugcugucuucgccgcuacuccuguuccugcugcugcugugggcgccgccuucgagccgcgcagguaagagugcucuggggaccggaccucggggacuguaagaggugcgcagaaccuccgcgccgcugucaucucgggcuccuucgccgccggccuccuccgagccugcagaacuuuccuccuuggccuguggaaugcaccgggcaagacaacgaauaccauucguugggggcccaggagagggagccgggccaacuccauccccgcggcguaccgcccccuccucaaacgggccugcuggguggggcuguuggucgagucaaggaagaaucugccucguguuagaucccagcagaggugcucacacuuuuguccccaaaccucgcauuuucugucccacaucacaggcgacccgcugcaucccacgcagcccuuaagcagaaacuuuccuucugaaagcuggaaagggccgcccccuagagucaaggccauucaguuccucagggacgccuagggguggagggggaucccagaaguuugaaaccccagcuauggacuucccucuguacacacccucuugcuugucugagcuaaguuucugcaauucccaggggacagaguucccuguagucccugacaagucuucaggggcacuggggagcccugugagguaggccagcccuacuccuagccgucaaaccuccaaaccccuuagagguaguuuucuugggcuuucugcccaaagaugggaugaacgggaagccuggagagggccuuggagucugggcugggagcuucucagaugaucugcagaugugagacuccugccagguuggguucucugaaggagcccugauccaaugggcagaaucagggagguacugggauugucccugucuguauuucagcgcuuucaggcucaggucugggcaggcauauuauuuucagcaucacucuuguuaguuaguugugggauaaaccuccccagagcccuuaaacaccauagcccagggugggaaggcaccaggcaugugcugauacagggaggcgaaggcaguuagaaagaguucaggcagccgaacagcggguggaguggucagcccuugcgcagugacagggcucuccuuagcuuagcugguguuacuaggacuagcaggagaauccauuuccaccccccauggccaauuacaauauucuucuccugcuuucuggcaccauuaguguccaguggccacaggaugagcaagaguggaaaugggaggggccagggccugcggggaccgagggagagcaugggcugacgaugcucacucuuguggaacuuggaccaacugccccggaguucccaggguuaagcuagcaguagggaaugcugaaggcccucaggaaaguguggaggagagacaagagaggucagccucucuuuucccuauacccccacaauguuccccugugcgccccagaaccccaggagggaagccuucaguggaccucucgccugggaagcugggguuaccacuagcauagguuggguguuccggguucacccuguccacccuguaccuugucccagcccugcccuguccuguggccaccuaccucucuucgucacucuauuacuaugcucugccccacuucccugugcuguugagggugcggccauuuggaaggggcugccuggguccuggcugugcuguuagcuguuuugcuuuggacagaguugacuuuuagaagcacauaaagaaacugcuuuucugggugggcuucgggaagcuuuccccucugcuccuguggugcgacccacuuugaagucacccucagu

SEQ ID NO: 9904 - RNA, 2501 nt, Mus musculus
acugagggugacuucaaagugggucgcaccacaggagcagaggggaaagcuucccgaagcccacccagaaaagcaguuucuuuaugugcuucuaaaagucaacucuguccaaagcaaaacagcuaacagcacagccaggacccaggcagccccuuccaaauggccgcacccucaacagcacagggaaguggggcagagcauaguaauagagugacgaagagagguagguggccacaggacagggcagggcugggacaagguacaggguggacagggugaacccggaacacccaaccuaugcuagugguaaccccagcuucccaggcgagagguccacugaaggcuucccuccugggguucuggggcgcacaggggaacauuguggggguauagggaaaagagaggcugaccucucuugucucuccuccacacuuuccugagggccuucagcauucccuacugcuagcuuaacccugggaacuccggggcaguugguccaaguuccacaagagugagcaucgucagcccaugcucucccucgguccccgcaggcccuggccccucccauuuccacucuugcucauccuguggccacuggacacuaauggugccagaaagcaggagaagaauauuguaauuggccaugggggguggaaauggauucuccugcuaguccuaguaacaccagcuaagcuaaggagagcccugucacugcgcaagggcugaccacuccacccgcuguucggcugccugaacucuuucuaacugccuucgccucccuguaucagcacaugccuggugccuucccacccugggcuaugguguuuaagggcucuggggagguuuaucccacaacuaacuaacaagagugaugcugaaaauaauaugccugcccagaccugagccugaaagcgcugaaauacagacagggacaaucccaguaccucccugauucugcccauuggaucagggcuccuucagagaacccaaccuggcaggagucucacaucugcagaucaucugagaagcucccagcccagacuccaaggcccucuccaggcuucccguucaucccaucuuugggcagaaagcccaagaaaacuaccucuaagggguuuggagguuugacggcuaggaguagggcuggccuaccucacagggcuccccagugccccugaagacuugucagggacuacagggaacucuguccccugggaauugcagaaacuuagcucagacaagcaagaggguguguacagagggaaguccauagcugggguuucaaacuucugggaucccccuccaccccuaggcgucccugaggaacugaauggccuugacucuagggggcggcccuuuccagcuuucagaaggaaaguuucugcuuaagggcugcgugggaugcagcgggucgccugugaugugggacagaaaaugcgagguuuggggacaaaagugugagcaccucugcugggaucuaacacgaggcagauucuuccuugacucgaccaacagccccacccagcaggcccguuugaggagggggcgguacgccgcggggauggaguuggcccggcucccucuccugggcccccaacgaaugguauucguugucuugcccggugcauuccacaggccaaggaggaaaguucugcaggcucggaggaggccggcggcgaaggagcccgagaugacagcggcgcggagguucugcgcaccucuuacaguccccgagguccgguccccagagcacucuuaccugcgcggcucgaaggcggcgcccacagcagcagcaggaacaggaguagcggcgaagacagcagcagggcgccugggcgcgcagcuuuccagcggguguguacguccaugccggcggggugcgcgggccggggagcgggagacgcacacgaugcacggggaccagagacacgucccggguggcggacgcuaggggagcacgacaacuucagggagucauaggaagcucggcacccgcccgaucucccccgcggcgguggcuguucuggaagaggcagcgggcgcgcucgcccacggcgcagggaucgacuguggcccgggacggccgggacccccucgcuggcugcucgcgcacucccuguccuccuccuucuagucucguggccuccucaccgcugcugccccgcgacccgcuccccgugggcgcuccgcuggagugagguccugcgccagccgcggggaccaggagugcggaccucgccuucggcgcugagcacuuuuccccccuuucccucccucccucgcugcuggcagacaacgcggaggcuguggauucccccaccccccaccgcccccaacgcccgcagcaaaucagagcccggcgccccgcucagcaaggccgguccccgccucccacugggcgccgagggcgaggggguggggauagcgggcgagucgcggcgaggaaggggcuggcccggggcgggagcggacgugggacggggccggcgcccccguucuuu

SEQ ID NO: 9905 - RNA, 2501 nt, Mus musculus
ccgcguugugcacucugaacagcagggcucaggaauuggagagcacaggccacacaaguggccuaggcacgcgugugcaaggcguucaugcuccagcgcuugcuggcgggauggccgcugccuaccugaaguaguccaucuugcaguagaucuccuuguucuugauguagcagcuauucugcugccucagcgaugugcgacacacggagcacucgaggcaccgcacgugccagaugagguuguugaccuggggagggggcagaggugggggucggcuuggcgcgggccucuuucacgcccgcccccagccuccccagccucauuugcagagacagagagacacugaagcucagaaggggcguauggcuucccuacuuuucuucuauaauacagagaggcucaaggaaauugagauacagccuugcauucucuuguuggaaccggggcaaaaggagaccuccuguuugggaacacuugcccaaagcugcgcgaucgguuagcgguuggauugggaggccgaggaaaauggaccuggcaaggucauugcuucccuacagcucuuggggcugcaaaccacacccgugggcaagcaggcacaccuacccugacucaccuugagcagauaccgguccaggaucuccagaccgcaacuggagcagauauucuugccggcagacggcacggaagaggcagcagagggcggcgagcagacagacggugugcugggcguacauggggaggcucuaccuucguccuuguccagagcgccugccaaggccucugcgucugacugagccugaaaugggagagaggaacagcgaagcgcuuagccgaguacucagaguugaaucugguuuccucgcgcaccgacugacaccgaaaugugccagggaugucgcgcccuaggcuggaguacaagaaugaaaggaccuauuggagaagaagggacggcccccaacuuuuaacacagcgcauccugggugcaggaagcagccaaagcucacauuccaggccagaaaaaccaaggcucaacgagaggcggcuccuaucggcaguuuuccagcgcagggguagagguugguagccggaaggcugagccagaagcccuggccugugcuguuggggggacucggggccgaaagcaggaccgaaaggacucaccauggcaggcggagcggucccuucgagacagcggguggucgcuuugcagccggacccuggcugggccaucaccugggggagggggagggaaugcaggcgacggcggcugcugaacuggcucggagcugucagagcccagcgccuccccucgccuguuauauaaaccggcgcugaacaaugaguccuaacuuuguagugggcauuuaaagcccuuccccacaaaagcggugucucucuaaugaagcaauuugaauuuggauuggguuuuuuucccucucucucccccucucccugcacuuaacccguggcucuugaaguaaucgcuuaguuccuuugcaauccaagccucugagggggaaaaaaaacacgcgcacacacacaaacuaccugcaauuagaaauugucgugaaugcccaagauaagagguagccagagugucaauuccaacugucaaucagugagauccaucaggccgcccaaagaauugcaaauuugauuuuuuaaugguaguaauuaaaaaucgaauuuuuuucucccuccgcccccucccuucuccuacucucgguacaaaaugcaaaaaggagaaaagagagaaagaaagaaaauaaaaaggagauggggguggugguggugguaguggugguggugguugagaaaauaaaacccagagcgcuaggagcauccgcccgcucgacgcgcgccgggaaauugaagcggggauauugacaccgauucaaacgccuuuggagggccaguucaagggaagccccaagccaaagagggcgagaucggcgagugaaaugaggccaaaaagagaaaagagaggccucuuggaggaggaaagagaacccuccagacucuuggagcucccgggaccggccccucaucgagauccucagcguugcgccggcacaaccucuggcgcaucggcgcuaucagcgucuauucagacggacaauacuggccucgccuccucuugauucgccuaugucuuugcuaaaucgcuuuuugagaaauuccuccaacauuugcauaauguguucccgcuuuccgcgaccccccacccccgccugcccgcucgcacgcucacacacuugcagacacacucucccgggcucacucagcaccccuccuuccugcugccgcccgccacccgacccggcccgguugaaucccggcucccgcuggccccaggauccccgacgcucacccacucgccugcuugcucaccuggucggugguggggccgcccuccgccggcaaccggcagcccucgggcagcgccggggcggcgcucucaugcuuccaguacaugggcccgggagcgggagggcucggug

SEQ ID NO: 9906 - RNA, 2501 nt, Mus musculus
caccgagcccucccgcucccgggcccauguacuggaagcaugagagcgccgccccggcgcugcccgagggcugccgguugccggcggagggcggccccaccaccgaccaggugagcaagcaggcgagugggugagcgucggggauccuggggccagcgggagccgggauucaaccgggccgggucggguggcgggcggcagcaggaaggaggggugcugagugagcccgggagagugugucugcaagugugugagcgugcgagcgggcaggcggggguggggggucgcggaaagcgggaacacauuaugcaaauguuggaggaauuucucaaaaagcgauuuagcaaagacauaggcgaaucaagaggaggcgaggccaguauuguccgucugaauagacgcugauagcgccgaugcgccagagguugugccggcgcaacgcugaggaucucgaugaggggccggucccgggagcuccaagagucuggaggguucucuuuccuccuccaagaggccucucuuuucucuuuuuggccucauuucacucgccgaucucgcccucuuuggcuuggggcuucccuugaacuggcccuccaaaggcguuugaaucggugucaauauccccgcuucaauuucccggcgcgcgucgagcgggcggaugcuccuagcgcucuggguuuuauuuucucaaccaccaccaccacuaccaccaccaccacccccaucuccuuuuuauuuucuuucuuucucucuuuucuccuuuuugcauuuuguaccgagaguaggagaagggagggggcggagggagaaaaaaauucgauuuuuaauuacuaccauuaaaaaaucaaauuugcaauucuuugggcggccugauggaucucacugauugacaguuggaauugacacucuggcuaccucuuaucuugggcauucacgacaauuucuaauugcagguaguuugugugugugcgcguguuuuuuuucccccucagaggcuuggauugcaaaggaacuaagcgauuacuucaagagccacggguuaagugcagggagagggggagagagagggaaaaaaacccaauccaaauucaaauugcuucauuagagagacaccgcuuuuguggggaagggcuuuaaaugcccacuacaaaguuaggacucauuguucagcgccgguuuauauaacaggcgaggggaggcgcugggcucugacagcuccgagccaguucagcagccgccgucgccugcauucccucccccucccccaggugauggcccagccaggguccggcugcaaagcgaccacccgcugucucgaagggaccgcuccgccugccauggugaguccuuucgguccugcuuucggccccgaguccccccaacagcacaggccagggcuucuggcucagccuuccggcuaccaaccucuaccccugcgcuggaaaacugccgauaggagccgccucucguugagccuugguuuuucuggccuggaaugugagcuuuggcugcuuccugcacccaggaugcgcuguguuaaaaguugggggccgucccuucuucuccaauagguccuuucauucuuguacuccagccuagggcgcgacaucccuggcacauuucggugucagucggugcgcgaggaaaccagauucaacucugaguacucggcuaagcgcuucgcuguuccucucucccauuucaggcucagucagacgcagaggccuuggcaggcgcucuggacaaggacgaagguagagccuccccauguacgcccagcacaccgucugucugcucgccgcccucugcugccucuuccgugccgucugccggcaagaauaucugcuccaguugcggucuggagauccuggaccgguaucugcucaaggugagucaggguaggugugccugcuugcccacgggugugguuugcagccccaagagcuguagggaagcaaugaccuugccagguccauuuuccucggccucccaauccaaccgcuaaccgaucgcgcagcuuugggcaaguguucccaaacaggaggucuccuuuugccccgguuccaacaagagaaugcaaggcuguaucucaauuuccuugagccucucuguauuauagaagaaaaguagggaagccauacgccccuucugagcuucagugucucucugucucugcaaaugaggcuggggaggcugggggcgggcgugaaagaggcccgcgccaagccgacccccaccucugcccccuccccaggucaacaaccucaucuggcacgugcggugccucgagugcuccgugugucgcacaucgcugaggcagcagaauagcugcuacaucaagaacaaggagaucuacugcaagauggacuacuucagguaggcagcggccaucccgccagcaagcgcuggagcaugaacgccuugcacacgcgugccuaggccacuuguguggccugugcucuccaauuccugagcccugcuguucagagugcacaacgcgg

SEQ ID NO: 9907 - RNA, 2501 nt, Mus musculus
uagggugguuuugcauguccauuuuauaaauaaauacaccgaggaccagcaaggacuaaaggugagccaacuggcaggcuguguauuaggaauguaaauuacagcuccucaugucugaccuggccucugccugcucaacggagaaggaagcucuucuguuggcgggcaggaguggcaguagcguguuuuccaugcaggaccucgugugcaggcuggacuggacugcauggcuucucaccuccuugcuccucauccuucuucaagcaagcuaugguucaaaccagccucuuccaccauuuguucugccuacaagccuuguccuccuucgugcccauccucagagagccucaguuugcuauaucccaaauggaugcauuucugacacuguaaaaagaucuugcaccucaaggaucgugaguuacggucugagcagucaccaugcaguaauuaauaaaacgucuuggcuaaggcuggagcagaggaaguuggcggucagccugucagaggugacaacuggagggaggaguggggguggagccgugagaugggugggaggggaccugccagugcuggggcagugcuggaguugcacccgaggagccagccguuggcauugcacauccauccacucccagagucaugagucgugaguccgaccccaguggugcccccacgcgucccggaauucgguggccugcaggcggagccuugaacgcuaggcucaacucucucuuccuucugcaggaaggagucucucgcucugguuuccccugcugcugcuccugcugcugccgccgacacccucgguccugcucgcagauccuggggugcccucaccagguaggugcccccgccggaugcccgugaaaauuccaaguccugcgccgugggcuugguccaucucccuuccaggcggacucccugauuccccuuucugcucgcggugccggggaauaggguguugagguuauggaauggggucccuggagaauggcuagggccuaccugggaucucucuggcacacagcccacugagaucccgagucggcaggggaagcagagacagguucuuuaacuucucaccugauaugugguccgacuuuccaagcagccucuguacccccccccccccccccccccagaacucggcgguuuccugugggggcuccuuggggaggaagcggcagacgccaaggggaaggcgggcuggacacugaguuccuuuucuuuggccucuaacuuuuggggagucuaucuuaacgcucaaccuaucuccccaacgguagauacagggaugggggugggggacaccagcuauccugggaauggggaagugggcacauagugaccaggaaauugagguucaguaggugcgauaacagccccaagucacauaaugcauagugggcucaggguuugaauucaggaucagccuaauccagucacucucaauaccugcagugguucaaagaagccaguucugcaauucugucccgcuucucucccucagggcagaaccagguucuaggaaagaaaaauaauuuacuccccgccccccccauacuuccccugcccuccaccuuuccuuccucucuuuacaauuuggaugcccaucuguaaaauggggccaagaaagguuggcagugggggaaagggauacuacaggaccuuggaacucagaggacagaguggccugagaaucacagcaggcuuccuggaggaugggguuugagugagaaaaagagcuggggacaccugugcuagaaaggugacagucuggguuuuuggaaaggaagccauuugugauccagcacugcaguuuaccaagauuagcugugcgugccuuuucuuuggugcucacagcagccuugugggaggcagaugcguuaaguccauuuuguagaucagaacuuugagaggcucaggaaguggggccacuuguuggagaccccacagugagcugaugguagagccaaggcugacauguuggccaugcugacuuucaguuucagcaugaguccagcucucaccugacccuccacccuuugaggauccgguguucaugcaccugucuuccuugcugggauucuuuuagggaaaggguagaguucagcuuggagggcaaagcugugccagggaauccacaaauguucaaguucaucccuuccagacccuggguuuggcuugguguccucccuuuagccugggaguaggcaugacuuggugacccaagcugcgccugacuagagccacgguguccccuuugccuauagucauauugcaagugcuguaguggaauuuuucuguuuugcauuccaagggcuuuuucuauuugagccuuuggcuggggccuggugacacagaggucacagucugauguggagugauguaggugcccagagugacgcuggaguccacagucugaugguggagauaggcgccagcauguuguuaaguaggagagugagggcuguggcgaagggugagagagaaguauaaag

SEQ ID NO: 9908 - RNA, 2501 nt, Mus musculus
cuuuauacuucucucucacccuucgccacagcccucacucuccuacuuaacaacaugcuggcgccuaucuccaccaucagacuguggacuccagcgucacucugggcaccuacaucacuccacaucagacugugaccucugugucaccaggccccagccaaaggcucaaauagaaaaagcccuuggaaugcaaaacagaaaaauuccacuacagcacuugcaauaugacuauaggcaaaggggacaccguggcucuagucaggcgcagcuugggucaccaagucaugccuacucccaggcuaaagggaggacaccaagccaaacccagggucuggaagggaugaacuugaacauuuguggauucccuggcacagcuuugcccuccaagcugaacucuacccuuucccuaaaagaaucccagcaaggaagacaggugcaugaacaccggauccucaaaggguggagggucaggugagagcuggacucaugcugaaacugaaagucagcauggccaacaugucagccuuggcucuaccaucagcucacuguggggucuccaacaaguggccccacuuccugagccucucaaaguucugaucuacaaaauggacuuaacgcaucugccucccacaaggcugcugugagcaccaaagaaaaggcacgcacagcuaaucuugguaaacugcagugcuggaucacaaauggcuuccuuuccaaaaacccagacugucaccuuucuagcacagguguccccagcucuuuuucucacucaaaccccauccuccaggaagccugcugugauucucaggccacucuguccucugaguuccaagguccuguaguaucccuuucccccacugccaaccuuucuuggccccauuuuacagaugggcauccaaauuguaaagagaggaaggaaagguggagggcaggggaaguauggggggggcggggaguaaauuauuuuucuuuccuagaaccugguucugcccugagggagagaagcgggacagaauugcagaacuggcuucuuugaaccacugcagguauugagagugacuggauuaggcugauccugaauucaaacccugagcccacuaugcauuaugugacuuggggcuguuaucgcaccuacugaaccucaauuuccuggucacuaugugcccacuuccccauucccaggauagcuggugucccccacccccaucccuguaucuaccguuggggagauagguugagcguuaagauagacuccccaaaaguuagaggccaaagaaaaggaacucaguguccagcccgccuuccccuuggcgucugccgcuuccuccccaaggagcccccacaggaaaccgccgaguucuggggggggggggggggggggguacagaggcugcuuggaaagucggaccacauaucaggugagaaguuaaagaaccugucucugcuuccccugccgacucgggaucucagugggcugugugccagagagaucccagguaggcccuagccauucuccagggaccccauuccauaaccucaacacccuauuccccggcaccgcgagcagaaaggggaaucagggaguccgccuggaagggagauggaccaagcccacggcgcaggacuuggaauuuucacgggcauccggcgggggcaccuaccuggugagggcaccccaggaucugcgagcaggaccgagggugucggcggcagcagcaggagcagcagcaggggaaaccagagcgagagacuccuuccugcagaaggaagagagaguugagccuagcguucaaggcuccgccugcaggccaccgaauuccgggacgcgugggggcaccacuggggucggacucacgacucaugacucugggaguggauggaugugcaaugccaacggcuggcuccucgggugcaacuccagcacugccccagcacuggcagguccccucccacccaucucacggcuccacccccacuccucccuccaguugucaccucugacaggcugaccgccaacuuccucugcuccagccuuagccaagacguuuuauuaauuacugcauggugacugcucagaccguaacucacgauccuugaggugcaagaucuuuuuacagugucagaaaugcauccauuugggauauagcaaacugaggcucucugaggaugggcacgaaggaggacaaggcuuguaggcagaacaaaugguggaagaggcugguuugaaccauagcuugcuugaagaaggaugaggagcaaggaggugagaagccaugcaguccaguccagccugcacacgagguccugcauggaaaacacgcuacugccacuccugcccgccaacagaagagcuuccuucuccguugagcaggcagaggccaggucagacaugaggagcuguaauuuacauuccuaauacacagccugccaguuggcucaccuuuaguccuugcugguccucgguguauuuauuuauaaaauggacaugcaaaaccacccua

SEQ ID NO: 9909 - RNA, 2501 nt, Mus musculus
cccucaacuauaaaugcaguugcagaccagccuagccuaaaggagucgcugccaaauaaauaaauaaauaaauaaagucaucaagcaauuaaauauaugcauacuuucaaggaacucauuuguuuagcccccaaguucucaagcauaaaacccgggguauucuaggcuugucacuagaaagcucuauauuucaucaccgagcucuccggccucaccuauuuuguuuagaagaaccgauuccugagcaucugagacugcguguuguguaaguguauuacacagacacacacgggaauucucugcuguuuucugagagucuaauucaguuuugugugaaagcuuguaugacauuaacuuacauuaauccacagcucugucuccaggccuugcuuuaccucauccuaccgacacacuuacucuccauacgguaaaaauauauggaaggagacacauuaguaucuaaacgguggaaagccgcccccccaagaaaaaaguagcgcucuacagcaauaggggauauuugcauggaggagaucgaaauuuagaggaaaaaagaacgaauucauacacugcauguuuccucuauguaagcauuacacuaaauaucuguuagauuagucauguugccuugagacucuuccauguuuccucuagacaacugccaaugcucgcauggccucugaugaauaaacaugcugugacuugcuccuaaggaaacgccugucauguuccagggaaaaaugacuucuucacucuuaaaccaggggaaaaaaaaaaaaaagaacgacuuucauucauugcuuacaaagucgccuguuccuuaauguuccaauuuccggaauuuucauacucugcuuaaggcauuucuagguucugauuaacaaagaaaaagagaaacugggggugcuuuauggcaaagaggcuacaugacagcagugaggcggucucaccuaggacaggguuguguagcuugaccauuuacuacgacaaagguuauucucaaguucuccuuggcccuugcaggacuaccuguucccaccacuguuuacccaaacguuuaacagagugauguuuagcauauuuggcaggaaggcaugcuucauuuaauauuaacucaccaugugacagccccuucccuuccaaucgcuccucaaacacgugacgguaaaaaaaaaaaaaaaaaaguauagguguuugccaaugcgacugacuucgcacucggcuuuggcaucaccaauuggccagaagcacauacacacacacacccccagucagaggcgagcaccccgccugcucccggaacugucaagccgggcugacagcuggcacaccuugcugcgcccuccguggacuuucaggaagccccuuccuugcagucaccuugacagaaaccauccuccugggcuggagcgcuuggcuguggaaacuuuuccuuccuuucccggagcgcgcuuacaggugucgucccccccgccgcuacagagccccaacaaggggcccuuuguuaccacuuuugcuccgggacuccucacccaacgccugccauucgccuggccuuccguaaccccgaucggaaagcuugcccaaaguaccgaaccccccaccccgacucguccgggaggacgcagucucccgcccgcgugugggucggcccgggagcccggcggccccgcggggagcucgccucgggcaggugaagcgcgcgaggccucggcggccgggagggaggcuuacuuacccugcggagcccgcgggcugcauggcgggggugcggggcgcgcugcgggguaggggauccgggacgcugcgguccaucgcgcugcuggccgcggcgcgggcucgggcucggaggcggcgcgucacugcuagggugggagaggccggcgggucagggcgggagcggccgggccaagagcccgccucgacccacggcagccaggggcggccccgccuccccggggcgcuuccaccugccggucggucccugcccgagggcgccgcgacgacggcuacagguccccgccccggccgcagcccgcagccagucccgggcgaaggggcggcgcgcggcagcccgggcugugaaggaggaggaggagcggaccgggcgcgggacggucgccacgcccgcagugcuugggcuccagcggcccgcugcgcaccaacugaaucccgugcaaacuuuuccggaggagcugcgaaccacagcgcccccgccuucccaagccacugcccgcuuuaggggacccggcccguccaggcuccgcuccucccccgcacggcuagcucggacgcccggagcgagcgcgcggcggaaagcggccggcccccggccgccgcgcccgcgccccaacucacccugccccauggcccugccgggagccccgagcucgcagccgccucggccaccucgcucugcagaagugagggugacgaggucagcaucggagcgagcagagcagccagccggagaggggacggguagggcgagcgggcgggga

SEQ ID NO: 9910 - RNA, 2501 nt, Mus musculus
uccccgcccgcucgcccuacccguccccucuccggcuggcugcucugcucgcuccgaugcugaccucgucacccucacuucugcagagcgagguggccgaggcggcugcgagcucggggcucccggcagggccauggggcagggugaguuggggcgcgggcgcggcggccgggggccggccgcuuuccgccgcgcgcucgcuccgggcguccgagcuagccgugcgggggaggagcggagccuggacgggccggguccccuaaagcgggcaguggcuugggaaggcgggggcgcugugguucgcagcuccuccggaaaaguuugcacgggauucaguuggugcgcagcgggccgcuggagcccaagcacugcgggcguggcgaccgucccgcgcccgguccgcuccuccuccuccuucacagcccgggcugccgcgcgccgccccuucgcccgggacuggcugcgggcugcggccggggcggggaccuguagccgucgucgcggcgcccucgggcagggaccgaccggcagguggaagcgccccggggaggcggggccgccccuggcugccgugggucgaggcgggcucuuggcccggccgcucccgcccugacccgccggccucucccacccuagcagugacgcgccgccuccgagcccgagcccgcgccgcggccagcagcgcgauggaccgcagcgucccggauccccuaccccgcagcgcgccccgcacccccgccaugcagcccgcgggcuccgcaggguaaguaagccucccucccggccgccgaggccucgcgcgcuucaccugcccgaggcgagcuccccgcggggccgccgggcucccgggccgacccacacgcgggcgggagacugcguccucccggacgagucggggugggggguucgguacuuugggcaagcuuuccgaucgggguuacggaaggccaggcgaauggcaggcguugggugaggagucccggagcaaaagugguaacaaagggccccuuguuggggcucuguagcggcgggggggacgacaccuguaagcgcgcuccgggaaaggaaggaaaaguuuccacagccaagcgcuccagcccaggaggaugguuucugucaaggugacugcaaggaaggggcuuccugaaaguccacggagggcgcagcaaggugugccagcugucagcccggcuugacaguuccgggagcaggcggggugcucgccucugacuggggguguguguguguaugugcuucuggccaauuggugaugccaaagccgagugcgaagucagucgcauuggcaaacaccuauacuuuuuuuuuuuuuuuuuuaccgucacguguuugaggagcgauuggaagggaaggggcugucacauggugaguuaauauuaaaugaagcaugccuuccugccaaauaugcuaaacaucacucuguuaaacguuuggguaaacaguggugggaacagguaguccugcaagggccaaggagaacuugagaauaaccuuugucguaguaaauggucaagcuacacaacccuguccuaggugagaccgccucacugcugucauguagccucuuugccauaaagcacccccaguuucucuuuuucuuuguuaaucagaaccuagaaaugccuuaagcagaguaugaaaauuccggaaauuggaacauuaaggaacaggcgacuuuguaagcaaugaaugaaagucguucuuuuuuuuuuuuuuccccugguuuaagagugaagaagucauuuuucccuggaacaugacaggcguuuccuuaggagcaagucacagcauguuuauucaucagaggccaugcgagcauuggcaguugucuagaggaaacauggaagagucucaaggcaacaugacuaaucuaacagauauuuaguguaaugcuuacauagaggaaacaugcaguguaugaauucguucuuuuuuccucuaaauuucgaucuccuccaugcaaauauccccuauugcuguagagcgcuacuuuuuucuugggggggcggcuuuccaccguuuagauacuaaugugucuccuuccauauauuuuuaccguauggagaguaagugugucgguaggaugagguaaagcaaggccuggagacagagcuguggauuaauguaaguuaaugucauacaagcuuucacacaaaacugaauuagacucucagaaaacagcagagaauucccgugugugucuguguaauacacuuacacaacacgcagucucagaugcucaggaaucgguucuucuaaacaaaauaggugaggccggagagcucggugaugaaauauagagcuuucuagugacaagccuagaauaccccggguuuuaugcuugagaacuugggggcuaaacaaaugaguuccuugaaaguaugcauauauuuaauugcuugaugacuuuauuuauuuauuuauuuauuuggcagcgacuccuuuaggcuaggcuggucugcaacugcauuuauaguugaggg

SEQ ID NO: 9911 - RNA, 2501 nt, Mus musculus
ccgcugcccgggccgccgccagccauccgcugcggcgcgccgaagucccaggaugcuggcgccgagaccggcggggaggcacaaggaggagaagcgcuggcuccagggugcugcucgguggguaucucgccgcuuuuccacaucuucuugaacuuggaucggcgguucuggaaccagauuuugaccuuuguagaaaaaaaggaaaagcccugagcuuuaguacaggaaccugggcaggagguugguggaguggagacggcgggcgagcagaccugggcucugggccuccgcugcuucuagcuacauuggggggaucucaaaaugcugauggaugagcucuaaguaugugaccaagguucuggguagugcggugucaggucaguuauggaacccgcuuuagcagcagcgaguggaaaggcguuguagugugggauuucuguccacccgggucauuuucuuuccucccaugcggcugcccccuuugaaaaaaauuucuuauuuuguuuguuuguuuguuuuaagcauugggccuagaaguuuacuuugcccggaauaaaaaagcacaggugaaaauauacuuuugaaaaguuguuccggacgugcccgcuuccuagagaaagcaggccaucucccaccuugcucaccugaguuugggugaggcccagggacgccgccagcucggcucgcucuggcagggccagauacugggucuucuggaagcgucguugaagggccgccagcuggaaacuggaguagauggugcgugguuuccggacuuucuuuggcuucccguucacuauucggauuucaggcucaaggucuuccuugucugcaacgaaaagugaguggugagcacccaccguccaaccccgcgguccuaaaguucggagcggaggccuuuagagacuugaggaggccuucccaacuucagcacgcgccgacuggccuggccacggaacccugcaagggacccgggggagcugugcaagagagaaagaagaggcgggcagcaaagcuaugcgcuacccacagcaugccaacuggcccaaccgcccaccgacucugucccccggagcguggagaggcagaaacugcgauucgcgugcaguuggagauugggcagaguucagggcgggagcaagagaugcacagagugcaaggcuagagcuccggacugccccccaccccaugcuuacccggucccuccccgugacuugggcacccuagaugcuugcgaugcuuacccggcucguuguugaccggagacgaacuggugccguagggcgcguaggagguguacgcggcgguguagcccaggucguagcugcuuuuggcggaguaggagacauuguugaggccgcuggcgugguacugguaggagcccaugugcgcguagggcgaggcccccccgccgccgccgcccgccgggugcugcugguugguguaguagcugcuguccguagccguggacaccgggaggguuggcgacuccuggggcuugugcaggcugcuguugcugcugcugcuguugcuguugccgccagggccggcgcccgcaccgcucgggggcugcuggugcuggugguacgugcuggaggcggugaucugggucgagugcauaucagccaccagacugucaaagacuccagucauccugacccgggacaggaaagagcacggguggcgggcgagagggggaugcgaggcgccuccucugucuaucucuccgggucccuuccagcaaccaauguaauuacggggagggggagggagaggaaaacaagaaaugaggcuacggucuaggcgccuccuccccuggaggaggcgaucaccgugcguggcucgggaccgcagcugcuggccgcauccuucccgggccucucggaccucucggcuccuggcccggcucgggcggggggcgggcaauggagggggcaagagcggucagacccgguaggggcuccaggaggcgggagcaggugagcgacccccgagcagcuuuacgauugucugccgggcaggcuccugcagggugggcauuuaacacuuaucacgugaccgcgggcaacgucaccuagcaacagccaaucagaaggaaugagccgcggggcgccgggaguccgcgaccgggcggccccgggacccgcgugucacguggcgggcaaggcggccgcggugggugcguguacaagcacugcagaaaguggguacccgaucuggagcuggauagggugcgggauggcccgcaacaggacauaaggcuccgggaaagaaauggggucucccaccuuacucugcuuucaagagccaagucuaacgauuuacaucucuuguccaacuucgccuuaaucaaauaaagccaggaagagggccgagccagcucugucuccuuuuucuccagauacuuuuccucgaggugccuggcucgcacuacucuugucagccacuuugcaccugacgggcaauugauuuaaauuauccauaaaccgcguauaauaacc

SEQ ID NO: 9912 - RNA, 2501 nt, Mus musculus
gguuauuauacgcgguuuauggauaauuuaaaucaauugcccgucaggugcaaaguggcugacaagaguagugcgagccaggcaccucgaggaaaaguaucuggagaaaaaggagacagagcuggcucggcccucuuccuggcuuuauuugauuaaggcgaaguuggacaagagauguaaaucguuagacuuggcucuugaaagcagaguaaggugggagaccccauuucuuucccggagccuuauguccuguugcgggccaucccgcacccuauccagcuccagaucggguacccacuuucugcagugcuuguacacgcacccaccgcggccgccuugcccgccacgugacacgcgggucccggggccgcccggucgcggacucccggcgccccgcggcucauuccuucugauuggcuguugcuaggugacguugcccgcggucacgugauaaguguuaaaugcccacccugcaggagccugcccggcagacaaucguaaagcugcucgggggucgcucaccugcucccgccuccuggagccccuaccgggucugaccgcucuugcccccuccauugcccgccccccgcccgagccgggccaggagccgagagguccgagaggcccgggaaggaugcggccagcagcugcggucccgagccacgcacggugaucgccuccuccaggggaggaggcgccuagaccguagccucauuucuuguuuuccucucccucccccuccccguaauuacauugguugcuggaagggacccggagagauagacagaggaggcgccucgcaucccccucucgcccgccacccgugcucuuuccugucccgggucaggaugacuggagucuuugacagucugguggcugauaugcacucgacccagaucaccgccuccagcacguaccaccagcaccagcagcccccgagcggugcgggcgccggcccuggcggcaacagcaacagcagcagcagcaacagcagccugcacaagccccaggagucgccaacccucccgguguccacggcuacggacagcagcuacuacaccaaccagcagcacccggcgggcggcggcggcgggggggccucgcccuacgcgcacaugggcuccuaccaguaccacgccagcggccucaacaaugucuccuacuccgccaaaagcagcuacgaccugggcuacaccgccgcguacaccuccuacgcgcccuacggcaccaguucgucuccggucaacaacgagccggguaagcaucgcaagcaucuagggugcccaagucacggggagggaccggguaagcaugggguggggggcaguccggagcucuagccuugcacucugugcaucucuugcucccgcccugaacucugcccaaucuccaacugcacgcgaaucgcaguuucugccucuccacgcuccgggggacagagucggugggcgguugggccaguuggcaugcuguggguagcgcauagcuuugcugcccgccucuucuuucucucuugcacagcucccccgggucccuugcaggguuccguggccaggccagucggcgcgugcugaaguugggaaggccuccucaagucucuaaaggccuccgcuccgaacuuuaggaccgcgggguuggacggugggugcucaccacucacuuuucguugcagacaaggaagaccuugagccugaaauccgaauagugaacgggaagccaaagaaaguccggaaaccacgcaccaucuacuccaguuuccagcuggcggcccuucaacgacgcuuccagaagacccaguaucuggcccugccagagcgagccgagcuggcggcgucccugggccucacccaaacucaggugagcaaggugggagauggccugcuuucucuaggaagcgggcacguccggaacaacuuuucaaaaguauauuuucaccugugcuuuuuuauuccgggcaaaguaaacuucuaggcccaaugcuuaaaacaaacaaacaaacaaaauaagaaauuuuuuucaaagggggcagccgcaugggaggaaagaaaaugacccggguggacagaaaucccacacuacaacgccuuuccacucgcugcugcuaaagcggguuccauaacugaccugacaccgcacuacccagaaccuuggucacauacuuagagcucauccaucagcauuuugagauccccccaauguagcuagaagcagcggaggcccagagcccaggucugcucgcccgccgucuccacuccaccaaccuccugcccagguuccuguacuaaagcucagggcuuuuccuuuuuuucuacaaaggucaaaaucugguuccagaaccgccgauccaaguucaagaagauguggaaaagcggcgagauacccaccgagcagcacccuggagccagcgcuucuccuccuugugccuccccgccggucucggcgccagcauccugggacuucggcgcgccgcagcggauggcuggcggcggcccgggcagcgg

SEQ ID NO: 9913 - RNA, 2501 nt, Mus musculus
caccgcucucgacugcucucccuucccccuuccucccccuccucccucccuccuccuccccuccggccuagguccggguacuuaaagcagcgcgggcgggcuaaggcgggcgggcggcccaguccgguggcggcagaugcgcccagcgguggcagccgccggcggcgcgcaggugaccggccugcagcgcagccugcucagggagugcccugggagagcuggcgggagcuggaggccgauccgcccccagcgugcgcgcgucucggcgccaggagccgucccggggcguguuggcgagcgcugauauagauauaaggacauuucucuccauggcgucacgugacauaauuaccaccagaaucaaucaagaugaauugcacgucagcgcccgguggggauuuuugcuuaguugauccuggcccaagccucuugugcaaucgauggcucagguuggaggcgcggggagcggcccgaggcuugccggcgugcacgccgcgcagccaugaacgacuuugacgagugcggccccagcgcagccagcauguaccugccgggcugcgcuuacuacguggccccgucggacuucgccagcaagccgucguuccucucgcagccguccucgugccagaugacuuuccccuacuccuccaaccuggcgccacacguccagcccgugcgggagguggccuuucgcgacuacggccuggagcgcgccaaguggccguaccgcggcggaggcggcgguggcgcggggggcggcggcggcggcggucccggcgggggugguggcggcuccgggggcuacgcucccuacuacgccgcggcagcggcggcagcggcggcagcggcggcggccgaggaggcggccaugcaacgagaucugcucccgcccgccggccgccggccagacgugcucuucaaggcucccgagccggugugcggcgcucccgggccgccgcacgguccggcggccgcagccucuaacuucuacagcgccgugggucgcaacggcauccugccccagggcuuugaucaguucuacgaggcggcgcccggaccccccuucgccggcccgcagccccagcccgcucccgcgccgccacagcccgagggcgccgcugacaagggcgaccccaagccaggggcugguggcggcgggggcagucccugcgccaaggcgacuccgggcccagagcccaagggggcggcggaaggcgguggcggugaaggcgagggccccccgggggaggcgggggccgaaaagagcggcggcacagguaggcgcggggcgcgggccgaggggcuggcccggggcggcggagggggggcgguggggaccucccucugcuugcgccguuuuaugugcuacuuuauaagcauucgaggggguuuauacauccuauaagauuucccgggucguuguaaagcguguuuaugauaggaaaccaauuuaggugggcuuaagguagacuucgaagaggacauuaaucgccguagagagcuuucccucuauuuggguggggggggggugggugaguugaggaccuuagaggagggaaguacauuugcagccaguugaugagugggaacacgagagccuccugccuuucagggagaggguaagugaucugccgcacuggacuuaaccccaaccucuggcuggcgcucagcucggaguugagcagaugcuccugugggcgcgcucuugucucucucccuucauguuccaguucagagccugccuugccaucauccuuuuuccuaucucagugccagccuagaguguguguguguguguguguguguguguguguguguccgggcgugaacacauguccacgcccgcacucuacugugcccgcccauauaucaucccccacgacgcaggcagggccuuucaacggcggcaagggacgucccuaacugggccaaggccuggcccuagcucaguggccagagugggugggggcaagcaguagccucucucaccucuugguuucuuuuccuugcaguggccccccagaggucccggaaaaagcgcugucccuacaccaaguaccagauccgcgaacuggaacgcgaguuuuucuuuaauguauacauaaacaaagagaaaagacuccaacucucucggaugcucaaccucacugaccggcaagucaaaaucugguuccagaaucgcaggaugaaagaaaagaaacugaacagggaccgucugcaauauuucacuggaaaccccuuauuuugagaacuccaggauguacccccuccccagagccccacucacccacccuccuccccaccagccugcucucagcaggcccaauguccuuggguucaaugacgccucuucucuguggaacuucacgauuucuucucgccuucaacucgggaccucccagcgaccacuacagccugaggaagaggcccggaacuuggcugugcggauccuaauaaggggaacaugguaaauguaaacaucccuuuccaauuuuaccgcc

SEQ ID NO: 9914 - RNA, 2501 nt, Mus musculus
ggcgguaaaauuggaaagggauguuuacauuuaccauguuccccuuauuaggauccgcacagccaaguuccgggccucuuccucaggcuguaguggucgcugggaggucccgaguugaaggcgagaagaaaucgugaaguuccacagagaagaggcgucauugaacccaaggacauugggccugcugagagcaggcugguggggaggagggugggugaguggggcucuggggaggggguacauccuggaguucucaaaauaagggguuuccagugaaauauugcagacggucccuguucaguuucuuuucuuucauccugcgauucuggaaccagauuuugacuugccggucagugagguugagcauccgagagaguuggagucuuuucucuuuguuuauguauacauuaaagaaaaacucgcguuccaguucgcggaucugguacuugguguagggacagcgcuuuuuccgggaccucuggggggccacugcaaggaaaagaaaccaagaggugagagaggcuacugcuugcccccacccacucuggccacugagcuagggccaggccuuggcccaguuagggacgucccuugccgccguugaaaggcccugccugcgucgugggggaugauauaugggcgggcacaguagagugcgggcguggacauguguucacgcccggacacacacacacacacacacacacacacacacacacucuaggcuggcacugagauaggaaaaaggaugauggcaaggcaggcucugaacuggaacaugaagggagagagacaagagcgcgcccacaggagcaucugcucaacuccgagcugagcgccagccagagguugggguuaaguccagugcggcagaucacuuacccucucccugaaaggcaggaggcucucguguucccacucaucaacuggcugcaaauguacuucccuccucuaagguccucaacucacccaccccccccccacccaaauagagggaaagcucucuacggcgauuaauguccucuucgaagucuaccuuaagcccaccuaaauugguuuccuaucauaaacacgcuuuacaacgacccgggaaaucuuauaggauguauaaacccccucgaaugcuuauaaaguagcacauaaaacggcgcaagcagagggagguccccaccgcccccccuccgccgccccgggccagccccucggcccgcgccccgcgccuaccugugccgccgcucuuuucggcccccgccucccccggggggcccucgccuucaccgccaccgccuuccgccgcccccuugggcucugggcccggagucgccuuggcgcagggacugcccccgccgccaccagccccuggcuuggggucgcccuugucagcggcgcccucgggcuguggcggcgcgggagcgggcuggggcugcgggccggcgaagggggguccgggcgccgccucguagaacugaucaaagcccuggggcaggaugccguugcgacccacggcgcuguagaaguuagaggcugcggccgccggaccgugcggcggcccgggagcgccgcacaccggcucgggagccuugaagagcacgucuggccggcggccggcgggcgggagcagaucucguugcauggccgccuccucggccgccgccgcugccgccgcugccgccgcugccgcggcguaguagggagcguagcccccggagccgccaccacccccgccgggaccgccgccgccgccgccccccgcgccaccgccgccuccgccgcgguacggccacuuggcgcgcuccaggccguagucgcgaaaggccaccucccgcacgggcuggacguguggcgccagguuggaggaguaggggaaagucaucuggcacgaggacggcugcgagaggaacgacggcuugcuggcgaaguccgacggggccacguaguaagcgcagcccggcagguacaugcuggcugcgcuggggccgcacucgucaaagucguucauggcugcgcggcgugcacgccggcaagccucgggccgcuccccgcgccuccaaccugagccaucgauugcacaagaggcuugggccaggaucaacuaagcaaaaauccccaccgggcgcugacgugcaauucaucuugauugauucuggugguaauuaugucacgugacgccauggagagaaauguccuuauaucuauaucagcgcucgccaacacgccccgggacggcuccuggcgccgagacgcgcgcacgcugggggcggaucggccuccagcucccgccagcucucccagggcacucccugagcaggcugcgcugcaggccggucaccugcgcgccgccggcggcugccaccgcugggcgcaucugccgccaccggacugggccgcccgcccgccuuagcccgcccgcgcugcuuuaaguacccggaccuaggccggaggggaggaggagggagggaggagggggaggaagggggaagggagagcagucgagagcggug

SEQ ID NO: 9915 - RNA, 2501 nt, Mus musculus
aaccagcccgcgccccuaucccuuccugggaaccggcccucuugggcgcguucugccuggguaugugcagggagagcgcuucugugagcaggcgccacagcgcucugacuuuccucaguacgcguguccucccggaggccccucgaaucaagccuuuccuuccgcuggcggggcccgguggccgggugggggacucgaguggggcaggccggccggccaaacaagccccgggagacaggcuggccggcagcagagcucugggccgguugucuccaacgcgcacuaucacaggcgcuuaguagaugucgcuguuguccgugcuuacgcggccagccggccgggcuggggaacacgugaccugcaaggaggcugcggcucaaggccauuuucaaaucucauuggcuugguugucauguggucggcagaggcauccacaauuacaccgggaauguuuuccuagcgaugucagccuacaaaggacacaaucucucuucuucaaauuccuccccaaaauguccuuucccaacagcucuccugcugcuaauacuuuuuuaguagauuccuugaucagugccugcaggagugacaguuuuuauucgagcagcgccagcauguacaugccaccaccuagcgcagacauggggaccuauggaaugcaaaccuguggacugcucccgucuuuggccaaaagagaagugaaccaccaaaauauggguaugaauguacauccuuauauaccucaaguagacaguuggacagacccgaacagaucuugucgaauagagcaaccuguuacacagcaaguccccacuugcucauucaccgccaacauuaaagaagaauccaauugcugcauguauucugauaagcgcaacaaacucauuucugccgaggucccuucguaccagaggcugguccccgagucuuguccuguugagaaccccgagguuccugucccuggauauuuuagacugagucagaccuacgccaccgggaaaacccaagaguacaauaacagccccgaaggcagcuccacugucaugcuccagcucaacccucguggcgcggccaagccgcagcucucggcugcccagcugcagauggaaaagaagaugaacgaaagcgcgagcggccaggagcccacuaaagucucccaaguggagagccccgaggccaaaggcggccuuccagaagacaggagcugccuggcugagguuuccguguccagucccgaagugcaggagaaggaaagcaaaggucgguaugaacagaguugccaccccagcggggcgugcaguccgguaaaaccucgaaaagggagcgcucgggugcccagagcagagcccgggcagcggagcccagagcccauacuccgcaggugcugcuccacccggcuuuuagaagggauaucccugccuugaaagggucggggcuucucucccgcugcuccggccagaccuggccccaagcugauggcgccugggcagaggacaggcuugccggguuuaucagucuugagccagauccgaaauacaacaaaagagcuaaaaggagaccagccguuuguaaacagggcuccagugcccgcuuuucuuuggcucagauuugcagcccuaguuuuugccuugaacccagggaucauuuuaagguagccuaagacaccguguuuguguucaaggguuugcaccccgcauccugcgaucuaagagggaaaggaaaugguuuggccuguuggugcuuggguggggaagcagagguaaccuuggcuuugucuggcgaaagugccgcaggcuuugcaaucuucuacaaagggggcaaaggcggaggagggggagaacagaucugcauugcccaccuagggcugggguaaugcaaagaaccagggauauggguuucuaagaaggaaucuugagcccccacgcccauuucugcagucugucccucacugucuaccgggugagccacagaguuacauuucuggaggaaggcuuuugugugagagcaaagaaaaauugaggaaauucuggggggaaggggggaacuguaacaaugcccagucaggguggagaagggaucccugcuuccucauuaucucuugaaacagccugcaucccuauaaaccugguuguggaucuccuugucugccuaggagggguggguaagaagcggccgacuuggggcccuggagcaguagugagauacugguagaugaagcaagcuaugguucuuucugguggccugacggcuuagaauguuuuuggggggacggaggaauccuguaaaguuugcuauuauagucacauuuugugcaagccagaaaaguuguguaggagagagagagagagagagagagagagagagagagagagagagagagagagagagaauaugaggaggcagccucuggcacagaauauccuuucauucaucguguuaaguauuuaguucuaaauugguaccaauuuacaauccccuucaugcccaccuucguaagugauguu

SEQ ID NO: 9916 - RNA, 2501 nt, Mus musculus
aacaucacuuacgaaggugggcaugaaggggauuguaaauugguaccaauuuagaacuaaauacuuaacacgaugaaugaaaggauauucugugccagaggcugccuccucauauucucucucucucucucucucucucucucucucucucucucucucucucucucucuccuacacaacuuuucuggcuugcacaaaaugugacuauaauagcaaacuuuacaggauuccuccguccccccaaaaacauucuaagccgucaggccaccagaaagaaccauagcuugcuucaucuaccaguaucucacuacugcuccagggccccaagucggccgcuucuuacccaccccuccuaggcagacaaggagauccacaaccagguuuauagggaugcaggcuguuucaagagauaaugaggaagcagggaucccuucuccacccugacugggcauuguuacaguuccccccuuccccccagaauuuccucaauuuuucuuugcucucacacaaaagccuuccuccagaaauguaacucuguggcucacccgguagacagugagggacagacugcagaaaugggcgugggggcucaagauuccuucuuagaaacccauaucccugguucuuugcauuaccccagcccuaggugggcaaugcagaucuguucucccccuccuccgccuuugcccccuuuguagaagauugcaaagccugcggcacuuucgccagacaaagccaagguuaccucugcuuccccacccaagcaccaacaggccaaaccauuuccuuucccucuuagaucgcaggaugcggggugcaaacccuugaacacaaacacggugucuuaggcuaccuuaaaaugaucccuggguucaaggcaaaaacuagggcugcaaaucugagccaaagaaaagcgggcacuggagcccuguuuacaaacggcuggucuccuuuuagcucuuuuguuguauuucggaucuggcucaagacugauaaacccggcaagccuguccucugcccaggcgccaucagcuuggggccaggucuggccggagcagcgggagagaagccccgacccuuucaaggcagggauaucccuucuaaaagccggguggagcagcaccugcggaguaugggcucugggcuccgcugcccgggcucugcucugggcacccgagcgcucccuuuucgagguuuuaccggacugcacgccccgcugggguggcaacucuguucauaccgaccuuugcuuuccuucuccugcacuucgggacuggacacggaaaccucagccaggcagcuccugucuucuggaaggccgccuuuggccucggggcucuccacuugggagacuuuagugggcuccuggccgcucgcgcuuucguucaucuucuuuuccaucugcagcugggcagccgagagcugcggcuuggccgcgccacgaggguugagcuggagcaugacaguggagcugccuucggggcuguuauuguacucuuggguuuucccgguggcguaggucugacucagucuaaaauauccagggacaggaaccucgggguucucaacaggacaagacucggggaccagccucugguacgaagggaccucggcagaaaugaguuuguugcgcuuaucagaauacaugcagcaauuggauucuucuuuaauguuggcggugaaugagcaaguggggacuugcuguguaacagguugcucuauucgacaagaucuguucgggucuguccaacugucuacuugagguauauaaggauguacauucauacccauauuuuggugguucacuucucuuuuggccaaagacgggagcaguccacagguuugcauuccauagguccccaugucugcgcuaggugguggcauguacaugcuggcgcugcucgaauaaaaacugucacuccugcaggcacugaucaaggaaucuacuaaaaaaguauuagcagcaggagagcuguugggaaaggacauuuuggggaggaauuugaagaagagagauuguguccuuuguaggcugacaucgcuaggaaaacauucccgguguaauuguggaugccucugccgaccacaugacaaccaagccaaugagauuugaaaauggccuugagccgcagccuccuugcaggucacguguuccccagcccggccggcuggccgcguaagcacggacaacagcgacaucuacuaagcgccugugauagugcgcguuggagacaaccggcccagagcucugcugccggccagccugucucccggggcuuguuuggccggccggccugccccacucgagucccccacccggccaccgggccccgccagcggaaggaaaggcuugauucgaggggccuccgggaggacacgcguacugaggaaagucagagcgcuguggcgccugcucacagaagcgcucucccugcacauacccaggcagaacgcgcccaagagggccgguucccaggaagggauaggggcgcgggcugguu

SEQ ID NO: 9917 - RNA, 2501 nt, Mus musculus
gggagugugagcgcgguagagggaggggcacuccgagcugcuccauccguccguuuuauuagggacacauuaaucuauaaucaaauacaccucauaaaauuuuuauugaaaggcauaauaucauuacagaggucuuccaccuguuuuaaacaacacgccaagcugugugaguguguguguguguguguguguguguguguguguguguguguguagggauggguuuagguaagaaaagaggcgaggggagaacgacucccuuugggcgacagggguccgcccuuaaaggccagccugccuggggcagcccgggcccaggagccuccaacugcuccggggcuuuggauaaucgccuaggugugacuuagaagcccggcccagggcucagagcccaggagucggagagccagaguccggguggagaucgcaggacccagagaggcaagaagagaugaacaaauaguccccagcgccuccugcggccgcaguuaggccuguggccgccgccgccaccagggcgggcugagccgggccaggccgggcuggugcguggaccugggcccggcagcucuaauugcaacgcuccuguugaugaugauuuuuuuuuuuuuaaaucacagcagcccccaguuuagcggacugauuuacuccggguauugguaaauaugaucacgugggccgcgcgaccaauggugguggcugcagccugcgaacuagucggcggcucgggcgccggcgaggagccgcucggcggugggcaguggaaccuugggugggagcgagcggcgccucaccaugucguccaguggcacccucagcaacuacuacguggacucgcucauaggccaugagggcgacgagguguucgccgcgcgcuuugggccaccggggccggggacacagggccggcccgcagguguggccgauggcccagccgccgccaccgccgaguucgccucguguaguuuugcccccaaaucguccguguucuccgccucgugguccgcgguggccgcccagcccccggcggcggcgacgaugagcggccuguaccacccguacguguccccgccgccccuggcugccgccgagccgggacgcuacguacgcuccuggauggagccgcugcccggcuuccccggcggcgcaggcgguggcgguggcagugguggcggcgguggcggaggcccgggucccguucccagccccgguggcccagccaacgggcgccacuacgggauuaagccugaaaccggagcggccccggcccccgcugcagccuccaccuccuccuccuccuccaccuccucguccuccuccuccaaaaggacugagugcuccgcggcccgcgagucccaggggagcggcggcccagaauucccgugcaacucguuccugcgggacaaggcagcggcggcgacagggaacgggcccggggugggaaucgggaccgggccaggggcgguaggcucguccgagcccucagcuugcagcgaucacccgagcccgggcugcucgcugaaggaggaggagaagcagccgccgcagccgccgcagcagcaacuugacccaaguaagugcaaaagaaauugcccccugauuuauugcugaaaccuguaaggcucgaaugugcaaaacugauaguuuuacuaaccuauaaaaacgucuagacgccuacccaagccuaggcgagcaacacguauccauaaaaagcuucccauaaccaccuaccuugggcgcgcgguuuguacgguaaacagagcgcgggcauuaaggcuuuuuaugauaauucccccaaguugugaaaagcguccauccuuggugaaauuaauuuaacgaccucucuuccccacccugucgucucucccugccuccccuccgccccucgcucccuugucugcaaaccccccucuuccuagacaacccugcagcgaacuggauccacgcucgcuccacccggaaaaagcgcugucccuacaccaaauaccagacgcuagagcuggagaaggaauuccucuucaacauguaccucacccgggaccggcgcuacgagguggccaggauucugaaccuuacagagagacaagucaaaaucugguuccagaaccguaggaugaaaaugaaaaagaugagcaaggagaagugcccuaaaggagacugacccagugcgggucuggccugcagcacucaaaaggcagcggguuuuuuuguuuguuuguuuguuuguuuuguuuuuuguuuuuuguuguuguuuguuuucuuugugggugcuugauucagaaacucugcagcgacucggacuuucuucuuuuuuuagguagaagugacugugugguuggucucugugaguuaucugggggacacuguauuugcucgcauauguauuggagaaaccaaguggcuuuggagucuuguccugucccacucccucccuucccugcuccccugauuccuuaggaaaugcuauauuuugugagugcacgcaggcuugauggagcccu

SEQ ID NO: 9918 - RNA, 2501 nt, Mus musculus
agggcuccaucaagccugcgugcacucacaaaauauagcauuuccuaaggaaucaggggagcagggaagggagggagugggacaggacaagacuccaaagccacuugguuucuccaauacauaugcgagcaaauacagugucccccagauaacucacagagaccaaccacacagucacuucuaccuaaaaaaagaagaaaguccgagucgcugcagaguuucugaaucaagcacccacaaagaaaacaaacaacaacaaaaaacaaaaaacaaaacaaacaaacaaacaaacaaaaaaacccgcugccuuuugagugcugcaggccagacccgcacugggucagucuccuuuagggcacuucuccuugcucaucuuuuucauuuucauccuacgguucuggaaccagauuuugacuugucucucuguaagguucagaauccuggccaccucguagcgccggucccgggugagguacauguugaagaggaauuccuucuccagcucuagcgucugguauuugguguagggacagcgcuuuuuccggguggagcgagcguggauccaguucgcugcaggguugucuaggaagagggggguuugcagacaagggagcgaggggcggaggggaggcagggagagacgacaggguggggaagagaggucguuaaauuaauuucaccaaggauggacgcuuuucacaacuugggggaauuaucauaaaaagccuuaaugcccgcgcucuguuuaccguacaaaccgcgcgcccaagguaggugguuaugggaagcuuuuuauggauacguguugcucgccuaggcuuggguaggcgucuagacguuuuuauagguuaguaaaacuaucaguuuugcacauucgagccuuacagguuucagcaauaaaucagggggcaauuucuuuugcacuuacuugggucaaguugcugcugcggcggcugcggcggcugcuucuccuccuccuucagcgagcagcccgggcucgggugaucgcugcaagcugagggcucggacgagccuaccgccccuggcccggucccgauucccaccccgggcccguucccugucgccgccgcugccuugucccgcaggaacgaguugcacgggaauucugggccgccgcuccccugggacucgcgggccgcggagcacucaguccuuuuggaggaggaggacgaggagguggaggaggaggaggagguggaggcugcagcgggggccggggccgcuccgguuucaggcuuaaucccguaguggcgcccguuggcugggccaccggggcugggaacgggacccgggccuccgccaccgccgccaccacugccaccgccaccgccugcgccgccggggaagccgggcagcggcuccauccaggagcguacguagcgucccggcucggcggcagccaggggcggcggggacacguacgggugguacaggccgcucaucgucgccgccgccgggggcugggcggccaccgcggaccacgaggcggagaacacggacgauuugggggcaaaacuacacgaggcgaacucggcgguggcggcggcugggccaucggccacaccugcgggccggcccuguguccccggccccgguggcccaaagcgcgcggcgaacaccucgucgcccucauggccuaugagcgaguccacguaguaguugcugagggugccacuggacgacauggugaggcgccgcucgcucccacccaagguuccacugcccaccgccgagcggcuccucgccggcgcccgagccgccgacuaguucgcaggcugcagccaccaccauuggucgcgcggcccacgugaucauauuuaccaauacccggaguaaaucaguccgcuaaacugggggcugcugugauuuaaaaaaaaaaaaaucaucaucaacaggagcguugcaauuagagcugccgggcccagguccacgcaccagcccggccuggcccggcucagcccgcccugguggcggcggcggccacaggccuaacugcggccgcaggaggcgcuggggacuauuuguucaucucuucuugccucucuggguccugcgaucuccacccggacucuggcucuccgacuccugggcucugagcccugggccgggcuucuaagucacaccuaggcgauuauccaaagccccggagcaguuggaggcuccugggcccgggcugccccaggcaggcuggccuuuaagggcggaccccugucgcccaaagggagucguucuccccucgccucuuuucuuaccuaaacccaucccuacacacacacacacacacacacacacacacacacacacacacacucacacagcuuggcguguuguuuaaaacagguggaagaccucuguaaugauauuaugccuuucaauaaaaauuuuaugagguguauuugauuauagauuaaugugucccuaauaaaacggacggauggagcagcucggagugccccucccucuaccgcgcucacacuccc

SEQ ID NO: 9919 - RNA, 2501 nt, Mus musculus
guauaaacaccuugcuuacuccuguuucuuugugcaaaaugggcgaauagucuacagaauuuauaaucguuuuguaaauauuauuaguguggcucuaggaagggucgagcacuuacacccacuucuauagaagggagcacuuggaaaaaggccuucagacaagguucaauuauuuuguauuucagcaaaguccacccacgcaucucuaguugguuuggcaaauaugcaacucccacuaccagccuggugacacgaggugaaauucccauuguguggagauaacuucuacucuucuggugcaacagcaaucguuuucuauuuggauguuuguguuucgcucaguaaugauggcucaaaagaauauuuaguuuccuuguuccuuugugcuguuuuaaaaauggcauguuaggcugggggugggagggguuauccuuuugcuaaauuucacucuaucugagcaaguuuaaaguauauauguuguagaauuguaucaacagaauaaaugacuucaaucgaaggcauauuuuacccacucucaaggcuuaacauuguuuucucugaaauuugcauuccuagacagaauuuauaauuguaagaaauuauuuuuuaagcuauuacggaaaucaaagaaaugcuagcugccucguagggaaccacagccaccuuucuuaacuggcuaaauauuaaauagaugaauugucaggcuguuuagauucagcccgguuucucucaucuccucuucauaccauaaauaauaauaaaaauacauaaugcaucauggcuccaggcguuucccagcgcgguguguuaccacaggaguaucugcugagucugcgggugucugcaauaccccaagcgucaucuguggcuuaggguuucauggauuacuuuaaacagugucuagcccggcugacaucagcuuccucucacacauaggcucuaaggaagugucagguuggggguucccaccgucuaggcagccgcaaccucacaggcccggcgguggagggaggauguuggaagaagggggaggggucgcuucgaccaaaccugccgccuucgccuaccuucugaaguucuggagacuucagagaauugcuugguucuuuccugccaccaacgcgagucacgugacaggcacacucacuccuagcgugggugggggcggcggcgaguucugggagggcacacucccacgcggccgcccgccggagagagcugggcccgcggcacaaccauuuaaaacuucauaaauuauaaacaagccgccuuggccuucgccauaaauuccgcuccucuugagccugcaauuaguguuaggaagcacccaagucuaaacacaaccaaacgcucuccgaaggguccaagugcccgagguugcaagccuuuauuuauucccgggugccacccccucugcacucgaggcuugcacacagucaccuccucccccgccaccgcgggcaguacacacuccgcuggguuccccgcuuagcccgggaaggucacaauagcagcucuauccaccgaggcgcucgccgccuccucccucccgggucuucgagaagcaaagaaaggagugugggggaggggagccuggccagcaauggcgcccgggucucaggccucugcucuuguuucaagacgagacccgggaaguuggcauggguagggaagcagcagccuagcuugucuuucucccacgacgcuccucucccacgacgcuccucugcccccagaggcuucaccgcccgauugaggaugccccaaagcagucaggucuacccgaaauccagaauccauugagccagcggcuuccuuucugauccuuugcagaggaauagaugccagacggaauagaugccagacggaauagaugccagaagggaggagcaccugggccccuccggagggcguuggccuugggaggugucucucuuuugaagaaggggcaggaugacuucgguccagccuugggcacaccuucuuuuucuccauaguuuuugaggcgcgggggcgggacgaggaggggguggggauuaggaagguuguggaucuccgguagaguauuaggucuaaaggaaagagaucagguccuuggcucauggguggcagucauuugggccucucugguuguuccaucuaggcaaacaaauguggauuaacguaggauggcggucaggcagagguauggcccugcugcaaaauggaggugggaguggaggaagagggaccguuuccuuagcaucccuguaaaccucgggguccauucuggaguggaaugccuagaccuagcgagagggugcgaaguugucauggaaagcccuggaggguggcccuggccacugguaaggagguuaggaaaggaaaggaaaggaaaggaaaggaaaggaaaggaaaggaaaggaaaggagaaagggaaaucaaguacagauucugccuucuagcuuacagaccaaccucauccagggaacugacagagaaaaaucugccucugauagaau

SEQ ID NO: 9920 - RNA, 2501 nt, Mus musculus
auucuaucagaggcagauuuuucucugucaguucccuggaugagguuggucuguaagcuagaaggcagaaucuguacuugauuucccuuucuccuuuccuuuccuuuccuuuccuuuccuuuccuuuccuuuccuuuccuuuccuaaccuccuuaccaguggccagggccacccuccagggcuuuccaugacaacuucgcacccucucgcuaggucuaggcauuccacuccagaauggaccccgagguuuacagggaugcuaaggaaacggucccucuuccuccacucccaccuccauuuugcagcagggccauaccucugccugaccgccauccuacguuaauccacauuuguuugccuagauggaacaaccagagaggcccaaaugacugccacccaugagccaaggaccugaucucuuuccuuuagaccuaauacucuaccggagauccacaaccuuccuaauccccacccccuccucgucccgcccccgcgccucaaaaacuauggagaaaaagaaggugugcccaaggcuggaccgaagucauccugccccuucuucaaaagagagacaccucccaaggccaacgcccuccggaggggcccaggugcuccucccuucuggcaucuauuccgucuggcaucuauuccgucuggcaucuauuccucugcaaaggaucagaaaggaagccgcuggcucaauggauucuggauuucggguagaccugacugcuuuggggcauccucaaucgggcggugaagccucugggggcagaggagcgucgugggagaggagcgucgugggagaaagacaagcuaggcugcugcuucccuacccaugccaacuucccgggucucgucuugaaacaagagcagaggccugagacccgggcgccauugcuggccaggcuccccucccccacacuccuuucuuugcuucucgaagacccgggagggaggaggcggcgagcgccucgguggauagagcugcuauugugaccuucccgggcuaagcggggaacccagcggaguguguacugcccgcgguggcgggggaggaggugacugugugcaagccucgagugcagaggggguggcacccgggaauaaauaaaggcuugcaaccucgggcacuuggacccuucggagagcguuugguuguguuuagacuugggugcuuccuaacacuaauugcaggcucaagaggagcggaauuuauggcgaaggccaaggcggcuuguuuauaauuuaugaaguuuuaaaugguugugccgcgggcccagcucucuccggcgggcggccgcgugggagugugcccucccagaacucgccgccgcccccacccacgcuaggagugagugugccugucacgugacucgcguugguggcaggaaagaaccaagcaauucucugaagucuccagaacuucagaagguaggcgaaggcggcagguuuggucgaagcgaccccucccccuucuuccaacauccucccuccaccgccgggccugugagguugcggcugccuagacggugggaacccccaaccugacacuuccuuagagccuaugugugagaggaagcugaugucagccgggcuagacacuguuuaaaguaauccaugaaacccuaagccacagaugacgcuugggguauugcagacacccgcagacucagcagauacuccugugguaacacaccgcgcugggaaacgccuggagccaugaugcauuauguauuuuuauuauuauuuaugguaugaagaggagaugagagaaaccgggcugaaucuaaacagccugacaauucaucuauuuaauauuuagccaguuaagaaagguggcugugguucccuacgaggcagcuagcauuucuuugauuuccguaauagcuuaaaaaauaauuucuuacaauuauaaauucugucuaggaaugcaaauuucagagaaaacaauguuaagccuugagaguggguaaaauaugccuucgauugaagucauuuauucuguugauacaauucuacaacauauauacuuuaaacuugcucagauagagugaaauuuagcaaaaggauaaccccucccacccccagccuaacaugccauuuuuaaaacagcacaaaggaacaaggaaacuaaauauucuuuugagccaucauuacugagcgaaacacaaacauccaaauagaaaacgauugcuguugcaccagaagaguagaaguuaucuccacacaaugggaauuucaccucgugucaccaggcugguagugggaguugcauauuugccaaaccaacuagagaugcguggguggacuuugcugaaauacaaaauaauugaaccuugucugaaggccuuuuuccaagugcucccuucuauagaaguggguguaagugcucgacccuuccuagagccacacuaauaauauuuacaaaacgauuauaaauucuguagacuauucgcccauuuugcacaaagaaacaggaguaagcaagguguuuauac

SEQ ID NO: 9921 - RNA, 2501 nt, Mus musculus
agucauuggugaggcagaaaagagggaagaugcaaggaaugucuguucuagguuuaggacaagagggauuucugggucaaggaaacccgaaugcacccccccccccccaaagaggggcaagaguaacuugaccuucucagagggagggcuggguagaguccccucagggcaaaagcaauacuguuacccagcaucauccaggcucgcccaucauuccccgggaaauagcccaaggggucccgagagggaccagcccugaccgcugcaucccucgcccuucccugccuuucucccgcaauaccugucccaggagcugauguccagggcucucgccccgcccuuccgccggcgccgcucucccccgagcugggcggaggccccucagccacuuuggcuaaguuggcagcaaggcaggcgcguggaaccgcacuccagucgggaccggccagugcggggaaggcgccgauuggcuggcuggcgccacguggcugccgccgccgguauaugaagccacuauuuaccucgggcucgcucgccauggcucggcgagggcagcggggguagcgggaaggcggagcugcgcagaccugcagggugcggcgccuaggucgugcggagcgagccaugagcucuuaccuggaguacgugucgugcgccgcgggcgguggcagcggagggguaggcggcgacgugcucggcuucgcacccaaguucugccgcgccgacgcgcgcccuguggcccugcagccggccuucccccugggcagcggagacggcgccuucgugagcugccugccccuggccaccgcucggcccacgccgucgccucccgcaggccccgcucaguccccggucccacagcccgccgcgccccgguacgcgcccugcacccuggaaggcgccuacgagcggggcgccgcaccugccucugccgccgaguauggcuucuugggguccgggccggcguuugacuucccgggcgcacuugggagagcggcggacgagggcggggcgcacguccacuaugccaccucggcggucuucuccggcgggggaucauuccugcucagcggccagguggacuucgcugccuuuggcgagccuggccccuuccccgcgugucucaaggagcccgcagacggccaccccgggcccuuucagacuguguccccggccccuggagccugccccaagccggccucucccaccuccagccucccggccgcccacagcacuuucgaguggaugaaagugaagaggaacgcccccaagaaaaguaaggaggugggcgcugaggggaggcaccuggggguucggggggggggggcgccuccuucgugaagagccgggagcguguggccaccaacccuggagagagauucuacuccuaagcccuggucagagcccagggucagaaaaugccccaggagcugagaggccucagcagagcgcuucuucugguucagcuguguccaucacucaggagggcugcgcugugacuuugauucuaagucuuagcuccacuggauaguuucagcaucuccuccuccugcucacaccuugucuuuauguugcaggcaaacuguccgaauauggagccacaagcccucccagugccauccgcacaaauuucagcaccaagcaacugacagagcuagagaaagaguuucauuucaauaaguaccuaacuagagcccgacgcaucgagauagccaacuguuuacagcugaaugacacccaggucaaaaucugguuccagaaccguaggaugaagcagaagaagagggaacgagaggggcuucuggccacagcugccucuguggccucgauuaagcuuccccggucagaaacaagucccaucaaaucuggccggaaucuaggaagcccuucucaggcucaagagccuuccugaggcccacucuuaaggcugaggaccuugggucuacagaagucacagacugcuccccaccuuugaauagacuugagagcuuaguuugggcuggaggugggcauggguagaaauuaauacggauuuuacuuggcaaaggaauugucuaaauuggcuucugaguuccagaggcuguguauagagauauauauuugauaucuuuuauucgcauauuauuuuugccucauggggaggaaaggugucuuagcuaccugccuaaacgcugcuaugugagccacuuaaaauucucgggugcagaguggcaggccuucuuagucuaguguggucagaaacguaucucucugaaguuguuucaguuuuaauuuccuggacagacuacauauauucagcuuccugagaugaucaaagcuagcuaggguuuccucuauguagcuaagcugcuucaaugaugaucuucauauugugcuccaguuuguuuauuuaaaguggcgcuccuaccucuucgugugccugggugaagaaacacaaucacuguuuaguuaguagcggaacaaauccacaggguagguaaggauuagaaucugaauuauac

SEQ ID NO: 9922 - RNA, 2501 nt, Mus musculus
guauaauucagauucuaauccuuaccuacccuguggauuuguuccgcuacuaacuaaacagugauuguguuucuucacccaggcacacgaagagguaggagcgccacuuuaaauaaacaaacuggagcacaauaugaagaucaucauugaagcagcuuagcuacauagaggaaacccuagcuagcuuugaucaucucaggaagcugaauauauguagucuguccaggaaauuaaaacugaaacaacuucagagagauacguuucugaccacacuagacuaagaaggccugccacucugcacccgagaauuuuaaguggcucacauagcagcguuuaggcagguagcuaagacaccuuuccuccccaugaggcaaaaauaauaugcgaauaaaagauaucaaauauauaucucuauacacagccucuggaacucagaagccaauuuagacaauuccuuugccaaguaaaauccguauuaauuucuacccaugcccaccuccagcccaaacuaagcucucaagucuauucaaagguggggagcagucugugacuucuguagacccaagguccucagccuuaagagugggccucaggaaggcucuugagccugagaagggcuuccuagauuccggccagauuugaugggacuuguuucugaccggggaagcuuaaucgaggccacagaggcagcuguggccagaagccccucucguucccucuucuucugcuucauccuacgguucuggaaccagauuuugaccugggugucauucagcuguaaacaguuggcuaucucgaugcgucgggcucuaguuagguacuuauugaaaugaaacucuuucucuagcucugucaguugcuuggugcugaaauuugugcggauggcacugggagggcuuguggcuccauauucggacaguuugccugcaacauaaagacaaggugugagcaggaggaggagaugcugaaacuauccaguggagcuaagacuuagaaucaaagucacagcgcagcccuccugagugauggacacagcugaaccagaagaagcgcucugcugaggccucucagcuccuggggcauuuucugacccugggcucugaccagggcuuaggaguagaaucucucuccaggguugguggccacacgcucccggcucuucacgaaggaggcgccccccccccccgaacccccaggugccuccccucagcgcccaccuccuuacuuuucuugggggcguuccucuucacuuucauccacucgaaagugcugugggcggccgggaggcuggaggugggagaggccggcuuggggcaggcuccaggggccggggacacagucugaaagggcccgggguggccgucugcgggcuccuugagacacgcggggaaggggccaggcucgccaaaggcagcgaaguccaccuggccgcugagcaggaaugaucccccgccggagaagaccgccgagguggcauaguggacgugcgccccgcccucguccgccgcucucccaagugcgcccgggaagucaaacgccggcccggaccccaagaagccauacucggcggcagaggcaggugcggcgccccgcucguaggcgccuuccagggugcagggcgcguaccggggcgcggcgggcugugggaccggggacugagcggggccugcgggaggcgacggcgugggccgagcgguggccaggggcaggcagcucacgaaggcgccgucuccgcugcccagggggaaggccggcugcagggccacagggcgcgcgucggcgcggcagaacuugggugcgaagccgagcacgucgccgccuaccccuccgcugccaccgcccgcggcgcacgacacguacuccagguaagagcucauggcucgcuccgcacgaccuaggcgccgcacccugcaggucugcgcagcuccgccuucccgcuacccccgcugcccucgccgagccauggcgagcgagcccgagguaaauaguggcuucauauaccggcggcggcagccacguggcgccagccagccaaucggcgccuuccccgcacuggccggucccgacuggagugcgguuccacgcgccugccuugcugccaacuuagccaaaguggcugaggggccuccgcccagcucgggggagagcggcgccggcggaagggcggggcgagagcccuggacaucagcuccugggacagguauugcgggagaaaggcagggaagggcgagggaugcagcggucagggcuggucccucucgggaccccuugggcuauuucccggggaaugaugggcgagccuggaugaugcuggguaacaguauugcuuuugcccugaggggacucuacccagcccucccucugagaaggucaaguuacucuugccccucuuugggggggggggggugcauucggguuuccuugacccagaaaucccucuuguccuaaaccuagaacagacauuccuugcaucuucccucuuuucugccucaccaaugacu

SEQ ID NO: 9923 - RNA, 2501 nt, Mus musculus
gccauucaaacaauucuacuaugaaaugguguguccccucccccauuccugcagaugcuuuuugcuaaagauggaauuggggaaaaggggcaaaaucaacucugguucuucuucagacucagcucuuacccaguccaguaaagaauuauuugcuggggacaacaccacgaguccugugcaaauccugcuuuagaaacuauaaguuacccuugcugacaauuaguucaggcccagacucaggcucccuucuucugcccgccugcucugcugccccagugccuauguuuccucuagaacaauucauauucucauucucucucucucucucucucucucucucucucucucucucucucucucucucucccucucucccucucucucucccucccucccucccucccucccgugucugugugugugcaaagcuuucucucaaagucaguuuccauccccagccuaugcuucauuugugucucacugucuguuuagagcugguaccuauaaagcaagugagacuuucauuagcaaaaagcaagacaagagcauccuccaggccacuuucagcugcagaguucaagaccacagccaguucccagaaggcugugaggcagaacucgcuugcucagcucccgcagcaccagcugggugauuccacucuuucacuucucucccucaguucccuaucugcaaaaugggaauguccccccagcugccuugcaucacauccccugccaugaaaauaccacugagagaaaagauccaaaauucgagucccaccauuaucggaaaaaaaaaagugaagcaaggaaaaaaaaaaaagaaagaaaagaaaagucuggaggggagggguauagcuagcgcccacaaagcacgaaugcacacccagaaaagccagcacuaucucaggagcgaugaugagaacagagccagcagccucaagggacgccuuugagcggccaccuuggcaaggcugggaacuuucccccacaaaaagcgcccucgguucugaguccggcgcuucgcccaccgcccagcgccagggccuguccccaagcacccggccaccgccacugcccuucuguccaagcccucgugccccuccaggccgggucguaggucggccucggcucagccaggccgucccugcuccgcauccacagcccuccgcaaacacgcccccuccggccgcuucgggcgcgcaagcagggcccgcgcuggccagacgugaccagcuccgggaaaggccgggccaccgccgccugcagcccaugcgggagcuucuauggaagagucaacgggcacggcgggggacacccuggggaccccggaauccugcccuuccccuggcacccgggagccagggaaggggcugaguggcgggagcaggaggcuggccaagaucccugccagccuccuccaggaggaaggcucccaggaccacgaucucucagacccucgccggguguuccuggaacgggugacacccgggcaggugcaggcgaugccaauucggcccgcgucuuccuaccacacgcccaggcccacucgagagcuuaccuggcccuggcguagcaacagcagcagcggcagcagcgcccagcggagcccgggcgagcgcggggguguccgcgucucccgcgccgcgggcuucaugcccugcgcgcccuggaacgugcccgggacgcgccccgccgugugcccgaagccgggcgcccucgucuccgucuccagccgacgccuccgccuccuucuccgccagccgguccgccuaguccccgcuccgcccgccccgggcuuccccggggacauggcagcggcggcggcggcggccacacggcggagccuagcgcgccuggcgcggagcggccgcggccuuagacucgcaggggcuucgcggggcggagcgagcggcgcccacccuccgcgcguggcucccagcucccggcucccgcggccccggcugcucccucugccuccuccgcgcgucaugcggcuccggcugcagggagccgcgccgagcgcucggcccccucucuuccccucccccucugaauauucaucgcuuccucccgcucgggcgggccggccgcugccgugcuccgcggccccucgccgcccucucgccgcggcccccgcccccagcgagcuggcggcgggcggggagugggcgguggcgagcccggugcacgcucuggcgucuccccucccgcggccggaggaagcgcccccucccuguccgccuagcccucccacauuccugggacucgggacccgggacgcugcuccacuguuccagagccacgagcuaguauggaugggucaguagggacucuucagccugggacucccucccuggcucuggcuugagcgugccucuugcccaggucacagucgugcuugcuucuagaccgcaaucuggugaagccuggcccgugggugggcuuugggggagggugugggugaaccccccgaaacuauuggaagcacaccauguauuc

SEQ ID NO: 9924 - RNA, 2501 nt, Mus musculus
gaauacauggugugcuuccaauaguuucgggggguucacccacacccucccccaaagcccacccacgggccaggcuucaccagauugcggucuagaagcaagcacgacugugaccugggcaagaggcacgcucaagccagagccagggagggagucccaggcugaagagucccuacugacccauccauacuagcucguggcucuggaacaguggagcagcgucccgggucccgagucccaggaaugugggagggcuaggcggacagggagggggcgcuuccuccggccgcgggaggggagacgccagagcgugcaccgggcucgccaccgcccacuccccgcccgccgccagcucgcugggggcgggggccgcggcgagagggcggcgaggggccgcggagcacggcagcggccggcccgcccgagcgggaggaagcgaugaauauucagagggggaggggaagagagggggccgagcgcucggcgcggcucccugcagccggagccgcaugacgcgcggaggaggcagagggagcagccggggccgcgggagccgggagcugggagccacgcgcggagggugggcgccgcucgcuccgccccgcgaagccccugcgagucuaaggccgcggccgcuccgcgccaggcgcgcuaggcuccgccguguggccgccgccgccgccgcugccauguccccggggaagcccggggcgggcggagcggggacuaggcggaccggcuggcggagaaggaggcggaggcgucggcuggagacggagacgagggcgcccggcuucgggcacacggcggggcgcgucccgggcacguuccagggcgcgcagggcaugaagcccgcggcgcgggagacgcggacacccccgcgcucgcccgggcuccgcugggcgcugcugccgcugcugcuguugcuacgccagggccagguaagcucucgagugggccugggcgugugguaggaagacgcgggccgaauuggcaucgccugcaccugcccgggugucacccguuccaggaacacccggcgagggucugagagaucgugguccugggagccuuccuccuggaggaggcuggcagggaucuuggccagccuccugcucccgccacucagccccuucccuggcucccgggugccaggggaagggcaggauuccgggguccccagggugucccccgccgugcccguugacucuuccauagaagcucccgcaugggcugcaggcggcgguggcccggccuuucccggagcuggucacgucuggccagcgcgggcccugcuugcgcgcccgaagcggccggagggggcguguuugcggagggcuguggaugcggagcagggacggccuggcugagccgaggccgaccuacgacccggccuggaggggcacgagggcuuggacagaagggcaguggcgguggccgggugcuuggggacaggcccuggcgcugggcggugggcgaagcgccggacucagaaccgagggcgcuuuuugugggggaaaguucccagccuugccaagguggccgcucaaaggcgucccuugaggcugcuggcucuguucucaucaucgcuccugagauagugcuggcuuuucugggugugcauucgugcuuugugggcgcuagcuauaccccuccccuccagacuuuucuuuucuuucuuuuuuuuuuuuccuugcuucacuuuuuuuuuuccgauaauggugggacucgaauuuuggaucuuuucucucagugguauuuucauggcaggggaugugaugcaaggcagcuggggggacauucccauuuugcagauagggaacugagggagagaagugaaagaguggaaucacccagcuggugcugcgggagcugagcaagcgaguucugccucacagccuucugggaacuggcuguggucuugaacucugcagcugaaaguggccuggaggaugcucuugucuugcuuuuugcuaaugaaagucucacuugcuuuauagguaccagcucuaaacagacagugagacacaaaugaagcauaggcuggggauggaaacugacuuugagagaaagcuuugcacacacacagacacgggagggagggagggagggagggagagagagagggagagagggagagagagagagagagagagagagagagagagagagagagagagagagagagaaugagaauaugaauuguucuagaggaaacauaggcacuggggcagcagagcaggcgggcagaagaagggagccugagucugggccugaacuaauugucagcaaggguaacuuauaguuucuaaagcaggauuugcacaggacucgugguguuguccccagcaaauaauucuuuacuggacuggguaagagcugagucugaagaagaaccagaguugauuuugccccuuuuccccaauuccaucuuuagcaaaaagcaucugcaggaaugggggaggggacacaccauuucauaguagaauuguuugaauggc

SEQ ID NO: 9925 - RNA, 2501 nt, Mus musculus
aagugaggaaggaaaaguggggcauuuucaccucuuacuuuacuaaggacauugacccauuuaucauucucuucccucagaccuuccccccaaggccacucagcguggacaucugucccauacaaaaucucaccuccuacuguccuugcuugcagcacaguccaugccuugcccgaguccucucuccccacacaaaccagaaagcuggucuguaggaugccuugggccacccuaggguggccucucuagcggccucgguuuccccaccugcuaacuuggaucaaugacgccugagcgcggcacccgguggguaacgcucaggauccaggaaugaggaagggucccaugcucagcgcaggcucggugcggugccccaggcccaacugcucggcgccccucccucguccuccgcucuccccuccgccuccccugcuccccgcccuugcguuucuccgcuucagcuucugcuguccuucccacuugcucacgccucccuugccgggguccccacucgucgccggcuaaacccccgccaccccuggaggcccggucaagccgcagcgcgggcgaccaguguguagcccggcguccucaccgagcaggauagccggcugggaccgaagccgacccgcccgccaccagccaggugagggcagcccggaggaggcgggggcgcaggcuucucuucuaugcgagcgggggcggcgggaggcacgagggacccggucccuuuuccuggaaaggaggaccugggcgcuuuuucaugaaagaggcucaggggcuuuuacuucagagggagggguggagggcagggauaauggaaaaggggcuugcggggaccccuuaauggggcauuuuuccccacgagaagggacuuauugacugcuucuguaaaaguggggcucacauucuuggaaggaugcggacuuucaaggaagauacagggggguucuggcacgguuugaaagcaguguuaacugggauaugggaacaaggcgcuaggggcuuggagaugcccuuagucugacaucgcugcaccuucuccauugguucuauggcucugggucuauccagcucugucccaguuuuccucuuugaagaugacuauuuuugagcuucaccuggacagagcuuugugcagccauuuccuuuccuggagcucugagacccaccugacgccuuaccauccuccucugaccugcuggggaaugggauuguuagaggaaaggauccaggguucaggggcaugugcaguggaguacggaagguaggaaggguauuggacacacaagaaccuuuggcacugguggguucaucugacuuagaggggagguggcaaaggauaaggugggcaggagcuucgagcgaagaccugccaggaaagcugccgggcagagggagagcucccaccucucagcaaacaaaugacagaggcugugcuugccuuuguuugcuuccuccuucgcucccuugucucuucugguuuugcaaaaggggucacugaggcgggaaacacauugaccuuuguguaagagggagagcugguagagaagcgcacugauuugaaauggaaaaaaagaacaaacccucuguuuaaggcuaagaguucaguggaugaccuugagccaaaacguguaccccucguuuaggcaccagauuucucauccauaaaauggaagagggcuuaucuauauguccaaaagagcuuuguaugaagaaacagaguggaccggacacuucucagguguaguucucacuacuauggauggacccuuucccuccucccuacccucaccccauaacccauaggacagagagucagaaaaguauggaaggagucagcguucagcuggacuugaggucuuucuugugagaauuauauggcagugcaguuuauucugacagcugggcaguggacugcaggcgaacauccaggagugcgccacagcugcacagcuggaccuggccgcucucagcagccccucaacccccggaaucugcaagagacucaaggcuacacacacuuucaggguacuucccagaaaagcucuugccccgaguugucugucucuagcuuccugccugccugccuccaccuuggaguccacguuaaagcaugacagaaucccagcauuagugacucccagggacuggauaaugcuuccccaagcucuccauuuacugaggcucuaaccuugucaugucaagaaccugaccauaucgcuuuccccagggguaaagaacagucgccucuaggucugucccaguaccaugucccaguacagaccaugcucacaauugcugucuggguggcguaugcuuagcaccaguuuguguggcccuccauugugccauuuacacggaugaagccuuacucagagaguuaaacaaaacaaaaaaaaaauugccuaaggugaccggggcacgacucaguguccgagugccugcaguucauuccaagucccauaucuaggucuaagugucugccacucccaaaugaa

SEQ ID NO: 9926 - RNA, 2501 nt, Mus musculus
uucauuugggaguggcagacacuuagaccuagauaugggacuuggaaugaacugcaggcacucggacacugagucgugccccggucaccuuaggcaauuuuuuuuuuguuuuguuuaacucucugaguaaggcuucauccguguaaauggcacaauggagggccacacaaacuggugcuaagcauacgccacccagacagcaauugugagcauggucuguacugggacaugguacugggacagaccuagaggcgacuguucuuuaccccuggggaaagcgauauggucagguucuugacaugacaagguuagagccucaguaaauggagagcuuggggaagcauuauccagucccugggagucacuaaugcugggauucugucaugcuuuaacguggacuccaagguggaggcaggcaggcaggaagcuagagacagacaacucggggcaagagcuuuucugggaaguacccugaaaguguguguagccuugagucucuugcagauuccggggguugaggggcugcugagagcggccagguccagcugugcagcuguggcgcacuccuggauguucgccugcaguccacugcccagcugucagaauaaacugcacugccauauaauucucacaagaaagaccucaaguccagcugaacgcugacuccuuccauacuuuucugacucucuguccuauggguuauggggugaggguagggaggagggaaaggguccauccauaguagugagaacuacaccugagaaguguccgguccacucuguuucuucauacaaagcucuuuuggacauauagauaagcccucuuccauuuuauggaugagaaaucuggugccuaaacgagggguacacguuuuggcucaaggucauccacugaacucuuagccuuaaacagaggguuuguucuuuuuuuccauuucaaaucagugcgcuucucuaccagcucucccucuuacacaaaggucaauguguuucccgccucagugaccccuuuugcaaaaccagaagagacaagggagcgaaggaggaagcaaacaaaggcaagcacagccucugucauuuguuugcugagaggugggagcucucccucugcccggcagcuuuccuggcaggucuucgcucgaagcuccugcccaccuuauccuuugccaccuccccucuaagucagaugaacccaccagugccaaagguucuuguguguccaauacccuuccuaccuuccguacuccacugcacaugccccugaacccuggauccuuuccucuaacaaucccauuccccagcaggucagaggaggaugguaaggcgucaggugggucucagagcuccaggaaaggaaauggcugcacaaagcucuguccaggugaagcucaaaaauagucaucuucaaagaggaaaacugggacagagcuggauagacccagagccauagaaccaauggagaaggugcagcgaugucagacuaagggcaucuccaagccccuagcgccuuguucccauaucccaguuaacacugcuuucaaaccgugccagaaccccccuguaucuuccuugaaaguccgcauccuuccaagaaugugagccccacuuuuacagaagcagucaauaagucccuucucguggggaaaaaugccccauuaagggguccccgcaagccccuuuuccauuaucccugcccuccaccccucccucugaaguaaaagccccugagccucuuucaugaaaaagcgcccagguccuccuuuccaggaaaagggaccgggucccucgugccucccgccgcccccgcucgcauagaagagaagccugcgcccccgccuccuccgggcugcccucaccuggcugguggcgggcgggucggcuucggucccagccggcuauccugcucggugaggacgccgggcuacacacuggucgcccgcgcugcggcuugaccgggccuccagggguggcggggguuuagccggcgacgaguggggaccccggcaagggaggcgugagcaagugggaaggacagcagaagcugaagcggagaaacgcaagggcggggagcaggggaggcggaggggagagcggaggacgagggaggggcgccgagcaguugggccuggggcaccgcaccgagccugcgcugagcaugggacccuuccucauuccuggauccugagcguuacccaccgggugccgcgcucaggcgucauugauccaaguuagcagguggggaaaccgaggccgcuagagaggccacccuaggguggcccaaggcauccuacagaccagcuuucugguuuguguggggagagaggacucgggcaaggcauggacugugcugcaagcaaggacaguaggaggugagauuuuguaugggacagauguccacgcugaguggccuuggggggaaggucugagggaagagaaugauaaaugggucaauguccuuaguaaaguaagaggugaaaaugccccacuuuuccuuccucacuu

SEQ ID NO: 9927 - RNA, 2501 nt, Mus musculus
gaacccaggcugagaguugccaguacgauaauuuucuguuuaagcuggggauauuugagucgcaguaauggggacagauaaggggcucucuccggaaggcuaggaauguuagggcagacugaguaggagcuaaggcgagcgcaagaggcacaggcgggugggguccugggacuggggggcgagggcagagggcgggaaggggccgggccagagccgggggcgggaccaggcgggguggugguggcgggggccgagacgcgggaggcggggcggccaggcucgggacacccccucccgguccccuggcggggcggcuucaacuccggcaguacaggaggcagcagcagcccggagggcgacuugcagggcgcgccggccgagcuggacccgggacgcuuuucaacccgggggaacccuccgcugauucucuccgccccggcgucccuugggagcccgcgggacccccgggccggcagggaacgccggcggcggccgcagcaccaugaggcggugguggggcgcgcugcugcuuggcgcccugcucugcgcacacgguaagcggcgucgcagcgcccgcgccgaccgggccaccgggaaaguuugucccugagacuggucgcugcaggacucgccuccugggagugggaccgugaggcuggggccugaagucccacccucgagcucacuucgagcaccaacccuggcagagcgagcggaggaaagcaauagcagcccccgcagcucuucuagcacgagaggggacagcgguggugggacucguccccgcuguagucugggccggguggaagaagacccaagacgcucucucggcuuccaucgcugcucuuuaacgagccaggggcggguucccuuucagguuaaggcagggcuucugugucccuggugcgugcgaaugaaugugugcaaagaaaggaaggcggggaggauggucgcuaaacccauaaauuguaaacaguucucuuuccagggacugggggaucuuggguggauugcggagaggggcccagcugaaucugaguuacuugagcauccgggauucauggacuuggggagcaauuucucggacucgaaacccugcucucucugaggguccuugguucauacuugcgugcagcaucuccccuaaguggaguuuuggguucccucuccuggcugcggccaaucagcuuccugccccggauccuccccaagggagggguggggaacagcgauggaaaagagguuggggaggaacuuugggaagaaacugcuggaaagcucccucagaucgguucuggcccggguaaagcgcaggggcgcguucuuugggaacuuccaaaggcagccucgcgacccgugcaguggggccuuggccuccggggagcugggcggauggcagcggcacugcugcuucaucugcuccuuauuaauaacguguucggugcccggacgcaacuguuaugucuacuuaggacugcaguggaaucugcuucucugcagcagcuugggaacgugggugcacccggagauuuagcagcugccucugaguuugugcccaaagaucaaagaucgaucuuugaacucucaacuauauucacccgccggcuuuuccacgugggggagauccaguucuucgauucccuggcugcgggacgagggggugggguucagaaagagcggucugcagauccuggcgauucacggguucuuucuuucacauggaggagcucguguggaaagugcagauuucggaacuugccuggcaggguguggagcugucugggcacuuguuuuaaagauuguuuuagcucccgaguccaaaacaaaguucuggugucugcuauuuaaaccgcucguggguuuucaauggcuuuuuccaugugguaucuaacgccgaccgagucuuuucucuccgacugguagucuggccgacccacguuccucuucgcgccucguucucccccucucgggcucucuccucgaagguuauuuguagccucuucggcguguuaggacagcagcccuacugggguaggaauguaacuguucuucccaccacaugggccccuuaaagggacagcuaugcuuuugggggguuuccccccuucggguuucaagggaaggggauggaacuuuccucucggcccccuggaggaaguuuugaaaaagaucaagggaaauagcuaggcacuaggaaaagggggguggggugggggcuaaaacggauaccaacaaagccaaagaggagauugucgccuucugccccagggaagggggagcuggaagguuccggacugagacucgccaagaggaauucacugcuccagagcugcugucaaaauugcguacauuacauuugcaauggaggaugggggugagaacaggagcagagaaucguggauucuuaauguuuugcagugggaaagaaaaaaaaaaaaacaacauuagaggguucucaguaacuaguugagguucauuuuuaaaggagaagguuuaauaga

SEQ ID NO: 9928 - RNA, 2501 nt, Mus musculus
ucuauuaaaccuucuccuuuaaaaaugaaccucaacuaguuacugagaacccucuaauguuguuuuuuuuuuuuucuuucccacugcaaaacauuaagaauccacgauucucugcuccuguucucacccccauccuccauugcaaauguaauguacgcaauuuugacagcagcucuggagcagugaauuccucuuggcgagucucaguccggaaccuuccagcucccccuucccuggggcagaaggcgacaaucuccucuuuggcuuuguugguauccguuuuagcccccaccccaccccccuuuuccuagugccuagcuauuucccuugaucuuuuucaaaacuuccuccagggggccgagaggaaaguuccauccccuucccuugaaacccgaaggggggaaaccccccaaaagcauagcugucccuuuaaggggcccauguggugggaagaacaguuacauuccuaccccaguagggcugcuguccuaacacgccgaagaggcuacaaauaaccuucgaggagagagcccgagagggggagaacgaggcgcgaagaggaacgugggucggccagacuaccagucggagagaaaagacucggucggcguuagauaccacauggaaaaagccauugaaaacccacgagcgguuuaaauagcagacaccagaacuuuguuuuggacucgggagcuaaaacaaucuuuaaaacaagugcccagacagcuccacacccugccaggcaaguuccgaaaucugcacuuuccacacgagcuccuccaugugaaagaaagaacccgugaaucgccaggaucugcagaccgcucuuucugaaccccacccccucgucccgcagccagggaaucgaagaacuggaucucccccacguggaaaagccggcgggugaauauaguugagaguucaaagaucgaucuuugaucuuugggcacaaacucagaggcagcugcuaaaucuccgggugcacccacguucccaagcugcugcagagaagcagauuccacugcaguccuaaguagacauaacaguugcguccgggcaccgaacacguuauuaauaaggagcagaugaagcagcagugccgcugccauccgcccagcuccccggaggccaaggccccacugcacgggucgcgaggcugccuuuggaaguucccaaagaacgcgccccugcgcuuuacccgggccagaaccgaucugagggagcuuuccagcaguuucuucccaaaguuccuccccaaccucuuuuccaucgcuguuccccaccccucccuuggggaggauccggggcaggaagcugauuggccgcagccaggagagggaacccaaaacuccacuuaggggagaugcugcacgcaaguaugaaccaaggacccucagagagagcaggguuucgaguccgagaaauugcuccccaaguccaugaaucccggaugcucaaguaacucagauucagcugggccccucuccgcaauccacccaagaucccccagucccuggaaagagaacuguuuacaauuuauggguuuagcgaccauccuccccgccuuccuuucuuugcacacauucauucgcacgcaccagggacacagaagcccugccuuaaccugaaagggaacccgccccuggcucguuaaagagcagcgauggaagccgagagagcgucuugggucuucuuccacccggcccagacuacagcggggacgagucccaccaccgcuguccccucucgugcuagaagagcugcgggggcugcuauugcuuuccuccgcucgcucugccaggguuggugcucgaagugagcucgagggugggacuucaggccccagccucacggucccacucccaggaggcgaguccugcagcgaccagucucagggacaaacuuucccgguggcccggucggcgcgggcgcugcgacgccgcuuaccgugugcgcagagcagggcgccaagcagcagcgcgccccaccaccgccucauggugcugcggccgccgccggcguucccugccggcccgggggucccgcgggcucccaagggacgccggggcggagagaaucagcggaggguucccccggguugaaaagcgucccggguccagcucggccggcgcgcccugcaagucgcccuccgggcugcugcugccuccuguacugccggaguugaagccgccccgccaggggaccgggagggggugucccgagccuggccgccccgccucccgcgucucggcccccgccaccaccaccccgccuggucccgcccccggcucuggcccggccccuucccgcccucugcccucgccccccagucccaggaccccacccgccugugccucuugcgcucgccuuagcuccuacucagucugcccuaacauuccuagccuuccggagagagccccuuaucuguccccauuacugcgacucaaauauccccagcuuaaacagaaaauuaucguacuggcaacucucagccuggguuc

SEQ ID NO: 9929 - RNA, 2501 nt, Mus musculus
uguucuagccaggagaggagcccucuccuccuggaaaccucuucgccaugacuauccaacccugguccagaugagggcuguggccccagcuggccauucccuucuggugucccacugcgcaucaggaauucuuuccugcacuggagcaaggccagaagagcagcuacagagcagagcaggcugcagcguucauugagaagaaagcccagcucagucgguccccagcugcacugucccuggagccugggccccaacaaaccucuuucccucugagcagaaucuuuuaccugcuccaagagggcuauguggucccucaggaagcuguuguuuuacuccugggaagcaucuagaaccauccuuaggaagcacuggcccgguuucccuccauuuuacagaucagguaauggaggccugagggggaaagagagacacgcauggcccaggcucacaagggaaacagaggcaggaugaggguguugccacuucuccuaagacuaagcaucucuccuaguuccuuccaucugauguagaagacuaagacuugaacaaccucccucagacagcaaggccgggacaugcugcuugagaaugccugggagaucugucaccccaugacucccuaacugauggagacgcgaaaucaagcugagcaggacacucaaugacaucuaaggccuuugucugcuuaaguuuuguuagagcaagagguagagacaaacagguggggagccauguguuuggucucuggugugugugggguggaggggugugcaaauguggcucauuccaugguggggguggguucccagaagauucuccaaacagcccacguuucuucaggaugagccccugaauccugcccccccccccccccaccgcgugugcgugugcgugugcguguguguguguguguguguguguguaucugucugucagccaugcuccuccuccaucaagucuuagggcugagcccgagugaaagagagugaaaggaaauaagagagagccacguuuccuuagaaaagaaggggaaaggagugagaaggaggauaacuucacagcuaggagcagucaugaagccacagggagagacaaaguuagcagaaccacagggaacuuagggacaagaaguacaguggccaagagacugauaggaaaaaaaaagggucuucugagacgucacccggugcuucccugucccaccacccccuacugccuucccgggagggaggccagagcaggguucuucaguuucugggucuggcucuguaucugggucugccucugacccccuagaagcuucgggcgucuggccugggaaagcaccccugugcgcccccaggcggagauacagccccagagccaccgaggcccuaaagagggcgcaggaaagagcuccucuacuuugcgcccagucugguuccagaaccuugggguggguggagggcggauggaagacuauggcugacuaugccgcgcgcgggcugugggguuuggggugaggauuggugucucguuaguucaugucgagauucagaggccccuuacgccuccuuguccccuuccucuagaagccagaggccaacguguucuuggauugaguccccaggagugguguggggcgagagcugcgagccuacucucuaggcuccuggucuaagaggggcguccaaggaacuaguugccccaucuuaaaacccuagcacguguccauccaagggacccugugcugaacccccuccuuggcucuugcgggucuuugcaggguuccaggcgcucugcggagaggggugagaguugugugcaaaggggaaccgagacccuuucguucuuaccgcauuguugaggaaauccgacucauucaggucucccaaguccaggaagcuggaucccgggaacagccugucggccgggaaagguuccaagacggcguccaucgcgccggguuccaggggaccccuucgggcugcgcuuuccucacuccagggcggcggcgaaccccgcaccgggcugcggcugggcgcgggcaggcggcccggggggcagguccgggcgagccccgggggaggagcgguggggguggcgcgggucgggggcgcuggggggccuuagggcagcggcgccgaaagcaccgugggcuuucagccgacuccuccuccugcuccucccggggcgcagcuggcuuccauggggagcccggggguggggccgaugcuggaggagccccccaggccgggcgggagccaggggcgggggagcucaaugcucccccgaggauggguggcugccgagucgcagagaucucucugggucucuuccucugcgcggcuucugucacuuuccggagucugaaacugggaacccggggcugguuaacccagcuggcccgggcgccacgcccccacaucaauauucacgauaacucaauauuaaugaguagagggcguggcuggggcuucgucgccucuccuuuaaagagacgugugucuguuagguuuccu

SEQ ID NO: 9930 - RNA, 2501 nt, Mus musculus
aggaaaccuaacagacacacgucucuuuaaaggagaggcgacgaagccccagccacgcccucuacucauuaauauugaguuaucgugaauauugaugugggggcguggcgcccgggccagcuggguuaaccagccccggguucccaguuucagacuccggaaagugacagaagccgcgcagaggaagagacccagagagaucucugcgacucggcagccacccauccucgggggagcauugagcucccccgccccuggcucccgcccggccuggggggcuccuccagcaucggccccacccccgggcuccccauggaagccagcugcgccccgggaggagcaggaggaggagucggcugaaagcccacggugcuuucggcgccgcugcccuaaggccccccagcgcccccgacccgcgccacccccaccgcuccucccccggggcucgcccggaccugccccccgggccgccugcccgcgcccagccgcagcccggugcgggguucgccgccgcccuggagugaggaaagcgcagcccgaagggguccccuggaacccggcgcgauggacgccgucuuggaaccuuucccggccgacaggcuguucccgggauccagcuuccuggacuugggagaccugaaugagucggauuuccucaacaaugcgguaagaacgaaagggucucgguuccccuuugcacacaacucucaccccucuccgcagagcgccuggaacccugcaaagacccgcaagagccaaggaggggguucagcacagggucccuuggauggacacgugcuaggguuuuaagauggggcaacuaguuccuuggacgccccucuuagaccaggagccuagagaguaggcucgcagcucucgccccacaccacuccuggggacucaauccaagaacacguuggccucuggcuucuagaggaaggggacaaggaggcguaaggggccucugaaucucgacaugaacuaacgagacaccaauccucaccccaaaccccacagcccgcgcgcggcauagucagccauagucuuccauccgcccuccacccaccccaagguucuggaaccagacugggcgcaaaguagaggagcucuuuccugcgcccucuuuagggccucgguggcucuggggcuguaucuccgccugggggcgcacaggggugcuuucccaggccagacgcccgaagcuucuagggggucagaggcagacccagauacagagccagacccagaaacugaagaacccugcucuggccucccucccgggaaggcaguaggggguggugggacagggaagcaccgggugacgucucagaagacccuuuuuuuuuccuaucagucucuuggccacuguacuucuugucccuaaguucccugugguucugcuaacuuugucucucccuguggcuucaugacugcuccuagcugugaaguuauccuccuucucacuccuuuccccuucuuuucuaaggaaacguggcucucucuuauuuccuuucacucucuuucacucgggcucagcccuaagacuugauggaggaggagcauggcugacagacagauacacacacacacacacacacacacacgcacacgcacacgcacacgcggugggggggggggggggcaggauucaggggcucauccugaagaaacgugggcuguuuggagaaucuucugggaacccacccccaccauggaaugagccacauuugcacaccccuccaccccacacacaccagagaccaaacacauggcuccccaccuguuugucucuaccucuugcucuaacaaaacuuaagcagacaaaggccuuagaugucauugaguguccugcucagcuugauuucgcgucuccaucaguuagggagucauggggugacagaucucccaggcauucucaagcagcaugucccggccuugcugucugagggagguuguucaagucuuagucuucuacaucagauggaaggaacuaggagagaugcuuagucuuaggagaaguggcaacacccucauccugccucuguuucccuugugagccugggccaugcgugucucucuuucccccucaggccuccauuaccugaucuguaaaauggagggaaaccgggccagugcuuccuaaggaugguucuagaugcuucccaggaguaaaacaacagcuuccugagggaccacauagcccucuuggagcagguaaaagauucugcucagagggaaagagguuuguuggggcccaggcuccagggacagugcagcuggggaccgacugagcugggcuuucuucucaaugaacgcugcagccugcucugcucuguagcugcucuucuggccuugcuccagugcaggaaagaauuccugaugcgcagugggacaccagaagggaauggccagcuggggccacagcccucaucuggaccaggguuggauagucauggcgaagagguuuccaggaggagagggcuccucuccuggcuagaaca

SEQ ID NO: 9931 - RNA, 2501 nt, Mus musculus
ucuuaaagcacacacauauugacuggaccacugaaauggcucaguggguagagguacuugugccaauugugaugaccugaguucacccuugaccucuugagaacagugguguguuggucaagaguguaaccuauggagguaacugcuuaugugcaaauuucugcuacgucagugauuaccugugugaucccagcuacuuagcuucucugugccuuggguuucucuccauaaaacgcagcuauauuauaccuuguaauggggauccguuacauuaacauggcucaaaugcuuagcuagaucugagugucuggcuggcuuugcuguagugucugccuaacauuauuauguucaccuuggcuggaucccuaacuuacugagucacaguaaggaaguuauuuguucucuacaggucucucccuaugacugguggugcaaaagaccugggacagauaaugaguaaugugguauugaucuuuacgauuccugcuccccacgcccccagucccacucaccaaugaugacgccgcaggugagcagggcauagaaggaaguggucuguuugagcagcagguaggagagaagaacguugaacacgguggugagcgagcgucccacguuguagaagggcaccccuacguacuugaggcagagguuauugaagguuaucaugccgauaaagaccacugacagcggcagcacacuucgggccaccuugagguccagguuuaggguggggaagucuaccaugccggggcagcagguggccagagugcugaggcccuugcacagcagugaggucaccaggcauugguagaaggugacaaaaauggggguauccagcugcagggaggggcuguccagcagguacuuguugaggaauaccauggaaauggaggugacccaguagagagagaccaccagcgcgaucugcagagcccggagcagaaauggcuuguucccgcucucugacuccucggagacagcagagacuccagucagcgccaugcgcaggauccuggaccgcuucagaggcgcccuguucaugguggcagaagagcugggucaccuuacggccagaagcagucccuggacuacagggcuucaagcagcuagggucuguggcugcagccuucaacugucacaugggaugaccuaucgguccccuccuucuuggaugaaguucugcuuccggauuugccgaggugcaccgcuccucaucuugcucgcucccggggcgggggagggagguggugucacgaaacaagacccagggaagggagaaggggccuaacuaaggaugugggcuuugacagccauggccaguuugaggacaggggacacgugagucgcagggagaaaggaagcgagagagcgaaggaaggacggagcggaggaggaaauaacuggacgcggaccgcgugggaagcaugggcugcgggaacccccggaagcacccgcagagccgaaaggagggcgugcugcagggagaucaccgaggcucaggaaggcgucucgagggacacggacaggggccugaccggagcaaggcccugcgguugccacgagccgaauucaaguuccggcucagcgacgcgggucccgggccacuuaccgagcagggcgggcccugcgcgcauuuccugacacgccuacgagccgccuuaaagggccagcucgcaggccguugccacuucccgcggccgucaagagcuccccggcaagucugcaccuaugcccacagaccugcccucuucuuccgggaguccccggagaucagggaaggguuugcaagugcuauagccucucccauuuucuggaagguucugucauucuccccuccacccgcacuaucuuuuccccugauaucuucagaucgaccagacucggucaggugcaucuucaccaucuacccagaaaauggaauaccaccuuucugcuuagggagacccccccccucccuccgcccagcccuugcgcccggcuccccaccguugcaccucccucgucccucgagcucaggccacucgggaagaccuuguugcaguccucuccuuuuuuccuaccccuauuuucaccgcuuccagaccuagucaggacaugaagucccggagauccaagcagcacuuccagaggcgagaagccaugucaccuccuccagauaaaguccauucuggaugcccagaccaaagccucugagcuucucaaugcuguauccccuucccggggcccuuucccuuccagaacguaccguccguccacccgacugggcucugguguccuggcugaugcagggaccuggugcucacccucggcggugcccucgggugcaccugcagcaccacccucggcugaacuugcaacgcugcccaagccgcgcccccaguacgacuuccugccacgucgggcuuugggcaagguggggcgauuacccacgggagcccaucaagaaagccucuuuccuuuaucuaaggucaacgccaucucccacccuccaccccagc

SEQ ID NO: 9932 - RNA, 2501 nt, Mus musculus
gcugggguggagggugggagauggcguugaccuuagauaaaggaaagaggcuuucuugaugggcucccguggguaaucgccccaccuugcccaaagcccgacguggcaggaagucguacugggggcgcggcuugggcagcguugcaaguucagccgaggguggugcugcaggugcacccgagggcaccgccgagggugagcaccaggucccugcaucagccaggacaccagagcccagucggguggacggacgguacguucuggaagggaaagggccccgggaaggggauacagcauugagaagcucagaggcuuuggucugggcauccagaauggacuuuaucuggaggaggugacauggcuucucgccucuggaagugcugcuuggaucuccgggacuucauguccugacuaggucuggaagcggugaaaauagggguaggaaaaaaggagaggacugcaacaaggucuucccgaguggccugagcucgagggacgagggaggugcaacgguggggagccgggcgcaagggcugggcggagggagggggggggucucccuaagcagaaaggugguauuccauuuucuggguagauggugaagaugcaccugaccgagucuggucgaucugaagauaucaggggaaaagauagugcggguggaggggagaaugacagaaccuuccagaaaaugggagaggcuauagcacuugcaaacccuucccugaucuccggggacucccggaagaagagggcaggucugugggcauaggugcagacuugccggggagcucuugacggccgcgggaaguggcaacggccugcgagcuggcccuuuaaggcggcucguaggcgugucaggaaaugcgcgcagggcccgcccugcucgguaaguggcccgggacccgcgucgcugagccggaacuugaauucggcucguggcaaccgcagggccuugcuccggucaggccccuguccgugucccucgagacgccuuccugagccucggugaucucccugcagcacgcccuccuuucggcucugcgggugcuuccggggguucccgcagcccaugcuucccacgcgguccgcguccaguuauuuccuccuccgcuccguccuuccuucgcucucucgcuuccuuucucccugcgacucacguguccccuguccucaaacuggccauggcugucaaagcccacauccuuaguuaggccccuucucccuucccugggucuuguuucgugacaccaccucccucccccgccccgggagcgagcaagaugaggagcggugcaccucggcaaauccggaagcagaacuucauccaagaaggaggggaccgauaggucaucccaugugacaguugaaggcugcagccacagacccuagcugcuugaagcccuguaguccagggacugcuucuggccguaaggugacccagcucuucugccaccaugaacagggcgccucugaagcgguccaggauccugcgcauggcgcugacuggagucucugcugucuccgaggagucagagagcgggaacaagccauuucugcuccgggcucugcagaucgcgcugguggucucucucuacugggucaccuccauuuccaugguauuccucaacaaguaccugcuggacagccccucccugcagcuggauacccccauuuuugucaccuucuaccaaugccuggugaccucacugcugugcaagggccucagcacucuggccaccugcugccccggcaugguagacuuccccacccuaaaccuggaccucaagguggcccgaagugugcugccgcugucaguggucuuuaucggcaugauaaccuucaauaaccucugccucaaguacguaggggugcccuucuacaacgugggacgcucgcucaccaccguguucaacguucuucucuccuaccugcugcucaaacagaccacuuccuucuaugcccugcucaccugcggcgucaucauuggugagugggacugggggcguggggagcaggaaucguaaagaucaauaccacauuacucauuaucugucccaggucuuuugcaccaccagucauagggagagaccuguagagaacaaauaacuuccuuacugugacucaguaaguuagggauccagccaaggugaacauaauaauguuaggcagacacuacagcaaagccagccagacacucagaucuagcuaagcauuugagccauguuaauguaacggauccccauuacaagguauaauauagcugcguuuuauggagagaaacccaaggcacagagaagcuaaguagcugggaucacacagguaaucacugacguagcagaaauuugcacauaagcaguuaccuccauagguuacacucuugaccaacacaccacuguucucaagaggucaagggugaacucaggucaucacaauuggcacaaguaccucuacccacugagccauuucagugguccagucaauaugugugugcuuuaaga

SEQ ID NO: 9933 - RNA, 2501 nt, Mus musculus
aagggcgaacacaggaaggggguuucaccagcccuugucacagccugcucuggggccaccagcgcuguguuuaguaggaaauagaggaauuagcucaaacggaaguuuuccuuuuugggaagggguggagggggcgacaaaaauggacugcaucucccaaagagacugccauucccgggccaaaccccagcagccaguuucuucggauccaaucuccacacaagcacagaacucuuuuuauaagcuagguggagggaauguuacacuucucgccucggugaguuugcccuuccagaacuuggaaaggaaacagccuggcaugaaaagaaaggggcaaguggguaacacacaauuuuuuuuuuuagacagcuuggcgaucagaccauugggugggcguuggcugguuggucguugcccguggcagagaagacagcccuaacccccaucauucauaccccagucccucucuuccucggaguguuauuaaguccccgggccggcggccguacuuggccuugcagugcaaaauguguuuggcgaggaagucaaggcggcgcuguagcagcugagcgugggguucugagagcuccgccagcucugggaaacgcgguucguggcgacuguagaggcgcagcaaccgggccgccgcguccugaccccggugcagcuccaagacgcgccuagcaguccgcucucggaauacacacaccgacuguagcagcgguucguuauacuugucccacaugccggcuacccgguagccgugcaccaagcccgccucauuguccagaaagaccaacgccccuccugguccucggugcagguugcucguagcgcggugcauaacgcgugggucccacuguaagcugaagagguugcucacaagccggucaaaguuggccgucagguaaucgaagaggaucagaucgguccauuguaccaaguccaccagcuccgccuggcugagguuggucagcucgcccccggcgucgcgcaggggccgcagacggccguccucugaucgccagggcucgggcaccaccacgucggugagguuaggcagccagcgcgucaggcucaccacgcugcccucgguccagugcgcggugcgcagcuccuccugcaccugcacccacugcgcgccccgagccuccacccgagccagugccagcggcggcacguggcgcuggaggcccagcaggcgcgcaagguaguaggacagggccucgcccuguaucugcucuggguugaugccguagcguacacaggcacgggugccgucggcaaagcgggcuaggcgguuggaacugcguccgcagcccccgcgauccagagccaccacccgagcaccccgugccaccuccagccacgcugcugcuugggcuucggaaaagccccggggaaccugcuccuccaggccgcggcuccagaagacgcccccgugcaccgcccugcgcuccucuggccaggacagcccggagggcucgugccgcccgcggucguccuggugccuccuaggcggguuauccgcgccggccgccagggugagcagcgcccggaaaguuuucagggagccgccgcgggcgucccauacuaggggcgggggcagagggaaucgcggcucgggcgcggggccgccacucuggaucggaugcggagggagucgaucuucgggcggccgggaggcuggcagcucgguccgcgguggcaggaguccuccccacagcgucagcagcgagcucaaagccagcagccagagccccgcggcggcggcggcgccccgcaucuuccuccccaugcuccugccggcgcgccggugccaccgccgccgcuucaagccaagcccgggcgcccgggugcgggcggcgaggcgggcccggcugcuagcuggcuccggggcuucgggugccggagccccaucgcggccgcggagcgcugcggggcucuggccagcgcucugccccggcgcugggaacucgccuccccguggcuucccagcagcuuuuguauuucgcugugagacccuccggcgggcgcgauucacaggcgcccggaccacgugggagcgagggggaucccccucccccuccucugccgccucuccccgccccccacucccccgccccuucccuuccucuuccccuuaaagcggcaaccgauccuuccaggagcgagagguggccccacguucugucccggacuucggggcggggaggaggcugaacugagggcguccgugcgggggcgucggagcgggggcgggggcagagaccaauuguagggcuugggaguagcggcguguccggugcucuuguugggagugggaugauccccuuguacccuccuuuggacugugucugaucugaaaacuucagacagccccccaccgcaguacaggcaggggucagggugaguccuuuugcuaccucacuuggugugauucacgcuggcuuauguaaauuccccggaaagucucgagcccuagaggaugugacuccagc

SEQ ID NO: 9934 - RNA, 2501 nt, Mus musculus
gcuggagucacauccucuagggcucgagacuuuccggggaauuuacauaagccagcgugaaucacaccaagugagguagcaaaaggacucacccugaccccugccuguacugcgguggggggcugucugaaguuuucagaucagacacaguccaaaggaggguacaaggggaucaucccacucccaacaagagcaccggacacgccgcuacucccaagcccuacaauuggucucugcccccgcccccgcuccgacgcccccgcacggacgcccucaguucagccuccuccccgccccgaaguccgggacagaacguggggccaccucucgcuccuggaaggaucgguugccgcuuuaaggggaagaggaagggaaggggcgggggaguggggggcggggagaggcggcagaggagggggagggggaucccccucgcucccacgugguccgggcgccugugaaucgcgcccgccggagggucucacagcgaaauacaaaagcugcugggaagccacggggaggcgaguucccagcgccggggcagagcgcuggccagagccccgcagcgcuccgcggccgcgauggggcuccggcacccgaagccccggagccagcuagcagccgggcccgccucgccgcccgcacccgggcgcccgggcuuggcuugaagcggcggcgguggcaccggcgcgccggcaggagcauggggaggaagaugcggggcgccgccgccgccgcggggcucuggcugcuggcuuugagcucgcugcugacgcuguggggaggacuccugccaccgcggaccgagcugccagccucccggccgcccgaagaucgacucccuccgcauccgauccagaguggcggccccgcgcccgagccgcgauucccucugcccccgccccuaguaugggacgcccgcggcggcucccugaaaacuuuccgggcgcugcucacccuggcggccggcgcggauaacccgccuaggaggcaccaggacgaccgcgggcggcacgagcccuccgggcuguccuggccagaggagcgcagggcggugcacgggggcgucuucuggagccgcggccuggaggagcagguuccccggggcuuuuccgaagcccaagcagcagcguggcuggagguggcacggggugcucgggugguggcucuggaucgcgggggcugcggacgcaguuccaaccgccuagcccgcuuugccgacggcacccgugccuguguacgcuacggcaucaacccagagcagauacagggcgaggcccuguccuacuaccuugcgcgccugcugggccuccagcgccacgugccgccgcuggcacuggcucggguggaggcucggggcgcgcagugggugcaggugcaggaggagcugcgcaccgcgcacuggaccgagggcagcguggugagccugacgcgcuggcugccuaaccucaccgacgugguggugcccgagcccuggcgaucagaggacggccgucugcggccccugcgcgacgccgggggcgagcugaccaaccucagccaggcggagcugguggacuugguacaauggaccgaucugauccucuucgauuaccugacggccaacuuugaccggcuugugagcaaccucuucagcuuacagugggacccacgcguuaugcaccgcgcuacgagcaaccugcaccgaggaccaggaggggcguuggucuuucuggacaaugaggcgggcuuggugcacggcuaccggguagccggcaugugggacaaguauaacgaaccgcugcuacagucgguguguguauuccgagagcggacugcuaggcgcgucuuggagcugcaccggggucaggacgcggcggcccgguugcugcgccucuacagucgccacgaaccgcguuucccagagcuggcggagcucucagaaccccacgcucagcugcuacagcgccgccuugacuuccucgccaaacacauuuugcacugcaaggccaaguacggccgccggcccggggacuuaauaacacuccgaggaagagagggacugggguaugaaugauggggguuagggcugucuucucugccacgggcaacgaccaaccagccaacgcccacccaauggucugaucgccaagcugucuaaaaaaaaaaauuguguguuacccacuugccccuuucuuuucaugccaggcuguuuccuuuccaaguucuggaagggcaaacucaccgaggcgagaaguguaacauucccuccaccuagcuuauaaaaagaguucugugcuuguguggagauuggauccgaagaaacuggcugcugggguuuggcccgggaauggcagucucuuugggagaugcaguccauuuuugucgcccccuccaccccuucccaaaaaggaaaacuuccguuugagcuaauuccucuauuuccuacuaaacacagcgcugguggccccagagcaggcugugacaagggcuggugaaacccccuuccuguguucgcccuu

SEQ ID NO: 9935 - RNA, 2501 nt, Mus musculus
guucggcuccucagccccaacaaaggugggagcagugugccaaccuuccuccuguccucugaggucagguccaggcucucucuguccuucccucauccauccugaauguuucugccuuccaauggauccuaggagcucuggcucccuaugggagccuccacugcagccucugcuggcuagacuguuacugucccugaaggucuuuucaacuuugucuagcacuugcuuuuagauaucccauggcagucuaagcuagggaacuuaaugaacccaaguucacacccagccccacuccuugcugugugacuaggggaagucaccuaaccucucugagccucuguuucccuacugguaagguguuggggggagcauuugucaccaaaucaccaugaggauaaaaugagauagcuuaugugaauuaccuaacauagcacagcaaagaacacacacacaaauggccaauaguguccuacugcaauuauuauuugcauuacuucugcaucagcauucaaaauuuaacauucaacaauggaggugcgauuuucuaaucccaacguaccaugucuaaaaagaaaaaaaaacccaguuuggcaccccuuacccccagaacuggauuuaguaauucuuguugagaggaacucacugaagucugagcugacuuaaugaccuagcuggcacuucuucaaagaaaauuuaacuaugcugaugauaaccaaagccuucguggaauuaucuguucauauauagauaaaggaggggggacgcuugaaaaugagccauacuggauauuuggcccaagcuccuccucuccacagccaccaaagucaccaaccacauuuagaugggauauuagggacugcgcuaaaguucacagguuacccugauacagguccccuccugcucugaggcugccaggcagcaaauaugaacccuguugcuguuugacuuugccuagacugcaagcacugcgcggcuggucgaauuauugcuccgguuauguguccuccuugguccauguuggaaccuuuaggccacucagagccucacacaaaccaguucaaacucccacaagcuaaaauaaagccguuggugaccaaagcugacuuuaagagccccgaaaacuagucaaagcugggacccacugucuucagcuuuucaaggcuccuuucugaaaagcucauugcccaaucucuggccuguagcuaugugcacaccuuggggagugcucuacaggucuguuccagugucugccucuaccugccuagccacaguuagccaggcuuggggagcccuugagcaccagagccuguuagucgggacagaggcugcgggcauccaagaguacaguuacuuuugagccaugugcuccagcaagcauggggaccucgcccaaaaucugcgggcaacuugcccagcaaacuuucuucucccuuucucuuuuccuuucaccaaagcagcacuucccaggcguaaacucuuuccaauagcauagccccaaaucccagcuuugcuuugcuagcccaauucacuacagucccuccccagggcgauucaacccagaggcauccagcuggaguccucaggcgcgguggcgggccacucaccgaucugcugauguggaugugccaggcucaacugcaagaggcaaaguccccaagcugugugccaccaaaacuuguccauggcgugcuggaugaaacggagggaucuagucgccucuggaaaagggucguggggagaagggcaacgagggugaauggaaccugucacuggcugggggcugcugggcaaugagaccgcuucggaaguuggcugugguuuuuauuccaggcuuugaaagagugagugaccuaagagggagggagcgcgcgaaggacacacccaaagcgagggggcugugacuaagcagccaacggaaguuuaaagacacaccagccugcuuucgcuacugccccugcacuccugcccugcucucuuggacagaagagaauggccgccccccucccccccccagcccccgugcgcccacguucuccagggccacuccacaggcuuccuacccuggcccagccuaccagccuaugagaagcgcugccugggacaaggagaaugacugaguucuaagaccucgccccucucaguuaaaucuuccaguuucuccuuugccacuaaacuugggaaccuggcuagggaaagacugguuuucccaggaagcugaggaagcuggacuuaucuuagggaggaacugaagaaagaaagaggcugaagggagagagagagagagagagagagagagagagagagagggagagggagagauccauccuaguggagagugcuuuccuggccaggguggggacugaaaaguggggaacuugugggaguguucuuuccucuuucccucugagagaaguccaaaccgcucaucugaucuuugauccggggaaaacccaagggugcucaacacauuucauucaugcucucaaaauaucuaccaauuu

SEQ ID NO: 9936 - RNA, 2501 nt, Mus musculus
aaauugguagauauuuugagagcaugaaugaaauguguugagcacccuuggguuuuccccggaucaaagaucagaugagcgguuuggacuucucucagagggaaagaggaaagaacacucccacaaguuccccacuuuucaguccccacccuggccaggaaagcacucuccacuaggauggaucucucccucucccucucucucucucucucucucucucucucucucucucccuucagccucuuucuuucuucaguuccucccuaagauaaguccagcuuccucagcuuccugggaaaaccagucuuucccuagccagguucccaaguuuaguggcaaaggagaaacuggaagauuuaacugagaggggcgaggucuuagaacucagucauucuccuugucccaggcagcgcuucucauaggcugguaggcugggccaggguaggaagccuguggaguggcccuggagaacgugggcgcacgggggcugggggggggaggggggcggccauucucuucuguccaagagagcagggcaggagugcaggggcaguagcgaaagcaggcuggugugucuuuaaacuuccguuggcugcuuagucacagcccccucgcuuuggguguguccuucgcgcgcucccucccucuuaggucacucacucuuucaaagccuggaauaaaaaccacagccaacuuccgaagcggucucauugcccagcagcccccagccagugacagguuccauucacccucguugcccuucuccccacgacccuuuuccagaggcgacuagaucccuccguuucauccagcacgccauggacaaguuuugguggcacacagcuuggggacuuugccucuugcaguugagccuggcacauccacaucagcagaucggugaguggcccgccaccgcgccugaggacuccagcuggaugccucuggguugaaucgcccuggggagggacuguagugaauugggcuagcaaagcaaagcugggauuuggggcuaugcuauuggaaagaguuuacgccugggaagugcugcuuuggugaaaggaaaagagaaagggagaagaaaguuugcugggcaaguugcccgcagauuuugggcgagguccccaugcuugcuggagcacauggcucaaaaguaacuguacucuuggaugcccgcagccucugucccgacuaacaggcucuggugcucaagggcuccccaagccuggcuaacuguggcuaggcagguagaggcagacacuggaacagaccuguagagcacuccccaaggugugcacauagcuacaggccagagauugggcaaugagcuuuucagaaaggagccuugaaaagcugaagacagugggucccagcuuugacuaguuuucggggcucuuaaagucagcuuuggucaccaacggcuuuauuuuagcuugugggaguuugaacugguuugugugaggcucugaguggccuaaagguuccaacauggaccaaggaggacacauaaccggagcaauaauucgaccagccgcgcagugcuugcagucuaggcaaagucaaacagcaacaggguucauauuugcugccuggcagccucagagcaggaggggaccuguaucaggguaaccugugaacuuuagcgcagucccuaauaucccaucuaaaugugguuggugacuuugguggcuguggagaggaggagcuugggccaaauauccaguauggcucauuuucaagcguccccccuccuuuaucuauauaugaacagauaauuccacgaaggcuuugguuaucaucagcauaguuaaauuuucuuugaagaagugccagcuaggucauuaagucagcucagacuucagugaguuccucucaacaagaauuacuaaauccaguucuggggguaaggggugccaaacuggguuuuuuuuucuuuuuagacaugguacguugggauuagaaaaucgcaccuccauuguugaauguuaaauuuugaaugcugaugcagaaguaaugcaaauaauaauugcaguaggacacuauuggccauuuguguguguguucuuugcugugcuauguuagguaauucacauaagcuaucucauuuuauccucauggugauuuggugacaaaugcuccccccaacaccuuaccaguagggaaacagaggcucagagagguuaggugacuuccccuagucacacagcaaggaguggggcugggugugaacuuggguucauuaaguucccuagcuuagacugccaugggauaucuaaaagcaagugcuagacaaaguugaaaagaccuucagggacaguaacagucuagccagcagaggcugcaguggaggcucccauagggagccagagcuccuaggauccauuggaaggcagaaacauucaggauggaugagggaaggacagagagagccuggaccugaccucagaggacaggaggaagguuggcacacugcucccaccuuuguuggggcugaggagccgaac

SEQ ID NO: 9937 - RNA, 2501 nt, Mus musculus
gaaugagugcauaggagauauggaccuuugucacacauuuccaauggagucuaugaaaaaugagagaaauuuaagauuuuuccaucagaagaguggaaaucaaauguauaauucuuguacaggcuagaucccacuaccccuuacuaggaugguguaugugagcagacaggguaagauacucaaaaauacagcaccuucucccucuguuuuucuuuuuaaaaucucauccuuaucauauacucugauaaacuggcuucaauccuaucuccccucuccuuugcacuagucccucucugaaauaugagaguuaugacuguaaacuagaaaaaaagccaguauuauaugaaaacauuuauuggcugaguaauaaaauguacauaagggauuucuauaguuagacccucccucuggaaauauaaguuuucaauaaacaaaaggaagcaaugcuaucugaguccaagaagaaaaaaacaugcugacaacuuaaaucauagacacuugaguguuaagcaaucuguuucuuugauggugaagugaaagacacaucaugagugggcaaccacccuaaaguuuugcuaucuuaaauguugcaucuucaacuuacacaaacccacaauggaacuuugaacaucuuacugguggugauuugcaugcaaauucucaauaacacucuuacaacaaaacagaaacaacuaagaacaugguaaauaaauaagagcgaaaggagaaucaaugaacuuccuugucuggcaggcaugccacacaccugggaccucaucugaaaaucaggcaucucagccuucagagaccaaagagaagccugcugaugcaaaggagccacgcaccucgucccccgccaggauguggaaguuuaaucagucuuuccacacaaaugcauccuuuagauggagucgaaagaagagauucuguuagagcaauaaaacccuuuaggaaauaacccagggguuaguuuaaaauugcuuuuuuuugcaagugaaaaauccuuaauaauaacauaaauaaugcacaaaaccaaacuaaaaucagaauaacucaacuuauuaaaauuuuucuuucuuuucgaaagaugacuucagacguguucugaaagugcaaauuuggauaaaaugaagcaguuacaauggaaauauuagccugucuucugugccccacccuccagauagucgcuuuucagucgaccuaagcgggucccauggcuccugaugguaugugccagcagcucguauuugucucugagccccacagagauguccagugucuccuucagcaaggaccugguguggaccagcauccccaggaaguccucauugagucugcuuuccugccggcuauccugcucuuggcccugcuugaacuugcuuuccagcucagugagggacuugucagaguuggaguaggcauccccgaucuggugggacucccgccucagguacuugccauagcucucuuccccauccaggucguaggagaugcucuugcugaugcccuccaggacgcguccagcauccuccaccuggcggcccaguacugugaacuccucucgaagagugaggcucagcaagcuacuggcuuggcccccuucccccugggagcagcgccugcgaucacucacccugaagagcagcuggcauuucucggggucaucauucuccucauagucuccaucaggcacgaaguaaugaugcaaagucccauuagacauuucuggguacagggggccaucaaaguagccucgacacagguggcaaaagaaacccauccagaucaacuucgggaacaccauucuggauauucgggagaagcguuuuaguccaggaacaaggaaaaagguucccccgggugucagcggcuucgggagaaggcgcccuccucaggcgcagcucgcuugccgcucucugauccugguuccuccacaggcuucauguggcucuacgcagcagcggugugcaccacgcuccucagcgucccugauccucucucuacugagaggcuggaccuuugcuguuuuagcaggauagcccgacccaccgacuggggaccugcugcuccaggcgcuggcuuugcggucaccuucggaguucccucuggcuccagggagacggagcuaguagcuaagggaagcuguucugacacuguuucaaccccuggacugggugggaaugcagcguuuucuuuccccuuggcuaaagauauccugaggauugcaggacucucaaauuacagcuaguuucgucacuuggaagccaaggaacaaauuuggaaagaaagcuuucaccaguuccuuuauuaaagguacagggucuccuuuuuucaaucuugaaaaaggagacccuguacaauaagacguaucuugaauggggauaguagaggauaauuauaaacauaaaauccagcugcuauuagcauauuuaggaaagaggugauugcuucagagaaauggcauuucagacauuuaaauaccagaugagaaauguauuuuu

SEQ ID NO: 9938 - RNA, 2501 nt, Mus musculus
aaaaauacauuucucaucugguauuuaaaugucugaaaugccauuucucugaagcaaucaccucuuuccuaaauaugcuaauagcagcuggauuuuauguuuauaauuauccucuacuauccccauucaagauacgucuuauuguacagggucuccuuuuucaagauugaaaaaaggagacccuguaccuuuaauaaaggaacuggugaaagcuuucuuuccaaauuuguuccuuggcuuccaagugacgaaacuagcuguaauuugagaguccugcaauccucaggauaucuuuagccaaggggaaagaaaacgcugcauucccacccaguccagggguugaaacagugucagaacagcuucccuuagcuacuagcuccgucucccuggagccagagggaacuccgaaggugaccgcaaagccagcgccuggagcagcagguccccagucggugggucgggcuauccugcuaaaacagcaaagguccagccucucaguagagagaggaucagggacgcugaggagcguggugcacaccgcugcugcguagagccacaugaagccuguggaggaaccaggaucagagagcggcaagcgagcugcgccugaggagggcgccuucucccgaagccgcugacacccgggggaaccuuuuuccuuguuccuggacuaaaacgcuucucccgaauauccagaaugguguucccgaaguugaucuggauggguuucuuuugccaccugugucgaggcuacuuugauggcccccuguacccagaaaugucuaaugggacuuugcaucauuacuucgugccugauggagacuaugaggagaaugaugaccccgagaaaugccagcugcucuucagggugagugaucgcaggcgcugcucccagggggaagggggccaagccaguagcuugcugagccucacucuucgagaggaguucacaguacugggccgccagguggaggaugcuggacgcguccuggagggcaucagcaagagcaucuccuacgaccuggauggggaagagagcuauggcaaguaccugaggcgggagucccaccagaucggggaugccuacuccaacucugacaagucccucacugagcuggaaagcaaguucaagcagggccaagagcaggauagccggcaggaaagcagacucaaugaggacuuccuggggaugcugguccacaccagguccuugcugaaggagacacuggacaucucuguggggcucagagacaaauacgagcugcuggcacauaccaucaggagccaugggacccgcuuaggucgacugaaaagcgacuaucuggaggguggggcacagaagacaggcuaauauuuccauuguaacugcuucauuuuauccaaauuugcacuuucagaacacgucugaagucaucuuucgaaaagaaagaaaaauuuuaauaaguugaguuauucugauuuuaguuugguuuugugcauuauuuauguuauuauuaaggauuuuucacuugcaaaaaaaagcaauuuuaaacuaaccccuggguuauuuccuaaaggguuuuauugcucuaacagaaucucuucuuucgacuccaucuaaaggaugcauuuguguggaaagacugauuaaacuuccacauccuggcgggggacgaggugcguggcuccuuugcaucagcaggcuucucuuuggucucugaaggcugagaugccugauuuucagaugaggucccagguguguggcaugccugccagacaaggaaguucauugauucuccuuucgcucuuauuuauuuaccauguucuuaguuguuucuguuuuguuguaagaguguuauugagaauuugcaugcaaaucaccaccaguaagauguucaaaguuccauuguggguuuguguaaguugaagaugcaacauuuaagauagcaaaacuuuagggugguugcccacucaugaugugucuuucacuucaccaucaaagaaacagauugcuuaacacucaagugucuaugauuuaaguugucagcauguuuuuuucuucuuggacucagauagcauugcuuccuuuuguuuauugaaaacuuauauuuccagagggagggucuaacuauagaaaucccuuauguacauuuuauuacucagccaauaaauguuuucauauaauacuggcuuuuuuucuaguuuacagucauaacucucauauuucagagagggacuagugcaaaggagaggggagauaggauugaagccaguuuaucagaguauaugauaaggaugagauuuuaaaaagaaaaacagagggagaaggugcuguauuuuugaguaucuuacccugucugcucacauacaccauccuaguaagggguagugggaucuagccuguacaagaauuauacauuugauuuccacucuucugauggaaaaaucuuaaauuucucucauuuuucauagacuccauuggaaaugugugacaaagguccauaucuccuaugcacucauuc

SEQ ID NO: 9939 - RNA, 2501 nt, Mus musculus
cacacacacacacacacacacacacacacacacacacacacacacacacacacggaggagccuuaauccaacggugcaauguguccaauaagaguaaugaaaacaccuauaucugcagacuugguuguggugauagugaaggaggaucuuguuuucuuaagauccuuuuccuucguugcuuugaaaagucuguacucccaagugcccugugccgccugccugccuugucccaaaaagaaaaaggggagggggugaggagagggcagcccuggggugaaagaagagcccucacccugggaugggguuaucuuaaccucuucuacgcuauuuauuuaacuuguaagagcagucagaaggaaaccacuacucuggaguuccugggacagcuuaaagcccuggugacccauugaacacaguagauuguuuuaaucaguucguauccuggcaccaucucaggggaacauaaacagacgugcgcaccacuuggguuugcucuuuccaccaagagauccaauuacuuacugauggucgucauucugcccuccaacaguuaagaggagauuuuaaccccucacuucuaggcuauauuucuccaucaaaggguagggauuuggauucuacuggggaggggaaagacggcugcugagcuagaccagagagcccccuaagguucucuggaagguccucggacgaaaggcuagucaucucgcauccuccccagccagucucgcugguggaugguugccagagccgggcauaggcaaacacuaagcugaagaacgccagagagggaacagccaguccagggcuauagagaaguuguucuucccaaacuagaauucaggaaauaaguaggaccagggagaugacagccacaugccuuucccuucacucuagacuucuaccaggagcuagagagggcucaccggaauggcucacagcagcggcagcgagcgaggagcaagaggcaaagcgcgcaguagagcgcagucgcuagcgaggcgcagcgaggcguuaccgaggccugugggguacagaucggccagcaucuacggaagugggaaacagccaguaguggcugcccggcgccugcaggucugcuguauggaggaugagagcguggaaccccccaagaggcucaaaaaagacagccacgcgccggccggagcacagccagcacaagaguguguggcgcgugcacucaagcuucgagguacccgaccccgacuuguuaagccgcgcggauucugucuuaccagccucaguugcaucugccauacccgcaaaugcacacgccaccaauucccaaguccuuagcaguuaccacucaaagcccugggaccgccacuccuacagacgccccugucccagcccuguacccaacucucaaggcugucucugcuugcaacuugcugcgaggucggcuucagcucacagagaugccagcuccggggcucugacucggcaacagugcccugucccggcaggcgacucccgcgggcucugugcuucaagcaccaggaccgaguuugcaggguuccagcacauggaaacgggaugcacuuuuuugacaacuucucucucuaccuuccucccucccccguggacccagugccccucagucaccacaucuaccucugcggcaggaaggaccagguucgguucuuuaaugcgcacucaagggucuuuggugcaccaaggggcugugucacaacugagaagaauucgagaugguaugaacccuggggacuccuuggcuagccuggguucauaccaacacacacgcgagcgagcgcgcgcacacacacacagagacacacacacaccagaauaccgccgcgcucaccugucacuuccguggguccucagguucuucgcuguggacgaguggcgcugcgugagaccgcggcucgagccacuugggcucgacgcgggaggaagacgaaggagagcgccgcuaccacgguacucugggucuccaggucugcgaagggcgcaccuagugucgggcaucucccggucuccgguuuaaaugccgccagccaagcgccggggacugcgucucuccauuggucaggcgccgucgccgccgcgggacccgcuauccgcccccuuucccgguagugcccccgcccacugcaccccuccugcuucccugcgggguccccucuccgcccgccucgccucuuugucuacacccaccccccugccccugcccgucugggugggagaggucaccccagggaaccgcgccuggaaugcacagcaaaucacauuuuccgcucccguuggagaggggagcgagggaggaaauccccccaccccggcuucuagccccucaucccuuuccagccccaggucugggcuucucuagcaggcugaacuucgccugcauggggcuccacgcucaggagucccggcugcgcugagcagagcaacggagcgggucgugacaagcuagguguuuccucaccauugugcugaauggcaccguuggacag

SEQ ID NO: 9940 - RNA, 2501 nt, Mus musculus
cuguccaacggugccauucagcacaauggugaggaaacaccuagcuugucacgacccgcuccguugcucugcucagcgcagccgggacuccugagcguggagccccaugcaggcgaaguucagccugcuagagaagcccagaccuggggcuggaaagggaugaggggcuagaagccgggguggggggauuuccucccucgcuccccucuccaacgggagcggaaaaugugauuugcugugcauuccaggcgcgguucccuggggugaccucucccacccagacgggcaggggcagggggguggguguagacaaagaggcgaggcgggcggagaggggaccccgcagggaagcaggaggggugcagugggcgggggcacuaccgggaaagggggcggauagcgggucccgcggcggcgacggcgccugaccaauggagagacgcaguccccggcgcuuggcuggcggcauuuaaaccggagaccgggagaugcccgacacuaggugcgcccuucgcagaccuggagacccagaguaccgugguagcggcgcucuccuucgucuuccucccgcgucgagcccaaguggcucgagccgcggucucacgcagcgccacucguccacagcgaagaaccugaggacccacggaagugacaggugagcgcggcgguauucuggugugugugugucucugugugugugugcgcgcgcucgcucgcguguguguugguaugaacccaggcuagccaaggaguccccaggguucauaccaucucgaauucuucucaguugugacacagccccuuggugcaccaaagacccuugagugcgcauuaaagaaccgaaccugguccuuccugccgcagagguagauguggugacugaggggcacuggguccacgggggagggaggaagguagagagagaaguugucaaaaaagugcaucccguuuccaugugcuggaacccugcaaacucgguccuggugcuugaagcacagagcccgcgggagucgccugccgggacagggcacuguugccgagucagagccccggagcuggcaucucugugagcugaagccgaccucgcagcaaguugcaagcagagacagccuugagaguuggguacagggcugggacaggggcgucuguaggaguggcggucccagggcuuugagugguaacugcuaaggacuugggaauugguggcgugugcauuugcggguauggcagaugcaacugaggcugguaagacagaauccgcgcggcuuaacaagucggggucggguaccucgaagcuugagugcacgcgccacacacucuugugcuggcugugcuccggccggcgcguggcugucuuuuuugagccucuugggggguuccacgcucucauccuccauacagcagaccugcaggcgccgggcagccacuacuggcuguuucccacuuccguagaugcuggccgaucuguaccccacaggccucgguaacgccucgcugcgccucgcuagcgacugcgcucuacugcgcgcuuugccucuugcuccucgcucgcugccgcugcugugagccauuccggugagcccucucuagcuccugguagaagucuagagugaagggaaaggcauguggcugucaucucccugguccuacuuauuuccugaauucuaguuugggaagaacaacuucucuauagcccuggacuggcuguucccucucuggcguucuucagcuuaguguuugccuaugcccggcucuggcaaccauccaccagcgagacuggcuggggaggaugcgagaugacuagccuuucguccgaggaccuuccagagaaccuuagggggcucucuggucuagcucagcagccgucuuuccccuccccaguagaauccaaaucccuacccuuugauggagaaauauagccuagaagugagggguuaaaaucuccucuuaacuguuggagggcagaaugacgaccaucaguaaguaauuggaucucuugguggaaagagcaaacccaaguggugcgcacgucuguuuauguuccccugagauggugccaggauacgaacugauuaaaacaaucuacuguguucaaugggucaccagggcuuuaagcugucccaggaacuccagaguagugguuuccuucugacugcucuuacaaguuaaauaaauagcguagaagagguuaagauaaccccaucccagggugagggcucuucuuucaccccagggcugcccucuccucacccccuccccuuuuucuuuuugggacaaggcaggcaggcggcacagggcacuugggaguacagacuuuucaaagcaacgaaggaaaaggaucuuaagaaaacaagauccuccuucacuaucaccacaaccaagucugcagauauagguguuuucauuacucuuauuggacacauugcaccguuggauuaaggcuccuccgugugugugugugugugugugugugugugugugugugugugugugugugugug

SEQ ID NO: 9941 - RNA, 2501 nt, Mus musculus
cacccaccaggauugacucaggaggcagcuuccuuuaagggguccaaccuuuugcccucuuuuauuuuuaaaccagacugucucgauccccaagcgucucugucauggaauuauucaaggagaugugcuuuaaugaaagccucccuaaagggucuuaggugguccccaaagaagcaucgcgucuggggacucucaugcagaacgucuccaguucacauggcgcaagauccuaagcgcuaaaggcugaguacgccaaggcugcgugggcggagaccuauuuuucugacaaguuccagggcuccugugcgggaucggagucucccccuucacuuucagcccgagagcugugcgccaagcagcagggggcggagaaaugaacccguccguccccgucccccgcccccgcccccgagaacccuccccccucccugcuuccugccucuuuaaaagguccugggcuccucagucaagccagccacugccuggagucagccagccucaucggacuucugcaggcaaucgcgaagcugcuauccaguucugccacggucucucccggcgcaccggcagucucagcgucuucaccggacucagcguccuuguccuucacuucaccuuugccaccucuccggguuacugagccccggugcacacagguaaaccucccgccucugcggagcaccuggccggccaccucaaagccccaggcugcagaugaucagcgcuacuccucaucuccuacucuuccccuucugguuuuccuaacuccuuuauccugccccgucuauccccuggaaagaacuuuccggagcugguucucuucagccuucggguucacaaacuauaccuccaagacaccccaagauuuucuccccaguagucuccagguuaccccugacugucgccauccaaaauacauucuguaaucuugucuaaaggggcgggggggaggggacggacccaagucacuuuauacccuuuauccuggaacuccaacaaucccccugccucuggcgcucuuuuuauacuggauaccguuuggaaaguaaacccuucuuuuucagcacauauggggcaaaagaagaaacacacacacacacacacacacacacacacacacacacacacacacaccucugcccuuccaccuugcuuccuggucucugacucuggccuccugugcuucuugcuacaggcuccguguugggcacaaaggcuccaccauggagcuccugcggggacuagguguccuguuccuguugcauauguguggaagcaaccgcauuccaggugaguuugugauauauucauuuuccucccccuucuccucucucucucucucucucucucucucucucucucucucucucucucucgauagcuccuguguuuccuuggaguccuuaucuccugauaaggaugcagcuucccucgcucagcuuuccauaauugccauuauugucacgaguucccaccuuggcuccucacagccagaacuuuacccccuuauaccuagccuagaaagccgauugucuucucucuccuuacagagucugggggagauaacgguguguuugacaucuuugaacucauuggaggugcacgaaggggccccggucgccgacuggugaagggccaagaucuauccagccccgccuuccgcauugagaaugccaaccugauccccgcugugccggaugacaaguuccaagaccuacuggacgcugugugggccgacaaaggcuucaucuuccuggcuuccuugaggcagaugaagaagacccggggcacacuccuggcuguggaacggaaagacaacacuggccagaucuucaguguggucuccaacggcaaagcuggcacccuggaccugagccugagccugccagggaagcaacaaguggugucaguggaggaagcucuccuggccacuggccaguggaagagcaucacgcuguuuguucaagaggaccgggcucaacucuacauagacugugauaagauggagagcgcggagcuggauguacccauccagagcaucuucaccagggaucuggccagcguugccaggcuccgaguugcaaagggagaugucaaugacaauuuucagguaaaucuucuuaccugucacaagggcuauguggaauuaauaucgguagacuaaaaaugauucucaaauguaaagaggaacagacacccccagaagguugguuaaaucauauuacagaugacccaaaacuccaggguuucagauuugauagggacccgagaaauuuuguuccuaauaagaaauaaguuguaauggugccaggaccugggacccaugcuuucaaagcuaucaggagagauaagaaaugguuuuccuauuacacucagccuguuucagaaugggguacucccugugcccuuaggaaaguaacuuguaucaaauguaccuagcaguuuuaauagggcaugaaaaggauacuuugucaguauuugagucccugggcaggguguuc

SEQ ID NO: 9942 - RNA, 2501 nt, Mus musculus
gaacacccugcccagggacucaaauacugacaaaguauccuuuucaugcccuauuaaaacugcuagguacauuugauacaaguuacuuuccuaagggcacagggaguaccccauucugaaacaggcugaguguaauaggaaaaccauuucuuaucucuccugauagcuuugaaagcaugggucccagguccuggcaccauuacaacuuauuucuuauuaggaacaaaauuucucgggucccuaucaaaucugaaacccuggaguuuugggucaucuguaauaugauuuaaccaaccuucugggggugucuguuccucuuuacauuugagaaucauuuuuagucuaccgauauuaauuccacauagcccuugugacagguaagaagauuuaccugaaaauugucauugacaucucccuuugcaacucggagccuggcaacgcuggccagaucccuggugaagaugcucuggauggguacauccagcuccgcgcucuccaucuuaucacagucuauguagaguugagcccgguccucuugaacaaacagcgugaugcucuuccacuggccaguggccaggagagcuuccuccacugacaccacuuguugcuucccuggcaggcucaggcucagguccagggugccagcuuugccguuggagaccacacugaagaucuggccaguguugucuuuccguuccacagccaggagugugccccgggucuucuucaucugccucaaggaagccaggaagaugaagccuuugucggcccacacagcguccaguaggucuuggaacuugucauccggcacagcggggaucagguuggcauucucaaugcggaaggcggggcuggauagaucuuggcccuucaccagucggcgaccggggccccuucgugcaccuccaaugaguucaaagaugucaaacacaccguuaucucccccagacucuguaaggagagagaagacaaucggcuuucuaggcuagguauaaggggguaaaguucuggcugugaggagccaaggugggaacucgugacaauaauggcaauuauggaaagcugagcgagggaagcugcauccuuaucaggagauaaggacuccaaggaaacacaggagcuaucgagagagagagagagagagagagagagagagagagagagagagagagaggagaagggggaggaaaaugaauauaucacaaacucaccuggaaugcgguugcuuccacacauaugcaacaggaacaggacaccuaguccccgcaggagcuccaugguggagccuuugugcccaacacggagccuguagcaagaagcacaggaggccagagucagagaccaggaagcaagguggaagggcagagguguguguguguguguguguguguguguguguguguguguguguguguuucuucuuuugccccauaugugcugaaaaagaaggguuuacuuuccaaacgguauccaguauaaaaagagcgccagaggcagggggauuguuggaguuccaggauaaaggguauaaagugacuuggguccguccccucccccccgccccuuuagacaagauuacagaauguauuuuggauggcgacagucagggguaaccuggagacuacuggggagaaaaucuuggggugucuuggagguauaguuugugaacccgaaggcugaagagaaccagcuccggaaaguucuuuccaggggauagacggggcaggauaaaggaguuaggaaaaccagaaggggaagaguaggagaugaggaguagcgcugaucaucugcagccuggggcuuugagguggccggccaggugcuccgcagaggcgggagguuuaccugugugcaccggggcucaguaacccggagagguggcaaaggugaagugaaggacaaggacgcugaguccggugaagacgcugagacugccggugcgccgggagagaccguggcagaacuggauagcagcuucgcgauugccugcagaaguccgaugaggcuggcugacuccaggcaguggcuggcuugacugaggagcccaggaccuuuuaaagaggcaggaagcagggaggggggaggguucucgggggcgggggcgggggacggggacggacggguucauuucuccgcccccugcugcuuggcgcacagcucucgggcugaaagugaagggggagacuccgaucccgcacaggagcccuggaacuugucagaaaaauaggucuccgcccacgcagccuuggcguacucagccuuuagcgcuuaggaucuugcgccaugugaacuggagacguucugcaugagaguccccagacgcgaugcuucuuuggggaccaccuaagacccuuuagggaggcuuucauuaaagcacaucuccuugaauaauuccaugacagagacgcuuggggaucgagacagucugguuuaaaaauaaaagagggcaaaagguuggaccccuuaaaggaagcugccuccugagucaauccuggugggug

SEQ ID NO: 9943 - RNA, 2501 nt, Mus musculus
agucuggaaaggaaagggagauccaaauccccugguccugcuuuuugcuuuccuaguuuaagcuuuccccaccugcuagaggacuguagguaucuaaugccuggaucaggugcaccgccuacggggaccccuuagaguuuccacccccuggaccauucgggaaccaccucaccucccgccgcaucacugggcuacccuccuauccucugguggcgagggucucagccuuuaagcagacgaucucuaaggacugcucgccgggcacgcgcagagcuggaagcccagaaguuggaagaggggcggggaccugcgcccuacuggcuggcugacagggggagcggcgggggcggaggcccccuccggugggugcugggacuguagccacuagaggccuggaggggaggggagagugaccgugagucugucugacugacaggcugcgaagagcagccaauauauauaagaaaggcucuggagcaagcagguuucaguagcggcgcugcucgcaggcuaggaacccgaggccaagagcugcagccaaagucacuugggugcaguguacucccucacuagcccgcucgagacccuaggauuugcuccaggacacguacuuagagcagccaccgcccagucgcccucaccuggauuaccuaccgaggcaucgagcagcggaguuuuugagaaggcgacaagggagcagcgucccgaggggaaucagcuuuucaggaacucggcuggcagacgggacuugcgggagagcgacaucccuaacaagcagauucggagucccggaguggagaggacaccccaagggaugacgccugcgucccggagcgccugucgcugggcgcuacugcugcuggcgguacuguggccgcagguaaugucucacguccucuccgcccccucccgcagcgcuccgggcuugcgccccggccccggcugagccugaccgcucuccucccuccuucucucggucccugugcagcagcgcgcugcgggcuccggcaucuuccagcugcggcugcaggaguucgucaaccagcgcgguaugcuggccaaugggcaguccugcgaaccgggcugccggacuuucuuccgcaucugccuuaagcacuuccaggcaaccuucuccgagggacccugcaccuuuggcaaugucuccacgccgguauugggcaccaacuccuucgucgucagggacaagaauagcggcaguggucgcaacccucugcaguugcccuucaauuucaccuggccgguaagcacaacuuaaaugcaccgggagauaaccgaagggaaagaagggagcgccgggacaccagagcuccuuuccaaagcgcucucuggagagccccaagggcucuuucucuucugcccccgccccccuguucucucauaggaucaucccggagaggcuuugguuagucuuuccucccaguuucuucccuuuccuucuccccaauucuugggauacgaauuucauuaccaaacccccaacgcggcgccgcccgcccaccccccggcucucacuuacacucccgcaucccucaucccuccccugccuucucagcucgcgcgcagcgcugcgcgaacaccaguuauguugagccgagcuccguaacuauauccugcaauuagauuaauuaaacaggcugcugcgaggcacccccuccuuucccucccugcugauaucgcuaucucuaaugucccccacccccccuuuugcuucccagggaaccuucucacucaacauccaagcuuggcacacaccgggagacgaccugcggccaggugaguaucuaacuucucggccacaggggggcgacaucacacagcgccgaaagaguuaaccaguuauaggcggggguggggguuggggacgcaggcuuggggggugggggccaggacgcuuagcuuggccggagcugcgccccgcgcuggacgcucggauuccgcucgcugccuggacucagagcacaauugcguuuccugcggguuauuuuuggcgugggaacgcggggagcacggcggugagaaaggccgaggcugccagcgccgcugacgggccucuuccuguauuuuacaccuuuugcgaauuccgcuccuuuggaaagggaauaauggcuuugggauguuguucugacacagaggaaaaggauauuucaccagcacaacaauucucacuuugaaaaggaaaaagaaaaaccauuaccuacgucuagaacagaaccccuugcucccaguucucgaaccagaaaacuucccccuuuaaauuuuuucuuuuuuuccauuuugaccucuuuuccucuuuccccuccguaucugccuccacaacccuaggauaucuuaacauccguccauuguacccuuuuuugaaugcuaucaagcccccugcacaugcacacacccagggagacuaaguagcaagauucugggacccucuggccugugcuuacuugcagguagaguuaaucuagauaauuagagugugaacugac

SEQ ID NO: 9944 - RNA, 2501 nt, Mus musculus
gucaguucacacucuaauuaucuagauuaacucuaccugcaaguaagcacaggccagagggucccagaaucuugcuacuuagucucccugggugugugcaugugcagggggcuugauagcauucaaaaaaggguacaauggacggauguuaagauauccuaggguuguggaggcagauacggaggggaaagaggaaaagaggucaaaauggaaaaaaagaaaaaauuuaaagggggaaguuuucugguucgagaacugggagcaagggguucuguucuagacguagguaaugguuuuucuuuuuccuuuucaaagugagaauuguugugcuggugaaauauccuuuuccucugugucagaacaacaucccaaagccauuauucccuuuccaaaggagcggaauucgcaaaagguguaaaauacaggaagaggcccgucagcggcgcuggcagccucggccuuucucaccgccgugcuccccgcguucccacgccaaaaauaacccgcaggaaacgcaauugugcucugaguccaggcagcgagcggaauccgagcguccagcgcggggcgcagcuccggccaagcuaagcguccuggcccccaccccccaagccugcguccccaacccccacccccgccuauaacugguuaacucuuucggcgcugugugaugucgccccccuguggccgagaaguuagauacucaccuggccgcaggucgucucccggugugugccaagcuuggauguugagugagaagguucccugggaagcaaaagggggggugggggacauuagagauagcgauaucagcagggagggaaaggagggggugccucgcagcagccuguuuaauuaaucuaauugcaggauauaguuacggagcucggcucaacauaacugguguucgcgcagcgcugcgcgcgagcugagaaggcaggggagggaugagggaugcgggaguguaagugagagccggggggugggcgggcggcgccgcguuggggguuugguaaugaaauucguaucccaagaauuggggagaaggaaagggaagaaacugggaggaaagacuaaccaaagccucuccgggaugauccuaugagagaacaggggggcgggggcagaagagaaagagcccuuggggcucuccagagagcgcuuuggaaaggagcucuggugucccggcgcucccuucuuucccuucgguuaucucccggugcauuuaaguugugcuuaccggccaggugaaauugaagggcaacugcagaggguugcgaccacugccgcuauucuugucccugacgacgaaggaguuggugcccaauaccggcguggagacauugccaaaggugcagggucccucggagaagguugccuggaagugcuuaaggcagaugcggaagaaaguccggcagcccgguucgcaggacugcccauuggccagcauaccgcgcugguugacgaacuccugcagccgcagcuggaagaugccggagcccgcagcgcgcugcugcacagggaccgagagaaggagggaggagagcggucaggcucagccggggccggggcgcaagcccggagcgcugcgggagggggcggagaggacgugagacauuaccugcggccacaguaccgccagcagcaguagcgcccagcgacaggcgcuccgggacgcaggcgucaucccuugggguguccucuccacuccgggacuccgaaucugcuuguuagggaugucgcucucccgcaagucccgucugccagccgaguuccugaaaagcugauuccccucgggacgcugcucccuugucgccuucucaaaaacuccgcugcucgaugccucgguagguaauccaggugagggcgacugggcgguggcugcucuaaguacguguccuggagcaaauccuagggucucgagcgggcuagugagggaguacacugcacccaagugacuuuggcugcagcucuuggccucggguuccuagccugcgagcagcgccgcuacugaaaccugcuugcuccagagccuuucuuauauauauuggcugcucuucgcagccugucagucagacagacucacggucacucuccccuccccuccaggccucuaguggcuacagucccagcacccaccggagggggccuccgcccccgccgcucccccugucagccagccaguagggcgcagguccccgccccucuuccaacuucugggcuuccagcucugcgcgugcccggcgagcaguccuuagagaucgucugcuuaaaggcugagacccucgccaccagaggauaggaggguagcccagugaugcggcgggaggugaggugguucccgaaugguccaggggguggaaacucuaagggguccccguaggcggugcaccugauccaggcauuagauaccuacaguccucuagcagguggggaaagcuuaaacuaggaaagcaaaaagcaggaccaggggauuuggaucucccuuuccuuuccagacu

SEQ ID NO: 9945 - RNA, 2501 nt, Mus musculus
gaaauagauuuuugaaagaaagaugcugaaccaaacaaaggccucuugagaacauuaaaaucaauuuuccacccauuuacugaacucuuaucaagucaggaaaaaugcaccccuagaaugacaagaaacuucagcaugugcacucgcuugaaucauugagcaggcucuuccaaaggacagaacuguggccguuuauuucuaucuuaccacuucuaauagagacuccaacuuaaucucagagauuguccuuuuuaaacgauuaaaaacucuuaggggaauuauuuccaucuccuucagcuccggaaacugccaagccuuagacagccaaccugaccgauuuaagucaucccagcugcaacacuagggcaugggaagcugauaguacagggcuuuccaagaagauaccgcaugaacacccauuuagagccagccacagcugcaugcagagcucacgcaggccggacacuaguguucaaaacccucugccuuacaaacuuccaggguaggugucugaacgcgaguguacagcucugguuuucaugagaaugacuuaaaggaaggaccaucuccugaccacgcaucucaucucagucucuggauucuucccuuucagcgaugccucccaaauagcugaugcccacacgggaaaagcacuucucccugcaacuggaauugguaagcagcagaagcagugggcuucucccuuucucuggguuucagcuccuccccuucuuccacaaggaaccauucucgccuccccaaaucugcuucaacaauggcccaggauucccuccagccaggacuucuccucugggccaggaacaaggcgaguuaucugaacaagaguugaugaccgaguaacuuuggcacuuccaggcugucucccggggaucucacccaggguccucuacgggccagaaccugcccugucaguugcuguggaucuuaaagucccaagaagggcgaggggaggcacaccgaagcagcugggagcuucccuuacccuuucagcgcaucguguccuccgccgccucuucucuuggcccgauuggcucuggucuccuucaggcucccagccuccaaauuggcguccgccccauggcucguguaggacucgaggagcagggcgaacgccagcgcgaccuccagcagcccuccucgccgcauggugccgccggccgccacucgcuccgccgccgccgccgccgccgccgccgcgccuuccagcggcccgagucuccggggucccgcugucucacuguccggcuguccugaugcagagagguccccggccuggguccuacagcuuucuucuccagggacugcucccacuucggguagucccugccuguccugcaacacagacaaguccccaaggcggggaggugagacacucagggcuccgggaugcugaaagcucgcaguccccggugccgagcccagaccgcgcgccgccugcgcguggcgcaguuacucggaggaacgaggaccacucgaucccaacuagcugcagagccagaacccggcgacuggcauccgcggacccuguggccucgcggcgccaaguaccgugucccuagggagcccaggcgucccgcgagcggacugccuacacggucuuaauggcacugauugcgcgcggugacggcugacgccccagcucuccaaaaaggguccucuccgcccacauaccgggucauggccaaccccgccaguccccugcauccgacguggagcagggcacugcagucccggaucuugcagcugucaggcagagagggccagcugcagaugcucgagacauccccucacccugcccggccuccugcccuggaugccgcgcaaacggcccuccagccacccgccugccgcccgacccuggcgggaccccaugagacccacuggacuagcggcucggacucucaggcggcgguggcugcucugcuccgcagcugucccagcuguggccgccuguggcacccacagucucugccccaacucugcggcccccuccuuucccaccucuucaaguaucguccgcgcagcgguuucucgcgagagaaauacuuuuuuaaaaaaaagaaagaaagaaaaagaaaaugacacccuccccaccuccccccaucaccaccccacccccggccccaucuauccucccuuuccacuccccucugccagccaccgcccggacccgggccucccucauucgcaggaucagugcccugggaggaggcggaggugauccaguccugccuggccugggauauuccgucccaggguggggaagagagggaaugggaagagguggaguagcgguuuagaccgaucugccugcggcugagagguccagacccgagauucccgcgaucagaagcacggagagcugggccaccugcgcggagaacgcaugcuggacaccuuggccaacgaggcccaggaggcccuggcuggaaaggggcucuguggcaguggcccucgcuucucagcccagucuucugcug

SEQ ID NO: 9946 - RNA, 2501 nt, Mus musculus
cagcagaagacugggcugagaagcgagggccacugccacagagccccuuuccagccagggccuccugggccucguuggccaagguguccagcaugcguucuccgcgcagguggcccagcucuccgugcuucugaucgcgggaaucucgggucuggaccucucagccgcaggcagaucggucuaaaccgcuacuccaccucuucccauucccucucuuccccacccugggacggaauaucccaggccaggcaggacuggaucaccuccgccuccucccagggcacugauccugcgaaugagggaggcccggguccgggcgguggcuggcagaggggaguggaaagggaggauagauggggccgggggugggguggugauggggggagguggggagggugucauuuucuuuuucuuucuuucuuuuuuuuaaaaaaguauuucucucgcgagaaaccgcugcgcggacgauacuugaagaggugggaaaggagggggccgcagaguuggggcagagacugugggugccacaggcggccacagcugggacagcugcggagcagagcagccaccgccgccugagaguccgagccgcuaguccagugggucucauggggucccgccagggucgggcggcaggcggguggcuggagggccguuugcgcggcauccagggcaggaggccgggcagggugaggggaugucucgagcaucugcagcuggcccucucugccugacagcugcaagauccgggacugcagugcccugcuccacgucggaugcaggggacuggcgggguuggccaugacccgguaugugggcggagaggacccuuuuuggagagcuggggcgucagccgucaccgcgcgcaaucagugccauuaagaccguguaggcaguccgcucgcgggacgccugggcucccuagggacacgguacuuggcgccgcgaggccacaggguccgcggaugccagucgccggguucuggcucugcagcuaguugggaucgagugguccucguuccuccgaguaacugcgccacgcgcaggcggcgcgcggucugggcucggcaccggggacugcgagcuuucagcaucccggagcccugagugucucaccuccccgccuuggggacuugucuguguugcaggacaggcagggacuacccgaagugggagcagucccuggagaagaaagcuguaggacccaggccggggaccucucugcaucaggacagccggacagugagacagcgggaccccggagacucgggccgcuggaaggcgcggcggcggcggcggcggcggcggcggagcgaguggcggccggcggcaccaugcggcgaggagggcugcuggaggucgcgcuggcguucgcccugcuccucgaguccuacacgagccauggggcggacgccaauuuggaggcugggagccugaaggagaccagagccaaucgggccaagagaagaggcggcggaggacacgaugcgcugaaaggguaagggaagcucccagcugcuucggugugccuccccucgcccuucuugggacuuuaagauccacagcaacugacagggcagguucuggcccguagaggacccugggugagauccccgggagacagccuggaagugccaaaguuacucggucaucaacucuuguucagauaacucgccuuguuccuggcccagaggagaaguccuggcuggagggaauccugggccauuguugaagcagauuuggggaggcgagaaugguuccuuguggaagaaggggaggagcugaaacccagagaaagggagaagcccacugcuucugcugcuuaccaauuccaguugcagggagaagugcuuuucccgugugggcaucagcuauuugggaggcaucgcugaaagggaagaauccagagacugagaugagaugcguggucaggagaugguccuuccuuuaagucauucucaugaaaaccagagcuguacacucgcguucagacaccuacccuggaaguuuguaaggcagaggguuuugaacacuaguguccggccugcgugagcucugcaugcagcuguggcuggcucuaaauggguguucaugcgguaucuucuuggaaagcccuguacuaucagcuucccaugcccuaguguugcagcugggaugacuuaaaucggucagguuggcugucuaaggcuuggcaguuuccggagcugaaggagauggaaauaauuccccuaagaguuuuuaaucguuuaaaaaggacaaucucugagauuaaguuggagucucuauuagaagugguaagauagaaauaaacggccacaguucuguccuuuggaagagccugcucaaugauucaagcgagugcacaugcugaaguuucuugucauucuaggggugcauuuuuccugacuugauaagaguucaguaaauggguggaaaauugauuuuaauguucucaagaggccuuuguuugguucagcaucuuucuuucaaaaaucuauuuc

SEQ ID NO: 9947 - RNA, 2501 nt, Mus musculus
uaggacaauuuccugacgguuggugucuuuccuaauaguguaucauuauggguagcaacagguaauuuguccauuuuugcuaucgaaauuccuagaaugaaaacccugggagaaaaugggaaaagugaggaagcugaagaccugaguaacucaaaggcucggugcagcugagagcugaguuccuaagcacuuaguggcuugaagccuggcaaagaguggggagcacuggggcauauacacuggagagacguggguggggccucuagacuccaggccgacacuugucacggucugguucccaguuucuucccccgcgugucccucccccugaugccccgccccacccacccccuguccgcucagggagccccgggggcggcccagccagagucccacgugaagccgcgggggcgggcaccggcgccuuccugcucuacccuuguauggugacccgaggggccagcccucgaguauuuaagcccgggcucgacgaagagcccccagaaccgucagcucccgccacacagacaccgcgccgccggagccgagggagaggacauccggaagcaggaggcuuugcgaugccgaucgccauggggcuggagacggcgugcgagcuagagugcgcggcgcugggcgcgcugcugcgggagccgcgggaggccgagcgcacgcugcugcucgacugccgcccguuccuggccuucugccggagccacgugcgcgccgcgcgaccggugcccuggaacgcgcugcugcggcggcgugcgcgcggcacccccgccgcugcccucgccugucuguugcccgaccgcgcacuccgggcgcgccugggccgcggggagcuggcccgugccguggugcuggaugaaagcagcgcgucuguggccgagcucccgccggacggccccgcucaccugcugcuagccgcacugcagcacgagaugcgcgggggacccacgaccgugugcuucuugcgaggugagcccgcgccccgcgcccugcgcccuucgccccuucucccauguuccgcgccccgcgcucuuagccccuugucccacguuccgugccccguucccgaccucuuggcuaaucauacccuuucuugucuuucccacaggcgguuucaaaagcuuccagacguacuguccggaucugugcucugaagcuccugcccaggcccugccuccugcuggggccgaaaauagcaacucugacccgaggguuccgaucuaugaccaggugaguugauauucgaauuuguugucuucauugugcauucuagagggaugccucuggagaacgccaguggggaaagacagggguguguuccaauauacauucccagauguggagaguguuugugugaccugcaaauggugugaacguguauauauccucauacagacuuuaaggcauauguggcacaaagugucugaacauauguccccuuguggccucaagacuuuuaauucuguccuuggucagaaggccuagagcuucucuuguuucuagccaauccaagaugucuggaucaagcccuccagcacaaggcugagugaggucucaccaccguccccuuccuccuccagggugguccuguggaaaucuugcccuaccuguacuugggcagcugcaaccacuccucagaucuucagggccugcaggccugcggcaucacagcaguucucaaugucucugccagcugccccaaccacuuugagggucuuuuccauuacaagagcauuccaguagaagauaaccagaugguggagauaagugccugguuccaggaggcuaucagcuucauagguaggggagccucagcccaggguucugugggaacuguaggggagaagguacaggcaccugauuccucuguccaccuuccugucugacucucggcuccacauuucuuuuucagacucggugaagaauagugggggccgggugcuggugcacugccaagcuggcaucucucgcucagccaccaucugccuggcauaccugauucagagccaccggguacggcuggacgaggccuuugacuuuguuaagcaacgucggggagucaucucccccaacuucaguuucauggggcagcugcuacagcuggagacccaggugcugugucacugaggcaaagcccagccuggccccacccacagcucuggcuuugacugacuccugggggaagcugcuguggcccagcuccucccuccucaucuugccgucccacuggggugcuaggaaauccaggaugacggcugcucugauauggugcucuucugagguggcauaagggcuggcccuuauuugcucucccuccuucgacuugcagaaauuaauuuaauuaauuaauuuacuauauuaaagcccuuggucacccaagggcucagaaaacaagcugugacaagcagaaaccaugucuaggggugugcagcccuugacccaaagcuuaagccuugugcucccaggggagccaggaagugacgugugug

SEQ ID NO: 9948 - RNA, 2501 nt, Mus musculus
cacacacgucacuuccuggcuccccugggagcacaaggcuuaagcuuugggucaagggcugcacaccccuagacaugguuucugcuugucacagcuuguuuucugagcccuugggugaccaagggcuuuaauauaguaaauuaauuaauuaaauuaauuucugcaagucgaaggagggagagcaaauaagggccagcccuuaugccaccucagaagagcaccauaucagagcagccgucauccuggauuuccuagcaccccagugggacggcaagaugaggagggaggagcugggccacagcagcuucccccaggagucagucaaagccagagcuguggguggggccaggcugggcuuugccucagugacacagcaccugggucuccagcuguagcagcugccccaugaaacugaaguugggggagaugacuccccgacguugcuuaacaaagucaaaggccucguccagccguacccgguggcucugaaucagguaugccaggcagaugguggcugagcgagagaugccagcuuggcagugcaccagcacccggcccccacuauucuucaccgagucugaaaaagaaauguggagccgagagucagacaggaagguggacagaggaaucaggugccuguaccuucuccccuacaguucccacagaacccugggcugaggcuccccuaccuaugaagcugauagccuccuggaaccaggcacuuaucuccaccaucugguuaucuucuacuggaaugcucuuguaauggaaaagacccucaaagugguuggggcagcuggcagagacauugagaacugcugugaugccgcaggccugcaggcccugaagaucugaggagugguugcagcugcccaaguacagguagggcaagauuuccacaggaccacccuggaggaggaaggggacgguggugagaccucacucagccuugugcuggagggcuugauccagacaucuuggauuggcuagaaacaagagaagcucuaggccuucugaccaaggacagaauuaaaagucuugaggccacaaggggacauauguucagacacuuugugccacauaugccuuaaagucuguaugaggauauauacacguucacaccauuugcaggucacacaaacacucuccacaucugggaauguauauuggaacacaccccugucuuuccccacuggcguucuccagaggcaucccucuagaaugcacaaugaagacaacaaauucgaauaucaacucaccuggucauagaucggaacccucgggucagaguugcuauuuucggccccagcaggaggcagggccugggcaggagcuucagagcacagauccggacaguacgucuggaagcuuuugaaaccgccugugggaaagacaagaaaggguaugauuagccaagaggucgggaacggggcacggaacgugggacaaggggcuaagagcgcggggcgcggaacaugggagaaggggcgaagggcgcagggcgcggggcgcgggcucaccucgcaagaagcacacggucgugggucccccgcgcaucucgugcugcagugcggcuagcagcaggugagcggggccguccggcgggagcucggccacagacgcgcugcuuucauccagcaccacggcacgggccagcuccccgcggcccaggcgcgcccggagugcgcggucgggcaacagacaggcgagggcagcggcgggggugccgcgcgcacgccgccgcagcagcgcguuccagggcaccggucgcgcggcgcgcacguggcuccggcagaaggccaggaacgggcggcagucgagcagcagcgugcgcucggccucccgcggcucccgcagcagcgcgcccagcgccgcgcacucuagcucgcacgccgucuccagccccauggcgaucggcaucgcaaagccuccugcuuccggauguccucucccucggcuccggcggcgcggugucuguguggcgggagcugacgguucugggggcucuucgucgagcccgggcuuaaauacucgagggcuggccccucgggucaccauacaaggguagagcaggaaggcgccggugcccgcccccgcggcuucacgugggacucuggcugggccgcccccggggcucccugagcggacaggggguggguggggcggggcaucagggggagggacacgcgggggaagaaacugggaaccagaccgugacaagugucggccuggagucuagaggccccacccacgucucuccaguguauaugccccagugcuccccacucuuugccaggcuucaagccacuaagugcuuaggaacucagcucucagcugcaccgagccuuugaguuacucaggucuucagcuuccucacuuuucccauuuucucccaggguuuucauucuaggaauuucgauagcaaaaauggacaaauuaccuguugcuacccauaaugauacacuauuaggaaagacaccaaccgucaggaaauuguccua

SEQ ID NO: 9949 - RNA, 2501 nt, Mus musculus
ugcacauauauagaucacacacacacacacacacacacacacacacacguaauuuauuuugagacagagucucacuauguaguucugggugaccuggaacuugcuauguagaucaggcuagacucgaacucacaaagauccauccgccuuugccucucgugugcugggaugagagguguacacuauccuccccacauccuuuuuaagacuccccuccuuggguccuuugcauuccacacuuccagauuaggacaagcagguuccuaagccagaauguccucuccccaacaaacucucaacacuugcagcgaguugugggugaugggcguggagggagcagugaucaugugguacaggcagcaaguccagcagagcauauagggugucaagggauggggcuucgagccuagagcgcguucugauuggcuggccccucagcugcugaggcgcaugcgcagagcccaguuuccggcuucgucggcucagucacacggcuguuuggcgggaguuggcggcuggugugaggugagcuuccugagacucgugugccggauuggaccaggcuggguugggcugggcugggcuuggcuuugggucaggcagggacugauguggaacucgggcuggugggcgugucucacagacaaacagucagaggcaagcugguggcccuggagagccccacuuugcccuuugcuuggcuuguggcaccugagacucagagagcaggcaaggauggacuuccggugccgccucggagacaggcccugcccuccaucuugguuuuggcgagaaccuuccuugcaggcguagggguauuugcugcagcugagaacuuuuuaaaguuaaguucugugaugguuaguagggcaggaacauuggggauguguguguugcauuuuagccuuuggugaagagcuacauaagagccaggcaccaagugccaccuguguagugcgggugggaggacucagaguggaagggacguggcuucugggcgcccccgagccgaggcccuguuggguaucugcucagauaccacaucucaaaguuauuuuuacagcagcagcuggaaacccccgcucuuuauauaacaagcucucugcuuuuaaacguuggccuuaauuccuaauguuuaagcacgucauauagucagcgagaagaugccugugaacuguacuggcccucggggaagagugugcaucuacacagacugccaguggcccucacuuagggaucuugcuugccagaugugucuguaauagugguguuugagaaacagagggaggaggauggagaauucaaagcuggucggggcaaaauagcaagacagugucuuaaaaagcgugagugagcuguccccaacugaccuggauuucaugagcuagguaguuggcuuaauuggcucaugagaaugcuccaugccuugucuuuuaaucuguuauuuuagggccagcauuggucggugggguuagauuuugagguuaggagucucaagcugaggagugucaaacgucuuccuugcaaaggaggcaggccuccuuacauugcagccuugaccuugggcuucucugugcuuagggucugaauggggcugugagaacauuuuuuaaaguaggggaugcaucugaaaugagaucuccagggccuguguauacaucaaucaggauccgguuacugcuuggcuucauggugcuaaauagcaccaaggggcagaggaggagcaccagaggaacccuggaaacuaagccacaggcaucuggcucuccugggcccuuuccauaccacuuaauugcugggucuacacaugaauuauuugcaauucuuacccucaggacgacuuucagaugaugugagggaagugagaugggaaccccgagggcuccacaaggcugcuuuucuggcugccuugggcccuggaacucauggagaaagaagaaucuagauguaucaugaacuaacaauuuguggucucaaaacucaaaaaggcacucucaggcuagcgugcaguuaaugugauugaguuggggaauaaaaagaauauaaauaauuaggccagucuguucaccauggacaugguggaagaucaggguaggggacccuuuugggcaggagucucucuuccacagaagcauaauggauccgagguucugcaagagggcugcucagcaggacuuagguuuauggagagaguauccuuuuccuuguauccucuucuugcugguauaauccagcccagccuaggcuuuuccuucuacacggagagccuuacguugccauuacaaucacaguugcuguuagaacacauuggggcauguggauggaagauagccacucauguugccugagggagccccugacuuuucaaguacagcucacuuccuggagggaccacuugggucagugacagggauuugaucagacugccuccagucuccuggcaauuguccucauugcugauggcuuaaguguugucugucuugggguagacucuggcauca

SEQ ID NO: 9950 - RNA, 2501 nt, Mus musculus
ugaugccagagucuaccccaagacagacaacacuuaagccaucagcaaugaggacaauugccaggagacuggaggcagucugaucaaaucccugucacugacccaaguggucccuccaggaagugagcuguacuugaaaagucaggggcucccucaggcaacaugaguggcuaucuuccauccacaugccccaauguguucuaacagcaacugugauuguaauggcaacguaaggcucuccguguagaaggaaaagccuaggcugggcuggauuauaccagcaagaagaggauacaaggaaaaggauacucucuccauaaaccuaaguccugcugagcagcccucuugcagaaccucggauccauuaugcuucuguggaagagagacuccugcccaaaaggguccccuacccugaucuuccaccauguccauggugaacagacuggccuaauuauuuauauucuuuuuauuccccaacucaaucacauuaacugcacgcuagccugagagugccuuuuugaguuuugagaccacaaauuguuaguucaugauacaucuagauucuucuuucuccaugaguuccagggcccaaggcagccagaaaagcagccuuguggagcccucgggguucccaucucacuucccucacaucaucugaaagucguccugaggguaagaauugcaaauaauucauguguagacccagcaauuaagugguauggaaagggcccaggagagccagaugccuguggcuuaguuuccaggguuccucuggugcuccuccucugccccuuggugcuauuuagcaccaugaagccaagcaguaaccggauccugauugauguauacacaggcccuggagaucucauuucagaugcauccccuacuuuaaaaaauguucucacagccccauucagacccuaagcacagagaagcccaaggucaaggcugcaauguaaggaggccugccuccuuugcaaggaagacguuugacacuccucagcuugagacuccuaaccucaaaaucuaaccccaccgaccaaugcuggcccuaaaauaacagauuaaaagacaaggcauggagcauucucaugagccaauuaagccaacuaccuagcucaugaaauccaggucaguuggggacagcucacucacgcuuuuuaagacacugucuugcuauuuugccccgaccagcuuugaauucuccauccuccucccucuguuucucaaacaccacuauuacagacacaucuggcaagcaagaucccuaagugagggccacuggcagucuguguagaugcacacucuuccccgagggccaguacaguucacaggcaucuucucgcugacuauaugacgugcuuaaacauuaggaauuaaggccaacguuuaaaagcagagagcuuguuauauaaagagcggggguuuccagcugcugcuguaaaaauaacuuugagaugugguaucugagcagauacccaacagggccucggcucgggggcgcccagaagccacgucccuuccacucugaguccucccacccgcacuacacagguggcacuuggugccuggcucuuauguagcucuucaccaaaggcuaaaaugcaacacacacauccccaauguuccugcccuacuaaccaucacagaacuuaacuuuaaaaaguucucagcugcagcaaauaccccuacgccugcaaggaagguucucgccaaaaccaagauggagggcagggccugucuccgaggcggcaccggaaguccauccuugccugcucucugagucucaggugccacaagccaagcaaagggcaaaguggggcucuccagggccaccagcuugccucugacuguuugucugugagacacgcccaccagcccgaguuccacaucagucccugccugacccaaagccaagcccagcccagcccaacccagccugguccaauccggcacacgagucucaggaagcucaccucacaccagccgccaacucccgccaaacagccgugugacugagccgacgaagccggaaacugggcucugcgcaugcgccucagcagcugaggggccagccaaucagaacgcgcucuaggcucgaagccccaucccuugacacccuauaugcucugcuggacuugcugccuguaccacaugaucacugcucccuccacgcccaucacccacaacucgcugcaaguguugagaguuuguuggggagaggacauucuggcuuaggaaccugcuuguccuaaucuggaaguguggaaugcaaaggacccaaggaggggagucuuaaaaaggauguggggaggauaguguacaccucucaucccagcacacgagaggcaaaggcggauggaucuuugugaguucgagucuagccugaucuacauagcaaguuccaggucacccagaacuacauagugagacucugucucaaaauaaauuacgugugugugugugugugugugugugugugugugaucuauauaugugca

SEQ ID NO: 9951 - RNA, 2501 nt, Mus musculus
caagcagucagaugggggaaagggaggagaggcccugguugcaccaggagagguugcagucauaagccugagacaggcugccccuuucuccucucugagcugguucuggcccuugggcccugcuccaggaccuucagagaggcucagggggugcgaagaaucccuugagagcaguuguaccugccccaggacugcagggcccuuguaagggaacuaguucacucuguaaaugacuauaaacaauaguaauuguccaccugacagacuuccuauccuguccuucccacccccacaaguccccuccucuaaccucuuccagagaagauuucagaagggaaagcccacaggguucucccagauaccaguggggccaacugaaauggaugucuauggagaacacagcacuucuggcaucugcugagcuacaagguggcuggcuggcuugggucugcugccagugaaugcaugugggcucacccacaaucuauuuccagagauggguaucuauggggaucacacacacugaucacaucauacagauugauguuugcucagauuuccaaggaacuaaagcaagaccgagguuuguaacaucuacaaaggguaagaaagagugagaagccuguuuaagggaaaacacauuaguaucaagaaccccucgggcgcgcucucucucucucuaguaagagaacaggaaguugauaaacuuccacaguuagguugugggucaucuaagcuuuccagguaaggaccgcccagaggggaagggucuaaagugagggaaucacucacccagaggcaggacgaagaaaaaggggaaccagcacaggacgaagacacccacgacgauggcuagggucuuggcagccuuuuucucgcgggaaaacuugagcagccuuacggagagcgagcugcgcaaggugugccccuugcuacucugugucccuggauuuccuuuggcgcuaguggcugcgccgcgacaguggauccucagaaccaccucagaggccuugcccggcucccucuugaugcccgccucgaggcugcgcguggugcugcgcgcgaccacauacacgcggcaguacaugaccacgaucacugccauggggagguagaaggagcauacggaagagaagaucgcauagcccaccuccucggugaugccgcagaaacgcucauccgggggcacugguuccuuccaaccuaguagcggucccacagauaccaccaaggccaccgcccagagcagagccagaauggcagcggccuugcguucugucauaauggcuggauacuugagcgaguggcgcacacccacguaccgguccacagagauggugcagaggcuaaggauggaggcagugcagcauagcacguccaccgcggcccauacgucgcagaagguccggccgaaggcccagaagccuagaaccuccauaguggcugagaagggcaacacagcugcacucaguagcaggucagccacugcuagguucacgaugaaauaguuggugaccgucugcaaguggcgguugcaggccacggagaggaugacgagaagguugcccgccacagcggugaggaugaaggcggcuaggaagacacccacucccacgcccugagcacucaccacuagccccccgacggccgccgagccauucaccucgccgcuugccgcggcccccgcuucugccguggagcucugguuguccucgccgcugccgguucccaccacagcgcuaccgccuguggcacccggcacgccgcccaccgccggacccucggggccaaccgugccagcuccgccgcccgcgccggagcccccagugcuacugcucgcccgggguccuucgaaagugacgcucaggaugucgcggaaagucaucucacggcgcagccgucggggcccgagcccaggcacagggcgagcaaguggcggggagggagcccgcgggcaucgccgcagcgcccgagccagccccgcgcgccggucccgucgguccugcccaaguucccgcggcagaggggccgcaggggagcggugcugcagggagagcggggcggaggucaccaggccgugaaggucccaacgggaacgggcucuggcgguggcugcagagucacaagaaaacaagggccggggccggcucccugcucccugcuccccucuccaagcguguccuggcgagcgguggcuccuccgggagcgucagugcaggcggcggccucugcagcgcaggggacucugcgcgggggcgggacggaggaggggcggcggggagggaggagggggcggccggcgcgagccagcgaaggggcuccgcgcguccagcggcugcggggguccucgccggugcucacgaccguccucugcccuagcuguccccuuauccuccuuuccucagcucuccugcaccccggcuuuugccccagcgcuccucgcugccucccuuccucucucuggacuugcggucacucucugcuugcccuugcccuagcgg

SEQ ID NO: 9952 - RNA, 2501 nt, Mus musculus
ccgcuagggcaagggcaagcagagagugaccgcaaguccagagagaggaagggaggcagcgaggagcgcuggggcaaaagccggggugcaggagagcugaggaaaggaggauaaggggacagcuagggcagaggacggucgugagcaccggcgaggacccccgcagccgcuggacgcgcggagccccuucgcuggcucgcgccggccgcccccuccucccuccccgccgccccuccuccgucccgcccccgcgcagaguccccugcgcugcagaggccgccgccugcacugacgcucccggaggagccaccgcucgccaggacacgcuuggagaggggagcagggagcagggagccggccccggcccuuguuuucuugugacucugcagccaccgccagagcccguucccguugggaccuucacggccuggugaccuccgccccgcucucccugcagcaccgcuccccugcggccccucugccgcgggaacuugggcaggaccgacgggaccggcgcgcggggcuggcucgggcgcugcggcgaugcccgcgggcucccuccccgccacuugcucgcccugugccugggcucgggccccgacggcugcgccgugagaugacuuuccgcgacauccugagcgucacuuucgaaggaccccgggcgagcaguagcacugggggcuccggcgcgggcggcggagcuggcacgguuggccccgaggguccggcggugggcggcgugccgggugccacaggcgguagcgcuguggugggaaccggcagcggcgaggacaaccagagcuccacggcagaagcgggggccgcggcaagcggcgaggugaauggcucggcggccgucggggggcuaguggugagugcucagggcgugggagugggugucuuccuagccgccuucauccucaccgcuguggcgggcaaccuucucgucauccucuccguggccugcaaccgccacuugcagacggucaccaacuauuucaucgugaaccuagcaguggcugaccugcuacugagugcagcuguguugcccuucucagccacuauggagguucuaggcuucugggccuucggccggaccuucugcgacguaugggccgcgguggacgugcuaugcugcacugccuccauccuuagccucugcaccaucucuguggaccgguacgugggugugcgccacucgcucaaguauccagccauuaugacagaacgcaaggccgcugccauucuggcucugcucugggcgguggccuuggugguaucugugggaccgcuacuagguuggaaggaaccagugcccccggaugagcguuucugcggcaucaccgaggaggugggcuaugcgaucuucucuuccguaugcuccuucuaccuccccauggcagugaucguggucauguacugccgcguguauguggucgcgcgcagcaccacgcgcagccucgaggcgggcaucaagagggagccgggcaaggccucugaggugguucugaggauccacugucgcggcgcagccacuagcgccaaaggaaauccagggacacagaguagcaaggggcacaccuugcgcagcucgcucuccguaaggcugcucaaguuuucccgcgagaaaaaggcugccaagacccuagccaucgucgugggugucuucguccugugcugguuccccuuuuucuucguccugccucugggugagugauucccucacuuuagacccuuccccucugggcgguccuuaccuggaaagcuuagaugacccacaaccuaacuguggaaguuuaucaacuuccuguucucuuacuagagagagagagagcgcgcccgagggguucuugauacuaauguguuuucccuuaaacaggcuucucacucuuucuuacccuuuguagauguuacaaaccucggucuugcuuuaguuccuuggaaaucugagcaaacaucaaucuguaugaugugaucagugugugugauccccauagauacccaucucuggaaauagauugugggugagcccacaugcauucacuggcagcagacccaagccagccagccaccuuguagcucagcagaugccagaagugcuguguucuccauagacauccauuucaguuggccccacugguaucugggagaacccugugggcuuucccuucugaaaucuucucuggaagagguuagaggaggggacuugugggggugggaaggacaggauaggaagucugucagguggacaauuacuauuguuuauagucauuuacagagugaacuaguucccuuacaagggcccugcaguccuggggcagguacaacugcucucaagggauucuucgcacccccugagccucucugaagguccuggagcagggcccaagggccagaaccagcucagagaggagaaaggggcagccugucucaggcuuaugacugcaaccucuccuggugcaaccagggccucuccucccuuucccccaucugacugcuug

SEQ ID NO: 9953 - RNA, 2501 nt, Mus musculus
ugagccccaggacgccggggcgccgcagccgugcgggcucugcuggcgagcgcugaugggggugcgccagagucaggcugagggaugcagaguggcggcccgcccgccacccagaucuucgcugcgcccuugcccggacacggcaucgcccacgauggcugccccgagccaugggucgcggcccagcuaacgcagaacguccgucccucgcccggcgagucccggagccagccccgcgccccgccagcgcuggucccugaggccgacgacagcagcagccuugccucagccuucccuucccgucccggccccgcacuccucccccugcucgaggcugugugucagcacuuggcuggagacuucuugaacuugccgggagagugacuugggcuccccacuucgcgccgguguccucgcccggcggauccagucuugccgccuccagcccgaucaccucucuuccucagcccgcugggcccaccccaagacacaguucccuacagggagaacacccggagaaggaggaggaggcgaagaaaagcaacagaagcccaguugcugcuccaggucccucggacagagcuuuuuccauguggagacucucucaauggacgugcccccuagugcuucuuagacggacugcggucuccuaaagguagaggacacgggccggggacccgggguuggcuggcgggugacaccgcuucccgcccaacggcgcagggcgccugggaggacugguggaguggaguggacguaaacauacccucacccggugcacgugcagcggaucccuagagggguuaggcauuccaaaccccagaucccucugccuugcccacuggccugcgaccuuccuccagccgguuccuccuccccaaguuuucgauacauuauaagggcuguuuugggcuuucaaaaaaaaaaaugcagaaauccauuuaaagaguauggccaguagauuuuacuaguucauugcugaccaguaaguacuccaagccuuagagauccuuggcuauccuuaagaaguaggucccauuuaggaagauacuaaaaguugggguucuccauguguguuuacugacuaugcgaaugugucauagcuuacacgugcauucauaaacacuaucuauuuaguuaauugcaggaaggugcauggauuucuugacugcacaggagucuggggaagggggacaggguugccugugggucaaccuuaaauaguuaggggcguaggccacaacuugcaaguggcgucauuagcaguaaucuugaguuuagcgcuuacugaaucuacaaguuugauaugcucaacuaccaggaaauuguauacagcgccucuaaggaagucacuugugcauuugugucuguuaauaugcacaugagcgcugcacuguauaaguuugucagggaugcaguguccgaccaaccuauggcuucccagcuuccugacacccgcauucccagcuagugucacaagaaaaggguacagacggucaaugcucuuuuuaauugggaguuaagaccaagccccaaguaagaaguccggcugggacuuggggguccuccauccucuugaucauccaggcuguagcccgcgaauaugacaugccaggagggcauccuggagaaggccagcgagcucuaugggagccgaggccgcgggggcgggcggaggacugggcggggaacgugggugacucacgucggcccuguccgcaggucgaccaugguggccgggacccgcugucuucuaguguugcugcuuccccagguccuccugggcggcgcggccggccucauuccagagcugggccgcaagaaguucgccgcggcauccagccgacccuugucccggccuucggaagacguccucagcgaauuugaguugaggcugcucagcauguuuggccugaagcagagacccacccccagcaaggacgucguggugccccccuauaugcuagaucuguaccgcaggcacucaggccagccaggagcgcccgccccagaccaccggcuggagagggcagccagccgcgccaacaccgugcgcagcuuccaucacgaaggugagcgggcggcggguggcggggcggggacggcgggcgggcggagacuaggcgggcagcccgggccuccacuagcacaguagaaggccuuucggcuucuguacgguccccucuguggccccagccagggauuccccgcuggugaguccucacccuuuccuggcaaguagccaaaagacaggcuccucccccuagaacuggagggaaaucgagugauggggaagagggugagagacugacuagccccuagucagcacagcaugcgagauuuccacagaagguagagaguuggagcuccuuaaaucugcuuggaagcucagaucugugacuuguguucacgcuguaguuuuaagcuaggcagagccaagggcagaauguucggagauaguauuagcaaaucaaauccagggccucaaagcauucaaauuu

SEQ ID NO: 9954 - RNA, 2501 nt, Mus musculus
aaauuugaaugcuuugaggcccuggauuugauuugcuaauacuaucuccgaacauucugcccuuggcucugccuagcuuaaaacuacagcgugaacacaagucacagaucugagcuuccaagcagauuuaaggagcuccaacucucuaccuucuguggaaaucucgcaugcugugcugacuaggggcuagucagucucucacccucuuccccaucacucgauuucccuccaguucuagggggaggagccugucuuuuggcuacuugccaggaaagggugaggacucaccagcggggaaucccuggcuggggccacagaggggaccguacagaagccgaaaggccuucuacugugcuaguggaggcccgggcugcccgccuagucuccgcccgcccgccguccccgccccgccacccgccgcccgcucaccuucgugauggaagcugcgcacgguguuggcgcggcuggcugcccucuccagccgguggucuggggcgggcgcuccuggcuggccugagugccugcgguacagaucuagcauauaggggggcaccacgacguccuugcugggggugggucucugcuucaggccaaacaugcugagcagccucaacucaaauucgcugaggacgucuuccgaaggccgggacaagggucggcuggaugccgcggcgaacuucuugcggcccagcucuggaaugaggccggccgcgccgcccaggaggaccuggggaagcagcaacacuagaagacagcgggucccggccaccauggucgaccugcggacagggccgacgugagucacccacguuccccgcccaguccuccgcccgcccccgcggccucggcucccauagagcucgcuggccuucuccaggaugcccuccuggcaugucauauucgcgggcuacagccuggaugaucaagaggauggaggacccccaagucccagccggacuucuuacuuggggcuuggucuuaacucccaauuaaaaagagcauugaccgucuguacccuuuucuugugacacuagcugggaaugcgggugucaggaagcugggaagccauagguuggucggacacugcaucccugacaaacuuauacagugcagcgcucaugugcauauuaacagacacaaaugcacaagugacuuccuuagaggcgcuguauacaauuuccugguaguugagcauaucaaacuuguagauucaguaagcgcuaaacucaagauuacugcuaaugacgccacuugcaaguuguggccuacgccccuaacuauuuaagguugacccacaggcaacccugucccccuuccccagacuccugugcagucaagaaauccaugcaccuuccugcaauuaacuaaauagauaguguuuaugaaugcacguguaagcuaugacacauucgcauagucaguaaacacacauggagaaccccaacuuuuaguaucuuccuaaaugggaccuacuucuuaaggauagccaaggaucucuaaggcuuggaguacuuacuggucagcaaugaacuaguaaaaucuacuggccauacucuuuaaauggauuucugcauuuuuuuuuuugaaagcccaaaacagcccuuauaauguaucgaaaacuuggggaggaggaaccggcuggaggaaggucgcaggccagugggcaaggcagagggaucugggguuuggaaugccuaaccccucuagggauccgcugcacgugcaccgggugaggguauguuuacguccacuccacuccaccaguccucccaggcgcccugcgccguugggcgggaagcggugucacccgccagccaaccccggguccccggcccguguccucuaccuuuaggagaccgcaguccgucuaagaagcacuagggggcacguccauugagagagucuccacauggaaaaagcucuguccgagggaccuggagcagcaacugggcuucuguugcuuuucuucgccuccuccuccuucuccggguguucucccuguagggaacugugucuuggggugggcccagcgggcugaggaagagaggugaucgggcuggaggcggcaagacuggauccgccgggcgaggacaccggcgcgaaguggggagcccaagucacucucccggcaaguucaagaagucuccagccaagugcugacacacagccucgagcagggggaggagugcggggccgggacgggaagggaaggcugaggcaaggcugcugcugucgucggccucagggaccagcgcuggcggggcgcggggcuggcuccgggacucgccgggcgagggacggacguucugcguuagcugggccgcgacccauggcucggggcagccaucgugggcgaugccguguccgggcaagggcgcagcgaagaucuggguggcgggcgggccgccacucugcaucccucagccugacucuggcgcacccccaucagcgcucgccagcagagcccgcacggcugcggcgccccggcguccuggggcuca

SEQ ID NO: 9955 - RNA, 2501 nt, Mus musculus
ugaacccuccugacauauuuggggccauucuucuccuuuguugcuauuuagcucgcgacccgcggguaauccucgcgcgggaggggggcgcacauugucgugcugauggacgggcccauuuggcggcuccgcgccccccggaggagacacacaaagcccaggcacgugcgccuccccauagaggagcagcagaccgugaagggaggcggggccgggcgugugccugggccaggcggggcggcggcgccgggcgcggcggggcggggcggggcggggcggccgaggggcgcgcgcuggggccccgcgcccucagguacaucugccgcaccuaccgggcgacccucgagucccggccccuuuuuugccgcuccgucgcccucccgcccucgucggcggaggagcugcggacgcucugauuggcucugggggaagcgggaggcgagaacaauggcccccuccccccguuaaaagggagcggcgcccgggcccggggacagggacgcgcgugcggagcgcagagccgggccagcagccgcgggcacugcgggagucccgaagccgccgcgugcaggcgaugggcuggggucacugagggccgccagggccgagcacggaggugggacccaaccagugcgucgcccuuuucaccgcgccaacaugccccgcggguuucuggugaagcgcagcaagaaguccacgcccguguccuaccggguccgcggcggcgaggacagugaccgggcgcugcugcugucacccggcugcgggggcgcccgcgccgagcccccggugcccagccccgggccgcugccgccaccuccgccgccggcgcucgcggagcgcgcccaugcugcgcucgccgccgcgcucgccugcgcgccaggcccgccgccgccacccccgccaggcccgcgggccgcgcacuucggcaaccccgaggcugcgcacccggcgccucucuacagucccacgcggccggugagccgcgagcacgagaagcacaaguacuucgagcgcagcuucaaccugggcucgccgguguccgcugaguccuuccccacgcccgccgcgcugcucgcagggggaggcagcggcgccaacggcgcuggcggcggcggcggcggcaccugcggcggagacgcgcugcucuucgcucccgccgagcucaagaugggcacugcguucuccgccggcgccgaggcggcccgggguccugggaccgguccuccacugucccccgccgcggcccugcggcccccgggcaagcgaccggcgccccccgccgcugucgcuacagagccgcccgccaaggcagccaaggccccgagcgccaaaaagccgaaggccauccgcaagcugcacuucgaggacgaggugaccacgucgccgguucuggggcucaagaucaaggagggcccgguggaggcgccgcggggucgcgcggggggcgcgacccgaccccugggcgaguucaucugccagcugugcaaggaggaguacgcugacccguucgcgcuggcgcagcacaagugcucgcgcaucgugcgcguggaguaccgcugcccagagugcgccaaggucuucagcugcccggccaaccuggccucgcaccgccgcuggcacaaaccacggccggugcccgcggcggcccgcgcgccagagccagaagccgccaccagggcggaggcgcgcgaggcugcgggcggcggcagcagcgaucgggacacgccgagcccuggcggcguauccgagucaggcuccgaggacgggcucuacgagugccaccacugcgccaagaaguuccgucgccaggccuaucugcgcaagcaccugcuggcacaucaccaggcgcugcaggccaaaggcgcgcccccgcccccgccgccgccgccaccccccgccgaggacauccuggcuuucuacgcggggcccgacgaaaaggcgccccaggaggccucgggcgacggcgaggcggccggcgugcugggccugagugcgaccgcccagugccaccugugcccagugugcggggagaccuuccccagcaagggcgcccaggagcgccaccugcgccugcugcacgcugcccagguguuccccugcaaguacugcccggccaccuucuacagcuccccgggccugacccggcacaucaacaagugccacccgucugagaauagacaggugauccuccuucaggugccugugcguccggccugcuagagugcgcccucgguccgggggcccccagaacugugccuucacucggagacccacaaagagagagcgccccccaugccugaucuggggguccccuacucccauuccagggugaaaguguccucuucgcuucgcuucgguggagcaugaccaccuggucuucucgcugugacuccuuuggaccccaaccccuuugcguugugcccccccccccaagccccauggcgcaacaggaguccgucucuuucuguacaggggaggaaaaaaaugcuguauacguu

SEQ ID NO: 9956 - RNA, 2501 nt, Mus musculus
aacguauacagcauuuuuuuccuccccuguacagaaagagacggacuccuguugcgccauggggcuugggggggggggcacaacgcaaagggguugggguccaaaggagucacagcgagaagaccagguggucaugcuccaccgaagcgaagcgaagaggacacuuucacccuggaaugggaguaggggacccccagaucaggcauggggggcgcucucucuuugugggucuccgagugaaggcacaguucugggggcccccggaccgagggcgcacucuagcaggccggacgcacaggcaccugaaggaggaucaccugucuauucucagacggguggcacuuguugaugugccgggucaggcccggggagcuguagaagguggccgggcaguacuugcaggggaacaccugggcagcgugcagcaggcgcagguggcgcuccugggcgcccuugcuggggaaggucuccccgcacacugggcacagguggcacugggcggucgcacucaggcccagcacgccggccgccucgccgucgcccgaggccuccuggggcgccuuuucgucgggccccgcguagaaagccaggauguccucggcgggggguggcggcggcggcgggggcgggggcgcgccuuuggccugcagcgccuggugaugugccagcaggugcuugcgcagauaggccuggcgacggaacuucuuggcgcagugguggcacucguagagcccguccucggagccugacucggauacgccgccagggcucggcgugucccgaucgcugcugccgccgcccgcagccucgcgcgccuccgcccugguggcggcuucuggcucuggcgcgcgggccgccgcgggcaccggccgugguuugugccagcggcggugcgaggccagguuggccgggcagcugaagaccuuggcgcacucugggcagcgguacuccacgcgcacgaugcgcgagcacuugugcugcgccagcgcgaacgggucagcguacuccuccuugcacagcuggcagaugaacucgcccaggggucgggucgcgccccccgcgcgaccccgcggcgccuccaccgggcccuccuugaucuugagccccagaaccggcgacguggucaccucguccucgaagugcagcuugcggauggccuucggcuuuuuggcgcucggggccuuggcugccuuggcgggcggcucuguagcgacagcggcggggggcgccggucgcuugcccgggggccgcagggccgcggcgggggacaguggaggaccggucccaggaccccgggccgccucggcgccggcggagaacgcagugcccaucuugagcucggcgggagcgaagagcagcgcgucuccgccgcaggugccgccgccgccgccgccagcgccguuggcgccgcugccucccccugcgagcagcgcggcgggcguggggaaggacucagcggacaccggcgagcccagguugaagcugcgcucgaaguacuugugcuucucgugcucgcggcucaccggccgcgugggacuguagagaggcgccgggugcgcagccucgggguugccgaagugcgcggcccgcgggccuggcggggguggcggcggcgggccuggcgcgcaggcgagcgcggcggcgagcgcagcaugggcgcgcuccgcgagcgccggcggcggagguggcggcagcggcccggggcugggcaccgggggcucggcgcgggcgcccccgcagccgggugacagcagcagcgcccggucacuguccucgccgccgcggacccgguaggacacgggcguggacuucuugcugcgcuucaccagaaacccgcggggcauguuggcgcggugaaaagggcgacgcacugguugggucccaccuccgugcucggcccuggcggcccucagugaccccagcccaucgccugcacgcggcggcuucgggacucccgcagugcccgcggcugcuggcccggcucugcgcuccgcacgcgcgucccuguccccgggcccgggcgccgcucccuuuuaacggggggagggggccauuguucucgccucccgcuucccccagagccaaucagagcguccgcagcuccuccgccgacgagggcgggagggcgacggagcggcaaaaaaggggccgggacucgagggucgcccgguaggugcggcagauguaccugagggcgcggggccccagcgcgcgccccucggccgccccgccccgccccgccccgccgcgcccggcgccgccgccccgccuggcccaggcacacgcccggccccgccucccuucacggucugcugcuccucuauggggaggcgcacgugccugggcuuugugugucuccuccggggggcgcggagccgccaaaugggcccguccaucagcacgacaaugugcgccccccucccgcgcgaggauuacccgcgggucgcgagcuaaauagcaacaaaggagaagaauggccccaaauaugucaggaggguuca

SEQ ID NO: 9957 - RNA, 2501 nt, Mus musculus
caacaccaaguccucugggccccaaagagagccggaaaagagaucgcccuagggccagcgggaccugaggcucagccucgcccagauucuagaacuucagugaccuggaccaccgccaacucaggcgccccaaauguauuuuacucucccuaggggcuccucaaaucagcuggccagcacacugagucagcaccgaggccggaaaucuccguugcuaucccagguagucaaaagccaccuuuggaaccucacuggggcagucucaagcgaaaaucaucucaguguccucuauucugggguuucguaccgggaccccacuccuuagucauaggggagugaagcgcagugccugcacagaguccgggagcagcuggaggcaucgcguggaggaauaaggaagggaccgccaacucggcuaggaacuguuagugucccggcuucguagcgacaaacuuuuuuucucuuuguccacuggucuuugauucuuugccuguaccucuguccccaacuccuacccaccuucucuuccccagcuccccacccccucgccagccgaccucccaccccuccccagccgcgcgcugccaaacauaacucuguuaggauagugcguggcucggccacgaagaggauuuggaggcgccgcaagucaauauuugaucacaaaguuaauauuaucucaaggcuaacagugugucguauaaaaaagagacccauuugaguagaaggagggcggaaaaggcggcuguccaggaaggcuagaggugggggggcggguaccggugaagggagcgugcggaggcuggggacgcggagauagcugucaccccacuucucccuggccagggcaagagcuuaccucgggcuccgcguaguagcugcuccagucggauggcucgugcccuuccaucuucacggcucccagcauacuggaagccgagugcauggcgguuuaaaauuuaacagccacaacaaacgaccagcaaucagcccccacccccacccucuuaaaaaaaaaagucagcaaugguaccguccccucccucccgcccucucucgcgcucccccucucucccucucuggacuccacuuccucucucucucccgcggccugcggcgggaaguagcugggagugggcgggaagguggcuggcggaggagggggccgaagaacccuggaggccggaacccgagacucgccgucgggcgugcacucugucgccgcgcucccggggcugccggugcaggcugaggcuggcagugucgagcugccgggaggcggcgggaagcuagcggcgugggggcgggcggggggagagcgagaggagggggaggaggaggaggaggagguguggaccgcgcagcggacaagugccgcaaugacgugagcggcuggugauauagcgcggugcgcuggcgcuggccuccaauccccagaccccgggcagcccauuugaauaaucagcucacacuuaggugagaggaagccagggcuagcguuccgcaccugccgcugggcgccccgagcuagcccaucuccugcugucccuggcacucccaagaccccgaccugcaagcaggcgugcuggcgcccugguggagucccuuccuuuacguccacggggagucuuccguggacccagagaccugggaucaagccacccuuggagaaacucaggucuccugcucccgccccgccccuccucaucgccccaagcacgggguucgucaauccgaaggcgcguaccgccuugguggccugcaaagcgaggcaagccagauuuauuuaucucggguuuccucccuuuuagugcacauucccugucaaaacaacaagcaggugacagccaauuugcaaagcgcuguccuauuuagaaaaacuguguacacaccuuuaacucgcuggccgcugcuccggaggccccuccccguuacaguuaagucccggggcggccucaggaggcgcguaggacucgcguggucuggccgcccuggucgucaguuaccucaguccucuuucuggcuacccaccucagucggccuggagagacccguuuagcugcagccaauacccgggaggcagcgauuugccucuggcaugagggccucgguguuucaagguuacuuuucaguuaaauccaaggugcccaaagcauuucguaacuaaaacaaacagggcaguagguggggguagggcaggagaaaaaaaaucaauaaugggccuugugggaugacuucaggaggaucuguguucucugccugcagagaccaggacugucuuauaaaaauugaaaauuucaguuucuuuucucuuuagcuucuagguguuaaaaagugucauuugaaguguugucuucugccuuugaggcagaggcaggaggaucucagagaagucuaggcugaccuagucuauagagugaguuucaagacauccgggcuacagagagaaaccuugucuccccaaacaaaacaaacaugaaaacaacagaguaugucauuua

SEQ ID NO: 9958 - RNA, 2501 nt, Mus musculus
uaaaugacauacucuguuguuuucauguuuguuuuguuuggggagacaagguuucucucuguagcccggaugucuugaaacucacucuauagacuaggucagccuagacuucucugagauccuccugccucugccucaaaggcagaagacaacacuucaaaugacacuuuuuaacaccuagaagcuaaagagaaaagaaacugaaauuuucaauuuuuauaagacaguccuggucucugcaggcagagaacacagauccuccugaagucaucccacaaggcccauuauugauuuuuuuucuccugcccuacccccaccuacugcccuguuuguuuuaguuacgaaaugcuuugggcaccuuggauuuaacugaaaaguaaccuugaaacaccgaggcccucaugccagaggcaaaucgcugccucccggguauuggcugcagcuaaacgggucucuccaggccgacugagguggguagccagaaagaggacugagguaacugacgaccagggcggccagaccacgcgaguccuacgcgccuccugaggccgccccgggacuuaacuguaacggggaggggccuccggagcagcggccagcgaguuaaagguguguacacaguuuuucuaaauaggacagcgcuuugcaaauuggcugucaccugcuuguuguuuugacagggaaugugcacuaaaagggaggaaacccgagauaaauaaaucuggcuugccucgcuuugcaggccaccaaggcgguacgcgccuucggauugacgaaccccgugcuuggggcgaugaggaggggcggggcgggagcaggagaccugaguuucuccaaggguggcuugaucccaggucucuggguccacggaagacuccccguggacguaaaggaagggacuccaccagggcgccagcacgccugcuugcaggucggggucuugggagugccagggacagcaggagaugggcuagcucggggcgcccagcggcaggugcggaacgcuagcccuggcuuccucucaccuaagugugagcugauuauucaaaugggcugcccggggucuggggauuggaggccagcgccagcgcaccgcgcuauaucaccagccgcucacgucauugcggcacuuguccgcugcgcgguccacaccuccuccuccuccuccucccccuccucucgcucuccccccgcccgcccccacgccgcuagcuucccgccgccucccggcagcucgacacugccagccucagccugcaccggcagccccgggagcgcggcgacagagugcacgcccgacggcgagucucggguuccggccuccaggguucuucggcccccuccuccgccagccaccuucccgcccacucccagcuacuucccgccgcaggccgcgggagagagagaggaaguggaguccagagagggagagagggggagcgcgagagagggcgggagggaggggacgguaccauugcugacuuuuuuuuuuaagagggugggggugggggcugauugcuggucguuuguuguggcuguuaaauuuuaaaccgccaugcacucggcuuccaguaugcugggagccgugaagauggaagggcacgagccauccgacuggagcagcuacuacgcggagcccgagguaagcucuugcccuggccagggagaaguggggugacagcuaucuccgcguccccagccuccgcacgcucccuucaccgguacccgcccccccaccucuagccuuccuggacagccgccuuuuccgcccuccuucuacucaaaugggucucuuuuuuauacgacacacuguuagccuugagauaauauuaacuuugugaucaaauauugacuugcggcgccuccaaauccucuucguggccgagccacgcacuauccuaacagaguuauguuuggcagcgcgcggcuggggaggggugggaggucggcuggcgaggggguggggagcuggggaagagaagguggguaggaguuggggacagagguacaggcaaagaaucaaagaccaguggacaaagagaaaaaaaguuugucgcuacgaagccgggacacuaacaguuccuagccgaguuggcggucccuuccuuauuccuccacgcgaugccuccagcugcucccggacucugugcaggcacugcgcuucacuccccuaugacuaaggaguggggucccgguacgaaaccccagaauagaggacacugagaugauuuucgcuugagacugccccagugagguuccaaagguggcuuuugacuaccugggauagcaacggagauuuccggccucggugcugacucagugugcuggccagcugauuugaggagccccuagggagaguaaaauacauuuggggcgccugaguuggcggugguccaggucacugaaguucuagaaucugggcgaggcugagccucaggucccgcuggcccuagggcgaucucuuuuccggcucucuuuggggcccagaggacuugguguug

SEQ ID NO: 9959 - RNA, 2501 nt, Mus musculus
gugcuuuuaaguugccagagaacacagcugggaggcuggagagagagagaggagaggagagguacagagcccggaaagacaaaggccaccugggucucuggagcaaaucccucagaacuucugcagcguccgaucaguccugacgugcugcagcacuaccuccuuggcggaagaugcgcacuuguacuccagcucugcacgagcagcgcccugcuucuugcgcaggugacagagaagcgccaaaagcgccaccaccagggacaggcuggcaauggagaugccaaugagcacgccagagugcacuggccuugcagaagggggaccugucggagagccuggcguagggcugacuggaggcuccccagagcccuccucuuccuuggugucuucccuaacagggauggggucacagucuuugcuaaucugaccagcaagggcugugucaggcccgcagauacacucauaggagccagggaaguuucgacauucacuggugaagcauucgccuugacugcacucaucaauguccgugcauacggaacccucguccaggaugaagccuucagggcauucacaaacaguaggagaguuagggucacagucugcugggcacgaaguuucauugcagaacauuucgcacuugugcgguucauccggcuugggugcgaagccuggagcgcagaugcaucgguagucgguggggcucacuggcuggcacugaaacucgcaguuagauccgaaacacggauccagaagcuccacgcacucuccauccaccaacucauagccaucauagcagaagcauucgaagccgcccuugguguuaacacagagcuggggacauggauugggccccugcuuacagucauccacguccucacaccgguguccgucugcagccaacugguagccugucucacacauacaggaguaagagccuggcacuucagcguugcugacacaaaaaugcucgcagaguucguugcacgauugaaccacaggucuugcacacgaacguccaucggccugcagguccaugucucuggggcagaggcaucuggguucauucgugcuccuauugcacaaguacucacagccaccauucuccacgcugcaauuccaggcuccugucgcuucccaagcccagugucccucugaaguuccgggcggggcccugcacaccagcuccaagccaaggggcuccaccgcggcggaacugccuaccggcagcguuugaaaguccgcaccacugaccccgaacgggguguuguagguacuagagaugugggcagccucaggaucgcgaguauucaccgucagaggccugcaggaagcugugaaguaaaacucacagaggaaacccugggucucagucucgcauggcuucucuucccaggccggcucgccgggugcagcuucaguugcugucgagaccgugacgcacagagggccgcagaguggagccgucuggucguugggccgcgcccaccugcuguaacuggugugguuaucgccaguaacccacuggaagccgcgcaggggcccgagaugcaccgggucgucacagcccugcgggagcuguaaaccgauccagggcccuaaauccauacugcucuggcucagcagaagggagaugacaucggcagccacugaggagcgcacugucaucaaauguccuugcaggcgcuggcaggccuggcuggcaucgaggaaggucgcggggcccuggaaaagcgcgaagcacucaugcuccacgcauugacugccugugggcugcagcuuggcuagugcggagagccccaggcuagcuggagccagcacacccagaaagaaaaucccaagcaugcuguccaggggugcaccgugcaaguuccgagaaaagcuagcccugcgcuggugcagacacccaguccaggcagagggguuuccguaugccugcggcgacagcagcuagccucuaucacaaccuagacguuucuagcccaggcuccuagucccugcgaggcagccucuaacaugccacuccgcugaagcuccaguuuauaaaugcgcggcccucccucuuugcacguucgggaaaaggaaggaagugccuggugggaagggcugaugcugcguucucggauuacuggguucuccggacgccuugcgcccgcccuccagccugggaucaccucugcgcgaugaguuaaaaagucugucugggcguugggaggcccucgggcguggccugcaggcgccaccacagaacagaacugugucagcaagacgacaguuccugccccagacucuccgguauagcccgcggguagccuguguuuaaaccucuacacacguacacacacucagacgcgaacacacacacacucacacucacacuuccacauagaugcuaccaaaguuuggaagaugguccgguugguggggcagggaaaagaaaaguccaguagaggugugucugagacuugcaagacucugaaaaaggugagcuaaaugcaagg

SEQ ID NO: 9960 - RNA, 2501 nt, Mus musculus
ccuugcauuuagcucaccuuuuucagagucuugcaagucucagacacaccucuacuggacuuuucuuuucccugccccaccaaccggaccaucuuccaaacuuugguagcaucuauguggaagugugagugugaguguguguguguucgcgucugaguguguguacguguguagagguuuaaacacaggcuacccgcgggcuauaccggagagucuggggcaggaacugucgucuugcugacacaguucuguucugugguggcgccugcaggccacgcccgagggccucccaacgcccagacagacuuuuuaacucaucgcgcagaggugaucccaggcuggagggcgggcgcaaggcguccggagaacccaguaauccgagaacgcagcaucagcccuucccaccaggcacuuccuuccuuuucccgaacgugcaaagagggagggccgcgcauuuauaaacuggagcuucagcggaguggcauguuagaggcugccucgcagggacuaggagccugggcuagaaacgucuagguugugauagaggcuagcugcugucgccgcaggcauacggaaaccccucugccuggacugggugucugcaccagcgcagggcuagcuuuucucggaacuugcacggugcaccccuggacagcaugcuugggauuuucuuucugggugugcuggcuccagcuagccuggggcucuccgcacuagccaagcugcagcccacaggcagucaaugcguggagcaugagugcuucgcgcuuuuccagggccccgcgaccuuccucgaugccagccaggccugccagcgccugcaaggacauuugaugacagugcgcuccucaguggcugccgaugucaucucccuucugcugagccagagcaguauggauuuagggcccuggaucgguuuacagcucccgcagggcugugacgacccggugcaucucgggccccugcgcggcuuccaguggguuacuggcgauaaccacaccaguuacagcaggugggcgcggcccaacgaccagacggcuccacucugcggcccucugugcgucacggucucgacagcaacugaagcugcacccggcgagccggccugggaagagaagccaugcgagacugagacccaggguuuccucugugaguuuuacuucacagcuuccugcaggccucugacggugaauacucgcgauccugaggcugcccacaucucuaguaccuacaacaccccguucggggucaguggugcggacuuucaaacgcugccgguaggcaguuccgccgcgguggagccccuuggcuuggagcuggugugcagggccccgcccggaacuucagagggacacugggcuugggaagcgacaggagccuggaauugcagcguggagaaugguggcugugaguacuugugcaauaggagcacgaaugaacccagaugccucugccccagagacauggaccugcaggccgauggacguucgugugcaagaccugugguucaaucgugcaacgaacucugcgagcauuuuugugucagcaacgcugaagugccaggcucuuacuccuguaugugugagacaggcuaccaguuggcugcagacggacaccggugugaggacguggaugacuguaagcaggggcccaauccauguccccagcucuguguuaacaccaagggcggcuucgaaugcuucugcuaugauggcuaugaguugguggauggagagugcguggagcuucuggauccguguuucggaucuaacugcgaguuucagugccagccagugagccccaccgacuaccgaugcaucugcgcuccaggcuucgcacccaagccggaugaaccgcacaagugcgaaauguucugcaaugaaacuucgugcccagcagacugugacccuaacucuccuacuguuugugaaugcccugaaggcuucauccuggacgaggguuccguaugcacggacauugaugagugcagucaaggcgaaugcuucaccagugaaugucgaaacuucccuggcuccuaugaguguaucugcgggccugacacagcccuugcuggucagauuagcaaagacugugaccccaucccuguuagggaagacaccaaggaagaggagggcucuggggagccuccagucagcccuacgccaggcucuccgacaggucccccuucugcaaggccagugcacucuggcgugcucauuggcaucuccauugccagccugucccuggugguggcgcuuuuggcgcuucucugucaccugcgcaagaagcagggcgcugcucgugcagagcuggaguacaagugcgcaucuuccgccaaggagguagugcugcagcacgucaggacugaucggacgcugcagaaguucugagggauuugcuccagagacccagguggccuuugucuuuccgggcucuguaccucuccucuccucucucucucuccagccucccagcuguguucucuggcaacuuaaaagcac

SEQ ID NO: 9961 - RNA, 2501 nt, Mus musculus
augacaucuuuuugguaguuuuccuuuggagguauaagaucgauuuucuacuguuugcaaccaaaccugcuuggcagaaccaacuuccucauaccagacucaucccaagaauuguuuuuaaccaucuuaacaauuuucaguaaccauaauugacuccauuuuguaucuggggccuugagagguugaaucugagccaaaguuaagcagcuaauuaguggcaggccaggauucaaaucaaagccauagaagucccccucuacucacccuuaagcaccuuauaaguauugcuuuguuaaagcacuagcccuguuuugcagcugggaagcuaagaccagaagaggucauagacaguggagcaguggccagauuccccugggaguuacaggggaggagcagaguuuugguguggugaggucacuugugagcucacaauacaguuacccugaugggcggggccaaacuggggccccugguuagagggcagggccgaggcagcaugggcaguggccucuagugaccaguccugugaccaguccuaucaugggaaacagcaguucccacaagaggaccaaagcacccaaucaggccaacaaggacaggccaccugacauggacaaagcccgucacaagcaguucuucagccaucucaagaggaagaagccaagugugaguauggagaggcuagaagggacgcugggugccaggagcaugagggguuagagacucucuagagagaacaggaucucuggagcccauauagguaguaguaguauagggauucuagaagcaauggcuggggggagggggggaggaggaagagugcucucucaaccagggaucagguauagugucucugggaccacagaccugaaauaccuuuacacccucucuccagcccauggccucgcaacacgccacuuucccuuucuuucaguggcgagaggcuccugacccugcccgugugggugagaacccccgcaucaaggcugggaaaguaugcaguggucaauggguuccuguggggaggcagggucucaggguacggggcacaguggggcuccggagguugggucgggcacggaagaagccucaggccccacgagggcauguucuucccuucacacccgcccacccccagaccaagaucgugcugcuuuucccgcuggacaagcggcagcagcuggccgaggcagcggcgggcccauuugugaggccggugcggccaacugaggacccgcucggcgccccaacgugcuucccagcgguggcgccuaugcuacguggggcuggcgacggcguggacaggcgcgaaggcgcgcgcgcucgggagaugaaaaggauccuggugcugcugcugcagcuggacgcacggcugcaggaggaggggcgucgagugggaggcaggccggggggcggggccaaggucccgcagugcuggcagccgcuguaugcgcacgugcugacccaacgcgaugccuguggugaaggcgacccccgcgaggagcagccgcgcaagcggcgccgcugcccucgcccgcggcccugagugccuggcacgaccccuagcgccaggacucugcucaauaaagagcacauagcaaacccugugucugccacuucugugccugcugucggucaccuggucaaaacugaggccccgagcgaguaggaguuagaacagucaccaacacgaccuggagcuagggcugccuuuuacuuuucguagcacaaaggucagcucaugccaaauccguagacugaagguggacuugagcaacgcuaggaagaacuuguuucaggcaaagguuugaggucuccaagaguccccaacguucaaaaaucccucuucggaagaggaaggguuucaggcuuacaaacaucauaccaggaugucagucauggugaagcuggaaccucagagucugcuuuuggcacacacucaagaaaaggggcuugaaccucuagucucucacccuacagccugucagcucccaagcacucaggucccccaaacuuuagggucccuuaaucaaagcacuuuccuccagagguaccaguucuauccucuaccauuuguagccaaaaucuucuuccaaaccacuaaucuguguauggcaaauuaguuuccccugcuaguauauaauccucagucucucugcugccccuccaaaggccaaggcuacaauuaguguaugcacacccagcugccgauccccacugccaucagugcucucccucugcuccuccauacugacauagcaccaguggccucugaugucacucuuauucccgagagaagcagcaugcucugaacagaagccacugcuggcuuucuuggaucccacacccagcuccagaccagacccuaaagccaccauuccugugacaauaccagcacucaagaggaugggguaggaguaacuugaauucaguaccacagauugcuuaaaacaaaaauugagcugggcggugguggcucacgccuuuaaucccagcacuug

SEQ ID NO: 9962 - RNA, 2501 nt, Mus musculus
caagugcugggauuaaaggcgugagccaccaccgcccagcucaauuuuuguuuuaagcaaucugugguacugaauucaaguuacuccuaccccauccucuugagugcugguauugucacaggaaugguggcuuuagggucuggucuggagcugggugugggauccaagaaagccagcaguggcuucuguucagagcaugcugcuucucucgggaauaagagugacaucagaggccacuggugcuaugucaguauggaggagcagagggagagcacugauggcaguggggaucggcagcugggugugcauacacuaauuguagccuuggccuuuggaggggcagcagagagacugaggauuauauacuagcaggggaaacuaauuugccauacacagauuagugguuuggaagaagauuuuggcuacaaaugguagaggauagaacugguaccucuggaggaaagugcuuugauuaagggacccuaaaguuugggggaccugagugcuugggagcugacaggcuguagggugagagacuagagguucaagccccuuuucuugagugugugccaaaagcagacucugagguuccagcuucaccaugacugacauccugguaugauguuuguaagccugaaacccuuccucuuccgaagagggauuuuugaacguuggggacucuuggagaccucaaaccuuugccugaaacaaguucuuccuagcguugcucaaguccaccuucagucuacggauuuggcaugagcugaccuuugugcuacgaaaaguaaaaggcagcccuagcuccaggucguguuggugacuguucuaacuccuacucgcucggggccucaguuuugaccaggugaccgacagcaggcacagaaguggcagacacaggguuugcuaugugcucuuuauugagcagaguccuggcgcuaggggucgugccaggcacucagggccgcgggcgagggcagcggcgccgcuugcgcggcugcuccucgcgggggucgccuucaccacaggcaucgcguugggucagcacgugcgcauacagcggcugccagcacugcgggaccuuggccccgccccccggccugccucccacucgacgccccuccuccugcagccgugcguccagcugcagcagcagcaccaggauccuuuucaucucccgagcgcgcgcgccuucgcgccuguccacgccgucgccagccccacguagcauaggcgccaccgcugggaagcacguuggggcgccgagcggguccucaguuggccgcaccggccucacaaaugggcccgccgcugccucggccagcugcugccgcuuguccagcgggaaaagcagcacgaucuuggucugggggugggcgggugugaagggaagaacaugcccucguggggccugaggcuucuuccgugcccgacccaaccuccggagccccacugugccccguacccugagacccugccuccccacaggaacccauugaccacugcauacuuucccagccuugaugcggggguucucacccacacgggcagggucaggagccucucgccacugaaagaaagggaaaguggcguguugcgaggccaugggcuggagagaggguguaaagguauuucaggucuguggucccagagacacuauaccugaucccugguugagagagcacucuuccuccucccccccuccccccagccauugcuucuagaaucccuauacuacuacuaccuauaugggcuccagagauccuguucucucuagagagucucuaaccccucaugcuccuggcacccagcgucccuucuagccucuccauacucacacuuggcuucuuccucuugagauggcugaagaacugcuugugacgggcuuuguccaugucagguggccuguccuuguuggccugauugggugcuuugguccucuugugggaacugcuguuucccaugauaggacuggucacaggacuggucacuagaggccacugcccaugcugccucggcccugcccucuaaccaggggccccaguuuggccccgcccaucaggguaacuguauugugagcucacaagugaccucaccacaccaaaacucugcuccuccccuguaacucccaggggaaucuggccacugcuccacugucuaugaccucuucuggucuuagcuucccagcugcaaaacagggcuagugcuuuaacaaagcaauacuuauaaggugcuuaagggugaguagagggggacuucuauggcuuugauuugaauccuggccugccacuaauuagcugcuuaacuuuggcucagauucaaccucucaaggccccagauacaaaauggagucaauuaugguuacugaaaauuguuaagaugguuaaaaacaauucuugggaugagucugguaugaggaaguugguucugccaagcagguuugguugcaaacaguagaaaaucgaucuuauaccuccaaaggaaaacuaccaaaaagaugucau

SEQ ID NO: 9963 - RNA, 2501 nt, Mus musculus
uuaaguucccgggagcuuggguaaccagucucuaugcugaauuucuaggcaaguguucuaccgaguuauaccuccauccccucucuguugaauuuccacccacaccaguaugaugccuacacggaacucccccaaggcauuccugagguuugggaauuccauccccuaucagcacuucaucuugccagcuucucccuuucaucuauucauucaauaaucauuuacugagugcccaacacugugcugaauucuggagaaagaauaguggaugaaaaagccacacucccugcuuuucgaggccucauagacaacaguaagcccaaauaaauaaccacaggcuuuuuaauaaagcagugaccuuuaacgggggccagaagaagacagaucaaagguccugcuuuguuaucuggauaugcuuuauagagguggaggagaaaaggaaagcccaguacaggguaggcacacccacuaaacuguaguaagucacggcuguacugcucuuaaucucugaauagaaaacccaaauugaccagguggcuggugucaauagaugaccagaagguuccaccaggacauccuuucccacauccacucuuguaccgccaaggcuacccugcgccccccccccaagaaaauuaguuuugacaggcagcucugacauuugaggucccaaagucuacacagcccauucuuaaucccaucacagguaaagugagauccagucaggcugguggguucugguggucaggaagcagaggagaggauuucagucgccaggcugggagugacaauggaagagccaggcuagaaagggccggagcagcauccuccgguauagacagggauauagcucaagugcaggcaccaccaggaggaagucagggagcagaagaaugcucuggugccaggaagugacguugaaggaaagagggcagagggaugcuggauaaagaaugguggggagcacagagcuggaccacaugggcaggagagauagcaauaggggaggaauaccaacggaucucuugguccccagcucccucucucaagcccagcuuccuucccaaacuccaucuccuucaguuucagcagaggguggagaacacagaucuuguugcugaccagaagcuccuaccgaccugacuaacauccgggccagauccccaucucuggaagggguaggguaauccacagaacagcaaaggcacuguaguccccaaggacuuugagaggucaugccguccauccccuugucucccaauacccagaauccccagacagagaggaaucacauuuucuuuaccccucucuggacaugaagagauagauucucagcucuucucgggacacucugcuucccauaaucccuggcuauggugaaguucuccugaagaucuagacuccaucccgccugcugcagucuccuacuuggcuuuucuauccuguccucuguggcuagagaaaagcuuuuacuaggugaccacagcuguucuuuaggcucuccccuccagcaucccuuuuuucucaauagguucuuccuaaaagguaaucauaaucucuccugcugcaguccuugcauccccucccgugucgcauccuacgccuccaaggcaaaaauacccccuuucccaccagacaguuaacagggcugaggaagaaggggagagguccaggaugcagaggaugaaugaaggagaugggagauuggaaauggaugcucagaacaggaggaggaggaccaggacaccagcccccacccucaaccccccaaggcggggcagggauggggccagagggccucaccaguauccgggucucccaagaaggcguccucguccuuacggccccucaguggggccgcaggcgcuggcucguccuccggcagccucgggaagcuggugaugcucauauaguccacuggugaguaggcgccuagggcgcucuccuggcuagccucguucucagccgccauccucgcccuaacccccagcagcgcagcgccugccggaaguggcagugaagaggggggugcgagggcggagggcggggucugagcuccuggacagccgggagggggcgcccccaccgucagcaguguccuaguaugacucgcccccgccugcuuaaagucuacugauugcagccugcaggcaggugcaggaggaugggagcccagaggacaguggaagguugccaggaugaagacgcuacucugggauccucaaacaaucccuggcccuuccuccuuccagucugaauccagcccagauuccauaugcuucuagaaccacagacugacuuuugagcgcaaauuucucuuugauuucagauccucuucggaccacucacuuccuggacuccaaauuucucuguggucgccaagauuccccucuucugaucucaaacuacuuuuccgaccccacuaagacuacuuacucuucauacccgcaguguucuuuuugacuuacgacucugacuucauuucaucccaagauuccuuu

SEQ ID NO: 9964 - RNA, 2501 nt, Mus musculus
aaaggaaucuugggaugaaaugaagucagagucguaagucaaaaagaacacugcggguaugaagaguaaguagucuuaguggggucggaaaaguaguuugagaucagaagaggggaaucuuggcgaccacagagaaauuuggaguccaggaagugagugguccgaagaggaucugaaaucaaagagaaauuugcgcucaaaagucagucugugguucuagaagcauauggaaucugggcuggauucagacuggaaggaggaagggccagggauuguuugaggaucccagaguagcgucuucauccuggcaaccuuccacuguccucugggcucccauccuccugcaccugccugcaggcugcaaucaguagacuuuaagcaggcgggggcgagucauacuaggacacugcugacggugggggcgcccccucccggcuguccaggagcucagaccccgcccuccgcccucgcaccccccucuucacugccacuuccggcaggcgcugcgcugcuggggguuagggcgaggauggcggcugagaacgaggcuagccaggagagcgcccuaggcgccuacucaccaguggacuauaugagcaucaccagcuucccgaggcugccggaggacgagccagcgccugcggccccacugaggggccguaaggacgaggacgccuucuugggagacccggauacuggugaggcccucuggccccaucccugccccgccuugggggguugagggugggggcugguguccugguccuccuccuccuguucugagcauccauuuccaaucucccaucuccuucauucauccucugcauccuggaccucuccccuucuuccucagcccuguuaacugucuggugggaaaggggguauuuuugccuuggaggcguaggaugcgacacgggaggggaugcaaggacugcagcaggagagauuaugauuaccuuuuaggaagaaccuauugagaaaaaagggaugcuggaggggagagccuaaagaacagcuguggucaccuaguaaaagcuuuucucuagccacagaggacaggauagaaaagccaaguaggagacugcagcaggcgggauggagucuagaucuucaggagaacuucaccauagccagggauuaugggaagcagagugucccgagaagagcugagaaucuaucucuucauguccagagagggguaaagaaaaugugauuccucucugucuggggauucuggguauugggagacaaggggauggacggcaugaccucucaaaguccuuggggacuacagugccuuugcuguucuguggauuacccuaccccuuccagagauggggaucuggcccggauguuagucaggucgguaggagcuucuggucagcaacaagaucuguguucuccacccucugcugaaacugaaggagauggaguuugggaaggaagcugggcuugagagagggagcuggggaccaagagauccguugguauuccuccccuauugcuaucucuccugcccaugugguccagcucugugcuccccaccauucuuuauccagcaucccucugcccucuuuccuucaacgucacuuccuggcaccagagcauucuucugcucccugacuuccuccugguggugccugcacuugagcuauaucccugucuauaccggaggaugcugcuccggcccuuucuagccuggcucuuccauugucacucccagccuggcgacugaaauccucuccucugcuuccugaccaccagaacccaccagccugacuggaucucacuuuaccugugaugggauuaagaaugggcuguguagacuuugggaccucaaaugucagagcugccugucaaaacuaauuuucuuggggggggggcgcaggguagccuuggcgguacaagaguggaugugggaaaggauguccugguggaaccuucuggucaucuauugacaccagccaccuggucaauuuggguuuucuauucagagauuaagagcaguacagccgugacuuacuacaguuuagugggugugccuacccuguacugggcuuuccuuuucuccuccaccucuauaaagcauauccagauaacaaagcaggaccuuugaucugucuucuucuggcccccguuaaaggucacugcuuuauuaaaaagccugugguuauuuauuugggcuuacuguugucuaugaggccucgaaaagcagggaguguggcuuuuucauccacuauucuuucuccagaauucagcacaguguugggcacucaguaaaugauuauugaaugaauagaugaaagggagaagcuggcaagaugaagugcugauaggggauggaauucccaaaccucaggaaugccuugggggaguuccguguaggcaucauacugguguggguggaaauucaacagagaggggauggagguauaacucgguagaacacuugccuagaaauucagcauagagacugguuacccaagcucccgggaacuuaa

SEQ ID NO: 9965 - RNA, 2501 nt, Mus musculus
acauacacauuuaagcucuccaaacacagacuuaguuauaugccauguccugggcggccugucugaacuguaccagggccucuggcuuccaccuucuucuggucgggaccccugaaguaucaacuucuccucucuuucccuauacuuucugccucugucauaucuucuggcccagacucccucuuguaucccugaggcuucugggcuccaaacugagccuguccuugccucuaugggggaggaucugcugcaagcucaaaauuuuggggucucuugaggccucuuucagggauccugguccucucuagcaagcacuguggcccagauagguucucugaagcccaggguacugcagcccuuugcagaagugguucuguucccagcugaggcaauacccugggaaauacucacucaccugacuguugaagggcaguuggguccccacccacaguuccgguacucagccuuuauauagcucucugcuccuucuuguaggacgcaggucacauuucuguguaccacauaggcacagagagaccugcaggggaaggaacaccucuggaauguuuggcccgagcucaccucuugcucucagaguuccccguaucuuuuuuuauuuauuuuauuuuauuuuuuuauuuuuguuucauggaaccuuggaccucugccugggguccauaucuucugaacggggucuguguccuugaugggugucuacugucuacugagccacgugcucaauugaaccagaagauugggugucuacccaacaccacucugaaaaggccgccucagcuucucccucaaccacuuggccuucuuucuauucacccccacccccacccgggcuccuucacugguucuaaacuccuuauccuggccuucaagguuucuagagcacaacuuaguggcuucuuuuuaaucaggcuuuccuccuuccuccugugaaaaagcucucuagccucggcuuugccauuuccuugcucccgagagcaguacucgugucuucucuuauaggacaucugcccugaugcuccuggauucacggaaugugguugugggcuggguacuugccuucaagguuuuauauucgauuggaauucaaauuccuguauaaaccacuguggaagucuguccauucuacaguacaagcccaggacccacaaguccucaccagcugugcaucucacccaccuuggggcucccgcagggcuauuggggccagaccauaggaggggaggagcaacuaccuaaaauaagcauggcucugucuacaaccacgcaaggcagaagagagacagaaggcauuggacuggggagccccguguguuccaggcgcggacagcccuuccuccucucccuccaccugguccgcugcgccuggaguuugcucacagcgcagcuggaaaauguuacuucgcuggaaagguuuccacgggcacugccaggaucccagucuccgcgccaggcccccucggcugacuuguucuucgccaaccccgcagccuccuggauggcggggcgccuacccgcgcaaagaaucgugucgggggaaccgccccaucgguggcugggguacccauaucucgacgccuccgcgccgguccgggcaggugggaguggcggcgcgccacgcgggggccucccucggguucccgccguggcccggccccgcgcuuacuuguguggccccgggcgcagccgcggacgccauccggugguguagaggcuguaacgggaggcacugggcugugcgggccgcgcgaggagaggggugcccuuggccugcgcccccgagagcagcgccgcgacggugcacagccacacggacagacggcggcccaucgcgcucggucgucacucugucccucggggugccucccgcgggggauccuccgcucgcccuccgggcucccgcggccacucgcgaccgacccccggagcgcgcugguucggccgccuggagcugugcggccgcugcgucccgccgaguggccggggcuacucgcggcuggggccgcgcaggggaggcgggaggcgggcucugcacggauuagcauaaacuuggggccgcgccgcgagcuccgccagcccccuccccgucgccagcccccggccccagcuccaagcugacgcccgaagggccgcgugcaaacacgagguuaagaaacgagcaggcgggacgcagggcgcuaaauuccaggaggcuccccaaacacgcgcagccccuguguacuuuuaggguaccggacaaaaagcugcaaagccugcaggcaggccuggccucccugcugggaccucuuaagacucgcugucuagcaggacacuucagucuugaacgucuagugaguauggguaccauagucccgacccuggacccgagaugaacuuguauagaggcacaccaggaacccuuuccccagccagaguguccccugucuaugggugacccaggagaucugauaacugcagauuucacuucacaccaacuuuugcagacc

SEQ ID NO: 9966 - RNA, 2501 nt, Mus musculus
ggucugcaaaaguuggugugaagugaaaucugcaguuaucagaucuccugggucacccauagacaggggacacucuggcuggggaaaggguuccuggugugccucuauacaaguucaucucggguccagggucgggacuaugguacccauacucacuagacguucaagacugaaguguccugcuagacagcgagucuuaagaggucccagcagggaggccaggccugccugcaggcuuugcagcuuuuuguccgguacccuaaaaguacacaggggcugcgcguguuuggggagccuccuggaauuuagcgcccugcgucccgccugcucguuucuuaaccucguguuugcacgcggcccuucgggcgucagcuuggagcuggggccgggggcuggcgacggggagggggcuggcggagcucgcggcgcggccccaaguuuaugcuaauccgugcagagcccgccucccgccuccccugcgcggccccagccgcgaguagccccggccacucggcgggacgcagcggccgcacagcuccaggcggccgaaccagcgcgcuccgggggucggucgcgaguggccgcgggagcccggagggcgagcggaggaucccccgcgggaggcaccccgagggacagagugacgaccgagcgcgaugggccgccgucuguccguguggcugugcaccgucgcggcgcugcucucgggggcgcaggccaagggcaccccucuccucgcgcggcccgcacagcccagugccucccguuacagccucuacaccaccggauggcguccgcggcugcgcccggggccacacaaguaagcgcggggccgggccacggcgggaacccgagggaggcccccgcguggcgcgccgccacucccaccugcccggaccggcgcggaggcgucgagauauggguaccccagccaccgauggggcgguucccccgacacgauucuuugcgcggguaggcgccccgccauccaggaggcugcgggguuggcgaagaacaagucagccgagggggccuggcgcggagacugggauccuggcagugcccguggaaaccuuuccagcgaaguaacauuuuccagcugcgcugugagcaaacuccaggcgcagcggaccagguggagggagaggaggaagggcuguccgcgccuggaacacacggggcuccccaguccaaugccuucugucucucuucugccuugcgugguuguagacagagccaugcuuauuuuagguaguugcuccuccccuccuauggucuggccccaauagcccugcgggagccccaaggugggugagaugcacagcuggugaggacuuguggguccugggcuuguacuguagaauggacagacuuccacagugguuuauacaggaauuugaauuccaaucgaauauaaaaccuugaaggcaaguacccagcccacaaccacauuccgugaauccaggagcaucagggcagauguccuauaagagaagacacgaguacugcucucgggagcaaggaaauggcaaagccgaggcuagagagcuuuuucacaggaggaaggaggaaagccugauuaaaaagaagccacuaaguugugcucuagaaaccuugaaggccaggauaaggaguuuagaaccagugaaggagcccgggugggggugggggugaauagaaagaaggccaagugguugagggagaagcugaggcggccuuuucagagugguguuggguagacacccaaucuucugguucaauugagcacguggcucaguagacaguagacacccaucaaggacacagaccccguucagaagauauggaccccaggcagagguccaagguuccaugaaacaaaaauaaaaaaauaaaauaaaauaaauaaaaaaagauacggggaacucugagagcaagaggugagcucgggccaaacauuccagagguguuccuuccccugcaggucucucugugccuaugugguacacagaaaugugaccugcguccuacaagaaggagcagagagcuauauaaaggcugaguaccggaacuguggguggggacccaacugcccuucaacagucaggugagugaguauuucccaggguauugccucagcugggaacagaaccacuucugcaaagggcugcaguacccugggcuucagagaaccuaucugggccacagugcuugcuagagaggaccaggaucccugaaagaggccucaagagaccccaaaauuuugagcuugcagcagauccucccccauagaggcaaggacaggcucaguuuggagcccagaagccucagggauacaagagggagucugggccagaagauaugacagaggcagaaaguauagggaaagagaggagaaguugauacuucaggggucccgaccagaagaagguggaagccagaggcccugguacaguucagacaggccgcccaggacauggcauauaacuaagucuguguuuggagagcuuaaauguguaugu

SEQ ID NO: 9967 - RNA, 2501 nt, Mus musculus
aaaugugcuuuuccguuguggcauugacccucuuuguaguuccgacauuuaaggcuguuuugguucgguucucccuauucagaaauaggcuuuaagaaauuaaaugcugcuacccaacgccuuauagcaggaaaguggcugcggccgagauagaguccugucuaucuggugugugagucagcuaaggugcuccacacucucuucuucugcggacagaaaucauuccccauauucccccaaacccgugccacacgccaaagagcagcucuuggggucuggguucuuagugguaggccagagaguggaguccugcacaagacacgccucggugucuguuucucgccugcucuuaggagaggccgccagggggcgccugcugggucuggcuucuacugccgugggaagccuacaucugcccagcaggugucccugcccagagcaaacaggccgcugggagucccgggaccuugaagauaaggcuuggacaggauaaauccagugugaggaucggaucggggcuuagaugugugaacgguaucgaagucaguggcgguagaugugcccagagggcagcaagagagcggccugggccucgaugagcagccauggaccccagggagacaacaggugagcccucuccuuccuguguagccuaacuaggucccuugagaaccacuaagggaacacacacacuguacggauggaaaaugugcugcccaauaagacuacccagcugggcuccaggcacagaacuaaaccuagcucucaccccccuacaccccaccccugucucuuccuccagagaagccugguucccuugcaccuaagaaucacuaagccuuucuuccguuccccaccccacccccacacggcacacugagccugcucuauccauuuuucugugguuucuuggcagagcaggccaucgccccuuaacccacggcugccccucccucaaccccccaguuccuugaaugagcccauucugagcaaggccggugcguggcucugacuccagaccagcuuccuauccgagauucuucucccuucuggcuuuccagcgaggguagaagaacaaaaauccuucuggcagggucuguggugguaaggugacaagcuagcuagaugugccaguggcuugaugguggagguaggaggaaaggcaagccuuuucuagagugggccagagcggagccagcaccccagggcaaacaucugaguauagcuccaccgggccuuugaaacucaggguuggcucuugacuaagggcucccuuaagcuccucuuggcuuaagucaacacgcacuugaugucgcuugcaccucaggacucuuagaaagucaaaacagcugcccucucaauuucagcuuuccaaauccgcuguuccacggggggggggggggcggucuagggagggcaaagagagucaucaucguucaaaggcuugcuuugaaguaguggcccauuagagugagcccaggucuccugauaaggauccuugcauugaagaggaaauuucucggacgcccuuaggauagggaaagugcauucccaaggaaagugcgcuccaaagaggucugaguucaagagcuaauccggaaaggacacuuugggaaggugccaggcguggagggagauuagggaaggaggaccugcauuuuguuggccuugccagagggggaucggaaaagguacugcagguuagacguggacacguaggcuguuaagacuugucccccuacggguuuuacgcuggcuucccugcagaccccucguugcccccgggcccuuugacucaccugagccugccggacagcucagaggugcggcuacagagcgacgggcccagccuccuggggaguuggaccagguaacggcggcggcgugggcagguugcccuaaguggggaaugccagacagccagggcgagcccaagcggcagcugcauuuaaccuggagcgggaggguggggagggggagcgcgggcugcgaccccucccacuggcaggagcguucucccccuuccucucaacacucgggccccagcaagcacggcgccccuuuuuccugcugcucugggagcugcaggcgcgagcugcgggccggaauugggcuacagcuggagucgggcggcgacacuccgggcagccggaaugcucuggaauccuacacgagacacuucccagaggagagccccaagaggcggagcgguccugaccgccgccugccuggccugccugggcuuccaaggacgcgcccgacucuugcccuccucugucccuuccuggagugaugaaaggccgagacuugguccugccguaaagguaaaaggacucaaaaggacagccuuggaguucccagcucucuucagggcccaacuugcucauuucccaaauaaagacucaccacagacucuuuuucaugugcuccuuuuaauugcgcaggcuuugagagaacccauccucauuugucaaacucucggacugauaagcaacagaccc

SEQ ID NO: 9968 - RNA, 2501 nt, Mus musculus
gggucuguugcuuaucaguccgagaguuugacaaaugaggauggguucucucaaagccugcgcaauuaaaaggagcacaugaaaaagagucuguggugagucuuuauuugggaaaugagcaaguugggcccugaagagagcugggaacuccaaggcuguccuuuugaguccuuuuaccuuuacggcaggaccaagucucggccuuucaucacuccaggaagggacagaggagggcaagagucgggcgcguccuuggaagcccaggcaggccaggcaggcggcggucaggaccgcuccgccucuuggggcucuccucugggaagugucucguguaggauuccagagcauuccggcugcccggagugucgccgcccgacuccagcuguagcccaauuccggcccgcagcucgcgccugcagcucccagagcagcaggaaaaaggggcgccgugcuugcuggggcccgaguguugagaggaagggggagaacgcuccugccagugggaggggucgcagcccgcgcucccccuccccacccucccgcuccagguuaaaugcagcugccgcuugggcucgcccuggcugucuggcauuccccacuuagggcaaccugcccacgccgccgccguuaccugguccaacuccccaggaggcugggcccgucgcucuguagccgcaccucugagcuguccggcaggcucaggugagucaaagggcccgggggcaacgaggggucugcagggaagccagcguaaaacccguagggggacaagucuuaacagccuacguguccacgucuaaccugcaguaccuuuuccgaucccccucuggcaaggccaacaaaaugcagguccuccuucccuaaucucccuccacgccuggcaccuucccaaaguguccuuuccggauuagcucuugaacucagaccucuuuggagcgcacuuuccuugggaaugcacuuucccuauccuaagggcguccgagaaauuuccucuucaaugcaaggauccuuaucaggagaccugggcucacucuaaugggccacuacuucaaagcaagccuuugaacgaugaugacucucuuugcccucccuagaccgccccccccccccccguggaacagcggauuuggaaagcugaaauugagagggcagcuguuuugacuuucuaagaguccugaggugcaagcgacaucaagugcguguugacuuaagccaagaggagcuuaagggagcccuuagucaagagccaacccugaguuucaaaggcccgguggagcuauacucagauguuugcccuggggugcuggcuccgcucuggcccacucuagaaaaggcuugccuuuccuccuaccuccaccaucaagccacuggcacaucuagcuagcuugucaccuuaccaccacagacccugccagaaggauuuuuguucuucuacccucgcuggaaagccagaagggagaagaaucucggauaggaagcuggucuggagucagagccacgcaccggccuugcucagaaugggcucauucaaggaacugggggguugagggaggggcagccguggguuaaggggcgauggccugcucugccaagaaaccacagaaaaauggauagagcaggcucagugugccgugugggggugggguggggaacggaagaaaggcuuagugauucuuaggugcaagggaaccaggcuucucuggaggaagagacaggggugggguguaggggggugagagcuagguuuaguucugugccuggagcccagcuggguagucuuauugggcagcacauuuuccauccguacaguguguguguucccuuagugguucucaagggaccuaguuaggcuacacaggaaggagagggcucaccuguugucucccugggguccauggcugcucaucgaggcccaggccgcucucuugcugcccucugggcacaucuaccgccacugacuucgauaccguucacacaucuaagccccgauccgauccucacacuggauuuauccuguccaagccuuaucuucaaggucccgggacucccagcggccuguuugcucugggcagggacaccugcugggcagauguaggcuucccacggcaguagaagccagacccagcaggcgcccccuggcggccucuccuaagagcaggcgagaaacagacaccgaggcgugucuugugcaggacuccacucucuggccuaccacuaagaacccagaccccaagagcugcucuuuggcguguggcacggguuugggggaauauggggaaugauuucuguccgcagaagaagagaguguggagcaccuuagcugacucacacaccagauagacaggacucuaucucggccgcagccacuuuccugcuauaaggcguuggguagcagcauuuaauuucuuaaagccuauuucugaauagggagaaccgaaccaaaacagccuuaaaugucggaacuacaaagagggucaaugccacaacggaaaagcacauuu

SEQ ID NO: 9969 - RNA, 2501 nt, Mus musculus
uugaagauaaggcuuggacaggauaaauccagugugaggaucggaucggggcuuagaugugugaacgguaucgaagucaguggcgguagaugugcccagagggcagcaagagagcggccugggccucgaugagcagccauggaccccagggagacaacaggugagcccucuccuuccuguguagccuaacuaggucccuugagaaccacuaagggaacacacacacuguacggauggaaaaugugcugcccaauaagacuacccagcugggcuccaggcacagaacuaaaccuagcucucaccccccuacaccccaccccugucucuuccuccagagaagccugguucccuugcaccuaagaaucacuaagccuuucuuccguuccccaccccacccccacacggcacacugagccugcucuauccauuuuucugugguuucuuggcagagcaggccaucgccccuuaacccacggcugccccucccucaaccccccaguuccuugaaugagcccauucugagcaaggccggugcguggcucugacuccagaccagcuuccuauccgagauucuucucccuucuggcuuuccagcgaggguagaagaacaaaaauccuucuggcagggucuguggugguaaggugacaagcuagcuagaugugccaguggcuugaugguggagguaggaggaaaggcaagccuuuucuagagugggccagagcggagccagcaccccagggcaaacaucugaguauagcuccaccgggccuuugaaacucaggguuggcucuugacuaagggcucccuuaagcuccucuuggcuuaagucaacacgcacuugaugucgcuugcaccucaggacucuuagaaagucaaaacagcugcccucucaauuucagcuuuccaaauccgcuguuccacggggggggggggggcggucuagggagggcaaagagagucaucaucguucaaaggcuugcuuugaaguaguggcccauuagagugagcccaggucuccugauaaggauccuugcauugaagaggaaauuucucggacgcccuuaggauagggaaagugcauucccaaggaaagugcgcuccaaagaggucugaguucaagagcuaauccggaaaggacacuuugggaaggugccaggcguggagggagauuagggaaggaggaccugcauuuuguuggccuugccagagggggaucggaaaagguacugcagguuagacguggacacguaggcuguuaagacuugucccccuacggguuuuacgcuggcuucccugcagaccccucguugcccccgggcccuuugacucaccugagccugccggacagcucagaggugcggcuacagagcgacgggcccagccuccuggggaguuggaccagguaacggcggcggcgugggcagguugcccuaaguggggaaugccagacagccagggcgagcccaagcggcagcugcauuuaaccuggagcgggaggguggggagggggagcgcgggcugcgaccccucccacuggcaggagcguucucccccuuccucucaacacucgggccccagcaagcacggcgccccuuuuuccugcugcucugggagcugcaggcgcgagcugcgggccggaauugggcuacagcuggagucgggcggcgacacuccgggcagccggaaugcucuggaauccuacacgagacacuucccagaggagagccccaagaggcggagcgguccugaccgccgccugccuggccugccugggcuuccaaggacgcgcccgacucuugcccuccucugucccuuccuggagugaugaaaggccgagacuugguccugccguaaagguaaaaggacucaaaaggacagccuuggaguucccagcucucuucagggcccaacuugcucauuucccaaauaaagacucaccacagacucuuuuucaugugcuccuuuuaauugcgcaggcuuugagagaacccauccucauuugucaaacucucggacugauaagcaacagaccccagagagcugacccgugcuacacucaaagaaaagaaaacccccguagcauuaagccaaggguguuguuugggcaucagaaagacucagauccgccgccucccccccaccccaauccugguaaugcaguuuggagccuuggucacauuuucaccggugcaugugccugcucgaauugagguugugcuccggaccuggagcuggcaaaggcuguuuccccuuaugaguugaaagcuuaauuacuauuuccacaaagcccaccuccaucugagaaccaaauguaggguuuuaaacacagcuauuccacuuggccccagacuacaacagccgggaagccacccacacaguguagcaccugggugauccuggugaggucugugcaggguucuuggaacacaaauauuuagcucauuucccaaguccuucuucccccagaucccuuggaggacauaaaucaaccccaucucca

SEQ ID NO: 9970 - RNA, 2501 nt, Mus musculus
uggagaugggguugauuuauguccuccaagggaucugggggaagaaggacuugggaaaugagcuaaauauuuguguuccaagaacccugcacagaccucaccaggaucacccaggugcuacacuguguggguggcuucccggcuguuguagucuggggccaaguggaauagcuguguuuaaaacccuacauuugguucucagauggaggugggcuuuguggaaauaguaauuaagcuuucaacucauaaggggaaacagccuuugccagcuccagguccggagcacaaccucaauucgagcaggcacaugcaccggugaaaaugugaccaaggcuccaaacugcauuaccaggauuggggugggggggaggcggcggaucugagucuuucugaugcccaaacaacacccuuggcuuaaugcuacggggguuuucuuuucuuugaguguagcacgggucagcucucuggggucuguugcuuaucaguccgagaguuugacaaaugaggauggguucucucaaagccugcgcaauuaaaaggagcacaugaaaaagagucuguggugagucuuuauuugggaaaugagcaaguugggcccugaagagagcugggaacuccaaggcuguccuuuugaguccuuuuaccuuuacggcaggaccaagucucggccuuucaucacuccaggaagggacagaggagggcaagagucgggcgcguccuuggaagcccaggcaggccaggcaggcggcggucaggaccgcuccgccucuuggggcucuccucugggaagugucucguguaggauuccagagcauuccggcugcccggagugucgccgcccgacuccagcuguagcccaauuccggcccgcagcucgcgccugcagcucccagagcagcaggaaaaaggggcgccgugcuugcuggggcccgaguguugagaggaagggggagaacgcuccugccagugggaggggucgcagcccgcgcucccccuccccacccucccgcuccagguuaaaugcagcugccgcuugggcucgcccuggcugucuggcauuccccacuuagggcaaccugcccacgccgccgccguuaccugguccaacuccccaggaggcugggcccgucgcucuguagccgcaccucugagcuguccggcaggcucaggugagucaaagggcccgggggcaacgaggggucugcagggaagccagcguaaaacccguagggggacaagucuuaacagccuacguguccacgucuaaccugcaguaccuuuuccgaucccccucuggcaaggccaacaaaaugcagguccuccuucccuaaucucccuccacgccuggcaccuucccaaaguguccuuuccggauuagcucuugaacucagaccucuuuggagcgcacuuuccuugggaaugcacuuucccuauccuaagggcguccgagaaauuuccucuucaaugcaaggauccuuaucaggagaccugggcucacucuaaugggccacuacuucaaagcaagccuuugaacgaugaugacucucuuugcccucccuagaccgccccccccccccccguggaacagcggauuuggaaagcugaaauugagagggcagcuguuuugacuuucuaagaguccugaggugcaagcgacaucaagugcguguugacuuaagccaagaggagcuuaagggagcccuuagucaagagccaacccugaguuucaaaggcccgguggagcuauacucagauguuugcccuggggugcuggcuccgcucuggcccacucuagaaaaggcuugccuuuccuccuaccuccaccaucaagccacuggcacaucuagcuagcuugucaccuuaccaccacagacccugccagaaggauuuuuguucuucuacccucgcuggaaagccagaagggagaagaaucucggauaggaagcuggucuggagucagagccacgcaccggccuugcucagaaugggcucauucaaggaacugggggguugagggaggggcagccguggguuaaggggcgauggccugcucugccaagaaaccacagaaaaauggauagagcaggcucagugugccgugugggggugggguggggaacggaagaaaggcuuagugauucuuaggugcaagggaaccaggcuucucuggaggaagagacaggggugggguguaggggggugagagcuagguuuaguucugugccuggagcccagcuggguagucuuauugggcagcacauuuuccauccguacaguguguguguucccuuagugguucucaagggaccuaguuaggcuacacaggaaggagagggcucaccuguugucucccugggguccauggcugcucaucgaggcccaggccgcucucuugcugcccucugggcacaucuaccgccacugacuucgauaccguucacacaucuaagccccgauccgauccucacacuggauuuauccuguccaagccuuaucuucaa

SEQ ID NO: 9971 - RNA, 2501 nt, Mus musculus
gugcgcgcagccucgcgcgggcggagcgaggagggaugcgugcgggaacuuuucgccugccccgcaaguccgggucccggcguuuagaggagcuguccuccgccgccagccccgagugcccgccccgcccccacuuccgccucccgccucuuccucguucccggcucccagggccgccgguccccagggaaccccgcaggcuuagccccacccggccggcgcugcucgcucccacgcccccgccgccgcuugucgggagcgcacccagggagccagcggggcgcgggcgcugcagguaggggggaaugcgggguugggcucaggugcggcgaacugggcccccgcagcacgggaacuuggggugcccuccuccgcccgccccgucuucgcccacgcgccaguccccuuuuagggaauucuuugccucuugccuccucaggcgcggguggggccgggacagagggcguucguucuccauuucccugguuccuucccggugucagccucccgucuccaaaucccuacucuucccaguaccuauggucguguaaacaacuaccuagcucugggaauuggcuccgcagccccccuguggacagucccuucagccugguaagaccacaacgucagggggaggggaaaagagaggcguccggguggccccgggucagcggcagcucccucgcgagcucgccuccccucuccucuccgcagaccgccccuggggcccuggguauuuuuagcguugugaccugggcggcagcucuaagagccuuucuggaguccucgucugcugcucccuucucccuucucuggcagccacaucagcuccaggcacugacuuggccuugccucuaucauuaguuucgggucccuccugagcuaccccaguacucgaggaccuggccacgcgcugugauuacacuguggccagcugagguuuauuggaggaugacagcgugguccucacccuagagcuuccccuguucccugugaugcauggguucaguaguguaccaggaacggggaugaaugcacagggcuggccccagagcucugguguccugcaaaacucgguauuggcaaucucgacaccuggucugaacuguacucaguccccacccuucuaguugguacuuacuaacuugggaaauaagccaaacaugugugagaggaggggacaacugugagaguucagaggacaggugcucaguucucuacaaacagcccuccuucacgaaguauauugucagauaguguuugagguagguaggaugauaccuucaggugggaccccuggggccagaaagaggcagaggcaagucaggaaguuaggucuuugcccccagagaaaguguuuggaggugaugaggauugugguggcggugguggugguaguggugguauguguguguuuugggggacaggaagcauggaguauuauugacuuagcuauagucuuuggguuuuguaaggacugggaagaaccagagguauagcgcccuacacuucauccaucucgcccuguucuucccuggccuucagaggggagcugaguccaucaaauggccagcuccuuccagucucucagagggcauguaggcaguuagccagcauuggcagccuucauuaacgacaggcucuugcggugccuggaacugacauccccuuuguggaaccagggccagccucgccucgcgaaagaggcugcugaggccagagcuguccagacuggaagcgaggcugugcugcugggaugccagcugucaaggggcuccuuaugccuaggcccccacugcguucuuucucauccccacaucugugcuugccuuacccuauucccgcacaggggcugacauggacccaaauccgagagcagcccuggagcgccaacagcugcggcuccgggagaggcagaaguucuuugaggacauuuuacagccagagacagaguuugucuucccccugucccaucugcaccuggagucacaaagacguaaguuucaauuucugaggaauggaauugggcuagguugggaaagguguccuuguggcucucagaucuugggaaccagcucccuuccuguuuuugaggcccaauuuggggucuugcauguacaugugaccaucucucagcucuagccuggucuguuugcucuccucccuugugugcagcccccauagguagcaucucgucuauggaagugaauguggacacacuggagcaaguggaguuuauugaucuugcggaucaggauggagcagauguguucuugccuugugaggaguccucgccagcuccccagaugucugguauguccucugcuuuggaaucuggguaccauuuggccagagcuggauauuugggccagaaaagaaagagguuguaggucugagccagggaaaaaucuuaaguagaaguuggaaguauguguuuuugcuagagaaacaguuggcugcucucauuuagggaaguugacucuaaggggcaacugagguau

SEQ ID NO: 9972 - RNA, 2501 nt, Mus musculus
auaccucaguugccccuuagagucaacuucccuaaaugagagcagccaacuguuucucuagcaaaaacacauacuuccaacuucuacuuaagauuuuucccuggcucagaccuacaaccucuuucuuuucuggcccaaauauccagcucuggccaaaugguacccagauuccaaagcagaggacauaccagacaucuggggagcuggcgaggacuccucacaaggcaagaacacaucugcuccauccugauccgcaagaucaauaaacuccacuugcuccaguguguccacauucacuuccauagacgagaugcuaccuaugggggcugcacacaagggaggagagcaaacagaccaggcuagagcugagagauggucacauguacaugcaagaccccaaauugggccucaaaaacaggaagggagcugguucccaagaucugagagccacaaggacaccuuucccaaccuagcccaauuccauuccucagaaauugaaacuuacgucuuugugacuccaggugcagaugggacagggggaagacaaacucugucucuggcuguaaaauguccucaaagaacuucugccucucccggagccgcagcuguuggcgcuccagggcugcucucggauuuggguccaugucagccccugugcgggaauaggguaaggcaagcacagauguggggaugagaaagaacgcagugggggccuaggcauaaggagccccuugacagcuggcaucccagcagcacagccucgcuuccagucuggacagcucuggccucagcagccucuuucgcgaggcgaggcuggcccugguuccacaaaggggaugucaguuccaggcaccgcaagagccugucguuaaugaaggcugccaaugcuggcuaacugccuacaugcccucugagagacuggaaggagcuggccauuugauggacucagcuccccucugaaggccagggaagaacagggcgagauggaugaaguguagggcgcuauaccucugguucuucccaguccuuacaaaacccaaagacuauagcuaagucaauaauacuccaugcuuccugucccccaaaacacacacauaccaccacuaccaccaccaccgccaccacaauccucaucaccuccaaacacuuucucugggggcaaagaccuaacuuccugacuugccucugccucuuucuggccccaggggucccaccugaagguaucauccuaccuaccucaaacacuaucugacaauauacuucgugaaggagggcuguuuguagagaacugagcaccuguccucugaacucucacaguuguccccuccucucacacauguuuggcuuauuucccaaguuaguaaguaccaacuagaaggguggggacugaguacaguucagaccaggugucgagauugccaauaccgaguuuugcaggacaccagagcucuggggccagcccugugcauucauccccguuccugguacacuacugaacccaugcaucacagggaacaggggaagcucuagggugaggaccacgcugucauccuccaauaaaccucagcuggccacaguguaaucacagcgcguggccagguccucgaguacugggguagcucaggagggacccgaaacuaaugauagaggcaaggccaagucagugccuggagcugauguggcugccagagaagggagaagggagcagcagacgaggacuccagaaaggcucuuagagcugccgcccaggucacaacgcuaaaaauacccagggccccaggggcggucugcggagaggagaggggaggcgagcucgcgagggagcugccgcugacccggggccacccggacgccucucuuuuccccucccccugacguuguggucuuaccaggcugaagggacuguccacaggggggcugcggagccaauucccagagcuagguaguuguuuacacgaccauagguacugggaagaguagggauuuggagacgggaggcugacaccgggaaggaaccagggaaauggagaacgaacgcccucugucccggccccacccgcgccugaggaggcaagaggcaaagaauucccuaaaaggggacuggcgcgugggcgaagacggggcgggcggaggagggcaccccaaguucccgugcugcgggggcccaguucgccgcaccugagcccaaccccgcauuccccccuaccugcagcgcccgcgccccgcuggcucccugggugcgcucccgacaagcggcggcgggggcgugggagcgagcagcgccggccggguggggcuaagccugcgggguucccuggggaccggcggcccugggagccgggaacgaggaagaggcgggaggcggaagugggggcggggcgggcacucggggcuggcggcggaggacagcuccucuaaacgccgggacccggacuugcggggcaggcgaaaaguucccgcacgcaucccuccucgcuccgcccgcgcgaggcugcgcgcac

SEQ ID NO: 9973 - RNA, 2501 nt, Mus musculus
auccuaagccggcuaaggacgaguaccuuucgucuuagagggaggcuuucuggacacggaaacuggggaaggauuauggucucagccuuccaggaggagaccaagcccagaggcgagagaaaaaugacuaugggcucuaucugcuguccuacuagacacccuuccugugucgacugcagccuuuuugagcaagucaacuaucugcaaacaacccuacagaguccccugagagaagggaccagugaggggccagcugagccaccaaagacuccacacugagaggccaagcuagccaaaagccaggccaugcuucuaaaggauggcuggccgaacaggcgaucuuggucacuugccucugguccucguuccuggacucagcucucagagacuaucuugucucuucccaaacuugaucucucuggauucccacacaucucuuuucugggcccccuucccagccucccaugcagcccugagcaugcugagcugucauuuacuccuggcacccaggacacaggccaugugaggcaggccucacccuccagacacgcugaggugccagccugacucagaggaauugcaccugucccgguccucaccccaagccucugcugguccccaaggcuggcugccuccugugcccagcagcccacccugugugaacaaguucacccugccucuuuccccaggccuauuuucugcucugauuuggaaauuuacaucuuccuccaacagccaagugcaaacugcaccacacagcaaguacauaaacaaggagccagccugguccucucacccgcugucccgagccuuggggcagaccuguccuuaccacuagccuucccugucuuuugucaucucuuaaaauaccugugggugccucagccucugccaggcgugucgguaggcuguguuuauacccuuccuuaugagcagagugggguuauaauucagggcuagauguuacaucugcagggcaggcuauucuaguauguauccaggccuggaggcaccaagacuauccagcaaagcucgacucuguucucaccaaggccguagcauuuuagaguuuuauaaaccauuuccccccaacaaaguagggguacaccguacugaaucacaugggaagggugccucuuaagaguaguaguccuuggagaacucgcuuggagccccugccuuuuaaccgguauacucaucgugaggagccaggagccucuguguaggccuccauggggggaaacagacuccagacucaccuuggcggccaccgaugaguugggcuucuccagcaggucccaaaguuucuuccucuucucagcacagcacguguugucgaacuccucgcccucccgcucccgcagcgucucagccucccgcuucagcuccucguucaucugcuccuucuuuuggugguagcgggccuggcagcaggacuccagguagaucucaucgaugccccaguaguccagcuccuggcugaagcucagcgcgcacaucuccuccaucaugugcagccggccggugcgguagaaauugagaauagaggugaaggcgccaggguggcggucgaagaaguacucguuguccucgaggcuguagucgucgcacaccuggagcagagagucgugcguguugcagucccggagcuugcccagccgcgugcgaggcaggcgguccagagugcgccacagcaccucgugcgccaggcccccgacguugaggcgcacccggcgcgagcacgccuugcugcgcacgaucuccaugggcucgggcggcagcgagcugguggagcgcgagccaugcuucgucaugcccgccggcaucgcuggucuggccgcccccgcccccccugcccccccaggccgcugucacucgacggcaaggcccgcugccgcgggggcggggggcggggagcucugcaggccgcuguggugcaggggugcgcgagggcgggcgucgcggcuaccgucucaccuccaucccgacggcugcgaggcagaaagcgaaagcggacacgggucagcgaaccguacugugaggccccucccccaggguccccuaccggccuugaccuucccaaggcuuaagcggcucaggggaguuggggggcgggggggggggaagggaggacggauggcugcuguuccucccgccggugcugaagucagccccaccccaggacgaagggagggguggcccuccaggcgggagaggcccccaggaggcucccaggaagccccacccccgcccuggcgcaauccggccgcccggggcgcuguccgucccgucgagugcugaaacucccugcucucgggcuggagagcccaaccuggcccccgcaauugggaggcaagggagaggcagggagaacuuucuuucucucuuuagugaguucucaucuccucccaccccaagauagucaagauuuugggugggagcauaacgauggcauugggcuugcuuuuucuaaaucuuagaagauuuugggccgagugagg

SEQ ID NO: 9974 - RNA, 2501 nt, Mus musculus
ccucacucggcccaaaaucuucuaagauuuagaaaaagcaagcccaaugccaucguuaugcucccacccaaaaucuugacuaucuuggggugggaggagaugagaacucacuaaagagagaaagaaaguucucccugccucucccuugccucccaauugcgggggccagguugggcucuccagcccgagagcagggaguuucagcacucgacgggacggacagcgccccgggcggccggauugcgccagggcggggguggggcuuccugggagccuccugggggccucucccgccuggagggccaccccucccuucguccugggguggggcugacuucagcaccggcgggaggaacagcagccauccguccucccuucccccccccccgccccccaacuccccugagccgcuuaagccuugggaaggucaaggccgguaggggacccugggggaggggccucacaguacgguucgcugacccguguccgcuuucgcuuucugccucgcagccgucgggauggaggugagacgguagccgcgacgcccgcccucgcgcaccccugcaccacagcggccugcagagcuccccgccccccgcccccgcggcagcgggccuugccgucgagugacagcggccugggggggcagggggggcgggggcggccagaccagcgaugccggcgggcaugacgaagcauggcucgcgcuccaccagcucgcugccgcccgagcccauggagaucgugcgcagcaaggcgugcucgcgccgggugcgccucaacgucgggggccuggcgcacgaggugcuguggcgcacucuggaccgccugccucgcacgcggcugggcaagcuccgggacugcaacacgcacgacucucugcuccaggugugcgacgacuacagccucgaggacaacgaguacuucuucgaccgccacccuggcgccuucaccucuauucucaauuucuaccgcaccggccggcugcacaugauggaggagaugugcgcgcugagcuucagccaggagcuggacuacuggggcaucgaugagaucuaccuggaguccugcugccaggcccgcuaccaccaaaagaaggagcagaugaacgaggagcugaagcgggaggcugagacgcugcgggagcgggagggcgaggaguucgacaacacgugcugugcugagaagaggaagaaacuuugggaccugcuggagaagcccaacucaucgguggccgccaaggugagucuggagucuguuuccccccauggaggccuacacagaggcuccuggcuccucacgaugaguauaccgguuaaaaggcaggggcuccaagcgaguucuccaaggacuacuacucuuaagaggcacccuucccaugugauucaguacgguguaccccuacuuuguuggggggaaaugguuuauaaaacucuaaaaugcuacggccuuggugagaacagagucgagcuuugcuggauagucuuggugccuccaggccuggauacauacuagaauagccugcccugcagauguaacaucuagcccugaauuauaaccccacucugcucauaaggaaggguauaaacacagccuaccgacacgccuggcagaggcugaggcacccacagguauuuuaagagaugacaaaagacagggaaggcuagugguaaggacaggucugccccaaggcucgggacagcgggugagaggaccaggcuggcuccuuguuuauguacuugcuguguggugcaguuugcacuuggcuguuggaggaagauguaaauuuccaaaucagagcagaaaauaggccuggggaaagaggcagggugaacuuguucacacagggugggcugcugggcacaggaggcagccagccuuggggaccagcagaggcuuggggugaggaccgggacaggugcaauuccucugagucaggcuggcaccucagcgugucuggagggugaggccugccucacauggccuguguccugggugccaggaguaaaugacagcucagcaugcucagggcugcaugggaggcugggaagggggcccagaaaagagaugugugggaauccagagagaucaaguuugggaagagacaagauagucucugagagcugaguccaggaacgaggaccagaggcaagugaccaagaucgccuguucggccagccauccuuuagaagcauggccuggcuuuuggcuagcuuggccucucaguguggagucuuugguggcucagcuggccccucacuggucccuucucucaggggacucuguaggguuguuugcagauaguugacuugcucaaaaaggcugcagucgacacaggaagggugucuaguaggacagcagauagagcccauagucauuuuucucucgccucugggcuuggucuccuccuggaaggcugagaccauaauccuuccccaguuuccguguccagaaagccucccucuaagacgaaagguacucguccuuagccggcuuaggau

SEQ ID NO: 9975 - RNA, 2501 nt, Mus musculus
cacuagggaacagugggacuuuagcuauuucucagcccaauccuuaaaugucugucggaacagcuggggcgaggugucagggaaccccaggaguugagacacccuggaauggggcgucuucaacucucaagugacauccauuuuuuaggaggaugaaggacgguucuugagguggggaaaucccagcugucagcucugccagucuaaggugugcaagggggcuggcaggcaaaggaagccacguuugggcaccucagcuuggcaggucugcgguugucagagaccgcccacugaugccccugcgagccccucgcgacgccugguccugcaacacgcuaggcagggugcggggcggagcuaggcagggacuggcugggggcugccccgcccggcgccugggccuccgcgcggcgccggcccccggggaggaguuaugauaauuuccuucccauuaaggcguucgggucccccggcuaucgccgggacacacugugagggugaggcuucuccgguccacggcugcggccucuacacacccacggcgaccacaucucugugcacagccaccgaugcgcguccagugacugggacagcaaggccggcgcgcgcggcgggggcggcggcagacgccuggccaccgugaccccgauuguggauuuaccgcucgggggguggggggagccuggauuuaacuggcgacuauuuugggggacgccggacgccauguuguggaaaauaacagauaaugucaaguaugaagaggauugcgaggugagcgggggcuagggaacguagccccgccggcccgagcggggucccagggcugcuggccaaggcuggggacguuugcgcggagcccucgccuucgggagggaugagggccagucuucggccaucuccugggccccuuguugaaucuggucuugucucucggggacaaggccuggcaagagcguggcaaacccacccgcagaacucaacuguggguuccuacgaagcgcacggcccuccuuuccauuuuccccgaagagcgcccugucuccgggucucagacguggcuuuuuucccacgaagucuguccaguguccacggaagcuucccugccagcgacaccuuugaggagucuccuccaaggaaggcuugucaccugccccgcuaccuccucgagaaagaaaaaaaaaaaaagaaagaaagaaaagaaaaguccaaacaacugcaaccugguuuucaagagaaguggggguuggggacuguggggugggggugaagccagauggggccuugagcgcucgcgaguacucuagccugucggacagguugagcuagaguuucggagaguaggagggagggaggcggcgagcgggaagaggaagaagauucaggcggcgcgaggcgagcaccggggaacguggggaggagaggccggcggccaggcugcgggagcgcaccgcacccgcacgaccucgaggggcugccccugcgugcaugcccgggcggcuuccgcuagggggcgacagugccccgcuccugugucccugcuacccuucugaccccugggacugaugaagacacaucuuuuaggaauuaagucugaccgccuuggggcgaggggacgugcgcaggcaaagguugcccaguuuggcagagucuuuucauuccuucucuacaccgggaugugugagaaccuugaccauggccgggcuggaagaccucacuuccuaaggcgcagaaggcacgggcuuggcuagcaaggaucacagcuccgaucccgcgugucggcucccggucucuccggacgacauuacuaugaggccuuaccugagagugucacuuccgcggcgcggccgccucuuaagggagugagagggggaugauccuuggggcggggaaacgcgcccuucgucggcguugcgcauuauccgcgcuauuugcgcgccgcagcgacaugggaggaggguuguugaacgagggcgcugugcgccgaggucgccgcacgccgaaccccuggggcacggguaaccggacuguggcgcggaacgcgcucuuggcaccuccaagcgacgcagcgcgggaaccuucgccagagggcucgaaggauucguccccucaggucuuagaccgauaggcucacaacgaaguccggggagcucauuguccccgggggcucucgggcucuggggcggaucgagacggguggugugagcuugguggggcgcauaggugccccucuccuggcuugcuuguucgcuguagcaggguuucguacuaaccgggucucuccuguuucucucccaggaucgccacgacucgagcaguaauggcaacccucgcaucccucaccucuccucuccgggacaacaucucuacagucccgcgccgccucucucgcacaccgggguugcagaguaccagccgccuccuuacuucccgccgccuuaccagcagcuggcauacucgcaguccgccgaccauuacucgcaucugggagaggcuuacgcugc

SEQ ID NO: 9976 - RNA, 2501 nt, Mus musculus
gcagcguaagccucucccagaugcgaguaauggucggcggacugcgaguaugccagcugcugguaaggcggcgggaaguaaggaggcggcugguacucugcaaccccggugugcgagagaggcggcgcgggacuguagagauguugucccggagaggagaggugagggaugcgaggguugccauuacugcucgagucguggcgauccugggagagaaacaggagagacccgguuaguacgaaacccugcuacagcgaacaagcaagccaggagaggggcaccuaugcgccccaccaagcucacaccacccgucucgauccgccccagagcccgagagcccccggggacaaugagcuccccggacuucguugugagccuaucggucuaagaccugaggggacgaauccuucgagcccucuggcgaagguucccgcgcugcgucgcuuggaggugccaagagcgcguuccgcgccacaguccgguuacccgugccccagggguucggcgugcggcgaccucggcgcacagcgcccucguucaacaacccuccucccaugucgcugcggcgcgcaaauagcgcggauaaugcgcaacgccgacgaagggcgcguuuccccgccccaaggaucaucccccucucacucccuuaagaggcggccgcgccgcggaagugacacucucagguaaggccucauaguaaugucguccggagagaccgggagccgacacgcgggaucggagcugugauccuugcuagccaagcccgugccuucugcgccuuaggaagugaggucuuccagcccggccauggucaagguucucacacaucccgguguagagaaggaaugaaaagacucugccaaacugggcaaccuuugccugcgcacguccccucgccccaaggcggucagacuuaauuccuaaaagaugugucuucaucagucccaggggucagaaggguagcagggacacaggagcggggcacugucgcccccuagcggaagccgcccgggcaugcacgcaggggcagccccucgaggucgugcgggugcggugcgcucccgcagccuggccgccggccucuccuccccacguuccccggugcucgccucgcgccgccugaaucuucuuccucuucccgcucgccgccucccucccuccuacucuccgaaacucuagcucaaccuguccgacaggcuagaguacucgcgagcgcucaaggccccaucuggcuucacccccaccccacaguccccaacccccacuucucuugaaaaccagguugcaguuguuuggacuuuucuuuucuuucuuucuuuuuuuuuuuuucuuucucgaggagguagcggggcaggugacaagccuuccuuggaggagacuccucaaaggugucgcuggcagggaagcuuccguggacacuggacagacuucgugggaaaaaagccacgucugagacccggagacagggcgcucuucggggaaaauggaaaggagggccgugcgcuucguaggaacccacaguugaguucugcggguggguuugccacgcucuugccaggccuuguccccgagagacaagaccagauucaacaaggggcccaggagauggccgaagacuggcccucaucccucccgaaggcgagggcuccgcgcaaacguccccagccuuggccagcagcccugggaccccgcucgggccggcggggcuacguucccuagcccccgcucaccucgcaauccucuucauacuugacauuaucuguuauuuuccacaacauggcguccggcgucccccaaaauagucgccaguuaaauccaggcuccccccaccccccgagcgguaaauccacaaucggggucacgguggccaggcgucugccgccgcccccgccgcgcgcgccggccuugcugucccagucacuggacgcgcaucgguggcugugcacagagauguggucgccguggguguguagaggccgcagccguggaccggagaagccucacccucacagugugucccggcgauagccgggggacccgaacgccuuaaugggaaggaaauuaucauaacuccuccccgggggccggcgccgcgcggaggcccaggcgccgggcggggcagcccccagccagucccugccuagcuccgccccgcacccugccuagcguguugcaggaccaggcgucgcgaggggcucgcaggggcaucagugggcggucucugacaaccgcagaccugccaagcugaggugcccaaacguggcuuccuuugccugccagcccccuugcacaccuuagacuggcagagcugacagcugggauuuccccaccucaagaaccguccuucauccuccuaaaaaauggaugucacuugagaguugaagacgccccauuccagggugucucaacuccugggguucccugacaccucgccccagcuguuccgacagacauuuaaggauugggcugagaaauagcuaaagucccacuguucccuagug

SEQ ID NO: 9977 - RNA, 2501 nt, Mus musculus
uacaguuacuuuaacagcccugacaaaaguaaccaccuuugauaagguuaguguuuacuugaggcucugauccucaagcauucacgcucuucggucauuaacacucauucacguacggauccucauuccccugaauauuuacaauuuugcguucugguuuucaauuguuugguggcuaugcucauggagaaaaaguugaggaguggggacaaccccccgugggaaucuauacuuggcuucuaaaauccgcuaaccuguagcuaucuuacucccuucgcucgcuagaccucgauauccagccccccaccccccaugcuuuggccaaaucuacucaaacaagguucccgccugccaccugccggcccacuagggucugcgccaugagcuaugcgccaacgcacagcucgcggggaggcacucccgcccccaaacaccucccuacugcacaugcccggcagaaguccgcgcaacuuuauagggccccauugccccaucucuccucagucuccucuauccucucccagacgagaggaucaguggaggcaccucucggagucuuagacuucagagucugagacuuagcgagaggagccucgaggagacuccuucucucuucuuuacccaucccuuucuuuuacuuacagccacaagcugaggcgcggagcuuuagaaaguucgcagugguuugaagguagguacaucccuucuuuuugccccgaggcgagauuggggucuucagaccccagcuucucuccucauaagguuaauccuuuucggccccaacaguccuugcgcaguggggccacucucugcagagccagagggugagucggcuucucggugagcaccuaagagaauggaucgcaggucccgggcucagcaguggcgccgagcucgccauaauuacaacgaccugugcccgcccauaggccgccgggcugccaccgcucuccucuggcucuccugcuccauugcucuccuccgcgcccuagccucuuccaacgcccgcgcccagcagcgugcugcccagcgccggagcuuccuuaacgcccaccaccgcuccgcugccgcugcagcugccgcacagguacucccugaguccucugaaucugagucugaucacgagcacgaggagguugagccugagcuggcccgccccgagugccuagaguacgaucaggacgacuacgagaccgagaccgauucugagaccgagccugaguccgauaucgaauccgagaccgaaaucgagaccgagccagagaccgagccagaaaccgagccagagaccgagccagaggacgagcgcggcccccggggugccaccuucaaccagucacucacucagcgucugcacgcucugaaguugcagagcgccgacgccuccccgagacgugcgcagcccaccacucaggagccugagagcgcaagcgagggggaggagccccagcgagggcccuuagaucaggauccucgggaccccgaggaggagccagaggagcgcaaggaggaaaacaggcagccccgccgcugcaagaccaggaggccagcccgccgucgcgaccaguccccggaguccccucccagaaaggggcccauccccauccggcgucacuaaugggugacuccguccagauucuccuuguuuucauggauaaagguuaguugcccugaccaaacuggggucccugagacaguagggugggaggaaagagacagaugggaggcaaggugggaagggagcggugcccauuaaucagcccgaaaugcaccccggaaaaggagagagggcucuucaagucucuccagggcacccaggggcgcuugggaggccaaagguuuguuggacggugaggcauuucuggcgccucgcuggagacaaccugagguccccgagcugauacccggugcgcaacauugaauucggugugccacacugaauucccagcgcgccccagguuuggaguuacauacauaaacggcaaagguaagucacuuguuuucuauguucucuccccuccuacagaaguuagucuucagcaacggaguuggcuuuagguagagcccacugggcucgauauggaggugcacgcaccaacuuuggcgaucugagacugcugcgccauagcuacaguauugcaaugcgcagaaaguaacugcguuugggauugggugacaacucuggagccuaaaucgcacguggcauucagccggcgcggagccuggaaaucggguaccggcauggccaauuuggggccgcgggacccuggagccagugccuccccccacgccgugcaaguagucuugguuaauaccgcucaccucuggagguucgaggaggccugagaucgugaaaaggggcgcgcgcaccucucccgugcguccuaaagccaaccuucccgcgcagaaaggaguuucuugauaguggauagugcuuggaggacacucaguggugguauaggguucuuuacgggugcccuucugggcuaccuggguuggca

SEQ ID NO: 9978 - RNA, 2501 nt, Mus musculus
ugccaacccagguagcccagaagggcacccguaaagaacccuauaccaccacugaguguccuccaagcacuauccacuaucaagaaacuccuuucugcgcgggaagguuggcuuuaggacgcacgggagaggugcgcgcgccccuuuucacgaucucaggccuccucgaaccuccagaggugagcgguauuaaccaagacuacuugcacggcguggggggaggcacuggcuccagggucccgcggccccaaauuggccaugccgguacccgauuuccaggcuccgcgccggcugaaugccacgugcgauuuaggcuccagaguugucacccaaucccaaacgcaguuacuuucugcgcauugcaauacuguagcuauggcgcagcagucucagaucgccaaaguuggugcgugcaccuccauaucgagcccagugggcucuaccuaaagccaacuccguugcugaagacuaacuucuguaggaggggagagaacauagaaaacaagugacuuaccuuugccguuuauguauguaacuccaaaccuggggcgcgcugggaauucaguguggcacaccgaauucaauguugcgcaccggguaucagcucggggaccucagguugucuccagcgaggcgccagaaaugccucaccguccaacaaaccuuuggccucccaagcgccccugggugcccuggagagacuugaagagcccucucuccuuuuccggggugcauuucgggcugauuaaugggcaccgcucccuucccaccuugccucccaucugucucuuuccucccacccuacugucucagggaccccaguuuggucagggcaacuaaccuuuauccaugaaaacaaggagaaucuggacggagucacccauuagugacgccggauggggaugggccccuuucugggaggggacuccggggacuggucgcgacggcgggcuggccuccuggucuugcagcggcggggcugccuguuuuccuccuugcgcuccucuggcuccuccucggggucccgaggauccugaucuaagggcccucgcuggggcuccucccccucgcuugcgcucucaggcuccugaguggugggcugcgcacgucucggggaggcgucggcgcucugcaacuucagagcgugcagacgcugagugagugacugguugaagguggcaccccgggggccgcgcucguccucuggcucggucucuggcucgguuucuggcucggucucuggcucggucucgauuucggucucggauucgauaucggacucaggcucggucucagaaucggucucggucucguagucguccugaucguacucuaggcacucggggcgggccagcucaggcucaaccuccucgugcucgugaucagacucagauucagaggacucagggaguaccugugcggcagcugcagcggcagcggagcgguggugggcguuaaggaagcuccggcgcugggcagcacgcugcugggcgcgggcguuggaagaggcuagggcgcggaggagagcaauggagcaggagagccagaggagagcgguggcagcccggcggccuaugggcgggcacaggucguuguaauuauggcgagcucggcgccacugcugagcccgggaccugcgauccauucucuuaggugcucaccgagaagccgacucacccucuggcucugcagagaguggccccacugcgcaaggacuguuggggccgaaaaggauuaaccuuaugaggagagaagcuggggucugaagaccccaaucucgccucggggcaaaaagaagggauguaccuaccuucaaaccacugcgaacuuucuaaagcuccgcgccucagcuuguggcuguaaguaaaagaaagggauggguaaagaagagagaaggagucuccucgaggcuccucucgcuaagucucagacucugaagucuaagacuccgagaggugccuccacugauccucucgucugggagaggauagaggagacugaggagagauggggcaauggggcccuauaaaguugcgcggacuucugccgggcaugugcaguagggagguguuugggggcgggagugccuccccgcgagcugugcguuggcgcauagcucauggcgcagacccuagugggccggcagguggcaggcgggaaccuuguuugaguagauuuggccaaagcaugggggguggggggcuggauaucgaggucuagcgagcgaagggaguaagauagcuacagguuagcggauuuuagaagccaaguauagauucccacgggggguuguccccacuccucaacuuuuucuccaugagcauagccaccaaacaauugaaaaccagaacgcaaaauuguaaauauucaggggaaugaggauccguacgugaaugaguguuaaugaccgaagagcgugaaugcuugaggaucagagccucaaguaaacacuaaccuuaucaaaggugguuacuuuugucagggcuguuaaaguaacugua

SEQ ID NO: 9979 - RNA, 2501 nt, Mus musculus
gaggagaggacggagccgaacgucccuacaaggccuccgcucaucagcccccuuacccaaagucgggagcagccggcaccgggagccagcucccggagccggcucagcacugagaccugcguccucuggcggcagagaaagaguucuauuuacgauuuucgagacgaaucggcacgcucuuaaaugccaagaaggcggagcuaaaguacagcaaaguacgaagagagaacagaaaaguuccuaaaguuguuggccgaccacagcccgaagggguaaguguaacuaggaaggugacagacuucaccagcaagagaugacucacuucagccaugguccuggguucuagccccugauuaucuauccuuacaaaguuuggaaacugaggcuggagaacuuuccaacaaaaauuugaauuuuuuaaaaaaaaauuuuuuuucacccuaguuuggcugggugcuccgucuuacggggccccaaauuuauuuugaaaagucgccaccguguuaugggcauguucaacugccuccacggcaauaauaugucaggacaacacgauauccccccugaagucggggagcagcccgagcaagaaccuuuggaagccccaggggcagcugcccccggugcuggggcuggcccagccgaagaaauggcgaccgaaccggacuccgaaccgucuaacaaugagcccguccccgacgagacuggcagugagaucaguggacccccagaagacuccaaaucugacauccaaagccccugccaggccuucgaggaaguccgaguggguggagacuacagcccaccuccggaggaagccaugccauucgagacacaacagcccagccugggagauuucuggcccacccuggagcagccaggaccaucugggaccccaucaggccuccaagccuucaacccagcgauuuuggagcccgggacccccacuggcgcgagcccaggccugggagccuauacccccccaccagaagaagcuaugccauuugaguucaacgagccugcccagggagaccauagccagccucccuugcaagucccagaccuugcgccaggagguccggaagcauugguccccagagcucuucccgcggagcccgggaacaucagauuugaaaacgcuggcuuccgagaagacuacagcccucccccugaagaaucugugccauuucaggucgguggagaagaauucgggggcgauagcccacccccaggacucccgcgagucaucccacaaaucggcauuggcggcgaguucccgacagucgcggucccgagugcgcucugccucgcucccgccgagaacgcgccuccccucuggguccgaggcgccauugacagaccauuccgcgaggcugucagaucuccuccuaacuucgcaugcgacagccccccgauggagaucaccagaccccugcuugagauuggcagagccuccauuggggucgacgacgacaccgcugucaauauggacagccccccaaucgcaagugauggcccgcccaucgaagucucgggagccccagauaagagcgagugcgcagagagacccccaguugagcgagaagcagccgagauggaaggaagcccuaccaccgccacugcgguggaaggaaaaguccccucuccggagagaggggacggaucuuccacccagccugaagcaauggaugccaagccagccccugcugcccaagccgucucuaccggaucugaugcuggagcuccuacggauuccgcgaugcucacagauagccagagcgaugccggagaagacgggacagccccaggaacgccuucagaucuccagucggauccugaagaacucgaagaagccccagcuguccgcgccgauccugacggaggggcagccccagucgccccagccacuccugccgaguccgagucugaaggcagcagagauccagccgccgagccagccuccgaggcagucccugccaccacggccgagucugccuccggggcagccccugucacccagguggagcccgcagccgcggcagucucugccacccuggcggagccugccgcccgggcagccccuaucacccccaaggagcccacuacccgggcaguccccucugcuagagcccauccggccgcuggagcagucccuggcgccccagcaaugucagccucugcuagggcagcugccgcuagggcagccuaugcagguccacuggucuggggagccaggucacucucagcuacucccgccgcucgggcaucccuuccugcccgcgcagcagcugccgcccgggcagccucugcugcccgcgcagucgcugcuggccggucagccucugccgcccccagcagggcccaucuuagaccccccagccccgagauccagguugcugacccgccuacuccgcggccuccuccgcggccgacugccuggccugacaaguacgagcggggccgaagcugcugcagguacgaggcaucgucuggcaucugcg

SEQ ID NO: 9980 - RNA, 2501 nt, Mus musculus
cgcagaugccagacgaugccucguaccugcagcagcuucggccccgcucguacuugucaggccaggcagucggccgcggaggaggccgcggaguaggcgggucagcaaccuggaucucggggcuggggggucuaagaugggcccugcugggggcggcagaggcugaccggccagcagcgacugcgcgggcagcagaggcugcccgggcggcagcugcugcgcgggcaggaagggaugcccgagcggcgggaguagcugagagugaccuggcuccccagaccaguggaccugcauaggcugcccuagcggcagcugcccuagcagaggcugacauugcuggggcgccagggacugcuccagcggccggaugggcucuagcagaggggacugcccggguagugggcuccuugggggugauaggggcugcccgggcggcaggcuccgccaggguggcagagacugccgcggcugcgggcuccaccugggugacaggggcugccccggaggcagacucggccgugguggcagggacugccucggaggcuggcucggcggcuggaucucugcugccuucagacucggacucggcaggaguggcuggggcgacuggggcugccccuccgucaggaucggcgcggacagcuggggcuucuucgaguucuucaggauccgacuggagaucugaaggcguuccuggggcugucccgucuucuccggcaucgcucuggcuaucugugagcaucgcggaauccguaggagcuccagcaucagauccgguagagacggcuugggcagcaggggcuggcuuggcauccauugcuucaggcuggguggaagauccguccccucucuccggagaggggacuuuuccuuccaccgcaguggcggugguagggcuuccuuccaucucggcugcuucucgcucaacugggggucucucugcgcacucgcucuuaucuggggcucccgagacuucgaugggcgggccaucacuugcgauuggggggcuguccauauugacagcggugucgucgucgaccccaauggaggcucugccaaucucaagcaggggucuggugaucuccaucggggggcugucgcaugcgaaguuaggaggagaucugacagccucgcggaauggucugucaauggcgccucggacccagaggggaggcgcguucucggcgggagcgaggcagagcgcacucgggaccgcgacugucgggaacucgccgccaaugccgauuugugggaugacucgcgggaguccugggggugggcuaucgcccccgaauucuucuccaccgaccugaaauggcacagauucuucagggggagggcuguagucuucucggaagccagcguuuucaaaucugauguucccgggcuccgcgggaagagcucuggggaccaaugcuuccggaccuccuggcgcaaggucugggacuugcaagggaggcuggcuauggucucccugggcaggcucguugaacucaaauggcauagcuucuucugguggggggguauaggcucccaggccugggcucgcgccagugggggucccgggcuccaaaaucgcuggguugaaggcuuggaggccugauggggucccagaugguccuggcugcuccagggugggccagaaaucucccaggcugggcuguugugucucgaauggcauggcuuccuccggaggugggcuguagucuccacccacucggacuuccucgaaggccuggcaggggcuuuggaugucagauuuggagucuucuggggguccacugaucucacugccagucucgucggggacgggcucauuguuagacgguucggaguccgguucggucgccauuucuucggcugggccagccccagcaccgggggcagcugccccuggggcuuccaaagguucuugcucgggcugcuccccgacuucaggggggauaucguguuguccugacauauuauugccguggaggcaguugaacaugcccauaacacgguggcgacuuuucaaaauaaauuuggggccccguaagacggagcacccagccaaacuagggugaaaaaaaauuuuuuuuuaaaaaauucaaauuuuuguuggaaaguucuccagccucaguuuccaaacuuuguaaggauagauaaucaggggcuagaacccaggaccauggcugaagugagucaucucuugcuggugaagucugucaccuuccuaguuacacuuaccccuucgggcuguggucggccaacaacuuuaggaacuuuucuguucucucuucguacuuugcuguacuuuagcuccgccuucuuggcauuuaagagcgugccgauucgucucgaaaaucguaaauagaacucuuucucugccgccagaggacgcaggucucagugcugagccggcuccgggagcuggcucccggugccggcugcucccgacuuuggguaagggggcugaugagcggaggccuuguagggacguucggcuccguccucuccuc

SEQ ID NO: 9981 - RNA, 2501 nt, Mus musculus
gcuuuuccuugaagcuaugacaaggugcaagccacuaugggauacagcuggacuccugugacagccugaacaguggaggaugugccucaggggucucucccuagaugauggggccaggugucugguacuaaugauaccauaaguguggucagcucuuugaucucuaggucaggcagucauuagcucuccauuagcaacccuacuuccaggagcccagcccugccuuccaugcugccuguuccgugaacaggacuguucuuauguucugucucccauaacuuaacugagagaccccuccauuaaaacagcuucuuggcuuaguccuacucacugcugggggccagcaaacaggcacagggcuugugucuggcucucuuuccugugacucuacuucaccggccacacuaacucuccugggagguuguaacugcugagggauccucaggaggcuagagaugaauuugagcaaugccagguaggaccugaggacucaggccaggaccaguuggguguaaggccagggacaguuugguagacaagcucuucagcuuucagcuuauuuuugcccagcaugaacccugcugagugacccucugguaugccacucacuggcagugacugcccagccuuggggggcaaagaguaagcucuuccccauacccacucagcaaagcaaaucagggcuauaucugccuuacacuuaaacccauuugagguguuugggugaauauaaauagauaaagaggagcaugugaauacuuggcucugaucugguuugcagcaucuacaaguacuggggacccagagccaccuggaggcucaggugugugcccccucccccuccagcuucccaaacagugcaaggcuguaucaccuggcagggcaucucaguccucaacuccuggucuggaagcaagguaaaccacucacugcaaccuccguauggcggcaggguccugcagugacuauggggaguaauuguucuagccaacaacugguucccaggacuugcucacuccugggugugagcagguccugugcaacucuuccuuuuguacugcccgggcacaccugucugcucagcccgguaccagcaggcacucaauaagcccucacugacuguaagcagguauugccuacucucaaaacuccgauuuacucauugggcuuggcagcccuaccucccaagcccagguacuuacgguuggucugagggcggcuccgggguagccuuggcaagguaggugacaggaacuaguccggugcuggguggaccagagagccuuugggcaaagauguagucccccuccuccuugagggcguagagucuguccccacggcugacgcucaguuccucugcacaucgagcagugaagucguagagcgcgcggaagagucgggcgcguggggcugggaagcuacaagguucaacggcagcggcuugcuccggcacuggguugucgucgugucccuggauccuggggaugucuuccuccgauucauccgcuggccauaucuuaucccagaaaaaggacaagaaagugagccgcuuccugaggaagggcuccaugccuagggggccugguugcggacgaaagcgcauggagccgaccucgggucaguacucugggaccuccgugcugccgcugaagaagcugagcacuacaaccaugcaccaggaucccagggugcaagagagaaaccggaaaggcuggugggacagccaggcuuaccccgggcuuucugcccacgucccuauuugguacagaaugggaagcgacaggugacacggacccuaacccuaaccccggaggucacuacagagugcuccuuaaucaggcauacaacagucaguuucccggaugguguaucaaugcguggggcggacggugaccuccgucccaggaccacacgggcugcuccuccuagucuacauacucuucuacagcugugcggucuggugagcuggaucucugcugggguuaaaagccgcugggcuugagauucgugucccaguaggcuacuagggugagagagaguugggcggagucugcgggaagggcgguguaggggggagggccuucuggaacaagcuacccuuuucauccccacuaacagacgcagguugcagggaccugcuuugccgggcuagcugggcacgugcaacuagcagccgccuugggagaggggucaacaaagggagcaguucaucgccagaggucauauuucugugaaacacugacuuuuuaaaugguggcucuuuaacauaacacaacaccaucucccacccgcuuucagggccagaugcaaguagcuaugugcagccuguccaacucagcggaggccucuggagcaaacgcucagcgcccaguaaacucuugcuauccugauuccuguguuguaaaaugagaugcugguaguaaucucuaggggaaucacugaagguccagguacauagguaaucaugggguacgauuucugaaccaggagaugcuuaauac

SEQ ID NO: 9982 - RNA, 2501 nt, Mus musculus
guauuaagcaucuccugguucagaaaucguaccccaugauuaccuauguaccuggaccuucagugauuccccuagagauuacuaccagcaucucauuuuacaacacaggaaucaggauagcaagaguuuacugggcgcugagcguuugcuccagaggccuccgcugaguuggacaggcugcacauagcuacuugcaucuggcccugaaagcgggugggagaugguguuguguuauguuaaagagccaccauuuaaaaagucaguguuucacagaaauaugaccucuggcgaugaacugcucccuuuguugaccccucucccaaggcggcugcuaguugcacgugcccagcuagcccggcaaagcaggucccugcaaccugcgucuguuaguggggaugaaaaggguagcuuguuccagaaggcccuccccccuacaccgcccuucccgcagacuccgcccaacucucucucacccuaguagccuacugggacacgaaucucaagcccagcggcuuuuaaccccagcagagauccagcucaccagaccgcacagcuguagaagaguauguagacuaggaggagcagcccgugugguccugggacggaggucaccguccgccccacgcauugauacaccauccgggaaacugacuguuguaugccugauuaaggagcacucuguagugaccuccgggguuaggguuaggguccgugucaccugucgcuucccauucuguaccaaauagggacgugggcagaaagcccgggguaagccuggcugucccaccagccuuuccgguuucucucuugcacccugggauccuggugcaugguuguagugcucagcuucuucagcggcagcacggaggucccagaguacugacccgaggucggcuccaugcgcuuucguccgcaaccaggcccccuaggcauggagcccuuccucaggaagcggcucacuuucuuguccuuuuucugggauaagauauggccagcggaugaaucggaggaagacauccccaggauccagggacacgacgacaacccagugccggagcaagccgcugccguugaaccuuguagcuucccagccccacgcgcccgacucuuccgcgcgcucuacgacuucacugcucgaugugcagaggaacugagcgucagccguggggacagacucuacgcccucaaggaggagggggacuacaucuuugcccaaaggcucucugguccacccagcaccggacuaguuccugucaccuaccuugccaaggcuaccccggagccgcccucagaccaaccguaaguaccugggcuugggagguagggcugccaagcccaaugaguaaaucggaguuuugagaguaggcaauaccugcuuacagucagugagggcuuauugagugccugcugguaccgggcugagcagacaggugugcccgggcaguacaaaaggaagaguugcacaggaccugcucacacccaggagugagcaaguccugggaaccaguuguuggcuagaacaauuacuccccauagucacugcaggacccugccgccauacggagguugcagugagugguuuaccuugcuuccagaccaggaguugaggacugagaugcccugccaggugauacagccuugcacuguuugggaagcuggagggggagggggcacacaccugagccuccagguggcucuggguccccaguacuuguagaugcugcaaaccagaucagagccaaguauucacaugcuccucuuuaucuauuuauauucacccaaacaccucaaauggguuuaaguguaaggcagauauagcccugauuugcuuugcugaguggguauggggaagagcuuacucuuugccccccaaggcugggcagucacugccagugaguggcauaccagagggucacucagcaggguucaugcugggcaaaaauaagcugaaagcugaagagcuugucuaccaaacugucccuggccuuacacccaacugguccuggccugaguccucagguccuaccuggcauugcucaaauucaucucuagccuccugaggaucccucagcaguuacaaccucccaggagaguuaguguggccggugaaguagagucacaggaaagagagccagacacaagcccugugccuguuugcuggcccccagcagugaguaggacuaagccaagaagcuguuuuaauggaggggucucucaguuaaguuaugggagacagaacauaagaacaguccuguucacggaacaggcagcauggaaggcagggcugggcuccuggaaguaggguugcuaauggagagcuaaugacugccugaccuagagaucaaagagcugaccacacuuaugguaucauuaguaccagacaccuggccccaucaucuagggagagaccccugaggcacauccuccacuguucaggcugucacaggaguccagcuguaucccauaguggcuugcaccuugucauagcuucaaggaaaagc

SEQ ID NO: 9983 - RNA, 2501 nt, Mus musculus
ccugcaguucuccccaaaugaaaaauacuguccugggcagugcuuagguuugcagaggaaaagcugcaacucgggcugggagcugaugauaucugggagccccacuggaaggauggagggcagugguguggcuaaggcaaaagcaaaguaaauuucuguguuuacaguccuuaugcauggaugcuagugaucacugaaacccuuuuaaagaaaaaaguuuaauuaaaaauuaaauauauuguauuauauauguauauauauauaaaggcaaaguaaaaaacacagucucauucuagaaaauacauagcagaaaagaauuagaugauucaaaaacaacccuggcagaggcagcuagcacguccagggccugagguuccuagggaaggcccaaagcacaggaacccccagaaggagguguguaaaugaggaggcgacagaaauggcaucuuuaggccaccagcucuaaaggcuguugcauacccuaacauacauaugcgaaaggaagggagcaggcaacucugccacuuggccacaugcagaagcgguggagggcaaggacagugucuagccugagaugcaagcacuguaauagaccgcgcugcuagcaucagacagcgcagaaaugaggcugcucucuucuggacaggacauggcgcgcggaccuaguuuggccagugccacgugguaggggaguguaguggcauccggucgaguccggcugcaauugagauacuggucaaauucggugagguccacaucggcccaaaggucggcgguaggcuccaguugcucugugcccucaagagacggggacucaggugguggugacagaggauugggaaacgggcccggagugcccagggugccauaguagagaccugcgaguggcgcggcaggcggcgcuguccugagcgcuucagccaggggcgccccguagcagaagcucgggucccgugccagcucaggggcauagggugcccggaaagcccgcagagcgcaguccucgggcgccaaaggcggugggaagaaggaggccucgccaggcuccaggccguccagaggcgagcgcucgggcguggguagccccaagccaucgaacuccgcacccagaguggguagcucgcggaaggagcgagcugacccugacgcugcagcgaaggccucgggcggcgcagacggcugcacgaggcccgggagcaagaggcccggcuccagccuccggaccuugcgcgccuguuuuuugcggcgaggccgguacuuguaguugggauggucgcgcaagugcugcacacgcagccguucggccucuuccacgaagggccgcuucuccgccguguucagcuccuuccacgcuuugccuguaggcgaagggagccuguuaguggaccagugucgggcgcacgacuagccaaaccgucgugcgccuugggcgcgcggcgugaaacauggcauagaccccagcgaccagccauaaaaucccgaaucccgacccucucccaaaguccccucccucgccgccccucuaagcauucgaggcucucacccagcaucuugcucaguacugcguugugcagauccggauuuuguugcgccagucgcuugcgcucguccuucgcccacaccaugaaggcguucaugggccgccgaaugcgcaacucgucggcaguuuggcgcucuccgcggccaaagccauagcgcccugauucggggcugcgcggugggcuccgcggaaggcuggacggggaggcgggcgaggugggcgagacguuggugacagggaggccgcgcgccucagcagcggccccgauuccaggggcccaugcacagucgcggcgggagggcgggucguccugugcgccguagccgggcggcgaucucugcauuccagcugggcaaggccugggcggaacgcggcgcgggagcgcaggagacaguggcgggcacugcaaagccaaguacggaggucugauggacgucggguggagacacuggggacgugguagcuucgugccaggaaggcaucccagauauagagacaucgggccaauccgcagcagagcuggcggaccggggcggggcugccccccuccgcgguggcucccuuuuuucuucccggcaggauccagcugaggccuccccagcgcagagccccccaucugcucccacugucucaaaagaagagacccccgugugggagaggacugcuggugugggcuaggucucagaaggagggguccuccaggguuuucagguuucagagccgcgcuggcaccccauccacagaaacagaccccugggcaguaaugaugggagagggcagcggcuuuagauuggaugaaggaagauuuaauuuagcaccaaguucuagggagguuacuuucaucguguaccucgggaaaaggaaugggauuuggcgauguucuugccucuucuuguggguuuacccucccagaugcugagcucagcuagguaguuccaacgccuuucccuaauuuugucgu

SEQ ID NO: 9984 - RNA, 2501 nt, Mus musculus
acgacaaaauuagggaaaggcguuggaacuaccuagcugagcucagcaucugggaggguaaacccacaagaagaggcaagaacaucgccaaaucccauuccuuuucccgagguacacgaugaaaguaaccucccuagaacuuggugcuaaauuaaaucuuccuucauccaaucuaaagccgcugcccucucccaucauuacugcccaggggucuguuucuguggauggggugccagcgcggcucugaaaccugaaaacccuggaggaccccuccuucugagaccuagcccacaccagcaguccucucccacacgggggucucuucuuuugagacagugggagcagauggggggcucugcgcuggggaggccucagcuggauccugccgggaagaaaaaagggagccaccgcggaggggggcagccccgccccgguccgccagcucugcugcggauuggcccgaugucucuauaucugggaugccuuccuggcacgaagcuaccacguccccagugucuccacccgacguccaucagaccuccguacuuggcuuugcagugcccgccacugucuccugcgcucccgcgccgcguuccgcccaggccuugcccagcuggaaugcagagaucgccgcccggcuacggcgcacaggacgacccgcccucccgccgcgacugugcaugggccccuggaaucggggccgcugcugaggcgcgcggccucccugucaccaacgucucgcccaccucgcccgccuccccguccagccuuccgcggagcccaccgcgcagccccgaaucagggcgcuauggcuuuggccgcggagagcgccaaacugccgacgaguugcgcauucggcggcccaugaacgccuucauggugugggcgaaggacgagcgcaagcgacuggcgcaacaaaauccggaucugcacaacgcaguacugagcaagaugcugggugagagccucgaaugcuuagaggggcggcgagggaggggacuuugggagagggucgggauucgggauuuuauggcuggucgcuggggucuaugccauguuucacgccgcgcgcccaaggcgcacgacgguuuggcuagucgugcgcccgacacugguccacuaacaggcucccuucgccuacaggcaaagcguggaaggagcugaacacggcggagaagcggcccuucguggaagaggccgaacggcugcgugugcagcacuugcgcgaccaucccaacuacaaguaccggccucgccgcaaaaaacaggcgcgcaagguccggaggcuggagccgggccucuugcucccgggccucgugcagccgucugcgccgcccgaggccuucgcugcagcgucagggucagcucgcuccuuccgcgagcuacccacucugggugcggaguucgauggcuuggggcuacccacgcccgagcgcucgccucuggacggccuggagccuggcgaggccuccuucuucccaccgccuuuggcgcccgaggacugcgcucugcgggcuuuccgggcacccuaugccccugagcuggcacgggacccgagcuucugcuacggggcgccccuggcugaagcgcucaggacagcgccgccugccgcgccacucgcaggucucuacuauggcacccugggcacuccgggcccguuucccaauccucugucaccaccaccugaguccccgucucuugagggcacagagcaacuggagccuaccgccgaccuuugggccgauguggaccucaccgaauuugaccaguaucucaauugcagccggacucgaccggaugccacuacacuccccuaccacguggcacuggccaaacuagguccgcgcgccauguccuguccagaagagagcagccucauuucugcgcugucugaugcuagcagcgcggucuauuacagugcuugcaucucaggcuagacacuguccuugcccuccaccgcuucugcauguggccaaguggcagaguugccugcucccuuccuuucgcauauguauguuaggguaugcaacagccuuuagagcugguggccuaaagaugccauuucugucgccuccucauuuacacaccuccuucuggggguuccugugcuuugggccuucccuaggaaccucaggcccuggacgugcuagcugccucugccaggguuguuuuugaaucaucuaauucuuuucugcuauguauuuucuagaaugagacuguguuuuuuacuuugccuuuauauauauauacauauauaauacaauauauuuaauuuuuaauuaaacuuuuuucuuuaaaaggguuucagugaucacuagcauccaugcauaaggacuguaaacacagaaauuuacuuugcuuuugccuuagccacaccacugcccuccauccuuccaguggggcucccagauaucaucagcucccagcccgaguugcagcuuuuccucugcaaaccuaagcacugcccaggacaguauuuuucauuuggggagaacugcagg

SEQ ID NO: 9985 - RNA, 2501 nt, Mus musculus
ggggucagaagguucuuucaugagggaguaggauguagggcuaaggagauugcaguuuauuaauucaguaaucagccauucaauuccuauagcgccaagcgauggcuaauuuguuccucccagguacuuaucaaaagcaaauggaggcggcaggacagugggaccacggcgcgcaggcuguccucagauggcgcgggugggggugggggugaucccugggcccacgggacugugccgcagcugucacuaagggaggcacagggcgcgccagacgagucgcagcuugcaggagcugcgggaaacgugacgucccaguccggcgcagccaggccaggguggcaccuucagaccccccagcacagcccaaggcgcacaaguccgggcguggcgaggggcgguaccaggcugaggcgcgccuccuauuggcugcccgacaccacccccacaccaaggacgauauaagcgcagauggcgccaggagcggaacagcgcccucgccaccgcgucucugcugcuuuugugcucucccucccaccauggccagucuuaaggaucucgaagggaaguggcgccugauggaaagccacggcuuugaggaguacaugaaagagcuaggugagauuuuaucgccgaaccccucccuggcuccucauccuuguggggauguguugguucccuuccaccaugcgaucgggggagcugcagggagcaccuugcggcaguuaggauggagugcccgccuuugucgccggcuccgcacguggugggucaccccgcuucuccccuuuucugcuucuugcccccgaagcagccccucauugcuuccggcccuucacaggugcgugccagcgguacugcugugagcccccuacaaacagccccucaguugccucuuaauguuauccccacuucucuuccuauccucaccugugccaccguccugccccaucauccuccccuggcguggcagcacucacucuccuuuucccuuugccccaucuuuuguuccucgauggcgccaguccccuccaccccaucuccgccucagagaggacaccgcgugguagggcgugguuucugcagaagcucuuuagaggcuaugaaugaugcugcuuauaucccuuucucugcagcacgucucagguccucuccucgccgcacuggcuaggcguggcgcccgcggcgcugcacggucgacagcugguggcaugugggcgaagugcggagacauccauugugcaugguuguugucuugcgaccguucuguucuacuucuuucucuugauucuggagggugaggagcaaggagacuugggccuggcuggaaaacuauaaucagaaacugcuguugcugggccguggcugccaacugcuacaagauggguguggcuuugcagcaagcacuugcuccuuaaagccuaaccagagagugggcaagguucaaauucacccucacuggaaauagugccucguugucuguugccaguuuugccuacucuuaagauagggaugcauugguaaacacagaacagacaacgaaaucgacacuugucacagaugcuaggaagugggaugggguuaacggaaagguacucucucggaagagguacugcugguaggaggaggcagcuucaggcgcugcuguucacaguauuccucccugguuaagaaccagccuuaauucuuuuaaacauucagcacacuauggggcuaagucuggcuccugaugaauccuguuugugcuaacgcuauugucagaauguggaugcauuagggguuugugucuuuccuuguccacaguggaaagccgcacaggugugagugagagccaguagagagcacuguuugaaagcagcugguguuuaugcugugaguggcuaguucuccagauuguggccuuaggaagguuauaggccuuacccauagguucugggcaauguagaggggagcacagcagaagacucacagggacacgggagccuggcugagcauccugcuuggacgagugucuccuuucuugugaaaguaucccagguuccuuaugaguguuaccaucaaggacacggacauaaaccacugcauaacccagaaauguggaacuccauacugugaauaaacaaaccacacagcauaaaagucaaccagauacucaaaucguacaguguuuccagauagcagcacgucagguuccuaacauacagaacaagccuuaccauggaagcucacauggucacacagcuuugaaauguuuguucuuucccuggguguguuuucccucuacuuauugacaccagaggcaugccacucacuuaaaauacugugcuguuugcauugaaagcuuauuuuaaagcaucuaccaacuguuuuuuuuuuguuuguuuguuuguuuuuuuuuuuuuuuuuuuuuuacuuacauuguuguuuugagaacacggucucucugcagcuuaggcugacuuugaacuguugacccucuuaccuccaugucuggaaugcugcug

SEQ ID NO: 9986 - RNA, 2501 nt, Mus musculus
cagcagcauuccagacauggagguaagagggucaacaguucaaagucagccuaagcugcagagagaccguguucucaaaacaacaauguaaguaaaaaaaaaaaaaaaaaaaaaacaaacaaacaaacaaaaaaaaaacaguugguagaugcuuuaaaauaagcuuucaaugcaaacagcacaguauuuuaagugaguggcaugccucuggugucaauaaguagagggaaaacacacccagggaaagaacaaacauuucaaagcugugugaccaugugagcuuccaugguaaggcuuguucuguauguuaggaaccugacgugcugcuaucuggaaacacuguacgauuugaguaucugguugacuuuuaugcugugugguuuguuuauucacaguauggaguuccacauuucuggguuaugcagugguuuauguccguguccuugaugguaacacucauaaggaaccugggauacuuucacaagaaaggagacacucguccaagcaggaugcucagccaggcucccgugucccugugagucuucugcugugcuccccucuacauugcccagaaccuauggguaaggccuauaaccuuccuaaggccacaaucuggagaacuagccacucacagcauaaacaccagcugcuuucaaacagugcucucuacuggcucucacucacaccugugcggcuuuccacuguggacaaggaaagacacaaaccccuaaugcauccacauucugacaauagcguuagcacaaacaggauucaucaggagccagacuuagccccauagugugcugaauguuuaaaagaauuaaggcugguucuuaaccagggaggaauacugugaacagcagcgccugaagcugccuccuccuaccagcaguaccucuuccgagagaguaccuuuccguuaaccccaucccacuuccuagcaucugugacaagugucgauuucguugucuguucuguguuuaccaaugcaucccuaucuuaagaguaggcaaaacuggcaacagacaacgaggcacuauuuccagugagggugaauuugaaccuugcccacucucugguuaggcuuuaaggagcaagugcuugcugcaaagccacacccaucuuguagcaguuggcagccacggcccagcaacagcaguuucugauuauaguuuuccagccaggcccaagucuccuugcuccucacccuccagaaucaagagaaagaaguagaacagaacggucgcaagacaacaaccaugcacaauggaugucuccgcacuucgcccacaugccaccagcugucgaccgugcagcgccgcgggcgccacgccuagccagugcggcgaggagaggaccugagacgugcugcagagaaagggauauaagcagcaucauucauagccucuaaagagcuucugcagaaaccacgcccuaccacgcgguguccucucugaggcggagaugggguggaggggacuggcgccaucgaggaacaaaagauggggcaaagggaaaaggagagugagugcugccacgccaggggaggaugauggggcaggacgguggcacaggugaggauaggaagagaaguggggauaacauuaagaggcaacugaggggcuguuuguagggggcucacagcaguaccgcuggcacgcaccugugaagggccggaagcaaugaggggcugcuucgggggcaagaagcagaaaaggggagaagcggggugacccaccacgugcggagccggcgacaaaggcgggcacuccauccuaacugccgcaaggugcucccugcagcucccccgaucgcaugguggaagggaaccaacacauccccacaaggaugaggagccagggagggguucggcgauaaaaucucaccuagcucuuucauguacuccucaaagccguggcuuuccaucaggcgccacuucccuucgagauccuuaagacuggccauggugggagggagagcacaaaagcagcagagacgcgguggcgagggcgcuguuccgcuccuggcgccaucugcgcuuauaucguccuugguguggggguggugucgggcagccaauaggaggcgcgccucagccugguaccgccccucgccacgcccggacuugugcgccuugggcugugcuggggggucugaaggugccacccuggccuggcugcgccggacugggacgucacguuucccgcagcuccugcaagcugcgacucgucuggcgcgcccugugccucccuuagugacagcugcggcacagucccgugggcccagggaucacccccacccccacccgcgccaucugaggacagccugcgcgccguggucccacuguccugccgccuccauuugcuuuugauaaguaccugggaggaacaaauuagccaucgcuuggcgcuauaggaauugaauggcugauuacugaauuaauaaacugcaaucuccuuagcccuacauccuacucccucaugaaagaaccuucugacccc

SEQ ID NO: 9987 - RNA, 2501 nt, Mus musculus
uccuaugaggguaacuaagcaagcugagacaguaguggcccagugaaggguaguguguggggggugcucagugggggcgggggcuuuccacuggacucccagucuuuaccgcggauauacaauuugcugaaggagcaaagaacauccucggcucuaaguagggcuuuuagugugcucauugaugagugaaagucgccacacaugucaagcuaaaggcaguuguuggguuacuaacaggacccagcgccuugcaaacauaugcgcuaagcuguguauacagauggcaggcagaauaauggagcaggcgccuuuuauaaagcucuggcugcugccugucuucagaccugggaaaugaaacuauucagacucgcggccagauagcgcuugcgauuguuuguuaccguuuuaauccuauuaauuaaaacguuaaccugauuggguagaaagcgcugucccaacaggcgagucuucuucauaauaaccuacucagagauaaugauguaaaagacucccccgucuguggcggcggcugguugauggguccggaaaucucuugaaggugaauccaagcaagauaaacggugcguagagcaggcgcgggauuggacucagaggcgguagcggcggcagccccgcucccuccgagaccagccucccaccaugaggggccgcggcccauggugagccuuagcagccagcaccgucggcuggagacgaagaagaagaagaagaggaggcggcgagcgcgggggaaggcgaaaaagaaaaagaaggggacagggcugcgggcagcguggggaccgacgcacgcagcagcuccggaaccccgccggcgcgcgucugugcggccgccugacucuccagcccagguggcggcuggcccggacgauggaacgcggguugcaccucggugcggcggccgcgagcgaagacgaccucuuccugcacaagagccugggcaccuccgccgccaagcgccuggaggcggcuuuucgcuccacacccccgggcauggaccugucccuggcgccuccaacucgcgaacgcccggcgucguccucgucgccccucggcuguuucgagcccgcugaucccgaaggggcugggcugcugcugccuccgcccggaggaggcgguggcgcgagcggcggcggcggcggggugagugucccggggcugcucgugggcucagcgggcguggggggcgagccgagccugagcagccugccggcgggggcugcccugugccucaaguacggcgagagcgccggacgcggcuccguggccgagagcagcgggggcgagcagagccccgacgacgacagcgacggccgcugcgagcuggugcugcgagccgggggccccgacccgcgggcaucgccgggagcggggggcggcagcgccaagguggccgagggcugcuccaacgcccacuugcaugguggcucgggccuccccccggggggccccacaaguggcggcggaagcggcggcgguggcggcggcagcagcaagaaauccaaagagcagaaggcguugcgccucaacaucaacgcucgcgagcgccggaggaugcacgaccugaacgacgcucuggaugagcugcgcgcggucauuccuuacgcgcacagcccuucagugcggaagcucuccaaaaucgccacgcugcuccucgccaagaacuacauccucaugcaggcacaggcccuggaggaaaugcggcgcuuagucgccuaccucaaccaaggccaggccaucucggcagccucucuucccagcuccgcggccgcggcugcggcggccgcugcccugcacccggcgcucggcgccuacgagcaggcggccggcuacccguucagugcagggcugccgcccgcugccuccugccccgagaagugugcccuauucaacagcgucucguccagccucugcaaacagugcacggagaagccuuaaacacucccuucuucgaaaaccucgagaccgaccccaaagcuagaggaaagugagaagcugcuccccauuccuuuuccuuugguccucuccuaaguugugaaacacuugcagggcaaacaaagcagaggcaggaacuuagaaguaucagagacaaaccggacauucagccuuggcaagcccggaaucucggucuuugggguggggagggaggggagagggagguuuagugcggaugaagugugcuuccuuuuuccccucagaaaaguggcaacuuugguggcucccuagaucucaaggaaguacagucuucuuuggaggcgaaaauaaguugaaaaguagugcuugauuauuagacgagaaaaguacugaguggcaaaauacuaauccuacuaacaccugacaauuggcaagugaugaaagggagagggguucagaguugagaggcucggggacagaauauucauucagacaaaucagaaagggcacucgaaaauacaucuugauucugagccaggagaaaaacuugaaaugcagacuuuauuuaa

SEQ ID NO: 9988 - RNA, 2501 nt, Mus musculus
uuaaauaaagucugcauuucaaguuuuucuccuggcucagaaucaagauguauuuucgagugcccuuucugauuugucugaaugaauauucuguccccgagccucucaacucugaaccccucucccuuucaucacuugccaauugucagguguuaguaggauuaguauuuugccacucaguacuuuucucgucuaauaaucaagcacuacuuuucaacuuauuuucgccuccaaagaagacuguacuuccuugagaucuagggagccaccaaaguugccacuuuucugaggggaaaaaggaagcacacuucauccgcacuaaaccucccucuccccucccuccccaccccaaagaccgagauuccgggcuugccaaggcugaauguccgguuugucucugauacuucuaaguuccugccucugcuuuguuugcccugcaaguguuucacaacuuaggagaggaccaaaggaaaaggaauggggagcagcuucucacuuuccucuagcuuuggggucggucucgagguuuucgaagaagggaguguuuaaggcuucuccgugcacuguuugcagaggcuggacgagacgcuguugaauagggcacacuucucggggcaggaggcagcgggcggcagcccugcacugaacggguagccggccgccugcucguaggcgccgagcgccgggugcagggcagcggccgccgcagccgcggccgcggagcugggaagagaggcugccgagauggccuggccuugguugagguaggcgacuaagcgccgcauuuccuccagggccugugccugcaugaggauguaguucuuggcgaggagcagcguggcgauuuuggagagcuuccgcacugaagggcugugcgcguaaggaaugaccgcgcgcagcucauccagagcgucguucaggucgugcauccuccggcgcucgcgagcguugauguugaggcgcaacgccuucugcucuuuggauuucuugcugcugccgccgccaccgccgccgcuuccgccgccacuuguggggccccccggggggaggcccgagccaccaugcaagugggcguuggagcagcccucggccaccuuggcgcugccgccccccgcucccggcgaugcccgcgggucggggcccccggcucgcagcaccagcucgcagcggccgucgcugucgucgucggggcucugcucgcccccgcugcucucggccacggagccgcguccggcgcucucgccguacuugaggcacagggcagcccccgccggcaggcugcucaggcucggcucgccccccacgcccgcugagcccacgagcagccccgggacacucaccccgccgccgccgccgcucgcgccaccgccuccuccgggcggaggcagcagcagcccagccccuucgggaucagcgggcucgaaacagccgaggggcgacgaggacgacgccgggcguucgcgaguuggaggcgccagggacagguccaugcccggggguguggagcgaaaagccgccuccaggcgcuuggcggcggaggugcccaggcucuugugcaggaagaggucgucuucgcucgcggccgccgcaccgaggugcaacccgcguuccaucguccgggccagccgccaccugggcuggagagucaggcggccgcacagacgcgcgccggcgggguuccggagcugcugcgugcgucgguccccacgcugcccgcagcccuguccccuucuuuuucuuuuucgccuucccccgcgcucgccgccuccucuucuucuucuucuucgucuccagccgacggugcuggcugcuaaggcucaccaugggccgcggccccucauggugggaggcuggucucggagggagcggggcugccgccgcuaccgccucugaguccaaucccgcgccugcucuacgcaccguuuaucuugcuuggauucaccuucaagagauuuccggacccaucaaccagccgccgccacagacgggggagucuuuuacaucauuaucucugaguagguuauuaugaagaagacucgccuguugggacagcgcuuucuacccaaucagguuaacguuuuaauuaauaggauuaaaacgguaacaaacaaucgcaagcgcuaucuggccgcgagucugaauaguuucauuucccaggucugaagacaggcagcagccagagcuuuauaaaaggcgccugcuccauuauucugccugccaucuguauacacagcuuagcgcauauguuugcaaggcgcuggguccuguuaguaacccaacaacugccuuuagcuugacauguguggcgacuuucacucaucaaugagcacacuaaaagcccuacuuagagccgaggauguucuuugcuccuucagcaaauuguauauccgcgguaaagacugggaguccaguggaaagcccccgcccccacugagcaccccccacacacuacccuucacugggccacuacugucucagcuugcuuaguuacccucauagga

SEQ ID NO: 9989 - RNA, 2501 nt, Mus musculus
ccuagcacucuucgagcuccaagcacggauuccagccccaaggagggcugcaagcuguaccagaagcuugaaucaaaguuccacuccaccaacacucgggacucuugcaaaaucagcaggacuugagaguuugaagaccauuaagugacagcauccacgcaccugcgugcuagggcccagagcaagcuaccugguccuaauagucguccccaaggucaacugggcgccgaacugaagaugaggaugcaucucgcccgggaacacugcgaagcuucaaacagucgacugcaggcagcucugcacgccggaagugcacuaauccgcagcacgugggguugccagggcgagcuucacgugacggggcgggaccucgggaagcuucgagccaaugggcgaccuggaggcggggccuguggcgcgccggggccuaucccggaaguguggucgcggcggggcgggcccgggcugggcgggccggggcggggagccgggugugggaagcguggcggccccgccccgucuccuggaccagccgcggccgccagcgccgccgcagccgcagggaccggcggacgcagcaaaggcgugcggugcggggccggaaggugaagaccuggggccgggucggcggggcggcgggggaugcagccggugaugcugggguccgggcgaggggaggagccgagaugcuugggaacuggagggcggcaagcgcgggaccgccggagcuagggcccuuuaccgcugggccgaaccgggaugccagggcggcgccgcugcggguccuaggcgcacugagggccaggugcaaccggccgggugcuccugucccagucuuccccgaaccugcggccuggcugauaccuuggcagcggggaugggacggagggaggcgccgggccccgcaucccggcgcaggaaggucgugggcacuucuugcgguggggugguggggacuggaccugccggcugggcgcuggugucgccuucacucuccggcgagcucuucugcggcuccuuuccccaccucccaccaagggcuggaaaaguuuucagaggccugaauggcaaaguauacuccacucagaguggguguucuauaaaugcaaacauaacgggcuagugaugcucggcuaccugucuucaaaaugagacauaaccccgccugcaugccgguuauuaaaacgcaaacaaacuuuucgcauaguucccucagaaaaaccgcacaucuccccaguccaccauggcagacgaaauugauuucacuacuggagaugcaggggcuuccagcacuuauccuaugcagugcucagcccugcgcaaaaacggcuucgucgugcucaaagggcgaccaugcaaaaucguggagaugucaacuuccaagacugggaagcauggucaugccaagguaggcccuuccaagucauuuuuuggcuucaccguuaagaucauucguguuccauucuacaucgugagguuucuauauugaaaaauaacuuuuuuuccuuccccucagucucuugaauggucagacauuacucucaguaaagcucuccauuuaaucggacccuuagaauguuucauuaacuggaaacuaaaacuuuuuuaaauccguguuuaguagaaacaagccuguucuucuaauucuaagagacuugguuuucacuuucuguggacucuuguuaauugacuugcugacgugugugguguguugaguuuugaugccaugaaacuguucggguuuuggguacuuacugaaucucguucugugucacugcaacuuuuuuuaaagaaaguaagaugaccuuggaagaggugaaaggcuccauuacagucagagcugggauugugcugcuguguagggagugacauagcugacagagauuaaacauguuuccugugguucucuccucugucagguacaccuuguuggaauugacauuuucacuggcaaaaaauaugaagacauuuguccuucuacucacaacauggauguuccaaauauuaagagaaacgauuaucaaguaaguacugauuucuuuaacagcauuucagaaguguauaaacacccucuuuaguaguaguuugacaagacuugagaguaguuuuauagaguauauuccuuaccaguuacuagacuccacuuaucuuacagauuagagaaauagugcuuuguuuaguucuguuguuguuguuguuaauauucugugccuuuuucuguugugaaguaggagaucauaggucucaggcuggccuugaacucacuauucaaggaugaucuucagucucggacacucgggccucugccugugaaugcugagauuguagguugcaucuuugugccuggcuauccuguguuggagaucaaauccagguuugaaucugguucugguacuuucuagcuagauggucuuuuacaaagugugugucuucucuaaaccucugccuuuccgaacaaaccagggggacauguggguugaaugagagagugugcgcccaua

SEQ ID NO: 9990 - RNA, 2501 nt, Mus musculus
uaugggcgcacacucucucauucaacccacaugucccccugguuuguucggaaaggcagagguuuagagaagacacacacuuuguaaaagaccaucuagcuagaaaguaccagaaccagauucaaaccuggauuugaucuccaacacaggauagccaggcacaaagaugcaaccuacaaucucagcauucacaggcagaggcccgaguguccgagacugaagaucauccuugaauagugaguucaaggccagccugagaccuaugaucuccuacuucacaacagaaaaaggcacagaauauuaacaacaacaacaacagaacuaaacaaagcacuauuucucuaaucuguaagauaaguggagucuaguaacugguaaggaauauacucuauaaaacuacucucaagucuugucaaacuacuacuaaagaggguguuuauacacuucugaaaugcuguuaaagaaaucaguacuuacuugauaaucguuucucuuaauauuuggaacauccauguugugaguagaaggacaaaugucuucauauuuuuugccagugaaaaugucaauuccaacaagguguaccugacagaggagagaaccacaggaaacauguuuaaucucugucagcuaugucacucccuacacagcagcacaaucccagcucugacuguaauggagccuuucaccucuuccaaggucaucuuacuuucuuuaaaaaaaguugcagugacacagaacgagauucaguaaguacccaaaacccgaacaguuucauggcaucaaaacucaacacaccacacacgucagcaagucaauuaacaagaguccacagaaagugaaaaccaagucucuuagaauuagaagaacaggcuuguuucuacuaaacacggauuuaaaaaaguuuuaguuuccaguuaaugaaacauucuaaggguccgauuaaauggagagcuuuacugagaguaaugucugaccauucaagagacugaggggaaggaaaaaaaguuauuuuucaauauagaaaccucacgauguagaauggaacacgaaugaucuuaacggugaagccaaaaaaugacuuggaagggccuaccuuggcaugaccaugcuucccagucuuggaaguugacaucuccacgauuuugcauggucgcccuuugagcacgacgaagccguuuuugcgcagggcugagcacugcauaggauaagugcuggaagccccugcaucuccaguagugaaaucaauuucgucugccaugguggacuggggagaugugcgguuuuucugagggaacuaugcgaaaaguuuguuugcguuuuaauaaccggcaugcaggcgggguuaugucucauuuugaagacagguagccgagcaucacuagcccguuauguuugcauuuauagaacacccacucugaguggaguauacuuugccauucaggccucugaaaacuuuuccagcccuuggugggagguggggaaaggagccgcagaagagcucgccggagagugaaggcgacaccagcgcccagccggcagguccaguccccaccaccccaccgcaagaagugcccacgaccuuccugcgccgggaugcggggcccggcgccucccuccgucccauccccgcugccaagguaucagccaggccgcagguucggggaagacugggacaggagcacccggccgguugcaccuggcccucagugcgccuaggacccgcagcggcgccgcccuggcaucccgguucggcccagcgguaaagggcccuagcuccggcggucccgcgcuugccgcccuccaguucccaagcaucucggcuccuccccucgcccggaccccagcaucaccggcugcaucccccgccgccccgccgacccggccccaggucuucaccuuccggccccgcaccgcacgccuuugcugcguccgccggucccugcggcugcggcggcgcuggcggccgcggcugguccaggagacggggcggggccgccacgcuucccacacccggcuccccgccccggcccgcccagcccgggcccgccccgccgcgaccacacuuccgggauaggccccggcgcgccacaggccccgccuccaggucgcccauuggcucgaagcuucccgaggucccgccccgucacgugaagcucgcccuggcaaccccacgugcugcggauuagugcacuuccggcgugcagagcugccugcagucgacuguuugaagcuucgcaguguucccgggcgagaugcauccucaucuucaguucggcgcccaguugaccuuggggacgacuauuaggaccagguagcuugcucugggcccuagcacgcaggugcguggaugcugucacuuaauggucuucaaacucucaaguccugcugauuuugcaagagucccgaguguugguggaguggaacuuugauucaagcuucugguacagcuugcagcccuccuuggggcuggaauccgugcuuggagcucgaagagugcuagg

SEQ ID NO: 9991 - RNA, 2501 nt, Mus musculus
gagaauaugccucgaaaaaaaaaaaaaaaaaacaaaaacaacaacaacaacaacgaagucuaacguccauccuauuaggaguaucguuuaagcucuuuuuuuuuuuuggucaacagaauucggugucuucggcuacugagcuucccugucugugaugaagauguguaggcuaggacacuaacagucuuacuaaaaugacucaaggacgcuuuaagagggaaaaaaacauuuguagacacacaguggagaggagccacugacugggaagucauucaguuaagagugguuagucuuaauauuuagcaacacuuuucauuaaucauaauggcuagaaaaggauaauaaucaacuacccguaucucuggaaacacaaaggaaagugauacagaucugauacauuuaaacaguaaguuucucugaaacaauauuaugucucccaacuaagacauucaaagagcaaagaugauuagggauauuggaggcaggguaaugaaaucaucuuuuuaaauagauuaacuacuuagauagaacggaccaugucauucugacccuaacuugucauccagauucucuguuagaucauagagaaaggacagggcaggauaucaaaacaucuggauauagaaaaucagcaauauacauagagaaccgaaucagcaugcucccaagacaugccugggcuuguuucucacaugcuuacucccaccugaugaaaccccagcaugcguggccccagaaucaugcagcaguccugcagaaacaaggcccuccucccagcagaggcacaaaaaggccuuauuucaaagcaaaacacuggccggccgggugggguggggguguuuacagugcagguuuaccuauuauuacauuuuauguucauaauguucaaagaaagaauagagaccucaaaaauacuguuagauuuaauaaucaacauaagguuaaaaaaaaaagcccucccccaaaagucuauaggugacaaucacaacagguauuacauuuggguaaaaauaaauaaauaaauaacucuaaaaauaaauaaaaccaaagcuaagcuucagugaauacacaagcugaaauacagacucaaaaacaugcucggauccguucaaacugcugcauuaauuuaagagacuaauuuagaagcuguuauaaaaauacuucucagaucucaaaauccauccgauuggacgugugcgauggcagacacgaaggaugcacagcgcuugauguccuaauuuggaagggagcucagagacacuaaagaaaaucacagcuccaccauguaccggucugagggaaaugaaugaccacagcacacguuuccacgguugggcuggggccuacuccucaccggcuguacugcaaacaacagccuccccugagcagaaacagacccagggcaaagaagagaauccaggaacagguuccuggcguccggguaaaguaaggaaggcuaccccuggguauuccggagaagagaagacaagagaaaaccuuacucagaggucaccaaaacguggcaggcagaaaaacagcccuggcaggcuguuuuacaucacagaagaaagcuuagaaggggaggaggccuuggcgacccaggcucagcaucuaggacucaaaacugcgccccugcagcaucgcccccgcgugugccauucccgggcugggcaagcucacacgcauucggguccugcgaggaugccggccgggagcaccgagucgccgaggcggcugugcgaauggcugcgggaucgggaucgguggcccgcuggacgccgcgggcgaggcugacacgcgcacacggacgcaaccgagcggacucgaggaccgcacucaccggaaccggcaggccgcagccgccccgccaccccgcgcgccgcugcccgcuccaagaccacuuucugcgcucgccgccgccgaccggccgcuccgcugcuggaggcugauugucaaaagucggucggagcggagccaccgggaaacagcugcaggaagugacugcggaaccgggaggcggcggcggcggcggcggcggaggaggaggaggaggaggaggaggaggcagggcucccggcagcgcuacugcgcaugugcacggacaagcggcugcucccgcagacccgggacgccgagcaggugcggaacagcgacucgaaaggguacccuacccuggcccugauggcuccucggagcugccccagccuacccugaaagcgaugagggcagaagcuuggcagagccugguaggagggcggagguucuccucugagaccuggaaacugcacuccuugcgccuccgcccaaagacauuggaaaggagcccgcucaccggcaggacccgaaggacugcagaaguccccgggauaccuucaagagaggcgcugggauggauugcagcccuagcuuguucugccggcuuguaccuucugcaugugaauacuuguauaguggcuagggguuucuccuuggauaacaugacacgaauuuuccauauuacc

SEQ ID NO: 9992 - RNA, 2501 nt, Mus musculus
gguaauauggaaaauucgugucauguuauccaaggagaaaccccuagccacuauacaaguauucacaugcagaagguacaagccggcagaacaagcuagggcugcaauccaucccagcgccucucuugaagguaucccggggacuucugcaguccuucggguccugccggugagcgggcuccuuuccaaugucuuugggcggaggcgcaaggagugcaguuuccaggucucagaggagaaccuccgcccuccuaccaggcucugccaagcuucugcccucaucgcuuucaggguaggcuggggcagcuccgaggagccaucagggccaggguaggguacccuuucgagucgcuguuccgcaccugcucggcgucccgggucugcgggagcagccgcuuguccgugcacaugcgcaguagcgcugccgggagcccugccuccuccuccuccuccuccuccuccuccgccgccgccgccgccgccgccucccgguuccgcagucacuuccugcagcuguuucccgguggcuccgcuccgaccgacuuuugacaaucagccuccagcagcggagcggccggucggcggcggcgagcgcagaaaguggucuuggagcgggcagcggcgcgcgggguggcggggcggcugcggccugccgguuccggugagugcgguccucgaguccgcucgguugcguccgugugcgcgugucagccucgcccgcggcguccagcgggccaccgaucccgaucccgcagccauucgcacagccgccucggcgacucggugcucccggccggcauccucgcaggacccgaaugcgugugagcuugcccagcccgggaauggcacacgcgggggcgaugcugcaggggcgcaguuuugaguccuagaugcugagccugggucgccaaggccuccuccccuucuaagcuuucuucugugauguaaaacagccugccagggcuguuuuucugccugccacguuuuggugaccucugaguaagguuuucucuugucuucucuucuccggaauacccagggguagccuuccuuacuuuacccggacgccaggaaccuguuccuggauucucuucuuugcccugggucuguuucugcucaggggaggcuguuguuugcaguacagccggugaggaguaggccccagcccaaccguggaaacgugugcuguggucauucauuucccucagaccgguacaugguggagcugugauuuucuuuagugucucugagcucccuuccaaauuaggacaucaagcgcugugcauccuucgugucugccaucgcacacguccaaucggauggauuuugagaucugagaaguauuuuuauaacagcuucuaaauuagucucuuaaauuaaugcagcaguuugaacggauccgagcauguuuuugagucuguauuucagcuuguguauucacugaagcuuagcuuugguuuuauuuauuuuuagaguuauuuauuuauuuauuuuuacccaaauguaauaccuguugugauugucaccuauagacuuuugggggagggcuuuuuuuuuuaaccuuauguugauuauuaaaucuaacaguauuuuugaggucucuauucuuucuuugaacauuaugaacauaaaauguaauaauagguaaaccugcacuguaaacacccccaccccacccggccggccaguguuuugcuuugaaauaaggccuuuuugugccucugcugggaggagggccuuguuucugcaggacugcugcaugauucuggggccacgcaugcugggguuucaucaggugggaguaagcaugugagaaacaagcccaggcaugucuugggagcaugcugauucgguucucuauguauauugcugauuuucuauauccagauguuuugauauccugcccuguccuuucucuaugaucuaacagagaaucuggaugacaaguuagggucagaaugacaugguccguucuaucuaaguaguuaaucuauuuaaaaagaugauuucauuacccugccuccaauaucccuaaucaucuuugcucuuugaaugucuuaguugggagacauaauauuguuucagagaaacuuacuguuuaaauguaucagaucuguaucacuuuccuuuguguuuccagagauacggguaguugauuauuauccuuuucuagccauuaugauuaaugaaaaguguugcuaaauauuaagacuaaccacucuuaacugaaugacuucccagucaguggcuccucuccacugugugucuacaaauguuuuuuucccucuuaaagcguccuugagucauuuuaguaagacuguuaguguccuagccuacacaucuucaucacagacagggaagcucaguagccgaagacaccgaauucuguugaccaaaaaaaaaaaagagcuuaaacgauacuccuaauaggauggacguuagacuucguuguuguuguuguuguuuuuguuuuuuuuuuuuuuuuuucgaggcauauucuc

SEQ ID NO: 9993 - RNA, 2501 nt, Mus musculus
agcugaagccagcagucagucaguaagcaaaguucuaacuugcacuaaaaagaccccagggauuaacgggcauuaauuaccuuacucuaaaugcaaguuagugacuuuguucuagaagccccuuugacuucgcuaauugguggaugaccauuaguacaacuggauagcucaucagaggugaacagacaagugggcuuuucagcaaagagaaccacuugucuucaccaagucuuuuccaaaugucaauaugcuucaaguuauaccaaagcugggagauuucaucuugcuuuucaaccugucuagguggccuggguggguuucugccggcagcaguuuccuaccuuugguuucuaugcuucuauccacgaggggggauuaauuagccgggcugaagcuggaggaggcugucgugacgagcccaguggcgauuggccgcccgccugccuggcccugccuuuauaauuuccacacgagugcaucugggcucuuacacaaaccaacagcagcuucuucugacagacacacacucacccccgacgcacacucugcacacuuuuccucuaccugauuaacaguccugcacacaccaugauuacgggaaaacguaaauaaauacggaaaggggugauuauuuugacuacuggaagagcuuugcugggucucagcauaacuuuuguuuuuauuaccgagaaggugcucucuccacgcgucucucucugacacggauucuuuagcggaggggagaaaaggggagagcucagccuuucacuuuaagacccgcuagucucgagcgggggaaaaaaggccagcagggcagggcggcccccugcugcagcuaguccgagagaggcucggugccuuuugagcgugguccccuuucuccaccgaaguuggcuccagcgcuagcagccgcauuggaucccacagccuauugcgagacuccgguguacaauccggaucucugccccaacaugaucgcggcccaggccaagcuggucuaccaccugaauaaguacuacaacgagaaaugccaggccaggaaagcugccaucgccaaaaccauccgggaagucugcaaaguggucuccgacguccugaaggagguugaagugcaggaaccgcguuucaucagcucccucaaugagauggacaaccgcuacgagggccuggagguuaucucucccaccgaguucgaggugguacucuaucugaaccagauggggguguuuaacuucguggacgacggcucccugccuggcugugcggugcugaaacugagcgaugggcgcaagaggagcaugucccucuggguggaauucaucaccgccucuggcuaccucucggcacgcaaaauccguuccagguuucagacacugguggcucaggcgguggacaaguguagcuacagagauguaguaaagaugguggcugacacgagcgaagugaaacugagaauccgagauagguauguggugcagaucaccccggccuuuaaaugcaccgggauuuggccgcggagugcugcccacuggccgcuuccccacauccccuggccaggacccaaccggguggcagagguuaaggcugaaggguucaauuuguuguccaaggagugccacucccuggccggcaagcagaguucggcugagagcgaugcuugggugcugcaguuugcagaggccgagaacagacugcagauggggggcugcaggaagaaaugccucucuauccugaaaacccugcgugaucgccaccuggaguugccaggccagccccugaacaacuaccacaugaagacucugguguccuacgagugcgagaagcauccucgagagucggacugggacgaaucuugccugggcgaucggcugaacggaauucuucugcagcucaucucaugccugcagugccggcgguguccccauuacuucuuaccgaacuuagaucuguuucaaggcaaaccccacucggccuuggaaaacgcugcuaaacaaacguggcgacuggcaagagagauccugaccaacccaaaaaguuuggaaaaacuuuagaggaugaucuaauccagggcugacaagaaugagcauucuucucaaagucccgacgaaaugaaaacuuccugguugauuccuauguacuauuucucgagacagugcaaacaaucucuuccuuuaaaaggaguaacaacacaacauuuaaccaucaucucacacaggggaaaaaccacaccacaagcaucuuuauggaggcaucccccagcucccccgaaaagugcacaacaccccaaaacagcuggcugcaaugcaagaccauggccaacuccagcaaaggauuauaguaaucuugagacuuaggugcggcugccuuccagcaaacagggcccggauguaccaucggaagcaaaguguaauguauauuuugaucuguaacaaaaguugugaucucauguugucuuugaaaguguggauauugguguuuugugauuuggugaucagaacuga

SEQ ID NO: 9994 - RNA, 2501 nt, Mus musculus
ucaguucugaucaccaaaucacaaaacaccaauauccacacuuucaaagacaacaugagaucacaacuuuuguuacagaucaaaauauacauuacacuuugcuuccgaugguacauccgggcccuguuugcuggaaggcagccgcaccuaagucucaagauuacuauaauccuuugcuggaguuggccauggucuugcauugcagccagcuguuuugggguguugugcacuuuucgggggagcugggggaugccuccauaaagaugcuuguggugugguuuuuccccugugugagaugaugguuaaauguuguguuguuacuccuuuuaaaggaagagauuguuugcacugucucgagaaauaguacauaggaaucaaccaggaaguuuucauuucgucgggacuuugagaagaaugcucauucuugucagcccuggauuagaucauccucuaaaguuuuuccaaacuuuuuggguuggucaggaucucucuugccagucgccacguuuguuuagcagcguuuuccaaggccgagugggguuugccuugaaacagaucuaaguucgguaagaaguaauggggacaccgccggcacugcaggcaugagaugagcugcagaagaauuccguucagccgaucgcccaggcaagauucgucccaguccgacucucgaggaugcuucucgcacucguaggacaccagagucuucaugugguaguuguucaggggcuggccuggcaacuccagguggcgaucacgcaggguuuucaggauagagaggcauuucuuccugcagccccccaucugcagucuguucucggccucugcaaacugcagcacccaagcaucgcucucagccgaacucugcuugccggccagggaguggcacuccuuggacaacaaauugaacccuucagccuuaaccucugccacccgguuggguccuggccaggggauguggggaagcggccagugggcagcacuccgcggccaaaucccggugcauuuaaaggccggggugaucugcaccacauaccuaucucggauucucaguuucacuucgcucgugucagccaccaucuuuacuacaucucuguagcuacacuuguccaccgccugagccaccagugucugaaaccuggaacggauuuugcgugccgagagguagccagaggcggugaugaauuccacccagagggacaugcuccucuugcgcccaucgcucaguuucagcaccgcacagccaggcagggagccgucguccacgaaguuaaacacccccaucugguucagauagaguaccaccucgaacucggugggagagauaaccuccaggcccucguagcgguuguccaucucauugagggagcugaugaaacgcgguuccugcacuucaaccuccuucaggacgucggagaccacuuugcagacuucccggaugguuuuggcgauggcagcuuuccuggccuggcauuucucguuguaguacuuauucaggugguagaccagcuuggccugggccgcgaucauguuggggcagagauccggauuguacaccggagucucgcaauaggcugugggauccaaugcggcugcuagcgcuggagccaacuucgguggagaaaggggaccacgcucaaaaggcaccgagccucucucggacuagcugcagcagggggccgcccugcccugcuggccuuuuuucccccgcucgagacuagcgggucuuaaagugaaaggcugagcucuccccuuuucuccccuccgcuaaagaauccgugucagagagagacgcguggagagagcaccuucucgguaauaaaaacaaaaguuaugcugagacccagcaaagcucuuccaguagucaaaauaaucaccccuuuccguauuuauuuacguuuucccguaaucauggugugugcaggacuguuaaucagguagaggaaaagugugcagagugugcgucgggggugagugugugucugucagaagaagcugcuguugguuuguguaagagcccagaugcacucguguggaaauuauaaaggcagggccaggcaggcgggcggccaaucgccacugggcucgucacgacagccuccuccagcuucagcccggcuaauuaauccccccucguggauagaagcauagaaaccaaagguaggaaacugcugccggcagaaacccacccaggccaccuagacagguugaaaagcaagaugaaaucucccagcuuugguauaacuugaagcauauugacauuuggaaaagacuuggugaagacaagugguucucuuugcugaaaagcccacuugucuguucaccucugaugagcuauccaguuguacuaauggucauccaccaauuagcgaagucaaaggggcuucuagaacaaagucacuaacuugcauuuagaguaagguaauuaaugcccguuaaucccuggggucuuuuuagugcaaguuagaacuuugcuuacugacugacugcuggcuucagcu

SEQ ID NO: 9995 - RNA, 2501 nt, Mus musculus
guugggcaaagcaaggcgcugugcagggccagggcgugcccaccugcaaaccgcugguugucuggagccugcaaacaccuugcgaguuccggggaggcuccggagaugucugucucagacugcucagcucaaagcuuuagacacaacgcugccagcguccagaagguuuucagcgugucagcaacuucacuuuacagagcuagcugguggaggaccgaggaaaccccuccagccauacgcuggccagaagccaccgcugcccuagagcaccuuuuguucugaccacugauucgagugguggcggccuugccaggcgugcaggggcaccgcgaucucugcuuccagaggccaccucccgcccugggcgcccagcccugagccggcggcccggagcuugcacggcggagacacgccccuugccuccccgcggagcacagacucgcccgggcuccuaggcuccgcccaccccgcugggagccuggcuuucucuccugcccccugcacucgagacccagccgagcgcggagacgagcugcagccuucauggacugugagcgggguacaggguagguaguacgccaggguccgaggccacgcgcucuccaaaagaccuccaagguugagcgcgggcucagaauguggccggaagaagagucgcggcgucccuggugaaggucccggguugcaagguagggaguaggcagauggccaggcaaaguugaucagagaggaggugguuggccugcgccuucgggccgcugggaacagccgaacuacuuggacuugacccgccgcgccccaggcgcucugagcagcgccuaucagucgcccugcgcgggagcgcacuugcaaacuugguggaggugcccugcgcguccuguuguguaaccuccgcgccgccagcuggaccgggaaguugcccgcacguccuucagcuuagaucggucgcagcuccgggcgaauuucauggcccgcgacaaaagcgcggccagagccggcgugggcgagccccugcgcgcuccgacccguggggaacucccgcgcgcggucccuggccugcgccuccgaugcgcgcugagucucucgccgcugcugcccgcucgccgcggucugcccuuucuaguagcugccugaguuggaaagaagaggaugaccgaggugccuuggucgguuguccccaacgggacggaugcugccuuucuggcgggccugggcucgcuuuggggaaacaguacugucgccucaacugcagcaguuuccucuucauuccaaugugcccugaccaagaccgguuuccaguucuacuaccugccggcugucuacauuuuaguguucaucauaggcuuccuaggcaacagcguggcuaucuggauguucguuuuccacaugaagccuuggagcggcaucuccguguacauguucaauuuggcucuggcugacuuuuuauacgugcucacccuaccagcccucaucuucuacuacuucaacaagacugacuggaucuucggggaugcuaugugcaagcugcagagauucaucuuccacguaaaucucuacgguagcaucuuguuccucaccugcaucagcgcacacagguacaguggcgugguguacccucucaagucucugggcaggcucaagaagaagaaugccauuuaugucagcgugcugguguggcucauuguggugguggccaucuccccuauucucuucuacucuggcacugggacucggaaaaacaaaacugucaccugcuaugacaccacguccaaugauuaccugcgaaguuauuucaucuacaguaugugcacgacuguggccauguucugcaucccuuuggugcugaucuugggcuguuauggauuaauuguuaaagcuuugauuuacaaugaccuggacaacucuccgcuccggaggaaauccauuuaccuggugauaauuguccugacgguguuugcugugucuuauaucccuuuccaugugaugaaaacgaugaauuugcgagcacgguuggauuuccagaccccagaaaugugugauuucaacgacaggguuuaugccacuuaucagguaacaagaggucuagcaagucucaacagcuguguggaccccauucuuuauuucuuggcuggagauacauucagaaggagacugucccgagccaccaggaaagcuuccaggaggagugaggccaauuuacaauccaagagugaagaaaugacucucaauauuuuaucugaguucaagcagaauggagacacgaguuugugaaggcacgagauccuagcuccugaguuuuguaacaugguaggaugcucauagaacaagaugcuuuucuuccuaaguuccuaguaauguaagagaauucuccaaagaagaaagucgugagucuaaaaauuaagaagcaucaauuugaugcacauauccacauuuauuguucuuuccuguaaucuccuuucuuacugaauagaaguauguguaauaaacacuuccccuuccuc

SEQ ID NO: 9996 - RNA, 2501 nt, Mus musculus
gaggaaggggaaguguuuauuacacauacuucuauucaguaagaaaggagauuacaggaaagaacaauaaauguggauaugugcaucaaauugaugcuucuuaauuuuuagacucacgacuuucuucuuuggagaauucucuuacauuacuaggaacuuaggaagaaaagcaucuuguucuaugagcauccuaccauguuacaaaacucaggagcuaggaucucgugccuucacaaacucgugucuccauucugcuugaacucagauaaaauauugagagucauuucuucacucuuggauuguaaauuggccucacuccuccuggaagcuuuccugguggcucgggacagucuccuucugaauguaucuccagccaagaaauaaagaaugggguccacacagcuguugagacuugcuagaccucuuguuaccugauaaguggcauaaacccugucguugaaaucacacauuucuggggucuggaaauccaaccgugcucgcaaauucaucguuuucaucacauggaaagggauauaagacacagcaaacaccgucaggacaauuaucaccagguaaauggauuuccuccggagcggagaguuguccaggucauuguaaaucaaagcuuuaacaauuaauccauaacagcccaagaucagcaccaaagggaugcagaacauggccacagucgugcacauacuguagaugaaauaacuucgcagguaaucauuggacguggugucauagcaggugacaguuuuguuuuuccgagucccagugccagaguagaagagaauaggggagauggccaccaccacaaugagccacaccagcacgcugacauaaauggcauucuucuucuugagccugcccagagacuugagaggguacaccacgccacuguaccugugugcgcugaugcaggugaggaacaagaugcuaccguagagauuuacguggaagaugaaucucugcagcuugcacauagcauccccgaagauccagucagucuuguugaaguaguagaagaugagggcugguagggugagcacguauaaaaagucagccagagccaaauugaacauguacacggagaugccgcuccaaggcuucauguggaaaacgaacauccagauagccacgcuguugccuaggaagccuaugaugaacacuaaaauguagacagccggcagguaguagaacuggaaaccggucuuggucagggcacauuggaaugaagaggaaacugcugcaguugaggcgacaguacuguuuccccaaagcgagcccaggcccgccagaaaggcagcauccgucccguuggggacaaccgaccaaggcaccucggucauccucuucuuuccaacucaggcagcuacuagaaagggcagaccgcggcgagcgggcagcagcggcgagagacucagcgcgcaucggaggcgcaggccagggaccgcgcgcgggaguuccccacgggucggagcgcgcaggggcucgcccacgccggcucuggccgcgcuuuugucgcgggccaugaaauucgcccggagcugcgaccgaucuaagcugaaggacgugcgggcaacuucccgguccagcuggcggcgcggagguuacacaacaggacgcgcagggcaccuccaccaaguuugcaagugcgcucccgcgcagggcgacugauaggcgcugcucagagcgccuggggcgcggcgggucaaguccaaguaguucggcuguucccagcggcccgaaggcgcaggccaaccaccuccucucugaucaacuuugccuggccaucugccuacucccuaccuugcaacccgggaccuucaccagggacgccgcgacucuucuuccggccacauucugagcccgcgcucaaccuuggaggucuuuuggagagcgcguggccucggacccuggcguacuaccuacccuguaccccgcucacaguccaugaaggcugcagcucgucuccgcgcucggcugggucucgagugcagggggcaggagagaaagccaggcucccagcggggugggcggagccuaggagcccgggcgagucugugcuccgcggggaggcaaggggcgugucuccgccgugcaagcuccgggccgccggcucagggcugggcgcccagggcgggagguggccucuggaagcagagaucgcggugccccugcacgccuggcaaggccgccaccacucgaaucaguggucagaacaaaaggugcucuagggcagcgguggcuucuggccagcguauggcuggagggguuuccucgguccuccaccagcuagcucuguaaagugaaguugcugacacgcugaaaaccuucuggacgcuggcagcguugugucuaaagcuuugagcugagcagucugagacagacaucuccggagccuccccggaacucgcaagguguuugcaggcuccagacaaccagcgguuugcaggugggcacgcccuggcccugcacagcgccuugcuuugcccaac

SEQ ID NO: 9997 - RNA, 2501 nt, Mus musculus
cccucaggggaaagcugggcaucuagagaagcauuuuauuagagauaaagaauuuacucuaaacucaagguugaauagaaucuguuaucaaguuuuccugaagcaccacagugcuuaauaaaaaaaauucaacuuuaggggggaaauauauuauccaaaauggcuuaguagagcuuaaaucuugcacuuuuucaaaccuucuggggaaagaaacacauaagaauagacuaaagcuuguagcuuauaucagugauacccaaaacccagauaugguaccauauugggcaguuucagcuaauauaaugcaaaacuaagaucaaauuaaaaacaugauaaauccacuuacagaauuucagaugagauuauaucacuagauaaauacaugagagagagagagagagcgcgugcgcgauugauucucugcuuuaguuaaaauagaucugcugcaaagaacugaauuuaaggaaauauuuaucucgaggcuggagagaugacaugugguuaagcacacuuguugcucuugcagacuagaguucagcuccuggcccucauguggagggucuauucccauucauaacuucaguucuggggggugcagugccgccccccuccccacuucugaccuuaccaggcccuaggcaugccucugguacacaugcauacaugaagagagaacacauaaauuuugcuuuagaaaauauuuuuuaaguacuauaucauaaugcuaccacagcuaaaaucaauggucucucccugacaaacugcaucagcaucagcuggcucuuccuuucuggauaggccuggaugcuuucuucuucucucuucucgucccauucgacaaccaagaacaauuucgauaauguaauaguuuuuaaugcugcagcucccugguggccauucauuucaaucaaaucuuccaacgugaaagagagaaaaugccacacuuuucucucaguaaaaggaaggccccuuccuagaguuaugaggugucaacacuucagagagcucaaacucccugcgucugccuuagacacccaaagguaaaacacagauuucaucugggugaagacugcaaaucguccuaccucccuccaaaaacaaaccguugggcaauuccuuacuuggcaguagcguuuccuaacaaagcaagcugcuucuccuaaaggcugggaacgggguuugugggaggggggucuacuuaagucaaaaaucaaugccugccuuuuaguccugcaccuuuuaguccugcagucacaaacacagcuagcucuccgugcugcagcuggccgcauccuuuacagccugaaaaaguaaggcucccuccaucuaagaguuccuuuacaaugcuuuguacauuccacucagaccuuuuauuaauaauguagccuuaaucuuuaggagucuccucuuuccaaaucucccauucccuuccuccucgccaccucucccccaggaagcacucuccuacccuagggaccacaggcccuuucccgccuagaaugugcguuccucccuccgggccugcagcagguccaucggcguggcgugcggacaguauucuccacuucuccuuggucgcggugacaaccaggccaccacuaccucggcccccgaggcuuacauagcucaaggcagggcaggauggauccgugaggccgcgguggcccggcucgccaagagcacuggacgccccuccaaguggcccagauucucgagucucucguccggagccucgagacccagccccgagaccaggcgcggaggccagagcccagggcguggcagcucgcggcgccccgcuccacggaggagcgagcggcgcccggggccucgaagccccgacccacgaaccuagaaggcugcgccgcgagagagaggggcgcucggcagccgcccaaccgucuccccgccucggccucccgcccgcccgccccgcacucaccucccgugcgcccgugguacccgcaacggugcggcccgcgcucgcucucugcgcgcgaacacggacuccccgcagccgcacgcacgccgagcgggcgggcgcgcgccuccuucacgcacgcgcgcgcgcgcggggucccugcguccgcagcccagcgccguuaucgcuguuaucgccgcagcugccggccucugccgcgggcgggcgccagcaucacggccaccgcaggcuucgccuaaguccuccaccuccaaccccggcucucugccucgugccaucuuuugacagaaagcaagaaauuuuauuuuugaauggaaccaccuucacccuagguccugggagaaacagagucaguacagaaacacccagccuucaugaccaaaggcuucucccuucucccuucucggggagaugccuaaauguguagcccgcagauuuccgccccagggcugacuuggaaaggaggaagccuuggcacauucagaaggcuguuucuccuuucaggagugcgggaguggggguggggagaggaaagcuuugguguauguggaccagaggc

SEQ ID NO: 9998 - RNA, 2501 nt, Mus musculus
gccucugguccacauacaccaaagcuuuccucuccccacccccacucccgcacuccugaaaggagaaacagccuucugaaugugccaaggcuuccuccuuuccaagucagcccuggggcggaaaucugcgggcuacacauuuaggcaucuccccgagaagggagaagggagaagccuuuggucaugaaggcuggguguuucuguacugacucuguuucucccaggaccuagggugaaggugguuccauucaaaaauaaaauuucuugcuuucugucaaaagauggcacgaggcagagagccgggguuggagguggaggacuuaggcgaagccugcgguggccgugaugcuggcgcccgcccgcggcagaggccggcagcugcggcgauaacagcgauaacggcgcugggcugcggacgcagggaccccgcgcgcgcgcgcgugcgugaaggaggcgcgcgcccgcccgcucggcgugcgugcggcugcggggaguccguguucgcgcgcagagagcgagcgcgggccgcaccguugcggguaccacgggcgcacgggaggugagugcggggcgggcgggcgggaggccgaggcggggagacgguugggcggcugccgagcgccccucucucucgcggcgcagccuucuagguucgugggucggggcuucgaggccccgggcgccgcucgcuccuccguggagcggggcgccgcgagcugccacgcccugggcucuggccuccgcgccuggucucggggcugggucucgaggcuccggacgagagacucgagaaucugggccacuuggaggggcguccagugcucuuggcgagccgggccaccgcggccucacggauccauccugcccugccuugagcuauguaagccucgggggccgagguagugguggccugguugucaccgcgaccaaggagaaguggagaauacuguccgcacgccacgccgauggaccugcugcaggcccggagggaggaacgcacauucuaggcgggaaagggccuguggucccuaggguaggagagugcuuccugggggagagguggcgaggaggaagggaaugggagauuuggaaagaggagacuccuaaagauuaaggcuacauuauuaauaaaaggucugaguggaauguacaaagcauuguaaaggaacucuuagauggagggagccuuacuuuuucaggcuguaaaggaugcggccagcugcagcacggagagcuagcuguguuugugacugcaggacuaaaaggugcaggacuaaaaggcaggcauugauuuuugacuuaaguagaccccccucccacaaaccccguucccagccuuuaggagaagcagcuugcuuuguuaggaaacgcuacugccaaguaaggaauugcccaacgguuuguuuuuggagggagguaggacgauuugcagucuucacccagaugaaaucuguguuuuaccuuugggugucuaaggcagacgcagggaguuugagcucucugaaguguugacaccucauaacucuaggaaggggccuuccuuuuacugagagaaaaguguggcauuuucucucuuucacguuggaagauuugauugaaaugaauggccaccagggagcugcagcauuaaaaacuauuacauuaucgaaauuguucuugguugucgaaugggacgagaagagagaagaagaaagcauccaggccuauccagaaaggaagagccagcugaugcugaugcaguuugucagggagagaccauugauuuuagcugugguagcauuaugauauaguacuuaaaaaauauuuucuaaagcaaaauuuauguguucucucuucauguaugcauguguaccagaggcaugccuagggccugguaaggucagaaguggggaggggggcggcacugcaccccccagaacugaaguuaugaaugggaauagacccuccacaugagggccaggagcugaacucuagucugcaagagcaacaagugugcuuaaccacaugucaucucuccagccucgagauaaauauuuccuuaaauucaguucuuugcagcagaucuauuuuaacuaaagcagagaaucaaucgcgcacgcgcucucucucucucucucauguauuuaucuagugauauaaucucaucugaaauucuguaaguggauuuaucauguuuuuaauuugaucuuaguuuugcauuauauuagcugaaacugcccaauaugguaccauaucuggguuuuggguaucacugauauaagcuacaagcuuuagucuauucuuauguguuucuuuccccagaagguuugaaaaagugcaagauuuaagcucuacuaagccauuuuggauaauauauuuccccccuaaaguugaauuuuuuuuauuaagcacuguggugcuucaggaaaacuugauaacagauucuauucaaccuugaguuuagaguaaauucuuuaucucuaauaaaaugcuucucuagaugcccagcuuuccccugaggg

SEQ ID NO: 9999 - RNA, 2501 nt, Mus musculus
ggaagcccagccacauauuuucauuggcuggagccaugcagcaccaagaugcuaaaaauacuuucuuuucuuuuaaguugggacaaacaaaucagaccaagcaaauaauugcauaucauuucucccaucuuaagucucuuacuagaaaaugcucugcauagcucggucaaagcaaaggaucuguuuuauauuuguacacacacccacugucagaaauacccccuucagcuuauuuuugcccaggaugauucaauaagcuauauuugcauucacagcaaggauggucagcauuuagguaggacuuuauuucucacuugcuuuguauuggagagagagagagcuucaugaguggugaaaacaaaccagcaagacaggccaaaucauucauaaaaaugcauacaacgaguaugaccuuaauggaaccacaaaguguuuccaugcacucacucgggaaucaucuagaccguggaaacucagugugauucuuaaaaugaaaggcuacgagcugcgaacaccuugcccaagcugagucgucuguggcuggcaaagggaaauuuuauguuucuucuuuuagacuucucacagcuaacucuaaaacacgcgugugccuuccugaagaugcacacacaggguucuacagaucagcuaaauaaagguuucuccagggagacaagccuuuuaaaagcaaauaucuguaggauaaccuacagucaaguggugguguggacuuuaccaucacucccaacauuucucaaguuaacuacuaaaugaacaaacguaauaacaagagcacuaaucacaacacaagcuugcagguuccguucaugagucacuaguguauauagucucuuuuuuccccccuugaaaaagaacacggguuagaaaaugucugcauaauucuuuaugucuacaaaccaaggcuugccucuugggaaaggauuggcagauguagcagaagggcuguuugccuagauugcagcugggccuuugacaagugcuucggguaaaagacuugguguuguauguacccaccaaacgccaggcaggaccgugcgcuggugcuguggauuucaaagauaacuccugggaggaagcuggaaaaucaggauauuaucucccacacauacgcucagaagccaacauccccgcggccgcucccucagaugcgccagaaggucaaugagugguaccugcaaagccaacuaacuauccaccaagcuacuuuuccagcaccagcaccagcucagagagaaguuggcggugcgcuuccccuuaacuguaccuugcaacugggcagagagagaguccuggugcugcugguacuugagcgccacugccucagcuuugcgcagcugcgucugcaguuccaaguagagcaucgcgccauagaggaagccgaagaccaccgugagaagcagcagcgucuggaagauccgcuucugcuuucgggagcacaucccguuucccauagucccuccugugccccgcgcugcggcggcgggagccgucguguccucgguccucggcugcgucggacagcucagcaacggccaccgcgagaaguagcuggacacggcaugagcagaagacgcgagacacaaaagccggaccagagaggaagaggcggccgcucagcccccgcggccggcugggcgccaggucaucgacgccacccggccagcagccaccaaacuucugcgaugucggauuuccgcgaguggcugggcccgcguggagucucuuugcauacuucagagcccgcugcccuugcuacugguccccgcgcgcagccggcuugguuuucccuacuccccacuuuuuggccucgcuguccccaccgucaguccccgccccucgcgccggcucccgcugcuggacuuugucgcuaccacugguaggggacgcgcgcccaacaaagggaccuggcuccaggcggcguccccuugaacggucccucgguauugaugaagagauggggacugguuggucuggucagguuaagggggguggugggcuggugucacugaucuggaagcuccagccgcccgccaccucccacccaacuuacgugucacccacggccccgcuaucauggccaacgggauuccgggaggaagucccacucgggcuccccgcucauugggcccgcgcaagccaccgcucccuccuuucggggagcuaaugcugggcuccauuggacgccagcuuuguccgucccgccccgggccgcgccuacccucucagcucugggcaggcucugagcuccgugggccgcgcggccgccuggcgccugggugcgcccacguggagccuggaugggugcggagggguggaggagccugguugggagggcuagggacuuguccuggccugaggcuuggugaucauugcgcaugugugugcauguaugucccagcacuuggaaugcacguggagcaagaguacagugcuuauaugcacaccaacaaccgcaaagcaaccgugggugcacucugcuuagc

SEQ ID NO: 10000 - RNA, 2501 nt, Mus musculus
gcuaagcagagugcacccacgguugcuuugcgguuguuggugugcauauaagcacuguacucuugcuccacgugcauuccaagugcugggacauacaugcacacacaugcgcaaugaucaccaagccucaggccaggacaagucccuagcccucccaaccaggcuccuccaccccuccgcacccauccaggcuccacgugggcgcacccaggcgccaggcggccgcgcggcccacggagcucagagccugcccagagcugagaggguaggcgcggcccggggcgggacggacaaagcuggcguccaauggagcccagcauuagcuccccgaaaggagggagcgguggcuugcgcgggcccaaugagcggggagcccgagugggacuuccucccggaaucccguuggccaugauagcggggccgugggugacacguaaguugggugggagguggcgggcggcuggagcuuccagaucagugacaccagcccaccaccccccuuaaccugaccagaccaaccaguccccaucucuucaucaauaccgagggaccguucaaggggacgccgccuggagccaggucccuuuguugggcgcgcguccccuaccagugguagcgacaaaguccagcagcgggagccggcgcgaggggcggggacugacgguggggacagcgaggccaaaaaguggggaguagggaaaaccaagccggcugcgcgcggggaccaguagcaagggcagcgggcucugaaguaugcaaagagacuccacgcgggcccagccacucgcggaaauccgacaucgcagaaguuugguggcugcuggccggguggcgucgaugaccuggcgcccagccggccgcgggggcugagcggccgccucuuccucucugguccggcuuuugugucucgcgucuucugcucaugccguguccagcuacuucucgcgguggccguugcugagcuguccgacgcagccgaggaccgaggacacgacggcucccgccgccgcagcgcggggcacaggagggacuaugggaaacgggaugugcucccgaaagcagaagcggaucuuccagacgcugcugcuucucacgguggucuucggcuuccucuauggcgcgaugcucuacuuggaacugcagacgcagcugcgcaaagcugaggcaguggcgcucaaguaccagcagcaccaggacucucucucugcccaguugcaagguacaguuaaggggaagcgcaccgccaacuucucucugagcuggugcuggugcuggaaaaguagcuugguggauaguuaguuggcuuugcagguaccacucauugaccuucuggcgcaucugagggagcggccgcggggauguuggcuucugagcguaugugugggagauaauauccugauuuuccagcuuccucccaggaguuaucuuugaaauccacagcaccagcgcacgguccugccuggcguuugguggguacauacaacaccaagucuuuuacccgaagcacuugucaaaggcccagcugcaaucuaggcaaacagcccuucugcuacaucugccaauccuuucccaagaggcaagccuugguuuguagacauaaagaauuaugcagacauuuucuaacccguguucuuuuucaaggggggaaaaaagagacuauauacacuagugacucaugaacggaaccugcaagcuuguguugugauuagugcucuuguuauuacguuuguucauuuaguaguuaacuugagaaauguugggagugaugguaaaguccacaccaccacuugacuguagguuauccuacagauauuugcuuuuaaaaggcuugucucccuggagaaaccuuuauuuagcugaucuguagaacccugugugugcaucuucaggaaggcacacgcguguuuuagaguuagcugugagaagucuaaaagaagaaacauaaaauuucccuuugccagccacagacgacucagcuugggcaagguguucgcagcucguagccuuucauuuuaagaaucacacugaguuuccacggucuagaugauucccgagugagugcauggaaacacuuugugguuccauuaaggucauacucguuguaugcauuuuuaugaaugauuuggccugucuugcugguuuguuuucaccacucaugaagcucucucucucuccaauacaaagcaagugagaaauaaaguccuaccuaaaugcugaccauccuugcugugaaugcaaauauagcuuauugaaucauccugggcaaaaauaagcugaaggggguauuucugacaguggguguguguacaaauauaaaacagauccuuugcuuugaccgagcuaugcagagcauuuucuaguaagagacuuaagaugggagaaaugauaugcaauuauuugcuuggucugauuuguuugucccaacuuaaaagaaaagaaaguauuuuuagcaucuuggugcugcauggcuccagccaaugaaaauauguggcugggcuucc

SEQ ID NO: 10001 - RNA, 2501 nt, Mus musculus
uugggcuggagaaccgggaggaaaaagcccaggccacaaagagucuaguacugcugguuuaugguuacucggggacagggacgcagugcugagacuuaaaggcugcugcacaucgauacgggcgcaggccacgcggggcgugaaacgcguuccagcccugauccgacugcaaggcagcuagcccggcuccacgcguguccucgacuuucguugccuccuccucgcucuccccucgcucucccugggacaggguggcccgcgcuugucugcuugcaaggcaaucaccagagcgcgcgcgcaggggcugcugccucggggugggggcgcagcccgaauuuccugccagcgagcgcgugaggggcauucucaacgcagccagccccagaaaguagugaccggccuccucggauuacuccgguuuggcuccucccuugcucccccuccuccaccuccagauuugcauaaaaaaggccaagaaaacucuggcugggccccagccucugcucacucugcucccccgggucggagccccccggagcugcgcgcgggcuugcagugccuugcccgcgccgaccucccggcgcccggcuucgcgcguucgcgccgcccgcuguccagagcccccacgagcagagcgagggagucccggacgagcucgagcuccggccgccucucgcuucccccgcucggcucccuccgccccccgggggucgcuaguccacgaugccgcggggcccugccucgcugcugcugcuaguccucgccucgcacugcugccugggcucggcgcgugggcucuuccucuucggccagcccgacuucuccuacaagcgcagcaacugcaagcccauccccgccaaccugcagcugugccacggcaucgaguaccagaacaugcggcugcccaaccugcugggccacgagaccaugaaggaggugcuggagcaggcgggcgccuggauuccgcuggucaugaagcagugccacccggacaccaagaaguuccugugcucgcucuucgccccugucugucucgacgaccuagaugagaccauccagccgugucacucgcucugcgugcaggugaaggaccgcugcgccccggucauguccgccuucggcuuccccuggccagacaugcuggagugcgaccguuucccgcaggacaacgaccucugcaucccccucgcuaguagcgaccaccuccugccggccacagaggaagguaagccuucccuauucgauccacccacucccaagaagccugaggugcuaggaccuggggagugggguggguggggugggggacaccccgcagccaccacuccacauccuaguuuguccaggcuggaggucccaaccuuggauauggcagcucuccuugcccuaaucuguugccauacggaguuagagauauccacccaugcgccaagauuccuccuugguucuaacaguuccucuuagguaguuaagaaagccaaacaaaaguggcaagccuuuuuuuaagauucuugcucugcguccccgcuucugaaagcauuuaccaugauuggguccuagugaugagcacccaggcucagccucucucugcacguucuugucccacuggauaaaaacaaacgauacacguugaucaccuuuugagauuguuuuuuuguccuucgccaauguagguuuggagauaaaaaaacgaagacugucugggagcgaguggaacccugacuauugguuuuaacuccccagguguuugggggagagaggcuaaaggcaaucaacaggacucaucucucugucacuaucugcuuuuaucuuaggagugguuuuaauuagcuggggaaaaaaucaugcagaagaguucccucaaguuuuuagaaaacagagggaaguucauaggcaaaaaccaucaaagcaaugaaaaccucaugcacucuugauacuuuuccugaaaggaaaaaguauacaaugugucugagcugauuugggccccggagauagaaaagggggcuuccuuaccccucucuggcugcagccgcaucucccuuucaaucgcuaauuuuuuuccugcagacaucauuaguuaaagaaaauacaaaguuguuuagcaaucuuuccuggcaggcaccaugagucugcaaucaucuuauugguuagguuucuaauuuauugcaaauguuuggcauuuuucaaacauuugcccaacauauacaauagaauaaccaauacagguugguagcauuucauacacacuccgagccucccgauuggaaguguuucucucugguuggguagggcugggguuguuuuguggggguugccuuuguuguuuuucuuccugccaucaacccaaauagacacaggguauuccuccagaguucacuuuccuccuucaaaauaagccuggacgccugcgaaguuugcuugauauuuucaaaaaucagauaacuuuucuuuuaugggucacaagguuuuuuuuuuucuuuuucccugugaaaauuugauuu

SEQ ID NO: 10002 - RNA, 2501 nt, Mus musculus
aaaucaaauuuucacagggaaaaagaaaaaaaaaaaccuugugacccauaaaagaaaaguuaucugauuuuugaaaauaucaagcaaacuucgcaggcguccaggcuuauuuugaaggaggaaagugaacucuggaggaauacccugugucuauuuggguugauggcaggaagaaaaacaacaaaggcaacccccacaaaacaaccccagcccuacccaaccagagagaaacacuuccaaucgggaggcucggaguguguaugaaaugcuaccaaccuguauugguuauucuauuguauauguugggcaaauguuugaaaaaugccaaacauuugcaauaaauuagaaaccuaaccaauaagaugauugcagacucauggugccugccaggaaagauugcuaaacaacuuuguauuuucuuuaacuaaugaugucugcaggaaaaaaauuagcgauugaaagggagaugcggcugcagccagagagggguaaggaagcccccuuuucuaucuccggggcccaaaucagcucagacacauuguauacuuuuuccuuucaggaaaaguaucaagagugcaugagguuuucauugcuuugaugguuuuugccuaugaacuucccucuguuuucuaaaaacuugagggaacucuucugcaugauuuuuuccccagcuaauuaaaaccacuccuaagauaaaagcagauagugacagagagaugaguccuguugauugccuuuagccucucucccccaaacaccuggggaguuaaaaccaauagucaggguuccacucgcucccagacagucuucguuuuuuuaucuccaaaccuacauuggcgaaggacaaaaaaacaaucucaaaaggugaucaacguguaucguuuguuuuuauccagugggacaagaacgugcagagagaggcugagccugggugcucaucacuaggacccaaucaugguaaaugcuuucagaagcggggacgcagagcaagaaucuuaaaaaaaggcuugccacuuuuguuuggcuuucuuaacuaccuaagaggaacuguuagaaccaaggaggaaucuuggcgcauggguggauaucucuaacuccguauggcaacagauuagggcaaggagagcugccauauccaagguugggaccuccagccuggacaaacuaggauguggagugguggcugcggggugucccccaccccacccaccccacuccccagguccuagcaccucaggcuucuugggaguggguggaucgaauagggaaggcuuaccuuccucuguggccggcaggagguggucgcuacuagcgagggggaugcagaggucguuguccugcgggaaacggucgcacuccagcaugucuggccaggggaagccgaaggcggacaugaccggggcgcagcgguccuucaccugcacgcagagcgagugacacggcuggauggucucaucuaggucgucgagacagacaggggcgaagagcgagcacaggaacuucuugguguccggguggcacugcuucaugaccagcggaauccaggcgcccgccugcuccagcaccuccuucauggucucguggcccagcagguugggcagccgcauguucugguacucgaugccguggcacagcugcagguuggcggggaugggcuugcaguugcugcgcuuguaggagaagucgggcuggccgaagaggaagagcccacgcgccgagcccaggcagcagugcgaggcgaggacuagcagcagcagcgaggcagggccccgcggcaucguggacuagcgacccccggggggcggagggagccgagcgggggaagcgagaggcggccggagcucgagcucguccgggacucccucgcucugcucgugggggcucuggacagcgggcggcgcgaacgcgcgaagccgggcgccgggaggucggcgcgggcaaggcacugcaagcccgcgcgcagcuccggggggcuccgacccgggggagcagagugagcagaggcuggggcccagccagaguuuucuuggccuuuuuuaugcaaaucuggagguggaggagggggagcaagggaggagccaaaccggaguaauccgaggaggccggucacuacuuucuggggcuggcugcguugagaaugccccucacgcgcucgcuggcaggaaauucgggcugcgcccccaccccgaggcagcagccccugcgcgcgcgcucuggugauugccuugcaagcagacaagcgcgggccacccugucccagggagagcgaggggagagcgaggaggaggcaacgaaagucgaggacacgcguggagccgggcuagcugccuugcagucggaucagggcuggaacgcguuucacgccccgcguggccugcgcccguaucgaugugcagcagccuuuaagucucagcacugcgucccuguccccgaguaaccauaaaccagcaguacuagacucuuuguggccugggcuuuuuccucccgguucuccagcccaa

SEQ ID NO: 10003 - RNA, 2501 nt, Mus musculus
agcagcaccucccugucacccaaaagaacgcuugaauuccgagcuguuucauugaguccauuucgacugccgguugccgggggggggggggggggacaauucuugcgcuaguggggucuccggaugccuggagcugagcuguccagagcaccaaaucugguagagaacuacuagggaacuggugaaacgggaccuguguucgcccugcaggccgagagagcauccgugacccaggcgagagccgugcccuguucuugccagaggcacaaaccccguucuugccuucugacgcuucucgguccgccuacugaugcgggagaaggguaucuuggcucuuggagaacccuggacccacccacauuucuagaaacaggagggauuccggaaaggaugggggugaaguggucacagagcagggcccccaggugguguggaaggcggggcgggggcggggccgccucaugcaccagcuggguauaaaagccuagagcucuggcgcccagcggcugugcaauuguccuccacgcggcuugguccccagguggaaggaucuguucugcaaaggagacagcaaaguaucuuuagccuaaaggacucagcguccaguguucuaguugaagaucuaaagagaaagccaccuugcugccacuaugccuaacuuuucuggcaacuggaagaucauccgaucggaaaacuuugaggaaaugcuaaaagcucuggguaaggagguuuucgugaguugggaagggaggacaagaagggcgcuggggucuuuagagcagaggccgaauaaacggaagggggccgaaucagggaauguaccugggagccugcauccuaggaaaggggcgugccggauacccuggguccuggggcaccaggcccaagacucuuaaauccuacuuucugaggcugggcgcccaccagugccagcuucaacggugacucagagccugugaagcaaguagaaaccagaagcacgagguuagucucaggagggguuggcuagccucggcgccuggaccugcugaccagggcaccuggcucugagcuuuaagaauccagaauccaggcagggagccccuaggagacauuccaagaucuuuccgcguacccuaacaguaacccaauccaggcgacagguccauuauccucaacacuuggcuccgcccaccaggugguccaccacuucagcuccccgacccucccccacaccuugcacuucccacuccagucuccccaccccaccccaccccaccccacccccaccugugagacauauuuuccuacagcaaccggcucccaagcccuaaaaucgcucuggacaauuaccacuuucuuagauuucaacaaauguccucgugugaaacaccaauccccauuuccgaaagucuaggauugccucccuccucgccacagaccagcugcacccugcgcaacugggcuguuagccaagggugggaacacaggaaccacccagacuuucccuacccaccuucuacuacccucuaggaugcgacugagcuagaagguauaggaaaggagagacaucugcggagagaugcaguuaaccgccccagggaguggaaacuaccccagagccuaagggucagcaugccuuccauuucugcacuggagaggagcccugugguggggagcaggggauacccuugaggagcuagggacuguauaagagugagucuggagcuaaaaagaauguugcgagggcaguagggccucuguucucaucuuuccucgcuguucauucucuuugugucagcuaaccgcaaugauccuuagagucauacccaguuuucuugcuccgcccuugcgaaauuaaagaucagagaauagaaauuuucagaaaaaucuauugcugucuccucccucauucgcucuaaauucuggccccucucugcaguggaugugggagccuggcaucacccccacccccaccccggguuccagcugcagagaaaggcccaauccuacagucugccuucagaauguuuguccuccccgcagggucucucugagccacgcgacuugcuaggggguagauugcaaacagacccguuguuacacaaacugccugugucagccaaggucagcugagccaggaccccagcucugcagacugagggaggcgggguucuccuuaacacagccuccagagacgccacagggucugcguucaggguccauguugugggagaguucagggcucaucaugauaaucagggcaaacacagcaggucuuucgguuaggacugggugaguccacuuuggggcuaaaugaagugucaguuuucuucucaggaacccagagcuauggaaugcaugaguauuuguguguauauauggggguggcggggagggggguugcacgguggcaguggcuuguccccuguagcaccuugaagggccaguucuucaccucaucaggcuuggaaagguggggguggauccuccuguugguggcagaggguugcucuccuuca

SEQ ID NO: 10004 - RNA, 2501 nt, Mus musculus
ugaaggagagcaacccucugccaccaacaggaggauccacccccaccuuuccaagccugaugaggugaagaacuggcccuucaaggugcuacaggggacaagccacugccaccgugcaaccccccuccccgccacccccauauauacacacaaauacucaugcauuccauagcucuggguuccugagaagaaaacugacacuucauuuagccccaaaguggacucacccaguccuaaccgaaagaccugcuguguuugcccugauuaucaugaugagcccugaacucucccacaacauggacccugaacgcagacccuguggcgucucuggaggcuguguuaaggagaaccccgccucccucagucugcagagcugggguccuggcucagcugaccuuggcugacacaggcaguuuguguaacaacgggucuguuugcaaucuacccccuagcaagucgcguggcucagagagacccugcggggaggacaaacauucugaaggcagacuguaggauugggccuuucucugcagcuggaacccggggugggggugggggugaugccaggcucccacauccacugcagagaggggccagaauuuagagcgaaugagggaggagacagcaauagauuuuucugaaaauuucuauucucugaucuuuaauuucgcaagggcggagcaagaaaacuggguaugacucuaaggaucauugcgguuagcugacacaaagagaaugaacagcgaggaaagaugagaacagaggcccuacugcccucgcaacauucuuuuuagcuccagacucacucuuauacagucccuagcuccucaaggguauccccugcuccccaccacagggcuccucuccagugcagaaauggaaggcaugcugacccuuaggcucugggguaguuuccacucccuggggcgguuaacugcaucucuccgcagaugucucuccuuuccuauaccuucuagcucagucgcauccuagaggguaguagaagguggguagggaaagucugggugguuccuguguucccacccuuggcuaacagcccaguugcgcagggugcagcuggucuguggcgaggagggaggcaauccuagacuuucggaaauggggauugguguuucacacgaggacauuuguugaaaucuaagaaagugguaauuguccagagcgauuuuagggcuugggagccgguugcuguaggaaaauaugucucacagguggggguggggugggguggggugggguggggagacuggagugggaagugcaaggugugggggagggucggggagcugaagugguggaccaccuggugggcggagccaaguguugaggauaauggaccugucgccuggauuggguuacuguuaggguacgcggaaagaucuuggaaugucuccuaggggcucccugccuggauucuggauucuuaaagcucagagccaggugcccuggucagcagguccaggcgccgaggcuagccaaccccuccugagacuaaccucgugcuucugguuucuacuugcuucacaggcucugagucaccguugaagcuggcacuggugggcgcccagccucagaaaguaggauuuaagagucuugggccuggugccccaggacccaggguauccggcacgccccuuuccuaggaugcaggcucccagguacauucccugauucggcccccuuccguuuauucggccucugcucuaaagaccccagcgcccuucuuguccucccuucccaacucacgaaaaccuccuuacccagagcuuuuagcauuuccucaaaguuuuccgaucggaugaucuuccaguugccagaaaaguuaggcauaguggcagcaagguggcuuucucuuuagaucuucaacuagaacacuggacgcugaguccuuuaggcuaaagauacuuugcugucuccuuugcagaacagauccuuccaccuggggaccaagccgcguggaggacaauugcacagccgcugggcgccagagcucuaggcuuuuauacccagcuggugcaugaggcggccccgcccccgccccgccuuccacaccaccugggggcccugcucugugaccacuucacccccauccuuuccggaaucccuccuguuucuagaaauguggguggguccaggguucuccaagagccaagauacccuucucccgcaucaguaggcggaccgagaagcgucagaaggcaagaacgggguuugugccucuggcaagaacagggcacggcucucgccugggucacggaugcucucucggccugcagggcgaacacaggucccguuucaccaguucccuaguaguucucuaccagauuuggugcucuggacagcucagcuccaggcauccggagaccccacuagcgcaagaauugucccccccccccccccccggcaaccggcagucgaaauggacucaaugaaacagcucggaauucaagcguucuuuugggugacagggaggugcugcu

SEQ ID NO: 10005 - RNA, 2501 nt, Mus musculus
auaggccagcaacagacacauaacagaugccagcgaauacuuguaacacaguggcuggugguacugcguaaucagcucucugugcacguguauucaaaaucuaugcauccaaaccagcuacucgucaaacaugcaggaaaaaaaaaagagucuguucugaacacauacagagguuuuugucacuguucccuaaacagcaugcauauacuuaggaauuauaagucaccuagagacggguuccuguguaugaaagacaugcguaggugagaugcaaagacaucauucugugugagggacuugggcaccugcagguccaggcagccucuagggguuggagacucaaacccacagacgcaggggugggguugggagcgcaacuaugguccuacuucacccccuuggcaaacaccccccuccccgcccucaggugccaaccaggaguuucuuucccccacaguaaagcuccaaccuucccuuccuaacccuuccucuuccaggagggccuccuagacugaacccugcugaaacagcggcuucucccucugcuuccucuccaccaggacuuguaaggaagcuccccuggugcccaacauccucugcccccuccaucccucccucccucccacuuugcucucagccauuccccucugccuggcacgggcuuucccaccggaucuccuggcucagaagccagcugggacaaagacccugucccugccagucuggccucuauccaguugcuccuucccccacccaucuuuugugaaagccuacaacuuggaguguacuggagaaggguacagggagaggccagucgucccccccccccccccgcccuggcccucagcucuggaaacaguuucucuuucugagaucucauugcgcauacaggcucacggggaaagugagguggaugaccagagaggguuagagcuaacucugagccaaaccgggagccaggucacugugcccucaggaaggaaagcugcacagauaaugaacacacucuguaaagagucagacuugggaguauucggggacccaggacuacauggcuaaugaugcagccgggggucaguuacaacgucaggcaagauuuccuaccgaccauaccuauucucacuggcuccaucucccacucggucugccuucauagucgcuagccugagccuaagcgguccuccuagauccucccaggacagacuccccugcuaagcagcgcucuggccugugcugugcagcgggccgggcgagcagucacucggguuaccgcuggcaaguaagccaggugcuggagcguucugaggaggggaggcugggagcaggagcuacucacacgcccgcccggcccuguggcuaccucuuuuacccguguuggggcagcacgggaugaggaaggaagccugaggccagaggauccgacugcccugagacaugaauuuuugauccaaguggccaagaguggcuacugugacacuucccggaggaaagccaccacaaggaccggagcucagcaguccccugucgucuccagcccgggcauccuuagucgcuccgcagcccagacguccccuggcuccugaaggcugcgcggcgaggacagugagcgagcagacgcguggcucagggugccgaagccggcacagagcgcugcgcgcccaccuucagagaggcgccgcugccgaccgcacccccgagugccuggggaccccaggaagcuacggugggucacugucucggucgcccacagcagccaguaucgcggcccgcucucgcccucgcccggauccuuuggcucagagaggucaagaaacuuacccaaggucacacagcaagcaagcaagcgaccgauagggccaggccuccgcacucaccuugcgagguccccuccgcgcacaccgcacgucccgcagccgcagccgagacugcggcgcaaugcgcgggcgcgagcagggccgggcgcgcgggacccagacaggggcgccagcucgccgggagccucacaaaacccccuuucuucccacgcgccccgccuuccccgccguccccggcccuugccgcccccguggggggcucugcgcggucacgggacccgcugccuucucugugcggguuccgggcgacagcgggcagagggaggacaagcgaaguaggacaagguuccgcggacgggagcccaagacuugcagcggggagggcagaaggggcggggagggagcgauggagggcgcuguggcgacgcaggauggagaguuagaacacgggagggacuucucauugguuaaagggaggaagaccggcucaaacuuagucgcgcagaggauggagggacgacaggagcuuugccccgggaaagagggcacugcugggugaaaaggggaaguccuuuucucaggccagagaaaaggcagaugaccacagccaucccucuugaggaagcuuugaucgggcugugcucccccggugcuccucucccuccccggcggaggagcugacuuugc

SEQ ID NO: 10006 - RNA, 2501 nt, Mus musculus
gcaaagucagcuccuccgccggggagggagaggagcaccgggggagcacagcccgaucaaagcuuccucaagagggauggcuguggucaucugccuuuucucuggccugagaaaaggacuuccccuuuucacccagcagugcccucuuucccggggcaaagcuccugucgucccuccauccucugcgcgacuaaguuugagccggucuuccucccuuuaaccaaugagaagucccucccguguucuaacucuccauccugcgucgccacagcgcccuccaucgcucccuccccgccccuucugcccuccccgcugcaagucuugggcucccguccgcggaaccuuguccuacuucgcuuguccucccucugcccgcugucgcccggaacccgcacagagaaggcagcgggucccgugaccgcgcagagccccccacgggggcggcaagggccggggacggcggggaaggcggggcgcgugggaagaaaggggguuuugugaggcucccggcgagcuggcgccccugucugggucccgcgcgcccggcccugcucgcgcccgcgcauugcgccgcagucucggcugcggcugcgggacgugcggugugcgcggaggggaccucgcaaggugagugcggaggccuggcccuaucggucgcuugcuugcuugcugugugaccuuggguaaguuucuugaccucucugagccaaaggauccgggcgagggcgagagcgggccgcgauacuggcugcugugggcgaccgagacagugacccaccguagcuuccugggguccccaggcacucgggggugcggucggcagcggcgccucucugaaggugggcgcgcagcgcucugugccggcuucggcacccugagccacgcgucugcucgcucacuguccucgccgcgcagccuucaggagccaggggacgucugggcugcggagcgacuaaggaugcccgggcuggagacgacaggggacugcugagcuccgguccuugugguggcuuuccuccgggaagugucacaguagccacucuuggccacuuggaucaaaaauucaugucucagggcagucggauccucuggccucaggcuuccuuccucaucccgugcugccccaacacggguaaaagagguagccacagggccgggcgggcgugugaguagcuccugcucccagccuccccuccucagaacgcuccagcaccuggcuuacuugccagcgguaacccgagugacugcucgcccggcccgcugcacagcacaggccagagcgcugcuuagcaggggagucuguccugggaggaucuaggaggaccgcuuaggcucaggcuagcgacuaugaaggcagaccgagugggagauggagccagugagaauagguauggucgguaggaaaucuugccugacguuguaacugacccccggcugcaucauuagccauguaguccuggguccccgaauacucccaagucugacucuuuacagaguguguucauuaucugugcagcuuuccuuccugagggcacagugaccuggcucccgguuuggcucagaguuagcucuaacccucucuggucauccaccucacuuuccccgugagccuguaugcgcaaugagaucucagaaagagaaacuguuuccagagcugagggccagggcgggggggggggggggacgacuggccucucccuguacccuucuccaguacacuccaaguuguaggcuuucacaaaagaugggugggggaaggagcaacuggauagaggccagacuggcagggacagggucuuugucccagcuggcuucugagccaggagauccggugggaaagcccgugccaggcagaggggaauggcugagagcaaagugggagggagggagggauggagggggcagaggauguugggcaccaggggagcuuccuuacaaguccugguggagaggaagcagagggagaagccgcuguuucagcaggguucagucuaggaggcccuccuggaagaggaaggguuaggaagggaagguuggagcuuuacugugggggaaagaaacuccugguuggcaccugagggcggggagggggguguuugccaagggggugaaguaggaccauaguugcgcucccaaccccaccccugcgucuguggguuugagucuccaaccccuagaggcugccuggaccugcaggugcccaagucccucacacagaaugaugucuuugcaucucaccuacgcaugucuuucauacacaggaacccgucucuaggugacuuauaauuccuaaguauaugcaugcuguuuagggaacagugacaaaaaccucuguauguguucagaacagacucuuuuuuuuuuccugcauguuugacgaguagcugguuuggaugcauagauuuugaauacacgugcacagagagcugauuacgcaguaccaccagccacuguguuacaaguauucgcuggcaucuguuaugugucuguugcuggccuau

SEQ ID NO: 10007 - RNA, 2501 nt, Mus musculus
gggaggcggucgaggcgggaccaaagcccacccagccggggggucccggggcgggacuggcggaggcugggcucggcuucucgaccggaguuccuugaagguggugacuucucggggaggugccaaagaaccucccaaggacccagucggcgggagcucagugucgggcgagaagacuaugagccagucgcugcgaucuuucuuggccugcggcacaaggggcagcccuggaccccgcuugcgcuucugggccagcucauggaaggacgugauuguccgauggggcaccggcuccuggcugacgucaccucuccaucccccaucaguuuucccugcaucuauuuucgaaccagaauugguguucaaacaagaagccaauuucccagauuccguuuuuaagcucgaguuuguauuuucgucuguuuuccgaccagagucacuguccucgaugguuuuccacccagcuucaguuuucucugugucaauuuuccaaaugggguuaauuuuccaacugggcucugcuuucccugcgucgauucucccaucuucggucucugagagcucagagguagcaagauccuguuccccacugucuuccucuuccuccaagccuggggaagguagguccuggcagguggucagggcguugcaguucgaguccaggucagguccagguggagaagauauuccagagcaagaaucaggagagcaacagaaacugucuggagagcaggugcuagggcccgcuggagccagaggagagcccagcuccaaggugcuaggcugaggguuugcauccucauuaccaggcaggucucgcgaguagacugacacuggagacucaucagggcuaaggucugagcaggagcugagagaggaagagcauccuggaucugaaggggaaacagccucuuccuccugggaaggguccugcugauuuucuaugcuggacccgugcuccuggcagcaucuacagggcacagcuggacuguuggaguuggcauccacaagggucccgcugcagggcccccugcuuuccuugcccccggugucucccgggggcgggggugugcucagaggccccucucguaguucaggacggcgggacaagugcaggccuagggagacaugcuggagauggaugugauugagguugcagaguaaagcccgcugaggggacagcauggugccgagggaggacgacguauggcuuucagagaaccaagaggauccagcgucucacauccaccuaccugacaguguagaugcagaccuagaaaacaggggugguugaaaccuagaucacggguaagggcacuggaggugacugaggacuagaacaggccugggaaggaucuggcugcuuugggagauauuuaaaugagauucaaaucaccacggacaggccauuaguucccacugcaguauuugcagguggagcugaacauaaccuccagggaacggagaaaggagggucaucagagaaugcaguuguacucugaucuuuguggggcugcgaagcuugaaaaaagaguggggcccagaauaugggggugcgaugcuugaaaaagaauagggcccagaauacaccgauucuuccuaaucaagcucuguccuccagccuaacccugggaggaaggggaccccgcccggaugcucuagugagguggaugguggggaacaagacgaaggguuugguuuguuaacgcaggagaggggucugggcuggagcaaggggaagcauucugcugucagcucugcaucugucccagucccuguucagcucuagccuuccuccuguguccucacccaccgcaacgccaagauuuguccauucacucugugucgucucccaucacccagccaucgcccguuucuuuauucuuuuaacugcuccucuccugugcuaucaauccauccauccauccaugcaucuauccauccauccauccgcacccucagaccgagcccuccucaccgcaguccuccuggaaucgcuccggccuugggcucgucugcguccccgcccagcagggaacagagcggaggggaggggcaccggcaaaacccacuguggcugcgcagccgcaccccuucacgcaugggcguggcauagcucaggaccgccccucaacccccacgcaacacuugacguugugccuaugucacccaucuacaaagcagacgcuuugggucucaaggaaugcuuuugccaaccuggauuccaagcugcccucucccaccccugcauucuggauaaagcugaacuccugacugccacaagaauaaaaccacaggauguugaacaauaauuuauugagacccccucccucccagccucuccaauuccggggucacuuucuccguuuguagaucuuguuugcaaguuccaugaagauggaugggggcaggggcgcagagcacugcucuaugagacucuugaggcgguuguaacugucuuccucauacuugaagaaagcagacugcagauccagcgccuc

SEQ ID NO: 10008 - RNA, 2501 nt, Mus musculus
gaggcgcuggaucugcagucugcuuucuucaaguaugaggaagacaguuacaaccgccucaagagucucauagagcagugcucugcgccccugcccccauccaucuucauggaacuugcaaacaagaucuacaaacggagaaagugaccccggaauuggagaggcugggagggagggggucucaauaaauuauuguucaacauccugugguuuuauucuuguggcagucaggaguucagcuuuauccagaaugcaggggugggagagggcagcuuggaauccagguuggcaaaagcauuccuugagacccaaagcgucugcuuuguagaugggugacauaggcacaacgucaaguguugcguggggguugaggggcgguccugagcuaugccacgcccaugcgugaaggggugcggcugcgcagccacaguggguuuugccggugccccuccccuccgcucuguucccugcugggcggggacgcagacgagcccaaggccggagcgauuccaggaggacugcggugaggagggcucggucugagggugcggauggauggauggauagaugcauggauggauggauggauugauagcacaggagaggagcaguuaaaagaauaaagaaacgggcgauggcugggugaugggagacgacacagagugaauggacaaaucuuggcguugcggugggugaggacacaggaggaaggcuagagcugaacagggacugggacagaugcagagcugacagcagaaugcuuccccuugcuccagcccagaccccucuccugcguuaacaaaccaaacccuucgucuuguuccccaccauccaccucacuagagcauccgggcgggguccccuuccucccaggguuaggcuggaggacagagcuugauuaggaagaaucgguguauucugggcccuauucuuuuucaagcaucgcacccccauauucugggccccacucuuuuuucaagcuucgcagccccacaaagaucagaguacaacugcauucucugaugacccuccuuucuccguucccuggagguuauguucagcuccaccugcaaauacugcagugggaacuaauggccuguccguggugauuugaaucucauuuaaauaucucccaaagcagccagauccuucccaggccuguucuaguccucagucaccuccagugcccuuacccgugaucuagguuucaaccaccccuguuuucuaggucugcaucuacacugucagguagguggaugugagacgcuggauccucuugguucucugaaagccauacgucguccucccucggcaccaugcuguccccucagcgggcuuuacucugcaaccucaaucacauccaucuccagcaugucucccuaggccugcacuugucccgccguccugaacuacgagaggggccucugagcacacccccgcccccgggagacaccgggggcaaggaaagcagggggcccugcagcgggacccuuguggaugccaacuccaacaguccagcugugcccuguagaugcugccaggagcacggguccagcauagaaaaucagcaggacccuucccaggaggaagaggcuguuuccccuucagauccaggaugcucuuccucucucagcuccugcucagaccuuagcccugaugagucuccagugucagucuacucgcgagaccugccugguaaugaggaugcaaacccucagccuagcaccuuggagcugggcucuccucuggcuccagcgggcccuagcaccugcucuccagacaguuucuguugcucuccugauucuugcucuggaauaucuucuccaccuggaccugaccuggacucgaacugcaacgcccugaccaccugccaggaccuaccuuccccaggcuuggaggaagaggaagacaguggggaacaggaucuugcuaccucugagcucucagagaccgaagaugggagaaucgacgcagggaaagcagagcccaguuggaaaauuaaccccauuuggaaaauugacacagagaaaacugaagcuggguggaaaaccaucgaggacagugacucuggucggaaaacagacgaaaauacaaacucgagcuuaaaaacggaaucugggaaauuggcuucuuguuugaacaccaauucugguucgaaaauagaugcagggaaaacugaugggggauggagaggugacgucagccaggagccggugccccaucggacaaucacguccuuccaugagcuggcccagaagcgcaagcgggguccagggcugccccuugugccgcaggccaagaaagaucgcagcgacuggcucauagucuucucgcccgacacugagcucccgccgacuggguccuugggagguucuuuggcaccuccccgagaagucaccaccuucaaggaacuccggucgagaagccgagcccagccuccgccagucccgccccgggaccccccggcugggugggcuuuggucccgccucgaccgccuccc

SEQ ID NO: 10009 - RNA, 2501 nt, Mus musculus
cggaugccgcagugagagagccggggaguccgggcgcagcggcaacaaaggcccgggaagcggggcgggggcggcagcggccuccugguccggugugcgccgccuccuaccuccgucggucccugcccacaccggaguggagagggcgaaaggagguucugggaaccaucccguuccggagcuuucaccugcgcccagguguaugcgggggaggugaaccugaucaacgcuccccccaaggcuauuuccacacccccuaggcucuggcaagcuaccagcagugggguuccccaaggguggcggggaacccagggucucucgccugcgagcucucugcucgugccagacuguagcggggcgggggucggacguguaaaucuuaagggggggaugagcaagauagauacagcaggggagucagcccucggggccccccggggaggauggagucccgcuccgggggggaggggcugcaaccccacccccgagguuuccaugggaagcgaaaggggggcgucauuagcucauccccacccccagucugacacucugggcgcgaggagaaagagggggaggcgcagagccccaaacaacaaagagcagagcagcaagcaggagccccucccccggaagguugggggucguggucgaggcccuucagguccccuccccuggggucucaccauuuguucccuagucggcccccagggcggagagucagaagcaaagcugccgccaccgcccgggcaggugugacagugauccccguguccccagggaucccccuaccaauacacugagguggccagagugauacacacgacagcucggcagggagaagacaagggcagcaaggacugugcagaaugauggcccgguccggcagccggcaccgagccgccgcgccacacaccggaggaaaccacacggccgcccugacacccgcccagaccgcggcggcgccaagagccaccccagcccagacaagacuggccacgcggacaccgaccgcagcccccuccccgauccgccgcccgcucccaccccuagacggucgccgacgcagacacacaaaucacacacagacacacgcacacugacagccgcgcacgcccguucacacucagugccauacgccgucccuagcuucagugcgugugugugugugugugugugcgugugugugugugugugugugugugacaugccgacaucucugccuucuuccuucucaccaguacccugcguuccuagggccccccaacuucgcgacccuggcccggcucaccccagcagggcuuauucacacaaccagagcaaccccuuacccuucguccugaggagguggagaaucggaguuccugccuuaaugccgaaccccacuuuuaaaaccaagagucuuaagcagaaccccaucaacauuacaggcugaaaacaggucauccuucagcucccaaacgcagcggccuaucccuagcacaccgguacucacagacuucaaccuagccaaaaggagcguggauggugggggagacuacgggacagagaacacuauuccauuggcgaguguggagagaaaccaagaugggguuagggacccccaacagccuccuccgcacggccagagcgcucuuuacuaugccccaacagcuucucucagacacccccgaguuucacagacgcccacauagugcguccccucucccucgccucucgguaccaagccugucucccaggacugcugccagguuccccuaggacuucucgggcccaccagcucccccaucacugacgcgggacgcacggguucuccggguccccgacucacugcugauuggagcuguuccaguauaccgcaugccgguuucccagugcgcccccaggccccugggccagcagcggcagcagcggcacgggcacgagcagcagcagcagcagcagcggagccgccgccauccccggagccgccgccgccgccgccccccgacugagccccgcacucccggcuucucagcuucccagcucccugcugccgccgcugccagcccccaaucuuagucacgcccacaauccuucccuccgcccuucugggcgcgcccccgaagccccgccccuggcgcgcucacgcggggcuccgccccacuugagcccagagcgcgccgcgcgugggcgacccauacuguguagccccuuuaggaacaacgcgccucuccucucuccuaggugauuugcugcagagguuugcgucuuuaggucccccaagcuuggaguucacagaaggauuuggaagccaagaccuggacauacaucugguguagguccacaccuuucuccauagagugugggggcguugagcgaagaucuacgucuggaauaagcaagaguagacccauaucggaccucuacuuccuccaccccuuuccaugugugcaaggaguuaaauggacacaagauggggaagccuucaggugguaccaagagcuaacagcuggcugccugaa

SEQ ID NO: 10010 - RNA, 2501 nt, Mus musculus
uucaggcagccagcuguuagcucuugguaccaccugaaggcuuccccaucuuguguccauuuaacuccuugcacacauggaaagggguggaggaaguagagguccgauaugggucuacucuugcuuauuccagacguagaucuucgcucaacgcccccacacucuauggagaaagguguggaccuacaccagauguauguccaggucuuggcuuccaaauccuucugugaacuccaagcuugggggaccuaaagacgcaaaccucugcagcaaaucaccuaggagagaggagaggcgcguuguuccuaaaggggcuacacaguaugggucgcccacgcgcggcgcgcucugggcucaaguggggcggagccccgcgugagcgcgccaggggcggggcuucgggggcgcgcccagaagggcggagggaaggauugugggcgugacuaagauugggggcuggcagcggcggcagcagggagcugggaagcugagaagccgggagugcggggcucagucggggggcggcggcggcggcggcuccggggauggcggcggcuccgcugcugcugcugcugcugcucgugcccgugccgcugcugccgcugcuggcccaggggccugggggcgcacugggaaaccggcaugcgguauacuggaacagcuccaaucagcagugagucggggacccggagaacccgugcgucccgcgucagugaugggggagcuggugggcccgagaaguccuaggggaaccuggcagcaguccugggagacaggcuugguaccgagaggcgagggagaggggacgcacuaugugggcgucugugaaacucgggggugucugagagaagcuguuggggcauaguaaagagcgcucuggccgugcggaggaggcuguugggggucccuaaccccaucuugguuucucuccacacucgccaauggaauaguguucucugucccguagucucccccaccauccacgcuccuuuuggcuagguugaagucugugaguaccggugugcuagggauaggccgcugcguuugggagcugaaggaugaccuguuuucagccuguaauguugaugggguucugcuuaagacucuugguuuuaaaagugggguucggcauuaaggcaggaacuccgauucuccaccuccucaggacgaaggguaagggguugcucugguugugugaauaagcccugcuggggugagccgggccagggucgcgaaguuggggggcccuaggaacgcaggguacuggugagaaggaagaaggcagagaugucggcaugucacacacacacacacacacacacacgcacacacacacacacacacacgcacugaagcuagggacggcguauggcacugagugugaacgggcgugcgcggcugucagugugcgugugucugugugugauuugugugucugcgucggcgaccgucuaggggugggagcgggcggcggaucggggagggggcugcggucgguguccgcguggccagucuugucugggcugggguggcucuuggcgccgccgcggucugggcgggugucagggcggccgugugguuuccuccgguguguggcgcggcggcucggugccggcugccggaccgggccaucauucugcacaguccuugcugcccuugucuucucccugccgagcugucguguguaucacucuggccaccucaguguauugguagggggaucccuggggacacggggaucacugucacaccugcccgggcgguggcggcagcuuugcuucugacucuccgcccugggggccgacuagggaacaaauggugagaccccaggggaggggaccugaagggccucgaccacgacccccaaccuuccgggggaggggcuccugcuugcugcucugcucuuuguuguuuggggcucugcgccucccccucuuucuccucgcgcccagagugucagacuggggguggggaugagcuaaugacgccccccuuucgcuucccauggaaaccucgggggugggguugcagccccucccccccggagcgggacuccauccuccccggggggccccgagggcugacuccccugcuguaucuaucuugcucaucccccccuuaagauuuacacguccgacccccgccccgcuacagucuggcacgagcagagagcucgcaggcgagagacccuggguuccccgccacccuuggggaaccccacugcugguagcuugccagagccuaggggguguggaaauagccuuggggggagcguugaucagguucaccucccccgcauacaccugggcgcaggugaaagcuccggaacgggaugguucccagaaccuccuuucgcccucuccacuccggugugggcagggaccgacggagguaggaggcggcgcacaccggaccaggaggccgcugccgcccccgccccgcuucccgggccuuuguugccgcugcgcccggacuccccggcucucucacugcggcauccg

SEQ ID NO: 10011 - RNA, 2501 nt, Mus musculus
cugcccauauauauauguuuauguauaucuuccacccauggguucccccccagagagccaucuccaucuggccucacuucucuaaagccaaacaucucagucauuugcuccacacuuccuguuuggugcuuguuucuugauugucacucuccaguuuguagcugugcaagugugggugugggagaugggcuggggacuucucugccucuuccuucuaaacuggcagggcuuucacuuccuccccagacucccaguucugccuucuaaaggcuguuugggucagaagacacccccacccuuggguguccuuucugaaccacaggaaaacagaacucgcugucuccgaagugccuugcagcuccuuaggaacaaagggaagugguggugggggcgcugggguauguugaguaguaacugagacaggcagagaggcccaguccugcucucccaagauggaagagaggaccucaguccugccuggcaccaugaacagcuaagcggggaucuucucuuucaucagugucuucucccccagaaucccaccagaugauaguggugcucagccuaccccagacgcccucagcuguacccacaggagaacacugagacacggaggggccugaugcuucccauugcaucucucugaaccucaggcuccucccaaagcuuuaugucaauccuguagaggauuaaaaacguguaaaauacaggguggguuaauaccugaaaucccagcacucaagagauagaggcagaagaggcacaaguuugaggccagccuggguuaugggagagccugucuaauauauauauauauuuucuuuauauauauauauauaaagaaaauauagguagggguaacaaaccaagcuugaggaauucuaccuuccaggcagaaagaaagccuggaagccacuguccccacgaccagcacaggauaaaucucccccauguccuuuggcucuuucuauguuguugaauaagcccucagccccuaaaauaaccuguagagaagcagucucccaguuccuccagaagagaccaggcaggcugcugggccugaagccagagcccacagagaggccuagaccuacaaggcagagugcaaggaagguaaacacagugccccuacccuacccuccgccugguccaccugcuaaucagggagggcuggggcagggggcggaggcacaguuccaagaggucccacauccuuugcugucaaacucacaggauugggauggauguggguguuggcauucugcaugcuagggcuaguuggcuaaaggaguaaguuugugaggcgggaacacccaugacucagagcccaugaugucagacccuucaccgucgggucacugucauuacacacgacauggaauguaguagaacuaaggaaagccacgcgaggugccacaacuaaagcagagagagccaguggcauaaaggacucuccagaagggacuacuacuguuccacuagggcgcgcccucuggguaucucuuuuuggagcgacccgggaugcaguugaguaagacugggaacacugggaaccagacaccagagucagguuucaggaaaacacacuguccuguacucagacuugagguaacuggccagacacagacaggagcacgcaguuauaggcgcuagacgcaacagggggcgcgcgaaccuccaccgcgucagcacaggugagucagcccaggcuagcagccgguaccggcggggcucacucugcgaacggaaccagacagugucacauuccccacgcccgcuccggguuccucuuacccagcgcgcggcagcucccgaggaccagcgcgaccgcgggcgcggccagcagggcgaccaacagcgugcagccgacggucagcaugcuuccuucuacgcgggacggcgggcggcagagcggcuccgcagccggggccgggcggccggcagacuggggcagcgagagcagucgcccucggccucgggcuccacacucagcucgcacugcgagcgcucgccccggcguggcucagaucggugugggcgcgacuucccacaugcacgugacacacagcagccggccguccuggcaacagugaaacauuugaggaaccggugcugaagcuccucuuggcagccccggcucgcgguuacgaaagcccaguaggauggcgcaaucggccagcgcuccgggccaccggaggggguuacuuccugcagccgcgccacaccugagcccccagggacccccaccagggccccuccccagguuuugacgcugagauaaggagaaauaucccccuccuuccuuccauccgcgccuccgcuugaguuuugcuuucaugagcgccagccaguggcucuggcuguuaaaguagaaggcaggucaguguccugggugcuuacgggaaucaaacagggaauccgaaaagacaccgaugucugcuucgagcccagagauugugauuuaauuggucugaaggaaaacuuaggcguccauaaccuga

SEQ ID NO: 10012 - RNA, 2501 nt, Mus musculus
ucagguuauggacgccuaaguuuuccuucagaccaauuaaaucacaaucucugggcucgaagcagacaucggugucuuuucggauucccuguuugauucccguaagcacccaggacacugaccugccuucuacuuuaacagccagagccacuggcuggcgcucaugaaagcaaaacucaagcggaggcgcggauggaaggaaggagggggauauuucuccuuaucucagcgucaaaaccuggggaggggcccuggugggggucccugggggcucagguguggcgcggcugcaggaaguaacccccuccgguggcccggagcgcuggccgauugcgccauccuacugggcuuucguaaccgcgagccggggcugccaagaggagcuucagcaccgguuccucaaauguuucacuguugccaggacggccggcugcugugugucacgugcaugugggaagucgcgcccacaccgaucugagccacgccggggcgagcgcucgcagugcgagcugaguguggagcccgaggccgagggcgacugcucucgcugccccagucugccggccgcccggccccggcugcggagccgcucugccgcccgccgucccgcguagaaggaagcaugcugaccgucggcugcacgcuguuggucgcccugcuggccgcgcccgcggucgcgcugguccucgggagcugccgcgcgcuggguaagaggaacccggagcgggcguggggaaugugacacugucugguuccguucgcagagugagccccgccgguaccggcugcuagccugggcugacucaccugugcugacgcgguggagguucgcgcgcccccuguugcgucuagcgccuauaacugcgugcuccugucugugucuggccaguuaccucaagucugaguacaggacaguguguuuuccugaaaccugacucuggugucugguucccaguguucccagucuuacucaacugcaucccgggucgcuccaaaaagagauacccagagggcgcgcccuaguggaacaguaguagucccuucuggagaguccuuuaugccacuggcucucucugcuuuaguuguggcaccucgcguggcuuuccuuaguucuacuacauuccaugucguguguaaugacagugacccgacggugaagggucugacaucaugggcucugagucauggguguucccgccucacaaacuuacuccuuuagccaacuagcccuagcaugcagaaugccaacacccacauccaucccaauccugugaguuugacagcaaaggaugugggaccucuuggaacugugccuccgcccccugccccagcccucccugauuagcagguggaccaggcggaggguaggguaggggcacuguguuuaccuuccuugcacucugccuuguaggucuaggccucucugugggcucuggcuucaggcccagcagccugccuggucucuucuggaggaacugggagacugcuucucuacagguuauuuuaggggcugagggcuuauucaacaacauagaaagagccaaaggacaugggggagauuuauccugugcuggucguggggacaguggcuuccaggcuuucuuucugccuggaagguagaauuccucaagcuugguuuguuaccccuaccuauauuuucuuuauauauauauauauaaagaaaauauauauauauauuagacaggcucucccauaacccaggcuggccucaaacuugugccucuucugccucuaucucuugagugcugggauuucagguauuaacccacccuguauuuuacacguuuuuaauccucuacaggauugacauaaagcuuugggaggagccugagguucagagagaugcaaugggaagcaucaggccccuccgugucucaguguucuccuguggguacagcugagggcgucugggguaggcugagcaccacuaucaucuggugggauucugggggagaagacacugaugaaagagaagauccccgcuuagcuguucauggugccaggcaggacugagguccucucuuccaucuugggagagcaggacugggccucucugccugucucaguuacuacucaacauaccccagcgcccccaccaccacuucccuuuguuccuaaggagcugcaaggcacuucggagacagcgaguucuguuuuccugugguucagaaaggacacccaagggugggggugucuucugacccaaacagccuuuagaaggcagaacugggagucuggggaggaagugaaagcccugccaguuuagaaggaagaggcagagaaguccccagcccaucucccacacccacacuugcacagcuacaaacuggagagugacaaucaagaaacaagcaccaaacaggaaguguggagcaaaugacugagauguuuggcuuuagagaagugaggccagauggagauggcucucugggggggaacccauggguggaagauauacauaaacauauauauaugggcag

SEQ ID NO: 10013 - RNA, 2501 nt, Mus musculus
uaggacgagggcccagcaccuucagcaggaguuuuaguucuuucugcucucacuagcuguggucacucgaaucaugaacaucugcucuuucaggcucaaauggcucaagaaaagcaggagucgggguagggccuagucuauguugaggguggugggugggcacaggcagccaggcuggcaaagacaggaugaaaguguagcauuguguguagagaggagaguugccagccgggucacaugccaggaucucaugcaguucuaucucuggccaaaacgcuaggggucugagagucaccccccccccccccccacggcuaaccugcuucaaggagaaaaggaagucuucuuggagauuggcuuguucuauuuaacucuagaaacuggggggaaauacccuguuccuuuuccucuucauuagucuuuuaauuauuuuguuugagacaugauuuuacucuguaguccauacuggcccuguauucacagugugcuucaggcugaccucaaacuuguggcaguccugucucagccuccugagagcugggauugcaagcgugugguccaaugcccaucuugcuuguuauuccuuuaacugcucacaccgcuccauuccucagcgggggcaacucugcgaguagcucccccccaccccuccuucacuaucucuuuaggauacuccaacaacuagaguucucuggcuguugugaaggugcccugcccuuccugugaaaugcucugagcugauucuaaugccucuuuuuuccucuuuccaaauuguuucuucucagaagagauuugugacuccucauuuucuuuuggaucccuuggucccaucuuccucucgcuuucuagauaauccccccccccaccucguccuuccaauaaacuuuaaucccucaccuacuaugugcuggauacagaauggggccugagaagcacaaaaacaggguguagaaaccaggcauggggaggcagagccaagcaggucuaaccucagcuacagagugaguuugagauaggucuggccacgugaaaccuugucucaaaaaaaaaaguaaauaaaaauaagcaauaacaacaaaaaaaguugugggaauccuucaggcguuccagaaacaacuuagcuuguuuucuccaacgucuccccaccucucuccuaauccugaaagcccuuuguacacuauaaagagcugagcaaacguuuagucguguuccuuucagggaaauggaccagcugccccugccccuuggcagguaauggaguuauccuuugaucagcagagggucggggucugagucgggcaggacugcagcacgugucccuucucaccccugcucucccuaaccagcagagugcguaaacaaagacgggcaggagggcugcccgggacuagggcaguggggaaagaguggacuggagaacuguagcuggccgaguguccuacacuccugagcauucacacacuggccucuggcuagcucucccugucgcagagauagcaguaaucgcuggguuagagaggaaaaggaaaagaauggaaggaucuccuccauagucuuucucccaccccaugccuccccccccuaccccccagccccuaggcuucccuuucugaaaccucuccucccccacauaaguacacauggcuacggguggacauuagcacagacccaguuguaccuacccccaucugcagccaggauccaagucaccuuuaacaggagagcgaagaacaacauauuauccccacaaugggguacaagggaccaggaauuugggguuuagaagagagagguggagagggagggagagagaggaguuucuggcguucuaucucuuuucuucuugucucugucucugcagacuuccagggacuugauuuuccacagguuaacacgaacuucuggaucccaggauaaauuucuuccucucucacuuucucucucuuccucucucugcccucuccguaugucccuucguaaucuccacaccacuuacuggccagcaacuucacaguugccucccgcuuuuaagguggcucgaaaccgguguacgugaggagggggguggugccugggcugcagccgagcagcuccuuaaauagcggauuaggcaugcaggauggcccagcagagcccagcgcccuggccuuggcucaggacccuggagugagcucuuccuuugcuauuuacacugccgcucguacggguguccccuggaacucucggucagggaagggggguuucgcaccucucccucccaggacaccguguucucauuccccugccugaggagcacaucccugggugguaugggacugcugguggggaaccuguuucugaaaccaagagaaguugagcugguuggaaccagaaagaauucagauucgggagauaggagaacagaaguuggaggcucagggagcagguggggaguggaaagucaaacuuuaaaaucuggauuguggagagcaagaaguggggcgaggagaauauuugucuuc

SEQ ID NO: 10014 - RNA, 2501 nt, Mus musculus
gaagacaaauauucuccucgccccacuucuugcucuccacaauccagauuuuaaaguuugacuuuccacuccccaccugcucccugagccuccaacuucuguucuccuaucucccgaaucugaauucuuucugguuccaaccagcucaacuucucuugguuucagaaacagguuccccaccagcagucccauaccacccagggaugugcuccucaggcaggggaaugagaacacgguguccugggagggagaggugcgaaaccccccuucccugaccgagaguuccaggggacacccguacgagcggcaguguaaauagcaaaggaagagcucacuccaggguccugagccaaggccagggcgcugggcucugcugggccauccugcaugccuaauccgcuauuuaaggagcugcucggcugcagcccaggcaccaccccccuccucacguacaccgguuucgagccaccuuaaaagcgggaggcaacugugaaguugcuggccaguaagugguguggagauuacgaagggacauacggagagggcagagagaggaagagagagaaagugagagaggaagaaauuuauccugggauccagaaguucguguuaaccuguggaaaaucaagucccuggaagucugcagagacagagacaagaagaaaagagauagaacgccagaaacuccucucucucccucccucuccaccucucucuucuaaaccccaaauuccuggucccuuguaccccauuguggggauaauauguuguucuucgcucuccuguuaaaggugacuuggauccuggcugcagauggggguagguacaacugggucugugcuaauguccacccguagccauguguacuuaugugggggaggagagguuucagaaagggaagccuaggggcugggggguaggggggggaggcauggggugggagaaagacuauggaggagauccuuccauucuuuuccuuuuccucucuaacccagcgauuacugcuaucucugcgacagggagagcuagccagaggccagugugugaaugcucaggaguguaggacacucggccagcuacaguucuccaguccacucuuuccccacugcccuagucccgggcagcccuccugcccgucuuuguuuacgcacucugcugguuagggagagcaggggugagaagggacacgugcugcaguccugcccgacucagaccccgacccucugcugaucaaaggauaacuccauuaccugccaaggggcaggggcagcugguccauuucccugaaaggaacacgacuaaacguuugcucagcucuuuauaguguacaaagggcuuucaggauuaggagagagguggggagacguuggagaaaacaagcuaaguuguuucuggaacgccugaaggauucccacaacuuuuuuuguuguuauugcuuauuuuuauuuacuuuuuuuuuugagacaagguuucacguggccagaccuaucucaaacucacucuguagcugagguuagaccugcuuggcucugccuccccaugccugguuucuacacccuguuuuugugcuucucaggccccauucuguauccagcacauaguaggugagggauuaaaguuuauuggaaggacgagguggggggggggauuaucuagaaagcgagaggaagaugggaccaagggauccaaaagaaaaugaggagucacaaaucucuucugagaagaaacaauuuggaaagaggaaaaaagaggcauuagaaucagcucagagcauuucacaggaagggcagggcaccuucacaacagccagagaacucuaguuguuggaguauccuaaagagauagugaaggaggggugggggggagcuacucgcagaguugcccccgcugaggaauggagcggugugagcaguuaaaggaauaacaagcaagaugggcauuggaccacacgcuugcaaucccagcucucaggaggcugagacaggacugccacaaguuugaggucagccugaagcacacugugaauacagggccaguauggacuacagaguaaaaucaugucucaaacaaaauaauuaaaagacuaaugaagaggaaaaggaacaggguauuuccccccaguuucuagaguuaaauagaacaagccaaucuccaagaagacuuccuuuucuccuugaagcagguuagccguggggggggggggggggugacucucagaccccuagcguuuuggccagagauagaacugcaugagauccuggcaugugacccggcuggcaacucuccucucuacacacaaugcuacacuuucauccugucuuugccagccuggcugccugugcccacccaccacccucaacauagacuaggcccuaccccgacuccugcuuuucuugagccauuugagccugaaagagcagauguucaugauucgagugaccacagcuagugagagcagaaagaacuaaaacuccugcugaaggugcugggcccucguccua

SEQ ID NO: 10015 - RNA, 2501 nt, Mus musculus
ucagugcguugcuuugcuacugcuuuuguuuacaggcugaauaaacagugucuuguggcagcuuugcccuuagcccaggcccacuggaccauggaacugguucugaagaagggucaguauaaggugccguucccucuuuuccacugcccuucccagcagggggcaucuggccccaggucuagucagaugcuccugagucagaggacagcggacacucuaggcugaggucauccuaucuucucucugcucugcaucucucccucucacaccagguucugccuuuuagacaaacauaagaaggggaaaaggccuuguuuuguuucuguagcccuucacuguccucugguuuccccucggaccuguaggaagcccuuccugauugcuaacuacauuuccuggcauuaugaaguucggggaagacaggagauaugaggugacacccacugcugcuuuuaaaauaaacaaaaauagaaagcaagagaaucguugggggagcucucuguaggauucgagagcagguagcaguggcccucgagagcacacucggucaaggcuucccuuagcuugcucugaggccucuccaaccguuauguuuuggccccuucaagaggggccugggggcucaacacuaguucucugcuugucucaguagacugcuuugagaugaguacagcucuccagcugcaaguguaucugcuucgacaccauaaaaggcuuuauuuacccaaauacaagggcagaaaacaagugucuagugacaaaagcagaacagguuagagcuaagggagggcuucccacucgguugguuuugggugagggcaggcaagggaggaagggccagucugaaagggacaggaacaggccaccaugaucagacagucacagggaagcaaguucaguuucucagcauucuuguuauugagucaagaguuggggcuucacaaagggggaagggaucuggauuccacgaccuggcuuuauauucugaccccaugugccgggcugugguuuccuguaaaacuacagagccaaagccauggagacacacacacaggcgcucacaguccuaacuccauucccccugucuacaaauaaagaugggcagaauaugaguuccuugaauuuuuuuuuucuuuuuucuuuuuacccuuuaaguggaguggacggugaggaacaagccugguucaggaugcuagcuccuacaagaauccggcauucaccgcugcucuaccccuggucccagagacugccuccaaguuguguuuucuaugauuuagggagacugugcuacucaggggaccuacauaugcccuccucccucccaacccccgcaggaacggagagaguggugggcugggguggggaagacaggaaggaucgagggauacgaauaccaguguguaacaaaaacaaaccccaccaaaacccccaaccguauuuuagggggccagaauagagggagaggcggcggaugucagaacuucugagaaagguguccgcaaaggcacaucaaauaaguaaacuccuaaaccccacucagguucucucacucgggggugacuuuuuucugcagacacaggacuuuugcgaccccugaacuugcagagauggaggcggggcaagccggagaacuagccgccguggggacagggucccgacggcucgcgcaagggcgggcgccuaccuccuucucggagacguagagcuggucgccuuucagcaccacauagcgguuuuuccaaaucucccugaaaaucccuuucccgcagaauuuccggacccagccgaccuucucgggcgccgcagacugaugguuuccauccggaggccccugcccggggcgagacgaggagcggcggcucagacuggucucugcgcccuccccgccccccccgccagccccagccccauuguccgcgcgccgcgcacucacccgcuugccggagccgcucuucuucauggcgggaucgggcggccgcgcccgcugcucgcucggcggcucgugcuagccgcaggccgggcccccgcugcccccgccgcccccgucgcccaugcccgcccccgccgcaccggccccggccaccgccgcugacgucgcgggcuccgaaugaagggcggaccgcggcgccgccgccgugcgcuccccgccccccgccuuuguuuccgacccggcacccggcggaggcgcgagcggauaaccgggaggcgcggcggugggggcgggcccgaggcguggcgagcgggauggagcggaggcgccgugggagagcggccgccucggacccgcagacuccggcuggcggagccccgggagucuccacucucgaccuacugccgggcggacgugagcgccccgcgaggccugcgguaaacacgcgugcagcggcggggaggcccggaggacgcucggaccgcgagcucuucugaguccuguguuucugauguggcuuggagggagcccaaguuugagcgcggcuuuccucaccacuccugggucucug

SEQ ID NO: 10016 - RNA, 2501 nt, Mus musculus
cagagacccaggaguggugaggaaagccgcgcucaaacuugggcucccuccaagccacaucagaaacacaggacucagaagagcucgcgguccgagcguccuccgggccuccccgccgcugcacgcguguuuaccgcaggccucgcggggcgcucacguccgcccggcaguaggucgagaguggagacucccggggcuccgccagccggagucugcggguccgaggcggccgcucucccacggcgccuccgcuccaucccgcucgccacgccucgggcccgcccccaccgccgcgccucccgguuauccgcucgcgccuccgccgggugccgggucggaaacaaaggcggggggcggggagcgcacggcggcggcgccgcgguccgcccuucauucggagcccgcgacgucagcggcgguggccggggccggugcggcgggggcgggcaugggcgacgggggcggcgggggcagcgggggcccggccugcggcuagcacgagccgccgagcgagcagcgggcgcggccgcccgaucccgccaugaagaagagcggcuccggcaagcgggugagugcgcggcgcgcggacaauggggcuggggcuggcggggggggcggggagggcgcagagaccagucugagccgccgcuccucgucucgccccgggcaggggccuccggauggaaaccaucagucugcggcgcccgagaaggucggcuggguccggaaauucugcgggaaagggauuuucagggagauuuggaaaaaccgcuauguggugcugaaaggcgaccagcucuacgucuccgagaaggagguaggcgcccgcccuugcgcgagccgucgggacccuguccccacggcggcuaguucuccggcuugccccgccuccaucucugcaaguucaggggucgcaaaaguccugugucugcagaaaaaagucacccccgagugagagaaccugagugggguuuaggaguuuacuuauuugaugugccuuugcggacaccuuucucagaaguucugacauccgccgccucucccucuauucuggcccccuaaaauacgguuggggguuuuggugggguuuguuuuuguuacacacugguauucguaucccucgauccuuccugucuuccccaccccagcccaccacucucuccguuccugcggggguugggagggaggagggcauauguagguccccugaguagcacagucucccuaaaucauagaaaacacaacuuggaggcagucucugggaccagggguagagcagcggugaaugccggauucuuguaggagcuagcauccugaaccaggcuuguuccucaccguccacuccacuuaaaggguaaaaagaaaaaagaaaaaaaaaauucaaggaacucauauucugcccaucuuuauuuguagacagggggaauggaguuaggacugugagcgccugugugugugucuccauggcuuuggcucuguaguuuuacaggaaaccacagcccggcacauggggucagaauauaaagccaggucguggaauccagaucccuucccccuuugugaagccccaacucuugacucaauaacaagaaugcugagaaacugaacuugcuucccugugacugucugaucaugguggccuguuccugucccuuucagacuggcccuuccucccuugccugcccucacccaaaaccaaccgagugggaagcccucccuuagcucuaaccuguucugcuuuugucacuagacacuuguuuucugcccuuguauuuggguaaauaaagccuuuuauggugucgaagcagauacacuugcagcuggagagcuguacucaucucaaagcagucuacugagacaagcagagaacuaguguugagcccccaggccccucuugaaggggccaaaacauaacgguuggagaggccucagagcaagcuaagggaagccuugaccgagugugcucucgagggccacugcuaccugcucucgaauccuacagagagcucccccaacgauucucuugcuuucuauuuuuguuuauuuuaaaagcagcagugggugucaccucauaucuccugucuuccccgaacuucauaaugccaggaaauguaguuagcaaucaggaagggcuuccuacagguccgaggggaaaccagaggacagugaagggcuacagaaacaaaacaaggccuuuuccccuucuuauguuugucuaaaaggcagaaccuggugugagagggagagaugcagagcagagagaagauaggaugaccucagccuagaguguccgcuguccucugacucaggagcaucugacuagaccuggggccagaugcccccugcugggaagggcaguggaaaagagggaacggcaccuuauacugacccuucuucagaaccaguuccaugguccagugggccugggcuaagggcaaagcugccacaagacacuguuuauucagccuguaaacaaaagcaguagcaaagcaacgcacuga

SEQ ID NO: 10017 - RNA, 2501 nt, Mus musculus
aguuggcagagaugggggagggucucugaacuaugcuugccguccaucuucaaagccggccaccucaguguauuauguguagaagaaauucaauggaauccucaguaaagagaggaugagagcagugagugacuggcaucacacaaaaucaccaccagcagucuuaaaggcauuacugggaauacugaguucauuacugggaaugcuggagggccugaguggcagcuuauaagcuacaguuggauauaugacuuggccaucaucuuucuuuauacucucccucccuugguauccaauauuuccauauuccauccuuauuuugcucaucguuccugcugccuuagcucccacaccccacugccaccaacguuccuggaauuuuggaccuagcuauuuuuaaaacugucaacucaguaggcaccucccuccuccucucagcuguccaguacuugggccaaccauauacucucccuccccccuccccccacaccaaaccuccucuggcucucugaccugagugagacugcagccauuccggggcaaucauggagaaagagaugggggacccccuggcuggagcagaccaacagaauaggcaacuauggcucgagaacccaguaucagaguaaugcuugaccucgggaaacaguaaguccagaugaaaugucgaucacuuugauaagcuuuugggucaaggccagaacuucauaaaguuacagacaucuguucugaaaacuaagaucuccccuuagcaacuaccccagucuucacuuuuccucuugccuagauguuuucuaauccauggccauuugauguuuaaugcugccucucucuggcuuuccuauuuuccucuccaucuuauuacaccaagaccuugggagagggggagggggcagugcuaaggacugggcccagggccuugagcaugguaaacacucagcuaccaucgaguuacacucccaucccuaccucaagaccucucugaccuccugcucauaugcuuaucccaaaguaggguuuugacaggagaaaaggagacagacccucccccauaucuguucuccucaaaagaccaggagugucuggauugggcuuuucagcugggucuggaaaaacacaugaacuguuagacagaaacauauauuaauuugaaugcuugauuuguaccccauccugugagagggaucguacugucagcccucuggagaggcugagagaccggcucuccuuucacugggaaggugauaucguagacagggcgucugccuaccauguuacccuuugugcccuucuaacacagugaagaaaaugaaacggcaggugguuucuggugggaaggauccauaagaaguauguucuuaaagcgugaucagauccuggugcuacuggggacccacugacauggucagaaccucacuuucucuagggguccuccauuuuuggcacaucugcuauuugguagucaggauggggcaguacacuggacucugcacacugaggucacucaaccuucccuccaccaccaccccgcccccguaggcauauugcacaagggaccugaagguggccgcaggggcagggcacagaggcucaccagccacgcucacccucuggaagccuccuucuucccaagauccagucugucucauuuuuguuuuggucucuucagaugcucucucuacccaccaucuugacuggucuccaacccuucucuuuccccacacucagccaaauuucuucuuccagucacagaaguacccagagaaauucacuagguaggaggcucaucaucugggaagaaccggugccuggggggaccuggcuggauagguaugggccaguccccuaguccccgguccccccacggcagcccuccaacucuaagcacccucacucuccugcugcuccucuguggacaggguaaggaagggccagggaaggguuggacauauccagagguuaggaugcuggguaggaaugagcgcgcgggggugggggugggugggggugugggggugugggggguggggggagagugaggagggaugugugcugagucccagcaccucccaacucugaaagaggccugucuuguuucccauuuaacuugaagaaggacacagauggcguccuuagaccccagggaaaagaagucugacugcuuuacacguuuuuaguagaggaaaggagggaaggaggcaaggauugggagaaugaagguugagauugggaaagcggccacgcugagugguaggaacggugggauggcggaugguuuuuggcaguuaggugcauacuggacuuggauagaaccugugucucauuucacugcccucucccuuccguccccagcucacucccagugcaagauccuccgcugcaaugccgaguaugucucguccacucugagucuucggggagguggcucaccggacacgccgcguggaggcggccguggugggcuggccucagguggcuugugucgcgcccugcgcuccuac

SEQ ID NO: 10018 - RNA, 2501 nt, Mus musculus
guaggagcgcagggcgcgacacaagccaccugaggccagcccaccacggccgccuccacgcggcguguccggugagccaccuccccgaagacucagaguggacgagacauacucggcauugcagcggaggaucuugcacugggagugagcuggggacggaagggagagggcagugaaaugagacacagguucuauccaaguccaguaugcaccuaacugccaaaaaccauccgccaucccaccguuccuaccacucagcguggccgcuuucccaaucucaaccuucauucucccaauccuugccuccuucccuccuuuccucuacuaaaaacguguaaagcagucagacuucuuuucccuggggucuaaggacgccaucuguguccuucuucaaguuaaaugggaaacaagacaggccucuuucagaguugggaggugcugggacucagcacacaucccuccucacucuccccccaccccccacacccccacacccccacccacccccacccccgcgcgcucauuccuacccagcauccuaaccucuggauauguccaacccuucccuggcccuuccuuacccuguccacagaggagcagcaggagagugagggugcuuagaguuggagggcugccguggggggaccggggacuaggggacuggcccauaccuauccagccagguccccccaggcaccgguucuucccagaugaugagccuccuaccuagugaauuucucuggguacuucugugacuggaagaagaaauuuggcugaguguggggaaagagaaggguuggagaccagucaagaugguggguagagagagcaucugaagagaccaaaacaaaaaugagacagacuggaucuugggaagaaggaggcuuccagagggugagcguggcuggugagccucugugcccugccccugcggccaccuucaggucccuugugcaauaugccuacgggggcgggguggugguggagggaagguugagugaccucagugugcagaguccaguguacugccccauccugacuaccaaauagcagaugugccaaaaauggaggaccccuagagaaagugagguucugaccaugucaguggguccccaguagcaccaggaucugaucacgcuuuaagaacauacuucuuauggauccuucccaccagaaaccaccugccguuucauuuucuucacuguguuagaagggcacaaaggguaacaugguaggcagacgcccugucuacgauaucaccuucccagugaaaggagagccggucucucagccucuccagagggcugacaguacgaucccucucacaggaugggguacaaaucaagcauucaaauuaauauauguuucugucuaacaguucauguguuuuuccagacccagcugaaaagcccaauccagacacuccuggucuuuugaggagaacagauaugggggagggucugucuccuuuucuccugucaaaacccuacuuugggauaagcauaugagcaggaggucagagaggucuugagguagggaugggaguguaacucgaugguagcugaguguuuaccaugcucaaggcccugggcccaguccuuagcacugcccccucccccucucccaaggucuugguguaauaagauggagaggaaaauaggaaagccagagagaggcagcauuaaacaucaaauggccauggauuagaaaacaucuaggcaagaggaaaagugaagacugggguaguugcuaaggggagaucuuaguuuucagaacagaugucuguaacuuuaugaaguucuggccuugacccaaaagcuuaucaaagugaucgacauuucaucuggacuuacuguuucccgaggucaagcauuacucugauacuggguucucgagccauaguugccuauucuguuggucugcuccagccagggggucccccaucucuuucuccaugauugccccggaauggcugcagucucacucaggucagagagccagaggagguuugguguggggggaggggggagggagaguauaugguuggcccaaguacuggacagcugagaggaggagggaggugccuacugaguugacaguuuuaaaaauagcuagguccaaaauuccaggaacguugguggcaguggggugugggagcuaaggcagcaggaacgaugagcaaaauaaggauggaauauggaaauauuggauaccaagggagggagaguauaaagaaagaugauggccaagucauauauccaacuguagcuuauaagcugccacucaggcccuccagcauucccaguaaugaacucaguauucccaguaaugccuuuaagacugcugguggugauuuugugugaugccagucacucacugcucucauccucucuuuacugaggauuccauugaauuucuucuacacauaauacacugagguggccggcuuugaagauggacggcaagcauaguucagagacccucccccaucucugccaacu

SEQ ID NO: 10019 - RNA, 2501 nt, Mus musculus
uaaaagaaaagucuucaaagaaaauauuuuaaaacauuaacugaauaugaauacuuugagaacuuaaaaauguauauucaaauaauaaaugaaauuccagaaauaagaaggaaauaucugaccucaaaaucagagucauuuacuccuuccugauagugacaacugccagaauuagcaaccuaaaaaaaaaaaaaaaaaacuguaagauuauauauuucaagcuaaugacaguuaaauacaccagacuaugauuagcaaaauggcuccaugaguaacaaugauggccacaaugagaaccugauuugagcccagauuuacaaguuguaguaugaccuccacacauauaucaugguaugugugacacucacauacauacaaauauacauaagcacacauauacacaaauguaauaagaauuaaauuacauaaaacuacuaauccuacaacuaccaauuuuuucuucaaauaauucaaucucuaauuacaaucucuaauaauuuaauucuuauuacacucuuacuaaccuguucgagcaugggcaaaauacuaaguuuuugaaaagcaggaucugugaaauaagaaaaugucauuaaauaugagaacaucacuuuauauuauuuuaccuaacugaaugucaagaguauuaauguaauacuuguguuguauaacuggcaauguauauaacaaaauguuucuaugaaaauuuacauauuuguccaaaccuaccuuuaucaauguuuucccgacuggacauuguaaauggaacaccaaaaucaccuucuguacauuuguuggcagucuagaaauacaaagagguucuuuaaauauucugcucaauaccucuuuacuguuauuacauaacagaaacuuuguauauucuagaauauuaauaauuucaauaguauaugguuuccuucaaucucacucaaccaaauugagaucuucacuaaaucaaauaucaaugacaugucuuagcuauagcagaaauuaccuguagcauuaacaacauaucaaagacccggcccugcaaaaguagaaauacugggaauuguaugugcuauugggggcggagccauuucuccagcccagcagugaauuuuacaagaaucacguuuaaaggagucuaaaaaguuugaauguuggcaacauacaauaaggccuguaauuacgggcaaaaaaaaaaaaaaaaaaaauccaccccaaauuuuaggguauaucagcgauuaauguaacauacaaaguguaaggcaugcuuuucuuauuagcaucucucucgugagucucugugggcucgcacacgugcccgugguguggaagccacccuucucgccuugaccgcgugcguucuagggauggaacuuucuagggguggaccucaggucuccgggcucggcggcugcacgugccuuucgccccgucccgggcccgggcacugucuccgaagcgcccacgcaagcugaccuugaaguaguuggagucuccucccgccgucugcgguuucacggcggacacuugacugcugcucagccucggcgggacgaacagugugaagggcuuuugcuucuccaugcugccuccugggccucgggggaagggaagaggucacacggcugggugaggccgaaguacagugagccaggucccucagaggggcccagcguccgugucacccugcggcgcguguggccugcacggugaaagccugcacggccgcaccaucucuccacuccagccggccacgcgaccacgggcccagcccgaaccucgaaggccgcccgcgacugccugaggcccagggcccggggccucccuggcccgcgaagcccgcgaagccaagcaccuggacacgcgugacagagguguguacgugggccccaggccccgacacccuccacacccucaccguugucaggcuccgcggcccguggccccgcgugcgcuccuuuaugaagacgacauggaacggaaccgugagcuuccccucagaaccuccuggaagcccgagaacucgcgggacugggaggcuggccgcgaccggcucaauuuaacgguugguccagcuggccgggaucucgcgcgcagcacuucucgcgagauuucccuucccacgugccggguucucuaccaagucugcgcucaaaauugucggaggaugcugggaaagcccccccccaacccccucguugguguauagccauuuaaaggcgucucagugcuuuccuuuucuaaggcuguauuuauuauguucuggugcguguuauagaguguuucauguggauguaugcaucaacccgugcaccacgugcagcguccugggcauccauaaggaguaggagcccuuggaauuggaguuacagaugguuguuaguugccugguggaugcugagaaccaaacaugaguccugugcuacagccauaagccccauaaaaagaagucauuucugaggaguccugugguugcugggugcuaaagauggcuuugggagucuauagaacuuccu

SEQ ID NO: 10020 - RNA, 2501 nt, Mus musculus
aggaaguucuauagacucccaaagccaucuuuagcacccagcaaccacaggacuccucagaaaugacuucuuuuuauggggcuuauggcuguagcacaggacucauguuugguucucagcauccaccaggcaacuaacaaccaucuguaacuccaauuccaagggcuccuacuccuuauggaugcccaggacgcugcacguggugcacggguugaugcauacauccacaugaaacacucuauaacacgcaccagaacauaauaaauacagccuuagaaaaggaaagcacugagacgccuuuaaauggcuauacaccaacgaggggguugggggggggcuuucccagcauccuccgacaauuuugagcgcagacuugguagagaacccggcacgugggaagggaaaucucgcgagaagugcugcgcgcgagaucccggccagcuggaccaaccguuaaauugagccggucgcggccagccucccagucccgcgaguucucgggcuuccaggagguucugaggggaagcucacgguuccguuccaugucgucuucauaaaggagcgcacgcggggccacgggccgcggagccugacaacggugaggguguggagggugucggggccuggggcccacguacacaccucugucacgcguguccaggugcuuggcuucgcgggcuucgcgggccagggaggccccgggcccugggccucaggcagucgcgggcggccuucgagguucgggcugggcccguggucgcguggccggcuggaguggagagauggugcggccgugcaggcuuucaccgugcaggccacacgcgccgcagggugacacggacgcugggccccucugagggaccuggcucacuguacuucggccucacccagccgugugaccucuucccuucccccgaggcccaggaggcagcauggagaagcaaaagcccuucacacuguucgucccgccgaggcugagcagcagucaaguguccgccgugaaaccgcagacggcgggaggagacuccaacuacuucaaggucagcuugcgugggcgcuucggagacagugcccgggcccgggacggggcgaaaggcacgugcagccgccgagcccggagaccugagguccaccccuagaaaguuccaucccuagaacgcacgcggucaaggcgagaaggguggcuuccacaccacgggcacgugugcgagcccacagagacucacgagagagaugcuaauaagaaaagcaugccuuacacuuuguauguuacauuaaucgcugauauacccuaaaauuugggguggauuuuuuuuuuuuuuuuuuuugcccguaauuacaggccuuauuguauguugccaacauucaaacuuuuuagacuccuuuaaacgugauucuuguaaaauucacugcugggcuggagaaauggcuccgcccccaauagcacauacaauucccaguauuucuacuuuugcagggccgggucuuugauauguuguuaaugcuacagguaauuucugcuauagcuaagacaugucauugauauuugauuuagugaagaucucaauuugguugagugagauugaaggaaaccauauacuauugaaauuauuaauauucuagaauauacaaaguuucuguuauguaauaacaguaaagagguauugagcagaauauuuaaagaaccucuuuguauuucuagacugccaacaaauguacagaaggugauuuugguguuccauuuacaauguccagucgggaaaacauugauaaagguagguuuggacaaauauguaaauuuucauagaaacauuuuguuauauacauugccaguuauacaacacaaguauuacauuaauacucuugacauucaguuagguaaaauaauauaaagugauguucucauauuuaaugacauuuucuuauuucacagauccugcuuuucaaaaacuuaguauuuugcccaugcucgaacagguuaguaagaguguaauaagaauuaaauuauuagagauuguaauuagagauugaauuauuugaagaaaaaauugguaguuguaggauuaguaguuuuauguaauuuaauucuuauuacauuuguguauaugugugcuuauguauauuuguauguaugugagugucacacauaccaugauauauguguggaggucauacuacaacuuguaaaucugggcucaaaucagguucucauuguggccaucauuguuacucauggagccauuuugcuaaucauagucugguguauuuaacugucauuagcuugaaauauauaaucuuacaguuuuuuuuuuuuuuuuuuagguugcuaauucuggcaguugucacuaucaggaaggaguaaaugacucugauuuugaggucagauauuuccuucuuauuucuggaauuucauuuauuauuugaauauacauuuuuaaguucucaaaguauucauauucaguuaauguuuuaaaauauuuucuuugaagacuuuucuuuua

SEQ ID NO: 10021 - RNA, 2501 nt, Mus musculus
gugcucuuaaucacugagccaucucuccagcccagggagacuaaaacuggugaaaagcagucaaguguuuugaaaagccaguugccgugugggccagauuaaggugagcgcuggguacuacaugcuuccaugcuuuuucacagggaaccugaaguccccagccaaacugggucauaaagauggggguggggggcacucuagucacugaaaggcucuuuuucuccaucuuccuucuuucccuuucccuuucuaaaggaauguuucaagccagauguaagauauaggccucucugcuuccucguccgaacccgccuuuuugccuucuccaacacugcagagauaaaaaagauccaaaaggaagauuuuucucuaacaggaaaacagggguggggguggggauggagagagcagcaucuugaaaugauaggaaucugcagcccaagcugccuugccccucagccagcuaccccucaccccuccagcccagauuccuaguccaggggagaaagcagcuacagggugcaagagaagagaccucgcucugugggagguaggggugggggugaggagggggugcuuguuucaggggaggagcagagcaagcggggaagggagacacuacauguuagagagggcacuggcccagcccaagaggccaguucgacuggagaggugaggaggaaggaugagccauccgaaucuuuuugcaguccgauucuacccuccuugcccuuccuggaaagaggaugcguauccaaagggggaugaaggaguccuggggccgggucgggaauucuacaaagaacacagcaggcauccgguggauccuggacgccuuuugccucaucugcccuuuggaagugucugaagauuaaggccugcaggaagagaucugaagagagggucucacaacucuugagacucuagaagccccuggggcuuggggaggaaaggcgggagguuauguuaucugggacaggaaagcaaaagggggcaucgguguuccaaauuacacccucaaagccaaggcuggugacaaacgccugcguuaugcaaccccaaggauuuaauuuguuucgguugugggcauuaggggaaguuugugccucaauuucacuucuaagccuuuccguggaugcuacuggcucguugugugggcuagacuagcagagggaugugggggacagccagcugcccccccuacucgugucuccaagggcucuuaggugguguaagguuuuuugaagaccaugaccaugccaaacagacacugcaggauguggagaggcgacuaguucccacccugagagagaaucaccaaguagcuucugcgguagagguuucaguagaaauaccaaggggcacaauggggcagccuaggggacuucaaccaucagcucccuccuuccagaugcccagggcucuccucuccagcgccucauuuucuccaacuccucacuggccacuggaaacuucugggacuguguccuuccucuaauuccuccuaggcaauucuggugccuaagcagccgaugcccagagcaaugcacucguuccaguaagccuaccaaccccagaaccauacuuaccaccaggacgugucuacacgggccggcagagucaggaguagcagcagcagcaggcaggcaagacccaggcgggcggaagauggggacacgucgggggccgugggucugggcacggggacgcgggcacgccgaggggcgagcugcgcggcuucauccucacccugcagcuucagcauagcuccccgcagacucccgccccgaagcccgcagggccguggacgggcacugucugggcuuccucaggcgucuccuagaucgccccacagaguggccauggggaccaugggcgaccgaggaccucaaggcacguggagcccgggagccagacgcaggguucccaagagcgugcagggccaggagaccgacgagcgcugagccgggugugggcggucgggugcggugucaguggcuccggggcgcggagugcggcgggggccagagcgcgccgacagccccugcggccgcagcucucauuggacggggcggggcggggccggggacacgcgcggccuucagcgcggcuccgcccgcgccagcccgggugcuccccggcgcccuagguguggcggccgccuccuccccuccguucuacggggcgccaccgcgccgcguccccaccugcucuggccacccgcgacggggcucuucccugccugcagcccccugucccuaccgacgccacgccacgccaccggguccuagcgcccuucacucagcaacgcggaccacugcguuugauggcaaggagcacacgguguguguggcgagggagagacguggagaggguugcggacacuuccaguucuuuaaguacagaagaugcacuuucucuugguccucccauccuugcgcuucuaggaaacugguagacacccggccagcaagaguugcgggauagugggacuccuuugg

SEQ ID NO: 10022 - RNA, 2501 nt, Mus musculus
ccaaaggagucccacuaucccgcaacucuugcuggccgggugucuaccaguuuccuagaagcgcaaggaugggaggaccaagagaaagugcaucuucuguacuuaaagaacuggaaguguccgcaacccucuccacgucucucccucgccacacacaccgugugcuccuugccaucaaacgcagugguccgcguugcugagugaagggcgcuaggacccgguggcguggcguggcgucgguagggacagggggcugcaggcagggaagagccccgucgcggguggccagagcagguggggacgcggcgcgguggcgccccguagaacggaggggaggaggcggccgccacaccuagggcgccggggagcacccgggcuggcgcgggcggagccgcgcugaaggccgcgcguguccccggccccgccccgccccguccaaugagagcugcggccgcaggggcugucggcgcgcucuggcccccgccgcacuccgcgccccggagccacugacaccgcacccgaccgcccacacccggcucagcgcucgucggucuccuggcccugcacgcucuugggaacccugcgucuggcucccgggcuccacgugccuugagguccucggucgcccaugguccccauggccacucuguggggcgaucuaggagacgccugaggaagcccagacagugcccguccacggcccugcgggcuucggggcgggagucugcggggagcuaugcugaagcugcagggugaggaugaagccgcgcagcucgccccucggcgugcccgcguccccgugcccagacccacggcccccgacguguccccaucuuccgcccgccugggucuugccugccugcugcugcugcuacuccugacucugccggcccguguagacacguccuggugguaaguaugguucugggguugguaggcuuacuggaacgagugcauugcucugggcaucggcugcuuaggcaccagaauugccuaggaggaauuagaggaaggacacagucccagaaguuuccaguggccagugaggaguuggagaaaaugaggcgcuggagaggagagcccugggcaucuggaaggagggagcugaugguugaaguccccuaggcugccccauugugccccuugguauuucuacugaaaccucuaccgcagaagcuacuuggugauucucucucagggugggaacuagucgccucuccacauccugcagugucuguuuggcauggucauggucuucaaaaaaccuuacaccaccuaagagcccuuggagacacgaguagggggggcagcuggcugucccccacaucccucugcuagucuagcccacacaacgagccaguagcauccacggaaaggcuuagaagugaaauugaggcacaaacuuccccuaaugcccacaaccgaaacaaauuaaauccuugggguugcauaacgcaggcguuugucaccagccuuggcuuugaggguguaauuuggaacaccgaugcccccuuuugcuuuccugucccagauaacauaaccucccgccuuuccuccccaagccccaggggcuucuagagucucaagaguugugagacccucucuucagaucucuuccugcaggccuuaaucuucagacacuuccaaagggcagaugaggcaaaaggcguccaggauccaccggaugccugcuguguucuuuguagaauucccgacccggccccaggacuccuucaucccccuuuggauacgcauccucuuuccaggaagggcaaggaggguagaaucggacugcaaaaagauucggauggcucauccuuccuccucaccucuccagucgaacuggccucuugggcugggccagugcccucucuaacauguagugucucccuuccccgcuugcucugcuccuccccugaaacaagcacccccuccucacccccaccccuaccucccacagagcgaggucucuucucuugcacccuguagcugcuuucuccccuggacuaggaaucugggcuggaggggugagggguagcuggcugaggggcaaggcagcuugggcugcagauuccuaucauuucaagaugcugcucucuccauccccacccccaccccuguuuuccuguuagagaaaaaucuuccuuuuggaucuuuuuuaucucugcaguguuggagaaggcaaaaaggcggguucggacgaggaagcagagaggccuauaucuuacaucuggcuugaaacauuccuuuagaaagggaaagggaaagaaggaagauggagaaaaagagccuuucagugacuagagugccccccacccccaucuuuaugacccaguuuggcuggggacuucagguucccugugaaaaagcauggaagcauguaguacccagcgcucaccuuaaucuggcccacacggcaacuggcuuuucaaaacacuugacugcuuuucaccaguuuuagucucccugggcuggagagauggcucagugauuaagagcac

SEQ ID NO: 10023 - RNA, 2501 nt, Mus musculus
uaucacucagccugucaguccauguguguaugguaugaaggaaaggacccgggaauggagauguucagaaauaucucaacccaggaauuucaagccauugauguuuggagauagcaagauaaagacauuacuucagggcuaccuggcuuuugguggcauuucaagcaugcacagaaauaaugcacagcugcuggcuucaaagaugaccagccacuccuggaucuggcucuguaaccccaaugcugccauagacagggauacagauggacacccaaggguuaauacucuagccugcaucuggcuggacaggcucuuccuggcuugcuucuuccucccacccacugccucagccucugacuaugagagcagccuggaaacugcggcagucucugagcacuucaagacaucauguuccauuuuccaaucaguacagucugcagacagagacccggccugacugccuggcugaaccucggccuccucucuuuccucuuaugucuccuuguagucuuucuuuucuucccucuucucucuuuaugcuuguugcaugugggauaacuuccucccuuccccuccuccuaaccccaccuucugccucucacugagccccucucucugcuguucuacuuuucucuccucccagacaccugcaacgcgcugcccaucacaaguucgguuccuacccuccagguuuucccucucauucucuucugaagcaaacccacuugcuguggauugaaaguaccauccuucacucuguaagagccaugcuaucaucugcugccauuacuggagacagcuucugagcagcccauuaucagcugcagcucugaacucuccuugcacuuucuuuccucagucagccgcagagucuagaauagccccaucucauuuucuucaagaaaagauucggguccagcuccccucaaagagccacccaagucccuaauaguuccuacacauccauugaacaaguagcagcaugcccaucucucucucucucucucucucucucucucucucucugccaacagguugcucagcacagguccugguguaaagcugagugagccugaauuuucccuacccugaaggcccacucccaacuggggccuaaaacaugugcaacaaccaaagaaagauaucuacuggggaugaugccacacucggaucuugugucacucggaaccuggagaccugguugaccauucuggcagacauugggccugugccaaucccugcgauaccccccccccccagacccccaucucucucuccagccuguggguagcucaguguucuccuccgugcaaugggaugagcagccuucucuuuaccucgcaaagcgcugcagccccaggagcagcuauugaaauaccgcgggccucagccguagcuuagaagcaguaaggaagccagaacccagggccgagaagccugggcagcuggcgagaaggggcuguccgcuccaaguggccccgcagagccgccugcugcuugcugcagagcuccugccccagcccggcccgggccccgcgcgccacgguugcagcuuaccgaagaagggcagcgccccgcggcgccccgcgcggucauacgggcagcugggucccggcacggcguguuggccgcccugguucgcucgcucccuugcucgcuaguggcugaagagcccgcgccccggucgagggccacgccgcuguccugggaugcagagagccgcagcgacaccgagagcaccgaggcaaacuuucacuuuccccuggccgagcuucgcuggccagcccucggcacagccuuuuaagcgggcgggcuggcggggcaugugguuuaugggaaaucacccuggcucuccgccagacacacacagacauacacacacacaaacacacucacaggcacugacacauacuacaccccagaggcccacugagccgccgacucccuucccccaagcgggccgccuggucguccccgcuagcucucuuccccgucgcucuguggcugugcagccuccucaaaguaacccgggcuccaccgcccucccccgcccuucucgagcucuggacaagacacugccuuuccuucugugcucgccacucuugucaaucucgugugauuguucucggucuaaugcuggccccuagggacuuucccucaaggcccgaaaauccucaaaucugagcaggaaacggacagaguacauugaacaggacuugaauggggauggaccaacgccucucugcugcagcuccauucaagucccucauggaacccagggcagcagguuugcagauuggcuugcucccuccuaugcauuguucaaagaaucuacuauacuacuauacuauccucuccccuggcuguagggagaaguggggagcauccagcuaccuggguaggagaggaaggacuugguccugugacaacuagcuggguguuucugcacucugccaggagacacuucaggugcuuaaccugaaagcacuggcuggcccccu

SEQ ID NO: 10024 - RNA, 2501 nt, Mus musculus
agggggccagccagugcuuucagguuaagcaccugaagugucuccuggcagagugcagaaacacccagcuaguugucacaggaccaaguccuuccucuccuacccagguagcuggaugcuccccacuucucccuacagccaggggagaggauaguauaguaguauaguagauucuuugaacaaugcauaggagggagcaagccaaucugcaaaccugcugcccuggguuccaugagggacuugaauggagcugcagcagagaggcguugguccauccccauucaaguccuguucaauguacucuguccguuuccugcucagauuugaggauuuucgggccuugagggaaagucccuaggggccagcauuagaccgagaacaaucacacgagauugacaagaguggcgagcacagaaggaaaggcagugucuuguccagagcucgagaagggcgggggagggcgguggagcccggguuacuuugaggaggcugcacagccacagagcgacggggaagagagcuagcggggacgaccaggcggcccgcuugggggaagggagucggcggcucagugggccucugggguguaguaugugucagugccugugaguguguuuguguguguguaugucugugugugucuggcggagagccagggugauuucccauaaaccacaugccccgccagcccgcccgcuuaaaaggcugugccgagggcuggccagcgaagcucggccaggggaaagugaaaguuugccucggugcucucggugucgcugcggcucucugcaucccaggacagcggcguggcccucgaccggggcgcgggcucuucagccacuagcgagcaagggagcgagcgaaccagggcggccaacacgccgugccgggacccagcugcccguaugaccgcgcggggcgccgcggggcgcugcccuucuucgguaagcugcaaccguggcgcgcggggcccgggccgggcuggggcaggagcucugcagcaagcagcaggcggcucugcggggccacuuggagcggacagccccuucucgccagcugcccaggcuucucggcccuggguucuggcuuccuuacugcuucuaagcuacggcugaggcccgcgguauuucaauagcugcuccuggggcugcagcgcuuugcgagguaaagagaaggcugcucaucccauugcacggaggagaacacugagcuacccacaggcuggagagagagaugggggucugggggggggggguaucgcagggauuggcacaggcccaaugucugccagaauggucaaccaggucuccagguuccgagugacacaagauccgaguguggcaucauccccaguagauaucuuucuuugguuguugcacauguuuuaggccccaguugggagugggccuucaggguagggaaaauucaggcucacucagcuuuacaccaggaccugugcugagcaaccuguuggcagagagagagagagagagagagagagagagagagagaugggcaugcugcuacuuguucaauggauguguaggaacuauuagggacuuggguggcucuuugaggggagcuggacccgaaucuuuucuugaagaaaaugagauggggcuauucuagacucugcggcugacugaggaaagaaagugcaaggagaguucagagcugcagcugauaaugggcugcucagaagcugucuccaguaauggcagcagaugauagcauggcucuuacagagugaaggaugguacuuucaauccacagcaaguggguuugcuucagaagagaaugagagggaaaaccuggaggguaggaaccgaacuugugaugggcagcgcguugcaggugucugggaggagagaaaaguagaacagcagagagaggggcucagugagaggcagaaggugggguuaggaggaggggaagggaggaaguuaucccacaugcaacaagcauaaagagagaagagggaagaaaagaaagacuacaaggagacauaagaggaaagagaggaggccgagguucagccaggcagucaggccgggucucugucugcagacuguacugauuggaaaauggaacaugaugucuugaagugcucagagacugccgcaguuuccaggcugcucucauagucagaggcugaggcagugggugggaggaagaagcaagccaggaagagccuguccagccagaugcaggcuagaguauuaacccuuggguguccaucuguaucccugucuauggcagcauugggguuacagagccagauccaggaguggcuggucaucuuugaagccagcagcugugcauuauuucugugcaugcuugaaaugccaccaaaagccagguagcccugaaguaaugucuuuaucuugcuaucuccaaacaucaauggcuugaaauuccuggguugagauauuucugaacaucuccauucccggguccuuuccuucauaccauacacacauggacugacaggcugagugaua

SEQ ID NO: 10025 - RNA, 2501 nt, Mus musculus
ccuuugcaaccugccccaaaugcuuaauguuuugacuccucccauaaaccagccuaacucgacagcaccugcuguuuaucuugcauagcuauuugucaccuuucgguguuugcucuacccuccucuuuccuggaguguccuuugaggcauuuccaaugugcaugaccuauccuuuuucacaguggaccuguuuaguguccccagccucccucagucuucacagagccauuuguaucuuacauagaaaauguuucuauccccaaaguaccuuauaccugaaucguuuccuaccucguaguuuuaugugccagcucaacugugcaacaugacucacgcuucccggguaacuaagguccaggcccccacugccagaagaguagaugaagcaucaacagcccugggagaaguucacaccggaggauuucaggagccgcagcagcugcgccugcgcaccgcccacugaccacgcggagggcggguggagcauagagcgagagaggaggagacaguucggucgcgucagcccggcccacagcguccaguauaaaguuagccgcccacaguccaucgcuguauccccgaaggggcuaagaucgcccaaaaugucauccaagucuaugguucuggguuacugggauauccgcggggugaguggucccucgccagcccagccucugggacagagaggugcaggcggccgggcgggggucaggggccggugggccgaucuccagccuaccuaugggguccccaggacuguggguagaggaauaagguacuggaaguucccgggcgugagcgaaggggcugccuaaggacaauuucccuggacaggacgcaggagcuuggcagcguuggguuggggacauugacggagggggccugcgagcaagugggcacugcgcaggcgcgcugaccggggucuuucuccauccccugcuuuuagcuggcucaugcuauccgcaugcuucuggaguuuacugauaccagcuaugaggagaaacgguacaucuguggggaagguaaugaaugucugugggugcgcuacaguuguuuuuuacccagaggguuguaccacaccaagauggugugggacccccugcuccuguaagcugggaacuuugccaagagaggcccauagaguuaucucuugcuguucaggcccaucuuugcagaaacucaaggguuaguuuuuggggauugggaacuugagauaacaggucuaagucucagcuaggucgguaacgggcuugggucccacuucucucuuacagcuccugacuaugauagaagccaauggcuggacgugaaauucaagcuagaucuggacuuuccuaacguaggugguuuuggaggagugggcagaagggaaggccuucaaguguaucuguuuucacuucaucucuggcuugggagcaucuagauagagacucuucacguuuauagaauggauagaauucaagggucauugaacagaacugagaauaacauuuuauuuccuacuaacgucugagaaacacuaauauucuccucuuaaaggcaggcuauaagagacaugaguugauagccaggucugugacuuuaucacugauagauuccagguauuuucaugguauccuaaauguauccucauguguccugguuguuaaaacaccuauuuuuuuuuuaaauguauccauaaucacccuacuuuuacauacuuuaagguauaaaauauuuacauuuugcuuuuuaaacgucuauaugccacacauacauucacagugacacacaggauuaagcacccuugucuagagucaggugaggacccagugcuacuuucuauuuauuuaguuauuucuccuggcuucuacucucacacaccuugcaagucuucucuuuuccagaggaguggcgguccuggaggacuagguucacauuaacuuuccccuucuagcugcccuaccucauggacgggaagaacaagaucacccagaguaacgccauccugagauacaucgcacgcaagcacaacaugugugagugggcugaaggggauaggagggaggaggcaguuggcucaccuggagguuggcaauccugagggugauuuguugccaucuggcugcagguggugacacugaagaagaaaagauacgaguagacaucauggagaaccagaucauggacuuccgcaugcagcugguucgccucugcuacaauucuaaccacguaaguuuccucaucuggaaucaccuuuguuggguuucaggccaaagugcuaaggauuauucugcucgcuucuaugguugccaucuuucuaucaacccaaacuggaaggauuagaaacagacucuauuuuuuggugugguuuguccuguaagucugguguuagcuccuccuccuuuccaaagccccagcucuccauccugccuucuccaauuaaaggcagaaagaagcugccuagaguguguccaucacugguccaggcccugacuauagcuauugggggaaggggccag

SEQ ID NO: 10026 - RNA, 2501 nt, Mus musculus
cuggccccuucccccaauagcuauagucagggccuggaccagugauggacacacucuaggcagcuucuuucugccuuuaauuggagaaggcaggauggagagcuggggcuuuggaaaggaggaggagcuaacaccagacuuacaggacaaaccacaccaaaaaauagagucuguuucuaauccuuccaguuuggguugauagaaagauggcaaccauagaagcgagcagaauaauccuuagcacuuuggccugaaacccaacaaaggugauuccagaugaggaaacuuacgugguuagaauuguagcagaggcgaaccagcugcaugcggaaguccaugaucugguucuccaugaugucuacucguaucuuuucuucuucagugucaccaccugcagccagauggcaacaaaucacccucaggauugccaaccuccaggugagccaacugccuccucccuccuauccccuucagcccacucacacauguugugcuugcgugcgauguaucucaggauggcguuacucugggugaucuuguucuucccguccaugagguagggcagcuagaaggggaaaguuaaugugaaccuaguccuccaggaccgccacuccucuggaaaagagaagacuugcaaggugugugagaguagaagccaggagaaauaacuaaauaaauagaaaguagcacuggguccucaccugacucuagacaagggugcuuaauccugugugucacugugaauguauguguggcauauagacguuuaaaaagcaaaauguaaauauuuuauaccuuaaaguauguaaaaguagggugauuauggauacauuuaaaaaaaaaauagguguuuuaacaaccaggacacaugaggauacauuuaggauaccaugaaaauaccuggaaucuaucagugauaaagucacagaccuggcuaucaacucaugucucuuauagccugccuuuaagaggagaauauuaguguuucucagacguuaguaggaaauaaaauguuauucucaguucuguucaaugacccuugaauucuauccauucuauaaacgugaagagucucuaucuagaugcucccaagccagagaugaagugaaaacagauacacuugaaggccuucccuucugcccacuccuccaaaaccaccuacguuaggaaaguccagaucuagcuugaauuucacguccagccauuggcuucuaucauagucaggagcuguaagagagaagugggacccaagcccguuaccgaccuagcugagacuuagaccuguuaucucaaguucccaauccccaaaaacuaacccuugaguuucugcaaagaugggccugaacagcaagagauaacucuaugggccucucuuggcaaaguucccagcuuacaggagcagggggucccacaccaucuuggugugguacaacccucuggguaaaaaacaacuguagcgcacccacagacauucauuaccuuccccacagauguaccguuucuccucauagcugguaucaguaaacuccagaagcaugcggauagcaugagccagcuaaaagcaggggauggagaaagaccccggucagcgcgccugcgcagugcccacuugcucgcaggcccccuccgucaauguccccaacccaacgcugccaagcuccugcguccuguccagggaaauuguccuuaggcagccccuucgcucacgcccgggaacuuccaguaccuuauuccucuacccacaguccuggggaccccauagguaggcuggagaucggcccaccggccccugacccccgcccggccgccugcaccucucugucccagaggcugggcuggcgagggaccacucaccccgcggauaucccaguaacccagaaccauagacuuggaugacauuuugggcgaucuuagccccuucggggauacagcgauggacugugggcggcuaacuuuauacuggacgcugugggccgggcugacgcgaccgaacugucuccuccucucucgcucuaugcuccacccgcccuccgcguggucagugggcggugcgcaggcgcagcugcugcggcuccugaaauccuccggugugaacuucucccagggcuguugaugcuucaucuacucuucuggcagugggggccuggaccuuaguuacccgggaagcgugagucauguugcacaguugagcuggcacauaaaacuacgagguaggaaacgauucagguauaagguacuuuggggauagaaacauuuucuauguaagauacaaauggcucugugaagacugagggaggcuggggacacuaaacagguccacugugaaaaaggauaggucaugcacauuggaaaugccucaaaggacacuccaggaaagaggaggguagagcaaacaccgaaaggugacaaauagcuaugcaagauaaacagcaggugcugucgaguuaggcugguuuaugggaggagucaaaacauuaagcauuuggggcagguugcaaagg

SEQ ID NO: 10027 - RNA, 2501 nt, Mus musculus
ggaagcuuucuagaaucuucccaggggggauaaguccauggucuuuccugcuguuuccaccuccugacaaccugucacuuuccauuagaucuacuugucugguuuauauagcacguaugucuuguuccucaggaucucucagcgccucccugcuucugaaccccaguuccuuugaaaccuuaccuuuccuacucgguccccucugguacucaagucagaacagggaaggucaggaggugaaagaguucaggcaacauuggccccacucuugaggcagcagagaaagucucagaguuuauuuacucucaggacucccaggcuggccugcagcccauuaggaucucagauacccagagacaaucccaaaugcccuccagauuugaugauuuccauccaaaccacaauuacuuaggauuuagugacaucgugcuaaguccuaucuccugugaauucaaagaucuuuagaacuugguucucuuggauauuaaggguaaauuggucccuagcugaauccagugcuugaggguacaguaauaacuucauauagaaucugguauauggcuugucuaacaaaaucuuuucugcaagaaugcacaaaauguuccccaaaucuuuaugauuugaaaugcuggcugcaucucaaggaccagugaaacaagccaguauucccacuagaccagagaaggggaaacugaggccaugggccggugaauguuucaaggucacaggguaaaucuaauauugagcuauacucuagaaugcugacaggcauuugauccauguuugacuaauguuggaaacuaguguccagagaagugacuuguccaaggucauagagcugagacagguagcucuaggccugcaaccuaccaucccuccuucccggcucaauguucuguuaugccagcugucacauuuucuucugucuuaauugguuuuuuuauguaaucauuggauugggaaacuguucauucauccauccauuucuuuacucgguuacaguuucccaaauugcuccagugacuucagcugguagucugucuccugaguccaccccagggaucauccagguccuagaagguuccaggcaggaugguuucuguaacccauuuccuuuccuggugccuuuaguaguagcguuguucucacugcaaaguggaccuuacccuccuuguccuccucaccccucccgccacugaagagugguaugugcaggaucagaguucuggaaagguuacacccgggucuucucguccgagugaaaugugagcgcccugggcaaaggcgccuugcacauagaagguccgaauccgggacuccgcaugccgggcuccucucccuccuuccaccgagcgcuggagcagcaacccugguucuccccucccccgcccaccugucgccaccccccacccuuccgcgguggcugggcccgcugcaucuccccagccuccuccggggccacauugcuucggguccgcgucacaauccaggcucccgaaauagcccgggguuagggccgacucacccacuggagaacuuugaugaagcccagcggcuccuccaggcgcugccagcgcagccccaggagcaggcgguccaccugcggagacaaagccagcagacggucaaggcgggccggcccggagggaaagcguggggcuuucuauucacauugcgggggcgggagagacggaaucagacacauucgggacaucuagguagacagggacuagcgagaguccacaggccggguacucggggcuuaccugcuggcgcggagacuuguccgaggugcggccggggcucuccgucgaggacaugcuggcgcgucggggcgcagugcaaggguucgacucccuggccgggaggcugcguggggcgcgggggcgcugggggcggcgggcucgaggccgugggcaggccgggcuccaggcuggcgggcugggucgugggggcgcugcugcucgcgcucucggaggcucuguccgccgcgcugccccgccggcugcagaaaacccccgaguccgauucaaacuucugucaaacaaucuggcggacuuggcagccgagucacguggcgugcgaucgcgaacccugcucccgccccuugcucuccccuuuuuccgcgcguagggcgccuuaaagggaccuguggagccugcuagccgucgggcugccagaaggcuccgggguuuuugccagaagcuuccaggauggguccccacuagaacagcccagcugcuucaacgccacggccaaggucaggaaccuacacgggaugcgugggcucuagugcagcuuucccgauuuuccuggguucuguggaaggguuuucuucuacaaauaccguagugacuagagcacacaagauuuaccuaaggcauucuuagugcuucugcugcuguaacaacggcgcuccaccagccagaacaaagaacugaacuuuuacuucgcaucagacacggucuuacuuuuuaacaacaaacagcguuuggauguua

SEQ ID NO: 10028 - RNA, 2501 nt, Mus musculus
uaacauccaaacgcuguuuguuguuaaaaaguaagaccgugucugaugcgaaguaaaaguucaguucuuuguucuggcugguggagcgccguuguuacagcagcagaagcacuaagaaugccuuagguaaaucuugugugcucuagucacuacgguauuuguagaagaaaacccuuccacagaacccaggaaaaucgggaaagcugcacuagagcccacgcaucccguguagguuccugaccuuggccguggcguugaagcagcugggcuguucuaguggggacccauccuggaagcuucuggcaaaaaccccggagccuucuggcagcccgacggcuagcaggcuccacaggucccuuuaaggcgcccuacgcgcggaaaaaggggagagcaaggggcgggagcaggguucgcgaucgcacgccacgugacucggcugccaaguccgccagauuguuugacagaaguuugaaucggacucggggguuuucugcagccggcggggcagcgcggcggacagagccuccgagagcgcgagcagcagcgcccccacgacccagcccgccagccuggagcccggccugcccacggccucgagcccgccgcccccagcgcccccgcgccccacgcagccucccggccagggagucgaacccuugcacugcgccccgacgcgccagcauguccucgacggagagccccggccgcaccucggacaagucuccgcgccagcagguaagccccgaguacccggccuguggacucucgcuagucccugucuaccuagaugucccgaaugugucugauuccgucucucccgcccccgcaaugugaauagaaagccccacgcuuucccuccgggccggcccgccuugaccgucugcuggcuuugucuccgcagguggaccgccugcuccuggggcugcgcuggcagcgccuggaggagccgcugggcuucaucaaaguucuccagugggugagucggcccuaaccccgggcuauuucgggagccuggauugugacgcggacccgaagcaauguggccccggaggaggcuggggagaugcagcgggcccagccaccgcggaagggugggggguggcgacaggugggcgggggaggggagaaccaggguugcugcuccagcgcucgguggaaggagggagaggagcccggcaugcggagucccggauucggaccuucuaugugcaaggcgccuuugcccagggcgcucacauuucacucggacgagaagacccggguguaaccuuuccagaacucugauccugcacauaccacucuucaguggcgggaggggugaggaggacaaggaggguaagguccacuuugcagugagaacaacgcuacuacuaaaggcaccaggaaaggaaauggguuacagaaaccauccugccuggaaccuucuaggaccuggaugaucccugggguggacucaggagacagacuaccagcugaagucacuggagcaauuugggaaacuguaaccgaguaaagaaauggauggaugaaugaacaguuucccaauccaaugauuacauaaaaaaaccaauuaagacagaagaaaaugugacagcuggcauaacagaacauugagccgggaaggagggaugguagguugcaggccuagagcuaccugucucagcucuaugaccuuggacaagucacuucucuggacacuaguuuccaacauuagucaaacauggaucaaaugccugucagcauucuagaguauagcucaauauuagauuuacccugugaccuugaaacauucaccggcccauggccucaguuuccccuucucuggucuagugggaauacuggcuuguuucacugguccuugagaugcagccagcauuucaaaucauaaagauuuggggaacauuuugugcauucuugcagaaaagauuuuguuagacaagccauauaccagauucuauaugaaguuauuacuguacccucaagcacuggauucagcuagggaccaauuuacccuuaauauccaagagaaccaaguucuaaagaucuuugaauucacaggagauaggacuuagcacgaugucacuaaauccuaaguaauugugguuuggauggaaaucaucaaaucuggagggcauuugggauugucucuggguaucugagauccuaaugggcugcaggccagccugggaguccugagaguaaauaaacucugagacuuucucugcugccucaagaguggggccaauguugccugaacucuuucaccuccugaccuucccuguucugacuugaguaccagaggggaccgaguaggaaagguaagguuucaaaggaacugggguucagaagcagggaggcgcugagagauccugaggaacaagacauacgugcuauauaaaccagacaaguagaucuaauggaaagugacagguugucaggagguggaaacagcaggaaagaccauggacuuauccccccugggaagauucuagaaagcuucc

SEQ ID NO: 10029 - RNA, 2501 nt, Mus musculus
agaccaguccaccaccacuuuggcuggugauagagaagcgguugcggguguugccgcuggugaucugguagguaaugacacugugagcgucucgauccacggcugacacggucaccacacuggugcccacggcggcguccucguugagccgaacgguguacucuggcugcgugaagguuggguuguugucauugacguccaggaugguuacacugacacuggcugaggccgugagcgcuggggugccauggucccgggccucuacaccaaagcuguagaaaucaaccucuucccgauccaacucugcggccacagagauccagccugugccauuguuaauggugaagggaaagucgugcccaaccccugccaggcuauacucgaggcgggcguuaucaccagcgucagcaucaauugccuggacgugcagaacaagguagccuaaagggacacucucuaggacgguggccuggaaaggggugcugacaaagaugggggcguuaucguugaugucuaggacuugcacuguuacuaggccagagacauuggagaguggaggacggccaccguccugagcccggauccgaagcguauacucuuugguugucucauagucgagugggcuuaccacauccagggcuccagucugagcauccagauagaacuggccccgagcauugccacucaugaugcuguagugcacuagggcauugcugcccuugucucuaucggaggcggugacucggagaacuggggcuccuggggucacauccucccgcaccuggaccacauaacgcuucucgcuaaacuggggggcguugucauuaucauccuccaccgacaggaaaacaauggcuguggaacuccgcgggccugggucccggcccuggucacucgccuccacuguuaacuuguaggauuccacuuccucccggucuacagggccgcggguucggaucacccccgagcgaggaucgaucucaaaggcgucugaggggcugccuccggcccccuccagcaggcgguacagaauguuggcauugggaggggcgucgccgucgguggcccugacuguaagcaccucauagccaaccuccagguucucccugaggcucuccuuguacucuugcugcucaaaaacagggucgugaucguuggugucggucaccaagaugguaagcguggccaaggcacuccgucggggcauaccgugauccugugcagugacccugaagacgugggugcucuuggucucccgauccagcuccucagcuguggugacaacaccggugauuggguccaaggagaagaaaugauuggagcggcuaucaaagagggcauccaugguguacucaagucgacccgccucacccucaucuggaucaauggcucuuaaggaugcaacagagguaccagcaggcugguucucaggcacuguggccugguagcugggaggcuggaacuggggagcuguauucacauuccuuuuccugcgcccacccagagauuccucuggugagccuuccccagcccugagcccuggggccugugccagcuugcaagacuggcaucugagccguggggccuuuaagcaagggugcucuucaggcagggucagcgugccuuguggagaaagguguccuccgauacccaggagacgacagcuccaggggcagccuucagaggauggcggaagagggauaugagccccugauucuggacaccaaacccucaggccaucgugguggggcaccagguggccggucagcucaaugcccgauucucugcagcggcugguguagagccagagguucgaagcagaggcugggcagagccagcccacgggggcgcaggccccagaggagcugcgucccccggaucccagagaacgacagggccccacuugaucucccaguaguggcgacgguggcagcagcagcaacagcaguagcagcggcagcagcggcguugggaggggggcgcuggcagcccggcuccgcaucucucccuguucccggccagccgggucaacagccgcggcggcucuuccuccggcuccugccggccccgccgcgccucaugcccgggccggggcgcggguccccgggggccaccuguacgucccacugggccugcacccagauggcucggcggggccgcgcucuuagcccacgaugcgccgggcucccaccacucucgaagccgggcccgcucccgagucgccgcgaccacugcggguucacgcugcgcuuccaccugcgcucugagcguucucuaccugcgcccgcgggccgcgaggaucucuggcucugccgggucccccggucccgagccccagaauguccccuccgcccgcguaaggucgcccaccugcgucugcggagccucacgcuccggcccgggcccggcugccaacgauggcccugcgccacccgcucgcgcccugcguccccgccgcggcagcuaccggucgccggggucccgggcccagacccgcguuc

SEQ ID NO: 10030 - RNA, 2501 nt, Mus musculus
gaacgcgggucugggcccgggaccccggcgaccgguagcugccgcggcggggacgcagggcgcgagcggguggcgcagggccaucguuggcagccgggcccgggccggagcgugaggcuccgcagacgcaggugggcgaccuuacgcgggcggaggggacauucuggggcucgggaccgggggacccggcagagccagagauccucgcggcccgcgggcgcagguagagaacgcucagagcgcagguggaagcgcagcgugaacccgcaguggucgcggcgacucgggagcgggcccggcuucgagaguggugggagcccggcgcaucgugggcuaagagcgcggccccgccgagccaucugggugcaggcccagugggacguacagguggcccccggggacccgcgccccggcccgggcaugaggcgcggcggggccggcaggagccggaggaagagccgccgcggcuguugacccggcuggccgggaacagggagagaugcggagccgggcugccagcgccccccucccaacgccgcugcugccgcugcuacugcuguugcugcugcugccaccgucgccacuacugggagaucaaguggggcccugucguucucugggauccgggggacgcagcuccucuggggccugcgcccccgugggcuggcucugcccagccucugcuucgaaccucuggcucuacaccagccgcugcagagaaucgggcauugagcugaccggccaccuggugccccaccacgauggccugaggguuugguguccagaaucaggggcucauaucccucuuccgccauccucugaaggcugccccuggagcugucgucuccuggguaucggaggacaccuuucuccacaaggcacgcugacccugccugaagagcacccuugcuuaaaggccccacggcucagaugccagucuugcaagcuggcacaggccccagggcucagggcuggggaaggcucaccagaggaaucucugggugggcgcaggaaaaggaaugugaauacagcuccccaguuccagccucccagcuaccaggccacagugccugagaaccagccugcugguaccucuguugcauccuuaagagccauugauccagaugagggugaggcgggucgacuugaguacaccauggaugcccucuuugauagccgcuccaaucauuucuucuccuuggacccaaucaccgguguugucaccacagcugaggagcuggaucgggagaccaagagcacccacgucuucagggucacugcacaggaucacgguaugccccgacggagugccuuggccacgcuuaccaucuuggugaccgacaccaacgaucacgacccuguuuuugagcagcaagaguacaaggagagccucagggagaaccuggagguuggcuaugaggugcuuacagucagggccaccgacggcgacgccccucccaaugccaacauucuguaccgccugcuggagggggccggaggcagccccucagacgccuuugagaucgauccucgcucgggggugauccgaacccgcggcccuguagaccgggaggaaguggaauccuacaaguuaacaguggaggcgagugaccagggccgggacccaggcccgcggaguuccacagccauuguuuuccugucgguggaggaugauaaugacaacgccccccaguuuagcgagaagcguuaugugguccaggugcgggaggaugugaccccaggagccccaguucuccgagucaccgccuccgauagagacaagggcagcaaugcccuagugcacuacagcaucaugaguggcaaugcucggggccaguucuaucuggaugcucagacuggagcccuggaugugguaagcccacucgacuaugagacaaccaaagaguauacgcuucggauccgggcucaggacgguggccguccuccacucuccaaugucucuggccuaguaacagugcaaguccuagacaucaacgauaacgcccccaucuuugucagcaccccuuuccaggccaccguccuagagagugucccuuuaggcuaccuuguucugcacguccaggcaauugaugcugacgcuggugauaacgcccgccucgaguauagccuggcagggguugggcacgacuuucccuucaccauuaacaauggcacaggcuggaucucuguggccgcagaguuggaucgggaagagguugauuucuacagcuuugguguagaggcccgggaccauggcaccccagcgcucacggccucagccagugucaguguaaccauccuggacgucaaugacaacaacccaaccuucacgcagccagaguacaccguucggcucaacgaggacgccgccgugggcaccaguguggugaccgugucagccguggaucgagacgcucacagugucauuaccuaccagaucaccagcggcaacacccgcaaccgcuucucuaucaccagccaaaguggugguggacuggucu

SEQ ID NO: 10031 - RNA, 2501 nt, Mus musculus
gagcaauccaaugcuuuuuucuuuuauggagcuuuuccuuggcuggagaggccuccgagaaacagcagccuuaaacaaguuacaaagaaaagaaucagggaaaaugcccagcacacuagcauaauucauucuagccaaggcauugcuccaacuuuguugaugauuuguuuuaaggauacaggacacagggaggauuuuuuuuaacucaaauggucauuucuauuaacaaaacaaaaauaaacaaacaaaagagaaaugaaguuagaaagagagguagaaaaaacaauuuacccagacucugaggagacaaaaccuucccuugggucacuaaauccaccaagauggaaaugagagccacccauucuaguuuucgagcccacgccauuuccacuggcauugccacguucaguguccagcccugagauuccuucaagcgaaaaucgacugcuugcucacagaaggcaccaacugcccauucugggugcagggcagacaugcauaccccaacacacacacacacacacacacacacacacaccucgaagagaccagcccaccuucucauuaccaugccaaaaaaaaaguagcuuuguaggaggucauuugacaaguaagccguuuucugggcucuauuaauaacucccuaggagcaggugugcugaggguccgauggucagaggguaaagcgagguguggugugggccgccaggccuugaaguaaacaggaaagcuuggcgccuccgugaagcaacugccuauucuucuuuuuaaaacuucugucuuuacuccuccgccucacccaaccgccccacaaguucauuuauuacguuuaaagguauucacggagaaccccuccuaagagauugcagcaaauccuagacguuucuccaugaacugauugcuuaagaaaguuuuaacuuuagccaacgcuuacuugcacacacacacacacgaaagucacccugcuagcgauaacgaagcacgccacuuuguuuuaacuucagguacauuaauuuccagaaacacauacugcuaaguuugcaugggcacuuuuaacuuccuccgcuccccacacccccaacauugccuccucucaacagaacuagcaaucccuaaagggcacacagcacuacuuaaguuggacacacagcacuaaauaaguacucuaaagucugcacaguaauugaucaacucuauaacaaaugaggggggaggggacccuagagacauuguagucauuucugugacaaaagcuuacgaaacucaacauuucuccacucuuaucgcuacaguccauucucaggcaauggaaauuauuggcguggugccugauaauuuugucuacaggauuucaaaaaaaaaaaaauaauaauaauaagcgucuucccuuuucuccguucuaaugaaucacagcuucucuagcaugcccucccccagucguuucuauaauuuggaaauuaaucuuuuuuuuuuucuaacuucauaaacuccgugccccaagaagaagucagucaagaaggacuccauagcaucuuggugaugcccggguucguuuugcuuuguuuuuucucaaaguuuuuguuuguuucguuuguguuuaaagguucguucuugacaccuggacgccccauagccggagccugcgaggcucacaacccccuaccucgcucaagccggacgaagcugcguccgcaggacucugggucuacaccgcgcgauccgcaucuugcugcugucggcgacugacggcgaccagcucacucgcaaaguucccugagcugggguccccucccuccucagcggugcacuccaauggccagcccugccugcgcugcccgcaccacuuuugcaagacgaagucucugagcgccccgccgaggcuggguggcuccucuaggaagggacugggagggguuaaugcuuuuaacuccuccgcccucugccagcggcagggggccccucagggucugggcugcuaagaagcagccucccagaaagaucuggggcagagugacuaaaauaaaaccaaaugaauaggagccccuccgccccaaccagcagagagaagggaagagaaggggcggagccuggcagcuccuaaauucuaauucacacagcuucccgcaguccccagcgcgggacggacucugaaacuaggcauggggaucccugggaaaacuuuucuucguuaaaaaucuuagaggacagaggacaagccugcacuugguagaggagcuuucuggucccagaccccacagcccugaggauccguguagcccgagugguccggugcccugggggccacuuccacgcggucaggggaaacccgagccacugcccggagagccgcagccacgccgcagagaggggauccugagaaggucggaggagagcagccccgaaguacugaaaagcuucuguccuccaccuccucuuccuccacccccuccacuccgauccuggugaagccuugaaacuugcggucuggugggcagaaagug

SEQ ID NO: 10032 - RNA, 2501 nt, Mus musculus
cacuuucugcccaccagaccgcaaguuucaaggcuucaccaggaucggaguggaggggguggaggaagaggagguggaggacagaagcuuuucaguacuucggggcugcucuccuccgaccuucucaggauccccucucugcggcguggcugcggcucuccgggcaguggcucggguuuccccugaccgcguggaaguggcccccagggcaccggaccacucgggcuacacggauccucagggcuguggggucugggaccagaaagcuccucuaccaagugcaggcuuguccucuguccucuaagauuuuuaacgaagaaaaguuuucccagggauccccaugccuaguuucagaguccgucccgcgcuggggacugcgggaagcugugugaauuagaauuuaggagcugccaggcuccgccccuucucuucccuucucucugcugguuggggcggaggggcuccuauucauuugguuuuauuuuagucacucugccccagaucuuucugggaggcugcuucuuagcagcccagacccugaggggcccccugccgcuggcagagggcggaggaguuaaaagcauuaaccccucccagucccuuccuagaggagccacccagccucggcggggcgcucagagacuucgucuugcaaaaguggugcgggcagcgcaggcagggcuggccauuggagugcaccgcugaggagggaggggaccccagcucagggaacuuugcgagugagcuggucgccgucagucgccgacagcagcaagaugcggaucgcgcgguguagacccagaguccugcggacgcagcuucguccggcuugagcgagguaggggguugugagccucgcaggcuccggcuauggggcguccaggugucaagaacgaaccuuuaaacacaaacgaaacaaacaaaaacuuugagaaaaaacaaagcaaaacgaacccgggcaucaccaagaugcuauggaguccuucuugacugacuucuucuuggggcacggaguuuaugaaguuagaaaaaaaaaaagauuaauuuccaaauuauagaaacgacugggggagggcaugcuagagaagcugugauucauuagaacggagaaaagggaagacgcuuauuauuauuauuuuuuuuuuuuugaaauccuguagacaaaauuaucaggcaccacgccaauaauuuccauugccugagaauggacuguagcgauaagaguggagaaauguugaguuucguaagcuuuugucacagaaaugacuacaaugucucuaggguccccuccccccucauuuguuauagaguugaucaauuacugugcagacuuuagaguacuuauuuagugcuguguguccaacuuaaguagugcugugugcccuuuagggauugcuaguucuguugagaggaggcaauguuggggguguggggagcggaggaaguuaaaagugcccaugcaaacuuagcaguauguguuucuggaaauuaauguaccugaaguuaaaacaaaguggcgugcuucguuaucgcuagcagggugacuuucgugugugugugugugcaaguaagcguuggcuaaaguuaaaacuuucuuaagcaaucaguucauggagaaacgucuaggauuugcugcaaucucuuaggagggguucuccgugaauaccuuuaaacguaauaaaugaacuuguggggcgguugggugaggcggaggaguaaagacagaaguuuuaaaaagaagaauaggcaguugcuucacggaggcgccaagcuuuccuguuuacuucaaggccuggcggcccacaccacaccucgcuuuacccucugaccaucggacccucagcacaccugcuccuagggaguuauuaauagagcccagaaaacggcuuacuugucaaaugaccuccuacaaagcuacuuuuuuuuuggcaugguaaugagaaggugggcuggucucuucgagguguguguguguguguguguguguguguguguugggguaugcaugucugcccugcacccagaaugggcaguuggugccuucugugagcaagcagucgauuuucgcuugaaggaaucucagggcuggacacugaacguggcaaugccaguggaaauggcgugggcucgaaaacuagaauggguggcucucauuuccaucuugguggauuuagugacccaagggaagguuuugucuccucagagucuggguaaauuguuuuuucuaccucucuuucuaacuucauuucucuuuuguuuguuuauuuuuguuuuguuaauagaaaugaccauuugaguuaaaaaaaauccucccuguguccuguauccuuaaaacaaaucaucaacaaaguuggagcaaugccuuggcuagaaugaauuaugcuagugugcugggcauuuucccugauucuuuucuuuguaacuuguuuaaggcugcuguuucucggaggccucuccagccaaggaaaagcuccauaaaagaaaaaagcauuggauugcuc

SEQ ID NO: 10033 - RNA, 2501 nt, Mus musculus
gaauacucugguuccacucaggauuuaaaucguggcuacugauauuuauuagaccuguggugauaauaauggcaggcauggugugucacaaagagguggguggggaaaaggagagagaaacagagagacagaggcaaagacaaaaaacacauagaggagacacagacacucagaugagagagagagagagagagagagagagagagagagagagagagagagagagagagagagaaugaauuugauuuccacagcaucagccccuuaagggaaggugagauuccuaagagaucaguagagagcacuagggaacucgcugcuguguugccauggugaugauggcaauggcaaugacaguggcaccagauuucccaguuccugggaagccccuccggcuccugugggugggcggcggcgaucggugcagcaaauccgcgcucgcacccgggccugcggggcaggggcgcggcgcucgauuuccuuuccugccuccgcagccccugugcgcaugcucggccuacgcggccccagccuuugauugaucggucggcagcggcugcgacccugggcgucagacgggcggugauggggagcccggcgcugggagcggcucagugaucagcgguggaggccggugacuacuggugaguaccgcggcauggggcuccgcaagaagaacgccaggaaccccccgguguugagccacgaauucauggugcagaaccacgcggauauggucuccugcgugggcauguucuucgugcuggggcuuauguucgagggcaccuccgagaugucgaucgcguuccucacucugcagcauggagucguugucccagcggaagggcugcccuccggguccaggacccuguaccauuauggggucaaagaucuggccacaguguucuucuacaugcugguggccaucaucauccacgccaccauucaggaguacgugcuagauaagcucagcaggagacugcagcucaccaaaggcaaacaaaacaaacugaaugaggccgggcagcugaguguguucuauauaguguccgggaucuggggcaugaucauucuggccucugagaacugccugucagacccuacacucuuguggaagucucagccccacaacaugaugacauuucagaugaaauuuuucuacauuucacaguuggcuuacugguuucauagcuuuccggagcuuuacuuccagaaagucaggaagcaagauaucccgggucagcucaucuacauuggccuccaccucuuccacauuggaggggccuaucucuuguacuugaaccacuugggccugcugcugcugaugcugcacuacgccguagagcuccucuccagcgugugcagccugcuuuacuuuggugaugagcgguaccagaaaggguugucucuguggccuaucguguuuauauccgggagacucgugacauugauugucucggugguuacaguagggcuucaccuggccgggacaaaucggaauggcaaugcacucucugguaaugucaaugugcuggcagcuaaaaucgcuguucuguccucgaguugcaguauccagguguacauaacauggaccuugacuacugucuggcuucagagaugguuagaagacgcgaaccuucauguuuguggaaggaagagacgguccagggcgagaaaaggcacagaaaauggaguggagaauccgaauagaauagacucuccaccaaagaagaaagagaaggcuccuuaagcagcuucaagcuaauugauucuuaccuccaagggaauccacuccuugcuauguggugucucugugcuagagaguuucuguuuuucagaacgggucgugcuuuuuuaaauauugcuauuguuauugucuaauguguuuuuaaggguuggcagcgguaugagugguggugggaauuaagauuaaaccacucagccucuaaauccugucagaauaguuaacagaccaacaucguauuuaguuuagauuguuaccucaacgauuguccaaacguuucguggugaugacugcagaauuguguguauaaauaauaguuuccugcuuccaguguucuuuaucgcauuaacaagucuggcagcaaagugguuuucuccauguucucuugcaggauaaaguggaaaaucugauaaagguggaacuuaaaucaguauuauguaaucguugggauuccuuuuuaaaguuguuuuaaauuuacaauggaaaguauuugucaaacccccaaaguauguguuuaauuuuguaauuagugacugcuagugcuaugcccccauuaaagcaucaaacuccgaauagaugacauguguggugauauugacauuuaucgaaucaaaauaccuuuaauaaauaucauggguuacugaagaggugaacaacuucuuccuguuuauuuuaaacacuuguccaggaaaacucacaaaauucaaccuuacugaaaaaaaaucguaucuacucaauauuuacuaagaaugguuuu

SEQ ID NO: 10034 - RNA, 2501 nt, Mus musculus
aaaaccauucuuaguaaauauugaguagauacgauuuuuuuucaguaagguugaauuuugugaguuuuccuggacaaguguuuaaaauaaacaggaagaaguuguucaccucuucaguaacccaugauauuuauuaaagguauuuugauucgauaaaugucaauaucaccacacaugucaucuauucggaguuugaugcuuuaaugggggcauagcacuagcagucacuaauuacaaaauuaaacacauacuuuggggguuugacaaauacuuuccauuguaaauuuaaaacaacuuuaaaaaggaaucccaacgauuacauaauacugauuuaaguuccaccuuuaucagauuuuccacuuuauccugcaagagaacauggagaaaaccacuuugcugccagacuuguuaaugcgauaaagaacacuggaagcaggaaacuauuauuuauacacacaauucugcagucaucaccacgaaacguuuggacaaucguugagguaacaaucuaaacuaaauacgauguuggucuguuaacuauucugacaggauuuagaggcugagugguuuaaucuuaauucccaccaccacucauaccgcugccaacccuuaaaaacacauuagacaauaacaauagcaauauuuaaaaaagcacgacccguucugaaaaacagaaacucucuagcacagagacaccacauagcaaggaguggauucccuuggagguaagaaucaauuagcuugaagcugcuuaaggagccuucucuuucuucuuugguggagagucuauucuauucggauucuccacuccauuuucugugccuuuucucgcccuggaccgucucuuccuuccacaaacaugaagguucgcgucuucuaaccaucucugaagccagacaguagucaagguccauguuauguacaccuggauacugcaacucgaggacagaacagcgauuuuagcugccagcacauugacauuaccagagagugcauugccauuccgauuugucccggccaggugaagcccuacuguaaccaccgagacaaucaaugucacgagucucccggauauaaacacgauaggccacagagacaacccuuucugguaccgcucaucaccaaaguaaagcaggcugcacacgcuggagaggagcucuacggcguagugcagcaucagcagcagcaggcccaagugguucaaguacaagagauaggccccuccaauguggaagagguggaggccaauguagaugagcugacccgggauaucuugcuuccugacuuucuggaaguaaagcuccggaaagcuaugaaaccaguaagccaacugugaaauguagaaaaauuucaucugaaaugucaucauguuguggggcugagacuuccacaagaguguagggucugacaggcaguucucagaggccagaaugaucaugccccagaucccggacacuauauagaacacacucagcugcccggccucauucaguuuguuuuguuugccuuuggugagcugcagucuccugcugagcuuaucuagcacguacuccugaaugguggcguggaugaugauggccaccagcauguagaagaacacuguggccagaucuuugaccccauaaugguacaggguccuggacccggagggcagcccuuccgcugggacaacgacuccaugcugcagagugaggaacgcgaucgacaucucggaggugcccucgaacauaagccccagcacgaagaacaugcccacgcaggagaccauauccgcgugguucugcaccaugaauucguggcucaacaccgggggguuccuggcguucuucuugcggagccccaugccgcgguacucaccaguagucaccggccuccaccgcugaucacugagccgcucccagcgccgggcuccccaucaccgcccgucugacgcccagggucgcagccgcugccgaccgaucaaucaaaggcuggggccgcguaggccgagcaugcgcacaggggcugcggaggcaggaaaggaaaucgagcgccgcgccccugccccgcaggcccgggugcgagcgcggauuugcugcaccgaucgccgccgcccacccacaggagccggaggggcuucccaggaacugggaaaucuggugccacugucauugccauugccaucaucaccauggcaacacagcagcgaguucccuagugcucucuacugaucucuuaggaaucucaccuucccuuaaggggcugaugcuguggaaaucaaauucauucucucucucucucucucucucucucucucucucucucucucucucucucucucucucucaucugagugucugugucuccucuauguguuuuuugucuuugccucugucucucuguuucucucuccuuuuccccacccaccucuuugugacacaccaugccugccauuauuaucaccacaggucuaauaaauaucaguagccacgauuuaaauccugaguggaaccagaguauuc

SEQ ID NO: 10035 - RNA, 2501 nt, Mus musculus
cguggcucgcaggccucccggagucccgggaacacugauuggccagcugcgccucgcgaccuccuuucauuaauaaauuagcggcacgcuccagccgagcgcgagccaccaaucacaauagacagcggcggcgacaacagccgcagcuugagccacugccgccgccgcggcuucgguagcuugggcugcagccuggagcgccaacaggagcuuuagaaccauuuuaugcugauuagauaaaggggggacggaggggcgggggugauggaggaggaggauggauggccaggccaggggagggggagagggacuaaagaaagggaaagaaaugaaugaugauaauacgaugaaaagaauaagcuggggagggagagcgggggaccaggacaggcggaggaggagagggcgggggaaggguaggugaggagggggccccggggcagaucugauuguuuucuuggugguauauaagggguuuuaaggagagucgugugccagacacgcagccacugaaccacaagcagcucggcuuuaacuggagugccuuggagucgcgugccagcagccacacggccagggacugacugacagacaaccacgcacgagaacgacaacacacgagacucgggcgagcugccgcggucguccgggcucuuggcaaagucgcccagccgagaggcccccccgcggaggugcgccuaggaagcgccaagcccgcggcgcggaggacaccgugcucgguuccgggcugcggggacauucccggacacacaccggagcagcagcugcgccgcgacacaucuggagccgcguagguaagugugcaugccgcggcucuccacuucgcaggcaguguccccacgcaggcucacgccgcccacgcuaacuccaucgcucuagacgcagugacuucugugaccggcagaagguggcucgagcccggggcgcuccuccccagcucuguccucgccaucuucgcgaaugcacauugagggagauggagggggggggggcggggcgcggcgccagcgacacuuuacccuguccauucugggaauaaauuucaucugccucuucuuucucaggauguucgucaaaucugagacucuggaguugaaggaggaagaggagguacugaugcugcugggcucggcuuccccggccucggcgacccugaccccgauguccuccagcgcggacgaggaggaggacgaggagcugcgccggccgggcuccgcgcgugggcagcguggagcggaagccgggcagggggugcagggcaguccggcgucgggugccggggguugccggccagggcggcugcugggccugaugcacgagugcaagcgucgcccgucgcgcucacgggccgucucccgaggugccaagacggcggagacggugcagcgcaucaagaagacccgcaggcucaaggccaacaaccgcgagcgcaaccgcaugcacaaccuaaacgccgcgcuggacgcgcugcgcgaggugcugcccaccuuccccgaggaugccaagcucacgaagaucgagacgcugcgcuucgcccacaauuacaucugggcgcucaccgagacucugcgccuggcggaccacugcgccggcgccgguggccuccagggggcgcucuucacggaggcggugcuccugagcccgggagcugcgcucggcgccagcggggacagcccuucuccaccuuccuccuggagcugcaccaacagcccggcgucauccuccaacuccacguccccauacagcugcacuuuaucgcccgcuagccccgggucagacguggacuacuggcagcccccaccuccggagaagcaucguuaugcgccucaccugccccucgccagggacuguaucuagagcugcgggucucccucucucguccucuacccggcccucuucccauccuucucccgccccucacccuccacgccccggacuccacuucacagagcagagguggcccuugcaauccccucggcggcuggugcauucggggguggagaccagcucugguuuauugaagaugugaggauuuauggucaaagaggacuauggcgugugggagugggggcuggcguggggaaccucguaagacuguaaaagacacugagaaaaaguaccauaacuaacgagugugcagagcagacugacgcuccuccccucucucagagcugcuggaggagaacuccgggcaggcaguucgugugaaucucucagagggaaugcaacuggucccugugaucuuuucaccuucguuucuacauagagauguuaaugucagucgaaagaaauguauuuuagcaucugaaugaauuuacugguaauaauauuauccacacauuugcaauggcuggcaucugcucuauucccauugcugucugcaggcugugggaauuucaccugucaaaccaaacuuucccucucugaugugcacuuuguuuuuuucccagauucgucacaaugccuauugucccgcccuu

SEQ ID NO: 10036 - RNA, 2501 nt, Mus musculus
aagggcgggacaauaggcauugugacgaaucugggaaaaaaacaaagugcacaucagagagggaaaguuugguuugacaggugaaauucccacagccugcagacagcaaugggaauagagcagaugccagccauugcaaauguguggauaauauuauuaccaguaaauucauucagaugcuaaaauacauuucuuucgacugacauuaacaucucuauguagaaacgaaggugaaaagaucacagggaccaguugcauucccucugagagauucacacgaacugccugcccggaguucuccuccagcagcucugagagaggggaggagcgucagucugcucugcacacucguuaguuaugguacuuuuucucagugucuuuuacagucuuacgagguuccccacgccagcccccacucccacacgccauaguccucuuugaccauaaauccucacaucuucaauaaaccagagcuggucuccacccccgaaugcaccagccgccgaggggauugcaagggccaccucugcucugugaaguggaguccggggcguggagggugaggggcgggagaaggaugggaagagggccggguagaggacgagagagggagacccgcagcucuagauacagucccuggcgaggggcaggugaggcgcauaacgaugcuucuccggaggugggggcugccaguaguccacgucugacccggggcuagcgggcgauaaagugcagcuguauggggacguggaguuggaggaugacgccgggcuguuggugcagcuccaggaggaagguggagaagggcuguccccgcuggcgccgagcgcagcucccgggcucaggagcaccgccuccgugaagagcgcccccuggaggccaccggcgccggcgcagugguccgccaggcgcagagucucggugagcgcccagauguaauugugggcgaagcgcagcgucucgaucuucgugagcuuggcauccucggggaaggugggcagcaccucgcgcagcgcguccagcgcggcguuuagguugugcaugcgguugcgcucgcgguuguuggccuugagccugcgggucuucuugaugcgcugcaccgucuccgccgucuuggcaccucgggagacggcccgugagcgcgacgggcgacgcuugcacucgugcaucaggcccagcagccgcccuggccggcaacccccggcacccgacgccggacugcccugcacccccugcccggcuuccgcuccacgcugcccacgcgcggagcccggccggcgcagcuccucguccuccuccucguccgcgcuggaggacaucggggucagggucgccgaggccggggaagccgagcccagcagcaucaguaccuccucuuccuccuucaacuccagagucucagauuugacgaacauccugagaaagaagaggcagaugaaauuuauucccagaauggacaggguaaagugucgcuggcgccgcgccccgcccccccccccuccaucucccucaaugugcauucgcgaagauggcgaggacagagcuggggaggagcgccccgggcucgagccaccuucugccggucacagaagucacugcgucuagagcgauggaguuagcgugggcggcgugagccugcguggggacacugccugcgaaguggagagccgcggcaugcacacuuaccuacgcggcuccagaugugucgcggcgcagcugcugcuccgguguguguccgggaauguccccgcagcccggaaccgagcacgguguccuccgcgccgcgggcuuggcgcuuccuaggcgcaccuccgcgggggggccucucggcugggcgacuuugccaagagcccggacgaccgcggcagcucgcccgagucucguguguugucguucucgugcgugguugucugucagucagucccuggccguguggcugcuggcacgcgacuccaaggcacuccaguuaaagccgagcugcuugugguucaguggcugcgugucuggcacacgacucuccuuaaaaccccuuauauaccaccaagaaaacaaucagaucugccccggggcccccuccucaccuacccuucccccgcccucuccuccuccgccuguccuggucccccgcucucccuccccagcuuauucuuuucaucguauuaucaucauucauuucuuucccuuucuuuagucccucucccccuccccuggccuggccauccauccuccuccuccaucacccccgccccuccguccccccuuuaucuaaucagcauaaaaugguucuaaagcuccuguuggcgcuccaggcugcagcccaagcuaccgaagccgcggcggcggcaguggcucaagcugcggcuguugucgccgccgcugucuauugugauugguggcucgcgcucggcuggagcgugccgcuaauuuauuaaugaaaggaggucgcgaggcgcagcuggccaaucaguguucccgggacuccgggaggccugcgagccacg

SEQ ID NO: 10037 - RNA, 2501 nt, Mus musculus
acccagacuuugcuccgcgcgaauagguuucugucuccccaggcucuggcccucccacucagauuuagaagggguuugacgcacaaccguuuuuucuccguccauuccauccuugucccuuuccuaccauccccaccauccugcuccccagcuugagugcuagcuccugccacuggucagcuccugucggucgguaguugccuccggccccugauccuccgcuccucccuccuggguucuguccgggaccgcagucuccugggccccugggccucacuucucagcccuagugguccccuguccccucgaucgccccugcacgcucccccacccccgcaguggcccaaggcugugcucgccccuugaucgcccagcguacagcaggcucggccgcccgcccgcgcgccacugugcacuggaguuugguggaaucucugcugacgucacgacacuccgcacacggagucggagcggagggaagagagagggaugagagcgagggaggggagagagagugcgagaccgagagagaaagccggagagcagcagacagaaacugccggcgcccgcuagcuuuagcagccccccgcguggacccucucggaacuuggcacccucaagauccccgcaguuccacccagacccgcuccacggcgcuggcugugcagcccgagccucggccgccuggcagucacccugggaagcggugggacggggagacagccguucucucuccgguagccgguaaguggaggcccucucucccacagagcugugagauaaugcgagucuggaaauuuguuccacucuggagaaccuccgccguguaugauuuguggcucgccgggcuuguuucuccagauucagcgcaguuggcaaacagaucuuacagagccccuguuccguucgcccucaaucgcagacacuagaacaguccuacccggcguugaagucgacuggaagccaggcauggcuggcaguuaaaacgaggcaucuucccugaaauuucgaugccaacaggguagggagaaauccuccagcugaggauuagcccagucaagauaaagggccagcuacaaaguuucagcuacuggaauagauuagccccuucccaucauuacccauuggaaaaaaaaggagauuccaucuuaaccggcgguuagugaccucucaggcccaagcgaauuaccugagagccaggccuagaugccaacccgcacaauuacuucggauuauaaauccuuuaaauugaucaucagucaacuccaaucuuguacugagggagaugcauuuuaaacggaugcggagaggccacuauuuugcaacugguaacuaaguaaaaacaugcgauuccaaaccagcgaaauacaguccuuuuauuccaauuaaaucaccuucccuaaacaauuuagaaaucaaacuauccuaggaggcugggauauuuuuguuuuuauucuauuuuguaggacuaccguauuuuuuugagguaaauuaaaauggggagagagucuuuuacuauuaugaauuacaauaauaugcauucauacauucuaaacgauuuaacgaacaaguaauuugauuuuuaagagaucucugcauccuuuucagaccauuaguuacaauuaaagauauuuuauucucaugcaguaucauuuagaggagacuccaccuaaaaccaauaauuucacagaaacaaagauuguuacugaagugaauugaggacuuguuguuguuguuguuguuguuguuguuguuguuguuuggggggcguugaaaaugagcacaguauuccaauaaucaaaguuuaguuucaaaacaaaguagcuacuucacuuauggaauguuuugcuuugccucagcaaaacuacgccuaaguuacugcccugcuuuguccuguaagcugagcacuguagcuccaaagcuccagaagcacacauuccacagagcuuuaaagaaagcuugcucauggugaagcacggggcugugcuaaagugguaucuuaauuuccuuaaaugauuacccacugcaaauuaauuugcuggcuaaucacaccaauuuaguucauuuaaaacauauggccucaugcuuuuuauuuuucagcuuuccaugaaugguucugcugugggauaagaaaggaaaugaaaagggugaaaugggaaagaauuuuuguuuuuuuguuuuuuguuuuuuguguuuucuuggacugauuagaacucguagcuucuucuacaauuccauccuuguacugcuugggcagaaaucauuuuugaaacaaacugcucuguuucuuagggcuugccuaucugccuggccggaguggcacugugcaugcuaauugcuggauagugcuucauuaacacaauauggaauggaagcugacccaaaccagauugcuugguauauacauuccaaccaggaugggaacuuuuggcaugagaauaacuucuaaucaggaaacgucuccuaucuaaaauguugagauuagccaucaaaaccagugu

SEQ ID NO: 10038 - RNA, 2501 nt, Mus musculus
acacugguuuugauggcuaaucucaacauuuuagauaggagacguuuccugauuagaaguuauucucaugccaaaaguucccauccugguuggaauguauauaccaagcaaucugguuugggucagcuuccauuccauauuguguuaaugaagcacuauccagcaauuagcaugcacagugccacuccggccaggcagauaggcaagcccuaagaaacagagcaguuuguuucaaaaaugauuucugcccaagcaguacaaggauggaauuguagaagaagcuacgaguucuaaucaguccaagaaaacacaaaaaacaaaaaacaaaaaaacaaaaauucuuucccauuucacccuuuucauuuccuuucuuaucccacagcagaaccauucauggaaagcugaaaaauaaaaagcaugaggccauauguuuuaaaugaacuaaauuggugugauuagccagcaaauuaauuugcaguggguaaucauuuaaggaaauuaagauaccacuuuagcacagccccgugcuucaccaugagcaagcuuucuuuaaagcucuguggaaugugugcuucuggagcuuuggagcuacagugcucagcuuacaggacaaagcagggcaguaacuuaggcguaguuuugcugaggcaaagcaaaacauuccauaagugaaguagcuacuuuguuuugaaacuaaacuuugauuauuggaauacugugcucauuuucaacgccccccaaacaacaacaacaacaacaacaacaacaacaacaacaaguccucaauucacuucaguaacaaucuuuguuucugugaaauuauugguuuuagguggagucuccucuaaaugauacugcaugagaauaaaauaucuuuaauuguaacuaauggucugaaaaggaugcagagaucucuuaaaaaucaaauuacuuguucguuaaaucguuuagaauguaugaaugcauauuauuguaauucauaauaguaaaagacucucuccccauuuuaauuuaccucaaaaaaauacgguaguccuacaaaauagaauaaaaacaaaaauaucccagccuccuaggauaguuugauuucuaaauuguuuagggaaggugauuuaauuggaauaaaaggacuguauuucgcugguuuggaaucgcauguuuuuacuuaguuaccaguugcaaaauaguggccucuccgcauccguuuaaaaugcaucucccucaguacaagauuggaguugacugaugaucaauuuaaaggauuuauaauccgaaguaauugugcggguuggcaucuaggccuggcucucagguaauucgcuugggccugagaggucacuaaccgccgguuaagauggaaucuccuuuuuuuuccaauggguaaugaugggaaggggcuaaucuauuccaguagcugaaacuuuguagcuggcccuuuaucuugacugggcuaauccucagcuggaggauuucucccuacccuguuggcaucgaaauuucagggaagaugccucguuuuaacugccagccaugccuggcuuccagucgacuucaacgccggguaggacuguucuagugucugcgauugagggcgaacggaacaggggcucuguaagaucuguuugccaacugcgcugaaucuggagaaacaagcccggcgagccacaaaucauacacggcggagguucuccagaguggaacaaauuuccagacucgcauuaucucacagcucugugggagagagggccuccacuuaccggcuaccggagagagaacggcugucuccccgucccaccgcuucccagggugacugccaggcggccgaggcucgggcugcacagccagcgccguggagcgggucuggguggaacugcggggaucuugagggugccaaguuccgagaggguccacgcggggggcugcuaaagcuagcgggcgccggcaguuucugucugcugcucuccggcuuucucucucggucucgcacucucucuccccucccucgcucucaucccucucucuucccuccgcuccgacuccgugugcggagugucgugacgucagcagagauuccaccaaacuccagugcacaguggcgcgcgggcgggcggccgagccugcuguacgcugggcgaucaaggggcgagcacagccuugggccacugcgggggugggggagcgugcaggggcgaucgaggggacaggggaccacuagggcugagaagugaggcccaggggcccaggagacugcggucccggacagaacccaggagggaggagcggaggaucaggggccggaggcaacuaccgaccgacaggagcugaccaguggcaggagcuagcacucaagcuggggagcaggaugguggggaugguaggaaagggacaaggauggaauggacggagaaaaaacgguugugcgucaaaccccuucuaaaucugagugggagggccagagccuggggagacagaaaccuauucgcgcggagcaaagucugggu

SEQ ID NO: 10039 - RNA, 2501 nt, Mus musculus
guuuuuaacuuuagcuuuagguagcacaucgccuuucuguccugaccugggguguggaaguuggggggggggggggcuggucuagaaauggauguagugagacacaaaaggaagagagggggugcuugcuggcuaaaccuauaccucucagucuuagacuuucuugcuucuuuacccuaacccucugauuccaagucuccucucccccaccuuauaguccuaaccaaaagccgaauagccuuuggcugggcaggagcagaauucccaggagcgcgccuguguagaccgggugggcacagcaaggaauuaguugggccucgcacugcugauaggugcagacagaaccaucccucugccgcggcucggggccucgugauugguguggagccacgucacuccgacccgaagaagggucugggaggaggcggaggcggggagagcuggggagggccgccgcagagugacgucuugccaccaggaagcccgccucugguuuuaagauguuaggccaacagggaagcgcggagccgcagaucuugccggucucucgcuggggugucuggaacugagcugcggcagggucuggcuccagcucgacugcccgagggggugugcgugcgagccgcggagggugugcucggaggcccgcgccguggcuguggccguggccguggcggcugcagccgccucggggaaucuaauaucagcuaccugucccugucacucuugacacuucgcugucagggcugcagcgcggggggcgggcaaagcgcucucguagcuguccuuauuggagggguaucaaggggagggagggaggcaagaaaagggucuuugcccauucuuguuucgcuuuggaucguggaagucggcucccuaaagaggcucgcagcgguucccuccugcccacguccccacgucugcguuggccccccugccuuucggcugccgaacucuuuuuggcuggagucugaagcuagaggagacagggcuggaggauucggcaguuugcguucccuggcucuuucaagucucggcuaacacggggacacuuggcgccuagagcgcuaccgagaaccggcggccaccggggcuccacuggcgguagcccuggacucauagggcuccgcacucccucguccaugaacugcaugaaaggcccgcugcccuuggagcaccgagcagccgggacuaagcugucggccgccuccucacccuucugucaccauccccaggcguuagccauggcuucgguccuagcuccuggccagccccgcuccuuggacuccuccaaacauagacuggaggugcauacaaucuccgauacuuccagcccugaagucgcagguaaggcgccgcgcugccccucggacacuugagcgcagcccccuggcgccucccggcccgcucgacccucgaggaagucgcccccuccuagggaaggcguggucggaguggucguucuguuaacucaagggagaacuuccgggauucuggauucuggugaccccgucccuuccauucaguccccugccgacuugguucccucccacgccgccgagucuaccuuggucuuccuucaguuucuugggucacggaugccucggcauuucuauucaagggcguucagaggccgccccaacucugccccccuccucuuguuagcuuuuaccacccggggagccucacgccuuuaaaaaguauuucuaaaauuacuuagaaaggccccuggcaacgaagcaaaucuccccaccccgcgaggagcuggaggacuugcguuccuaacucuauccuaacaucuacuuuccuaguccuccaaagccucauggaaaucugagguuugggguggggugggggugucuguaaaacacgcgcauguucgugucuuaaaaggauguguuucuucucaacgguguauacuuuugagcaaaggcuauaaaaaaaugaauguaccgccucagugagauaaacguguaaauaaaacgugcggcgcugggggaggggaagaaauggggcgcacacacccacacuuucaccgcucacccccagacacagcgcucccuaaggaacggaggugccgagcacagaccuuuccccggccagcagccgggcucuuugccgccucugccacccgguccgguagagagguuguagaugggagucugacccgaaacuauguguuucuuucugcuuugcuuuuucagagaaagauaagggccagcaaggaaagaaugaggaugugggcgccgaggacccguccaagaagaagcggcaacgccggcagaggacucauuucacuagccagcagcugcaggagcuggaagccacuuuccagagaaaccgcuacccagacauguccacucgcgaagaaaucgccguguggaccaaccuuacggaagcccgaguccggguaggagccagcacccaaucugggaaaacgagggggccgaggccuugccaagaaucagagccugcagaucauggguggcgguaggaguggu

SEQ ID NO: 10040 - RNA, 2501 nt, Mus musculus
accacuccuaccgccacccaugaucugcaggcucugauucuuggcaaggccucggcccccucguuuucccagauugggugcuggcuccuacccggacucgggcuuccguaagguugguccacacggcgauuucuucgcgaguggacaugucuggguagcgguuucucuggaaaguggcuuccagcuccugcagcugcuggcuagugaaaugaguccucugccggcguugccgcuucuucuuggacggguccucggcgcccacauccucauucuuuccuugcuggcccuuaucuuucucugaaaaagcaaagcagaaagaaacacauaguuucgggucagacucccaucuacaaccucucuaccggaccggguggcagaggcggcaaagagcccggcugcuggccggggaaaggucugugcucggcaccuccguuccuuagggagcgcugugucugggggugagcggugaaagugugggugugugcgccccauuucuuccccucccccagcgccgcacguuuuauuuacacguuuaucucacugaggcgguacauucauuuuuuuauagccuuugcucaaaaguauacaccguugagaagaaacacauccuuuuaagacacgaacaugcgcguguuuuacagacacccccaccccaccccaaaccucagauuuccaugaggcuuuggaggacuaggaaaguagauguuaggauagaguuaggaacgcaaguccuccagcuccucgcgggguggggagauuugcuucguugccaggggccuuucuaaguaauuuuagaaauacuuuuuaaaggcgugaggcuccccgggugguaaaagcuaacaagaggaggggggcagaguuggggcggccucugaacgcccuugaauagaaaugccgaggcauccgugacccaagaaacugaaggaagaccaagguagacucggcggcgugggagggaaccaagucggcaggggacugaauggaagggacggggucaccagaauccagaaucccggaaguucucccuugaguuaacagaacgaccacuccgaccacgccuucccuaggagggggcgacuuccucgagggucgagcgggccgggaggcgccagggggcugcgcucaaguguccgaggggcagcgcggcgccuuaccugcgacuucagggcuggaaguaucggagauuguaugcaccuccagucuauguuuggaggaguccaaggagcggggcuggccaggagcuaggaccgaagccauggcuaacgccuggggauggugacagaagggugaggaggcggccgacagcuuagucccggcugcucggugcuccaagggcagcgggccuuucaugcaguucauggacgagggagugcggagcccuaugaguccagggcuaccgccaguggagccccgguggccgccgguucucgguagcgcucuaggcgccaaguguccccguguuagccgagacuugaaagagccagggaacgcaaacugccgaauccuccagcccugucuccucuagcuucagacuccagccaaaaagaguucggcagccgaaaggcaggggggccaacgcagacguggggacgugggcaggagggaaccgcugcgagccucuuuagggagccgacuuccacgauccaaagcgaaacaagaaugggcaaagacccuuuucuugccucccucccuccccuugauaccccuccaauaaggacagcuacgagagcgcuuugcccgccccccgcgcugcagcccugacagcgaagugucaagagugacagggacagguagcugauauuagauuccccgaggcggcugcagccgccacggccacggccacagccacggcgcgggccuccgagcacacccuccgcggcucgcacgcacacccccucgggcagucgagcuggagccagacccugccgcagcucaguuccagacaccccagcgagagaccggcaagaucugcggcuccgcgcuucccuguuggccuaacaucuuaaaaccagaggcgggcuuccugguggcaagacgucacucugcggcggcccuccccagcucuccccgccuccgccuccucccagacccuucuucgggucggagugacguggcuccacaccaaucacgaggccccgagccgcggcagagggaugguucugucugcaccuaucagcagugcgaggcccaacuaauuccuugcugugcccacccggucuacacaggcgcgcuccugggaauucugcuccugcccagccaaaggcuauucggcuuuugguuaggacuauaaggugggggagaggagacuuggaaucagaggguuaggguaaagaagcaagaaagucuaagacugagagguauagguuuagccagcaagcacccccucucuuccuuuugugucucacuacauccauuucuagaccagccccccccccccccaacuuccacaccccaggucaggacagaaaggcgaugugcuaccuaaagcuaaaguuaaaaac

SEQ ID NO: 10041 - RNA, 2501 nt, Mus musculus
uggagaauaagacaccuucccaguaguaguccuacagugaucuaauuucuaauuguaaaguuaaauguacacacacccagcccacaggaguagggagaagaaaccagguuggcugcaaccaagaaagcucaggcuacuauucacgggaugguuucugaaagcuugaaauaaaacagauuagccagacucacagcuguugggggcggggaggagggggcaguuuugacuaaugcaccgggacgcugaaaugugcugaauaacagaucugucagagcagaaagaauguuugcuucguauaaagggcagauaaggaaaugggcaagaagaggagcuuauucaaaaaucaaaugcaaccaaccaagcucuuucuauacaacugccuccuccuccuccuccucuuccccaccacugcuguaagaaaagcccaaaaccaggccgugaagagugucucaaguguccucguauuuuacaagcugucugcaucagcaauccacauuauuucccucuccgauguaaaguguacccagagagacuccaaguuuaggaugcagauuuaugcaucagaucacacuuacaccugugacuguuagccuguuuagauucacaccuaccagacuuucuggacaccuaggcuguguguguguguguguguguguguguguguguguguguguguguguguguuucuuuguaaauggacaccuaggcuguguguguguguguguguguguguguuucuuuguaaauaugugugccccaaaguaaugcaccacaaauccaaaugugggcaaagaauugcuuuuggaaaauaaaaggcuuagccucuggcugcuuuccacucuucuuuaaacucuuuaucucuucaauucaucuucgcuuuacccucaggcucaaaguacaaaacaaccccaacuucuauuuccuccgaccagguggugaaccgggagcgggugccuuuuucuuccgcgcuccgaggcuuuuccucugguccccuccagggacaggaaagccaaucaauccuggaauugauucguuccaagauugcagguaaaacaggugcggcaucuucaaggcagcccugggacaagcucugagggauggggacaggggugagugguggugugagccagcgggaaaccuguccagcugaggccuucaguggggacugagcccgggaucuccggggagaucgcgcggugcgcugccuuggggggacacgcugagugacagcagagacccugccggagguuguugggaccugucagagcaagcaacagucaggcccgccaggucugagcggugccgcgugcuacacacacacacacacacacacacacacacacacacgcaccccgagcgccuccucucaguacucauguuaagcuuguguacaccguccccccuccgaaccacaaaccgagagcccucgggugccauuuguuccaaguacgguccucgccgccacccuuugucgaaucgccgggucaccugcaaguuuccccucgggacacaguccauccugaucacuggcuguagggacgcuccacgcgucaccugugucccugcuccugcccgcucucaccgcacacggggcacgagccucucuuucuccugagcccggagccaggcugcuccacucgaggucccugagggaaaggggagggcacccgagacccgccucaccucccgucgaagucggcagccaccugcagguagagcgaggacgcgagcaccgccgcuaggagcacagccaugccggaggaccgggacgcggggacgcugaagguugcggggagcugcgcgucccgggaucucccggccgccuucggcgcggcacccgcggcugcugggacgcacagagcgcagcgcgcagccgggcaggucugcggcgggcuggcagagccccuccggcucccuccuggcgaggggaggcgcugcggcgggagccgcgccgcccgcggggaggggcgaggcgggagggacgcgccgcgcagcccgccgcccucccugccccgccgcccuggugcccugggcgcgcgccggggcucgccccuccccgggccccaggggcaggggcggcucaggggcggggaugcggcgcgcaggcagccucggccacggguggcgcuugcccccgggcugcgagaaaaguugggagcagagcuagggagagggcuugucgggugaccugccugaaaaagugagcccagccgccagaggcuggggcgacagugggguuggaaguggaaguacgcguucuguggggguagacagaugcccccccacauacacacacagguggucuauaggggagaacccaacuuuucugcaccuaccggagggguuccuggacugaugaaggcaggcagacccagauugcuucuccuacagagcuggaauaucccugcaccuuuuaacggggguggggaguguggugggggggguucggcucucaggucgaauuuugaagaagaacucugggcucaggagaaagagaagaa

SEQ ID NO: 10042 - RNA, 2501 nt, Mus musculus
uucuucucuuucuccugagcccagaguucuucuucaaaauucgaccugagagccgaaccccccccaccacacuccccacccccguuaaaaggugcagggauauuccagcucuguaggagaagcaaucugggucugccugccuucaucaguccaggaaccccuccgguaggugcagaaaaguuggguucuccccuauagaccaccuguguguguaugugggggggcaucugucuacccccacagaacgcguacuuccacuuccaaccccacugucgccccagccucuggcggcugggcucacuuuuucaggcaggucacccgacaagcccucucccuagcucugcucccaacuuuucucgcagcccgggggcaagcgccacccguggccgaggcugccugcgcgccgcauccccgccccugagccgccccugccccuggggcccggggaggggcgagccccggcgcgcgcccagggcaccagggcggcggggcagggagggcggcgggcugcgcggcgcgucccucccgccucgccccuccccgcgggcggcgcggcucccgccgcagcgccuccccucgccaggagggagccggaggggcucugccagcccgccgcagaccugcccggcugcgcgcugcgcucugugcgucccagcagccgcgggugccgcgccgaaggcggccgggagaucccgggacgcgcagcuccccgcaaccuucagcguccccgcgucccgguccuccggcauggcugugcuccuagcggcggugcucgcguccucgcucuaccugcagguggcugccgacuucgacgggaggugaggcgggucucgggugcccuccccuuucccucagggaccucgaguggagcagccuggcuccgggcucaggagaaagagaggcucgugccccgugugcggugagagcgggcaggagcagggacacaggugacgcguggagcgucccuacagccagugaucaggauggacugugucccgaggggaaacuugcaggugacccggcgauucgacaaaggguggcggcgaggaccguacuuggaacaaauggcacccgagggcucucgguuugugguucggaggggggacgguguacacaagcuuaacaugaguacugagaggaggcgcucggggugcguguguguguguguguguguguguguguguguguguagcacgcggcaccgcucagaccuggcgggccugacuguugcuugcucugacaggucccaacaaccuccggcagggucucugcugucacucagcguguccccccaaggcagcgcaccgcgcgaucuccccggagaucccgggcucaguccccacugaaggccucagcuggacagguuucccgcuggcucacaccaccacucaccccuguccccaucccucagagcuugucccagggcugccuugaagaugccgcaccuguuuuaccugcaaucuuggaacgaaucaauuccaggauugauuggcuuuccugucccuggaggggaccagaggaaaagccucggagcgcggaagaaaaaggcacccgcucccgguucaccaccuggucggaggaaauagaaguugggguuguuuuguacuuugagccugaggguaaagcgaagaugaauugaagagauaaagaguuuaaagaagaguggaaagcagccagaggcuaagccuuuuauuuuccaaaagcaauucuuugcccacauuuggauuuguggugcauuacuuuggggcacacauauuuacaaagaaacacacacacacacacacacacacacagccuagguguccauuuacaaagaaacacacacacacacacacacacacacacacacacacacacacacacacacagccuagguguccagaaagucugguaggugugaaucuaaacaggcuaacagucacagguguaagugugaucugaugcauaaaucugcauccuaaacuuggagucucucuggguacacuuuacaucggagagggaaauaauguggauugcugaugcagacagcuuguaaaauacgaggacacuugagacacucuucacggccugguuuugggcuuuucuuacagcagugguggggaagaggaggaggaggaggaggcaguuguauagaaagagcuugguugguugcauuugauuuuugaauaagcuccucuucuugcccauuuccuuaucugcccuuuauacgaagcaaacauucuuucugcucugacagaucuguuauucagcacauuucagcgucccggugcauuagucaaaacugcccccuccuccccgcccccaacagcugugagucuggcuaaucuguuuuauuucaagcuuucagaaaccaucccgugaauaguagccugagcuuucuugguugcagccaaccugguuucuucucccuacuccugugggcuggguguguguacauuuaacuuuacaauuagaaauuagaucacuguaggacuacuacugggaaggugucuuauucucca

SEQ ID NO: 10043 - RNA, 2501 nt, Mus musculus
aacaaaagaaagccaagaaugaggauuguuguuuuuuuguuuuuguuuguuuguuuguuuggagguaugcuuuuaaccacuguacauaguguugggcuucauaaagacaauuucuuuucagauauaucauggacuuuucuuuuuuucuuuuuugaacagaggcucauaucccacccaccuguggggucaucacggucaagcccugaaagaaacuuacuuuuaggcugcuguacacugguuguccacaaggacgcacuucacagauccgggucucuuucaccaggcggcacucuggguugucauugguaacucguguggagaugccaguuccgcagcucuuggagcacugggaccaagacguggucugaacgaugcauuucuggccaugggcgugcagaggguugaaaagaacucgcgguucggugccaaagacuagaaagauaaaggaaauggaaggcuucuuagaugcuugcauacacacacugguuucuacaaaguugcagaccaagaaagcauuucugcacagugucuuaaggacucuauauccacuuaccaggaagccucuucagugagcugccuuuuccaauugcgauuaacucauuguuucucguuaacuccaccuccgaggcaucgaguccgaggaggucauccuggucguccagggaguccuuaaugcugucuucaucacaaacccacucuucacagcacugcccgcugacuuucaccagccggggguugggacagcccagauuggggagagacaguucuuggggacacagaggaaugcagcccacggcgccaucaauacaugugcacugguguuuacaguugggcuggaagcuuuccccguuuugguagauucuggaguuauauucacagggucugccuucugacugagcugcaaagacgaccaaaagagagagaggagaagguuaagauucgccgccacaggcugaaacucauacauauuuuccgcuguucaauucaauguaugguaaaguucccuacaguucccccgagacuccagagcugaacaauaaguuagucaggaaucacuuuuccguaugcgcuuuucguugggcccagacacucugaauugcauuccagacugcugaaaucaugugccuuucugccaagcuaccaucaacaaagcguccaccauacauggucucaaaauuacuaaacuucuggacuauggggacuauuauuuuuuuuaaaggggccaaaccacaagccucuuaccucugcagaucccuuucagagcgguggagcuggcgccgaaauugcauuccaaccccuugguguggucgcagggcugaguuuugcugcaguccucguugaguuguuuagcgcagaccuuacagcagccgcagccgucccggaccaacccgacucccggggcgcacuugggugccuccagagggcaguggcaggcggcggggcagguggagagcgccugcaagagggagaagcgcgugagauugcuuugcauugcucggggaggcacguaaacugcccugagccuaggucuggcuguggggcuccguccaccagaagugucucgaucgcgucccggcagccugaccaccccagcggcugcgucccaggaagaggcccccugggcauaaagcaacagcuaccuccgaacuuuucagucuaacuuucccugcggugaaagaucauggcccggggaaaggaaucgaugagggcagaccgggaagcagugguuaaaaaaaaaaauccaacucaccagucuggucaaguggagaagggugacggcgacagcgagcguccugaaggugcuggagcucauuguggcgcgcaggaggaaccggggcgagcgcggcgacacagaaccaacaagccggcgagcagcgggaucaaaugcgcccggagugcggugaggcgagggccgaggcggcggguguccuucucucgaggugcuggcggaggaggcgcagagauugcaggcgcuucucuggggcgcucucgcucacggucugccccagcgccgggagcccgcccuuuauaaugccugccuaggcgccgcguguugcagugacguagcucugucggcgcguucuagaauucucaaacaucucaggaauguugguuggcgcgggcugcugccaagcaccuccccuggcuccguugcaccuuuuccccccucuucucagauccaucagagagaaaaaaaaguucguuuuuuuccacuuuaaauaacaacuuccuuuggggagggcgggaugcuuggggcgcgagggugaugauuuugauugaagaggguauauggggggggggggcgugguguauguguuggugugaacccuucagaucuuugccuagacaugggagggcgggagacagaggaacaaaagugguuuuguuuggugaugccuaccgggaaaggcagcgagcuguuugcuuguuuacaaccaaggugagaguaaaguuaucuacugagaguccaaaggggagggggaguugguuucuaagccagg

SEQ ID NO: 10044 - RNA, 2501 nt, Mus musculus
ccuggcuuagaaaccaacucccccuccccuuuggacucucaguagauaacuuuacucucaccuugguuguaaacaagcaaacagcucgcugccuuucccgguaggcaucaccaaacaaaaccacuuuuguuccucugucucccgcccucccaugucuaggcaaagaucugaaggguucacaccaacacauacaccacgccccccccccccauauacccucuucaaucaaaaucaucacccucgcgccccaagcaucccgcccuccccaaaggaaguuguuauuuaaaguggaaaaaaacgaacuuuuuuuucucucugauggaucugagaagaggggggaaaaggugcaacggagccaggggaggugcuuggcagcagcccgcgccaaccaacauuccugagauguuugagaauucuagaacgcgccgacagagcuacgucacugcaacacgcggcgccuaggcaggcauuauaaagggcgggcucccggcgcuggggcagaccgugagcgagagcgccccagagaagcgccugcaaucucugcgccuccuccgccagcaccucgagagaaggacacccgccgccucggcccucgccucaccgcacuccgggcgcauuugaucccgcugcucgccggcuuguugguucugugucgccgcgcucgccccgguuccuccugcgcgccacaaugagcuccagcaccuucaggacgcucgcugucgccgucacccuucuccacuugaccagacuggugaguuggauuuuuuuuuuuaaccacugcuucccggucugcccucaucgauuccuuuccccgggccaugaucuuucaccgcagggaaaguuagacugaaaaguucggagguagcuguugcuuuaugcccagggggccucuuccugggacgcagccgcugggguggucaggcugccgggacgcgaucgagacacuucugguggacggagccccacagccagaccuaggcucagggcaguuuacgugccuccccgagcaaugcaaagcaaucucacgcgcuucucccucuugcaggcgcucuccaccugccccgccgccugccacugcccucuggaggcacccaagugcgccccgggagucggguugguccgggacggcugcggcugcuguaaggucugcgcuaaacaacucaacgaggacugcagcaaaacucagcccugcgaccacaccaagggguuggaaugcaauuucggcgccagcuccaccgcucugaaagggaucugcagagguaagaggcuugugguuuggccccuuuaaaaaaaauaauaguccccauaguccagaaguuuaguaauuuugagaccauguaugguggacgcuuuguugaugguagcuuggcagaaaggcacaugauuucagcagucuggaaugcaauucagagugucugggcccaacgaaaagcgcauacggaaaagugauuccugacuaacuuauuguucagcucuggagucucgggggaacuguagggaacuuuaccauacauugaauugaacagcggaaaauauguaugaguuucagccuguggcggcgaaucuuaaccuucuccucucucucuuuuggucgucuuugcagcucagucagaaggcagacccugugaauauaacuccagaaucuaccaaaacggggaaagcuuccagcccaacuguaaacaccagugcacauguauugauggcgccgugggcugcauuccucuguguccccaagaacugucucuccccaaucugggcugucccaacccccggcuggugaaagucagcgggcagugcugugaagaguggguuugugaugaagacagcauuaaggacucccuggacgaccaggaugaccuccucggacucgaugccucggagguggaguuaacgagaaacaaugaguuaaucgcaauuggaaaaggcagcucacugaagaggcuuccugguaaguggauauagaguccuuaagacacugugcagaaaugcuuucuuggucugcaacuuuguagaaaccaguguguguaugcaagcaucuaagaagccuuccauuuccuuuaucuuucuagucuuuggcaccgaaccgcgaguucuuuucaacccucugcacgcccauggccagaaaugcaucguucagaccacgucuuggucccagugcuccaagagcugcggaacuggcaucuccacacgaguuaccaaugacaacccagagugccgccuggugaaagagacccggaucugugaagugcguccuuguggacaaccaguguacagcagccuaaaaguaaguuucuuucagggcuugaccgugaugaccccacaggugggugggauaugagccucuguucaaaaaagaaaaaaagaaaaguccaugauauaucugaaaagaaauugucuuuaugaagcccaacacuauguacagugguuaaaagcauaccuccaaacaaacaaacaaacaaaaacaaaaaaacaacaauccucauucuuggcuuucuuuuguu

SEQ ID NO: 10045 - RNA, 2501 nt, Mus musculus
uacaaagauuuaacauagcaaggaaacugcaagugucucugcugucuggggguugguugcuaaacaagaaccucugcucaugcuccuuggaacaggaagaugagcauuauuuuugcacuugguaaacugaacaguugagagaaauuuucuugacuagguguuguuaaaauaucacuuacauuugaauucccagaucguauaacuuaguaaaucugacauuauuugaggucagauuauaacucuucuaggauucaaucaccauuaauuacauagauggugaagaaccuuaugcuacauguugaguucugugcucaucaaagagugaauagagcuaaaaugccucaagugacuacucaaaaauaaaauaauaaaaauaccaguggcugugcaucaggagccagacagucuucaguauaguaugaaucuccugcguauaaagucuguuauucccaagguugauucuuauuugcaagcuccugacuauaggagguggcauaaagucgggugugagcucugcuccuacuuacaauggaacaauuuucccucacaauguaaacaccuagugcuuuccuggccaaguuaaucuccaucaacugaaguagaccauauaaucaaaacacuuaaacgaagaaaacaaacauuuaacuggaaauacuggcuuggauuuugggaccccuuuguuucuucauuucaaauuuuuuuuuuuuuuuaaaugugaagcuuucucaaaggcuuaaguguaguaagcugacucuccuuugagcuaucaaggaauuuuaaaggcagggcaauggaucauugagagaguauaaaagaagccuuugggauuucaaauguacagauucagacucgauggaaucccacugguguuuggaaagcccgaggacuaucaugaagagaacagccauuuugucucuucuagcuccuguaaacgacaggcuaucuuuggacagauaccacgucuuuggguaucaaccaucucuccugagcccuucucacagucaaaucaaagcuguuacauaaaagugcagucaagacaaggcaaagggaauucugugucccuugcucaaggggcuguuaaugagcuuuuucuggccucuucuggcaacucucuaccucucccccuuguccuuuuacuccagugaggagggacucaaagcuaagggaccccaggaagagcaauggguuggcaguugggguagugggggcacucucacuaacaaaaacauuacauucuuugcaggaaggauguuugaaggguuuggguguuaaaguuggguuuacugacagccuagaugaagugcuauccgagguaaugaagagaacacaucuugggguuccgaaacuccgggggcaaaacaaaauuuguuuauguggagauagauaccucagcccuuaagggucccagagagacugguuccuaaauugggagacaacagcuuggggaucaacauuuggaagcuccagguaacuuugguccacaaaggcuccugccacgcaccuuccggcgcaaaugaccacuagaagucugcgaggagccccucaccgcaaauucaacucaccaggaaauugaugucgccugggcgaaccaggcgguagcugcauuuagcgcaguccuggcugcauuccgccugcacuguagccaggaggcaggacccaagcgccagcagccaggugcaaagccucaggaaccgcgccaugggcuguaggagagaagaacgcgccuguagggacccguucugucucugacaagguucucuuagagagaaccuugccggguggguggucguggaucaggaccagcagggacagucuuuccugagccccgcccacaacccaacaaccuccccgggugccucaaugagagcuuggacccuaguguuuccugcuguucuagugaugccugggacuauucuaucuuccuggagguauccuaucuucccacggggaguccuguuuuccugaugacauccuguccuuccgagggcgcccugucuucccuggcgucgguugcuuagggcaagauucuggagcgaacacugaaguucgcggcucgggagcaggcgcuugggggaauaggacccggacacccaaagcaaugaggaaccccgagaaaguuggacgaacgcaugcaccgagggaacaggcgacggucgccaaggcacgggcgacuuggggcaaagucacucacgcugccguugcuccagauggcgcagguuacuggaagagcguguaccagaugccacucugcaagagaaagaaagaaggcaaguguaaagcggccgcgucggggagcucugcgaggcgccgggcagcgucgcugggcagcggggcucugugcgccugccuugcuggcggcggccacagccacuuuauaauuaaccccaaaccgaaggaggcgcgcgcgccccaaucgccggcgggcugcagcugacgcaggcccuacgccaacccgcgccgacgccuagcgggaggggacguccccccagcacgcggccccg

SEQ ID NO: 10046 - RNA, 2501 nt, Mus musculus
cggggccgcgugcuggggggacguccccucccgcuaggcgucggcgcggguuggcguagggccugcgucagcugcagcccgccggcgauuggggcgcgcgcgccuccuucgguuugggguuaauuauaaaguggcuguggccgccgccagcaaggcaggcgcacagagccccgcugcccagcgacgcugcccggcgccucgcagagcuccccgacgcggccgcuuuacacuugccuucuuucuuucucuugcagaguggcaucugguacacgcucuuccaguaaccugcgccaucuggagcaacggcagcgugagugacuuugccccaagucgcccgugccuuggcgaccgucgccuguucccucggugcaugcguucguccaacuuucucgggguuccucauugcuuuggguguccggguccuauucccccaagcgccugcucccgagccgcgaacuucaguguucgcuccagaaucuugcccuaagcaaccgacgccagggaagacagggcgcccucggaaggacaggaugucaucaggaaaacaggacuccccgugggaagauaggauaccuccaggaagauagaauagucccaggcaucacuagaacagcaggaaacacuaggguccaagcucucauugaggcacccggggagguuguuggguugugggcggggcucaggaaagacugucccugcugguccugauccacgaccacccacccggcaagguucucucuaagagaaccuugucagagacagaacgggucccuacaggcgcguucuucucuccuacagcccauggcgcgguuccugaggcuuugcaccuggcugcuggcgcuuggguccugccuccuggcuacagugcaggcggaaugcagccaggacugcgcuaaaugcagcuaccgccugguucgcccaggcgacaucaauuuccuggugaguugaauuugcggugaggggcuccucgcagacuucuaguggucauuugcgccggaaggugcguggcaggagccuuuguggaccaaaguuaccuggagcuuccaaauguugauccccaagcuguugucucccaauuuaggaaccagucucucugggacccuuaagggcugagguaucuaucuccacauaaacaaauuuuguuuugcccccggaguuucggaaccccaagauguguucucuucauuaccucggauagcacuucaucuaggcugucaguaaacccaacuuuaacacccaaacccuucaaacauccuuccugcaaagaauguaauguuuuuguuagugagagugcccccacuaccccaacugccaacccauugcucuuccuggggucccuuagcuuugagucccuccucacuggaguaaaaggacaagggggagagguagagaguugccagaagaggccagaaaaagcucauuaacagccccuugagcaagggacacagaauucccuuugccuugucuugacugcacuuuuauguaacagcuuugauuugacugugagaagggcucaggagagaugguugauacccaaagacgugguaucuguccaaagauagccugucguuuacaggagcuagaagagacaaaauggcuguucucuucaugauaguccucgggcuuuccaaacaccagugggauuccaucgagucugaaucuguacauuugaaaucccaaaggcuucuuuuauacucucucaaugauccauugcccugccuuuaaaauuccuugauagcucaaaggagagucagcuuacuacacuuaagccuuugagaaagcuucacauuuaaaaaaaaaaaaaaauuugaaaugaagaaacaaaggggucccaaaauccaagccaguauuuccaguuaaauguuuguuuucuucguuuaaguguuuugauuauauggucuacuucaguugauggagauuaacuuggccaggaaagcacuagguguuuacauugugagggaaaauuguuccauuguaaguaggagcagagcucacacccgacuuuaugccaccuccuauagucaggagcuugcaaauaagaaucaaccuugggaauaacagacuuuauacgcaggagauucauacuauacugaagacugucuggcuccugaugcacagccacugguauuuuuauuauuuuauuuuugaguagucacuugaggcauuuuagcucuauucacucuuugaugagcacagaacucaacauguagcauaagguucuucaccaucuauguaauuaauggugauugaauccuagaagaguuauaaucugaccucaaauaaugucagauuuacuaaguuauacgaucugggaauucaaauguaagugauauuuuaacaacaccuagucaagaaaauuucucucaacuguucaguuuaccaagugcaaaaauaaugcucaucuuccuguuccaaggagcaugagcagagguucuuguuuagcaaccaacccccagacagcagagacacuugcaguuuccuugcuauguuaaaucuuugua

SEQ ID NO: 10047 - RNA, 2501 nt, Mus musculus
uccccucucaccaugcgcaccugcaauacaagcaguggucauuacccaaugugccacagccaggcucacagcucagaggaaaguuuauccuacagcccacggagcucaggaaagcagauguguucucuuugacccagccucuaguagcugcucagggccccagcuuagagaguggaaaaauaaaggagucuggauaguagacaguaucaccaccaccaccaacaacaacaacaacagcagcacacacacacacacacacacacacacacacacacacacacacaccuuggaaacaccagcuggaaaaagcguccucucagagcuccaggaugcaucuuauugcaaaacucaccagcucuucccuaagugauguucugggauccuuaacacugagagagaagugguuucuaaguucaagcagguccugaagccugaugcaguacuccuacccuguuucucagccucccgauucucuaguaccguacuaggcugcaagugaacucagcagugagaugcucagaacaaagcgagcacggagaaauuuugccugcagcuagcaggccauuuaaaagcaauuaaauugcguuuaaagagagaggcguggugagcuucaaaacccgguguugccugggaugagagacaccgggcuuucuagcaccggagaaagaugcuggcccugcuccuccuaugaaagauacuucuuauaagaaagcucuaggagguuacuaaaaccaaggucuuucucuuuuaaacaagcguuccauuucauucccugguugcugucugccaguccuuggcuacuaaagcgccccccaccccacccgcugcgaucaagagucuuuacuuucccucucuggucagggauccuggggguguguugagguuaggggggucagagugggagaguuguaccuggggccucagacucuaagagccagccacaagguuuaacuagguguucuuucgagggugggcuccccuaccucucaacagacaucaaaauuaaucaccuugcucauccccucuccaucuccuacacaaaccuacaagcaaaagggguuugaguggggauauauucccagaucuaagagccucccaaggacuaucucuucggugaaauggaauuaaauuguuuaaaacaaaaauguaagcuucauauuaguaaagagaagaggagaaaaguccucuccguccuaugacuacaacgaaaaugguaccuuugcaaggaaggcaaagacugaggugggagcuaggagucuccaucaccuugcugaggacauccuggagcgcugagaaaucaccgguucccagaggccccccauaccuacagacccuggcgcacuaaggucuguuccagcuuagcucugcccucccguuagccggccccacguccagcucaguuaucagacuugcuaaggauaaucagauaauucuguccugcagauuuaucagguaucccuuuucucugcugcucgucucuaccccuuuuucuggaucagggaaauaggaggugagaggcaagggacggagauccagaauggcccaguaccuuuuucuugggcccugguucccugcgaucugacagguacuugcccagcuugaaggugccaggcaccggcccaaggcgcaagccagccgggaugcagcagucagcguucacgcugguggccgaagugcgagaaguuccgugcauuguugccaccgccgccaggcagacgcuggggcucgcgggguccuccacggggcgcaagugacagaaccaggagcagccgcaugcagaggagggacccgcaccccgacgugcgucuucuguccgcggagugacgugggcgggcaugcacugcgccuuuucaauccgggcgggcgccuuuuggcacugcgagcgcaagggcgcggaguuuggugagagaguugcgcugugaagcagcugcagagucccacccgagagggucacauggagugguucccucagcccccugcauaaucgaggccucugaauggcuagcacacaaugguccaggcgaccuucccauuccuaaaaauccaauuugucaagggcgaagaaaaggcgcuggugaaucaaagguccggcgggaccauuaauccucagcaugggguauugucccugagacaguuacgauauuuuaagugacaaauccacuguauaauuucuccauaaauuuuacuuccuuuuauuguucaccgacaaaccaguuuugggaaauaagugacuacuuuaagucuacuuggcugauuccuuugagccuuggucuacuucaaagauucuuaauucucuccccuuggcuuuauuguaaaggagauuaaacaaagggacggggacuguuuggaggacuuguuaacuucuauugauuucuggcgugugccauacagaaauuaggcagguacuugaugggaaaacaccagaaaauaccuacacuuuuuaaauaacgaccauaguaccauuucagggauuggguucaggccaguccacaguuuagaac

SEQ ID NO: 10048 - RNA, 2501 nt, Mus musculus
guucuaaacuguggacuggccugaacccaaucccugaaaugguacuauggucguuauuuaaaaaguguagguauuuucugguguuuucccaucaaguaccugccuaauuucuguauggcacacgccagaaaucaauagaaguuaacaaguccuccaaacaguccccgucccuuuguuuaaucuccuuuacaauaaagccaaggggagagaauuaagaaucuuugaaguagaccaaggcucaaaggaaucagccaaguagacuuaaaguagucacuuauuucccaaaacugguuugucggugaacaauaaaaggaaguaaaauuuauggagaaauuauacaguggauuugucacuuaaaauaucguaacugucucagggacaauaccccaugcugaggauuaauggucccgccggaccuuugauucaccagcgccuuuucuucgcccuugacaaauuggauuuuuaggaaugggaaggucgccuggaccauugugugcuagccauucagaggccucgauuaugcagggggcugagggaaccacuccaugugacccucucgggugggacucugcagcugcuucacagcgcaacucucucaccaaacuccgcgcccuugcgcucgcagugccaaaaggcgcccgcccggauugaaaaggcgcagugcaugcccgcccacgucacuccgcggacagaagacgcacgucggggugcgggucccuccucugcaugcggcugcuccugguucugucacuugcgccccguggaggaccccgcgagccccagcgucugccuggcggcgguggcaacaaugcacggaacuucucgcacuucggccaccagcgugaacgcugacugcugcaucccggcuggcuugcgccuugggccggugccuggcaccuucaagcugggcaaguaccugucagaucgcagggaaccagggcccaagaaaaagguacugggccauucuggaucuccgucccuugccucucaccuccuauuucccugauccagaaaaagggguagagacgagcagcagagaaaagggauaccugauaaaucugcaggacagaauuaucugauuauccuuagcaagucugauaacugagcuggacguggggccggcuaacgggagggcagagcuaagcuggaacagaccuuagugcgccagggucuguagguauggggggccucugggaaccggugauuucucagcgcuccaggauguccucagcaaggugauggagacuccuagcucccaccucagucuuugccuuccuugcaaagguaccauuuucguuguagucauaggacggagaggacuuuucuccucuucucuuuacuaauaugaagcuuacauuuuuguuuuaaacaauuuaauuccauuucaccgaagagauaguccuugggaggcucuuagaucugggaauauauccccacucaaaccccuuuugcuuguagguuuguguaggagauggagaggggaugagcaaggugauuaauuuugaugucuguugagagguaggggagcccacccucgaaagaacaccuaguuaaaccuuguggcuggcucuuagagucugaggccccagguacaacucucccacucugaccccccuaaccucaacacacccccaggaucccugaccagagagggaaaguaaagacucuugaucgcagcgggugggguggggggcgcuuuaguagccaaggacuggcagacagcaaccagggaaugaaauggaacgcuuguuuaaaagagaaagaccuugguuuuaguaaccuccuagagcuuucuuauaagaaguaucuuucauaggaggagcagggccagcaucuuucuccggugcuagaaagcccggugucucucaucccaggcaacaccggguuuugaagcucaccacgccucucucuuuaaacgcaauuuaauugcuuuuaaauggccugcuagcugcaggcaaaauuucuccgugcucgcuuuguucugagcaucucacugcugaguucacuugcagccuaguacgguacuagagaaucgggaggcugagaaacaggguaggaguacugcaucaggcuucaggaccugcuugaacuuagaaaccacuucucucucaguguuaaggaucccagaacaucacuuagggaagagcuggugaguuuugcaauaagaugcauccuggagcucugagaggacgcuuuuuccagcugguguuuccaaggugugugugugugugugugugugugugugugugugugugugugugcugcuguuguuguuguuguugguggugguggugauacugucuacuauccagacuccuuuauuuuuccacucucuaagcuggggcccugagcagcuacuagaggcugggucaaagagaacacaucugcuuuccugagcuccgugggcuguaggauaaacuuuccucugagcugugagccuggcuguggcacauuggguaaugaccacugcuuguauugcaggugcgcauggugagagggga

SEQ ID NO: 10049 - RNA, 2501 nt, Mus musculus
gcucacacugugcugagcagcuggcgaaggaggagagcaccuccucaucccacaucgcuucuauuccaaucugagagcugccccucaccucccacaaaagcccuaaaacacgugggacuacaccaaugagacaauagcaguuggggcauaagaagccccgagggcguuauacacuuuagguuuucccgaagguugcaaaggaaucauuuaguauagcauguuuauauauaaaucacgagacaugugacuucuccggaaacaugucuacguagaccacaguuuggaguauucuugcugggaaauccuuugaacuaaaaggcacuuuaggaggcagcugcuauggaaacuaccccaccacugugcacuucucccagcucccgcaggcuggaguggcgguggggguggggccugaguaccgcacaguugaggggcagccuagugggggugggguagacuggggugggguggaggugggugggguggagguggguaggguguggguagaaagccugaagaccgcagcacaagccaggggcacugcagaaagcaggcggcaggguccgggugguccccgggccacgcuugcagagaaagcgagcagaaguccccgagggcgguggccagugcgcucuggacacccgaauucucucuagggggagaacguguguggccgagcaagcgguggcugcggccggcgagcgcgcgcccgguggugcugcgugugugugugugugugugugugugugugugugugugugugugugugugacaagcgucaggugacucgggucacgcagucacucccucgcgcucccggggagaacugccgcgcuccggcuggcuucucgggcagcagcggcagggagggggcugggcuccacugccacccccuugcucaccaggcgcggccccagggcgcugcgggccacucggcccacgcgggaccuuggaggcaagcgugggcgugaugagccaagugcugggcaagccgcagccgcagggugaggacggcggcgaggacgaggaggaggaugagcugguggggcuggcgggcuacgaggaugggcccgaguccucggacgccgagcuggacagcgggccggaggagggaggugagccaaccggccgagcgcucgcgguccccgcccugggagcgauguguguguguguguugggggugggggggaugcgggacgcgcggguccggggcgcugcggugggggaggggagcggccgggcugcagacggcggcggggagcagggucggaugucgagcuaaaagaagcagcuggcggcagcgugccggcugggucgcccacagcugcgcgugucauucuuccccgccguggccgcgggagggucugcggcgugggaccggggcgcuggggcggggcccgcgcugcaggugguauccgcgucucccgggagaccgcgggguucuagguccccagacacccugaaugcaucucgugucgcacccgggggugggcgccuggcgagcaauccuuggccgcugaagccaacuguuuguuguugccgaaggagcugaaguuagccuuucggauugggggcugcuugcauuucauucccgggacacaacaaagaaguugaguuuaggauuccagaauguuuuucuuuaauuuaaaaaaauuuuuuuuccccacaaaagcggaaggucacuuuaaaaggucaguugaacggggcuguuaacguucuccgaguuguaaauaucccagagaaaggauuaaucucuuuagugucucacacuaaagaaaccgaggaaugaaaguacccgugacaggaguuuuaagaacuuuuauugagaaucuaucgaacggaacuuaaaauucucucuacaaagccuuucucggaagacaguuuugauuuugcgucuggcagguacuucagugaaucagaaagggaauacaguuaacuaagacuuaagucuggcagaugaaaaacagcuuuucaagucgccucauuuccuggcuuuucuccagagaggacuagugcuggcuccccguuauuuaaacuugugugugcaccucugcgcuccacucauccgcacuucccuuaauuagucccacggucgaucguucagccacuuuuuuuuuuucccaaaaaaauuaaauugcucagguacuuuacuauuauauagcauuugguagauccgcccagggaaaggcugagugggauuguauuggcaaggcauuugcaaagauaggugcacaguagcucccuauugugguaguuuaaagagagaaagaagauccuauucuagaggggaaagccaguuauuugauacuguccugggggccagagaguuugcaaggaaggggcagaaccuauuuucuguagucuuuuuauuggagggccugggggcucuuuugaaauuugauuugaaguaaaccccugccggaggggaagaauuccugaaacaaaggcuuuuccagagcccagaaugggaggcucgcagugcaguuaaucuaaaggcuaaccug

SEQ ID NO: 10050 - RNA, 2501 nt, Mus musculus
cagguuagccuuuagauuaacugcacugcgagccucccauucugggcucuggaaaagccuuuguuucaggaauucuuccccuccggcagggguuuacuucaaaucaaauuucaaaagagcccccaggcccuccaauaaaaagacuacagaaaauagguucugccccuuccuugcaaacucucuggcccccaggacaguaucaaauaacuggcuuuccccucuagaauaggaucuucuuucucucuuuaaacuaccacaauagggagcuacugugcaccuaucuuugcaaaugccuugccaauacaaucccacucagccuuucccugggcggaucuaccaaaugcuauauaauaguaaaguaccugagcaauuuaauuuuuuugggaaaaaaaaaaaguggcugaacgaucgaccgugggacuaauuaagggaagugcggaugaguggagcgcagaggugcacacacaaguuuaaauaacggggagccagcacuaguccucucuggagaaaagccaggaaaugaggcgacuugaaaagcuguuuuucaucugccagacuuaagucuuaguuaacuguauucccuuucugauucacugaaguaccugccagacgcaaaaucaaaacugucuuccgagaaaggcuuuguagagagaauuuuaaguuccguucgauagauucucaauaaaaguucuuaaaacuccugucacggguacuuucauuccucgguuucuuuagugugagacacuaaagagauuaauccuuucucugggauauuuacaacucggagaacguuaacagccccguucaacugaccuuuuaaagugaccuuccgcuuuuguggggaaaaaaaauuuuuuuaaauuaaagaaaaacauucuggaauccuaaacucaacuucuuuguugugucccgggaaugaaaugcaagcagcccccaauccgaaaggcuaacuucagcuccuucggcaacaacaaacaguuggcuucagcggccaaggauugcucgccaggcgcccacccccgggugcgacacgagaugcauucagggugucuggggaccuagaaccccgcggucucccgggagacgcggauaccaccugcagcgcgggccccgccccagcgccccggucccacgccgcagacccucccgcggccacggcggggaagaaugacacgcgcagcugugggcgacccagccggcacgcugccgccagcugcuucuuuuagcucgacauccgacccugcuccccgccgccgucugcagcccggccgcuccccucccccaccgcagcgccccggacccgcgcgucccgcaucccccccacccccaacacacacacacacaucgcucccagggcggggaccgcgagcgcucggccgguuggcucaccucccuccuccggcccgcuguccagcucggcguccgaggacucgggcccauccucguagcccgccagccccaccagcucauccuccuccucguccucgccgccguccucacccugcggcugcggcuugcccagcacuuggcucaucacgcccacgcuugccuccaaggucccgcgugggccgaguggcccgcagcgcccuggggccgcgccuggugagcaaggggguggcaguggagcccagcccccucccugccgcugcugcccgagaagccagccggagcgcggcaguucuccccgggagcgcgagggagugacugcgugacccgagucaccugacgcuugucacacacacacacacacacacacacacacacacacacacacacacacacgcagcaccaccgggcgcgcgcucgccggccgcagccaccgcuugcucggccacacacguucucccccuagagagaauucggguguccagagcgcacuggccaccgcccucggggacuucugcucgcuuucucugcaagcguggcccggggaccacccggacccugccgccugcuuucugcagugccccuggcuugugcugcggucuucaggcuuucuacccacacccuacccaccuccaccccacccaccuccaccccaccccagucuaccccacccccacuaggcugccccucaacugugcgguacucaggccccacccccaccgccacuccagccugcgggagcugggagaagugcacaguggugggguaguuuccauagcagcugccuccuaaagugccuuuuaguucaaaggauuucccagcaagaauacuccaaacuguggucuacguagacauguuuccggagaagucacaugucucgugauuuauauauaaacaugcuauacuaaaugauuccuuugcaaccuucgggaaaaccuaaaguguauaacgcccucggggcuucuuaugccccaacugcuauugucucauugguguagucccacguguuuuagggcuuuugugggaggugaggggcagcucucagauuggaauagaagcgaugugggaugaggaggugcucuccuccuucgccagcugcucagcacagugugagc

SEQ ID NO: 10051 - RNA, 2501 nt, Mus musculus
accuggacgagcgagcggcgcgcgcgggggcccaggcggggggcgggaggcagcggcgggcagcgcaggccgccgggcccgggagaagcggagcggagaggagcgggggacacgggcggggccgccgcagcuccggaugggaccagcgcccgggcccguuaguccaggcaggagcuucgggagaagccgucacugggagagucaccccugccuuucccuccccucuggcccaggccucgcuucgcucccugccugcccaugucccaguccuuccgcggcgggcgcccucccaccucagcccggggcucuggcuucucgcagcucuuugcucucccggcccgaucagcugugagguguccccgggccguuucuuugugccagccucccccaagucccuaccccaucccaggcucagauuccucccuucucggcuuggaauugucaggcuacuucaccucucacuguccucaucccggucgcaggcccccuuggucucuucuuccuucugccacccuauccuuagucccuggaccuggcugugggcugguagcccacuccuucccgacccagguuuccccccauccucuucuugcgugguccccagcacuuucuguauccgggccgacuaagcuugcccccacuucucuuccuggcccucuuccccaggcuccaggcuggguggcgcuugugccugcccaguaggccagagcggccccugguucgggggaccgugggucagcugcucuauccccauggcacugccaucccugcugcuggugguggcagcccuggcagguggggugcguccuccgggggcacggaaccugacgcuggcgguggugcugccagaacacaaccugagcuaugccugggccuggccacggguggguccugcuguggcacuggcuguggaggcacugggccgggcacugcccguggaccugcgguuugucagcuccgaacuagacggcgccugcucugaguaccuggcaccacugcgcgcuguggaccucaagcuguaccaugaccccgaccuucuguugggccccgguuguguguaccccgcugccucuguggcucgcuuugccucacacuggcgccuuccccuccugacugcgggggcaguggccucuggcuuugcagcuaagaaugagcauuaucguacccugguucgcacuggccccucugcgcccaagcugggugaguuuguagugacauugcacgggcacuucaauuggacagcucgggcugcuuugcuguaucuggaugcucgcacagaugaccggccccacuacuucaccaucgagggcgucuuugaggcccugcagggcagcaaccucagugugcagcaccagguguaugcccgagagccagguggcccugagcaagccacccacuucaucagagccaacgggcgcaguaaguguggcccgggcuguuuuagaaacaggggaggugggccgcuaugucccuggagcagugcaacacagagaaauaggcagagauaggaaggggagaguucuaugugaugguugggauggaggaacuuuugaggacagagcuccugagagaaccuggcaucagucagaggucagcaaggcugagccuggggcugggguuugaguaguggaugugggugaugucugaucugaaaugugcaccugucugugagcagagaccccuuagauuggaacacaaagccucuugguagcauagagaugacucuauggguucagguuugauugggaaagcagguaaggcucacacaaaaauugugagcacaagugcuugugagccuagggagagguaggcaggaggggacgugggggcugugaagucuagcaaacacagcuuugggggaaggaggggcuugggucaucacgccagucucuggggucuggaguugggcucugacuuggaccagaugguccauguggccccagggcacuugcgacaugagcucuaaggggagggaugggaacaucuguuggguggucgauggguagggcacucucuuguaaugggaugacucagagaggaggggggaccuggaugcugucucagggugcccuucuguccugugcacucccaguuguguauaucugcggcccccuggaaaugcugcaugagauccugcuucaggcccagagggagaaccugaccaauggggacuaugucuucuuuuaccuugaugucuuuggggagagucuccgagcaggccccacccgugcaacaggccggccauggcaggacaaucgaacccaggaacaggcccaggcccucagagaggccuuucagguaccuuuggaacccaaacuaaagaugggaagacucacuugguuggaggaucuguuucucccaagacccuccugaaggcucuggaauagggcagguguggugugcuauggaagggaaauggucagaaauguucugugucuggucucacucuuccuuccugagauuugugacuguuaccuagugugcuugccaagacugaccuu

SEQ ID NO: 10052 - RNA, 2501 nt, Mus musculus
aaggucagucuuggcaagcacacuagguaacagucacaaaucucaggaaggaagagugagaccagacacagaacauuucugaccauuucccuuccauagcacaccacaccugcccuauuccagagccuucaggagggucuugggagaaacagauccuccaaccaagugagucuucccaucuuuaguuuggguuccaaagguaccugaaaggccucucugagggccugggccuguuccuggguucgauuguccugccauggccggccuguugcacggguggggccugcucggagacucuccccaaagacaucaagguaaaagaagacauaguccccauuggucagguucucccucugggccugaagcaggaucucaugcagcauuuccagggggccgcagauauacacaacugggagugcacaggacagaagggcacccugagacagcauccagguccccccuccucucugagucaucccauuacaagagagugcccuacccaucgaccacccaacagauguucccaucccuccccuuagagcucaugucgcaagugcccuggggccacauggaccaucugguccaagucagagcccaacuccagaccccagagacuggcgugaugacccaagccccuccuucccccaaagcuguguuugcuagacuucacagcccccacguccccuccugccuaccucucccuaggcucacaagcacuugugcucacaauuuuugugugagccuuaccugcuuucccaaucaaaccugaacccauagagucaucucuaugcuaccaagaggcuuuguguuccaaucuaaggggucucugcucacagacaggugcacauuucagaucagacaucacccacauccacuacucaaaccccagccccaggcucagccuugcugaccucugacugaugccagguucucucaggagcucuguccucaaaaguuccuccaucccaaccaucacauagaacucuccccuuccuaucucugccuauuucucuguguugcacugcuccagggacauagcggcccaccuccccuguuucuaaaacagcccgggccacacuuacugcgcccguuggcucugaugaaguggguggcuugcucagggccaccuggcucucgggcauacaccuggugcugcacacugagguugcugcccugcagggccucaaagacgcccucgauggugaaguaguggggccggucaucugugcgagcauccagauacagcaaagcagcccgagcuguccaauugaagugcccgugcaaugucacuacaaacucacccagcuugggcgcagaggggccagugcgaaccaggguacgauaaugcucauucuuagcugcaaagccagaggccacugcccccgcagucaggaggggaaggcgccagugugaggcaaagcgagccacagaggcagcgggguacacacaaccggggcccaacagaaggucggggucaugguacagcuugagguccacagcgcgcaguggugccagguacucagagcaggcgccgucuaguucggagcugacaaaccgcagguccacgggcagugcccggcccagugccuccacagccagugccacagcaggacccacccguggccaggcccaggcauagcucagguuguguucuggcagcaccaccgccagcgucagguuccgugcccccggaggacgcaccccaccugccagggcugccaccaccagcagcagggauggcagugccauggggauagagcagcugacccacggucccccgaaccaggggccgcucuggccuacugggcaggcacaagcgccacccagccuggagccuggggaagagggccaggaagagaagugggggcaagcuuagucggcccggauacagaaagugcuggggaccacgcaagaagaggauggggggaaaccugggucgggaaggagugggcuaccagcccacagccagguccagggacuaaggauaggguggcagaaggaagaagagaccaagggggccugcgaccgggaugaggacagugagaggugaaguagccugacaauuccaagccgagaagggaggaaucugagccugggaugggguagggacuugggggaggcuggcacaaagaaacggcccggggacaccucacagcugaucgggccgggagagcaaagagcugcgagaagccagagccccgggcugaggugggagggcgcccgccgcggaaggacugggacaugggcaggcagggagcgaagcgaggccugggccagaggggagggaaaggcaggggugacucucccagugacggcuucucccgaagcuccugccuggacuaacgggcccgggcgcuggucccauccggagcugcggcggccccgcccgugucccccgcuccucuccgcuccgcuucucccgggcccggcggccugcgcugcccgccgcugccucccgccccccgccugggcccccgcgcgcgccgcucgcucguccaggu

SEQ ID NO: 10053 - RNA, 2501 nt, Mus musculus
gaucagaguggcuggccagccgcacaugcucagugcaggucacuuugccauguuagcauccaacaagcauuugccgcagugguaaaugggggcagggaagggggucagccuuggcuucagcuuccacauacucaucaucugggacaucuaagccaccuauugcucaagcuggcccaaggauacccuagcucucugguuuaggaucuccaccuccagccacuggaauuucugucuccugaucccaugaaauucuauuuacccuucaaagcgcuuccuugacgguuacuccugugcucaaacuccgcccgcccagaccugcgcugcacgcucgcccucgcggcuucccaccugcacgcgcacagccuccuccucggccaggcccaccggguggcggcgguacgcacccagaacccggcagagcgcccacacggagcggccacagcggcgacagaagagcucauguccacccaauggcacuucccuggggaagugcuugcguggcuuccugccccaaguucuauuuucuggcucucacuggccaccacccugggcucccuaguaugauauguaguacauugcagugcuacuauccuaccccugaccaaccaggcaacuaacucauccagaugcggcgaggaucugauuucugacuuggcucacgguacaagccauggcgcugagugcugaguaugugcuugaugaaggaauggcucuguggauagacagaggaagggugccuagguugacgcauagccuugggucuccgaguagcagcauuugaggauccuuauuagcagucauuucacaguugcugaaggaugguucuggaagcaggggcaggacuccacuagucagacuguccucccucaggcccaauucagauuggaguuguagucuugucaagggugguuaagucaggagagagcagaaaggaaggugcuuugggcagaauuacaaagacuucuuggagauaaacauaaaaucagccccggggguucagaagguucuggcuagcuugccuuccucaaaugcagagaggagaauagauucugcagagccagggcagccggcuggggguccugcuuucucguuaucuauagaagauaaggcugugauuaacaagccucuuccguggguggggugggagaggggacagugguguauuugcauagggggaggagccggauucaaggcaggaagagggaccuuauugacuuagcaaaacaacauaggccaucaggucccaguucagaauggccuuuuaugaacuccaggguccagagacauuuccaggcuucauggaacacacgcauacauacaguuuucuuuuucuacaaucuggucuuuugagauagucucucuacauaucacagguuggcuguaaacucccaauuuuccaacuucauccuccccugugcucuguuaggcgaacgucccucccgcguccuugacucugguuggggaguugcccuagcagaagcgguaaagaacgugugaguacuaaccagcuugagccuccuguaccccaagccaaucuugggaagcuucgcuggugguuugagcaacuuuugcacuuccauaggguucugccucccgauccuacugucuacuaucuagaggaccucagggucccccuuuaguuucccuguccuaacgggauuugacccuccuuugacgguuacucuugugcucaaucuccgcccgcccagaccugcggugcacgcccucgcggcuucccaccugcacacgcacagccuccuccucggccaggcccaccggguggccgcggugcgcacccagaaccgggcagagcgcgcacacacagcggccgcagcggcgacagaagagcucagccgggcguucgcugugcuccggacagcgccagccauacgccccgucgggcugaaagggcgcccgcgccucgguagucucgcucgccauucucaguggcaaccgcuguucucugugcaguguggucggguuggguuggugcagaaaucgaaaccuugcucggggaggggcggggcggggcggggcgggcgacccagcucccaguggcaaacuggaggggcgaugaccugcuggagaguugaugcuuggucccaccuagugcuggauccgcggcacagcauccuuccacucuuucucaccuugaggaggaggaggucacuauagauaggaacgcgggugcuugcacugaugggcucacuggaagguuggcuucccgcuuguugaugauguugggcuucuggcaaacugcggaggugcguaguaggugguguggccugcccagagggccuacauuuucuacaccucauuuuguucuuuuccuguagugcuuccucccuauggucagccaugugggggcaggugggggugaaguuggaacauacuuccaagaagccccaauuaucuucaggcuaaaacuucaaagccccaggcccugaagauguucugauuucucuugccuugaugggugaaugacccacccuguuucuagc

SEQ ID NO: 10054 - RNA, 2501 nt, Mus musculus
gcuagaaacagggugggucauucacccaucaaggcaagagaaaucagaacaucuucagggccuggggcuuugaaguuuuagccugaagauaauuggggcuucuuggaaguauguuccaacuucacccccaccugcccccacauggcugaccauagggaggaagcacuacaggaaaagaacaaaaugagguguagaaaauguaggcccucugggcaggccacaccaccuacuacgcaccuccgcaguuugccagaagcccaacaucaucaacaagcgggaagccaaccuuccagugagcccaucagugcaagcacccgcguuccuaucuauagugaccuccuccuccucaaggugagaaagaguggaaggaugcugugccgcggauccagcacuaggugggaccaagcaucaacucuccagcaggucaucgccccuccaguuugccacugggagcugggucgcccgccccgccccgccccgccccuccccgagcaagguuucgauuucugcaccaacccaacccgaccacacugcacagagaacagcgguugccacugagaauggcgagcgagacuaccgaggcgcgggcgcccuuucagcccgacggggcguauggcuggcgcuguccggagcacagcgaacgcccggcugagcucuucugucgccgcugcggccgcugugugugcgcgcucugcccgguucugggugcgcaccgcggccacccggugggccuggccgaggaggaggcugugcgugugcaggugggaagccgcgagggcgugcaccgcaggucugggcgggcggagauugagcacaagaguaaccgucaaaggagggucaaaucccguuaggacagggaaacuaaagggggacccugagguccucuagauaguagacaguaggaucgggaggcagaacccuauggaagugcaaaaguugcucaaaccaccagcgaagcuucccaagauuggcuugggguacaggaggcucaagcugguuaguacucacacguucuuuaccgcuucugcuagggcaacuccccaaccagagucaaggacgcgggagggacguucgccuaacagagcacaggggaggaugaaguuggaaaauugggaguuuacagccaaccugugauauguagagagacuaucucaaaagaccagauuguagaaaaagaaaacuguauguaugcguguguuccaugaagccuggaaaugucucuggacccuggaguucauaaaaggccauucugaacugggaccugauggccuauguuguuuugcuaagucaauaaggucccucuuccugccuugaauccggcuccucccccuaugcaaauacaccacuguccccucucccaccccacccacggaagaggcuuguuaaucacagccuuaucuucuauagauaacgagaaagcaggacccccagccggcugcccuggcucugcagaaucuauucuccucucugcauuugaggaaggcaagcuagccagaaccuucugaacccccggggcugauuuuauguuuaucuccaagaagucuuuguaauucugcccaaagcaccuuccuuucugcucucuccugacuuaaccacccuugacaagacuacaacuccaaucugaauugggccugagggaggacagucugacuaguggaguccugccccugcuuccagaaccauccuucagcaacugugaaaugacugcuaauaaggauccucaaaugcugcuacucggagacccaaggcuaugcgucaaccuaggcacccuuccucugucuauccacagagccauuccuucaucaagcacauacucagcacucagcgccauggcuuguaccgugagccaagucagaaaucagauccucgccgcaucuggaugaguuaguugccugguuggucagggguaggauaguagcacugcaauguacuacauaucauacuagggagcccagggugguggccagugagagccagaaaauagaacuuggggcaggaagccacgcaagcacuuccccagggaagugccauuggguggacaugagcucuucugucgccgcuguggccgcuccgugugggcgcucugccggguucugggugcguaccgccgccacccggugggccuggccgaggaggaggcugugcgcgugcaggugggaagccgcgagggcgagcgugcagcgcaggucugggcgggcggaguuugagcacaggaguaaccgucaaggaagcgcuuugaaggguaaauagaauuucaugggaucaggagacagaaauuccaguggcuggagguggagauccuaaaccagagagcuaggguauccuugggccagcuugagcaauagguggcuuagaugucccagaugaugaguauguggaagcugaagccaaggcugacccccuucccugcccccauuuaccacugcggcaaaugcuuguuggaugcuaacauggcaaagugaccugcacugagcaugugcggcuggccagccacucugauc

SEQ ID NO: 10055 - RNA, 2501 nt, Mus musculus
aggcugcuguggcggaauguauacuggguccaacuccggccgcaggagcucagccacgaagccgcccgaggggcucacgucauugauguccgccagguugaagggggccgugggagguggcgcagauucucggcuguagaggagcccuccaccuguguugcuggcagccacgcccgggucacccccggcccggaucggauagcugaagcugcagguggagggcgcgcuggcagggccgcugcucgccggggaagacgaggaugaagcugacgccgagguggucacgguggcggccaccgauuccugguggguuagcgaguuggaaaggauaaagucuagguccaggaggucguugaacuccucggucucccuccgggcuaggagggccggguuguuacugcugcaagcugcaccagcuccgccacucuccaggucuguggccaccgucgccgccaggucguaggggcggccgggaagugggggaagucgcuucaugugagagaguuccucacgccaacgcugcaagaacagggagggagagagaaacuguuaauuguagcacccuguugccaccccuaauauugacuuguugggugaagcacaccaacacccugcuauaggaacuggacagaacaggaaggcagccucggggacuccaggggccacacugcaaucucagcuaacaccaagguaagagguggcgcguucguucuccugcaagcuagugccgucgcuccaccagcccaguccucuuccccgccagauccgcgggacgcuccagccgcccacggaauugggacacugggacacgguggcuuucuccccaugcaccauagccaccgggucgcccacgcgcuacgaucacuccggcccaaagggucucgagacuuguccaccuaaaauauaguggacugagugcgcccaccccacgguccggacgcccgaagacuaguggggaaccgcugugcgccccuggcgguaccgcagugccgggaccacacgcacuuaaggccgacucaagggccgaggagccaccucggaaggcuguagaguuccaauggagggcaauccuuguccuaaccaaggacucuuggugacccccggauuccgcccauacaccccaccccaucugcagaaaucuacagggcacuagcgcgacacucacguuagucggggcaccugcuggacgcagugucuucucccuucccgccgggccggacgcgaacguggagaaggacgggagcagagcgucgcugacagccaugucagacucgccagguggcugccugcgggccgggcggggcgcacagggaccaggagucaggggacacccuggccacugcuccgaagcuucccuccaauccucaccccuuucuguucccaaguccaacaucucaccuaccucauuaaugugggggcccagaagguccuccggaguccgaagaagagagagggguaccugagccccaaagucaacgaagauuaaaaacuuuagaaacaaaaccucaaaccaaaacccccagauugcccgagauccuucuucuuuggauucaauauaaaccggcgaugucuuuaaaaaaguuccuuuguauacaaaaauucuuagaaaaguuguaaacucuuauaaaaauagacaaucagcaaggcagauaaguagguccgauggccaggcugcacgcucuuggacucagcagugucccccaccguugucgcggccacuguggcugucggcggcgcgggggcugugguccgggcggugggcgggcggcgccgccaggugagaauggccgcgguggcgcggaacugcgagcugggcgguggcgcggggugcggaguccuggggacugugccgggugcgcgcggccaugggcgcgggucacgggcggguugcuggguggggggcuggaggggcggggaggggcacucggcggcuccgggugccgccgccgcccgccaccgccucugcuccccgcgcgcccggagccgcgcucgcucucuuggccggggaacugccggcggccgccgcgcgcuucuuacuuauaacuucucgcucgcuugcuccccgccuccucccuguggcggcgcgcggggcuccgccgccaggccccgcccccugccuuucuucuccccgccuucccgcagcccccacugcgcguugccaugguagcuaaauaaacaaacuccgcgcacgugggggcgggggcgagggaggggcgcgggcggggcggggccaggccgugacgccagccaggcagcuggcgggcuggagccgugcugacgccggcggcgguggcggcgacggcggcuccggcgcugggaguacggcguggcucccguggccgcgcuacucgggguccucugggcggccacggucgguucccugggcucgaaaguccugccacgggaacccuggcgggggacaggagguugggggugugugugugugggggggaagaggcggcgcgccccuaccccugcucgcguacgcgcuuguccugucg

SEQ ID NO: 10056 - RNA, 2501 nt, Mus musculus
cgacaggacaagcgcguacgcgagcagggguaggggcgcgccgccucuucccccccacacacacacacccccaaccuccugucccccgccaggguucccguggcaggacuuucgagcccagggaaccgaccguggccgcccagaggaccccgaguagcgcggccacgggagccacgccguacucccagcgccggagccgccgucgccgccaccgccgccggcgucagcacggcuccagcccgccagcugccuggcuggcgucacggccuggccccgccccgcccgcgccccucccucgcccccgcccccacgugcgcggaguuuguuuauuuagcuaccauggcaacgcgcagugggggcugcgggaaggcggggagaagaaaggcagggggcggggccuggcggcggagccccgcgcgccgccacagggaggaggcggggagcaagcgagcgagaaguuauaaguaagaagcgcgcggcggccgccggcaguuccccggccaagagagcgagcgcggcuccgggcgcgcggggagcagaggcgguggcgggcggcggcggcacccggagccgccgagugccccuccccgccccuccagccccccacccagcaacccgcccgugacccgcgcccauggccgcgcgcacccggcacaguccccaggacuccgcaccccgcgccaccgcccagcucgcaguuccgcgccaccgcggccauucucaccuggcggcgccgcccgcccaccgcccggaccacagcccccgcgccgccgacagccacaguggccgcgacaacggugggggacacugcugaguccaagagcgugcagccuggccaucggaccuacuuaucugccuugcugauugucuauuuuuauaagaguuuacaacuuuucuaagaauuuuuguauacaaaggaacuuuuuuaaagacaucgccgguuuauauugaauccaaagaagaaggaucucgggcaaucuggggguuuugguuugagguuuuguuucuaaaguuuuuaaucuucguugacuuuggggcucagguaccccucucucuucuucggacuccggaggaccuucugggcccccacauuaaugagguaggugagauguuggacuugggaacagaaaggggugaggauuggagggaagcuucggagcaguggccaggguguccccugacuccuggucccugugcgccccgcccggcccgcaggcagccaccuggcgagucugacauggcugucagcgacgcucugcucccguccuucuccacguucgcguccggcccggcgggaagggagaagacacugcguccagcaggugccccgacuaacgugagugucgcgcuagugcccuguagauuucugcagauggggugggguguaugggcggaauccgggggucaccaagaguccuugguuaggacaaggauugcccuccauuggaacucuacagccuuccgagguggcuccucggcccuugagucggccuuaagugcguguggucccggcacugcgguaccgccaggggcgcacagcgguuccccacuagucuucgggcguccggaccguggggugggcgcacucaguccacuauauuuuagguggacaagucucgagacccuuugggccggagugaucguagcgcgugggcgacccgguggcuauggugcauggggagaaagccaccgugucccagugucccaauuccgugggcggcuggagcgucccgcggaucuggcggggaagaggacugggcugguggagcgacggcacuagcuugcaggagaacgaacgcgccaccucuuaccuugguguuagcugagauugcaguguggccccuggaguccccgaggcugccuuccuguucuguccaguuccuauagcaggguguuggugugcuucacccaacaagucaauauuagggguggcaacagggugcuacaauuaacaguuucucucucccucccuguucuugcagcguuggcgugaggaacucucucacaugaagcgacuucccccacuucccggccgccccuacgaccuggcggcgacgguggccacagaccuggagaguggcggagcuggugcagcuugcagcaguaacaacccggcccuccuagcccggagggagaccgaggaguucaacgaccuccuggaccuagacuuuauccuuuccaacucgcuaacccaccaggaaucgguggccgccaccgugaccaccucggcgucagcuucauccucgucuuccccggcgagcagcggcccugccagcgcgcccuccaccugcagcuucagcuauccgauccgggccgggggugacccgggcguggcugccagcaacacagguggagggcuccucuacagccgagaaucugcgccaccucccacggcccccuucaaccuggcggacaucaaugacgugagccccucgggcggcuucguggcugagcuccugcggccggaguuggacccaguauacauuccgccacagcagccu

SEQ ID NO: 10057 - RNA, 2501 nt, Mus musculus
uugaaacaagggauaauuccuaccuaccugccacacaagguuguuaugagggcaaaagugagaucacguucauaaaaguagcuuucaaaugccaagcaccaaagaaacauaaauuaaguuuaacuacuuucacauggcgauugagacgcuuuaauaacauaagcuucacaaacauacgcuuacaacaccucacccaugcuggcauuuaaaauacacaucauccucaaauaacaccuuucuuuguuagucuuuacugaagggcaacauaggggaguagguuucucguaaauacccuaaagcauuugaaccaaccacccaaaacgcaaucgauuauccuacauaucucacgaaaacugaauauuuaugaccccagaauaggcugacaacauccuagaacuacacuucccacaaagcauagaguggaacacgggcagcaggcugggcggccuggcauuaagggcgaccacugcucccagcgagcuuggaucgucauccccuggaaaaucgcaacgcuuggcauggagugggacucucuccuuucugacagcuccgucacccucguuuuguuuuuuguuuuguuuuguuuuucugccauuaacagcggcccuauuggccuuuacagcuucaaccugaaagucaucucccaucugugaccuuucugccgauuccuuggaggugcgggaaaggcaacccucuccccuuccccaaagcuccacguccagaauucgcccgucagucagaaucaagggacaugcggggggucugacggaacggacggguggacacaguccgaccugggggcgacaggccgcgcgccagcuccgguagcaagccaggggcccgggauccccccaaagcccgggccgaagcagauuucgagcagggguagcuaagcccggggcucugguuucaauuucacgacgugacauugcaaaccugcggccuacgagcgcccgcggcggcggcccgcgccuguucgcccgcccucccgccaggccugagccccggagccccgugccgagaccaccgcacacccacuugcccggccccgcgcccccccagccucccgugucuggccgggcccagccccgguccugcguggaguuaaaucccgcucccagcugcaggcuccgcgccgcacuuacucagcucguccugggaggcggaggcggcggccgcagccauguugcgcccgggagcgagcgagggaggggcgggcgggcggccggcgaggggggcucgcggccgucgccgugccgugccgugcggugccgcgccgcgccgcgccgugccgcaggggcccggagccgccucgggucucucacgcgggccgcgcugcgcccucgaggcccgcccgcugccugcguccucugcgcugcgagcgucgcucucgccgcgccucgcgagcucgcgacucgggagcucccucucagccucgcgccucggaggagccgcugccgcccgugcggccgagugaccgcgcggcggcucuucggcucggcgcccggcuugcuagccucacgccggcucuuauauuuagaaagagcugagccauccuccccccucccccuccgccuccgccggccccucgcgcgcccgcucgcccgcccucgcugccucgcucgcgccgcguccugcccaccugccgccgccaagcuuccccggcgcggagcgggagacgcagacgcggcgggccaaccccuggaccugagccucauucccucagccgcacgcaagcacgcggccucugaccugagucggagccggucuccauagcccgggaugcugcggcgacccagcgagguggaggacgggccgggcccgaggagacgcgcggccgcuccggaggagccugcgugcggccgagcggagccgggcuguccuggcugccgcggagagcuuccccgccccgggcuguggcguuaaaggucugcggcugucacguccgccuggucggagcuggaggaacacgcgcccggacggaggaagagacgcggacucggaaaaguagagcggggcucgaaucggaggaggaggaggaggaagaggaggaagccccgcccugcgccucgcgcccaacuucucggccgccgcgcugacucaggccgggccuccgagcagccccgaaguuaaagcccagagggaccugcaccgagggcucacccugggggaugcuccccuaacguuagccucccgagcgagcugcgagccagggaagggccggaaaccacgauauuugagcuaccaagacgugcuuuagaguccuucuucuuaacccgaguuuaguggcaaucccaacuuuuaacuuuaagccucucguugguccaugaggucguguacagcugcaaaauggaauucaaaucaagggcuuauaugguuacuauaagaacaaccaaaaaaaaaaaaaaaagaaagaaauuaggugccagaucaaagacauuuuuagaggaaaagaaaauaaucgagacccuaaaugaacugaaguugcauauauucccgca

SEQ ID NO: 10058 - RNA, 2501 nt, Mus musculus
ugcgggaauauaugcaacuucaguucauuuagggucucgauuauuuucuuuuccucuaaaaaugucuuugaucuggcaccuaauuucuuucuuuuuuuuuuuuuuuugguuguucuuauaguaaccauauaagcccuugauuugaauuccauuuugcagcuguacacgaccucauggaccaacgagaggcuuaaaguuaaaaguugggauugccacuaaacucggguuaagaagaaggacucuaaagcacgucuugguagcucaaauaucgugguuuccggcccuucccuggcucgcagcucgcucgggaggcuaacguuaggggagcaucccccagggugagcccucggugcaggucccucugggcuuuaacuucggggcugcucggaggcccggccugagucagcgcggcggccgagaaguugggcgcgaggcgcagggcggggcuuccuccucuuccuccuccuccuccuccgauucgagccccgcucuacuuuuccgaguccgcgucucuuccuccguccgggcgcguguuccuccagcuccgaccaggcggacgugacagccgcagaccuuuaacgccacagcccggggcggggaagcucuccgcggcagccaggacagcccggcuccgcucggccgcacgcaggcuccuccggagcggccgcgcgucuccucgggcccggcccguccuccaccucgcugggucgccgcagcaucccgggcuauggagaccggcuccgacucaggucagaggccgcgugcuugcgugcggcugagggaaugaggcucagguccagggguuggcccgccgcgucugcgucucccgcuccgcgccggggaagcuuggcggcggcaggugggcaggacgcggcgcgagcgaggcagcgagggcgggcgagcgggcgcgcgaggggccggcggaggcggagggggaggggggaggauggcucagcucuuucuaaauauaagagccggcgugaggcuagcaagccgggcgccgagccgaagagccgccgcgcggucacucggccgcacgggcggcagcggcuccuccgaggcgcgaggcugagagggagcucccgagucgcgagcucgcgaggcgcggcgagagcgacgcucgcagcgcagaggacgcaggcagcgggcgggccucgagggcgcagcgcggcccgcgugagagacccgaggcggcuccgggccccugcggcacggcgcggcgcggcgcggcaccgcacggcacggcacggcgacggccgcgagccccccucgccggccgcccgcccgccccucccucgcucgcucccgggcgcaacauggcugcggccgccgccuccgccucccaggacgagcugaguaagugcggcgcggagccugcagcugggagcgggauuuaacuccacgcaggaccggggcugggcccggccagacacgggaggcugggggggcgcggggccgggcaagugggugugcgguggucucggcacggggcuccggggcucaggccuggcgggagggcgggcgaacaggcgcgggccgccgccgcgggcgcucguaggccgcagguuugcaaugucacgucgugaaauugaaaccagagccccgggcuuagcuaccccugcucgaaaucugcuucggcccgggcuuuggggggaucccgggccccuggcuugcuaccggagcuggcgcgcggccugucgcccccaggucggacuguguccacccguccguuccgucagaccccccgcaugucccuugauucugacugacgggcgaauucuggacguggagcuuuggggaaggggagaggguugccuuucccgcaccuccaaggaaucggcagaaaggucacagaugggagaugacuuucagguugaagcuguaaaggccaauagggccgcuguuaauggcagaaaaacaaaacaaaacaaaaaacaaaacgagggugacggagcugucagaaaggagagagucccacuccaugccaagcguugcgauuuuccaggggaugacgauccaagcucgcugggagcaguggucgcccuuaaugccaggccgcccagccugcugcccguguuccacucuaugcuuugugggaaguguaguucuaggauguugucagccuauucuggggucauaaauauucaguuuucgugagauauguaggauaaucgauugcguuuugggugguugguucaaaugcuuuaggguauuuacgagaaaccuacuccccuauguugcccuucaguaaagacuaacaaagaaagguguuauuugaggaugauguguauuuuaaaugccagcaugggugagguguuguaagcguauguuugugaagcuuauguuauuaaagcgucucaaucgccaugugaaaguaguuaaacuuaauuuauguuucuuuggugcuuggcauuugaaagcuacuuuuaugaacgugaucucacuuuugcccucauaacaaccuuguguggcagguagguaggaauuaucccuuguuucaa

SEQ ID NO: 10059 - RNA, 2501 nt, Mus musculus
cagggggcggagagggcagggugguaagaagcccuacaguccggaggacacucuuaggcccacgcccucuccacccccacccacccacucucacgcccucccugaaccccacacccggcuccagcgugggcaggggucucccaacagcccgaagagcuuucggggccugcgggaugcuagcgccuagucggugaggaguugcgcuucugucgucccuuuguugacaauucccugaaccaacuugaguuuggccagcuccacggcggcccugacgucacgcgcggucacguggccccgccucccucuggaucuuuaaguagaaaguaaucuaucaggccaguccuuaaaacgggacuuucgacuacccaggcuuggcuucccugucaccacccccccaacccccaaccccgcggucgcccaugcccgcgcccuccagagcugcuuggagcccggcgucccgcgcuugccuggaccgcuccugaaccccacgcccaaaccagaggucgaggaaggcuggugaagugagggggugcggcguggagaaaccuccggggucgcgagcaguagcugucuccucguagagaagcgucgaggaccgcaagaguucgcggagcgcggcugcggagcgcagcgcccgcaccgcgcgaugccaggccuccucgugugagcugacccgacagggccccgagcuaccugugcccucucccccccccccggcuuucuuucgggggacacucacaccuccuuugccugagcuccgcggccgccccucgcggccccccucgcucucugcucgcuccuggccgccgccaccaaccccgcggagggaugacccucuccggcagcggcagcgccagcgauauguccggccagacggugcugacggccgaggacguggacaucgauguggugggcgagggcgacgacgggcuggaggagaaggacagcgacgccgggugcgacagccccgcggggccuccggaccugcgccuggacgaggcggacgaagggccaccggugagcgcucaucacggccagucucaaccgcaagcccuggcacugcccaccgaggcgaccgggccggggaacgacacgggagcuccggaggccgacggcugcaagggcggcgaggacgcggugacaggcggcggugggcccggcgcgggcagcggggcgacgggaggucugaccccgaacaagcccaagaacagccuggugaagccacccuacucuuacaucgcgcucaucaccauggccauccugcagagcccgcagaagaagcugacccugagcggcaucugcgaguucaucagcaaccguuuuccguacuaccgggagaaguuccccgccuggcagaacagcauccgccacaaccugucgcucaacgacugcuucgucaagaucccccgcgagccgggcaacccgggcaagggcaacuacuggacccuggacccccaguccgaggacauguucgacaacggcagcuuccugcggcgccggaagcgcuucaagcgccaccagcaggagcaccugcgcgagcagacggcgcugaugaugcagagcuucggagccuacagccuggcggcggcggcgggcgcaggacccuacggccgccccuacggccugcaccccgcggcggcugcgggcgccuacucgcaccccgcggcggcggcggcggccgcggcugcugcggcgcuccaguacccguacgcgcuaccacccguggcucccgugcugccgcccgcagugccccugcugcccucgggcgagcugggccgcaaagcggccgccuucggcucgcagcucgguccgagccugcagcuacagcucaacacccugggcgccgccgcggcagccgcgggcacggcgggcgcggcgggcaccacgucgcucaucaaguccgagcccagugcgcggccgucguucagcaucgagaacaucauaggcgcgggauccgcggcgcccgggggcucggcuggggguggugggagcggcggcggagccggggguggcgggggcagugggggcggcggcggcgcgcaguccuuccugcggccgcccgggacugugcagucggcugcgcucauggccacgcaccagccccugucgcugagccggacgacugccaccaucgcgcccauucugagcgugccgcugucuggacaguuccugcagcccgcagccucagccgcagcggcugcggccgccgccgugcaagccaaguggcccgcucaauagugaugagcuaguggccgggccggacggcggccucuggcagcagccugcucuuccaggcgguacgcccucucugauccugguccaucuguccugguccugguccuggucccucuacccaauccuggacucugcuacccgcccccgacuccccaacacugaccaacagcggccuccauccccucacucaccuaagcuggcggagcaaacucaacccgcguccgcugggaauaacuuuccguacagguaaaacugauaaccgaauu

SEQ ID NO: 10060 - RNA, 2501 nt, Mus musculus
aauucgguuaucaguuuuaccuguacggaaaguuauucccagcggacgcggguugaguuugcuccgccagcuuaggugagugaggggauggaggccgcuguuggucaguguuggggagucgggggcggguagcagaguccaggauuggguagagggaccaggaccaggaccaggacagauggaccaggaucagagagggcguaccgccuggaagagcaggcugcugccagaggccgccguccggcccggccacuagcucaucacuauugagcgggccacuuggcuugcacggcggcggccgcagccgcugcggcugaggcugcgggcugcaggaacuguccagacagcggcacgcucagaaugggcgcgaugguggcagucguccggcucagcgacaggggcuggugcguggccaugagcgcagccgacugcacagucccgggcggccgcaggaaggacugcgcgccgccgccgcccccacugcccccgccacccccggcuccgccgccgcucccaccacccccagccgagcccccgggcgccgcggaucccgcgccuaugauguucucgaugcugaacgacggccgcgcacugggcucggacuugaugagcgacguggugcccgccgcgcccgccgugcccgcggcugccgcggcggcgcccaggguguugagcuguagcugcaggcucggaccgagcugcgagccgaaggcggccgcuuugcggcccagcucgcccgagggcagcaggggcacugcgggcggcagcacgggagccacgggugguagcgcguacggguacuggagcgccgcagcagccgcggccgccgccgccgccgcggggugcgaguaggcgcccgcagccgccgcggggugcaggccguaggggcggccguaggguccugcgcccgccgccgccgccaggcuguaggcuccgaagcucugcaucaucagcgccgucugcucgcgcaggugcuccugcugguggcgcuugaagcgcuuccggcgccgcaggaagcugccguugucgaacauguccucggacuggggguccaggguccaguaguugcccuugcccggguugcccggcucgcgggggaucuugacgaagcagucguugagcgacagguuguggcggaugcuguucugccaggcggggaacuucucccgguaguacggaaaacgguugcugaugaacucgcagaugccgcucagggucagcuucuucugcgggcucugcaggauggccauggugaugagcgcgauguaagaguaggguggcuucaccaggcuguucuugggcuuguucggggucagaccucccgucgccccgcugcccgcgccgggcccaccgccgccugucaccgcguccucgccgcccuugcagccgucggccuccggagcucccgugucguuccccggcccggucgccucggugggcagugccagggcuugcgguugagacuggccgugaugagcgcucaccgguggcccuucguccgccucguccaggcgcagguccggaggccccgcggggcugucgcacccggcgucgcuguccuucuccuccagcccgucgucgcccucgcccaccacaucgauguccacguccucggccgucagcaccgucuggccggacauaucgcuggcgcugccgcugccggagagggucaucccuccgcgggguugguggcggcggccaggagcgagcagagagcgaggggggccgcgaggggcggccgcggagcucaggcaaaggaggugugagugucccccgaaagaaagccgggggggggggagagggcacagguagcucggggcccugucgggucagcucacacgaggaggccuggcaucgcgcggugcgggcgcugcgcuccgcagccgcgcuccgcgaacucuugcgguccucgacgcuucucuacgaggagacagcuacugcucgcgaccccggagguuucuccacgccgcacccccucacuucaccagccuuccucgaccucugguuugggcgugggguucaggagcgguccaggcaagcgcgggacgccgggcuccaagcagcucuggagggcgcgggcaugggcgaccgcgggguuggggguuggggggguggugacagggaagccaagccuggguagucgaaagucccguuuuaaggacuggccugauagauuacuuucuacuuaaagauccagagggaggcggggccacgugaccgcgcgugacgucagggccgccguggagcuggccaaacucaaguugguucagggaauugucaacaaagggacgacagaagcgcaacuccucaccgacuaggcgcuagcaucccgcaggccccgaaagcucuucgggcuguugggagaccccugcccacgcuggagccgggugugggguucagggagggcgugagaguggguggguggggguggagagggcgugggccuaagaguguccuccggacuguagggcuucuuaccacccugcccucuccgcccccug

SEQ ID NO: 10061 - RNA, 2501 nt, Mus musculus
acgagcuuuccgggaagacagggugcaccuccuuuccccaggucccaguaucucauggcuagaauaaaaacauuggacugaaauuccucgccaaaauuauguucauucuaaauuuuauucccaucaaacauucauagaaagaaagaaagaaagaaaggaaggaaggaaggaaggaaggaaggaaggaaggaaggaaggaaggaaggaaagaaggaaggaaggaagaaagaucaaauuuuaggauguuccugagccccucagauacacacucacuucugcccucucaucucucaaaacagggaacucaguauuuccugugcccgucgcuuugggggcuguggugguuauaacugccuuauuuguuugcagcagggccuugcuauguagcccaggcuggucuugauuucacaauccuucugcuucagccuccugagagccaagauuauaggcaugccuggcucuaaaauguccuuucuuacccuggccgugacuccacaucccuuuaggcacagagcuuggggaacauugggaggggugauucgaguugagaacuugacacuacccacccgcacacuggcuggggcuaggucucucucagaagcccauucucucuucugccccaguagcaguggccagauacaccccacugcaaggggccauaauuccaaagugaucuuuuuccugguuacauccguagaucaccccuguggucaccaaaggaccuuuauuucccauuuaacaaaagaucaagacagaguagcuguccacccagagccgggugaaugacuccagccuccaaccccaagucuauuuccaagccggacaaaaaaaaaaagaccucaauggaacaaacccugggaagauucauuuggagggaacugcucaagcaagagcuucccguggcucagagccagaggcagauaugcucaagaagcugaccccgcccacccacucauucaccuaccagugcuccagucaugcaacccugacacccuuccgcuaaaucgaggccuacagaaccccaacaggcacccaggaugacugcuggaugaccaguugagaaagaugugccacuagaguucucagccucccgaugccacuuuacuucggaggacacguuuucugcaugaccacacugguagcccgcuccccgccucacacuuuuggaaccaagccccgcagugccuuuagcacguggccucccccaucacucugugccacaaggugcagcugagcacuaagucuugcccucgccucccgcaccucagggcugcacuuagagaccaccagacggcuagaugagcagagaagacccccgaagagcaucaccccaaccccaaagcaacgccguugccuggcacccauaccuuggagcaacggcggaagguggcgguggccacaugugcggccucaucagccaggccauccuccugggacgggagggcgagcaucagcucuucauaaucuccauccucguccugggcaccagcgccgguggggcacaguagcagcaacagcagcagcagcggcggcaacagcggcaacagcggccaccgcagccacgcagagcagugggugcccaucggggcgaggagaggugcgcgcggccucgggaaggacauggacgccugggacucggggcacuuggcuccggggcugcgggccgugaugucucuggggagccaaggacuggcucaguccucuagccucagaaagagagagagaacgggagcccaccggcagccugcgcguccacgugaagguggaagccuucugggguguggguacuggacgccugggggccgggagaucacgccaccccgagccccaucggaagauccucucugauuaaacauuaacgggccccgguacuaaaggaucagguuucggccucgcccuccccagacagcgucaaaugacgcucagagugaggacaaaaccccaaauccuaauugggcugcaaacgggaccuguuacauuccccccucuuaauccccacuccaauccuccucaggcggggugccaacucagaggcgugcugagccccaccucuuuagcauuuccggggucucccagccaccccuguacuucucccuccaacaauauuaacuaacuucuccugggcccuccuccugugacccaugacucuucacugcguggagugccgacuucccgacuucccgcuaccugccuaaacuuugcacuccauccagccuguaucccuucccucccuggccuccagcccucugcuccuugggcucaccugcacccuagccuaccuggaaaagacugcuuuccuuggguuccagcuacacuggucacuucgagggacagcucuacagagacuccacauuuaaaucuucaaagaugccagagacucaaacuucaucguaagcacaagcugggucagugugugugugugugugugugugugugugugugugugugugugugugugcgcgcgcgcgcgcgcgcgcgcgcagaggggacuccauccucag

SEQ ID NO: 10062 - RNA, 2501 nt, Mus musculus
cugaggauggaguccccucugcgcgcgcgcgcgcgcgcgcgcgcacacacacacacacacacacacacacacacacacacacacacacacacugacccagcuugugcuuacgaugaaguuugagucucuggcaucuuugaagauuuaaauguggagucucuguagagcugucccucgaagugaccaguguagcuggaacccaaggaaagcagucuuuuccagguaggcuagggugcaggugagcccaaggagcagagggcuggaggccagggagggaagggauacaggcuggauggagugcaaaguuuaggcagguagcgggaagucgggaagucggcacuccacgcagugaagagucaugggucacaggaggagggcccaggagaaguuaguuaauauuguuggagggagaaguacagggguggcugggagaccccggaaaugcuaaagagguggggcucagcacgccucugaguuggcaccccgccugaggaggauuggaguggggauuaagaggggggaauguaacaggucccguuugcagcccaauuaggauuugggguuuuguccucacucugagcgucauuugacgcugucuggggagggcgaggccgaaaccugauccuuuaguaccggggcccguuaauguuuaaucagagaggaucuuccgauggggcucgggguggcgugaucucccggcccccaggcguccaguacccacaccccagaaggcuuccaccuucacguggacgcgcaggcugccggugggcucccguucucucucucuuucugaggcuagaggacugagccaguccuuggcuccccagagacaucacggcccgcagccccggagccaagugccccgagucccaggcguccauguccuucccgaggccgcgcgcaccucuccucgccccgaugggcacccacugcucugcguggcugcgguggccgcuguugccgcuguugccgccgcugcugcugcuguugcugcuacugugccccaccggcgcuggugcccaggacgaggauggagauuaugaagagcugaugcucgcccucccgucccaggaggauggccuggcugaugaggccgcacauguggccaccgccaccuuccgccguugcuccaagguaugggugccaggcaacggcguugcuuugggguuggggugaugcucuucgggggucuucucugcucaucuagccgucugguggucucuaagugcagcccugaggugcgggaggcgagggcaagacuuagugcucagcugcaccuuguggcacagagugaugggggaggccacgugcuaaaggcacugcggggcuugguuccaaaagugugaggcggggagcgggcuaccaguguggucaugcagaaaacguguccuccgaaguaaaguggcaucgggaggcugagaacucuaguggcacaucuuucucaacuggucauccagcagucauccugggugccuguugggguucuguaggccucgauuuagcggaagggugucaggguugcaugacuggagcacugguaggugaaugagugggugggcggggucagcuucuugagcauaucugccucuggcucugagccacgggaagcucuugcuugagcaguucccuccaaaugaaucuucccaggguuuguuccauugaggucuuuuuuuuuuuguccggcuuggaaauagacuugggguuggaggcuggagucauucacccggcucuggguggacagcuacucugucuugaucuuuuguuaaaugggaaauaaagguccuuuggugaccacaggggugaucuacggauguaaccaggaaaaagaucacuuuggaauuauggccccuugcagugggguguaucuggccacugcuacuggggcagaagagagaaugggcuucugagagagaccuagccccagccagugugcggguggguagugucaaguucucaacucgaaucaccccucccaauguuccccaagcucugugccuaaagggauguggagucacggccaggguaagaaaggacauuuuagagccaggcaugccuauaaucuuggcucucaggaggcugaagcagaaggauugugaaaucaagaccagccugggcuacauagcaaggcccugcugcaaacaaauaaggcaguuauaaccaccacagcccccaaagcgacgggcacaggaaauacugaguucccuguuuugagagaugagagggcagaagugaguguguaucugaggggcucaggaacauccuaaaauuugaucuuucuuccuuccuuccuucuuuccuuccuuccuuccuuccuuccuuccuuccuuccuuccuuccuuccuuccuuucuuucuuucuuucuuucuaugaauguuugaugggaauaaaauuuagaaugaacauaauuuuggcgaggaauuucaguccaauguuuuuauucuagccaugagauacugggaccuggggaaaggaggugcacccugucuucccggaaagcucgu

SEQ ID NO: 10063 - RNA, 2501 nt, Mus musculus
uccaaaacagagaacccaaacguggguuccagucucagcucuccucuacugggcagaguagugacucuugggccucaguuucuccaucuaaaaccuuguugguucagaaccgggugacccaggcaugccuagcucugcagcucaacgcucucaggccuuguucccacuggcugcccuuggggagcucacauuggccuggugaagccaggacaccgcucugaaaggagacuuuucccuccaggaaauggggggagggcccuagauaagcacaaaggcucagagcauccuccuaggacagagucucccccaaaaggggaaaagaccacauucagauuuuaugggccuggccucauaccacucugcugccuguacagucaccagccaguccagucagccacuucagaaacucaacugauguccaaucaggagacuucaaaguggcaggccggguggcagaaaggaguuaacacaagcagaggacaggcccagaacacaagggccaggcagucagcuacuccuauguauaucgggacccacaggagcugcaggccuguacccagcuaaaaacccaccacuaaggacauucaucaacagaggccaucucuggaggcuaagaagaccacccauaccugaaggggguucuuccacugcaaucaaccagacuugccccaagagggggcuaccaaaacuuccuguccaccaagggggcucuggccacccaugaaggggcaagccucccuccaucuccaacacacacacagcuccuaaaggauccacacugcuggaggacaggguggcaagaagggucauguccucaugacagggaucuuagcuccaaacccugggcccacuuuaugccccuagagccagccaacucccccaaaucuggggcuacaauauaguuccuuacaauaccacuuugauacagagccucguccaaacgacuccucccaaaaccucucaccucagcccuacacacacacacacacacacacacacacacacacacacacacacgacauccccacccacgcaguucuggggaaaccggcaguuaacuuuucccaaaaacccugcaaaggcgacuagcuaggugggaagaaacagagaaaugggcccccauauccuuucgcggcaucucagggcccucaggggaagaaaaaaaaaaucuuaaaaaaaaaaaaaagcaagaaagaaaagaaaacuuucagaguuaacuuuaaauucccagcccccuccccccaaaucacccggcagcuucucucccccuuauuuuuuccuuuaaaguguaauuguauugugucucaccuccccgaaaggcucccggcucucuccaaagaaaaggaaaaaagccaacccuucgggugcccccucugcuuccagccgccucucccacauucucagacaguuuuauuaaaaucuucagacaaaagaaaaacaaaaauggcagccuggcuuauuuuuaaaacaggacagggacgccauauucugcagaucugcaaaaaaacggagaaauccggcacuggccgcuccaccgggccggcugcaaagugcgcgaaccgcgccguuugcaauccguuuauuugcauuaagccccaugaaucauuguuuaccggagaauugcagcagguuugaauagcccggcuuaggaaaacacacacgcacacacucggagacgaaccccagacacgccgcgggagacgcugccuaccccgcgcgcgcagccgccgcagccacggccgccccggggcccggcccgaggcaccggcgacccccgggcccacgcagcgcggccgccccgcgcugacagcgcucgcgcccgcccggcccccgccccgcaacucggcgcaacuuucccgcgggcgggcccgcucccccgcgcgccccgggcccgcacggaccuggcagugcuggcggcgcuccgggacgcggccgcagccccgagcccggcggcccgaguagggccgggcugggggcucccggcuucggcgguggcggcgguggcggcggcgcgcggcuggggcucggugcggagcggcgcgcaaaccuuccgggucgccugcuguucacuucuggguucugcaggcgccgcggcggcggaggccggcugugcagccgcgcggccccggcgcgcugggccccgcgagcgagccgcguccggccccccgccucucggcugcgcagcccgcccggccccggggcuccggcgagugggcagcgcccggcgcuggcgacggcgaggggagggggccggcggggcggggacgggccgcgcgcugggggcccccgcucggccccggggccucgucucgcgcucgccgccgccgccgccaaggaaaguugcgcggcgcccccugcccgcgccgcgccgcgccggaggcugagccacaaaggaacuccgcgccccccuccgcccgcccgagccgcgcggggagggcaccggcgcccggcccuaggacagccccuuccccagcacgggggcucccggggcccgggcggcc

SEQ ID NO: 10064 - RNA, 2501 nt, Mus musculus
ggccgcccgggccccgggagcccccgugcuggggaaggggcuguccuagggccgggcgccggugcccuccccgcgcggcucgggcgggcggaggggggcgcggaguuccuuuguggcucagccuccggcgcggcgcggcgcgggcagggggcgccgcgcaacuuuccuuggcggcggcggcggcgagcgcgagacgaggccccggggccgagcgggggcccccagcgcgcggcccguccccgccccgccggcccccuccccucgccgucgccagcgccgggcgcugcccacucgccggagccccggggccgggcgggcugcgcagccgagaggcggggggccggacgcggcucgcucgcggggcccagcgcgccggggccgcgcggcugcacagccggccuccgccgccgcggcgccugcagaacccagaagugaacagcaggcgacccggaagguuugcgcgccgcuccgcaccgagccccagccgcgcgccgccgccaccgccgccaccgccgaagccgggagcccccagcccggcccuacucgggccgccgggcucggggcugcggccgcgucccggagcgccgccagcacugccagguccgugcgggcccggggcgcgcgggggagcgggcccgcccgcgggaaaguugcgccgaguugcggggcgggggccgggcgggcgcgagcgcugucagcgcggggcggccgcgcugcgugggcccgggggucgccggugccucgggccgggccccggggcggccguggcugcggcggcugcgcgcgcgggguaggcagcgucucccgcggcgugucugggguucgucuccgagugugugcguguguguuuuccuaagccgggcuauucaaaccugcugcaauucuccgguaaacaaugauucauggggcuuaaugcaaauaaacggauugcaaacggcgcgguucgcgcacuuugcagccggcccgguggagcggccagugccggauuucuccguuuuuuugcagaucugcagaauauggcgucccuguccuguuuuaaaaauaagccaggcugccauuuuuguuuuucuuuugucugaagauuuuaauaaaacugucugagaaugugggagaggcggcuggaagcagagggggcacccgaaggguuggcuuuuuuccuuuucuuuggagagagccgggagccuuucggggaggugagacacaauacaauuacacuuuaaaggaaaaaauaagggggagagaagcugccgggugauuuggggggagggggcugggaauuuaaaguuaacucugaaaguuuucuuuucuuucuugcuuuuuuuuuuuuuuaagauuuuuuuuuucuuccccugagggcccugagaugccgcgaaaggauaugggggcccauuucucuguuucuucccaccuagcuagucgccuuugcaggguuuuugggaaaaguuaacugccgguuuccccagaacugcguggguggggaugucguguguguguguguguguguguguguguguguguguguguguguagggcugaggugagagguuuugggaggagucguuuggacgaggcucuguaucaaagugguauuguaaggaacuauauuguagccccagauuugggggaguuggcuggcucuaggggcauaaagugggcccaggguuuggagcuaagaucccugucaugaggacaugacccuucuugccacccuguccuccagcaguguggauccuuuaggagcuguguguguguuggagauggagggaggcuugccccuucauggguggccagagcccccuugguggacaggaaguuuugguagcccccucuuggggcaagucugguugauugcaguggaagaacccccuucagguauggguggucuucuuagccuccagagauggccucuguugaugaauguccuuagugguggguuuuuagcuggguacaggccugcagcuccugugggucccgauauacauaggaguagcugacugccuggcccuuguguucugggccuguccucugcuuguguuaacuccuuucugccacccggccugccacuuugaagucuccugauuggacaucaguugaguuucugaaguggcugacuggacuggcuggugacuguacaggcagcagagugguaugaggccaggcccauaaaaucugaauguggucuuuuccccuuuugggggagacucuguccuaggaggaugcucugagccuuugugcuuaucuagggcccuccccccauuuccuggagggaaaagucuccuuucagagcgguguccuggcuucaccaggccaaugugagcuccccaagggcagccagugggaacaaggccugagagcguugagcugcagagcuaggcaugccugggucacccgguucugaaccaacaagguuuuagauggagaaacugaggcccaagagucacuacucugcccaguagaggagagcugagacuggaacccacguuuggguucucuguuuugga

SEQ ID NO: 10065 - RNA, 2501 nt, Mus musculus
acaugccaacuaaccaacgccuacccuuaccagccuccccggagaccccuuagugcaacugagccccugugaaugggaaacuggagacuucaccagcgugugagcagcagacgcgugcugguguucgccaugcgugccuguagcugacccaagccccugcuuccugaacucaggguggcuaggggccugugucucucagacaaacaggccaaggagaagcucaggaggaccagggggaaccccgagucgggguccucugacaccacccuacugggagcagagagacccggggugcugucuggaagagcagguucucccgcggcucgcacacggcgugcuucgcggauccacaguaggggggcagacgucaacgccccucgccccccccccccugcgcggggggaaacugaggccgggggcggugucgcgugccggugucgccgcggccccgcccuccugcucgccccgccugcgcggggggcggcggcgguggcggcggcggcggcgacgcuuccugcgggcgcggccgcugugggcgcggagccgcgagcgagcgaacgaacgagcgaggcggagccggcggccgaggagccgagcgcaggucccgcgcagcccgcgccgcgaacaaaggccgccaugaagcccgggccgccgcgccgcgggaccgcacaggggcagcgcguggacaccgccacccaugcgcccggggcccgcgggcuguugcugccaccgcugcugcugcugcugcuggccggccgcgccgcgggggugagugaugggccccaagaggguccccagcguguaccccgcgugucuuugcguguccccucgucgcgcgugccgcgcugggugugucccggucucaugggguccccuccccgccgggaagcgugugcguccgguauccgcuggggucgccuucuccccacccccacuccaucccaagcugccugcagggccuugggggcauuggaggaggagggggugggucgaugaaggugacccgcgagggugaaugagggugacccugugugugugugucugcuucuaagaagggugcgugggcaccugugggugugggcacgggagaggcucuguccauauggcuggauggcauccgcaucccgcuccacacuagggugacccauucugcacgcuguguuccaccauggccaaggcugugugacugugggugagggggugugugcuuugacccauggaccugugugaaagcacacguaugugugugcagguguguagcgaugguggaccuggcucagcucccaccccagaagacaugggugugugugccaucagagguggguaccaggugaccccugacugucccuuugagaaaccgaaguagcuaagggauugaacuugguucugguuucacuagcagaacgggaggaagagggucgguccugcagguggaugagccgggucccugcucugaggaacccagcucccaagugaguucugaguugacaggugucuaaaugugggcugagugagcuggggaguucuagguccuacccccauguggcugacuccaggagcaauggcugucccuacccacucagaugaccaccagagcccaggcuggccggcacgccccuucucuccuaagcaagguggccagauuguagggaggcaggcaagacucugagcugcccugacaacuguuagcuuuggggaggggaccccaagauaguaccugguggucgguucaugccuugcccuuuuuuucuuuucuuuucuuuucuuuucuuuucuuuucuuuucuucuucuucucucucucucucuucuucuucuucuucuucuucuucuucuucuucuucuucuucuucuucuucuucuucuucuccuucuucuucuucuucuucuucuucuucuucuucuucuucuucuucuucuucuucuucuucuucuucuucuucuucuucuucuucuucuucuucuuuuuccuuuuuuuccugauggggugaggggagagguuccugagcaaaaggcagcacuacccacacuggcagugggaacugcuuuucagcagcauuauagaaaauuacccuugacaucaaagaucugguuucaaaguccagugaagaccaccacccaaucacagugaggucuugagccagccuggccacuccucugagucccagcuuuccucucugcaaagacggacuaagggugcccuccggggaggcagaguggacacagaggcaccuuugaaggcauuuugguguugaguacaaagggcucaggacaaauggcuucacuggagcuacugucccuaggaaggaauaauacacauucuacccguagugaaaggauucagggagauuuuugaggacucagcacauaguagggcuucaaccagguaggugugagggcaaaguggagcuggcaugauugagacugaugcugaguggcaugcccagauggugaccuggcugagcgaggggagagauugugguagggaugggucucaagaggu

SEQ ID NO: 10066 - RNA, 2501 nt, Mus musculus
accucuugagacccaucccuaccacaaucucuccccucgcucagccaggucaccaucugggcaugccacucagcaucagucucaaucaugccagcuccacuuugcccucacaccuaccugguugaagcccuacuaugugcugaguccucaaaaaucucccugaauccuuucacuacggguagaauguguauuauuccuuccuagggacaguagcuccagugaagccauuuguccugagcccuuuguacucaacaccaaaaugccuucaaaggugccucuguguccacucugccuccccggagggcacccuuaguccgucuuugcagagaggaaagcugggacucagaggaguggccaggcuggcucaagaccucacugugauugggugguggucuucacuggacuuugaaaccagaucuuugaugucaaggguaauuuucuauaaugcugcugaaaagcaguucccacugccaguguggguagugcugccuuuugcucaggaaccucuccccucaccccaucaggaaaaaaaggaaaaagaagaagaagaagaagaagaagaagaagaagaagaagaagaagaagaagaagaagaagaagaagaagaagaagaagaagaagaagaagaagaaggagaagaagaagaagaagaagaagaagaagaagaagaagaagaagaagaagaagaagaagaagagagagagagagaagaagaagaaaagaaaagaaaagaaaagaaaagaaaagaaaagaaaaaaagggcaaggcaugaaccgaccaccagguacuaucuugggguccccuccccaaagcuaacaguugucagggcagcucagagucuugccugccucccuacaaucuggccaccuugcuuaggagagaaggggcgugccggccagccugggcucugguggucaucugaguggguagggacagccauugcuccuggagucagccacauggggguaggaccuagaacuccccagcucacucagcccacauuuagacaccugucaacucagaacucacuugggagcuggguuccucagagcagggacccggcucauccaccugcaggaccgacccucuuccucccguucugcuagugaaaccagaaccaaguucaaucccuuagcuacuucgguuucucaaagggacagucaggggucaccugguacccaccucugauggcacacacacccaugucuucuggggugggagcugagccagguccaccaucgcuacacaccugcacacacauacgugugcuuucacacagguccaugggucaaagcacacacccccucacccacagucacacagccuuggccaugguggaacacagcgugcagaaugggucacccuaguguggagcgggaugcggaugccauccagccauauggacagagccucucccgugcccacacccacaggugcccacgcacccuucuuagaagcagacacacacacacagggucacccucauucacccucgcgggucaccuucaucgacccacccccuccuccuccaaugcccccaaggcccugcaggcagcuugggauggaguggggguggggagaaggcgaccccagcggauaccggacgcacacgcuucccggcggggaggggaccccaugagaccgggacacacccagcgcggcacgcgcgacgaggggacacgcaaagacacgcgggguacacgcuggggacccucuuggggcccaucacucacccccgcggcgcggccggccagcagcagcagcagcagcgguggcagcaacagcccgcgggccccgggcgcauggguggcgguguccacgcgcugccccugugcggucccgcggcgcggcggcccgggcuucauggcggccuuuguucgcggcgcgggcugcgcgggaccugcgcucggcuccucggccgccggcuccgccucgcucguucguucgcucgcucgcggcuccgcgcccacagcggccgcgcccgcaggaagcgucgccgccgccgccgccaccgccgccgccccccgcgcaggcggggcgagcaggagggcggggccgcggcgacaccggcacgcgacaccgcccccggccucaguuuccccccgcgcaggggggggggggcgaggggcguugacgucugccccccuacuguggauccgcgaagcacgccgugugcgagccgcgggagaaccugcucuuccagacagcaccccgggucucucugcucccaguaggguggugucagaggaccccgacucgggguucccccugguccuccugagcuucuccuuggccuguuugucugagagacacaggccccuagccacccugaguucaggaagcaggggcuugggucagcuacaggcacgcauggcgaacaccagcacgcgucugcugcucacacgcuggugaagucuccaguuucccauucacaggggcucaguugcacuaaggggucuccggggaggcugguaaggguaggcguugguuaguuggcaugu

SEQ ID NO: 10067 - RNA, 2501 nt, Mus musculus
gggagcaggguaagauagguguagagacggggagagucggcaucucccaggaggcaguagacagugaagggcaaccaacaggcagcaaaggcgccaagcaccacagccaauguggcgaugcccuugcggguggccacguagugagaggcaggcagcaggugucguuggagggcgaucugcugggcauggcggcagacgaugcggcagaucugggcauagagcugcaacaugaugccaaacaccaugaagaaggcgauggccagaaccaccagaugguucuuggagaguggauagaccacaccacacguggucaggccaucccggcaguuccaggccagcacgggaaccagccccaggcccagggcacccacccacaccaaggccagcaucacauaaguccgaguuaccguugucucugaguaguaagugagagcauuguacagggaaagguagcggucaacgguaauggccagcaggcugccgaugcuggcagugaaggccauugcuagcacgccgaccagcaucaagcucaucucuggugagccaaugcagaagucagccgcaaagugcaggaccaggcccaggccugccagcaggucugcuacggccaagcuacccaccagcaggaacaugggggcgcggaaggcaggagugcccacaaugauggccaccaccagcgcguucucgcaggacaccagggugccugagaugcacagcaccacaucccaggcccugggagagggcagcaguguagcugggccuguggguuccucuacuggguccacgcugcucacguucacacugccugagccagcugagaaccaggccauagagcuuccugcuccccacaucaugguaccuguagaagaaagguccuaugagaugcuggcaggcccguauccugacaggaggcccuucgagaaaagaaagcugucaggauaacagguaggguacggauguccugcacaccccacacccccaauucauguccugugguuuuuguccucugaugccuccaggccucuaaacaggggucccuuuuucucggugaucccuuuucugugucccuucacccuccccuccauuccucuaaguccugaagaccucuuggccacacguggucaaagaagugaaucaaagcuuaccauaagugaauaggggaagcacaggauucaaggugugcccucaauaggcucaugaauaggggagggaaacacgucaagaagaagagcagucagcucccucccaccagacacgaugacuugguuccugaagcucccagaccccucacgauucaugggcacugccagccucaagcuccgcccccaggcaaagccggugcagcuucuugccagcccccacucgacauucccaggguaacaccugggaacucauuuccccuacacucucccagacuucugacuccggacagacaccccacacacacugcccccuucuuccuccuaaccacugggucuccguagcagacacccccuggugaaagccggauuccugagucagaccccuccuucugcccggacaccuggaucuugggccugacuccgccuccugccuuggauagccgaagccccaaauaagacaccacccgcuacucggacgucuaggugcccgccccagacgccuccuguucucccaaccucagaugaccgcccgucccucuagggccucaggucccgcaggaaugcucacccuuugccgggucaccccaucauaccacucgagagcacccgaacacuuggggagcugccugcuuaugcagacucugcacauccagagucccagguacgaccccccgacccugagcaggggcaagcagccuuccgccggcccggcgccccugcacgcuguguccucccagacuccggguacccgcggcagggcccacuacucaccgguggcucaggaccgggugcggccgggccgcggggcgccuccacucagguucuggcagagcaaggugugcgcggaccccaagaagcccccgcggccgcgggagacgcggcgugagucaccccgccccgccccgcccccggccaccgguuuggugacgccagaagcccagcaggccaaugggcgcugcgcgcuggagcgcagcgcgugcugcgcggcauaguaaugaggccucgcgccgcccgcucccccauucauaaaaagugaccguggccgcggccccgcccccuccggagccggcucucuguccuugacgcggcgcccucugcgggucggggguuuuggggacacuagugggagagccuuaaaagagacucggggaggucacagaggaugugggaagaggucaagggauugggauagucugcgggggugaugaguaccuucgguggcagaaacgagcugacauaagacaggugauggagcgaaaugggcguccccggugaggaugacaggcucugccucugauagggccccgaggcgacggugacaggagcacgagggagcagggagguggguggcugugacga

SEQ ID NO: 10068 - RNA, 2501 nt, Mus musculus
ucgucacagccacccaccucccugcucccucgugcuccugucaccgucgccucggggcccuaucagaggcagagccugucauccucaccggggacgcccauuucgcuccaucaccugucuuaugucagcucguuucugccaccgaagguacucaucacccccgcagacuaucccaaucccuugaccucuucccacauccucugugaccuccccgagucucuuuuaaggcucucccacuaguguccccaaaacccccgacccgcagagggcgccgcgucaaggacagagagccggcuccggagggggcggggccgcggccacggucacuuuuuaugaaugggggagcgggcggcgcgaggccucauuacuaugccgcgcagcacgcgcugcgcuccagcgcgcagcgcccauuggccugcugggcuucuggcgucaccaaaccgguggccgggggcggggcggggcggggugacucacgccgcgucucccgcggccgcgggggcuucuugggguccgcgcacaccuugcucugccagaaccugaguggaggcgccccgcggcccggccgcacccgguccugagccaccggugaguagugggcccugccgcggguacccggagucugggaggacacagcgugcaggggcgccgggccggcggaaggcugcuugccccugcucagggucggggggucguaccugggacucuggaugugcagagucugcauaagcaggcagcuccccaaguguucgggugcucucgagugguaugauggggugacccggcaaagggugagcauuccugcgggaccugaggcccuagagggacgggcggucaucugagguugggagaacaggaggcgucuggggcgggcaccuagacguccgaguagcggguggugucuuauuuggggcuucggcuauccaaggcaggaggcggagucaggcccaagauccagguguccgggcagaaggaggggucugacucaggaauccggcuuucaccagggggugucugcuacggagacccagugguuaggaggaagaagggggcaguguguguggggugucuguccggagucagaagucugggagaguguaggggaaaugaguucccagguguuacccugggaaugucgagugggggcuggcaagaagcugcaccggcuuugccugggggcggagcuugaggcuggcagugcccaugaaucgugaggggucugggagcuucaggaaccaagucaucgugucuggugggagggagcugacugcucuucuucuugacguguuucccuccccuauucaugagccuauugagggcacaccuugaauccugugcuuccccuauucacuuaugguaagcuuugauucacuucuuugaccacguguggccaagaggucuucaggacuuagaggaauggaggggagggugaagggacacagaaaagggaucaccgagaaaaagggaccccuguuuagaggccuggaggcaucagaggacaaaaaccacaggacaugaauuggggguguggggugugcaggacauccguacccuaccuguuauccugacagcuuucuuuucucgaagggccuccugucaggauacgggccugccagcaucucauaggaccuuucuucuacagguaccaugauguggggagcaggaagcucuauggccugguucucagcuggcucaggcagugugaacgugagcagcguggacccaguagaggaacccacaggcccagcuacacugcugcccucucccagggccugggauguggugcugugcaucucaggcacccugguguccugcgagaacgcgcuggugguggccaucauugugggcacuccugccuuccgcgcccccauguuccugcugguggguagcuuggccguagcagaccugcuggcaggccugggccugguccugcacuuugcggcugacuucugcauuggcucaccagagaugagcuugaugcuggucggcgugcuagcaauggccuucacugccagcaucggcagccugcuggccauuaccguugaccgcuaccuuucccuguacaaugcucucacuuacuacucagagacaacgguaacucggacuuaugugaugcuggccuuggugugggugggugcccugggccuggggcugguucccgugcuggccuggaacugccgggauggccugaccacgugugguguggucuauccacucuccaagaaccaucuggugguucuggccaucgccuucuucaugguguuuggcaucauguugcagcucuaugcccagaucugccgcaucgucugccgccaugcccagcagaucgcccuccaacgacaccugcugccugccucucacuacguggccacccgcaagggcaucgccacauuggcuguggugcuuggcgccuuugcugccuguugguugcccuucacugucuacugccuccugggagaugccgacucuccccgucucuacaccuaucuuacccugcuccc

SEQ ID NO: 10069 - RNA, 2501 nt, Mus musculus
gcaagagcaccagcccccugucacucccuugcaccaagaauccaauuccaggaagucucucuuccccgcaguagcccccaucaaagcugcuagucacaucccuacccuaagggcaaucgaaggauuuucuuucuuuucuuuuucugaggguuuauuguugguugguuuuguuuuuugagacacucuguguagccgugaaacuuacucuguagaccagucuggccucgaaccuagagaucugccugacucagcuuccccauugcuggccuuaaauguguaugccaccacgccaggccgauuuucuagaaacuuggauuccaaggcuuuuuuuuuucuacaggauuccaggaagaguggguuuuguggucauccaguccuaacuuagcaacucuaggcaacucuuagcaagugcuuuucucuuugcuccaggcaaaaacuuuaggucgcaguccggcucagcuccuucgggcuccggggaugcaggggucagguccugggggcagagccgcaauucccuuugcagccggccacccuccccccuccccgcgggcuuuugcacacgacgcgcggcgggcggcuucacaccagguggcgaggagggccggggauaaagcgggcgggcgcggggcgcagcggcagggccggagcggaagguggaaggugacugcgagcugccaucgucccgcgcgcaacuucgagggcgcaccgagagaggcggcaugcagacuauggacaagcagaaccugcuggagagcacgcgcggagcccgguaaguucaagccccaaggggcgggaagcugggcagcaucacacguaccuccucuuugaccaucucggcugugguugguccgagcgggggcuugaacugggacccgauccgagggauggggugaggcaagagaaaggaaauuggcggcggccucguagccucagggaucaccugucucaccuggccaagcacacaguuccugaacgcugccugccuguacgcccgagugggacguagggugccuggaaccccgccuucacuccagcacuuugaucccgggcagcccugagguggggaggcccgguguccuugggugcgcugagcuauggucuuuagcugcuguuugagccagaacucugcucagagcucuuucucugagcucgaccggacugacugcccuuuggcuaguucgcaaagcucucagccugggaauggguggaggagcaggggaccaucauagaacaaggucccaagacucaccuccccaauaccacacccaccccccuguaacauuggcugcauaccucugcuuacccgccagccaacgcgggguucggaguguucuuacuuguucuggaaacagcagacuagcaauaacucccagagacuggcccagugcccccucccccgucuccggcugagcggucuccuguccuuccucuugccuccagguccuucuuaggaucucuguggaagagugaagcuagccggaucccuccuguggaccugcccgcgguugagcuggcuguccagagcaaccauuauugccaugcccagaaggauucuggaagucacccugaccccgagaagcagagggcccgacgcaaacucuauguggccucugccaucugccugguguucaugauuggcgaaaucauugguaaggccgugugugugugugugugugugugugugugugugugugugugugugugugaauuaagugaaaguugcugugcacauaggcugaauguuuacauuaaugcuaauggcaguaauagcuacccguuuuauugguuacuuuuucuucuuucuuuuuucuuucuuucuuccuuccuuccuuucuuucuauuuuuuuuuuuuugagcuuucacuuugcuugccuagaacucauaucugucuguuucugcuucuagaguguugggauuaacgauaugugacaccacaaccaccauuauuuauuuguuuguuuguucguuuguuuauuauuuuucgagacaggguuucucuguguaacccuggcuguuauaacucccuuagaccagacuggcuucgaacucagagaccugccugucucugccuuucaugugccucuaccaccgggcuaauuuuuuuuuuuuuuuuuaaggcaaucacuuggcauggcucuguaguuaagagcacuggcugcucuuccaggggaccuggcccugcuuccccgcaccuaugugagggcucugucaucuguuacucuaucuagccccagggagucggaugcccucuuguggcuucugugggcaccaggcauaugguauacauacauacauguaagcaaaagacauacacuuagguuaauaauaaaagagauaagaagagccccuacugaggcccuuauuuugcuuuccugucccuaggugaacuugauuuucugugaauaagaucugagauaaacagcugaggugcauauuuaacauaacaaagugaaccaggccuccagguucucccagccuccuucagucucuaccugguaaaa

SEQ ID NO: 10070 - RNA, 2501 nt, Mus musculus
uuuuaccagguagagacugaaggaggcugggagaaccuggaggccugguucacuuuguuauguuaaauaugcaccucagcuguuuaucucagaucuuauucacagaaaaucaaguucaccuagggacaggaaagcaaaauaagggccucaguaggggcucuucuuaucucuuuuauuauuaaccuaaguguaugucuuuugcuuacauguauguauguauaccauaugccuggugcccacagaagccacaagagggcauccgacucccuggggcuagauagaguaacagaugacagagcccucacauaggugcggggaagcagggccagguccccuggaagagcagccagugcucuuaacuacagagccaugccaagugauugccuuaaaaaaaaaaaaaaaaauuagcccggugguagaggcacaugaaaggcagagacaggcaggucucugaguucgaagccagucuggucuaagggaguuauaacagccaggguuacacagagaaacccugucucgaaaaauaauaaacaaacgaacaaacaaacaaauaaauaauggugguuguggugucacauaucguuaaucccaacacucuagaagcagaaacagacagauaugaguucuaggcaagcaaagugaaagcucaaaaaaaaaaaaauagaaagaaaggaaggaaggaagaaagaaagaaaaaagaaagaagaaaaaguaaccaauaaaacggguagcuauuacugccauuagcauuaauguaaacauucagccuaugugcacagcaacuuucacuuaauucacacacacacacacacacacacacacacacacacacacacacacacacggccuuaccaaugauuucgccaaucaugaacaccaggcagauggcagaggccacauagaguuugcgucgggcccucugcuucucggggucagggugacuuccagaauccuucugggcauggcaauaaugguugcucuggacagccagcucaaccgcgggcagguccacaggagggauccggcuagcuucacucuuccacagagauccuaagaaggaccuggaggcaagaggaaggacaggagaccgcucagccggagacgggggagggggcacugggccagucucugggaguuauugcuagucugcuguuuccagaacaaguaagaacacuccgaaccccgcguuggcuggcggguaagcagagguaugcagccaauguuacaggggggugggugugguauuggggaggugagucuugggaccuuguucuaugaugguccccugcuccuccacccauucccaggcugagagcuuugcgaacuagccaaagggcagucaguccggucgagcucagagaaagagcucugagcagaguucuggcucaaacagcagcuaaagaccauagcucagcgcacccaaggacaccgggccuccccaccucagggcugcccgggaucaaagugcuggagugaaggcgggguuccaggcacccuacgucccacucgggcguacaggcaggcagcguucaggaacugugugcuuggccaggugagacaggugaucccugaggcuacgaggccgccgccaauuuccuuucucuugccucaccccaucccucggaucgggucccaguucaagcccccgcucggaccaaccacagccgagauggucaaagaggagguacgugugaugcugcccagcuucccgccccuuggggcuugaacuuaccgggcuccgcgcgugcucuccagcagguucugcuuguccauagucugcaugccgccucucucggugcgcccucgaaguugcgcgcgggacgauggcagcucgcagucaccuuccaccuuccgcuccggcccugccgcugcgccccgcgcccgcccgcuuuauccccggcccuccucgccaccuggugugaagccgcccgccgcgcgucgugugcaaaagcccgcggggaggggggaggguggccggcugcaaagggaauugcggcucugcccccaggaccugaccccugcauccccggagcccgaaggagcugagccggacugcgaccuaaaguuuuugccuggagcaaagagaaaagcacuugcuaagaguugccuagaguugcuaaguuaggacuggaugaccacaaaacccacucuuccuggaauccuguagaaaaaaaaaagccuuggaauccaaguuucuagaaaaucggccuggcgugguggcauacacauuuaaggccagcaauggggaagcugagucaggcagaucucuagguucgaggccagacuggucuacagaguaaguuucacggcuacacagagugucucaaaaaacaaaaccaaccaacaauaaacccucagaaaaagaaaagaaagaaaauccuucgauugcccuuaggguagggaugugacuagcagcuuugaugggggcuacugcggggaagagagacuuccuggaauuggauucuuggugcaagggagugacagggggcuggugcucuugc

SEQ ID NO: 10071 - RNA, 2501 nt, Mus musculus
gaagugugcccagcacaggucuccauccccuuaugucuacacaaggauucucacagguaggaaguucuuuaagucagaccuaagucauauuucuaaaaccagaggcuguuauuuccuugagagauuaaucuccaaaauuagacccaggagcaguuuccagcugggaccagcuaccagguucgguggcuccccugaggccuuggacaggauugaacccaacucuugcuuaaaacucagaagccuucggagacagacaguucuguguucacucuggccggguggccauggcuaaguucccuaauauauaucuucuuuagaauacagacuccuuagcgacagcaguuagaauuauuuuacuauacauaauagcuuguguguguguguguguguguguguguguguguguauaggccagaguuugagggugggugucuuguucaguccugugagugggugggguacccaugugccuuggaccauguguagaagucagaggacaauuuccaggaaucucuucuuuuucaaacuugugggcucagggggacgacagaacccuccagcccucaggcuugguggcaagugucuuugcccacucagccaccucucuaccuucagggucucucauugaucuugaaacuccuaagcugguuggcuagagcucuagauccuccugucucuaccuccucaacaccggaaggucucaugggguggggguagcggagggggagggggcuugaacucaugucucuauguuuguaagguaaacacaccuuaugacuaugaucuacuucccccuaccacgucauuguuuauggaagugcuaucacccgagugagcgaaugguauacaaaugucuguuacauaaaacguuagaguaggagggaccagcauaccaggcauggaggaggugggagggggaggcagccugcuauguuucuaagauccccaagggagaauuccaaaaaucugccuuucacacccucggagacuuaucacuccagcuugguggagaucugcucugcugucuuaacccucucucuccuacugcggcugagaguuugucggacaggaugacaaucuuaacccuucacuccauccucuggaucugcuccugucccagccgccucccacucaggaguucccucccacucagcggcuccccaaggguagguuuacuuacugcugggguccagggucuugcucacagugccugucccagaggcaggcugaggcgugggugcuugugauacgccaccugccuuucuccucugcuaccgccaguaagguggccccagguuggggacugugcugcugcagcuugccgggagccccaccucgcaaugggugagcuucggggagauacgggagcgcuaaaucgaagcccggucggaagauguccgaggaggggcuggccucagcuaccaucgccugucccagccuggugcaaggggcuggguagagacucaacaccagaugguuccggccuccguuccaguucggaggcaggggcccgcaggcuccucuacgauccuggcuggggagaaaaaggagaaggcaagcgucugcugggcugagugcagaguagcgggagccuuccaaggaauccaggauccugcgcugagccucagaggucggaccagccggggagugcacaaagaucuugaggaccuuuccccuacacuuggaggugucaaagcaggcuccccaggugcagcugcuuccccgagagacccgagggagcugugcgacaucuucuggguucgucucagacugggagaaacucuguaagaaggcagcauccagccagcggggccagccuugggagcgcccuggaagaggaccgggcaacacugccaggcgaagggggaagacuccuaggaggacgaggaggagccagaaggcugacaacgccagccagaaggacuuucuucuccacagcauguggccaccaacagcuaggacuagaaggaagugaggaauuucuguagcaaguggaggaggcgaccccaggcaggagggagcuggaaaucagccuucugguccagcgcucucaccauugaaggcagguccccuagcuaaguucgacuaaccauuggccaccugugggauugaccccucgugggaaguccaaggaggcucuggcuuucuaaauuugcauucccacucuccgacugcuuucucuaccuucacacaaccuugccacccuuugcccucucaucgggaccucugcccugggccacugcucgggcugaugcaacccuuguccagaccacaagaucguguccauuugcgcucaggacugcaccccugaucuuacccuugacccaagggcaggcuaucuauggagaacugucuggguucauggggaguggguaucgggaggggguggccaaggaugauguagaaggaggcaggacuguccucucccacucuucccucugccccaaaagcucuugaaaaaaacccuggcuaccccuguguuugguggcuggccuucugug

SEQ ID NO: 10072 - RNA, 2501 nt, Mus musculus
cacagaaggccagccaccaaacacagggguagccaggguuuuuuucaagagcuuuuggggcagagggaagagugggagaggacaguccugccuccuucuacaucauccuuggccacccccucccgauacccacuccccaugaacccagacaguucuccauagauagccugcccuugggucaaggguaagaucaggggugcaguccugagcgcaaauggacacgaucuuguggucuggacaaggguugcaucagcccgagcaguggcccagggcagaggucccgaugagagggcaaaggguggcaagguugugugaagguagagaaagcagucggagagugggaaugcaaauuuagaaagccagagccuccuuggacuucccacgaggggucaaucccacagguggccaaugguuagucgaacuuagcuaggggaccugccuucaauggugagagcgcuggaccagaaggcugauuuccagcucccuccugccuggggucgccuccuccacuugcuacagaaauuccucacuuccuucuaguccuagcuguugguggccacaugcuguggagaagaaaguccuucuggcuggcguugucagccuucuggcuccuccucguccuccuaggagucuucccccuucgccuggcaguguugcccgguccucuuccagggcgcucccaaggcuggccccgcuggcuggaugcugccuucuuacagaguuucucccagucugagacgaacccagaagaugucgcacagcucccucgggucucucggggaagcagcugcaccuggggagccugcuuugacaccuccaaguguaggggaaagguccucaagaucuuugugcacuccccggcugguccgaccucugaggcucagcgcaggauccuggauuccuuggaaggcucccgcuacucugcacucagcccagcagacgcuugccuucuccuuuuucuccccagccaggaucguagaggagccugcgggccccugccuccgaacuggaacggaggccggaaccaucugguguugagucucuacccagccccuugcaccaggcugggacaggcgaugguagcugaggccagccccuccucggacaucuuccgaccgggcuucgauuuagcgcucccguaucuccccgaagcucacccauugcgagguggggcucccggcaagcugcagcagcacaguccccaaccuggggccaccuuacuggcgguagcagaggagaaaggcagguggcguaucacaagcacccacgccucagccugccucugggacaggcacugugagcaagacccuggaccccagcaguaaguaaaccuacccuuggggagccgcugagugggagggaacuccugagugggaggcggcugggacaggagcagauccagaggauggagugaaggguuaagauugucauccuguccgacaaacucucagccgcaguaggagagagaggguuaagacagcagagcagaucuccaccaagcuggagugauaagucuccgagggugugaaaggcagauuuuuggaauucucccuuggggaucuuagaaacauagcaggcugccucccccucccaccuccuccaugccugguaugcuggucccuccuacucuaacguuuuauguaacagacauuuguauaccauucgcucacucgggugauagcacuuccauaaacaaugacgugguagggggaaguagaucauagucauaagguguguuuaccuuacaaacauagagacaugaguucaagcccccucccccuccgcuacccccaccccaugagaccuuccgguguugaggagguagagacaggaggaucuagagcucuagccaaccagcuuaggaguuucaagaucaaugagagacccugaagguagagagguggcugagugggcaaagacacuugccaccaagccugagggcuggaggguucugucgucccccugagcccacaaguuugaaaaagaagagauuccuggaaauuguccucugacuucuacacaugguccaaggcacauggguaccccacccacucacaggacugaacaagacacccacccucaaacucuggccuauacacacacacacacacacacacacacacacacacaagcuauuauguauaguaaaauaauucuaacugcugucgcuaaggagucuguauucuaaagaagauauauauuagggaacuuagccauggccacccggccagagugaacacagaacugucugucuccgaaggcuucugaguuuuaagcaagaguuggguucaauccuguccaaggccucaggggagccaccgaaccugguagcuggucccagcuggaaacugcuccugggucuaauuuuggagauuaaucucucaaggaaauaacagccucugguuuuagaaauaugacuuaggucugacuuaaagaacuuccuaccugugagaauccuuguguagacauaaggggauggagaccugugcugggcacacuuc

SEQ ID NO: 10073 - RNA, 2501 nt, Mus musculus
ccucccuccuuuuugcuccccucccccucggccgcucgcugcuucacaguccccgagucgccgccgcugccgccgcccgcauccgcggcaggacuggcccgcgcgcuccccggggugcgcccaccucggucccgcgcccuccgggcucgcagggacacccuccuccccgcgcgucgcggccccgcccggcucggcccccgccccgcgcccgagagcgccgaggaugugaguccugcccgccgcugccggagcagcagccacucgcgcgcggagcccgagcgcagcgcagcucagcugcgggcgcucguugggucgcucgcgcgggcugcgcgcuccugccccaagcggugucccuccccggccucucgccggccccagcgccgcggcagccccgagggccguccccggccggccauccccggccccagcgccgcugacccuguccuccgcgggcggggacgcgggcggaggaggugccgccucggagcccccggacgcgaccaugucggaggugcugcccuacggcgacgagaagcugagccccuacggcgacggcggcgacgugggccagaucuucucgugccgccugcaggacaccaacaacuucuucggggcugggcagagcaagcggccucccaagcugggccagaucggccggagcaagcgcggugaguuccccgccccuuacccccugcggugcuggugcugcagccuggcuggggcucagggguccccgcgguaguaggaggaccaucugcgagaucuagggaucccuccugcggcggaagcuggaucaggccucgggcaagaguccccgcuuguccgggccaccagcggggucacccgggggcgugguagccucuacuugcugccgaggcccaaagguuauacccgcguccucaaccgcaccaaaguuugcuuuuagguuucacaccccucccccuuuuugcgcaguggagucgcaucugcacucucucugcucggccacccugggguaagggguccuggagcuucuuaggggucugcguggggcgcugcaggggaaggaccuuaacucccgcggggaagggcgaggagcauucaggucgcacuggcuuuucacuguuacuuggcagaggggagaaggguggucuagccugagauauuggaguuggagaagccccagggaaaccgagacucagggugcugccggaaaagacugggguggcgaggugaaguggggagauggucgggagaccgaggugggcugagagcuaaagcgagggagcuguaagggagccugggacucaagucuagggaggacgcugaagugcuggaacaaugagggugacagacaaggagaccuacggguagagacccagaguucuggacaggugaucugaucauccaguacagggaccgguggagggacugagagaggccaguggaggcagugaggcaggcggaagaggcaacugaagguaaagccccaggcggcagcgaagggagguucugcccuuugcgguggcacagagagcggaggggcggaggcuacagaccggggaacggggaagggagaacgggagggggacacccguucaggccaggccuaaacuuugcagccgcugaucggcgugggaaccuaccccagcuuuccuuccugcuccgggcaucuuugaacccggccugggcuaccgccaccagugaucugaagaccucaguuucccuuucucuccuuaagaaucagccuaggagacuucuuuguaaaggguugcaucggguugcagucgagcugggauggcucccucuggcuugcuccuucuuagaauccaucuaggaugagggcuaggcaguggggcaguucagaaccaggcagggaagggagccuagggcaauggggcuguucacccugcuuggaacagccagccuuccuuccucgcccuccccugcaccuccauaauggggauagacaaaguaucugcgaccccuggcuagcccaagcucucucacauuucucuuccccuccccccccuuuuuuuuuuuuuuuuuuugcaguuguuauugaagaugauaggauugaugacgugcugaaaaccaugaccgacaaggcacccccuggugucuaacugccccaaagacaauguguugagggaaagaauaagaagaguggcgggcugugacaguuacugacaaaaagcacgaggaggaggaggagggagaaagcacuuugaaauuuauuaauagcuugcuaccugcgaugaaaucgacaacuugugucucaagucaggccgggagacagaugagguggagaggaggaggaggaggaagaggaggagguggaggugguggaggugguggugguggugguagcagcgguagcgguggcucugggcuccucuacaaaaacaaaaguuaaaaaaaaacacacaaaaaguaaaaaaauaaaauaaaaaaaauaaaaaucacuauauacacacauauaaaagaaaaaagucucaguugcagcuauuugucaagauuaa

SEQ ID NO: 10074 - RNA, 2501 nt, Mus musculus
uuaaucuugacaaauagcugcaacugagacuuuuuucuuuuauauguguguauauagugauuuuuauuuuuuuuauuuuauuuuuuuacuuuuuguguguuuuuuuuuaacuuuuguuuuuguagaggagcccagagccaccgcuaccgcugcuaccaccaccaccaccaccuccaccaccuccaccuccuccucuuccuccuccuccuccucuccaccucaucugucucccggccugacuugagacacaaguugucgauuucaucgcagguagcaagcuauuaauaaauuucaaagugcuuucucccuccuccuccuccucgugcuuuuugucaguaacugucacagcccgccacucuucuuauucuuucccucaacacauugucuuuggggcaguuagacaccagggggugccuugucggucaugguuuucagcacgucaucaauccuaucaucuucaauaacaacugcaaaaaaaaaaaaaaaaaaaggggggggaggggaagagaaaugugagagagcuugggcuagccaggggucgcagauacuuugucuauccccauuauggaggugcaggggagggcgaggaaggaaggcuggcuguuccaagcagggugaacagccccauugcccuaggcucccuucccugccugguucugaacugccccacugccuagcccucauccuagauggauucuaagaaggagcaagccagagggagccaucccagcucgacugcaacccgaugcaacccuuuacaaagaagucuccuaggcugauucuuaaggagagaaagggaaacugaggucuucagaucacugguggcgguagcccaggccggguucaaagaugcccggagcaggaaggaaagcugggguagguucccacgccgaucagcggcugcaaaguuuaggccuggccugaacgggugucccccucccguucucccuuccccguuccccggucuguagccuccgccccuccgcucucugugccaccgcaaagggcagaaccucccuucgcugccgccuggggcuuuaccuucaguugccucuuccgccugccucacugccuccacuggccucucucagucccuccaccggucccuguacuggaugaucagaucaccuguccagaacucugggucucuacccguaggucuccuugucugucacccucauuguuccagcacuucagcguccucccuagacuugagucccaggcucccuuacagcucccucgcuuuagcucucagcccaccucggucucccgaccaucuccccacuucaccucgccaccccagucuuuuccggcagcacccugagucucgguuucccuggggcuucuccaacuccaauaucucaggcuagaccacccuucuccccucugccaaguaacagugaaaagccagugcgaccugaaugcuccucgcccuuccccgcgggaguuaagguccuuccccugcagcgccccacgcagaccccuaagaagcuccaggaccccuuaccccaggguggccgagcagagagagugcagaugcgacuccacugcgcaaaaagggggaggggugugaaaccuaaaagcaaacuuuggugcgguugaggacgcggguauaaccuuugggccucggcagcaaguagaggcuaccacgcccccgggugaccccgcugguggcccggacaagcggggacucuugcccgaggccugauccagcuuccgccgcaggagggaucccuagaucucgcagaugguccuccuacuaccgcggggaccccugagccccagccaggcugcagcaccagcaccgcaggggguaaggggcggggaacucaccgcgcuugcuccggccgaucuggcccagcuugggaggccgcuugcucugcccagccccgaagaaguuguugguguccugcaggcggcacgagaagaucuggcccacgucgccgccgucgccguaggggcucagcuucucgucgccguagggcagcaccuccgacauggucgcguccgggggcuccgaggcggcaccuccuccgcccgcguccccgcccgcggaggacagggucagcggcgcuggggccggggauggccggccggggacggcccucggggcugccgcggcgcuggggccggcgagaggccggggagggacaccgcuuggggcaggagcgcgcagcccgcgcgagcgacccaacgagcgcccgcagcugagcugcgcugcgcucgggcuccgcgcgcgaguggcugcugcuccggcagcggcgggcaggacucacauccucggcgcucucgggcgcggggcgggggccgagccgggcggggccgcgacgcgcggggaggagggugucccugcgagcccggagggcgcgggaccgaggugggcgcaccccggggagcgcgcgggccaguccugccgcggaugcgggcggcggcagcggcggcgacucggggacugugaagcagcgagcggccgagggggaggggagcaaaaaggagggagg

SEQ ID NO: 10075 - RNA, 2501 nt, Mus musculus
ucugcaguaggacaaguccuuagguucggaaaccaaggagcggauccccaggugccuuggggggcuuccaggugcagcguccaggggcgcgcgcgaggaggaggaguggaugcuccggguuggccgcgggcagggggcgcguccagcgggucccucccgguugcucccgggccaaucuuccucggcgcguccccgcaggcgcgcacccagggcucagccugugggcucgcgcacccgcggagcggggagcgugcgcgcgcgcucucccuccccgccccgcccgccgccaccccgcccccggccggguacccucgccggacccgagagagagcgccgccgccaucuuagccgccgccgccuccagcgcagcgcugccgacgaggggagggcgcgcgcggcccagcagcacggcggcugccguucccaucccggugcucgccgcgccgcccagccgccggcccccggcugcccgcgccccucucggcgucccgcgcgacucccugcugcuuccgcgucgggccggccguggcgccccgagcccgagcgaugcugcgccgcccugcgcccgcgcuggccccggccguccggcugcugcuggcggggcugcugugcggcggcggggucugggccgcgcgagguaagcgacggggcgcggugagccgggugcgggagucagaaccgagugcaagguugggccgaaugcagaagucaugcggggccgcgggguucgggucggggccgggugcgggaaccgugcucgggugcaagguggggggcugagugcgagggucaugcggggcggcgggguuaugggcaagugcugcaguccuguagggccucuggguucugggccgagugcgggacucgugccagagcccaggguucggguccuagugcgcgcauuguaucaggcaagguucggguccgaguguggggaucgugccgaggcccaggguucggauacgagugcgcgagucauauugggcaagguuggguccgaguucgggcauaguaaccgggugcaaggaggugggcagagugcaggagucgugcagggccgcggaauuuggguccgagugugggaauugugccagggcugaggguucagguccgagugcgcgcgucguauugggcgaggcucggaucccggugcgcagaucgucuccagcaagguucggggcccagaucguaucaggugcacagguacaggacccagugcaggaauagugucagcgcacagggaucggugccgagugagguaguguugcuggggcgcgggguuccgacccgacugugugacugauugccugggagcggggcucugggcugagugcggaacaucgagcccgcucgcuacgugagauucagguucaggcgcucagagaagagcuccggagaaccuaggcgcgcgcugcagaugccuggggaagccaauuuuguacccgggcggggcaccugggccaugacugcccuaguuguagccccagggugcuugaggugcuggucuggggagaucuggggacacgcggugggaguuagcccacuuuccaguagcgcaugcagccuggggggugcgccccugggugggaugcaguguacguguguuggaugaucagcccagggaugcacgcaaggauuuuggugugugcuuacauaagauuccacuccuccgcaucacuuucccaagaucccgguucucugcugcggcuagguggacaccacgacuucgccccuuuucgccuccucuccgcguccuuuaaacgcgguuucggaaguaacagaggcgaaaacuccucuuccuucccacccuuuugcccaaagacgaaauugagaagguguuugugaucacuuuucauccaccagugugaacaaagcgcucguccgcugcaccuuuacucagaguaguguaccggacuuguaugaccaccacagagaccagccagccccgcuaauuccuuaggagugugggaggcaaauaggauuuugcuguuuuaaaucuucauccacuucaucuaaacauuguaccugccuucugauauugaccgagcuugccaccaaaacugcuuacgcauugcagauaaagccuucugaauggaacuugaaaccguaaacauuuuuccuggucuuaaaguagucuagguagauagucuguagagagugcucgaaucuauuuucuucaaguguauauuuuggaaaucaaaagagcuuugugggaggaggauugauagaagucugggugagauggucacguaauaacuuugcaagcuuuaaaaaaagauugccuuuucugcuuggccugacuuaggaaaguuguguucacaaaaaagggcagaagagggcaaagcauccuuuguuccagcgugccacacagagggugauaaacugaaaacuucuuuuauuccaucuagaacauucuguccauucuugucaaauucagcuccuugccacuaaguaucuaauuaccgugcauuugauuuuuuuuuuugaaaaguuucagcaaa

SEQ ID NO: 10076 - RNA, 2501 nt, Mus musculus
uuugcugaaacuuuucaaaaaaaaaaaucaaaugcacgguaauuagauacuuaguggcaaggagcugaauuugacaagaauggacagaauguucuagauggaauaaaagaaguuuucaguuuaucacccucuguguggcacgcuggaacaaaggaugcuuugcccucuucugcccuuuuuugugaacacaacuuuccuaagucaggccaagcagaaaaggcaaucuuuuuuuaaagcuugcaaaguuauuacgugaccaucucacccagacuucuaucaauccuccucccacaaagcucuuuugauuuccaaaauauacacuugaagaaaauagauucgagcacucucuacagacuaucuaccuagacuacuuuaagaccaggaaaaauguuuacgguuucaaguuccauucagaaggcuuuaucugcaaugcguaagcaguuuugguggcaagcucggucaauaucagaaggcagguacaauguuuagaugaaguggaugaagauuuaaaacagcaaaauccuauuugccucccacacuccuaaggaauuagcggggcuggcuggucucugugguggucauacaaguccgguacacuacucugaguaaaggugcagcggacgagcgcuuuguucacacugguggaugaaaagugaucacaaacaccuucucaauuucgucuuugggcaaaagggugggaaggaagaggaguuuucgccucuguuacuuccgaaaccgcguuuaaaggacgcggagaggaggcgaaaaggggcgaagucgugguguccaccuagccgcagcagagaaccgggaucuugggaaagugaugcggaggaguggaaucuuauguaagcacacaccaaaauccuugcgugcaucccugggcugaucauccaacacacguacacugcaucccacccaggggcgcaccccccaggcugcaugcgcuacuggaaagugggcuaacucccaccgcguguccccagaucuccccagaccagcaccucaagcacccuggggcuacaacuagggcagucauggcccaggugccccgcccggguacaaaauuggcuuccccaggcaucugcagcgcgcgccuagguucuccggagcucuucucugagcgccugaaccugaaucucacguagcgagcgggcucgauguuccgcacucagcccagagccccgcucccaggcaaucagucacacagucgggucggaaccccgcgccccagcaacacuaccucacucggcaccgaucccugugcgcugacacuauuccugcacuggguccuguaccugugcaccugauacgaucugggccccgaaccuugcuggagacgaucugcgcaccgggauccgagccucgcccaauacgacgcgcgcacucggaccugaacccucagcccuggcacaauucccacacucggacccaaauuccgcggcccugcacgacuccugcacucugcccaccuccuugcacccgguuacuaugcccgaacucggacccaaccuugcccaauaugacucgcgcacucguauccgaacccugggccucggcacgauccccacacucggacccgaaccuugccugauacaaugcgcgcacuaggacccgaacccugggcucuggcacgagucccgcacucggcccagaacccagaggcccuacaggacugcagcacuugcccauaaccccgccgccccgcaugacccucgcacucagccccccaccuugcacccgagcacgguucccgcacccggccccgacccgaaccccgcggccccgcaugacuucugcauucggcccaaccuugcacucgguucugacucccgcacccggcucaccgcgccccgucgcuuaccucgcgcggcccagaccccgccgccgcacagcagccccgccagcagcagccggacggccggggccagcgcgggcgcagggcggcgcagcaucgcucgggcucggggcgccacggccggcccgacgcggaagcagcagggagucgcgcgggacgccgagaggggcgcgggcagccgggggccggcggcugggcggcgcggcgagcaccgggaugggaacggcagccgccgugcugcugggccgcgcgcgcccuccccucgucggcagcgcugcgcuggaggcggcggcggcuaagauggcggcggcgcucucucucggguccggcgaggguacccggccgggggcgggguggcggcgggcggggcggggagggagagcgcgcgcgcacgcuccccgcuccgcgggugcgcgagcccacaggcugagcccugggugcgcgccugcggggacgcgccgaggaagauuggcccgggagcaaccgggagggacccgcuggacgcgcccccugcccgcggccaacccggagcauccacuccuccuccucgcgcgcgccccuggacgcugcaccuggaagccccccaaggcaccuggggauccgcuccuugguuuccgaaccuaaggacuuguccuacugcaga

SEQ ID NO: 10077 - RNA, 2501 nt, Mus musculus
gagguuguacugggggguucuugcaugccacagagagaaauagggcugagcgcuccuguccaggcugcccugggccccuucccugguacacugguuccacuguuuccgaaugucugccgugggagcccuuccaggaauuugggguuagugaagggaauggggcucgauggcaggagggagggguccucccaguacccuggacagagcccucccuggcuccgcuccucaagcaccuccuacuggcucugguuguucgggucucgccuucggagcccaagacugucccaaaauugcaacaggguccguggagguagccguugcccugucagccgacccagggaggggagcccgcagcagaugggcgggggacgccugccaguuugcagcagcaacggccacgcguuguggaggcgugucugggcccgcuggggcccagaggagcagccggggcacacgcccaggaccgccuccacucgucugucaugugaccuucgucugucccacagguggaaucuggaguccagagcaaguugaaaaugagaugaacuccgaggaccccggggguugccucuucuugggaagcggagcuacgguuucuuuuucacacccuaaggccggggaaccaggucauuuuuaagucaauggggugcucuagauuuuauggagcacuuaaugugagggguccagcgaccccaguauugguuauggccgcuaggucggagaaagauuggaccuugcagagacaggauuuccgugcccagcuuaaaagcaguugguagaacgaaucuccuuucaaacccuuguuguaucucucugagguccccggcuggaagcucugcagccgcuggggaccuuucgguggccuagggaagagcucgcagauccgugggcgugaaugaagccauagggugcaggagaggaggcgaggccuggccccaaccacucuuccuguccaggaggucaguggcccgcacaucgcgcgaccccaccacagaugggacucuaaggccagaguggcaucccugggggacacugccgacucguucucuccagccccacccugugcagugacaaaggcgggaggagggagaggcgcuggcccgacucaaugggggcggggcggagcagggacgcagcccccuuaaagccuaguggcugauagugagcgcacuucuuuggcgggagcuugggucagacuuugaacuugguuaccggcuucgguuuucucucugccuugcagcaggggcaaggauccuccaccccgagguaacagacccugugcacccuucgcuuuccugcagagcaugaggcugcccagaagaguugaggacgcggcggagcugcgcaagguaggagcgggagauacgaacucguggcagguggggugggcgauggcggucuuucuaacuguggucucagcgccuucucgcucucccgcagaaccuaaagccgcugcuggagaagcgccggcgcgcgcggaucaacgagagccuaagccagcugaagggucucguauugccgcugcugggcgcggaggugagugucugggagcucugaaaacugaaguggagggucuuggggugcccagcgaggcggaugggccugcauggucccggggcuccguggggauccaaagaccugcgugugguccgcgugauggagugguagagaccaccgcgcgacuggagagcauuugggagcaagaacgagguacucagcugcccgguuuauuguggggugucucucuugucugaccuggcgcagacuucccgcucuucgaaguuggagaaggcagacauccuggaaaugacugugcgcuuccuacaggagcagccugcgacccuguacuccucugcagcaccuggugagugaccaugcuacaugcucaucccuugcccuccaguuugcaccguacucaggaccugagccucacaucugcucccugugcgcagggccuuugaauagcuaccucgaggguuaccgagccugucuggcgcgacuggcccgcguacugcccgccugcagcguccuggagcccgcagugagcgcgcgccuacuagagcaccugcgacagaggacugucagugaugacucgcccucacugacgcuaccacccgcuccagcuccagcuccuucuccgccggugccuccuccaggcaguucuggccuuuggaggccaugguagguuccuggauauuucacaggcaccugcugccggcugucagggaccuggaugggcuaccggaccaaggaaguucuccauggcaacugcaucuucucacucacuuugagaacagucuagcuccaacugcccugucaagaaucagauacugugaccuggcugggugaugaaaccuucaaggaagggcucggccagagggugaaauggggccaaaggaaaaagagcaaauaugugcagggugaggagaagcccagacuggaagaaguggugccucggcagggacacaccugcccuacagugggcagcagaccaaagucug

SEQ ID NO: 10078 - RNA, 2501 nt, Mus musculus
cagacuuuggucugcugcccacuguagggcaggugugucccugccgaggcaccacuucuuccagucugggcuucuccucacccugcacauauuugcucuuuuuccuuuggccccauuucacccucuggccgagcccuuccuugaagguuucaucacccagccaggucacaguaucugauucuugacagggcaguuggagcuagacuguucucaaagugagugagaagaugcaguugccauggagaacuuccuugguccgguagcccauccaggucccugacagccggcagcaggugccugugaaauauccaggaaccuaccauggccuccaaaggccagaacugccuggaggaggcaccggcggagaaggagcuggagcuggagcgggugguagcgucagugagggcgagucaucacugacaguccucugucgcaggugcucuaguaggcgcgcgcucacugcgggcuccaggacgcugcaggcgggcaguacgcgggccagucgcgccagacaggcucgguaacccucgagguagcuauucaaaggcccugcgcacagggagcagaugugaggcucagguccugaguacggugcaaacuggagggcaagggaugagcauguagcauggucacucaccaggugcugcagaggaguacagggucgcaggcugcuccuguaggaagcgcacagucauuuccaggaugucugccuucuccaacuucgaagagcgggaagucugcgccaggucagacaagagagacaccccacaauaaaccgggcagcugaguaccucguucuugcucccaaaugcucuccagucgcgcgguggucucuaccacuccaucacgcggaccacacgcaggucuuuggauccccacggagccccgggaccaugcaggcccauccgccucgcugggcaccccaagacccuccacuucaguuuucagagcucccagacacucaccuccgcgcccagcagcggcaauacgagacccuucagcuggcuuaggcucucguugauccgcgcgcgccggcgcuucuccagcagcggcuuuagguucugcgggagagcgagaaggcgcugagaccacaguuagaaagaccgccaucgcccaccccaccugccacgaguucguaucucccgcuccuaccuugcgcagcuccgccgcguccucaacucuucugggcagccucaugcucugcaggaaagcgaagggugcacagggucuguuaccucgggguggaggauccuugccccugcugcaaggcagagagaaaaccgaagccgguaaccaaguucaaagucugacccaagcucccgccaaagaagugcgcucacuaucagccacuaggcuuuaagggggcugcgucccugcuccgccccgcccccauugagucgggccagcgccucucccuccucccgccuuugucacugcacaggguggggcuggagagaacgagucggcagugucccccagggaugccacucuggccuuagagucccaucugugguggggucgcgcgaugugcgggccacugaccuccuggacaggaagagugguuggggccaggccucgccuccucuccugcacccuauggcuucauucacgcccacggaucugcgagcucuucccuaggccaccgaaagguccccagcggcugcagagcuuccagccggggaccucagagagauacaacaaggguuugaaaggagauucguucuaccaacugcuuuuaagcugggcacggaaauccugucucugcaagguccaaucuuucuccgaccuagcggccauaaccaauacuggggucgcuggaccccucacauuaagugcuccauaaaaucuagagcaccccauugacuuaaaaaugaccugguuccccggccuuagggugugaaaaagaaaccguagcuccgcuucccaagaagaggcaacccccgggguccucggaguucaucucauuuucaacuugcucuggacuccagauuccaccugugggacagacgaaggucacaugacagacgaguggaggcgguccugggcgugugccccggcugcuccucugggccccagcgggcccagacacgccuccacaacgcguggccguugcugcugcaaacuggcaggcgucccccgcccaucugcugcgggcuccccucccugggucggcugacagggcaacggcuaccuccacggacccuguugcaauuuugggacagucuugggcuccgaaggcgagacccgaacaaccagagccaguaggaggugcuugaggagcggagccagggagggcucuguccaggguacugggaggaccccucccuccugccaucgagccccauucccuucacuaaccccaaauuccuggaagggcucccacggcagacauucggaaacaguggaaccaguguaccagggaaggggcccagggcagccuggacaggagcgcucagcccuauuucucucuguggcaugcaagaaccccccaguacaaccuc

SEQ ID NO: 10079 - RNA, 2501 nt, Mus musculus
gacacugaagacuccgaugcgcaccaugagcuucuccagcuucucugucuuggugccgucaugcuucaugauggugcggaugcggaagagugacacgaaaccggccagcaggaaagaagugccaaugaacagauaaacgaagagaggcgccagcacaaagccacgcagugcguccacguuguugagccccacaaaacacacuccgcucaguacgucgccauccaccuggcccaacgccaagaugguuauaguuuugauggcuggcacagcccaggcggcuaaauggaaauacugugaguuggccucgauggcuucguggccccacuucaugccggcugccaggaaccaggugagggacaggaucacccaccagauggagcuggccaugcugaagaaguagagcaucauaaagaguauagugcagccuucuuucuuagugcccugcgccaccgugcgcgccccguccucugcaaacuugucguugcacaccacccgguccuccaacagaaagccagcgauguaggccaccgccaccgcuguguaacagccggacaggaaaaugaugggccguuccggguagcugaagcgccgcauguccacuagguacgugagcaccgugaagagcguggaggcgcagcacagcacggaccagaugccuauccaggugcgcgagaagcgcagcuccucuggcccgaaguacaugagcccguaaaccuugguggguucgcagggugcgccgcaguccuucucccccagaaagugguaguugagguaggagggcacccugagggcgcgcgggcaggagaacuuuccccgcuccaccgucccggcaccccccggguagccgccgcgguaaccaccgccgccgugcugcggauuacugguccagaacucugguagcaaggagggaguuggggugccuuugucggacguguucuggcccacgcacagcucuccugcgccgugcaccgggaacuucucgcacuugagugugucuggccacuggaagccgaacuuguucaugagcgccucgcagcccuggcgugcgcgcucgcacagggagcggcagggcgguagcgccugcuccaguacggugcacacaggcgcguacauggagcacaggaagaacuugagcucggcggagcacugcaccuucaccagaggguagaacuggugcaccuccagaccggcguccuccugauucguguggcccagcagguugggcaugauggucugguuguacgcgauguccgugcacagcgggauggagaugggcuggcaguagccgugguccgggauggagaugccccguucgccguuguacugcugcccgcucugcuggggcuggggcggcggcggggcuugcuggcccggcccggauaccuggcccgccgccugcgcucggacccccaaaagcagaggagccuccagcaaccaaagcagcagcagcagcccgcuagcccaacgccggggaucagcccgggggcggcgguggcuggccguguccucgugccccaccuccucccgccggcccgggagugcuucggcacaaaguuccaagcucagccggccggcggcccgggacucgcuaggcgccgccuccucagccauacuuuuucggcucccuccucggcgcggauugacugggacgggcagcggcgcggcgggugguggcucccacugugauccgggagagcuggucgcccgugcccuccgucggggugcggccgcucucugcccgcuccccgggauucugcuccgcgucccgcagccgccgccgccgccgcggaaacuugcgguucaugaagcgcgggcggcgaggagagcaagagugguccaggcgcgccggggucgcgucccucuucccuggcccgcggcaggcuguggcucuugucaggcggcgccgcguuaguggucgcagccgggcagaggagcgcccaacucucggcagccuagccgcccuggguccccccugcgccuccgccuccuccuucuccgccgccgccugaccauuugugucaaucccucaacucgcagccucugcucucccucgcgcgcccuccaacggguuucuaggcgccccccagucugucuuucaccgggagggaggagccuugaaaccgacgcggagcuggcggcucagggaccgucgcccaaucgcagcacccgcuucacagcgcaaagggagcccuuucccuccgagcccggacuggagcccgcagcagaccggaggagguggaggaaguagugguggcgguggcagagacuccgcuccggcacaaagaguagcuaugaagccggacaggcuaggucgcuuuugcuuuugcagaagaaagggcgaggacaaguaagagaauggucccauaugcggcaggagauaaugaauaggagucggcuggccgcggggauuuagcucugucuugcuuuuuaucugucuucauauuuuauaauccuacccucgacucucuggucacagacugcuacuuugagugcugcguucu

SEQ ID NO: 10080 - RNA, 2501 nt, Mus musculus
agaacgcagcacucaaaguagcagucugugaccagagagucgaggguaggauuauaaaauaugaagacagauaaaaagcaagacagagcuaaauccccgcggccagccgacuccuauucauuaucuccugccgcauaugggaccauucucuuacuuguccucgcccuuucuucugcaaaagcaaaagcgaccuagccuguccggcuucauagcuacucuuugugccggagcggagucucugccaccgccaccacuacuuccuccaccuccuccggucugcugcgggcuccaguccgggcucggagggaaagggcucccuuugcgcugugaagcgggugcugcgauugggcgacggucccugagccgccagcuccgcgucgguuucaaggcuccucccucccggugaaagacagacuggggggcgccuagaaacccguuggagggcgcgcgagggagagcagaggcugcgaguugagggauugacacaaauggucaggcggcggcggagaaggaggaggcggaggcgcaggggggacccagggcggcuaggcugccgagaguugggcgcuccucugcccggcugcgaccacuaacgcggcgccgccugacaagagccacagccugccgcgggccagggaagagggacgcgaccccggcgcgccuggaccacucuugcucuccucgccgcccgcgcuucaugaaccgcaaguuuccgcggcggcggcggcggcugcgggacgcggagcagaaucccggggagcgggcagagagcggccgcaccccgacggagggcacgggcgaccagcucucccggaucacagugggagccaccacccgccgcgccgcugcccgucccagucaauccgcgccgaggagggagccgaaaaaguauggcugaggaggcggcgccuagcgagucccgggccgccggccggcugagcuuggaacuuugugccgaagcacucccgggccggcgggaggagguggggcacgaggacacggccagccaccgccgcccccgggcugauccccggcguugggcuagcgggcugcugcugcugcuuugguugcuggaggcuccucugcuuuuggggguccgagcgcaggcggcgggccagguauccgggccgggccagcaagccccgccgccgccccagccccagcagagcgggcagcaguacaacggcgaacggggcaucuccaucccggaccacggcuacugccagcccaucuccaucccgcugugcacggacaucgcguacaaccagaccaucaugcccaaccugcugggccacacgaaucaggaggacgccggucuggaggugcaccaguucuacccucuggugaaggugcagugcuccgccgagcucaaguucuuccugugcuccauguacgcgccugugugcaccguacuggagcaggcgcuaccgcccugccgcucccugugcgagcgcgcacgccagggcugcgaggcgcucaugaacaaguucggcuuccaguggccagacacacucaagugcgagaaguucccggugcacggcgcaggagagcugugcgugggccagaacacguccgacaaaggcaccccaacucccuccuugcuaccagaguucuggaccaguaauccgcagcacggcggcggugguuaccgcggcggcuacccggggggugccgggacgguggagcggggaaaguucuccugcccgcgcgcccucagggugcccuccuaccucaacuaccacuuucugggggagaaggacugcggcgcacccugcgaacccaccaagguuuacgggcucauguacuucgggccagaggagcugcgcuucucgcgcaccuggauaggcaucugguccgugcugugcugcgccuccacgcucuucacggugcucacguaccuaguggacaugcggcgcuucagcuacccggaacggcccaucauuuuccuguccggcuguuacacagcgguggcgguggccuacaucgcuggcuuucuguuggaggaccggguggugugcaacgacaaguuugcagaggacggggcgcgcacgguggcgcagggcacuaagaaagaaggcugcacuauacucuuuaugaugcucuacuucuucagcauggccagcuccaucuggugggugauccugucccucaccugguuccuggcagccggcaugaaguggggccacgaagccaucgaggccaacucacaguauuuccauuuagccgccugggcugugccagccaucaaaacuauaaccaucuuggcguugggccagguggauggcgacguacugagcggaguguguuuuguggggcucaacaacguggacgcacugcguggcuuugugcuggcgccucucuucguuuaucuguucauuggcacuucuuuccugcuggccgguuucgugucacucuuccgcauccgcaccaucaugaagcaugacggcaccaagacagagaagcuggagaagcucauggugcgcaucggagucuucaguguc

SEQ ID NO: 10081 - RNA, 2501 nt, Mus musculus
gaugcuaggggcauaagaagagaucugccugugccaaaccucccaccacucucuaacuuggucagaagccaaguccacucugcaaaagaacaaaugaugucagguggguucauggaagggcaggagaggcaaaaaggagaggggguagacuaagaaucagccaaugacccucaggucugcauucaggggcugugacugggagccuaaaaggccucaaaggcaucccaaaccccaaugucuaucuggguuuccuucaagcccuaccauggaccgcugugguuuccuccuggcgccucuggucucugacagcagagacucccccacaugcugcauuaauggcucagccugugcccccagggaccuccccugcccccccagacugcuccgcuugccccccaaccccccucgugcugaaaccuaauccucugcagcagcuuuagcucaguccuguucugcagccccugccugccacuaccuccugcgcccuacuuggucuuuacugcagagacccagccccacggagucaacgccuguucuggggaaggcagagcugaccgaaguucaacucauccaguccuaucaggccaguacuuucaccugucuuggcuccucccgucucuaccuucuccuucucucuccguauuccuugcugagcuacuugagucccauuucaauccccaccacuauccugcuagcccuacaaaacagcuuccgugcuccuuagaaaucccauccccagucaggaaaccucccugcuccagccaugaaaccucccucaggacuggaggaggcccagcggcgacaggccucagacauccggguguucgccaacagcugcacgaugcaugguuugggccacaucuuuggcccuggaggccugacccugcgccgugggcugugggccacagcuguacuccugucgcuggcggccuuccucuaccagguggcugagcggguucgcuacuauggggaguuccaccauaagaccacccuggaugagcgugagagccaccagcuuaccuucccagcugucacuuuguguaacaucaauccccugcgccgcucacgccucacacccaaugacuugcacugggccggaacggcacugcugggucuggacccugcugaacaugcugccuaccuucgugcccugggccagcccccugcaccaccuggcuucaugcccaguccgacuuuugacauggcacaacucuacgccagagccggccacucccuugaggacauguugcuggacugccgauaccguggccagcccuguggaccugagaacuucacaguggugagccaguugcccgaagacccuauuuagugacuacaauuuucagccuugucaguaaggaaaccuuaccaccccugccuggcuaucccuuccuuccugcuggccacaggccuuccaucggagacauucguucugucuauccgggaagcugccuugggaggcuaucucuguccaucucaguuagacaucugugcaccuggcuaugccucucagugaggacagcaauccaagcaagcugcaggaccaagggcuaaucaguagagacacuugcuccuagaguagacugcaguacccugagacuauucuggggcaggagagaacugauguuccucugccuccucugaauuauuccaccccaaaagagggcaagaauacauccaguuaccccuguagggauacugcugucagggcuuuggcgagaggcagagaaguuacacugaggcaggaggcuucuccauuccacauaccuacaugugagacuaaggacauugagguauggccuaucaaguuccuucaaggagggugggagaagugguuucuucguaugagauccagucucaaaaaaguccaaagcauaaaacaagcaugggggugcacaucuuuuaucccagaaccuggaaaacagaggcaggaggaucccuggggauuugaggccagccucaucuacaauauauaaauucuaggacuacauagagagauucugucucaaaaaaaaaaaaaaaccuuaagaaaaugaggacaugguggaaaaucagcuagaucuccuagacuucaucacuuaggcucccccuagguacguaagacagcacaugcagggggagagcaucuacccaagaccuacugagcuugcacaucugccuccagaacuggaaggauuugucacugccaugguggcuuuuccuguggucccaggacuugguauuuggaaccaggaggaucaggaauuugaggccagcucaguuacaucgaaagcaccagacaaggccaggcuacauaagaucuuacucccugucccucccuccaaaacccuaaaggacaaaacaaagagaacgggcucaaggggugguauggucccauucccaagggcuuguuugagagagggacuguuccuuucuguuccccccaaccuccccccccccagauuuucacucgaauggggcaaugcuacaccuucaacucuggugcccagggggcagagcug

SEQ ID NO: 10082 - RNA, 2501 nt, Mus musculus
cagcucugcccccugggcaccagaguugaagguguagcauugccccauucgagugaaaaucuggggggggggagguuggggggaacagaaaggaacagucccucucucaaacaagcccuugggaaugggaccauaccaccccuugagcccguucucuuuguuuuguccuuuaggguuuuggagggagggacagggaguaagaucuuauguagccuggccuugucuggugcuuucgauguaacugagcuggccucaaauuccugauccuccugguuccaaauaccaaguccugggaccacaggaaaagccaccauggcagugacaaauccuuccaguucuggaggcagaugugcaagcucaguaggucuuggguagaugcucucccccugcaugugcugucuuacguaccuagggggagccuaagugaugaagucuaggagaucuagcugauuuuccaccauguccucauuuucuuaagguuuuuuuuuuuuuuugagacagaaucucucuauguaguccuagaauuuauauauuguagaugaggcuggccucaaauccccagggauccuccugccucuguuuuccagguucugggauaaaagaugugcacccccaugcuuguuuuaugcuuuggacuuuuuugagacuggaucucauacgaagaaaccacuucucccacccuccuugaaggaacuugauaggccauaccucaauguccuuagucucacauguagguauguggaauggagaagccuccugccucaguguaacuucucugccucucgccaaagcccugacagcaguaucccuacagggguaacuggauguauucuugcccucuuuugggguggaauaauucagaggaggcagaggaacaucaguucucuccugccccagaauagucucaggguacugcagucuacucuaggagcaagugucucuacugauuagcccuugguccugcagcuugcuuggauugcuguccucacugagaggcauagccaggugcacagaugucuaacugagauggacagagauagccucccaaggcagcuucccggauagacagaacgaaugucuccgauggaaggccuguggccagcaggaaggaagggauagccaggcaggggugguaagguuuccuuacugacaaggcugaaaauuguagucacuaaauagggucuucgggcaacuggcucaccacugugaaguucucagguccacagggcuggccacgguaucggcaguccagcaacauguccucaagggaguggccggcucuggcguagaguugugccaugucaaaagucggacugggcaugaagccagguggugcagggggcuggcccagggcacgaagguaggcagcauguucagcaggguccagacccagcagugccguuccggcccagugcaagucauugggugugaggcgugagcggcgcaggggauugauguuacacaaagugacagcugggaagguaagcugguggcucucacgcucauccaggguggucuuaugguggaacuccccauaguagcgaacccgcucagccaccugguagaggaaggccgccagcgacaggaguacagcuguggcccacagcccacggcgcagggucaggccuccagggccaaagauguggcccaaaccaugcaucgugcagcuguuggcgaacacccggaugucugaggccugucgccgcugggccuccuccaguccugagggagguuucauggcuggagcagggagguuuccugacuggggaugggauuucuaaggagcacggaagcuguuuuguagggcuagcaggauagugguggggauugaaaugggacucaaguagcucagcaaggaauacggagagagaaggagaagguagagacgggaggagccaagacaggugaaaguacuggccugauaggacuggaugaguugaacuucggucagcucugccuuccccagaacaggcguugacuccguggggcugggucucugcaguaaagaccaaguagggcgcaggagguaguggcaggcaggggcugcagaacaggacugagcuaaagcugcugcagaggauuagguuucagcacgagggggguuggggggcaagcggagcagucugggggggcaggggaggucccugggggcacaggcugagccauuaaugcagcaugugggggagucucugcugucagagaccagaggcgccaggaggaaaccacagcgguccaugguagggcuugaaggaaacccagauagacauugggguuugggaugccuuugaggccuuuuaggcucccagucacagccccugaaugcagaccugagggucauuggcugauucuuagucuacccccucuccuuuuugccucuccugcccuuccaugaacccaccugacaucauuuguucuuuugcagaguggacuuggcuucugaccaaguuagagaguggugggagguuuggcacaggcagaucucuucuuaugccccuagcauc

SEQ ID NO: 10083 - RNA, 2501 nt, Mus musculus
cgacgcggagccacgucccucucagcaccgcucagccuagaaucccacgggcgcugucccaccggcgcgaucggggccgcuggaccggcgcucaccgccuuguccuaagucaaguguccgagucgccgggaaacucaggcggcgaguuggccacaggaaguuuauucucgggcuccuuuucuaaaaggaggaaacagaaguuucucccaaccggcagcuuuucuuuuucgccuuuuuggcgcccugagagaucggggagggagucccccagagcugccaagcgacacccgcggggcuccuagucuuuuugcguugcccauuuuucuccagcccgugggucccggcagagcuccggcugcgcgcgggggcggaagggcgcgcgcaggggagggaccgagggacgcgccgacuuuuuagagggagggacucgguggacaaccgguuccgcggagcuugcagagcagaaacgaagugcggugcgcggcgaucgggggggucacuucccgagugucgcugccuccugucugccuugguuaggggacaucccgggagcgaaaagcccagcccguggccgggccgguggaccagcgagcgcgcagcagacugugcgcggccgcggcgagggcggggaagaaaaccacccuguuuccucuccggcccccaccgcggaucauguaccaggauuaucccgggaacuuugacaccucgucccggggcagcagcggcucuccugcgcacgccgaguccuacuccagcgguggcggcggccagcagguacgugcgggccggggugcaccuggcggcgcgggcagacuccuacccucuucuugcucccacugccuccacccccaaccuccuucuuuucccuuuccuagccaggcuagaaaaauacuucaccgcuguaaguuguggguuucuuuucuuuucuuuuucuuuuuuuuuuuccuguuccgcccuacccacucuccacuuuucuuuuucuuuuucuuuucuuuucuuuucuuuuuuuuuaagcaaguggagagugggcuugaagagccaacgacacccucucccccuuuucguacuuaauuuuccagaaaagcucuugaaauuacagguccccuccgggaagccuguugccuccuuccgagccgcucucccucccuuuucacguuccucuuucuagguaguggauaggcaagaaaauuuuugcgcccccuaagccccucccagccgucaaggacccuacgggggggggcgggggggaaggcuuuuuaacccuuucuucuucuguuauucuucggucuuagcuguuuucugaaagggauuggggacucaaaaacaaagcugggcuccuucaaguguuugggagugagggcgaggguugccccugggaauuaggugcgaaggucaggaaggaagaagcuggcuuugauuggcucuugacaccuccugugacacccccccuccagcuuccgguaaggguugggcaggagccuguacuuccccccccccccagcagaacuuugaggggcuuggggguaccuggggcaaagaagcugucagagagaagugggagaaagagacacaucgcuugagcuccugaguggauuuagaaguagaaaaacaucucuuucuaaagcagccagacugguuugcacugaaggauugugccuguaaucugugucuuuguagguaccagacagguauugguggggcgguaggggugguaggguaccuggccugugucgcaggaaccacaaacaccaucuugugagggaauugcaugaacucaaaagguccucugccaccugaagcccaccuuggcaagcaucugggaguuccuagccaagcuggcugcagccagaguuacuccauaagccaauagccauggccuugacuuugaccuuuagaagucaaccagauaggaggucaggggucuuccagggaaggguggagugagcugggaaauauaauaaaaauauggcuuucuuuguaaucugacaagaggggcaccucucucaaaguaauguuccauaucuggggaguccuucuaaaugacuuuucugugucuagcuccucccaagccccauaccuacuaagcacccacuguagacagccuggucugagcauugaggguccagucaguggacccuuucuuacuacugaacacccaaaucauaccugagaaguagucgcuuauguuugcaucccaguacauuugguguuuuggguugaacccaaacaucacucaucaauggguuuagaguccuuuauaccuguuguccccuacuuuccaauccaauaaccccaccccauguaccucuccuuuccaaccaacauagaagcuuugcguuucuguuucuuccacuaaugagaccaagacagugagcacugacaguacaaucucccugccuggcuuugcucagacucuggggccuggaugggaagucagaccggacaucagugccccaacugaauaaucugugucacuagggcuuugagcccaggaugugagc

SEQ ID NO: 10084 - RNA, 2501 nt, Mus musculus
gcucacauccugggcucaaagcccuagugacacagauuauucaguuggggcacugauguccggucugacuucccauccaggccccagagucugagcaaagccaggcagggagauuguacugucagugcucacugucuuggucucauuaguggaagaaacagaaacgcaaagcuucuauguugguuggaaaggagagguacauggggugggguuauuggauuggaaaguaggggacaacagguauaaaggacucuaaacccauugaugagugauguuuggguucaacccaaaacaccaaauguacugggaugcaaacauaagcgacuacuucucagguaugauuuggguguucaguaguaagaaaggguccacugacuggacccucaaugcucagaccaggcugucuacagugggugcuuaguagguauggggcuugggaggagcuagacacagaaaagucauuuagaaggacuccccagauauggaacauuacuuugagagaggugccccucuugucagauuacaaagaaagccauauuuuuauuauauuucccagcucacuccacccuucccuggaagaccccugaccuccuaucugguugacuucuaaaggucaaagucaaggccauggcuauuggcuuauggaguaacucuggcugcagccagcuuggcuaggaacucccagaugcuugccaaggugggcuucagguggcagaggaccuuuugaguucaugcaauucccucacaagaugguguuugugguuccugcgacacaggccagguacccuaccaccccuaccgccccaccaauaccugucugguaccuacaaagacacagauuacaggcacaauccuucagugcaaaccagucuggcugcuuuagaaagagauguuuuucuacuucuaaauccacucaggagcucaagcgaugugucucuuucucccacuucucucugacagcuucuuugccccagguacccccaagccccucaaaguucugcuggggggggggggaaguacaggcuccugcccaacccuuaccggaagcuggagggggggugucacaggaggugucaagagccaaucaaagccagcuucuuccuuccugaccuucgcaccuaauucccaggggcaacccucgcccucacucccaaacacuugaaggagcccagcuuuguuuuugaguccccaaucccuuucagaaaacagcuaagaccgaagaauaacagaagaagaaaggguuaaaaagccuucccccccgcccccccccguaggguccuugacggcugggaggggcuuagggggcgcaaaaauuuucuugccuauccacuaccuagaaagaggaacgugaaaagggagggagagcggcucggaaggaggcaacaggcuucccggaggggaccuguaauuucaagagcuuuucuggaaaauuaaguacgaaaagggggagagggugucguuggcucuucaagcccacucuccacuugcuuaaaaaaaaagaaaagaaaagaaaagaaaaagaaaaagaaaaguggagaguggguagggcggaacaggaaaaaaaaaaagaaaaagaaaagaaaagaaacccacaacuuacagcggugaaguauuuuucuagccuggcuaggaaagggaaaagaaggagguuggggguggaggcagugggagcaagaagaggguaggagucugcccgcgccgccaggugcaccccggcccgcacguaccugcuggccgccgccaccgcuggaguaggacucggcgugcgcaggagagccgcugcugccccgggacgaggugucaaaguucccgggauaauccugguacaugauccgcggugggggccggagaggaaacagggugguuuucuuccccgcccucgccgcggccgcgcacagucugcugcgcgcucgcugguccaccggcccggccacgggcugggcuuuucgcucccgggauguccccuaaccaaggcagacaggaggcagcgacacucgggaagugacccccccgaucgccgcgcaccgcacuucguuucugcucugcaagcuccgcggaaccgguuguccaccgagucccucccucuaaaaagucggcgcgucccucggucccuccccugcgcgcgcccuuccgcccccgcgcgcagccggagcucugccgggacccacgggcuggagaaaaaugggcaacgcaaaaagacuaggagccccgcgggugucgcuuggcagcucugggggacucccuccccgaucucucagggcgccaaaaaggcgaaaaagaaaagcugccgguugggagaaacuucuguuuccuccuuuuagaaaaggagcccgagaauaaacuuccuguggccaacucgccgccugaguuucccggcgacucggacacuugacuuaggacaaggcggugagcgccgguccagcggccccgaucgcgccggugggacagcgcccgugggauucuaggcugagcggugcugagagggacguggcuccgcgucg

SEQ ID NO: 10085 - RNA, 2501 nt, Mus musculus
guuuauguguauggguauucugccuuccugggucuacaugugcaccaugcacccguugccauggauucccugaaaccggagguacacacaguugugagcugacauguggaugcugggaguugaacccaggaccucuagucuagugcucccaacagcugagccuuuucuccagcuccaaguguugucaauccguccuuugaucuguuuacuucacugaacuagaacacagagaaacaaacacuucaccauaaaaaccauaaggaagugcauaaaaaacuuuauggaacacuuaaaaagaaaaaaaaguaaaauaccuugcuaaauagcaaaaauacuguuucaaacgggaccaggucucuggacccacucacuaauccugugacagugacaguugcuucacucugugaagugggcuuuugcaugggguugacggguuaacaugcuaacagguaaagaacucagcacagugugugcuguucauaaaguucugaugcuccagacgagccaccgugaaccucuuaggcuccaugcagacagacgccagcuccguagugcuucaaagagguaaauucacaaaugaauaagaaaaauaaguaguccgccaagccggacuguaugaauuugccaauauucaauuggucaaucaaaaaaguucucacauggcucaaagcaaauucauuguucaaguuguuugggucucuagugaguuaggguggagggguccacaaaggacuuuaaccguucgcuugcuuaacaaaggccagcaaccgcccacaagaagccgagcaaaccauucuccgccugggcaugagaaaaguccacaacugaacaagagagcaacagagcgagcucccggaggaagcaguagcugcaggaagcgccgguaccuuugcuccgcugccuuucccuacaagcugccgccagacccggcgcccuccugcccaccuuccccccuucucaggggccuuucccgggcugcggaacacaaaagaaccgacugcgaggcggcgcgcgaagcugggagccuccaggaauccgccgucgccugggggaggggaucgccccugaguccuguaguccggagcgccaccaaggcauuuccccacccaguccuguuugaacgccggguugaggauuggaaccucuccgacccauucucgggaacuuagcucgagccccgauccuccagcagccacgaagcucugcucaguccacauuccucuuuguugucccugguccccgcauucugucaagguaugcccugagcgcuccugcucuccaucucuaggaaagcugaaauucucggugcugugugacccuaagggcugacuggagccaggacuuccagcccgggugcgugcgcuuggcaacggccgcagggaggcgguuugcccuugcaccggcaucgcccucccgcugcggccaguagcacugugagcugcacauagguagcagaugguggcugguggccgggagucccacguccugucccccucccccagccuaccccccaccuuggccuuuccuggaguuuuccuuaccgcaaaagaguucucaagacccagaccgaaccuccucucgccgcccuucccgaaagcgggccgguggccugaaagucucaccgccuccugcucuugucuccggaacccagcgaccuccaccccuccacaggauggaaggaguaccggagcggagcaaugugccgcggagaggagccggccaccgccgcgggaaaaaguuugcacgcucuauaaccaguccuccagacccugggcucgcccacuggccgagacccacaccacccugcagccccuccagcuucgggaagacaaacuagguucccgccaccugcuguggaggcagaggaagacguugcucgagcuucuccacuccucaucccugcccuggguguucuagaagagggggagcucagcgccccgcgcugggucggcacucggagcaacucaccucuccgguccagcucuccuccgggucucggaacccuccagccccucgccucuaagcugggcuccuuccacuuaauucaugaauuauuuaagguccagccccagggcaccacaagagugauugggugagagcccgucccacugcuccgccccggguuggcuaagggugccugagucaggaccacgggacuccaggacucugggaaccuguugcguccucuagggucucuggcagagguuuggggauggaacuaaaggaacaccgacuccuucagaaacguacuuacucagggcugagcuuaaggccaggugccggggucuccacaaggcucgguaauuuaaagagcaggagccuagggcucugagucugagcgcacugauuggaccuucugagaggcuacaaugcccuggggacacccacgggacagagcauuuauuuccugcugaaaucccugcucagucccagaacacccuucucuaucaccuaauccuaaaucgcugcuuggaaggccgcuagcuccuaaaaucucuaac

SEQ ID NO: 10086 - RNA, 2501 nt, Mus musculus
guuagagauuuuaggagcuagcggccuuccaagcagcgauuuaggauuaggugauagagaaggguguucugggacugagcagggauuucagcaggaaauaaaugcucugucccguggguguccccagggcauuguagccucucagaagguccaaucagugcgcucagacucagagcccuaggcuccugcucuuuaaauuaccgagccuuguggagaccccggcaccuggccuuaagcucagcccugaguaaguacguuucugaaggagucgguguuccuuuaguuccauccccaaaccucugccagagacccuagaggacgcaacagguucccagaguccuggagucccgugguccugacucaggcacccuuagccaacccggggcggagcagugggacgggcucucacccaaucacucuuguggugcccuggggcuggaccuuaaauaauucaugaauuaaguggaaggagcccagcuuagaggcgaggggcuggaggguuccgagacccggaggagagcuggaccggagaggugaguugcuccgagugccgacccagcgcggggcgcugagcucccccucuucuagaacacccagggcagggaugaggaguggagaagcucgagcaacgucuuccucugccuccacagcagguggcgggaaccuaguuugucuucccgaagcuggaggggcugcaggguggugugggucucggccagugggcgagcccagggucuggaggacugguuauagagcgugcaaacuuuuucccgcggcgguggccggcuccucuccgcggcacauugcuccgcuccgguacuccuuccauccuguggagggguggaggucgcuggguuccggagacaagagcaggaggcggugagacuuucaggccaccggcccgcuuucgggaagggcggcgagaggagguucggucugggucuugagaacucuuuugcgguaaggaaaacuccaggaaaggccaaggugggggguaggcugggggagggggacaggacgugggacucccggccaccagccaccaucugcuaccuaugugcagcucacagugcuacuggccgcagcgggagggcgaugccggugcaagggcaaaccgccucccugcggccguugccaagcgcacgcacccgggcuggaaguccuggcuccagucagcccuuagggucacacagcaccgagaauuucagcuuuccuagagauggagagcaggagcgcucagggcauaccuugacagaaugcggggaccagggacaacaaagaggaauguggacugagcagagcuucguggcugcuggaggaucggggcucgagcuaaguucccgagaaugggucggagagguuccaauccucaacccggcguucaaacaggacuggguggggaaaugccuugguggcgcuccggacuacaggacucaggggcgauccccucccccaggcgacggcggauuccuggaggcucccagcuucgcgcgccgccucgcagucgguucuuuuguguuccgcagcccgggaaaggccccugagaaggggggaaggugggcaggagggcgccgggucuggcggcagcuuguagggaaaggcagcggagcaaagguaccggcgcuuccugcagcuacugcuuccuccgggagcucgcucuguugcucucuuguucaguuguggacuuuucucaugcccaggcggagaaugguuugcucggcuucuugugggcgguugcuggccuuuguuaagcaagcgaacgguuaaaguccuuuguggaccccuccacccuaacucacuagagacccaaacaacuugaacaaugaauuugcuuugagccaugugagaacuuuuuugauugaccaauugaauauuggcaaauucauacaguccggcuuggcggacuacuuauuuuucuuauucauuugugaauuuaccucuuugaagcacuacggagcuggcgucugucugcauggagccuaagagguucacgguggcucgucuggagcaucagaacuuuaugaacagcacacacugugcugaguucuuuaccuguuagcauguuaacccgucaaccccaugcaaaagcccacuucacagagugaagcaacugucacugucacaggauuagugaguggguccagagaccuggucccguuugaaacaguauuuuugcuauuuagcaagguauuuuacuuuuuuuucuuuuuaaguguuccauaaaguuuuuuaugcacuuccuuaugguuuuuauggugaaguguuuguuucucuguguucuaguucagugaaguaaacagaucaaaggacggauugacaacacuuggagcuggagaaaaggcucagcuguugggagcacuagacuagagguccuggguucaacucccagcauccacaugucagcucacaacuguguguaccuccgguuucagggaauccauggcaacgggugcauggugcacauguagacccaggaaggcagaauacccauacacauaaac

SEQ ID NO: 10087 - RNA, 2501 nt, Mus musculus
aaaugccugauuguugaaaacagguaagcacggguauuguaagacaaggaggacaacggcgugcacgagagagcagaagcaccaagccuguucgaaaaaaaucccagaauaaacuuuagcauggacucagcacagaacuccagcagacagcgccuugugccacaaaagccagugaugagaaagacccacugacguuggccagcacuucgucugcuccaggacaaccagaagggggccucgggacagccucuccaucacuaaauuccccgagugacuucggcagcauccacgcuguaaccucaucuccuccuggcagguguuucuggacuaagcaccugugcagcucccggguccacccugcagacaccggugacugaaggaacuucugcggcgaugagcgagcggugggcggaaaaugagccucaaaccaccccaugccccacccagucacucucauuggcugagccugccacgggggcggaggcagcgcacacccuucgcugacuccaccgauccgccggaacgaaagcgggucccgggacacuggugugugagaaacuauugcuagcacagaggaagcccgguccccaggccauggggguacagcugaggcugccacccggagagcccugccaugaaggugagugucagucccagcggugggacaguugggucacuuggguagcugggagcccagaugcgaggucucaaaacuagacucagaaaaaugugcggauucuuaacgcgccgucuucuaaucauuuaguauuccagucguccagucggcugucccaccaacgggacaguaaauacuuagcugagcccacugcacuccagacucuguggggaagcccaagucggagcaggacagaagugacgcccacuuagucccccggcuggcucaauguugauuacguccuacugaguguguggcagggaaauucaggaugcuugcugagggcagauuccaggguuugauccaggaggagguuuccuggcucagccucaacuccggaguacauggcagagggcgugccggggaucccgugggcuucccacagugcucccugaacacacugugccugagucccacggagagaucgcucagguaugacuuacugggcaauccuuugaguagggugacuacuccaacagggaacugggagugcccuuuuguuaguucuuccucagggcuagacugggauuuccagcccacaccuugccugguaaaaccccugggccccaccccuugaccuuugccagauguuccucacuuccacuggcuucuugcagucucuacacagaaggucagagaaaacugaauggaaguaaggggaaagguggggcaaccuugggaaaugugcauugcaaacgaaauuaucgguuuuuuuuuuaauccccacuggugucaggucauuucuaaccuacuugcuaacgacucaaagaagcugucugguaagaccugugccuuacagugagugcuucccagccuaaugcuacgaccauguaacuacagcuccucguguuguagagauucguguccuugcuucuuggccuuuccagcuuauaacuuaacgagggaauagaaagaaaaggggggagagacagaagaagagagaggacucaucaaaucccagcuaguaagaaaggggaaagguguguaaaagaaaaugugcaacaauucacaaacuauccccacauugagaccgguaucccuaaggcagcugcaucuaggguuguuuccuagacagucaugcgcuuaguggcaguuggucccuuuucuaaauaauucuggagcugccaagucagaucgucacuaaugcacccugcccuuguuuguucaaggaucugagagcagauugcacccacucauuugaccucuggauauuuuuccugcuuugcucaugcauuuaguaacuacaagaaguauuggagcucugugucacccgaugauuaaccgugcaggaagguacugggaaagaugggagaggccaaucuguaauuucaguaguaggagacuagguuuuaggccuaguguauccacuuggcucucuuucuuccucucuaaaguaggaagaaaucuuguugacagaguagguagcacuggguuaccucaggaaaucuacagggcagaacccuggcgggucuuaaauggagucugguuuuccuugauuuguuugaggugaugaacaagaauccugugagccgagcacuggccuagguccuaaaggacugucaucagucuggccuucaaugcuagcacucccaaucuguuuacuacccugaugacaggacauuccgagaagcaaaugacuugagaguguagagcugugacaaagucuaacagucaauguacugaagcuggagguggucugcagauuggguggcccagauccucuagagaaaguuuuuaaucuacccgagaucaaaaugaugagcuaaucauggagucugaggauaaagucguuucauaagaugccccccaaaaguuacaguaguac

SEQ ID NO: 10088 - RNA, 2501 nt, Mus musculus
guacuacuguaacuuuuggggggcaucuuaugaaacgacuuuauccucagacuccaugauuagcucaucauuuugaucucggguagauuaaaaacuuucucuagaggaucugggccacccaaucugcagaccaccuccagcuucaguacauugacuguuagacuuugucacagcucuacacucucaagucauuugcuucucggaauguccugucaucaggguaguaaacagauugggagugcuagcauugaaggccagacugaugacaguccuuuaggaccuaggccagugcucggcucacaggauucuuguucaucaccucaaacaaaucaaggaaaaccagacuccauuuaagacccgccaggguucugcccuguagauuuccugagguaacccagugcuaccuacucugucaacaagauuucuuccuacuuuagagaggaagaaagagagccaaguggauacacuaggccuaaaaccuagucuccuacuacugaaauuacagauuggccucucccaucuuucccaguaccuuccugcacgguuaaucaucgggugacacagagcuccaauacuucuuguaguuacuaaaugcaugagcaaagcaggaaaaauauccagaggucaaaugagugggugcaaucugcucucagauccuugaacaaacaagggcagggugcauuagugacgaucugacuuggcagcuccagaauuauuuagaaaagggaccaacugccacuaagcgcaugacugucuaggaaacaacccuagaugcagcugccuuagggauaccggucucaauguggggauaguuugugaauuguugcacauuuucuuuuacacaccuuuccccuuucuuacuagcugggauuugaugaguccucucucuucuucugucucuccccccuuuucuuucuauucccucguuaaguuauaagcuggaaaggccaagaagcaaggacacgaaucucuacaacacgaggagcuguaguuacauggucguagcauuaggcugggaagcacucacuguaaggcacaggucuuaccagacagcuucuuugagucguuagcaaguagguuagaaaugaccugacaccaguggggauuaaaaaaaaaaccgauaauuucguuugcaaugcacauuucccaagguugccccaccuuuccccuuacuuccauucaguuuucucugaccuucuguguagagacugcaagaagccaguggaagugaggaacaucuggcaaaggucaagggguggggcccagggguuuuaccaggcaaggugugggcuggaaaucccagucuagcccugaggaagaacuaacaaaagggcacucccaguucccuguuggaguagucacccuacucaaaggauugcccaguaagucauaccugagcgaucucuccgugggacucaggcacaguguguucagggagcacugugggaagcccacgggauccccggcacgcccucugccauguacuccggaguugaggcugagccaggaaaccuccuccuggaucaaacccuggaaucugcccucagcaagcauccugaauuucccugccacacacucaguaggacguaaucaacauugagccagccgggggacuaagugggcgucacuucuguccugcuccgacuugggcuuccccacagagucuggagugcagugggcucagcuaaguauuuacugucccguuggugggacagccgacuggacgacuggaauacuaaaugauuagaagacggcgcguuaagaauccgcacauuuuucugagucuaguuuugagaccucgcaucugggcucccagcuacccaagugacccaacugucccaccgcugggacugacacucaccuucauggcagggcucuccggguggcagccucagcuguacccccauggccuggggaccgggcuuccucugugcuagcaauaguuucucacacaccagugucccgggacccgcuuucguuccggcggaucgguggagucagcgaagggugugcgcugccuccgcccccguggcaggcucagccaaugagagugacuggguggggcauggggugguuugaggcucauuuuccgcccaccgcucgcucaucgccgcagaaguuccuucagucaccggugucugcaggguggacccgggagcugcacaggugcuuaguccagaaacaccugccaggaggagaugagguuacagcguggaugcugccgaagucacucggggaauuuagugauggagaggcugucccgaggcccccuucugguuguccuggagcagacgaagugcuggccaacgucagugggucuuucucaucacuggcuuuuguggcacaaggcgcugucugcuggaguucugugcugaguccaugcuaaaguuuauucugggauuuuuuucgaacaggcuuggugcuucugcucucucgugcacgccguuguccuccuugucuuacaauacccgugcuuaccuguuuucaacaaucaggcauuu

SEQ ID NO: 10089 - RNA, 2501 nt, Mus musculus
ucacuggagguuacuguguguuucagcauguugaacacgaggugaacacuuuacagaggucggcaggcuccugccuguaaugugguaauggagguuugagguaaugaggagauaaacuagggugggcgagagagacacauugagggacaugugaaguggaagaugugguaaccggcaaaagugucaccauaugugagaugaacuuuuuccuggggcagugccucugcaagugcugugcugcugcugcugguggcccccucaucuuccucuuccucccuaauucuccuaauuuuucuccccuucuuccuccaucuccucuccauccuccuuccccaagcucuuccuccuccucuucugcguuucuuucuuuucuuuuauucagugugugaggggcacauacaccaugauauaagcguguggaggucaaaggacaaccuuugggaguugggccucucacuuuaccaagaugguucucgggacuuaacucagggacuaaguugucagacuugguggcugucaccuuuaucacuaagccaucuugccagccccuccugaacacauuuacauugaagcagacucaagcuccaacugagaccugggauagaggagcuggggaagaagauaccaacaucuuccuuuguugaugaagcugggggagaagcuuuuuuaaggggcagaagugccaggacccagugacugacacagcggggggccuacccugacucccaaacagaauagauuacaaaguuagugggaucccaaacacaaaaagcaaccuuucauguucgaauuauaaaguugagggaagcuggucauuaagcccaaugcuuguuucuccuuagcucucuucaggcaggccggcucugguuaggguagccaagugggcagaccacuguaacuuuccgguagaauagaagcucagagcaucaagaugcaugcacagaagaacugagaccccucuaacccagaggcuguaagggguaaacuaggaaaaccaaggaauggcuucauucccaacaaguccacuugccuauugucauagaggauuuccgugcuuguuuagcagauuucaggucuguuuuucauacccccuagaaugaguccucgaauauuuaauaggucugucgcuaaaauguuagccacuuaagaaacuauucccccguugcauaucaauuucacucauucacuuucuccccgcagugauuucgaagaaaugaaacuuuuaaagagaaaccagcuuacugguuauuugcaaagggaaacaacaauaaagaagugacuacaaaaauagcuuuuuauuauaauaagucacuuuagcaacuacuugcacgagcauguguucacacacuucacccgcacacacacuuaugugcgugcuuaaguuacagcuugauaucugaagggaagccuuuaaacuauucuaggcucacaacgaagaccaggaaacacuugauaacgcauuucuuaaaaaguaaucuuaaacccacuagacacgggucaguuuuauauuaguaucugaaucuccgagaaaccacagugggcggggaauggcagaagcaagaccuggccacgauccacgccaggcaacagcugaccaccacuuggcuggcaucggucagccucccggccccgacugacguuauuuuuauccgcaugguuucuggcugcggagaggcacguccaggcgcaggcuccgcaggccaugacccgugucacucccgcagagggacagcuccgcucucuggccggccgggagccgcugcccaggauccagcccggccuucgccagcaucuuggcugcggacagcucccgcccugcggccccgcccugccgccucgcuccgccagcccagcccucgcgcccuccgucguccccgcccucuguggggucgcccgggccacccggcuucccaaucccucggccggccgcagcaggcucacagaccugcucggucgcugccgccgccgccgccgcugccgccaucuuggcccgccgcagcccgcgcuugcgcucuggcacugggguggggcucacacccucgauggccacgcccugucacgcccucgccacucccccgaaagaaauccagagugggcaagauucuguguagguucacauccuugcagggcggucccucacgaccguaagucgcccgcggguugcauggguguggcaaggaucucuggggcauccucaaguucuucggaaaggacgcccucaaaauccaaaacaugccuuuaccuuuauaucaacuccccgucuugggauacuguccuguccugagcugugacaaacugcaagggaguauuugaguguacuggugggugagacuugggugcagaucaaguggaaacuuuagguagcuuaaaucaaacuagucucuucccccucaacuccucuggaagccugugaagucaagucuggcacuuucuuugaggcauuagaggcagauuguccauuuaauauuggagacuauauuagguccuuaggaaccuaacuu

SEQ ID NO: 10090 - RNA, 2501 nt, Mus musculus
aaguuagguuccuaaggaccuaauauagucuccaauauuaaauggacaaucugccucuaaugccucaaagaaagugccagacuugacuucacaggcuuccagaggaguugagggggaagagacuaguuugauuuaagcuaccuaaaguuuccacuugaucugcacccaagucucacccaccaguacacucaaauacucccuugcaguuugucacagcucaggacaggacaguaucccaagacggggaguugauauaaagguaaaggcauguuuuggauuuugagggcguccuuuccgaagaacuugaggaugccccagagauccuugccacacccaugcaacccgcgggcgacuuacggucgugagggaccgcccugcaaggaugugaaccuacacagaaucuugcccacucuggauuucuuucgggggaguggcgagggcgugacagggcguggccaucgagggugugagccccaccccagugccagagcgcaagcgcgggcugcggcgggccaagauggcggcagcggcggcggcggcggcagcgaccgagcaggucugugagccugcugcggccggccgagggauugggaagccggguggcccgggcgaccccacagagggcggggacgacggagggcgcgagggcugggcuggcggagcgaggcggcagggcggggccgcagggcgggagcuguccgcagccaagaugcuggcgaaggccgggcuggauccugggcagcggcucccggccggccagagagcggagcugucccucugcgggagugacacgggucauggccugcggagccugcgccuggacgugccucuccgcagccagaaaccaugcggauaaaaauaacgucagucggggccgggaggcugaccgaugccagccaagugguggucagcuguugccuggcguggaucguggccaggucuugcuucugccauuccccgcccacugugguuucucggagauucagauacuaauauaaaacugacccgugucuaguggguuuaagauuacuuuuuaagaaaugcguuaucaaguguuuccuggucuucguugugagccuagaauaguuuaaaggcuucccuucagauaucaagcuguaacuuaagcacgcacauaagugugugugcgggugaagugugugaacacaugcucgugcaaguaguugcuaaagugacuuauuauaauaaaaagcuauuuuuguagucacuucuuuauuguuguuucccuuugcaaauaaccaguaagcugguuucucuuuaaaaguuucauuucuucgaaaucacugcggggagaaagugaaugagugaaauugauaugcaacgggggaauaguuucuuaaguggcuaacauuuuagcgacagaccuauuaaauauucgaggacucauucuaggggguaugaaaaacagaccugaaaucugcuaaacaagcacggaaauccucuaugacaauaggcaaguggacuuguugggaaugaagccauuccuugguuuuccuaguuuaccccuuacagccucuggguuagaggggucucaguucuucugugcaugcaucuugaugcucugagcuucuauucuaccggaaaguuacaguggucugcccacuuggcuacccuaaccagagccggccugccugaagagagcuaaggagaaacaagcauugggcuuaaugaccagcuucccucaacuuuauaauucgaacaugaaagguugcuuuuuguguuugggaucccacuaacuuuguaaucuauucuguuugggagucaggguaggccccccgcugugucagucacuggguccuggcacuucugccccuuaaaaaagcuucucccccagcuucaucaacaaaggaagauguugguaucuucuuccccagcuccucuaucccaggucucaguuggagcuugagucugcuucaauguaaauguguucaggaggggcuggcaagauggcuuagugauaaaggugacagccaccaagucugacaacuuagucccugaguuaagucccgagaaccaucuugguaaagugagaggcccaacucccaaagguuguccuuugaccuccacacgcuuauaucaugguguaugugccccucacacacugaauaaaagaaaagaaagaaacgcagaagaggaggaggaagagcuuggggaaggaggauggagaggagauggaggaagaaggggagaaaaauuaggagaauuagggaggaagaggaagaugagggggccaccagcagcagcagcacagcacuugcagaggcacugccccaggaaaaaguucaucucacauauggugacacuuuugccgguuaccacaucuuccacuucacaugucccucaaugugucucucucgcccacccuaguuuaucuccucauuaccucaaaccuccauuaccacauuacaggcaggagccugccgaccucuguaaaguguucaccucguguucaacaugcugaaacacacaguaaccuccaguga

SEQ ID NO: 10091 - RNA, 2501 nt, Mus musculus
aacgacgcagccgcguuagaauuucuccccagggccauauuucuagcgaggcccagacugucuauagaaaggauaauuugaauucuagauuuauauucguuuuagaaaugagcagcaauuuuacguguauuuucuuuucgaagagaauacaaaacaauagcacccccacccccaaauugggaagucaacucauuuuggaaaugauggcuguuuguaguuuccugaaaccucuuucccggcagaacgucaacaccucccccuucggccccccaccccaccccaucugguuugcuccccccuccucguuguuguugaagucuggggguugggacuggccccccugauugcauaagagcaaaaagcaaagaagaggucuugagccugagagagucagagagcaaggaguccuagggaaacuuuuauuuugaagagaccaagggggggggggacuucauuuccugacagcuauuuacuuuaagcaaaugauuaguuuuuggaggacggacuauaacauugaaucaauuacaaaaugcggguuuugagcccauuacuguuggagcuugagggagagaaacaaacggaggagcugcggggaaggacuggaagcuuggggcuuacuuuucacuccggguaucggauuuucuuugcaaauugacauagaaggagaagguaagggagaggaaaaagugacuuuuguuucucaagaaggucccugaucauaacuuggggcugcaagaagcuaaguaacuucaaauuuugggcaacgaggaaaacaaaaacaaaacagcugaguucagugguguguccagaaaguaacuuauucugaauaaacuucacuggaaugggggguguggggggguaaccauuagagagucaaagauaaaaaaaaaaaaagaaaaagaaaaagaaaaugaaaaaaaauccagaccuauuuuuaaaagcaauguuuuuuuuuuuuucccuacacaauccuauagccuuccaaagaaauuguuaggcuuacauuuuugagguuuuccuccaggguggggguggcguucgugcuuacugggacgaacaccaaguaacauuggggggguggaagccgcggcgcuuggccucuuggcagugggucacggaagaggacagguuuuuaaugaguauuuucauucgucgcccgcgguuuggcgggacuacgcuguagcggguggugcggcgcgaagcuuggggagggggcgcaccaggagaaguguguguguggaggggaaaggggcgccgaguggggcgcgggaaagcgcuaagaaaaaagggaggugugaagggcucggcuggaggaggucggaccucggaugccggccgggcacacucggcgccagucgagcccucguaauuacuggacggcgcugcuguuggaaacaucuggggccagacuugagcgcggcgguggcggcugcagcaccgugagaggggcgcgcgggcgaggggcgcagcuccaaggguuccggagagauuggagcgaauuacuugggugcuagaagccucgggcggaauccgcagugcgcugggaucgugcgccucucacuccagcgacggaggcagcggcggcagcggcggcgcggacgagcgaucuggaauaaugacaaacacauuuggccucgagugaagaagucguccuggccucgcauuccagcaacugggauuugaggaauuucaaacugcacuccgaggggcccucauugugcuccguaguccccacccccacucggcucacuugcgucuccaguggagucuuuucugcacggccggggguugggggggccuggcucuugcuuaguccuggccgcaggcagcaaagaggcaagaucccuggcuaggagcugaccucuugugaagaagucaggacaucucugaaaggacagacgugggugcagguaagcagaaauguaagaggccaaccacccucgccuccugccuacggaacucugggugcuucucugcccugggaugauggaugcgaggcacuggucgccugaacgcaaccuuuccagugccccccccccccaacuuuccucccaacgcucaguauccugcaaaacucaggggcggucuccgcgcagccuucccuccuucaccguuauucccuuggaaaucaguuuauacaugugagauuaacuucccucgagcagggccgggaaagcaggaagcgaucucuuggcuuugaagcuucugaggucggcgauucuuucuguuuggaaggcguguggggcagucugcagaguaaggcaguaugacucggcccuggucugcagcaggaccaagccagagccucgcagccaggugugcaggaguugccagugacuuggcgaccagccuuggcgagaaaggaaguguuggccuguuugucugcuguggggaguccuugcagaacccgcgcuuagaaacucccaggucugcuaagaccucuagaagacccggagggugugcaugggggaacccaagcuggggagggggcguggguggca

SEQ ID NO: 10092 - RNA, 2501 nt, Mus musculus
ugccacccacgcccccuccccagcuuggguucccccaugcacacccuccgggucuucuagaggucuuagcagaccugggaguuucuaagcgcggguucugcaaggacuccccacagcagacaaacaggccaacacuuccuuucucgccaaggcuggucgccaagucacuggcaacuccugcacaccuggcugcgaggcucuggcuugguccugcugcagaccagggccgagucauacugccuuacucugcagacugccccacacgccuuccaaacagaaagaaucgccgaccucagaagcuucaaagccaagagaucgcuuccugcuuucccggcccugcucgagggaaguuaaucucacauguauaaacugauuuccaagggaauaacggugaaggagggaaggcugcgcggagaccgccccugaguuuugcaggauacugagcguugggaggaaaguuggggggggggggcacuggaaagguugcguucaggcgaccagugccucgcauccaucaucccagggcagagaagcacccagaguuccguaggcaggaggcgagggugguuggccucuuacauuucugcuuaccugcacccacgucuguccuuucagagauguccugacuucuucacaagaggucagcuccuagccagggaucuugccucuuugcugccugcggccaggacuaagcaagagccaggcccccccaacccccggccgugcagaaaagacuccacuggagacgcaagugagccgaguggggguggggacuacggagcacaaugagggccccucggagugcaguuugaaauuccucaaaucccaguugcuggaaugcgaggccaggacgacuucuucacucgaggccaaauguguuugucauuauuccagaucgcucguccgcgccgccgcugccgccgcugccuccgucgcuggagugagaggcgcacgaucccagcgcacugcggauuccgcccgaggcuucuagcacccaaguaauucgcuccaaucucuccggaacccuuggagcugcgccccucgcccgcgcgccccucucacggugcugcagccgccaccgccgcgcucaagucuggccccagauguuuccaacagcagcgccguccaguaauuacgagggcucgacuggcgccgagugugcccggccggcauccgagguccgaccuccuccagccgagcccuucacaccucccuuuuuucuuagcgcuuucccgcgccccacucggcgccccuuuccccuccacacacacacuucuccuggugcgcccccuccccaagcuucgcgccgcaccacccgcuacagcguagucccgccaaaccgcgggcgacgaaugaaaauacucauuaaaaaccuguccucuuccgugacccacugccaagaggccaagcgccgcggcuuccacccccccaauguuacuugguguucgucccaguaagcacgaacgccacccccacccuggaggaaaaccucaaaaauguaagccuaacaauuucuuuggaaggcuauaggauuguguagggaaaaaaaaaaaaacauugcuuuuaaaaauaggucuggauuuuuuuucauuuucuuuuucuuuuucuuuuuuuuuuuuuaucuuugacucucuaaugguuacccccccacaccccccauuccagugaaguuuauucagaauaaguuacuuucuggacacaccacugaacucagcuguuuuguuuuuguuuuccucguugcccaaaauuugaaguuacuuagcuucuugcagccccaaguuaugaucagggaccuucuugagaaacaaaagucacuuuuuccucucccuuaccuucuccuucuaugucaauuugcaaagaaaauccgauacccggagugaaaaguaagccccaagcuuccaguccuuccccgcagcuccuccguuuguuucucucccucaagcuccaacaguaaugggcucaaaacccgcauuuuguaauugauucaauguuauaguccguccuccaaaaacuaaucauuugcuuaaaguaaauagcugucaggaaaugaagucccccccccccuuggucucuucaaaauaaaaguuucccuaggacuccuugcucucugacucucucaggcucaagaccucuucuuugcuuuuugcucuuaugcaaucaggggggccagucccaacccccagacuucaacaacaacgaggaggggggagcaaaccagauggggugggguggggggccgaagggggagguguugacguucugccgggaaagagguuucaggaaacuacaaacagccaucauuuccaaaaugaguugacuucccaauuugggggugggggugcuauuguuuuguauucucuucgaaaagaaaauacacguaaaauugcugcucauuucuaaaacgaauauaaaucuagaauucaaauuauccuuucuauagacagucugggccucgcuagaaauauggcccuggggagaaauucuaacgcggcugcgucguu

SEQ ID NO: 10093 - RNA, 2501 nt, Mus musculus
acggacgugggguucccuagaccuggggcuagagaagcuugugagcagcaauguggcaaugugguccugcauggguggguggguggggagccaaacccuggaccucugccacagcaaccaguucucuuaaagguugagccaucucccaggugucagcaauaguguuuguaguaauaacaguuaaagaccuguggaagguuuucuaaagucaaaacuccuuccuuuggcuccagucuuccuacaaggaaaagaagggcauccucagagcucuguccugccuuaacuagcccugaccuaggagagggaaagguccucuaaaggagucugacccagagcagcagccuucuguucccggggcaggacuacaagcauucuccuccgauuuggcaaagagccacuccuccuagccauccucccgccccaaucccauugcccagccccucugagccccccaccuccuaacuccaaguccagggaauuuccccagcaucuucaagcuccaguuuccugccugaaggaagagagagaacagauaaaaggggugcaguggguuugagaacaccauagugcucuguagagccccaaucuccacaccuccuccagcauaucccgagcuggugcucccugguccgggaucuuguccacaaugagccuccagcuccgcagcuccgcccgcauccccagcgguuccaucucgccauucaugcggauggcgccgcuggcauuucuguugcuguucacgcugccgcagcaucuagcugaaggugagggcgcagcaccugcguggcgcagggugccugacccauccgggcgggccaucgcagucagcgggucccaggagcggggaaaggggcucuuccagcauccuccuauaaucuugucucuuccacagcugccccuuccucagucauagccgcaacggagcugcguuguguuugcuuaaccguaacuccaaaaauuaaucccaaauugaucgcuaauuuggaggugaucccugcagguccacagugcccuacgguggaagucaugugaguucugacuguguucugggugcaggugaucuugggagauggaaguccaggacacccccugcccuacccacaucccuuaucccggauucuucagucacccgggcucaccugugcauccucuuuuuuuccuccuccgcagagcuaaacugaaaaaccagaaggaggucugucuggauccagaagcuccugugauaaagaaaaucauucagaaaauauugggcagguacuugcuaucuuagucucugcagcgggcaagguccuuauucucccuguaugaguugaggcucccaucccacauucgaaacugagcuuagaauaaaaggauucagaagggaaaguuguuauucugggauguugcaauaacccaaaacucaucucucucucucucucucucugucucucucucucucucucugucucucucucugucucucucucugucucucucucucucucugucucucucugucucucucucucucugucucucugucucucucucucucucucucucucucucucucucucucucucucucucucucucucuguguguguguguguguguguguguguuaggauaaacugaagaauuuuaguuacugauauaagucuuuucucaacagugacaaaaagaaagcuaagcggaaugcacucgcaguggaaagaacggccaguguucaauagaaagauuucugaggacucugaccccagugaagauaagaagaaagggcugauucucuccacccacggauuuucuuuaugaacucccugcuuugaugagaaaagggaaaccauugucccugaagcuuccugcucaucucacaaguguauuuagcaaaaauauuuccuauucuuuccuaucugucacacuaucggaaauugugauacuuuaguguguaagucaagaaucauugguuguuaaccuuucaaaaugucuugaacugaaggugacuauugcauugucuccggaauauguauauguauauguauauguauauguauauguauauguauauguauauguauauguauauguauauguauauguauauguauaugauguauauguauauguauauguguguguauauauauauauauauccuuuguaauguucaugagaaggcaaugcugucauacucucucucauaaaauggggaccucuuuuacuguuguuucuuggguguguuaagaguguucuuacgucugagccugggcuggcauauaacuuuuaugguuuuagaaagcugcugugucaugcagaaaccuauguagaacacaguuccuuauuuagaauuucuaaauguguaaguucuagaaggaucaauguguucucaucuuauaauuuuagacauuugaugucuucguaguauggcauaaugucaugacuuacucaacaaacuguauacuauuuauuaauuauuaacuaguuuauuaguauuacuauuugggccacuaacuauauauu

SEQ ID NO: 10094 - RNA, 2501 nt, Mus musculus
aauauauaguuaguggcccaaauaguaauacuaauaaacuaguuaauaauuaauaaauaguauacaguuuguugaguaagucaugacauuaugccauacuacgaagacaucaaaugucuaaaauuauaagaugagaacacauugauccuucuagaacuuacacauuuagaaauucuaaauaaggaacuguguucuacauagguuucugcaugacacagcagcuuucuaaaaccauaaaaguuauaugccagcccaggcucagacguaagaacacucuuaacacacccaagaaacaacaguaaaagagguccccauuuuaugagagagaguaugacagcauugccuucucaugaacauuacaaaggauauauauauauauauacacacacauauacauauacauauacaucauauacauauacauauacauauacauauacauauacauauacauauacauauacauauacauauacauauacauauacauauacauauuccggagacaaugcaauagucaccuucaguucaagacauuuugaaagguuaacaaccaaugauucuugacuuacacacuaaaguaucacaauuuccgauagugugacagauaggaaagaauaggaaauauuuuugcuaaauacacuugugagaugagcaggaagcuucagggacaaugguuucccuuuucucaucaaagcagggaguucauaaagaaaauccguggguggagagaaucagcccuuucuucuuaucuucacuggggucagaguccucagaaaucuuucuauugaacacuggccguucuuuccacugcgagugcauuccgcuuagcuuucuuuuugucacuguugagaaaagacuuauaucaguaacuaaaauucuucaguuuauccuaacacacacacacacacacacacacacagagagagagagagagagagagagagagagagagagagagagagagagagagagagacagagagacagagagagagagagacagagagagacagagagagagagagagacagagagagagacagagagagagacagagagagagagagagagacagagagagagagagagagagaugaguuuuggguuauugcaacaucccagaauaacaacuuucccuucugaauccuuuuauucuaagcucaguuucgaaugugggaugggagccucaacucauacagggagaauaaggaccuugcccgcugcagagacuaagauagcaaguaccugcccaauauuuucugaaugauuuucuuuaucacaggagcuucuggauccagacagaccuccuucugguuuuucaguuuagcucugcggaggaggaaaaaaagaggaugcacaggugagcccgggugacugaagaauccgggauaagggauguggguagggcaggggguguccuggacuuccaucucccaagaucaccugcacccagaacacagucagaacucacaugacuuccaccguagggcacuguggaccugcagggaucaccuccaaauuagcgaucaauuugggauuaauuuuuggaguuacgguuaagcaaacacaacgcagcuccguugcggcuaugacugaggaaggggcagcuguggaagagacaagauuauaggaggaugcuggaagagccccuuuccccgcuccugggacccgcugacugcgauggcccgcccggaugggucaggcacccugcgccacgcaggugcugcgcccucaccuucagcuagaugcugcggcagcgugaacagcaacagaaaugccagcggcgccauccgcaugaauggcgagauggaaccgcuggggaugcgggcggagcugcggagcuggaggcucauuguggacaagaucccggaccagggagcaccagcucgggauaugcuggaggagguguggagauuggggcucuacagagcacuaugguguucucaaacccacugcaccccuuuuaucuguucucucucuuccuucaggcaggaaacuggagcuugaagaugcuggggaaauucccuggacuuggaguuaggagguggggggcucagaggggcugggcaaugggauuggggcgggaggauggcuaggaggaguggcucuuugccaaaucggaggagaaugcuuguaguccugccccgggaacagaaggcugcugcucugggucagacuccuuuagaggaccuuucccucuccuaggucagggcuaguuaaggcaggacagagcucugaggaugcccuucuuuuccuuguaggaagacuggagccaaaggaaggaguuuugacuuuagaaaaccuuccacaggucuuuaacuguuauuacuacaaacacuauugcugacaccugggagauggcucaaccuuuaagagaacugguugcuguggcagagguccaggguuuggcuccccacccacccacccaugcaggaccacauugccacauugcugcucacaagcuucucuagccccaggucuagggaaccccacguccgu

SEQ ID NO: 10095 - RNA, 2501 nt, Mus musculus
cuagucucccguccuaagccccuacucccgcccacgcucacccaucccaucccaccccaugcccccgcucccuccuacgcucucuuguaucacacuaauccccucccccaccuccgaucucucagaaucggggugcuuacucccacucgccccaagacucuguggcccgcgggcucccccgugugcccaucacgcgcgcugcagcggucuuuagguccuaagugaccugaaacuaaaccaaggguucuagcaggcgaccagggggcgcguccagaggacggcagagaacucuaggacacucgcagcccgauccgccggcucccugucugcagcagugcuccagccuucggggugggcaaagcuucugugccauuaccgggucccgcccgcgcgggggccccuuuaagggagugggcggggcgauguuuauuagcauacauuagcauggcccugccccggaggcgggcgggcgcgcggcucagucccgcggagcggagcggugcgggcgcggagccgagcgaggcgcggagcuggcugcuggcgggugcggggacccucgccacccgaccugggagagcgggaugggacgccgcccgcggggaccuggguccccccggggaccuggcccuccacgccccgggccggggcugccaccacugcugcuuguacuggcgcuggcggcccaugggggcugcgcagcgcccgcgccccgcgcggaggaccucagccucgggguggugagugaacgacaggggcacgggacccugggcacucgggagccgaguccccaggcgcucacgaggugcaagggagaagggagacucgcccuugcuccuuucggagaggugcgcgaaucccggugaggcgggggugugggggggaacccauuuuuaagacagagaaacugaggcuggggcucgggcugcucgaggcucacgcuugcaggucuaggaggaugccggucccuuucccgcuccgugcagucgugcgccgcagccgcgggcgccccggggagguggucgcccagccggagccuggucucugguuaaaagcagcuccacagagaccucuggcggggugaccggugucacagacgcccggagcggugcgccccgcgagcuucgcggccggagugggaggucaggggcgcgcaccccaggccggggacgcgccugugggcguccggaaaaccugggguucccgaguuugccccgcugacgauguuagaagagccucccgcacggcgagcgugccgcgaccccgucucccuccuccaccggagcgaucggccuugucccgccggugcgggugacaaccucugcugugucaagcccgcugccguccccaucccgccaacucccacugccagagcuuagcuaggcacuccagcuuggggacccggguaccggcuucuucccaccucuugcccacccuccugacugaagucggguuuggaaacccgcaggagacccggaagguuucgaucagacuuuauggcuccgcaggcccgcgaagcccucugcaaaggcgcgcgcggugacuagagcccgcuuucgaggaggaggaggaggccccggccuggguuccuuagaucuggagacccggccaggcgcggcuuccugauuggcacaagccagccaauauccuaaugggguccuggcagaguccgcuuuccacgggcgguuggcaacgaggacuccuacaccucaggucuaggcaaggugucauggagauuuccugcuggaggagacacuggggcgggagcaaccuccaguuuggcaacauuugccccuggaucugagaggggcagacucugccaccccccaggcaucugagguggcagcgacccaugcuuucucugcccacuugcagaugucugaggguccccugagguggcuucuucccacuccaguggccucuaaaauagggguuccucacguuccugauccuaggcuuucauagcuggcuccccgaugccaugagcauuaggacauccagacccaguucuggugggugacaacagaguccagacgcacccucccccccccccccccccacacacacaccgucuuccuucaagcuuucaguguaucucuaacgggacugguuaggggacaggagacagagcgagggaggagucagggcgagggagccccugcccauccaaguucuuaaucaggcccaguguacuuaggaaguuugcagcagcggaccucggugguugaggugggguuggcuccucccccuggcaccugugggcuucauccgacuuuuccccuccccuacugaguuccugagcacuccagggucaccaacccaccagcacccugaagaucucacuaaccaggguaugugacuccaggcuugccagaggcagcaaaacccugucguccaauccuggguaaggcgggagggugccgcaggcagccuccugcccaggacaauacccucccgggugugggaaccggguccugcccgccucuccuuugguggcggugggg

SEQ ID NO: 10096 - RNA, 2501 nt, Mus musculus
ccccaccgccaccaaaggagaggcgggcaggacccgguucccacacccgggaggguauuguccugggcaggaggcugccugcggcacccucccgccuuacccaggauuggacgacaggguuuugcugccucuggcaagccuggagucacauacccugguuagugagaucuucagggugcugguggguuggugacccuggagugcucaggaacucaguaggggaggggaaaagucggaugaagcccacaggugccagggggaggagccaaccccaccucaaccaccgagguccgcugcugcaaacuuccuaaguacacugggccugauuaagaacuuggaugggcaggggcucccucgcccugacuccucccucgcucugucuccuguccccuaaccagucccguuagagauacacugaaagcuugaaggaagacggugugugugugggggggggggggggggagggugcgucuggacucuguugucacccaccagaacugggucuggauguccuaaugcucauggcaucggggagccagcuaugaaagccuaggaucaggaacgugaggaaccccuauuuuagaggccacuggagugggaagaagccaccucaggggacccucagacaucugcaagugggcagagaaagcaugggucgcugccaccucagaugccugggggguggcagagucugccccucucagauccaggggcaaauguugccaaacuggagguugcucccgccccagugucuccuccagcaggaaaucuccaugacaccuugccuagaccugagguguaggaguccucguugccaaccgcccguggaaagcggacucugccaggaccccauuaggauauuggcuggcuugugccaaucaggaagccgcgccuggccgggucuccagaucuaaggaacccaggccggggccuccuccuccuccucgaaagcgggcucuagucaccgcgcgcgccuuugcagagggcuucgcgggccugcggagccauaaagucugaucgaaaccuuccgggucuccugcggguuuccaaacccgacuucagucaggagggugggcaagaggugggaagaagccgguacccggguccccaagcuggagugccuagcuaagcucuggcagugggaguuggcgggauggggacggcagcgggcuugacacagcagagguugucacccgcaccggcgggacaaggccgaucgcuccgguggaggagggagacggggucgcggcacgcucgccgugcgggaggcucuucuaacaucgucagcggggcaaacucgggaaccccagguuuuccggacgcccacaggcgcguccccggccuggggugcgcgccccugaccucccacuccggccgcgaagcucgcggggcgcaccgcuccgggcgucugugacaccggucaccccgccagaggucucuguggagcugcuuuuaaccagagaccaggcuccggcugggcgaccaccuccccggggcgcccgcggcugcggcgcacgacugcacggagcgggaaagggaccggcauccuccuagaccugcaagcgugagccucgagcagcccgagccccagccucaguuucucugucuuaaaaauggguucccccccacacccccgccucaccgggauucgcgcaccucuccgaaaggagcaagggcgagucucccuucucccuugcaccucgugagcgccuggggacucggcucccgagugcccagggucccgugccccugucguucacucaccaccccgaggcugagguccuccgcgcggggcgcgggcgcugcgcagcccccaugggccgccagcgccaguacaagcagcagugguggcagccccggcccggggcguggagggccagguccccggggggacccagguccccgcgggcggcgucccaucccgcucucccaggucggguggcgaggguccccgcacccgccagcagccagcuccgcgccucgcucggcuccgcgcccgcaccgcuccgcuccgcgggacugagccgcgcgcccgcccgccuccggggcagggccaugcuaauguaugcuaauaaacaucgccccgcccacucccuuaaaggggcccccgcgcgggcgggacccgguaauggcacagaagcuuugcccaccccgaaggcuggagcacugcugcagacagggagccggcggaucgggcugcgaguguccuagaguucucugccguccucuggacgcgcccccuggucgccugcuagaacccuugguuuaguuucaggucacuuaggaccuaaagaccgcugcagcgcgcgugaugggcacacgggggagcccgcgggccacagagucuuggggcgagugggaguaagcaccccgauucugagagaucggaggugggggaggggauuagugugauacaagagagcguaggagggagcgggggcauggggugggaugggaugggugagcgugggcgggaguaggggcuuaggacgggagacuag

SEQ ID NO: 10097 - RNA, 2501 nt, Mus musculus
cguggcaggauugcuucccguucauaccacacccagccaauaaagucccgaagggcugcuucuugggugaugucauugaagcuagaagggacaggcauguccaagacugggcccgacuagggaaagaagaaguggagucacgugcuggggauguggcucagcugguaaagcccuggccuaccaccgaugaaauccuguguuccgacuccagcauuguauaagccaaucauggcggagcgcaccaguaauccuagcagaugagaggugcagccaggaagauggacguucagggucauucccuggcuauccucugcuucauaguauaucugaggcugaccugaggauacaggagacucuggcuaaagagaaggauugggucuauucuucacgacugcgcccccagcacccuagagaaccauaggggacacaggggagagacucuguaaaauacuggcugcauccacaagugaacucugcaggacaguugauggaaaaagacuguucaaaccaaguucuuucucagggcagauaguaccagagccaagauuuccauggaaagagccacaggccagucuaaaacaggaaagaccagacccugacauaaaaggcaggugaccauugcuacaaggaagaaggccaacagcagggaacaggggcccccaaggaaacagagaaggccugugguggcaauguccucuccuuacuuccucuuuugcugaaugcugggcagugcaguugaaaacugagagucuaagccagguguggugguucaucacuuguaacucuagcaaccugggaggcuaagggagccacauggcuaugagucggagguuaaugugagucgcugucucaaacacacacacacagagcuggugagaugacuugguggguuaaaggcacuagccacuaagccugaugaccuuaguuacaucccuggugaccuaggugagaccagacuccagcaaguuaucuuccaaccuccacauguacuguguagcacacggguggcgcccccccaccccacauaaauaauggguacacauuuuaaacaaagagagagaagagaggaagaggagagagcccaauaggaaacgagguaggaugaaugaaugaaucugagagaggaggagacugugagcacacagguuugcuucagccugcuucugcgccaacccuaccuagguaggaaaggagagcagggaugaggguccucugcuagcucugugcaaagucacauuugcuccccccuccucuacccccgcccccaaaucucuguaguggguagcaucuccuaggauucuacuuuucacaagaugggaaagagcaugggagguaugugcaccgggaugcaggaggcgugugcacaaacaucuacaacacucaggaaaguuaaagugggagcaagagauucacccggacauccaggccagccuagguuaucgaaggagacacagccucaaaacauaaacaaaaggcucaguagugacaagcacacacagggcccuggguucaagucccagcacuaugaaguaaaauuaaaagcuuuaaaaaaacaaaaacaaaaaaauccauugccuggggcagcgccugccuagcagaaaccaugcgguucucagcaugccaggucccacuuccugcucuggucgcuccccuccccagccugcaaacccauauuaaccuccucuaggugagcacaaggggaucuccagguacaggcaucccuccgcccauccccugacuucuggaagcuuccagaccccgggucccagggagcgcgcaccucccguagcggcugccgguaccauugcugcucgaaacccugcagccgguuguucgagaggucggcgcggaagugccacaguccguccagcgccuugagcucccgcgacgggcucuccuucgggaacagcaucccgcccuucagagccagcgcgcagcugcacagcagcuggcccagcgcgacccaacacgcacuccauuuuagggacauacuggccaggcugcccaccgaccagcggcugggcuuuuuagccuccucucugggagggcagaggcgggaccuggaagagucacauguucucgagagaagccgccugcgccaacuugguugagggcaagcgcuuguacagcugcuggcucaaggcuaucuagaggccccaaggcuggacucugcagaaagaggaagucgcuugaaguccuggaucguuuccccauaugccugacgucagccgcugccugccucacaucuauuaauaucucccccuccuucccucacacucuggggcuugccccucaggaccacuaggcuaagaucugaaagaagcccugaagucccugaucccacuguuucuucauaacuccugugaaaggaugagaguucaaaagagacacugagaagaauuuggggaguuuguuauuaaagccuggaaaggacacgcaggcagguucgaagcuaggucucuucuuagaggucucugaggaagggaguagaacugacagca

SEQ ID NO: 10098 - RNA, 2501 nt, Mus musculus
ugcugucaguucuacucccuuccucagagaccucuaagaagagaccuagcuucgaaccugccugcguguccuuuccaggcuuuaauaacaaacuccccaaauucuucucagugucucuuuugaacucucauccuuucacaggaguuaugaagaaacagugggaucagggacuucagggcuucuuucagaucuuagccuagugguccugaggggcaagccccagagugugagggaaggagggggagauauuaauagaugugaggcaggcagcggcugacgucaggcauauggggaaacgauccaggacuucaagcgacuuccucuuucugcagaguccagccuuggggccucuagauagccuugagccagcagcuguacaagcgcuugcccucaaccaaguuggcgcaggcggcuucucucgagaacaugugacucuuccaggucccgccucugcccucccagagaggaggcuaaaaagcccagccgcuggucggugggcagccuggccaguaugucccuaaaauggagugcguguugggucgcgcugggccagcugcugugcagcugcgcgcuggcucugaagggcgggaugcuguucccgaaggagagcccgucgcgggagcucaaggcgcuggacggacuguggcacuuccgcgccgaccucucgaacaaccggcugcaggguuucgagcagcaaugguaccggcagccgcuacgggaggugcgcgcucccugggacccggggucuggaagcuuccagaagucaggggaugggcggagggaugccuguaccuggagauccccuugugcucaccuagaggagguuaauauggguuugcaggcuggggaggggagcgaccagagcaggaagugggaccuggcaugcugagaaccgcaugguuucugcuaggcaggcgcugccccaggcaauggauuuuuuuguuuuuguuuuuuuaaagcuuuuaauuuuacuucauagugcugggacuugaacccagggcccugugugugcuugucacuacugagccuuuuguuuauguuuugaggcugugucuccuucgauaaccuaggcuggccuggauguccgggugaaucucuugcucccacuuuaacuuuccugaguguuguagauguuugugcacacgccuccugcaucccggugcacauaccucccaugcucuuucccaucuugugaaaaguagaauccuaggagaugcuacccacuacagagauuugggggcggggguagaggaggggggagcaaaugugacuuugcacagagcuagcagaggacccucaucccugcucuccuuuccuaccuagguaggguuggcgcagaagcaggcugaagcaaaccugugugcucacagucuccuccucucucagauucauucauucauccuaccucguuuccuauugggcucucuccucuuccucucuucucucucuuuguuuaaaauguguacccauuauuuauguggggugggggggcgccacccgugugcuacacaguacauguggagguuggaagauaacuugcuggagucuggucucaccuaggucaccagggauguaacuaaggucaucaggcuuaguggcuagugccuuuaacccaccaagucaucucaccagcucuguguguguguguuugagacagcgacucacauuaaccuccgacucauagccauguggcucccuuagccucccagguugcuagaguuacaagugaugaaccaccacaccuggcuuagacucucaguuuucaacugcacugcccagcauucagcaaaagaggaaguaaggagaggacauugccaccacaggccuucucuguuuccuugggggccccuguucccugcuguuggccuucuuccuuguagcaauggucaccugccuuuuaugucagggucuggucuuuccuguuuuagacuggccuguggcucuuuccauggaaaucuuggcucugguacuaucugcccugagaaagaacuugguuugaacagucuuuuuccaucaacuguccugcagaguucacuuguggaugcagccaguauuuuacagagucucuccccuguguccccuaugguucucuagggugcugggggcgcagucgugaagaauagacccaauccuucucuuuagccagagucuccuguauccucaggucagccucagauauacuaugaagcagaggauagccagggaaugacccugaacguccaucuuccuggcugcaccucucaucugcuaggauuacuggugcgcuccgccaugauuggcuuauacaaugcuggagucggaacacaggauuucaucggugguaggccagggcuuuaccagcugagccacauccccagcacgugacuccacuucuucuuucccuagucgggcccagucuuggacaugccugucccuucuagcuucaaugacaucacccaagaagcagcccuucgggacuuuauuggcugggugugguaugaacgggaagcaauccugccacg

SEQ ID NO: 10099 - RNA, 2501 nt, Mus musculus
uuucgucuccacagagaugucccacgucaucuuuucuaccagugucagcugaaggggguccucagucaggcuuucucgugucucuucucuuauuacccugccccaagcuuuguccugguuacagaugccaaauauuaggccucugaucuuucuggauuagagcugucaguguguccuuccguccgugaaaggcgaccggucugucugugacuugucaccgcaggagacugucgccugcgugaacggugucuggugucuccgcaggcugcgguccgucugucacgugggugucugccccgccgcugcgggucugcgggucugucggucugucugaaucuaccacuggagugugucugggcucccgcuccccggggucucggggcuugaagggagggaggaggggagguggcagcccgggggagcggggaggggcgggggcggagacagugggcgggcgggggcgccgugcggcccggaggggugugugcggggggccggaggcggcugucacugucggcucagccugcgccggggaacauuggccgccuccagcucccggcgcggcccgacccggcccggcuuggccgccucaggugagucucccaacccacccaggacccuccaccgagucgggaccaauccgcaucccgggggaaacgugcgauccuggaacgaucgaagccccccaacagagcuccuacugcaccuccugccccguggggccugccuagaggggccccuccacugccucgcacuccucugaaacucccgcuagccgcugcauacuuacugaugaugcucgcugggccggccgcugccucugcgcucccuuccugcagggacccccugaaggccccuuccccacucucuucaaagucuggggacacuggaagacgcccccuguuuggggcggagcccaaacugcgcagguuacugacaucccgaaugcaccaccccccaucccgagggccgcgaccccaacgucccuacccagcugagccccuugccagcuccaggaccccuccugcgcucucucucucucucucucucucucucucucucucucucucucucucugacucugucucucucuaugugucucugucucucucuuucccucccucccucccucccucccucucacccucccacccucccucuaaaaggaggcucagcggaagccccgaguuauaauuagccccacucggguuuccugguuaaucuccaacaacgccacuauccccagauccaggcgaccagaacuggcugggugaugggugaacacccggaggggguaguuccgacccggggaauuuugaucucuuggcuggagacgccggaacuacagcagcuguugcccccaaaauagcgccccugccuuugcuacggggaucuccggagcucccggaacacagacguccuggcucgcccuucaacccccucugcgaugcucacgauucuccagauacccccacaccaaggcucgggcggggagcucuggccucuucuuggucucuacugcucccgguuggcaguggagggcauugcaauauggggaugcaauaggggcuugaguucuggugagccccacaaggggcgagugagacaguuggcuggagucaggcgagaggggugcgguugauguaaagcaaacggguaccaaccggccguaccagaaagaagagaggcggagcaggguggggcaaggugucgacuggacaagauuccaagaugccuucagaaccugggacucccgauaccuugaaugcccaacccacuccccagaaggcuuuggcuaacccaggagaggcuugggcugugcuuucuuauaacuugcaagcucccgaaggggccacacccguccguccaugaggguccccugcaccuguccuggggccuauacaaagccuuuccaacccugugcuguauacuaggggucuuagcucaagcugcaggggaaagagguauggaggcccuuggaacuugcugggcaagggagacuauguauuagccaggcuuaucucaguuggcugcauuuguugcgguauggguguguguaugucugaucuuguguuugucugccugugucgcgucuccuagcuugacuccauuucuccccuccccuuaccaaucugccacaccuccucugcaacuccuugauaagcccugggcaagacuguuucuuaaucucccacugagcugcugucuucacccuuugccuuucuuucucccagcagacaccagccuguccuggcagucaugaggccucccugguauccccugcauacaccuucccuggcuuuuccacuccucuuccuccuccucucccuccugggaggaggggcaagggcugagggccgggaagacccgcagcugcuggugaggguucgagggggccagcugaggggcauccgccugaaggccccuggaggcccagucucagcuuuucugggcauccccuuugcagagccaccugugggcucacguagauuuaugccacc

SEQ ID NO: 10100 - RNA, 2501 nt, Mus musculus
gguggcauaaaucuacgugagcccacagguggcucugcaaaggggaugcccagaaaagcugagacugggccuccaggggccuucaggcggaugccccucagcuggcccccucgaacccucaccagcagcugcgggucuucccggcccucagcccuugccccuccucccaggagggagaggaggaggaagaggaguggaaaagccagggaagguguaugcaggggauaccagggaggccucaugacugccaggacaggcuggugucugcugggagaaagaaaggcaaagggugaagacagcagcucagugggagauuaagaaacagucuugcccagggcuuaucaaggaguugcagaggagguguggcagauugguaaggggaggggagaaauggagucaagcuaggagacgcgacacaggcagacaaacacaagaucagacauacacacacccauaccgcaacaaaugcagccaacugagauaagccuggcuaauacauagucucccuugcccagcaaguuccaagggccuccauaccucuuuccccugcagcuugagcuaagaccccuaguauacagcacaggguuggaaaggcuuuguauaggccccaggacaggugcaggggacccucauggacggacggguguggccccuucgggagcuugcaaguuauaagaaagcacagcccaagccucuccuggguuagccaaagccuucuggggaguggguugggcauucaagguaucgggagucccagguucugaaggcaucuuggaaucuuguccagucgacaccuugccccacccugcuccgccucucuucuuucugguacggccgguugguacccguuugcuuuacaucaaccgcaccccucucgccugacuccagccaacugucucacucgccccuuguggggcucaccagaacucaagccccuauugcauccccauauugcaaugcccuccacugccaaccgggagcaguagagaccaagaagaggccagagcuccccgcccgagccuugguguggggguaucuggagaaucgugagcaucgcagaggggguugaagggcgagccaggacgucuguguuccgggagcuccggagauccccguagcaaaggcaggggcgcuauuuugggggcaacagcugcuguaguuccggcgucuccagccaagagaucaaaauuccccgggucggaacuacccccuccggguguucacccaucacccagccaguucuggucgccuggaucuggggauaguggcguuguuggagauuaaccaggaaacccgaguggggcuaauuauaacucggggcuuccgcugagccuccuuuuagagggagggugggagggugagagggagggagggagggagggagggaaagagagagacagagacacauagagagagacagagucagagagagagagagagagagagagagagagagagagagagagagagagcgcaggagggguccuggagcuggcaaggggcucagcuggguagggacguuggggucgcggcccucgggaugggggguggugcauucgggaugucaguaaccugcgcaguuugggcuccgccccaaacagggggcgucuuccaguguccccagacuuugaagagaguggggaaggggccuucagggggucccugcaggaagggagcgcagaggcagcggccggcccagcgagcaucaucaguaaguaugcagcggcuagcgggaguuucagaggagugcgaggcaguggaggggccccucuaggcaggccccacggggcaggaggugcaguaggagcucuguuggggggcuucgaucguuccaggaucgcacguuucccccgggaugcggauuggucccgacucgguggaggguccuggguggguugggagacucaccugaggcggccaagccgggccgggucgggccgcgccgggagcuggaggcggccaauguuccccggcgcaggcugagccgacagugacagccgccuccggccccccgcacacaccccuccgggccgcacggcgcccccgcccgcccacugucuccgcccccgccccuccccgcucccccgggcugccaccuccccuccucccucccuucaagccccgagaccccggggagcgggagcccagacacacuccagugguagauucagacagaccgacagacccgcagacccgcagcggcggggcagacacccacgugacagacggaccgcagccugcggagacaccagacaccguucacgcaggcgacagucuccugcggugacaagucacagacagaccggucgccuuucacggacggaaggacacacugacagcucuaauccagaaagaucagaggccuaauauuuggcaucuguaaccaggacaaagcuuggggcaggguaauaagagaagagacacgagaaagccugacugaggacccccuucagcugacacugguagaaaagaugacgugggacaucucuguggagacgaaa

SEQ ID NO: 10101 - RNA, 2501 nt, Mus musculus
cccgcggugaguccccuccgggcggcugagcggagaugaggaaggaggcguacacgguaucuuuggugagggaagaccgcggaagacacagaagagggaagggggaaaaggggaggggaaagagaaaaaaaagaaaacaaguuucagaaagucgccucgcccuucaggguaggagaguagcgaaccgagcugguggccagaaauaaaaucgggaguagccgcccccucuccucgaaaugcgaaaaccuaggguccuuccuccagcaguucaggguucccagggacguggcucagggaagcggcccggcucgcugugucccagccccgucucuugccuacgaaguucucccuaacuggggaaggccacucaacagaccgcgcccguucagcuaaauccaaacccguaguuuauuuuucaggcgucacaagcucuggagguuuaaaacuucgaaugcuuuugaguugguugaaauguguccauaacgccauaccaacuaucugauucgcaaaguuuaauguuuaaccuuuuuagggcccucgucucccuuuuuuuuuucuccuugugagccgcgaauaauaauaauaauaauaaaagggguguucgguuuaggggcuuuuuguuguuguuuaccaaggucagauacgaaacggguuuauuuuuaaaggaagaucaccgccccccuccugcugcccccguugggccauugggagucgcagaauccgaguccccgagacguggcauucucgcccgugaacuggaaaaagacuccuucaaaacaagauuugguuucauuuuccaacgcccgggccugggaauaccgaugcccggagaacguggcuugguguggaggauuuggggaucaucagagaagaaagaaggggucuccaaagaucucaauucuacccuagcuuugugacccacacacccccaaaauaaccuacaaaggaaaaaaaauaacuuaacagcgcgggccagcggaggggcgccuccccagcaucggguaaacccuccuguaaguccuauuuaagcuguuuguuuaaaagaucugucgcuuuccuguucccgaggggguagggaggucucagagagcccacccuucccucccugacuaccagccccaggcuacucuagacccccugguuccgggagaaccggggcgcucuagcagacggagacuaagccacagcucccgggugaccagccgcccuacgcccagacccaaaaguccucuucccccaacuuugcuaaggacgccuauuuuaacguggcuuugguuacaacacccccucuuccucucgcccgcccucgcucuuuaucaggcucugguuaccagaaucgcguuuacuuuugaaaaaaucuaggaucgucacagcccgggauacuugucucaaaggcgccaggagcuucccgcauacacuuaaagauaauauucauuaaaggcagcguuuugaaaaaggcagagcccaggcgccccacuuuaaggaagucggggugaagcccuacggagcagccuuugccauggucgagaagcuggcguggcuaucugcgggguuccacugcguccuucucuacuuuuccccucuuaaaugcagcuaaaauggcugaauuccggcuuuuaauuaaaaacagccuauaaucgaaaccgucucggcguccccgggcuagcccgccgccugccgggaaccaaguagggaaccgccgcccucggcggugcugcagacugagagcucgggugggaguccaaggcgcagcgaugcguccucucccccugaucccugcccuccgcuucccuucuggggaccccgacuguuucggggaccuucugcuuugcggacccaagggguacgcugcacaaguucggggagcaucggggcccggagcguaccuggcgcggcggggcuccgggcuccaggcuccgacggcgacuccggcaaccgccgcgguuccuggcgcggcuaggcgcccguacugcccgccaucccucggccgccgcuccccuccgccacccgcagccgccucacacuuuuugcccgccuuuccuuuuuuugguagaaaaccgcuccccgggccgggcgcgcggcgcgccaacuccuccgcccucccgcggccccgcucccgcagcccccggaaaagccagcuuuccucccgccgagcuccccgcuuuuuaauaaaauccagguagcgccgguuuaaagaaucccaaaucuccauauacagcccgggauuggaaaagguacauuacacaaccccccuuucaaguuccucucgcuggaucuaaaaaaaaaaaaaaaaaaaaaaaagcgaagggggggcuuaagggggacgggggaggggagccucgcaggcgaagaaacacgcauuguucccgggugcccgccccccccuucgggccagcccccggccgcagcgcauuggucccgcucgccgcccaucacgcgcauguaaacaccuuggcccucagccauuccuauaaaaccaauuacggaccucggggcuccag

SEQ ID NO: 10102 - RNA, 2501 nt, Mus musculus
cuggagccccgagguccguaauugguuuuauaggaauggcugagggccaagguguuuacaugcgcgugaugggcggcgagcgggaccaaugcgcugcggccgggggcuggcccgaaggggggggcgggcacccgggaacaaugcguguuucuucgccugcgaggcuccccucccccgucccccuuaagcccccccuucgcuuuuuuuuuuuuuuuuuuuuuuuuagauccagcgagaggaacuugaaagggggguuguguaauguaccuuuuccaaucccgggcuguauauggagauuugggauucuuuaaaccggcgcuaccuggauuuuauuaaaaagcggggagcucggcgggaggaaagcuggcuuuuccgggggcugcgggagcggggccgcgggagggcggaggaguuggcgcgccgcgcgcccggcccggggagcgguuuucuaccaaaaaaaggaaaggcgggcaaaaagugugaggcggcugcggguggcggaggggagcggcggccgagggauggcgggcaguacgggcgccuagccgcgccaggaaccgcggcgguugccggagucgccgucggagccuggagcccggagccccgccgcgccagguacgcuccgggccccgaugcuccccgaacuugugcagcguaccccuuggguccgcaaagcagaagguccccgaaacagucgggguccccagaagggaagcggagggcagggaucagggggagaggacgcaucgcugcgccuuggacucccacccgagcucucagucugcagcaccgccgagggcggcgguucccuacuugguucccggcaggcggcgggcuagcccggggacgccgagacgguuucgauuauaggcuguuuuuaauuaaaagccggaauucagccauuuuagcugcauuuaagaggggaaaaguagagaaggacgcaguggaaccccgcagauagccacgccagcuucucgaccauggcaaaggcugcuccguagggcuucaccccgacuuccuuaaaguggggcgccugggcucugccuuuuucaaaacgcugccuuuaaugaauauuaucuuuaaguguaugcgggaagcuccuggcgccuuugagacaaguaucccgggcugugacgauccuagauuuuuucaaaaguaaacgcgauucugguaaccagagccugauaaagagcgagggcgggcgagaggaagaggggguguuguaaccaaagccacguuaaaauaggcguccuuagcaaaguugggggaagaggacuuuugggucugggcguagggcggcuggucacccgggagcuguggcuuagucuccgucugcuagagcgccccgguucucccggaaccagggggucuagaguagccuggggcugguagucagggagggaagggugggcucucugagaccucccuacccccucgggaacaggaaagcgacagaucuuuuaaacaaacagcuuaaauaggacuuacaggaggguuuacccgaugcuggggaggcgccccuccgcuggcccgcgcuguuaaguuauuuuuuuuccuuuguagguuauuuugggggugugugggucacaaagcuaggguagaauugagaucuuuggagaccccuucuuucuucucugaugauccccaaauccuccacaccaagccacguucuccgggcaucgguauucccaggcccgggcguuggaaaaugaaaccaaaucuuguuuugaaggagucuuuuuccaguucacgggcgagaaugccacgucucggggacucggauucugcgacucccaauggcccaacgggggcagcaggaggggggcggugaucuuccuuuaaaaauaaacccguuucguaucugaccuugguaaacaacaacaaaaagccccuaaaccgaacaccccuuuuauuauuauuauuauuauucgcggcucacaaggagaaaaaaaaaagggagacgagggcccuaaaaagguuaaacauuaaacuuugcgaaucagauaguugguauggcguuauggacacauuucaaccaacucaaaagcauucgaaguuuuaaaccuccagagcuugugacgccugaaaaauaaacuacggguuuggauuuagcugaacgggcgcggucuguugaguggccuuccccaguuagggagaacuucguaggcaagagacggggcugggacacagcgagccgggccgcuucccugagccacgucccugggaacccugaacugcuggaggaaggacccuagguuuucgcauuucgaggagagggggcggcuacucccgauuuuauuucuggccaccagcucgguucgcuacucuccuacccugaagggcgaggcgacuuucugaaacuuguuuucuuuuuuuucucuuuccccuccccuuuucccccuucccucuucugugucuuccgcggucuucccucaccaaagauaccguguacgccuccuuccucaucuccgcucagccgcccggaggggacucaccgcggg

SEQ ID NO: 10103 - RNA, 2501 nt, Mus musculus
acagacuguccgccucugcaaucgaccgucgugcuucccgcgccagaacaaggaagcccacgcgagccgcguagguggcucgcguggaagacccggguucgagucccgcugggagaauuccuccuaggcaaguggagucaucucggucaggauuucucagccggaagccgcgccaacaccucucaucgugggcggcaaguuguccccggggcuucuuugaccgugcggggccagccgacgcuuucucugaccguuuccgaagcccaguuuccuuuccuaaggagccuuggggauccugcacucgcgucucugaaacccaacccacgacagaacccagccgccugggccagcuuagcaaugcgcccgcgccccgcccuccgcgugacgcgaacgccggcggaccaaucagagagcgcggcgcgagccccacgcgccuguggccccacccuccaagcuuaagaaagggcgcgcgggcagagcccgggccagaacgccgcgcaaagcggagagcggguuuuugcgacggcaggcggcgcuugugcugccguuuccgugcugcacgcgguucccucgagugccgcgcucggacagacguagccggccgcgaaggcgcccagacggcaaaccagcgacccaugcugaagugagcacacaggucagcgagaugcuggcgcugcugaccgucggcguggcgcucgccguggccgccggacgagcccaggacagcccgauaccuggcagccgcuucgugugcaccgcguugccccccgaagcggcgcgcgccggcugcccgcugcccgcgaugcccaugcagggaggcgcucugagccccgaggaggagcugcgagccgcugugcugcagcugcgcgagaccgucgugcagcagaaggagacgcugggcgcccagcgagaagccauccgagagcucaccggcaagcuggcccgcugcgaggggcuggcgggcggcaaggcgcgcggcacaggcaaggacaccaugggcgaccugccgcgggacccgggccacgucguggagcagcuuagccgcuccuugcaaacccucaaggaccgcuuggagagccucgagguaccugugcgcgguggcaucuagcggguggugguccccgggaucgugggacugaggaugcgggagaaauggguacgugggcuggccgggcgcccccauccacggggagagcugaguucgggggugcaagucucgcuccuacucuggaccuuacugugauggccucccgucuccuuguccucuucuguccccacguucgaugggaaaggugaaauucucacccccaucuccauuccgucgcgcgcggggacuuacccacuagacucaccgugaacuuaccgagguuuuuaccuaaagaacccagacugccaagccuggagggcaaaacccggugaccccggcagccuguuuccucuuugcaaaccuccacuuucagaagcgggacacgcuccugcuggcuguacccagugcugagacugccaccggaggucagcugccccugggcaucugguguuuucuuugacaaauugcgucggggugugggaggacuggucuugacugaucugcaggauaguggagggggaaagccagcgaccccaggauguaagcaagccccuuauuaaccucaaagacgccucuucacagagucagcuuuuuuuuuuuuuuuuuuuuaaagaugcccuuagcuaugacuuuaggggaacggacuuuaucucgcuaucuucucccguggguaauuuggaacuuugggggagaaaucaucaauuaauuuucaucuuacuucccaccuuguuuaagaaguguggacauuucuguuaacagcguuuaucaaaaauaccuauuagcaaaaaugagguuuaaauuacagguguuaauuauugcuaaauuaucggaguguugcuuuuggcaugauugcuauauacaguauucccagcaucuguggguccaugagucaugauuacugagagcucacacuuuuugaguucuaagugugacucaggcagaguauuuaauuuuaacccuuguaauagagaauggcucgaggcagguccaguuuucuacaguuuauaaucugguacacugggacacagggauucaggcgcuugccaagggcucauggcugaggguggcuggcagccuccgagccagcgugauggcagaggagugagagaaauaggaagugaggguuuggauacauuaaaaacggagcugucugggguuuaguaacguauuauaccugaccuuuuccaggaauauggcagagcccguuugcccuuguaccauuuuggaacuuggggaccguguucauuucuagaugaaagcucgcuggcuuugaguaccauugauuaacuguuugaaaaaaaaaucuuaacuguguuuugggcuuuuuaugacauagaauuguagauguuggccaaauuuuuaggcuuuuugguaagagaagaaaagcagcuuuuucgagaggagaaagugagau

SEQ ID NO: 10104 - RNA, 2501 nt, Mus musculus
aucucacuuucuccucucgaaaaagcugcuuuucuucucuuaccaaaaagccuaaaaauuuggccaacaucuacaauucuaugucauaaaaagcccaaaacacaguuaagauuuuuuuuucaaacaguuaaucaaugguacucaaagccagcgagcuuucaucuagaaaugaacacgguccccaaguuccaaaaugguacaagggcaaacgggcucugccauauuccuggaaaaggucagguauaauacguuacuaaaccccagacagcuccguuuuuaauguauccaaacccucacuuccuauuucucucacuccucugccaucacgcuggcucggaggcugccagccacccucagccaugagcccuuggcaagcgccugaaucccugugucccaguguaccagauuauaaacuguagaaaacuggaccugccucgagccauucucuauuacaaggguuaaaauuaaauacucugccugagucacacuuagaacucaaaaagugugagcucucaguaaucaugacucauggacccacagaugcugggaauacuguauauagcaaucaugccaaaagcaacacuccgauaauuuagcaauaauuaacaccuguaauuuaaaccucauuuuugcuaauagguauuuuugauaaacgcuguuaacagaaauguccacacuucuuaaacaaggugggaaguaagaugaaaauuaauugaugauuucucccccaaaguuccaaauuacccacgggagaagauagcgagauaaaguccguuccccuaaagucauagcuaagggcaucuuuaaaaaaaaaaaaaaaaaaaagcugacucugugaagaggcgucuuugagguuaauaaggggcuugcuuacauccuggggucgcuggcuuucccccuccacuauccugcagaucagucaagaccaguccucccacaccccgacgcaauuugucaaagaaaacaccagaugcccaggggcagcugaccuccgguggcagucucagcacuggguacagccagcaggagcgugucccgcuucugaaaguggagguuugcaaagaggaaacaggcugccggggucaccggguuuugcccuccaggcuuggcagucuggguucuuuagguaaaaaccucgguaaguucacggugagucuaguggguaaguccccgcgcgcgacggaauggagaugggggugagaauuucaccuuucccaucgaacguggggacagaagaggacaaggagacgggaggccaucacaguaagguccagaguaggagcgagacuugcacccccgaacucagcucuccccguggaugggggcgcccggccagcccacguacccauuucucccgcauccucagucccacgaucccggggaccaccacccgcuagaugccaccgcgcacagguaccucgaggcucuccaagcgguccuugaggguuugcaaggagcggcuaagcugcuccacgacguggcccgggucccgcggcaggucgcccaugguguccuugccugugccgcgcgccuugccgcccgccagccccucgcagcgggccagcuugccggugagcucucggauggcuucucgcugggcgcccagcgucuccuucugcugcacgacggucucgcgcagcugcagcacagcggcucgcagcuccuccucggggcucagagcgccucccugcaugggcaucgcgggcagcgggcagccggcgcgcgccgcuucggggggcaacgcggugcacacgaagcggcugccagguaucgggcuguccugggcucguccggcggccacggcgagcgccacgccgacggucagcagcgccagcaucucgcugaccugugugcucacuucagcaugggucgcugguuugccgucugggcgccuucgcggccggcuacgucuguccgagcgcggcacucgagggaaccgcgugcagcacggaaacggcagcacaagcgccgccugccgucgcaaaaacccgcucuccgcuuugcgcggcguucuggcccgggcucugcccgcgcgcccuuucuuaagcuuggaggguggggccacaggcgcguggggcucgcgccgcgcucucugauugguccgccggcguucgcgucacgcggagggcggggcgcgggcgcauugcuaagcuggcccaggcggcuggguucugucguggguuggguuucagagacgcgagugcaggauccccaaggcuccuuaggaaaggaaacugggcuucggaaacggucagagaaagcgucggcuggccccgcacggucaaagaagccccggggacaacuugccgcccacgaugagagguguuggcgcggcuuccggcugagaaauccugaccgagaugacuccacuugccuaggaggaauucucccagcgggacucgaacccgggucuuccacgcgagccaccuacgcggcucgcgugggcuuccuuguucuggcgcgggaagcacgacggucgauugcagaggcggacagucugu

SEQ ID NO: 10105 - RNA, 2501 nt, Mus musculus
aauuuuuuaguuguuuauauuugagaccggguuuuacguaguccaaacuggccuugaacucaaacccucuaugugaccaagaauaaccuuaaacuucugacccuccugccucuacccgcuaagcgcuaggauagcaugccagugugccaccacacucaguguacaggaugcugaagaucaaaaucaggguucucauuaggacuguuugacaaagacacaaaaagggaucucuuucccauuguccuagaaacauccagccaauugaaacuuuugcucuuucgguggcucagauucaugcucuaggcuggugcuccagacuggaggcugccuccaggacacggcaaauacaauuugagcaaaggccuccccugggcugcaccgggaggaacccgcgcagcugggcgggcagagcgcgucaggcagccuugaggagcgcacgcccgcgggugacaguccccugcucgggcgcugcucccacccuuccaggaaggggcggggaaaaggaggcgccagaggcagccaccgcgcucccggagcucuuuaaaauccaagagccugggcagcaccgcuggccgcgccacaucccggcgcuguuguguccgcgcguauccaggcggcucucgugcaacgcggucucgggacgcgcccaugcggccgcucaccaugucugggcacuuucugcuggcccccaucccggaguccuccucugacuaccuccugcccaaggacaucaagcuggccgugcugggagcggguugugugggcaagagcgguaagugggacaaaggcgcgcaaagccgcccagggacagcggagggucuucacccgcagggaugccgggaugccgggaugccgggaugcaggaagaccccugccuguugcuucagagguccauuucugagcucuggacgggguuggugccuguugagugucgcucuaguccgguccaucacauuccgcggggaaaggcacuccgcgguggcggggcuuugucccgggaaccuggggggacgcgugcuguuccuuugagggcccaguuuggaacagcuugacccacuucuucagcugauuuuccuacuuuauuuuuucagcaaugauugugcgcuucuugaccaagagauucaucggcgacuacgaacccaacacaggcaagaauguuuccgugcuuccuggcucuuguacuuguaucucuuugcccuccccaccccucucucuuuauuuugcucauggggccgugggaacuuagaugcaaauuccucuucguuguacaggcaaacuguauucgagacucgucuauguggagggggaccagcuaucccuacagauccaggacacuccgggaggcauucagguaaggacugucaggaggguauguggugcaggcugagguguuuggcuccaggaucucagugagaugucucagcaugcccaauauguaggugugggcacacaaggugugcugaggguugggauguuggaugcccuccuagguggcaagaaaugguugauuagaacuaguuuccucuuaaaugcuaauuauaauuaguuaauuauuuuaaagauugcuguguagcccuggcugguuuguaguucagguuugcuuggacuccuuauaaucuuugaugccucagccucccaaguguugggauuacaggcugagccacccccucccagcaguagcccugacugaccacuggugcccgagcugccuaggcgggcgggcauugacacuuucagagcacauccugggacaaucuaaaaaccacagccuuggaacuaaggguccaguucaguaguaaggauuccuggguuccagcaccacacugaaaaaagcauggaguaggugggauucuggagggagugggguuugcguccuggcuagggcugucccccucucccccccccaaaaaaagcuagggaauguuuucucaagccaguaauugcaaucagauaaccuuuuggcuaucacuguggaaugcaacuuaacuaauugcucagcccuucuagggaggaaaagguugaguggagagcccagagaauggaauuuguuucugcaacauucucaagaaguugacugcuaaaaauauuuuuuuaugggcuugggaauagauauuuauguugggcuguuuccaggguuuuguuuguuaugaauuaguucccugaaaacgaagccguucuggucuguaauuauucuuaagugguuagaguucacuggagacugccuguggaaaaaguagguuaccagucuacauccaggccagcucagaaaauaauccagguugagcacuugucugaggcuuucugcagaaagccucuuguagaagcuagggagagccagacagcaauacucagugaucucucuguccaguguuccuacaggggcuacuccggugucauguuugagcuucuuugaccagauuccauuuuguuuuuucccaggcccaagacagccucagucaaaugguggauucucugaccaaaagugugcacugggcagaggg

SEQ ID NO: 10106 - RNA, 2501 nt, Mus musculus
cccucugcccagugcacacuuuuggucagagaauccaccauuugacugaggcugucuugggccugggaaaaaacaaaauggaaucuggucaaagaagcucaaacaugacaccggaguagccccuguaggaacacuggacagagagaucacugaguauugcugucuggcucucccuagcuucuacaagaggcuuucugcagaaagccucagacaagugcucaaccuggauuauuuucugagcuggccuggauguagacugguaaccuacuuuuuccacaggcagucuccagugaacucuaaccacuuaagaauaauuacagaccagaacggcuucguuuucagggaacuaauucauaacaaacaaaacccuggaaacagcccaacauaaauaucuauucccaagcccauaaaaaaauauuuuuagcagucaacuucuugagaauguugcagaaacaaauuccauucucugggcucuccacucaaccuuuuccucccuagaagggcugagcaauuaguuaaguugcauuccacagugauagccaaaagguuaucugauugcaauuacuggcuugagaaaacauucccuagcuuuuuuugggggggggagagggggacagcccuagccaggacgcaaaccccacucccuccagaaucccaccuacuccaugcuuuuuucaguguggugcuggaacccaggaauccuuacuacugaacuggacccuuaguuccaaggcugugguuuuuagauugucccaggaugugcucugaaagugucaaugcccgcccgccuaggcagcucgggcaccaguggucagucagggcuacugcugggaggggguggcucagccuguaaucccaacacuugggaggcugaggcaucaaagauuauaaggaguccaagcaaaccugaacuacaaaccagccagggcuacacagcaaucuuuaaaauaauuaacuaauuauaauuagcauuuaagaggaaacuaguucuaaucaaccauuucuugccaccuaggagggcauccaacaucccaacccucagcacaccuugugugcccacaccuacauauugggcaugcugagacaucucacugagauccuggagccaaacaccucagccugcaccacauacccuccugacaguccuuaccugaaugccucccggaguguccuggaucuguagggauagcuggucccccuccacauagacgagucucgaauacaguuugccuguacaacgaagaggaauuugcaucuaaguucccacggccccaugagcaaaauaaagagagagggguggggagggcaaagagauacaaguacaagagccaggaagcacggaaacauucuugccuguguuggguucguagucgccgaugaaucucuuggucaagaagcgcacaaucauugcugaaaaaauaaaguaggaaaaucagcugaagaagugggucaagcuguuccaaacugggcccucaaaggaacagcacgcguccccccagguucccgggacaaagccccgccaccgcggagugccuuuccccgcggaaugugauggaccggacuagagcgacacucaacaggcaccaaccccguccagagcucagaaauggaccucugaagcaacaggcaggggucuuccugcaucccggcaucccggcaucccggcaucccugcgggugaagacccuccgcugucccugggcggcuuugcgcgccuuugucccacuuaccgcucuugcccacacaacccgcucccagcacggccagcuugauguccuugggcaggagguagucagaggaggacuccgggaugggggccagcagaaagugcccagacauggugagcggccgcaugggcgcgucccgagaccgcguugcacgagagccgccuggauacgcgcggacacaacagcgccgggauguggcgcggccagcggugcugcccaggcucuuggauuuuaaagagcuccgggagcgcgguggcugccucuggcgccuccuuuuccccgccccuuccuggaagggugggagcagcgcccgagcaggggacugucacccgcgggcgugcgcuccucaaggcugccugacgcgcucugcccgcccagcugcgcggguuccucccggugcagcccaggggaggccuuugcucaaauuguauuugccguguccuggaggcagccuccagucuggagcaccagccuagagcaugaaucugagccaccgaaagagcaaaaguuucaauuggcuggauguuucuaggacaaugggaaagagaucccuuuuugugucuuugucaaacaguccuaaugagaacccugauuuugaucuucagcauccuguacacugagugugguggcacacuggcaugcuauccuagcgcuuagcggguagaggcaggagggucagaaguuuaagguuauucuuggucacauagaggguuugaguucaaggccaguuuggacuacguaaaacccggucucaaauauaaacaacuaaaaaauu

SEQ ID NO: 10107 - RNA, 2501 nt, Mus musculus
acuaagcgaaagcgauacacuugguggaacugggguggggggaacgagcaaggaagaaguaacagaaagaaagggaccaggaucaagugggcagaggagaugggugugcgcccacggggaucugugcaagcgaggcagcacgggugcggaaaucaauaagauaaauggaccgaucgccagcgcaaagccaaaggaaaguaagaaauaaagagaaagaaaagaauauuaaaucgcgggagaaugagaaaauaaacccgaaaagggaagaggaggggggcgagugcgccuguuacggcgugggugggguugacaagaauagaguacauuaugcaguucauuuaguuaacaagugaaauaaugaggaagcgugcagagugaaugccaagagaaagggcacaaaaacccuauugagaggccccggccgcuccuggcguagcccaucacauggcaauaguccuauuuaagcggcgccgccggcgucuuucagcaccacuagcgcuggccagcaccucgcccgcuccgggaggugcccgcagcagcagccaaggugauuccagcccgggcuugagccgcgcguggagccuccggggcccgggaagcugcggguggccgcggccaggggaagcuacgacaggaucugcaguucccucgggcuccaggggcgggcuggcggcagguggaccgcgcgccggagccaugccgcgcuccuuccugguggauucccuugugcugcgggaagccagcgacaagaaggcuccggagggcagcccgccaccgcucuuccccuacgcggucccgccgccgcacgcgcuccacggccucucgccgggcgccugccacgcgcgcaaggccggcuugcugugcguguguccccucugugucaccgcuucgcagcugcacgggccccccgggccgccggcacugccgcuacucaaggcguccuucccucccuucggaucgcaguacugccacgcaccccugggccgccagcacuccguguccccuggagucgcccacggcccggcugcggccgcagcagcugcugcacucuaccagaccuccuacccgcugccggaucccagacaguuucacugcaucucuguggguaagcgggguccccgcgcgaaauuggggggcgguggucccgggguggggggaagugagugagcuagggauggggaaacggcgcgcuaugggggacggugaggauacucgaggggcgcucacagugcuagacugggaccggacguaggaaccggggagaagccagaaagauccuggggcgaaggggaagggguuaaggccagcuuugagauguuccuuaaagggguguuagggacaaccgauuccgaggagaauuggagucugugacuuggcaaggaggcacccgccuguggagugaugaauggaaggauggaagggaugugugccugauuccaagguugaggcuagccucaguucagcgggaaauuaggcccaaggcucagagguuugaugaucucucucucucucucucucucucucucucucucucucucucucucucucuuucccucccucccccccccccccaucgcccuccagacagcagcucgaaccagcugcccagcagcaagaggaugcggacggcguucaccagcacacagcuccuggagcuggagcgagaguucgccuccaacauguaccucucccgccugcggcgcaucgagaucgcgaccuaucugaaccuguccgagaagcaggugaagaucugguuucagaaccgccgggugaagcacaagaaagaaggcaaaggcaguaaccaccgcggcggagcuggggcgggggccggcgggggcgcaccgcaaggcugcaagugcucuucgcucuccucagccaaaugcucagaggacgacgacgaauugcccaugucuccaucuuccuccgggaaggaugacagagaucucacagucacuccguaggugcgccuuuuagaggaccauugguuuccccaccccccaccccgacccuucccgcacugguccccaggcacccgcuggccaaccgacggauuucguugggcuuugcgguggugcgcagcuuuaggcagagcuaagaccuuagcagacacuugaagacagugccccugucccuugggcuucaggguguuuaggaggacuccaagcgaugaaggcugaguccuccuccuaggacacagccucuucucccaggcacgcaggccggagcacagcgccuugcugaccgccagcgccucuucgccugccaacucugggcugguucaagcuuccucgguuccacuauucucuccuucucggucaaucugggcuuuucacuccgcgaguggcuguuugcuuuucuuuuaacauuucuuucuugcccccaacucgucuccccccacugugguccuuuaugcaacacgucuauggacuuaacuuuuccuucccuccucaggaagucucucccuucuguccguuugucccuuaaacagggaucaggucuug

SEQ ID NO: 10108 - RNA, 2501 nt, Mus musculus
caagaccugaucccuguuuaagggacaaacggacagaagggagagacuuccugaggagggaaggaaaaguuaaguccauagacguguugcauaaaggaccacaguggggggagacgaguugggggcaagaaagaaauguuaaaagaaaagcaaacagccacucgcggagugaaaagcccagauugaccgagaaggagagaauaguggaaccgaggaagcuugaaccagcccagaguuggcaggcgaagaggcgcuggcggucagcaaggcgcugugcuccggccugcgugccugggagaagaggcuguguccuaggaggaggacucagccuucaucgcuuggaguccuccuaaacacccugaagcccaagggacaggggcacugucuucaagugucugcuaaggucuuagcucugccuaaagcugcgcaccaccgcaaagcccaacgaaauccgucgguuggccagcgggugccuggggaccagugcgggaagggucggggugggggguggggaaaccaaugguccucuaaaaggcgcaccuacggagugacugugagaucucugucauccuucccggaggaagauggagacaugggcaauucgucgucguccucugagcauuuggcugaggagagcgaagagcacuugcagccuugcggugcgcccccgccggcccccgccccagcuccgccgcggugguuacugccuuugccuucuuucuugugcuucacccggcgguucugaaaccagaucuucaccugcuucucggacagguucagauaggucgcgaucucgaugcgccgcaggcgggagagguacauguuggaggcgaacucucgcuccagcuccaggagcugugugcuggugaacgccguccgcauccucuugcugcugggcagcugguucgagcugcugucuggagggcgaugggggggggggggagggagggaaagagagagagagagagagagagagagagagagagagagagagagagagagaucaucaaaccucugagccuugggccuaauuucccgcugaacugaggcuagccucaaccuuggaaucaggcacacaucccuuccauccuuccauucaucacuccacaggcgggugccuccuugccaagucacagacuccaauucuccucggaaucgguugucccuaacaccccuuuaaggaacaucucaaagcuggccuuaaccccuuccccuucgccccaggaucuuucuggcuucuccccgguuccuacguccggucccagucuagcacugugagcgccccucgaguauccucaccgucccccauagcgcgccguuuccccaucccuagcucacucacuuccccccaccccgggaccaccgccccccaauuucgcgcggggaccccgcuuacccacagagaugcagugaaacugucugggauccggcagcggguaggaggucugguagagugcagcagcugcugcggccgcagccgggccgugggcgacuccaggggacacggagugcuggcggcccaggggugcguggcaguacugcgauccgaagggagggaaggacgccuugaguagcggcagugccggcggcccggggggcccgugcagcugcgaagcggugacacagaggggacacacgcacagcaagccggccuugcgcgcguggcaggcgcccggcgagaggccguggagcgcgugcggcggcgggaccgcguaggggaagagcgguggcgggcugcccuccggagccuucuugucgcuggcuucccgcagcacaagggaauccaccaggaaggagcgcggcauggcuccggcgcgcgguccaccugccgccagcccgccccuggagcccgagggaacugcagauccugucguagcuuccccuggccgcggccacccgcagcuucccgggccccggaggcuccacgcgcggcucaagcccgggcuggaaucaccuuggcugcugcugcgggcaccucccggagcgggcgaggugcuggccagcgcuaguggugcugaaagacgccggcggcgccgcuuaaauaggacuauugccaugugaugggcuacgccaggagcggccggggccucucaauaggguuuuugugcccuuucucuuggcauucacucugcacgcuuccucauuauuucacuuguuaacuaaaugaacugcauaauguacucuauucuugucaaccccacccacgccguaacaggcgcacucgccccccuccucuucccuuuucggguuuauuuucucauucucccgcgauuuaauauucuuuucuuucucuuuauuucuuacuuuccuuuggcuuugcgcuggcgaucgguccauuuaucuuauugauuuccgcacccgugcugccucgcuugcacagauccccgugggcgcacacccaucuccucugcccacuugauccuggucccuuucuuucuguuacuucuuccuugcucguuccccccaccccaguuccaccaaguguaucgcuuucgcuuagu

SEQ ID NO: 10109 - RNA, 2501 nt, Mus musculus
ucgaaaacuguaagcaaacccccgagaaagucuuucuuuuauaaaaguugcuuuggucacagugucucuuuacugcaauagaaaaguagccaaggcaaccaauaacaacgucagcaacaagacuguguccugcugcucuaugaacuccucggccauaauggaagagacagucucucguuuguugucauauugaaauccucucuuugaaguagcagugcccaacacaaauaaagccacauguacgugaggccuggagucugagccccagcacugaaggagaggggugggguauaacagugauuugcucuuuguaaaucucaccaacuggcaaaagugauauagagugaguuugaggaguggggguaacuuggaagcugagucacucuaugucuugacguacagugguuauguagguacacugauauauaacaacuggggaguggacacagaagauuuugcacauguguugcgcuuugaaucuggagagggacuaagacauuuccuacgaaggaguucagugcgguuugagcauggcugcaaguccuacucugauucugaguuacuucccuagaacccuuuagcccuuuagaaaaaucaucucugcuaugggaaagucacuaaucuaaucucauacacagccaaagcuaaccauuuugcauuaauagagccugaaaagaaaagcacgccacgccaugcguuugagaugucccugugcaucaacucgcuuaagaaagguacagcguucuccccauccuuuuccuuuauagccuacauuuuuuaauuuuaucaucuuuuuuuuuaaaguaauuggaaaccguuucugcucauuuaauguugcaaaauguuuucucuauuugucacggaagguucaagccagaauccuaaauguuggaaaugaaggggaaauaggccacugggcagacugaggccaagccaggagugccucagaaggcugcaaaacuagggcagggccugaucuccccccacccccacccccgacuucuagaacugucuccaacuccaacucaauccaacccccuugucuucccaaacagaaagcugacgcgagaccgauuagaacugggcagaauggggacuuuccccccuauaguuaguuacuauuuucaaucacagcuaugcuucuacccgaacaggcaacuugggagaguaguccuaggaguccuugaaagugucacuaggguuuaauccuaaaauaagaaaaguauggagaggggaaggguagcuaguuuuuaaauuuauaaaucuguuuugcauaguauuuccaaaguaacuagccacugagugaagcgaaaauugguacaggugggggucguuagcagggaugaccgcucuagcagaggaugcucgcaguuuucccauuaguuugcucugucagccuacaucucaaagaggugagaacgcaccggcucgagaaucuauaguacccagaggucgggucagggagucucgggccaccugcgcugcugaagaagacucucagaggcugacggagcauccaagcccaagcccaggcgcgguggccuggggacugagcugcagaggagcgcugcggaggagggugagggcaggggugggcaaaccaaagccaaguucaccgcuugaaaggggggacgugaaagaggggagugaugcggcggcgaggggagcgcgcgguggguaugagggagugaugcgcgcucggccggggugcagagggggugaggggccuuaccaagcagcagcagccgccggucgcugcgcugcgccaacgcccgcauggccuccggagcgcgcgguagccaggccgccggcccagccugugaugcggucccagcggcgcgccccgggcugcagguggcucgcugaaggaugcgcgucacugaccacagauucccucggacuggugcagagcagagggggaggaaccucucuccagaggccgcggccgcucgcugcuaggcgggcugaacuggcgcagugcugcagccgaucccacgugcccgccgugguccccagccugcgcuccuggcaccgggacugcggcaggggagacugggugcgguucggcuggggaaguugccuggacuccgugguugaguccccggaccucugcuuuaaacuccuaagggugagaagaguggugacacacagaccuccuucuucaugcgcggggaucuuugaugucccgugaugggcacugaaucggugccauacacugguaaccccgugaguuuuauuccacaucugguagaucugcauuguggacugauuuucuuugucucccuguccuuucuuauaggauguccaagauucccauccaccuccgacccagaaaagcagacgcgguuucaaggucaauaaauuagagagguuaaacagacacccaaacaaauuagaccgugcaccucaaaggauguuuggaguugucaccuccuaguucuggcuuuuagucucauagugucucuagguaacaauuauuucccgugcaucaagcugaauau

SEQ ID NO: 10110 - RNA, 2501 nt, Mus musculus
auauucagcuugaugcacgggaaauaauuguuaccuagagacacuaugagacuaaaagccagaacuaggaggugacaacuccaaacauccuuugaggugcacggucuaauuuguuugggugucuguuuaaccucucuaauuuauugaccuugaaaccgcgucugcuuuucugggucggagguggaugggaaucuuggacauccuauaagaaaggacagggagacaaagaaaaucaguccacaaugcagaucuaccagauguggaauaaaacucacgggguuaccaguguauggcaccgauucagugcccaucacgggacaucaaagauccccgcgcaugaagaaggaggucugugugucaccacucuucucacccuuaggaguuuaaagcagagguccggggacucaaccacggaguccaggcaacuuccccagccgaaccgcacccagucuccccugccgcagucccggugccaggagcgcaggcuggggaccacggcgggcacgugggaucggcugcagcacugcgccaguucagcccgccuagcagcgagcggccgcggccucuggagagagguuccucccccucugcucugcaccaguccgagggaaucuguggucagugacgcgcauccuucagcgagccaccugcagcccggggcgcgccgcugggaccgcaucacaggcugggccggcggccuggcuaccgcgcgcuccggaggccaugcgggcguuggcgcagcgcagcgaccggcggcugcugcugcuugguaaggccccucacccccucugcaccccggccgagcgcgcaucacucccucauacccaccgcgcgcuccccucgccgccgcaucacuccccucuuucacguccccccuuucaagcggugaacuuggcuuugguuugcccaccccugcccucacccuccuccgcagcgcuccucugcagcucaguccccaggccaccgcgccugggcuugggcuuggaugcuccgucagccucugagagucuucuucagcagcgcagguggcccgagacucccugacccgaccucuggguacuauagauucucgagccggugcguucucaccucuuugagauguaggcugacagagcaaacuaaugggaaaacugcgagcauccucugcuagagcggucaucccugcuaacgacccccaccuguaccaauuuucgcuucacucaguggcuaguuacuuuggaaauacuaugcaaaacagauuuauaaauuuaaaaacuagcuacccuuccccucuccauacuuuucuuauuuuaggauuaaacccuagugacacuuucaaggacuccuaggacuacucucccaaguugccuguucggguagaagcauagcugugauugaaaauaguaacuaacuauaggggggaaaguccccauucugcccaguucuaaucggucucgcgucagcuuucuguuugggaagacaaggggguuggauugaguuggaguuggagacaguucuagaagucggggguggggguggggggagaucaggcccugcccuaguuuugcagccuucugaggcacuccuggcuuggccucagucugcccaguggccuauuuccccuucauuuccaacauuuaggauucuggcuugaaccuuccgugacaaauagagaaaacauuuugcaacauuaaaugagcagaaacgguuuccaauuacuuuaaaaaaaaagaugauaaaauuaaaaaauguaggcuauaaaggaaaaggauggggagaacgcuguaccuuucuuaagcgaguugaugcacagggacaucucaaacgcauggcguggcgugcuuuucuuuucaggcucuauuaaugcaaaaugguuagcuuuggcuguguaugagauuagauuagugacuuucccauagcagagaugauuuuucuaaagggcuaaaggguucuagggaaguaacucagaaucagaguaggacuugcagccaugcucaaaccgcacugaacuccuucguaggaaaugucuuagucccucuccagauucaaagcgcaacacaugugcaaaaucuucuguguccacuccccaguuguuauauaucaguguaccuacauaaccacuguacgucaagacauagagugacucagcuuccaaguuacccccacuccucaaacucacucuauaucacuuuugccaguuggugagauuuacaaagagcaaaucacuguuauaccccaccccucuccuucagugcuggggcucagacuccaggccucacguacauguggcuuuauuuguguugggcacugcuacuucaaagagaggauuucaauaugacaacaaacgagagacugucucuuccauuauggccgaggaguucauagagcagcaggacacagucuuguugcugacguuguuauugguugccuuggcuacuuuucuauugcaguaaagagacacugugaccaaagcaacuuuuauaaaagaaagacuuucucggggguuugcuuacaguuuucga

SEQ ID NO: 10111 - RNA, 2501 nt, Mus musculus
cucuagagcucgccacgcugucacccuccuccccucacaccccagcccccuccagccugcagauggcccgcagggcacagagugaagcgggacuggacagcuccugccuuuucaucuucggccuccaggucccucaacaccugccccgccgcccggagaucuguaaagagcccacguagguguccuaaagugcuuccaaacuuggcaagggcgagagagggcggguggcuggggagggcggagguaugcagacagggagucagaguucccccucgaaagccucaaaaguguccacguccucaaaaagaauggaaccaauuuaagaagccccguagccacgucccuccccccucggcucccuccccugcucccccgcagucuccucccagcacugagucccgggccccuagcccuagcccucccauugguggagacguuuuuggaggcacccuccggcuggggaaacuuuucccauauaaauaaggcaggucugggcuuuauuauuuuagcaccacggcagcaggagguuucgacuaaguuggagggaacgguccacgauugcaugccugcgcccgccaggugauaccuccgcuggugacccaggggcucugcaacacaaggagucugcaugucuaagugguagacaugcucagcuuuguggauacgcggacucuguugcugcuugcaguaacuucgugccuagcaacaugccaauguaagugucuucugcuuguuugggggagaugaaggagagaggcuggauaggugggcacccuuaucucaacagagggaaacuucacacauucauuccacauacagcuugugaggucgcccucuaaucugucggagaaaacacuaggguucacgagauacaugggaaaagaauggaaauaugaaagacuugacuguugccaagaguugggggaaguuuuucccuuaaaacuagacuguuagcccggaugccccgguuggugaagcucacaaagaggcaaagaagguugccucaagauauaaaccuggcugacagcaugaacgacugagagggcuccacucuucaauucccagaauuaugcccguggucacguugugaaacuugaggccuaguuuagaaagccccguaauagaauaauacaaaacucacaggacuccauuuucuugugggcggccgaguugcucuggaugacguugaugaagauaaugauaaaaauacgcccccuggaggggguaaagugcaggaacagggaccaggccuuaagcgcuaggaauuccaauuaaagacuucccagguccauggaguaauuuacauuucugggccauauguaaagaacccagaugguguaucuugagaagcgggcugcuucggccucagcuuuuaucuucugaauagucaaagcagcgucccaauccauuaccugaucauggaaaugguaacuuuuaacuaaaauaagcucuguucacuuacacuucaacaaguucccaccuguaaucacacacgaaaacaacagaugugagaaauaucaacuucguccugagauucaagagccuggggauucuucucaggagucucuuacucguuuaccaugugacuucaaaugaaucaauugggccuuuuucuaaaaugugggguauauacuaaaugugccaacuucgaggcuauuuuccauuucuagguuguauaacuaacuagaauuuccugaagaaagaaugaagaaaaccacuuggguuucaucuuuuaaaauggcugccuaauuuaacuggacaaagauguuggcuugaugaguauucaggagggcguggccacacccagaccuucagcuacacgccccacgucugccacagccuaauuuugaauguguauauauuccuuucauccacuuuuauauaccccucgaggauacuaagaaguaauugcauuguacaaauuaauguuacaaguuaauuuuauaugaaaccagaguaagaggggauccccacagaaaaauauaguagacuuagggaaguagagauuugaaggucaacauacauuuuauucaacauccaaccacuaagaacaauaaagguuauccaacacacauuguccaaaauggcucacaaacugaguaauuaaaaggcacguuuccaaagccuguaaggcuuacuggcuucucuuaauucaggcaaacuguucuuccuucaauggagaaaauaaacuagacauaccauuuaucuaauugaacagugauucucaucaauugcccuaaaaugugaaugcaggaggugucccacucuucugagcagugaccacuucaacagauguucucauuccaaaugacacacuuugugaccaccaaauucaagcaauuuuuaggggugaaucauccuggagcaagucugaccgcaauuauaugccacaugauccuguaauuauuauacuguaggaaugaaacucagucuuuaaagucuuaggguaauuguagcaaagaaguggguauuuauuuuucucauuauuuuucaagauuuua

SEQ ID NO: 10112 - RNA, 2501 nt, Mus musculus
uaaaaucuugaaaaauaaugagaaaaauaaauacccacuucuuugcuacaauuacccuaagacuuuaaagacugaguuucauuccuacaguauaauaauuacaggaucauguggcauauaauugcggucagacuugcuccaggaugauucaccccuaaaaauugcuugaauuugguggucacaaagugugucauuuggaaugagaacaucuguugaaguggucacugcucagaagagugggacaccuccugcauucacauuuuagggcaauugaugagaaucacuguucaauuagauaaaugguaugucuaguuuauuuucuccauugaaggaagaacaguuugccugaauuaagagaagccaguaagccuuacaggcuuuggaaacgugccuuuuaauuacucaguuugugagccauuuuggacaauguguguuggauaaccuuuauuguucuuagugguuggauguugaauaaaauguauguugaccuucaaaucucuacuucccuaagucuacuauauuuuucuguggggauccccucuuacucugguuucauauaaaauuaacuuguaacauuaauuuguacaaugcaauuacuucuuaguauccucgagggguauauaaaaguggaugaaaggaauauauacacauucaaaauuaggcuguggcagacguggggcguguagcugaaggucuggguguggccacgcccuccugaauacucaucaagccaacaucuuuguccaguuaaauuaggcagccauuuuaaaagaugaaacccaagugguuuucuucauucuuucuucaggaaauucuaguuaguuauacaaccuagaaauggaaaauagccucgaaguuggcacauuuaguauauaccccacauuuuagaaaaaggcccaauugauucauuugaagucacaugguaaacgaguaagagacuccugagaagaauccccaggcucuugaaucucaggacgaaguugauauuucucacaucuguuguuuucgugugugauuacaggugggaacuuguugaaguguaagugaacagagcuuauuuuaguuaaaaguuaccauuuccaugaucagguaauggauugggacgcugcuuugacuauucagaagauaaaagcugaggccgaagcagcccgcuucucaagauacaccaucuggguucuuuacauauggcccagaaauguaaauuacuccauggaccugggaagucuuuaauuggaauuccuagcgcuuaaggccuggucccuguuccugcacuuuacccccuccagggggcguauuuuuaucauuaucuucaucaacgucauccagagcaacucggccgcccacaagaaaauggaguccugugaguuuuguauuauucuauuacggggcuuucuaaacuaggccucaaguuucacaacgugaccacgggcauaauucugggaauugaagaguggagcccucucagucguucaugcugucagccagguuuauaucuugaggcaaccuucuuugccucuuugugagcuucaccaaccggggcauccgggcuaacagucuaguuuuaagggaaaaacuucccccaacucuuggcaacagucaagucuuucauauuuccauucuuuucccauguaucucgugaacccuaguguuuucuccgacagauuagagggcgaccucacaagcuguauguggaaugaaugugugaaguuucccucuguugagauaagggugcccaccuauccagccucucuccuucaucucccccaaacaagcagaagacacuuacauuggcauguugcuaggcacgaaguuacugcaagcagcaacagaguccgcguauccacaaagcugagcaugucuaccacuuagacaugcagacuccuuguguugcagagccccugggucaccagcggagguaucaccuggcgggcgcaggcaugcaaucguggaccguucccuccaacuuagucgaaaccuccugcugccguggugcuaaaauaauaaagcccagaccugccuuauuuauaugggaaaaguuuccccagccggagggugccuccaaaaacgucuccaccaaugggagggcuagggcuaggggcccgggacucagugcugggaggagacugcgggggagcaggggagggagccgaggggggagggacguggcuacggggcuucuuaaauugguuccauucuuuuugaggacguggacacuuuugaggcuuucgagggggaacucugacucccugucugcauaccuccgcccuccccagccacccgcccucucucgcccuugccaaguuuggaagcacuuuaggacaccuacgugggcucuuuacagaucuccgggcggcggggcagguguugagggaccuggaggccgaagaugaaaaggcaggagcuguccagucccgcuucacucugugcccugcgggccaucugcaggcuggagggggcuggggugugaggggaggagggugacagcguggcgagcucuagag

SEQ ID NO: 10113 - RNA, 2501 nt, Mus musculus
gggcgucacgcgaggaggccccugggccaugacccucugucggcgucuguucgggcgcccgcagaggcuagacgcuugggcagggaagacgcuagccaagggcuccaaaguucaaagaccgacaagcaaacuauguuccuucacuacagcggcaagcggucggucggggcugcggcagacagagagccgauuauguaguccccauaaucucacugcagaucugagagggcacagaugugucugguuucuuucacaaauagacuuaauauguucuugaccaaaaaaaaaaaaaaaaaaaauccucucccuaugcaaggauacagagacagcaagaggagcagacucaaacuuccaucaacaauguauugcaaaggaaucuguaguaaggauauuuucguaguaaaggggaggaaccaaggaagaauucucacugucauaaauguaccccgcugggguccugugaauccguguuuugcuaaugugccccuaggccacauggccccuuuucccccuucaguccugaaaggaguggaagagucgguguaugaagcugcugccagaggaaggguggagaaggagggagggcugcggucuccgcucuacuggaguaggggaugcuaauauuagcagccuuauuaaugugucggugaggggagaucaaaaucgacuaguaaaauuucuccacugagacuucacgccucucauuuaccgcccaagcucucuaccccacuguaacgcucuaaggaaguuucacaguggacggaaaggggagucuguggggaagaaggaaggcagacaaauucuaggcacuuacggagagagcacucgauggagugugugugugugugugggggggggucccucuaacagagugaacucucggcaauccuccgcuauuuuaaaugacuuuuuguauuuggaaauaccuuggauaaaccgcaaaguucccuguucgcuuuucugucaggcugcagcccuccggcccccaggucacccggugugcugcccgcacccuccaugagaggccucggggcgcuucgcuggcuaauccagacuagaucucaccaacucagcacgcucacccagaauuccaacuaacuuuccuuuuauuacgcaaacaccacuagggcugcuugauuucacccaccccccgccccccaaaucccuuagccucuuugcagccaagcuggcuuucuggcuaggccagcuaggaauccagcuaaggagggauccucgagcagcgccagaggcaaaacacccgauuaaaccucuucaaaaguccuccacugcccccccccccaugccggugugaggugcuguccuguuugcagucccaggcccccacucgcuucugcgaagcacccuucuaugggugcggacagcguggcccucaucuaccacccaacuuggcgcccgcgggguuacggaugcccuggguaccugccucccgcccccgcgcgccuaccuggcuggcugguggcacucgggacgcgguuguaggcgccgccguacuggugguaggggcuggcguagccguagucggcauaagccuuggccggguagccggcugcggagccguucacgccgugguacugguacugguagggguugagcgcuuugccauaagaagcagagguaggagagcaguagccgugcggggcggcccccgcgggacuguaguagucagaaucgguggccgaggacucgggcaaaguuggcgauuccugagacggguggugcauggcggcggacgucgggaacggagcuuggaagucgccggaucggaugcuugggacucuucugucaaacacuccugucauagcucccgggcgguggcuguucuucuacugcggcggccgcugcugccugaauuggcuguggagcugcucuggucuaagcagacauggcugugggagcgagggaggaggaggaagaggaggaggcggcggcggcggcggggaggaggaggaggaggaggcugggagucguggaggcucugucucccgcaggcugacugcuggcugaggcgcagcacagccuugguuaaauccuuaauugcgcgcuuacgcacagcgggguggaucggguuccauuggccagggcuucgggagcagagcaacacccuaacucguccaacuaguuuuagcacaacaaagcauugcuuaaagagagagagagagagagagagagagagagagagagagagagagagagagagagagagagagaggcguacaaggagagagagagugugugugugugugugugugugugugugugugugagagagagagagagagagagagagagagagagagagagagagagagagagagaauaugaguuguucccuguugggggagggagggucucagucgaucucuuuuuagugaauagcuucgacaaaccaagcagucccagggccuagcuccgugcuguuugaagacaacguguuccaaucagcaaucucaaaaguacaguuuagaggaugcgguucuuga

SEQ ID NO: 10114 - RNA, 2501 nt, Mus musculus
ucaagaaccgcauccucuaaacuguacuuuugagauugcugauuggaacacguugucuucaaacagcacggagcuaggcccugggacugcuugguuugucgaagcuauucacuaaaaagagaucgacugagacccucccucccccaacagggaacaacucauauucucucucucucucucucucucucucucucucucucucucucucucucucucucacacacacacacacacacacacacacacacacacucucucucuccuuguacgccucucucucucucucucucucucucucucucucucucucucucucucucucucucucucucucuuuaagcaaugcuuuguugugcuaaaacuaguuggacgaguuaggguguugcucugcucccgaagcccuggccaauggaacccgauccaccccgcugugcguaagcgcgcaauuaaggauuuaaccaaggcugugcugcgccucagccagcagucagccugcgggagacagagccuccacgacucccagccuccuccuccuccuccuccccgccgccgccgccgccuccuccucuuccuccuccucccucgcucccacagccaugucugcuuagaccagagcagcuccacagccaauucaggcagcagcggccgccgcaguagaagaacagccaccgcccgggagcuaugacaggaguguuugacagaagagucccaagcauccgauccggcgacuuccaagcuccguucccgacguccgccgccaugcaccacccgucucaggaaucgccaacuuugcccgaguccucggccaccgauucugacuacuacagucccgcgggggccgccccgcacggcuacugcucuccuaccucugcuucuuauggcaaagcgcucaaccccuaccaguaccaguaccacggcgugaacggcuccgcagccggcuacccggccaaggcuuaugccgacuacggcuacgccagccccuaccaccaguacggcggcgccuacaaccgcgucccgagugccaccagccagccagguaggcgcgcgggggcgggaggcagguacccagggcauccguaaccccgcgggcgccaaguugggugguagaugagggccacgcuguccgcacccauagaagggugcuucgcagaagcgagugggggccugggacugcaaacaggacagcaccucacaccggcaugggggggggggcaguggaggacuuuugaagagguuuaaucggguguuuugccucuggcgcugcucgaggaucccuccuuagcuggauuccuagcuggccuagccagaaagccagcuuggcugcaaagaggcuaagggauuuggggggcggggggugggugaaaucaagcagcccuagugguguuugcguaauaaaaggaaaguuaguuggaauucugggugagcgugcugaguuggugagaucuagucuggauuagccagcgaagcgccccgaggccucucauggagggugcgggcagcacaccgggugaccugggggccggagggcugcagccugacagaaaagcgaacagggaacuuugcgguuuauccaagguauuuccaaauacaaaaagucauuuaaaauagcggaggauugccgagaguucacucuguuagagggacccccccccacacacacacacacacuccaucgagugcucucuccguaagugccuagaauuugucugccuuccuucuuccccacagacuccccuuuccguccacugugaaacuuccuuagagcguuacagugggguagagagcuugggcgguaaaugagaggcgugaagucucaguggagaaauuuuacuagucgauuuugaucuccccucaccgacacauuaauaaggcugcuaauauuagcauccccuacuccaguagagcggagaccgcagcccucccuccuucuccacccuuccucuggcagcagcuucauacaccgacucuuccacuccuuucaggacugaagggggaaaaggggccauguggccuaggggcacauuagcaaaacacggauucacaggaccccagcgggguacauuuaugacagugagaauucuuccuugguuccuccccuuuacuacgaaaauauccuuacuacagauuccuuugcaauacauuguugauggaaguuugagucugcuccucuugcugucucuguauccuugcauagggagaggauuuuuuuuuuuuuuuuuuuuggucaagaacauauuaagucuauuugugaaagaaaccagacacaucugugcccucucagaucugcagugagauuauggggacuacauaaucggcucucugucugccgcagccccgaccgaccgcuugccgcuguagugaaggaacauaguuugcuugucggucuuugaacuuuggagcccuuggcuagcgucuucccugcccaagcgucuagccucugcgggcgcccgaacagacgccgacagagggucauggcccaggggccuccucgcgugacgccc

SEQ ID NO: 10115 - RNA, 2501 nt, Mus musculus
accacuuuuuggacuauauggaauucccuuuaaaaacguauccagacuuuugguaagauaucuaggugugacucuuuccaaagauauauuaagaguaguugccccaacaaguuuucauaggcugugguggugacguauagaaaaaauguaaggcuugcacaguuaucuaaaauuccugcaaacuagcgguucccgaguagucugucauagucucuuaucuuccaguacaagcacgugcacuuauuuauauccuuagauuagcuucauguuacuuggcacuuguauacaggagcggcuuuuuuuuuuuuucuaauuucagauggaacuugagcuagaucaaagguauucgaagaaggucaauuuuuacuucucugaccaacagaggaugugaucucacgccguuaauucacgcugagccaaugcccuuuggcgccuuaucugguaguugagaaaacccaaucuagccauccccacccgcugggauaguaggacuuacccaaaagagcagguugagggcguagagcaagcagcgcaaacacuucacggaaucuucucuggccauugugagucuugggagggagaaaccccauccucucaccacauucuacugguccaggcagagccccggcgaucugcaggggcgggcacagcagagaacuaccuucacaagugaaccccucugccagcccucagcuggguccccaggauccccaagccuaguuuauuucagacguccucucaucgaaacucauuuguuagagucuuaaagggaauaaaacucccaaaaguccucacauggcaucggauaacaccugcugccaagagaaaagguuaacucucuggaugaauguacaguaaacuaguuuucccaggggaccaguggcauggcccuugagacuuucuuugcugucuccugggggacagcuuugugacucuggagaugccacaggcuccagugcuaucccuauucccaaggacggacacacacacacaucgaccucucggagcacaggaaugcccuucucugggcagcuccugggcccuaccucccugcucccaccccaccaccgggucgcacagcucgggugugaacucgggagccacugggggcgcagcacagagcugggaucccgcccggugacuaggguuucuuuggaagaacgugagaaaugcaguuuguccuccgggaauaauggaugagccuggggcgggauggcggggaggagaaauuggggagucagggccggugcggcaguacccaagccggaccggucaucauucacuaccacccccgcccccccggacgcgcaaccucggggucccgcgugccgccgcgacacugagguccccgccgcccgcagagcacaaagccugcgcggucaggcaaagucaccggcggccgcacgcccccggcaggacgcaccgcgcagggcagaagccacuccggcaggcggcagggaccgcgggcaggagagaugugggacuuguggccacucaccguucgagcugcgcuccugccggggaacagucggggacacacagcagacacucauccgggcagggacgcuccucccggagagccaaagggaugcaucggcgccagcagcagacgcuuccuugucuuccucucuccaaccgucggcgucgcuaacuccugggaaaaagaaaaaagaaaaaaaaaaaaaaaaaaaaaaaaaaaaaaaaaagucccgggcagcagacgcuggaaagucucugcuaagccaccucccaacgccgcugucccucccaaguccucgccaaguccggacaaggcagcagcggcagccagggccagcugcacaaacucucagcgcaugcucggccgcuggcugccggguuggguccuaguggguguuucuugucccucuuacccagagugacaccccagagagauucuucaccucugcgagauagaaugccggagagauuaaaaaccugcaaaacuaggaggaguccuugcagcacaccccuuuaaaaugguaccgucgugggaauggaggguggguuauaaggaagcaggcuuuuuauuauaugaaaauauuuguguuugagaaggggggccaccgguggcccaacccaauuccugcaaugagagacgaguuuucaggaccuuuguggagccgccuccggugacuugucauuaauguccugcccugugaaccuuauugauuuguugcacuccccgaucaaaaguagguaaauaaauauauaaaauaacauuucuuucccacucugaucuacuaacauuugcaaaaaccaucaauguaucucuauacagauuuagcauccagauagggaaaagaucaggcaauucuuucacaaguuuccaaaguuuuuaaacuuucuccugauacuguggugucuuggcaauguuggugauuuaaucuggaaaggcacauaggguagugaaucuuuggaagccgccuugauuuuuuuuuuuuuuuaacuagagauucaguaggguaucacaggaaccacau

SEQ ID NO: 10116 - RNA, 2501 nt, Mus musculus
augugguuccugugauacccuacugaaucucuaguuaaaaaaaaaaaaaaaucaaggcggcuuccaaagauucacuacccuaugugccuuuccagauuaaaucaccaacauugccaagacaccacaguaucaggagaaaguuuaaaaacuuuggaaacuugugaaagaauugccugaucuuuucccuaucuggaugcuaaaucuguauagagauacauugaugguuuuugcaaauguuaguagaucagagugggaaagaaauguuauuuuauauauuuauuuaccuacuuuugaucggggagugcaacaaaucaauaagguucacagggcaggacauuaaugacaagucaccggaggcggcuccacaaagguccugaaaacucgucucucauugcaggaauuggguugggccaccgguggccccccuucucaaacacaaauauuuucauauaauaaaaagccugcuuccuuauaacccacccuccauucccacgacgguaccauuuuaaaggggugugcugcaaggacuccuccuaguuuugcagguuuuuaaucucuccggcauucuaucucgcagaggugaagaaucucucuggggugucacucuggguaagagggacaagaaacacccacuaggacccaacccggcagccagcggccgagcaugcgcugagaguuugugcagcuggcccuggcugccgcugcugccuuguccggacuuggcgaggacuugggagggacagcggcguugggagguggcuuagcagagacuuuccagcgucugcugcccgggacuuuuuuuuuuuuuuuuuuuuuuuuuuuuuuuuuucuuuuuucuuuuucccaggaguuagcgacgccgacgguuggagagaggaagacaaggaagcgucugcugcuggcgccgaugcaucccuuuggcucuccgggaggagcgucccugcccggaugagugucugcuguguguccccgacuguuccccggcaggagcgcagcucgaacggugaguggccacaagucccacaucucuccugcccgcggucccugccgccugccggaguggcuucugcccugcgcggugcguccugccgggggcgugcggccgccggugacuuugccugaccgcgcaggcuuugugcucugcgggcggcggggaccucagugucgcggcggcacgcgggaccccgagguugcgcguccgggggggcgggggugguagugaaugaugaccgguccggcuuggguacugccgcaccggcccugacuccccaauuucuccuccccgccaucccgccccaggcucauccauuauucccggaggacaaacugcauuucucacguucuuccaaagaaacccuagucaccgggcgggaucccagcucugugcugcgcccccaguggcucccgaguucacacccgagcugugcgacccggugguggggugggagcagggagguagggcccaggagcugcccagagaagggcauuccugugcuccgagaggucgauguguguguguguccguccuugggaauagggauagcacuggagccuguggcaucuccagagucacaaagcugucccccaggagacagcaaagaaagucucaagggccaugccacugguccccugggaaaacuaguuuacuguacauucauccagagaguuaaccuuuucucuuggcagcagguguuauccgaugccaugugaggacuuuugggaguuuuauucccuuuaagacucuaacaaaugaguuucgaugagaggacgucugaaauaaacuaggcuuggggauccuggggacccagcugagggcuggcagagggguucacuugugaagguaguucucugcugugcccgccccugcagaucgccggggcucugccuggaccaguagaauguggugagaggaugggguuucucccucccaagacucacaauggccagagaagauuccgugaaguguuugcgcugcuugcucuacgcccucaaccugcucuuuuggguaaguccuacuaucccagcggguggggauggcuagauuggguuuucucaacuaccagauaaggcgccaaagggcauuggcucagcgugaauuaacggcgugagaucacauccucuguuggucagagaaguaaaaauugaccuucuucgaauaccuuugaucuagcucaaguuccaucugaaauuagaaaaaaaaaaaaagccgcuccuguauacaagugccaaguaacaugaagcuaaucuaaggauauaaauaagugcacgugcuuguacuggaagauaagagacuaugacagacuacucgggaaccgcuaguuugcaggaauuuuagauaacugugcaagccuuacauuuuuucuauacgucaccaccacagccuaugaaaacuuguuggggcaacuacucuuaauauaucuuuggaaagagucacaccuagauaucuuaccaaaagucuggauacguuuuuaaagggaauuccauauaguccaaaaaguggu

SEQ ID NO: 10117 - RNA, 2501 nt, Mus musculus
ccccaggcuguuuucuguccagugggccccaugugcugguuuguagguguuguaguuaauauggucauguauugugggcaacacuacugcccccucaccugauacaccggacggagcugcuguugcugcugcaggugcugcugcugggaugucuucauccaccuggauaaucucuacuguccuggcagcugugacuguacuccgcugcuggugccgcuugcgaaguuuauagaagacaaucaacauggcagcagcuaggagagucacugccacaaagcagccaaugaugaucuugguggucuucaugacuucauccaggcuggucugcaucuugucagugguaucuguggaggguacuggcaccugcuugggcacacggguggucugaaugagcaccgugguagaggugguauaugccggcugguaaccaguggauguggugggaacaggcuuguacuuccguguuauguccucaggugauaucucugugguuuccacuguuacaguggugaagaagcugaaguuggggguguugagcucggccgagcucacauugagguaggccgaggcauuggaguugccugccacauuggucaccaugcauguguauacuccagugucuaugagcagcacacgagaaaaguucaaggugccaucauugagaacagagauccggggaugccgggaggcguggcugagcacugucccauugggcagcaaccacuucacagaggacauagggggaguccgacacuucaguucugccauccgauccucagagauauugaggucccggggugcauccaugaugaaaggggcagagcacugaaaggcagccugguccaccucuaccagguagcggccucgcaugugcaugggagcaugacagcggccacagcagguggaauugguugggauauacucccgaagccaccaagccagccacagaauaucacaaucacaguuccaaggauugugguguaggugcaacuccaccagguaucucaggggugugaagaggucauggggcaaagaugagagguuauugugggcuaaguugaguuccacgagggaagccaguccgucaaaagcauuccgcucaaucaggcugaccugugaguucaucacccacaguuuuuugagggagcuuaggccauggaaggacccaggccugaucucaggaaagugguucccugacaucucaagcuccucgagccccaccagggguguaagauugggcauauccuuaauguugcacaugcccaaguucagguacuugagguugaacagccccucaaaagcccccucagagauauacuccagcuucuugaguucccccaaguccagacgcaugagggagggcacccgguugaaggcauaagaagggaugcucucaaugggauuguuucgcagccagagcucccgcaguuuggacagguacucaaaggccccacuggggaugacugucagccaguugucgaacaguuccagaguguugagacuggcgaggccauugaaggcccccaccucuaucugccugauggaguuccugcccagcugcaggaccuccaggugauggaggugccugaaggugucggccugaaucaucuggauguuguuuuccaugagguugagauaccggguguuggaaggaauacccugugggaccucagagaguccccggcgggugcacaccaccuugcugaacugguuacugcaggaacagacggaggggcaguuuuggggcccggcugaagcggcagcagcgauggcugcacacagaauccacacuugcgccgugagguagacgacgggaagcaggacggcauuccagguguggugcacaguuaccugccacaagagcuucaugguguggcacguucauaauucaccaucgccugggauuuuggcuuggaaaagagaaccagccuuaccccggcuuaagugagcuaggagcuccucuuuccaucuggagaaggagguggggagggggcgauuagagacaagcagaucggccuagaaaaacccugcgaaacuacugagcggccccucaucuaccagcccacccucaaggccaacccauagaaagcuaagacucucucccacguugcgaccauccccacccaauucccugucaccuaccucggaaggaaagcaggaaagaauuagcgcuguguccuuaagcuuucuccacgagagcugggcucaucguucccauucugacuuuaguuuuaauuaacaaagggggaaguagugggggcagggagggcagaggggaggggaggggagggguaggggagacaaaauggcuucuaguaaauccggagccggcgaagccgcggaguugaggcgcgccagggagagccaaggcccggcgggcuaugcaggugcaugcccccccgagagcccgaggagcggcgccaccagcgcuucccugcuuuguccuuggacccuggcaccagcuuguuccagucgcgggagaaggcgcuucaucgccaaag

SEQ ID NO: 10118 - RNA, 2501 nt, Mus musculus
cuuuggcgaugaagcgccuucucccgcgacuggaacaagcuggugccaggguccaaggacaaagcagggaagcgcugguggcgccgcuccucgggcucucgggggggcaugcaccugcauagcccgccgggccuuggcucucccuggcgcgccucaacuccgcggcuucgccggcuccggauuuacuagaagccauuuugucuccccuaccccuccccuccccuccccucugcccucccugcccccacuacuucccccuuuguuaauuaaaacuaaagucagaaugggaacgaugagcccagcucucguggagaaagcuuaaggacacagcgcuaauucuuuccugcuuuccuuccgagguaggugacagggaauuggguggggauggucgcaacgugggagagagucuuagcuuucuauggguuggccuugagggugggcugguagaugaggggccgcucaguaguuucgcaggguuuuucuaggccgaucugcuugucucuaaucgcccccuccccaccuccuucuccagauggaaagaggagcuccuagcucacuuaagccgggguaaggcugguucucuuuuccaagccaaaaucccaggcgauggugaauuaugaacgugccacaccaugaagcucuuguggcagguaacugugcaccacaccuggaaugccguccugcuucccgucgucuaccucacggcgcaaguguggauucugugugcagccaucgcugcugccgcuucagccgggccccaaaacugccccuccgucuguuccugcaguaaccaguucagcaagguggugugcacccgccggggacucucugaggucccacaggguauuccuuccaacacccgguaucucaaccucauggaaaacaacauccagaugauucaggccgacaccuucaggcaccuccaucaccuggagguccugcagcugggcaggaacuccaucaggcagauagaggugggggccuucaauggccucgccagucucaacacucuggaacuguucgacaacuggcugacagucauccccaguggggccuuugaguaccuguccaaacugcgggagcucuggcugcgaaacaaucccauugagagcaucccuucuuaugccuucaaccgggugcccucccucaugcgucuggacuugggggaacucaagaagcuggaguauaucucugagggggcuuuugaggggcuguucaaccucaaguaccugaacuugggcaugugcaacauuaaggauaugcccaaucuuacaccccugguggggcucgaggagcuugagaugucagggaaccacuuuccugagaucaggccuggguccuuccauggccuaagcucccucaaaaaacugugggugaugaacucacaggucagccugauugagcggaaugcuuuugacggacuggcuucccucguggaacucaacuuagcccacaauaaccucucaucuuugccccaugaccucuucacaccccugagauaccugguggaguugcaccuacaccacaauccuuggaacugugauugugauauucuguggcuggcuugguggcuucgggaguauaucccaaccaauuccaccugcuguggccgcugucaugcucccaugcacaugcgaggccgcuaccugguagagguggaccaggcugccuuucagugcucugccccuuucaucauggaugcaccccgggaccucaauaucucugaggaucggauggcagaacugaagugucggacucccccuauguccucugugaagugguugcugcccaaugggacagugcucagccacgccucccggcauccccggaucucuguucucaaugauggcaccuugaacuuuucucgugugcugcucauagacacuggaguauacacaugcauggugaccaauguggcaggcaacuccaaugccucggccuaccucaaugugagcucggccgagcucaacacccccaacuucagcuucuucaccacuguaacaguggaaaccacagagauaucaccugaggacauaacacggaaguacaagccuguucccaccacauccacugguuaccagccggcauauaccaccucuaccacggugcucauucagaccacccgugugcccaagcaggugccaguacccuccacagauaccacugacaagaugcagaccagccuggaugaagucaugaagaccaccaagaucaucauuggcugcuuuguggcagugacucuccuagcugcugccauguugauugucuucuauaaacuucgcaagcggcaccagcagcggaguacagucacagcugccaggacaguagagauuauccagguggaugaagacaucccagcagcagcaccugcagcagcaacagcagcuccguccgguguaucaggugagggggcaguaguguugcccacaauacaugaccauauuaacuacaacaccuacaaaccagcacauggggcccacuggacagaaaacagccugggg

SEQ ID NO: 10119 - RNA, 2501 nt, Mus musculus
uggcaaaagucauggagcccccuugaacucagucucuccuggucaaugucccugcuccuucugguguucucucucucucucucucucucucucucucucucucucucucucucucucucacacacacacacacacacacacaauuuccuuucugaguucuucacagguggacaauacaaccaggcuagaagccaggacuccuaggcugugucaacagccuugucaccaacuccagaaaguucugucaacaccagaucaguuugucuagcccuaaccacugccucaguuuccccauuacuuucuuuaacccaaucugaguguggaaggagugucccucaucccuaaauggcuaagacuagguugggguguacagugugcauggggaagcucagggccagcgcccccaccccauccccgcuccugcugaggacugcguggaggaggggcgggcggaggcggggccguggggcucagcgcggcccccacccgcgggccgggcggcauuccugggaggccggcgcucugacguggacccuggggcugcgggcgcggcgggggggucggcagcccgggggcuucuuaaacccacugccccggcccggcccgcacuucccgagcaccgcuccgccccgggagagagagagagcccuagccggacagcccagcagcucagcccaagaggccagcgagccccgccgcccagagcgcuaacgaagucuccgagaacucgguguccccgcgucccgccccgacagcacccacagcccgauccccaggccguacucccccggccccccgccgcgccaccaugaugaacaacagcaacuauucggacgccuccggccucggccugguugacgaggcggacgagaugccguccacggagaaggaccuagcggaggacgcaccguggaagaagauccagcagaacacauucacgcgguggugcaacgagcaucucaagugugugggcaagcgccugaccgaccugcagcgagaccucagcgacgggcugcgccucaucgcgcugcucgaagugcucagccagaagcgcauguaccgcaaguuccacccgcgccccaacuuccgccaaaugaagcuggaaaaugugucuguggcccuggaguuccuggagcgggaacacaucaagcucguguccaucggucagugcgggggucacagggaacggucacagcggggguaggaacaggucacauaggugcggguacugagauccggaacagaaaaccuuucccuugccuggucugauuucucccucgccaguacaggcuggagcccagauaccccucuaggacagguggcaccccugagaaguucccuuccgaaguuguccaaacaucuuagcuucagccucccuacacacacuccuaccgaccugcccaaaguccccucuuuuccuuccaccgggccacccuugcuugcacaugcuugcgaggacagggcuggugcccagugcuaauuccuugggggcguaucccgccacccacaugaaagcaaauggcuucccaucgccuucgucgcugggcaaaagcagucuuaagacagguuccagucgucucuggguucucagggcccugaggccagggagacuaguggccugaagcucgcugaugcgcuuggcaggcaugugcuccccaucugggaucuggccggacuagagcaaacagaacccggccucagaaaccuaaaaaggcacugagcaacguccugggagcuuuaaccccugauugcccuggucguuuaggucgucugggagggggacuccugccuguccaugcccuguuccaacccaccaccuggccugggauuggcuacagcuaagggucaagcugcccuggagggaggggaaggcugaggaagagaggaagucauugaguguaaccagauuuggaaggugugucaguucugaguggggguagggaggcgcaggagucuagagaguccagaagcccaggguggguuuugaguggcaagaagauaccuuacuuuucacagcccuaucccgcuaggaccaagguuuccaguuugcgucuugggugaacucuuagagcccuucugggauguacuagaaggaccccccugggaggaugcaccccagacccuggaagggaacuguauauggaaccaggugaugcccaccacuacaagcugcccccagagacuucaauauuuaacuagguaucugcccccucccuagucucccucauggccaucuccaggucuccggaauuagcagcugagaucaguccggggcccuuugcccuguucaggcuucuuccugggccuuaccucuuccagucccaguacuaacccccccccccuacacacacacacacacacacacacacacacacacacacaccccacccuccugcucuggccuggaaauagcccugucuccgugacacagcagaugucucugagcuuuccagaaggacaagccugaggacaaggggugggggagggggcccugguguaag

SEQ ID NO: 10120 - RNA, 2501 nt, Mus musculus
cuuacaccagggcccccucccccaccccuuguccucaggcuuguccuucuggaaagcucagagacaucugcugugucacggagacagggcuauuuccaggccagagcaggagggugggguguguguguguguguguguguguguguguguguguguguaggggggggggguuaguacugggacuggaagagguaaggcccaggaagaagccugaacagggcaaagggccccggacugaucucagcugcuaauuccggagaccuggagauggccaugagggagacuagggagggggcagauaccuaguuaaauauugaagucucugggggcagcuuguaguggugggcaucaccugguuccauauacaguucccuuccagggucuggggugcauccucccagggggguccuucuaguacaucccagaagggcucuaagaguucacccaagacgcaaacuggaaaccuugguccuagcgggauagggcugugaaaaguaagguaucuucuugccacucaaaacccacccugggcuucuggacucucuagacuccugcgccucccuacccccacucagaacugacacaccuuccaaaucugguuacacucaaugacuuccucucuuccucagccuuccccucccuccagggcagcuugacccuuagcuguagccaaucccaggccaggugguggguuggaacagggcauggacaggcaggagucccccucccagacgaccuaaacgaccagggcaaucagggguuaaagcucccaggacguugcucagugccuuuuuagguuucugaggccggguucuguuugcucuaguccggccagaucccagauggggagcacaugccugccaagcgcaucagcgagcuucaggccacuagucucccuggccucagggcccugagaacccagagacgacuggaaccugucuuaagacugcuuuugcccagcgacgaaggcgaugggaagccauuugcuuucauguggguggcgggauacgcccccaaggaauuagcacugggcaccagcccuguccucgcaagcaugugcaagcaaggguggcccgguggaaggaaaagaggggacuuugggcaggucgguaggaguguguguagggaggcugaagcuaagauguuuggacaacuucggaagggaacuucucaggggugccaccuguccuagagggguaucugggcuccagccuguacuggcgagggagaaaucagaccaggcaagggaaagguuuucuguuccggaucucaguacccgcaccuaugugaccuguuccuacccccgcugugaccguucccugugacccccgcacugaccgauggacacgagcuugauguguucccgcuccaggaacuccagggccacagacacauuuuccagcuucauuuggcggaaguuggggcgcggguggaacuugcgguacaugcgcuucuggcugagcacuucgagcagcgcgaugaggcgcagcccgucgcugaggucucgcugcaggucggucaggcgcuugcccacacacuugagaugcucguugcaccaccgcgugaauguguucugcuggaucuucuuccacggugcguccuccgcuagguccuucuccguggacggcaucucguccgccucgucaaccaggccgaggccggaggcguccgaauaguugcuguuguucaucaugguggcgcggcggggggccgggggaguacggccuggggaucgggcugugggugcugucggggcgggacgcggggacaccgaguucucggagacuucguuagcgcucugggcggcggggcucgcuggccucuugggcugagcugcugggcuguccggcuagggcucucucucucucccggggcggagcggugcucgggaagugcgggccgggccggggcaguggguuuaagaagcccccgggcugccgacccccccgccgcgcccgcagccccaggguccacgucagagcgccggccucccaggaaugccgcccggcccgcgggugggggccgcgcugagccccacggccccgccuccgcccgccccuccuccacgcaguccucagcaggagcggggauggggugggggcgcuggcccugagcuuccccaugcacacuguacaccccaaccuagucuuagccauuuagggaugagggacacuccuuccacacucagauuggguuaaagaaaguaauggggaaacugaggcagugguuagggcuagacaaacugaucugguguugacagaacuuucuggaguuggugacaaggcuguugacacagccuaggaguccuggcuucuagccugguuguauuguccaccugugaagaacucagaaaggaaauugugugugugugugugugugugugagagagagagagagagagagagagagagagagagagagagagagagagagaacaccagaaggagcagggacauugaccaggagagacugaguucaagggggcuccaugacuuuugcca

SEQ ID NO: 10121 - RNA, 2501 nt, Mus musculus
gaggagacauggucucugaaggugccagagaggaagcaaggaggcaagaauaucaugagaacccagaaacgagaggaggcagaugcccugagagcacugaaguggccuaugccagcuucccaaaggggacacagcaguaucccaacccaggccccccugcagccugcucugauuguagggaucuuuagucauggagguggggugcucggaccauccauccacugugggucagagacagcucggaggucugauauguuaugcuaggaucaagagauaacacaggcugaaaugaagacgaggaugugggaugcgugcaagaacgaacugguguguguauguccacgcguguccacucaucuauaccugucaguaaaggagcugcauguggcagaagccaggaacccccauauuggaugcagugggcucuggaaggcagaagcuagcugugcuguguuggcaacagcaugcaacacuccaacagaugcagcacuccagacagagagggcagccugucccugggacuagauaacauuauguccaggaaggaagcccuggccucugagcuuaggccugggguggggcccagcuacauuucucuucaccuuaugcccacucucaaggcaggaagguagaggcgagggcaccggccacagacaucauggaguggaaggguccccagaagugcugaccaagaaaggggcugaaggagaugucuggccuuucuuucucacagcggcaacucaaucaggaagagcuggaguaacugaaagucuuucucccagggacacuaggccugcgaagcagggggaugucaccugcuccuuucuuucuacugucaccauaaagaggaggacguuccagcccaauuuccggggcucaauaaaugccaccccaacucugggguucagugcuacucuccgguaucccuuaguucccaccagucucugguuucccucaguugucucauaauccacggccucccccacccccacccccaucccacugucuucacagaagcugaagagaaagucuccuacugcagucuguccucucuccacagcacaaggcgccaagcagcaaguuaagacuucaucugucaccacagcacugcccagcuuuccaccccaccgccauacagcucuccccaccacaggucccagccggucuaccuucacaccaccagcaucccaugcauucuguucucaccuuguccccagaaauuggcacugucuugacauggucucccugcccaacuuccauccacaaggaugaugcucgcgggcggggucucaguaucugaaaccccaagcgugaccuccucuagcgacccaacccuuaaagccccagcacccaaccagcuccucccgcuuugcuuaagcaggcacaacggagggggccgaggagccauucaggguguccucuuggauccccagcugaagacaggcucagucccuuuuccuggaagaucugcagaaaguccuggaaguggcacgaaucugguugcuccccagaaacugucuucagguuuccccuuacccuccuccuacucugcuuuugcagagaccaaccauaagugcaagccggacaggacuaagucauuucccacagagagcgcuccccucccccucuccucaauacaaauaauuaacuucagauacucagaugccaggacagccucugcuucaccgcuacuuaggacuccuuggcagggaccacagaaggacccggcccaguucagcaaucccugucuggccgcccugcccccacccugcucgcccaccgacggggaggacggagagagagcaccaaggccggccagcgacgcgcaacccaggcggggauggagaaguggucuggcccgguccgacggucugcugggcugagccauaaguuggggcacacccaggacgcuccgacucaccccgcgcggccagcgccaggcucccgaggugcaggagcagugguagcaacgccgcccgagcccccgccaugcucgcucgacccgccucgcuuuaggucugugcucagccggcgcugcgggaggcggggugcggagacucaagccgccgcccacccagucuuuguucagggagggcuccgcgguucuccgccccuuggugcccgcuccccuaucgcaccuagggcuucucaccccaccccaccccaauccaccccaccccaccccguuccccugaggauccugacccauagcagucuuccaagcucugcaggaaguugggugcgggguaagcgaccaggagcaaccaugucccugcccuuugggguugcucauccucuagggggucccagugacagucccagugacuuuacuuccaccucaugggcuuaugggaacagaaggcugagcuggacugaaaacccucugcaaggggcuggagagaugguucagugguuaagagcauuugcugcucuuguagaggacuugaguuccguucauagcacccacguggcugcucaccaucaucuauaauuucuauuuc

SEQ ID NO: 10122 - RNA, 2501 nt, Mus musculus
gaaauagaaauuauagaugauggugagcagccacgugggugcuaugaacggaacucaaguccucuacaagagcagcaaaugcucuuaaccacugaaccaucucuccagccccuugcagaggguuuucaguccagcucagccuucuguucccauaagcccaugagguggaaguaaagucacugggacugucacugggacccccuagaggaugagcaaccccaaagggcagggacaugguugcuccuggucgcuuaccccgcacccaacuuccugcagagcuuggaagacugcuaugggucaggauccucaggggaacgggguggggugggguggauuggggugggguggggugagaagcccuaggugcgauaggggagcgggcaccaaggggcggagaaccgcggagcccucccugaacaaagacugggugggcggcggcuugagucuccgcaccccgccucccgcagcgccggcugagcacagaccuaaagcgaggcgggucgagcgagcauggcgggggcucgggcggcguugcuaccacugcuccugcaccucgggagccuggcgcuggccgcgcggggugagucggagcguccugggugugccccaacuuauggcucagcccagcagaccgucggaccgggccagaccacuucuccauccccgccuggguugcgcgucgcuggccggccuuggugcucucucuccguccuccccgucggugggcgagcagggugggggcagggcggccagacagggauugcugaacugggccggguccuucuguggucccugccaaggaguccuaaguagcggugaagcagaggcuguccuggcaucugaguaucugaaguuaauuauuuguauugaggagagggggaggggagcgcucucugugggaaaugacuuaguccuguccggcuugcacuuaugguuggucucugcaaaagcagaguaggaggaggguaaggggaaaccugaagacaguuucuggggagcaaccagauucgugccacuuccaggacuuucugcagaucuuccaggaaaagggacugagccugucuucagcuggggauccaagaggacacccugaauggcuccucggcccccuccguugugccugcuuaagcaaagcgggaggagcugguugggugcuggggcuuuaaggguugggucgcuagaggaggucacgcuugggguuucagauacugagaccccgcccgcgagcaucauccuuguggauggaaguugggcagggagaccaugucaagacagugccaauuucuggggacaaggugagaacagaaugcaugggaugcugguggugugaagguagaccggcugggaccugugguggggagagcuguauggcggugggguggaaagcugggcagugcuguggugacagaugaagucuuaacuugcugcuuggcgccuugugcuguggagagaggacagacugcaguaggagacuuucucuucagcuucugugaagacagugggaugggggugggggugggggaggccguggauuaugagacaacugagggaaaccagagacuggugggaacuaagggauaccggagaguagcacugaaccccagaguugggguggcauuuauugagccccggaaauugggcuggaacguccuccucuuuauggugacaguagaaagaaaggagcaggugacaucccccugcuucgcaggccuagugucccugggagaaagacuuucaguuacuccagcucuuccugauugaguugccgcugugagaaagaaaggccagacaucuccuucagccccuuucuuggucagcacuucuggggacccuuccacuccaugaugucuguggccggugcccucgccucuaccuuccugccuugagagugggcauaaggugaagagaaauguagcugggccccaccccaggccuaagcucagaggccagggcuuccuuccuggacauaauguuaucuagucccagggacaggcugcccucucugucuggagugcugcaucuguuggaguguugcaugcuguugccaacacagcacagcuagcuucugccuuccagagcccacugcauccaauauggggguuccuggcuucugccacaugcagcuccuuuacugacagguauagaugaguggacacgcguggacauacacacaccaguucguucuugcacgcaucccacauccucgucuucauuucagccuguguuaucucuugauccuagcauaacauaucagaccuccgagcugucucugacccacaguggauggaugguccgagcaccccaccuccaugacuaaagaucccuacaaucagagcaggcugcaggggggccuggguugggauacugcuguguccccuuugggaagcuggcauaggccacuucagugcucucagggcaucugccuccucucguuucuggguucucaugauauucuugccuccuugcuuccucucuggcaccuucagagaccaugucuccuc

SEQ ID NO: 10123 - RNA, 2501 nt, Mus musculus
cccaaaccacggugaagguaagggcaaaagaagaggugggcuugucagucacauggugaguuggagcgguccggagggccaguguuaaggcugaggagacagaguggcccaagguauguugaaagggagcucucaggggucucccaaugcccuggaguguggcuccaucgacgcccgcgcgcagcggaucuccagcuccaggcgggcgcggacuaggugaggacaggcuacaggguaucuggggacugggugauggaugacucugucuccccggauucccaaaggagcccggcgaggggcgccgagcugucugcggucucgcggaggccccgggcuuccccgcggugggcgguggauggguaggggcccggggcgcggggugguggcgaggggcggggcggggcgcugccccgggcgggggcggcgcgaugcggaagugcggggcgggcugggcgacccgcgggcggugcagcucggcgagagcucagcucggccgcagcgccaggccggggcuccaggcuccccgcgggcgcacagcaaacagguaggucccggggcugugggcuguguugggcuccucgccccgagggcggugggaacagccccgggcuucagccaagccacggcuccgacccacggcgaccugcacgccccgggcaccugccaacggggccagcggggucgggaucccgcuccuccgcggugggcgaugaucgaaggcggcgccgggccagcgcgaauggcuccaaggcgcuccgcaccaggccagcucggagugccgggcuccggccgccaacguucgcaugcucggggaaagucccaagggcccaguggacauccccacugcgccucgccagggucaaggaugccaagcgcccugucacagucuggcggggaccagggaggagcgaguuuccgaccccgacccugucggcacacagcucgucucuccuccccggccacaccucacuuuuucgacuaaagagguugaggugucaagcagcgaucccucccaaggaucuuaaagccaaggacaggaaucugugggaauagaguuugaggggagacguugucaaauagaggcucugcuccuugacucguagcucaaaaggggacgacgauuuauucuuagcuguugagaagaaucggggcgggggcugauuaaugcuuggucuaguuucuugacggccugccccuaaacuuaagaaguaacaacuuagaaucugaacgugaagggaaaguguaguugggccgaaacgcaggcggagagaugucccgggccaguauucgcccucggugcagaugucucccagacuccaggugucucucgaaccuccagaggacccagagcggguaccuaguagcagggguggaagugggggcuuucuuggccuccuccuggcauagcaaggcggacacgucccgguccagaggagcggaccaggaacggacacuaagccaguaaccccgcgaugacuccaggggcugacccagguuccuucccacccccaccccccuucccuccgcguuaugccccggguggagucugccgggaugaucaggagggaacgaccuggccugaacuccaaagugaggauaagugaucaggaccagaaaggauguggacggggcugacggaggcuggagaggcuaaaagccucgcaugaggaccugugugauacaguacagcauucgcccucucuacucccuaagcuccuggcuaaagucuaggaaagagauagguaggagaccacuccuauuaacuaaaaguccuucggggguuuucccuugaacucuggccuucccccagccugccccugggaggaagccgggagaggguucuuccugccgcaccugcugccccagaaucucagccugugugcacucugaaggggcagggccccgggugugucgcucaccuggagagggcgggauuuaugcucaugccuacugcagguaaccccuggauguugccuugaacugggugugggguuuagaacgggacaauucgagagacaggagggguucgaagcucugccuuuauuccuuccguuauggcagcuucuccccaccagcuccggaguucucagugaucugacugcccaggcagccucuccugggacuucaugaccuuggggugagcuauggggacucuccaucgcagucgggauucaagggcugcuuccaugccccaucacaugugggauacuuccugaggucugacauggaagauggugggggcucuguucguuucuccuuuuuagggcucauagccagacaucucagucugcguugugugucagcacugcucuuauucaaaaccuccagacccaggagcgggcagucauguuuagacgcugcaauugugaacuggcaggcaggaucugacuuagaucuaagccuuuuuuguugggcaggagggagcuucugugggguagaugcugaacuugguccugcucagggcgaggcuccugugcaucuagcugcagguggugccuucu

SEQ ID NO: 10124 - RNA, 2501 nt, Mus musculus
agaaggcaccaccugcagcuagaugcacaggagccucgcccugagcaggaccaaguucagcaucuaccccacagaagcucccuccugcccaacaaaaaaggcuuagaucuaagucagauccugccugccaguucacaauugcagcgucuaaacaugacugcccgcuccugggucuggagguuuugaauaagagcagugcugacacacaacgcagacugagaugucuggcuaugagcccuaaaaaggagaaacgaacagagcccccaccaucuuccaugucagaccucaggaaguaucccacaugugauggggcauggaagcagcccuugaaucccgacugcgauggagaguccccauagcucaccccaaggucaugaagucccaggagaggcugccugggcagucagaucacugagaacuccggagcugguggggagaagcugccauaacggaaggaauaaaggcagagcuucgaaccccuccugucucucgaauugucccguucuaaaccccacacccaguucaaggcaacauccagggguuaccugcaguaggcaugagcauaaaucccgcccucuccaggugagcgacacacccggggcccugccccuucagagugcacacaggcugagauucuggggcagcaggugcggcaggaagaacccucucccggcuuccucccaggggcaggcugggggaaggccagaguucaagggaaaacccccgaaggacuuuuaguuaauaggaguggucuccuaccuaucucuuuccuagacuuuagccaggagcuuagggaguagagagggcgaaugcuguacuguaucacacagguccucaugcgaggcuuuuagccucuccagccuccgucagccccguccacauccuuucugguccugaucacuuauccucacuuuggaguucaggccaggucguucccuccugaucaucccggcagacuccacccggggcauaacgcggagggaaggggggugggggugggaaggaaccugggucagccccuggagucaucgcgggguuacuggcuuaguguccguuccugguccgcuccucuggaccgggacguguccgccuugcuaugccaggaggaggccaagaaagcccccacuuccaccccugcuacuagguacccgcucuggguccucuggagguucgagagacaccuggagucugggagacaucugcaccgagggcgaauacuggcccgggacaucucuccgccugcguuucggcccaacuacacuuucccuucacguucagauucuaaguuguuacuucuuaaguuuaggggcaggccgucaagaaacuagaccaagcauuaaucagcccccgccccgauucuucucaacagcuaagaauaaaucgucguccccuuuugagcuacgagucaaggagcagagccucuauuugacaacgucuccccucaaacucuauucccacagauuccuguccuuggcuuuaagauccuugggagggaucgcugcuugacaccucaaccucuuuagucgaaaaagugagguguggccggggaggagagacgagcugugugccgacagggucggggucggaaacucgcuccucccugguccccgccagacugugacagggcgcuuggcauccuugacccuggcgaggcgcaguggggauguccacugggcccuugggacuuuccccgagcaugcgaacguuggcggccggagcccggcacuccgagcuggccuggugcggagcgccuuggagccauucgcgcuggcccggcgccgccuucgaucaucgcccaccgcggaggagcgggaucccgaccccgcuggccccguuggcaggugcccggggcgugcaggucgccgugggucggagccguggcuuggcugaagcccggggcuguucccaccgcccucggggcgaggagcccaacacagcccacagccccgggaccuaccuguuugcugugcgcccgcggggagccuggagccccggccuggcgcugcggccgagcugagcucucgccgagcugcaccgcccgcgggucgcccagcccgccccgcacuuccgcaucgcgccgcccccgcccggggcagcgccccgccccgccccucgccaccaccccgcgccccgggccccuacccauccaccgcccaccgcggggaagcccggggccuccgcgagaccgcagacagcucggcgccccucgccgggcuccuuugggaauccggggagacagagucauccaucacccaguccccagauacccuguagccuguccucaccuaguccgcgcccgccuggagcuggagauccgcugcgcgcgggcgucgauggagccacacuccagggcauugggagaccccugagagcucccuuucaacauaccuugggccacucugucuccucagccuuaacacuggcccuccggaccgcuccaacucaccaugugacugacaagcccaccucuucuuuugcccuuaccuucaccgugguuuggg

SEQ ID NO: 10125 - RNA, 2501 nt, Mus musculus
gagcaggaagaauuuaaagaagcaaaacccccaaacuccgguucuucuccaccaggguucuagguaaaguugagaaagaucuaacuaacaaaaagcaagaaaagauugguagggcuggggaauugggcaggaauggagugaaaacucuugccugcuuuaggcaucccccugccacccuaaacugagagaaauguccucuccuaaaagucacgucaaacaaccuuaggaccaacuaaagauucagucaagugccucugggacacaacuugcacgcauccccccccccccccccccccgcgagggucuucuguagggugaagguucccgaauacccccaccccagccccuucgggcauuuaggccgccaaagcuggggcuccuccucuccagcgucugacucuccccuugcuuuucuucgcucgggcccucccccagccuccgcggaugggggggccgggcuuggcuccgcgaggcccgugcauuccagagagcagggccagcuagagcaacaaaggagcccgguagucggcagggagagcucagggggcugcggcgcgcucgcgcggagguggcugcugggccgcgggcuggcgugggggcggagccggggacccacucccgcaccccccccccccccccggccggcgccuggccuccaucgaggggcugggagucgguuuuaauggugggagagggaauggggcuggagaucggggccccggaggguucccaggguugaagacagcuucgaucuccaggccagggaguccggggucugugcauccuggcccgggccugcgcugcucaacauggggcccggguuccaaaguuugcaaaguugggagucgaggggcccggacgcgcgcggcgccuggcgaaagcuggccccagacuuucggggcgcaccggucgccuaaguagccuccgcggcccccggggucguguguguggccaggggacuccggggagcuccggggcgccucagcuuuugcugaguuggcuguuuggccauggccgcuggccgccccgugcgugggcccgagcuggcgccccggaggcugcugcaguugcugcugcugguacugcuggggggcccgggccggggggcggccuugagcgggaacgugaccgggccugggccucacagcgccagcgggagcucgaggagggacgugccggugaccagcccuccgccgccgcugcugagccacugcggccgggccgcccacugcgagccuuugcgcuacaacgugugccugggcucggcgcugcccuacggagccaccaccacgcugcuggcuggggacucggacucgcaggaggaagcgcacggcaagcucgugcucugguccgguaagcgcgcgggagucgggauugcgacgcggaggugaugggaccggccacugacggaaagaaaaggcucaggccucaaacuguugggcgggcgcggcuugcacccggaauaguuggagaaacgaguccggaacuuuugggacagguugcgugcgggaaggagacucugcguguuggagaaggggucggggcaagagaccagggaagccagucggucacaaagagcccgaguaaggaugggguuagggggaugcaaggagggagaagagauguauucgugaagcaacaguccauggggauucugggcaguguucagaccuugaggcaaucugaguuguagagaagaaagagaggaugaagguggaagacauuuaaggauuuggagggaaggggcgaggaaaacuuguacauucugagaaggaaaaaaaaaaugccuccuuguaguaacuaaaaagccaaacgaaccaccugguaaucuugauuuagaucagcccagggaaccaaugauuuuugucuuguuuuuacccguuuaaguuuccuuaucugaaaaauggaagcucugauccacucggguuaagaaggagggagacgauuuaaacaguuguuuguggcucuguggaaaugugaagccucacgccaguguaugcuguggaggaacauuaagucugggguguugagagccugugggcaccguccagaguggcagaaaguccuuuccuugggguaggauugugacagagccugaaaacagcagacuacaucaaacaaguccuuccuaggcuauuuaggaugguuuaucucucugccugucacccaguuggacugagagccuguagggugcuggggaggggacaguccuugucauuuucccaucccucuuccccaccccgaacccccacuucggugugauguaaaagcuguccuugauggaaaaagaaaauaaaauugagagcccggagcaaaccagagagccugacagugucccuagcuuuagcucuuccucugagguugugaggcuccgacuaggagguagugugaaccguaggcugacugucuugggcugagguguguugucaacuugacuacuagaguucucaguuguagcugagugcugccugggguccuaagguucuuggcuugaugcagau

SEQ ID NO: 10126 - RNA, 2501 nt, Mus musculus
aucugcaucaagccaagaaccuuaggaccccaggcagcacucagcuacaacugagaacucuaguagucaaguugacaacacaccucagcccaagacagucagccuacgguucacacuaccuccuagucggagccucacaaccucagaggaagagcuaaagcuagggacacugucaggcucucugguuugcuccgggcucucaauuuuauuuucuuuuuccaucaaggacagcuuuuacaucacaccgaaguggggguucgggguggggaagagggaugggaaaaugacaaggacuguccccuccccagcacccuacaggcucucaguccaacugggugacaggcagagagauaaaccauccuaaauagccuaggaaggacuuguuugauguagucugcuguuuucaggcucugucacaauccuaccccaaggaaaggacuuucugccacucuggacggugcccacaggcucucaacaccccagacuuaauguuccuccacagcauacacuggcgugaggcuucacauuuccacagagccacaaacaacuguuuaaaucgucucccuccuucuuaacccgaguggaucagagcuuccauuuuucagauaaggaaacuuaaacggguaaaaacaagacaaaaaucauugguucccugggcugaucuaaaucaagauuaccaggugguucguuuggcuuuuuaguuacuacaaggaggcauuuuuuuuuuccuucucagaauguacaaguuuuccucgccccuucccuccaaauccuuaaaugucuuccaccuucauccucucuuucuucucuacaacucagauugccucaaggucugaacacugcccagaauccccauggacuguugcuucacgaauacaucucuucucccuccuugcaucccccuaaccccauccuuacucgggcucuuugugaccgacuggcuucccuggucucuugccccgaccccuucuccaacacgcagagucuccuucccgcacgcaaccugucccaaaaguuccggacucguuucuccaacuauuccgggugcaagccgcgcccgcccaacaguuugaggccugagccuuuucuuuccgucaguggccggucccaucaccuccgcgucgcaaucccgacucccgcgcgcuuaccggaccagagcacgagcuugccgugcgcuuccuccugcgaguccgaguccccagccagcagcguggugguggcuccguagggcagcgccgagcccaggcacacguuguagcgcaaaggcucgcagugggcggcccggccgcaguggcucagcagcggcggcggagggcuggucaccggcacgucccuccucgagcucccgcuggcgcugugaggcccaggcccggucacguucccgcucaaggccgccccccggcccgggccccccagcaguaccagcagcagcaacugcagcagccuccggggcgccagcucgggcccacgcacggggcggccagcggccauggccaaacagccaacucagcaaaagcugaggcgccccggagcuccccggaguccccuggccacacacacgaccccgggggccgcggaggcuacuuaggcgaccggugcgccccgaaagucuggggccagcuuucgccaggcgccgcgcgcguccgggccccucgacucccaacuuugcaaacuuuggaacccgggccccauguugagcagcgcaggcccgggccaggaugcacagaccccggacucccuggccuggagaucgaagcugucuucaacccugggaacccuccggggccccgaucuccagccccauucccucucccaccauuaaaaccgacucccagccccucgauggaggccaggcgccggccggggggggggggggggugcgggaguggguccccggcuccgcccccacgccagcccgcggcccagcagccaccuccgcgcgagcgcgccgcagcccccugagcucucccugccgacuaccgggcuccuuuguugcucuagcuggcccugcucucuggaaugcacgggccucgcggagccaagcccggcccccccauccgcggaggcugggggagggcccgagcgaagaaaagcaaggggagagucagacgcuggagaggaggagccccagcuuuggcggccuaaaugcccgaaggggcugggguggggguauucgggaaccuucacccuacagaagacccucgcggggggggggggggggggggaugcgugcaaguugugucccagaggcacuugacugaaucuuuaguugguccuaagguuguuugacgugacuuuuaggagaggacauuucucucaguuuaggguggcagggggaugccuaaagcaggcaagaguuuucacuccauuccugcccaauuccccagcccuaccaaucuuuucuugcuuuuuguuaguuagaucuuucucaacuuuaccuagaacccugguggagaagaaccggaguuuggggguuuugcuucuuuaaauucuuccugcuc

SEQ ID NO: 10127 - RNA, 2501 nt, Mus musculus
acgggcggggacgcgcgcucgcccgcucgcgcgcgcucucgccaccgcagcucguccgccacgaucgcgcgccuccgcccggccgggggcgggagggcagagggcaccacccuguuuaccgcccgggcucgagcccugagccggaaacggucucccgggagcgggcgcgugagugcgcacccacccgcggcgcggcucugcgugggcagugagcaaagggccacggcggcugcgugucacccccgucacgacucuugcuacgcacuucgcccccagccuucagcucgcgagcugccgcggaccccucacguggccgccuccucccugacacgccgugccgagcaagccguggcugcggacccaggcgcuccggagucuuguccccaccccgccucggacgucacccgccucggaccacccaacccacaccuuccgccccgggcgcgcgcgggaggggguagauagcuccaagcugucagaagccuacagugugugccacaugacgaagcucgcccucguccucgacacucacgcagcagcuucgcugcgagcugaaacagacauauugggggggggggaccugucuugauuuuucucuugguuuuaaaagcaaccccccccauacauaagcguuagacuuagcucuaccuacgcacucgcuuugccucccccauggucuccuaccaaauccaagcgacuuaccaaauccaaaugcccacccuacacaccugcuagguaaccugccuucuggaaccucaaagccccacccaucccgccugugggggcaaccuguggugggggggagugaggcaacacgauuagguagugauagagaggggggacauacaaccccccaucuccagagcaagaggacgcauccugcuucccuccgccaaaauaauagccgaagucaaagcuccggcuucccaggggcugccucuccccccaccuucccccuagaaccaaaacgucgcgucccucccaaccgcucgcccccagcccuuacuucuuguugacggccgaggugggggggcgugggagccaugcaugaguugccucuagguucgggauguuggucuccucugagugaagaggugggaucucgaaauggaaacaguccucccuccccccccccaacccccccccgccggucccuccccuccuccuccuccucuucgucuguuuaccucaaguuugaauuuuaucugcgcaacauuagcuggaaugcggacauugaaaaaaaaaaaaaaaaccacucgcucucaacccggcagcagcuccggaggagccauguggcaucaagccaccgcaaaggggaaaaaaaagugcucuuagcaacacaaacauggcgaaauagcuccgacaugcccguuucacgcagcaacccuaccuuccuucgcucacccgccgagcauccuggcccgcugccucaggccccuugugggggaccguaagggggccccggggacugcgaggguggacgucaagagaguccaccgggaaaauagcacagaugacgcgccaacccaucugccucaccgagagugcggggacgcuuuuuccacccccaaggugggaguugagcaccaaauccuguccccaaguccugcuggacccguuuuccccacccuaaagaacuuaccuugaggcugaacacuacaccgcuuugcucucuuuucugguuccuuccucuggagugaggaggaaaaugaugcgcacguagauuccgagagcguauucuucuagaauuuucccaugaugguugguggggagcgauggggacucugagacaggugcggggcugccggcuaaaaguugcucagcgcaccacggugggcgacaggguccccggagcgggcggaggacccccacucucugucccuggcgucgcccacuugucacgccaggcugcugcgugcgcucggcugcagaggagguggcguaguuucucuuucucccaccucuucucacuuguuuuguagccgugggcuccccuaaugcuuuccucuccacaauguuguuucauuauaucauguccaucaugugacaccggagaggccucucuauggaaacuuaaaggggcucccacgugacugcagcagcaacaacagcagcaggaccgccggcggcggcggcggcagcauuuguaccaccacccaccaggagccccucgaagcaucccgaaggggcuuguggcgcugcgaaagcccagauaagggagccacugcauccgggagcuauggcgucggugcgugcguggagccagugcucauuacacagcaagcggaacaggagcguccuuaaauccuuuccugcagucaccaagcccacgcucuguuaaaaugacauuucgugguuccuacuuuauuuucccccaagagcugugaguucccuaucaggccugauuaaauuuuacaaagucaaaaagaaaagccagauuugcccucucagugagcucacucgcagaucguugguagaacagaaaugcccagaaaauaaca

SEQ ID NO: 10128 - RNA, 2501 nt, Mus musculus
uguuauuuucugggcauuucuguucuaccaacgaucugcgagugagcucacugagagggcaaaucuggcuuuucuuuuugacuuuguaaaauuuaaucaggccugauagggaacucacagcucuugggggaaaauaaaguaggaaccacgaaaugucauuuuaacagagcgugggcuuggugacugcaggaaaggauuuaaggacgcuccuguuccgcuugcuguguaaugagcacuggcuccacgcacgcaccgacgccauagcucccggaugcaguggcucccuuaucugggcuuucgcagcgccacaagccccuucgggaugcuucgaggggcuccugguggguggugguacaaaugcugccgccgccgccgccggcgguccugcugcuguuguugcugcugcagucacgugggagccccuuuaaguuuccauagagaggccucuccggugucacaugauggacaugauauaaugaaacaacauuguggagaggaaagcauuaggggagcccacggcuacaaaacaagugagaagaggugggagaaagagaaacuacgccaccuccucugcagccgagcgcacgcagcagccuggcgugacaagugggcgacgccagggacagagaguggggguccuccgcccgcuccggggacccugucgcccaccguggugcgcugagcaacuuuuagccggcagccccgcaccugucucagaguccccaucgcuccccaccaaccaucaugggaaaauucuagaagaauacgcucucggaaucuacgugcgcaucauuuuccuccucacuccagaggaaggaaccagaaaagagagcaaagcgguguaguguucagccucaagguaaguucuuuaggguggggaaaacggguccagcaggacuuggggacaggauuuggugcucaacucccaccuuggggguggaaaaagcguccccgcacucucggugaggcagauggguuggcgcgucaucugugcuauuuucccgguggacucucuugacguccacccucgcaguccccggggcccccuuacggucccccacaaggggccugaggcagcgggccaggaugcucggcgggugagcgaaggaagguaggguugcugcgugaaacgggcaugucggagcuauuucgccauguuuguguugcuaagagcacuuuuuuuuccccuuugcgguggcuugaugccacauggcuccuccggagcugcugccggguugagagcgagugguuuuuuuuuuuuuuuucaauguccgcauuccagcuaauguugcgcagauaaaauucaaacuugagguaaacagacgaagaggaggaggaggaggggagggaccggcggggggggguuggggggggggagggaggacuguuuccauuucgagaucccaccucuucacucagaggagaccaacaucccgaaccuagaggcaacucaugcauggcucccacgcccccccaccucggccgucaacaagaaguaagggcugggggcgagcgguugggagggacgcgacguuuugguucuagggggaagguggggggagaggcagccccugggaagccggagcuuugacuucggcuauuauuuuggcggagggaagcaggaugcguccucuugcucuggagaugggggguuguauguccccccucucuaucacuaccuaaucguguugccucacucccccccaccacagguugcccccacaggcgggauggguggggcuuugagguuccagaaggcagguuaccuagcagguguguagggugggcauuuggauuugguaagucgcuuggauuugguaggagaccaugggggaggcaaagcgagugcguagguagagcuaagucuaacgcuuauguaugggggggguugcuuuuaaaaccaagagaaaaaucaagacaggucccccccccccaauaugucuguuucagcucgcagcgaagcugcugcgugagugucgaggacgagggcgagcuucgucauguggcacacacuguaggcuucugacagcuuggagcuaucuacccccucccgcgcgcgcccggggcggaagguguggguugggugguccgaggcgggugacguccgaggcgggguggggacaagacuccggagcgccuggguccgcagccacggcuugcucggcacggcgugucagggaggaggcggccacgugagggguccgcggcagcucgcgagcugaaggcugggggcgaagugcguagcaagagucgugacgggggugacacgcagccgccguggcccuuugcucacugcccacgcagagccgcgccgcgggugggugcgcacucacgcgcccgcucccgggagaccguuuccggcucagggcucgagcccgggcgguaaacaggguggugcccucugcccucccgcccccggccgggcggaggcgcgcgaucguggcggacgagcugcgguggcgagagcgcgcgcgagcgggcgagcgcgcguccccgcccgu

SEQ ID NO: 10129 - RNA, 2501 nt, Mus musculus
aagaaacccaaccuugccggggcgugguggugcacgccuuuaaucccagcacucaggaggcagaggcaggcggauuucugaguuugaggccacccuggucuacaaagugaguuccaggacagccaagacuauacagagaaacccuaucucaaaaaggccaaaaaaaaaaaaaaaaaaaaaaaaaaaaaagaagaagaagaagaagaagaagcccaaccuugauguccagggacccgguugggagcaguucacugauggcuuccagggaucucccuuuagccuguaucuucuccaagcuuggcuucuauaagauuggaaucacuguggacuaacuagcucaucuggcuuuugaaugguacuaggggcucccccuccaaaagacugcaugugaagaccaugaaguugccagggcacucuacagacuugucgguccuuguuagacuguggcccuccaagcucuucccaucuuccucgaacugcaccccuccucaaggagcacaggcccuucccccaaugggaguacucuucccuuccaggucccguuggagucccaggccacccuccggagguuuaaaccuccauucccugaggaccagcccucgccacccuaccaucucaucucucauuguucugcagaauccuguucccccaacacuaacucccacagcagcagagucccuuccccgcuugggcggucaccacuguacuuccgacucuggaaagccucccuucgcuacuuucucccugcagcuaccugcucaagauaggcuacuccguuuaugaaaccugccucucucuccugggcugagucucucagcuguuuggcagggacuuugggacaccugcucugguuauguuugcagacacugccugaccucucaaacagaaaguaacauuccaccuucagaaagaagguagugggaucgucuccaagcugggucugaugggagaugggugcccgagguauuacuaagacacaacucaaaccucauuugugaaagaaauuucuuguuuacacaaaggggugggaggggcccaccauccuggccaugcucugagaaagaauccgguccuuuggcaacaugaaggcaaggaccccacugaaccaggcucugggacccuggaaggagcgcuuauuccacccgucccgggacaagcuuaagaaaaagcgcuugcacaagaaguacgcuacacgcgugggcauuuagggauuugaggucaguuucaggggcuccuucuuguggucccugcccgcggcuuugcuuaguuucaacgaccucccaauacgguccccuaguagccccaaacacgagaaagagaaaucgcauucugguggucaugcgggaaucugggaccuccccacaacccaaaguuucccccccaucuccagcgaacccaccaagugcccccuuuacaaucucacaaccuccggcucacucuacaccagugaagacuaggaauaaauccacgaucuggccccgcaccugcgggguucuccaauuuggagggggcguggauggugccaaggucaggacucugcgugcggccacgcgggagaggcugcaagcgguccgaccacgcggugcagccggcuucccaggagccccaccaggcuuggggcggaggggaaugaccaggggucccggcagagccgcggcuguccacucaccauuaugggagugagaugcaggcgacaguagcagcagcagcagcgcggagagcgccguagugggaggcaugguugugcucgcccggggacuccgagcagguggcugcggcgcuggcgcagggucgcgcguccggacagcgggagcgucggcgccgcuccgggaggccuggcgacggccgcgaacuccggagucgcgauccggccgcuccuccugccuaccgcagagcugggcugggacacggagccagcagcgacgagcgaaggugucugcggcccgggcggugucugcgccgcugcggccccgcgcacguugcugcgaagacucccgccccgucccguccgcgcuggccuccgcccccucccccaggagcucgcccacagcggcggcggggucgggcggggcggcggcugggcgggcgcugggcugcgaacaauaagcagaggaggaaacuccgcccuggagcgcggcgggcgggggagcaggggcuggcggucccgggcagugcgugugugagugagugugugugugugugugugugugugugugugugugugugugugugugugccugugaaucugugcucacgcuguguauacuugccugcgcgcgcgccagggacccugucagacaaucaauccaugccgcggauguccuacacauugcuuuugcaggggaucagcccggauccuccauaaugcuaccgcccuuacaacgcaggcacaggcccccccagucuggaaguuccgauaagaaccgacccuuccaggcccccagaccucagcgccuuccugcggcagaacaagggaagcagguccccugcccagcaggugc

SEQ ID NO: 10130 - RNA, 2501 nt, Mus musculus
gcaccugcugggcaggggaccugcuucccuuguucugccgcaggaaggcgcugaggucugggggccuggaagggucgguucuuaucggaacuuccagacugggggggccugugccugcguuguaagggcgguagcauuauggaggauccgggcugauccccugcaaaagcaauguguaggacauccgcggcauggauugauugucugacagggucccuggcgcgcgcgcaggcaaguauacacagcgugagcacagauucacaggcacacacacacacacacacacacacacacacacacacacacacacacacucacucacacacgcacugcccgggaccgccagccccugcucccccgcccgccgcgcuccagggcggaguuuccuccucugcuuauuguucgcagcccagcgcccgcccagccgccgccccgcccgaccccgccgccgcugugggcgagcuccugggggagggggcggaggccagcgcggacgggacggggcgggagucuucgcagcaacgugcgcggggccgcagcggcgcagacaccgcccgggccgcagacaccuucgcucgucgcugcuggcuccgugucccagcccagcucugcgguaggcaggaggagcggccggaucgcgacuccggaguucgcggccgucgccaggccucccggagcggcgccgacgcucccgcuguccggacgcgcgacccugcgccagcgccgcagccaccugcucggaguccccgggcgagcacaaccaugccucccacuacggcgcucuccgcgcugcugcugcugcuacugucgccugcaucucacucccauaauggugaguggacagccgcggcucugccgggaccccuggucauuccccuccgccccaagccugguggggcuccugggaagccggcugcaccgcguggucggaccgcuugcagccucucccgcguggccgcacgcagaguccugaccuuggcaccauccacgcccccuccaaauuggagaaccccgcaggugcggggccagaucguggauuuauuccuagucuucacugguguagagugagccggagguugugagauuguaaagggggcacuugguggguucgcuggagaugggggggaaacuuuggguuguggggaggucccagauucccgcaugaccaccagaaugcgauuucucuuucucguguuuggggcuacuaggggaccguauugggaggucguugaaacuaagcaaagccgcgggcagggaccacaagaaggagccccugaaacugaccucaaaucccuaaaugcccacgcguguagcguacuucuugugcaagcgcuuuuucuuaagcuugucccgggacggguggaauaagcgcuccuuccagggucccagagccugguucagugggguccuugccuucauguugccaaaggaccggauucuuucucagagcauggccaggauggugggccccucccaccccuuuguguaaacaagaaauuucuuucacaaaugagguuugaguugugucuuaguaauaccucgggcacccaucucccaucagacccagcuuggagacgaucccacuaccuucuuucugaagguggaauguuacuuucuguuugagaggucaggcagugucugcaaacauaaccagagcaggugucccaaagucccugccaaacagcugagagacucagcccaggagagagaggcagguuucauaaacggaguagccuaucuugagcagguagcugcagggagaaaguagcgaagggaggcuuuccagagucggaaguacaguggugaccgcccaagcggggaagggacucugcugcugugggaguuaguguugggggaacaggauucugcagaacaaugagagaugagaugguaggguggcgagggcugguccucagggaauggagguuuaaaccuccggaggguggccugggacuccaacgggaccuggaagggaagaguacucccauugggggaagggccugugcuccuugaggaggggugcaguucgaggaagaugggaagagcuuggagggccacagucuaacaaggaccgacaagucuguagagugcccuggcaacuucauggucuucacaugcagucuuuuggagggggagccccuaguaccauucaaaagccagaugagcuaguuaguccacagugauuccaaucuuauagaagccaagcuuggagaagauacaggcuaaagggagaucccuggaagccaucagugaacugcucccaaccgggucccuggacaucaagguugggcuucuucuucuucuucuucuucuuuuuuuuuuuuuuuuuuuuuuuuuuuuuuggccuuuuugagauaggguuucucuguauagucuuggcuguccuggaacucacuuuguagaccaggguggccucaaacucagaaauccgccugccucugccuccugagugcugggauuaaaggcgugcaccaccacgccccggcaagguuggguuucuu

SEQ ID NO: 10131 - RNA, 2501 nt, Mus musculus
agagugguuagaaugaaaucagaguaaaaugcuugcacaaaugucacaguauuaguaacagcucuugccuuuucauaguaaccuuaguauaaaaaccaaccccccucucugucucugucucugucucugucucugucugucuguuggucugucugugucugugucuguccccccuccuccccccucacacacagacaguauaaaccagaaagccagucaccagcugugaauggaaagauaugggagccccuacaagggccucaaucuccguaaucaaugagaguaauggaucgauaauccauuuuaucagcucuaccugugacuagugugagauuuccuuccccccuccuuucccuagacucuaucaccagacagcuaccauuaugcagucagaaagccauuaaugucucguucccaguucugaaccucgggugacucucaagcuugccucgauuuaccugagcacaaauccugacuguaugagucagggcaguaugugugaugaccauuaauaagcacggagggggccaauacugaguuuccuaucaggaaacucgggcuucccuuaguuugaauguucugguugugaugcaaauuuaauucgauauggcagguuaaagucagaaaaguuugaaagacugugggauaaggcaacaaguagacgggaugggggugggggcugaguucuucccacaaguccugccgcuaggaauagggcauucgccuuuguaaggagccuguuugcuggcucagaaucguugaccaugguuaagccacccacccuagaagccaccagcauccaucaucucugaaguaccuggcacauaauccuauuucuucuuccuagcccauccauccucucaggguuggaagacuggcugggaacuuccagaaggaagaaaaccauccuucccucacaaacaccagcuccucacgcuagcagcucaaaggagaaaucgaggaagaagcauccgagcauuccucuuccucaaauaagcagcugggggauuccaaugccuuaagcuggagcccacagccauucguucacuuuuauccccucgcggaaccgccuacuguugcaacgcacuccccaccccggaguggguggcuaggguagagacggugugacacagccagugagucuucccagaaaggcagccugccagcgaaagcuucuccagccccauccccuaacgcucucacguuaauuccuaaaaaugaagccuucggagaaagugaacuaggcggcugggaaaguuacggcgcagggagcaauccggagcaagggcaggcgcagagcagggucguucugaacccucgugggaggcgacguacgcgggaggggggggggugucuuccucucggcgucuauaagaaccuuucagcccagcaggaaaacagagaaaacaaaagccaaugugcccgcugccgcaaaccaauccucccgcacugaagcggagcaaauaggagagcggcgacuaggcggcggagcggagcugagagcggcggcgggacggagcagggggcggaacaaagcccccgggaucccucggcuccagucuggagacacagcgcccccgugccccgggacccccgggcagggagggaugcaggugugugggugcgagugcgugcgcagcgagucccucccccgcgcccccgaaacccagugugcagucucccccaccgcccccccccaauccuuccaucccuaaguggcucucaccggagcgaggaucgaaggugaccacgaacacggccaccaccugguccuccucuacgucgccuagcucuaggcgccccggcugcagcagcacuucggggggagcuggcucgucggguucccgccuucggggcgccuccgcggccacucggcccuccccacugccgccccggacccauccuccagcuugcagcgcgggguccugcggcacagagaccgcggggcccucggcccagcgcagcagcggcgccgcgucucccugcuccaccauggcgaggcgaggcggagccggggcgcgaggggcggggcaggcugcgggcacuccccuccgggccugcccgcccugccgcuuucugcggugcggaggcucucugggugcccgcugggcuuggccacaccugccccugcucggacaccagcgcacuugcuuggucccggagcucuggaagguggcccgcacggguucagcgccccguggccugguccgggcuucagcucugcaucucuguaugugggugcucuugauccauaguguagggugcaggacgcgcaucccuuagucugucaccugcgcguggguugaagagccuucccaacuaggauuccacugugaauuuuugaacgucaccauuauggagcggagcacauauauuauauaaucccgagagcuuggugaaaacugccuccaagucaggaagugaagcagaggacaucccaaguguuucaaauacacacacaaaucaagaucaaaaggacuguaagguugccauugggcauu

SEQ ID NO: 10132 - RNA, 2501 nt, Mus musculus
aaugcccaauggcaaccuuacaguccuuuugaucuugauuuguguguguauuugaaacacuugggauguccucugcuucacuuccugacuuggaggcaguuuucaccaagcucucgggauuauauaauauaugugcuccgcuccauaauggugacguucaaaaauucacaguggaauccuaguugggaaggcucuucaacccacgcgcaggugacagacuaagggaugcgcguccugcacccuacacuauggaucaagagcacccacauacagagaugcagagcugaagcccggaccaggccacggggcgcugaacccgugcgggccaccuuccagagcuccgggaccaagcaagugcgcugguguccgagcaggggcagguguggccaagcccagcgggcacccagagagccuccgcaccgcagaaagcggcagggcgggcaggcccggaggggagugcccgcagccugccccgccccucgcgccccggcuccgccucgccucgccaugguggagcagggagacgcggcgccgcugcugcgcugggccgagggccccgcggucucugugccgcaggaccccgcgcugcaagcuggaggauggguccggggcggcaguggggagggccgaguggccgcggaggcgccccgaaggcgggaacccgacgagccagcuccccccgaagugcugcugcagccggggcgccuagagcuaggcgacguagaggaggaccaggugguggccguguucguggucaccuucgauccucgcuccggugagagccacuuagggauggaaggauugggggggggcggugggggagacugcacacuggguuucgggggcgcgggggagggacucgcugcgcacgcacucgcacccacacaccugcaucccucccugcccgggggucccggggcacgggggcgcugugucuccagacuggagccgagggaucccgggggcuuuguuccgcccccugcuccgucccgccgccgcucucagcuccgcuccgccgccuagucgccgcucuccuauuugcuccgcuucagugcgggaggauugguuugcggcagcgggcacauuggcuuuuguuuucucuguuuuccugcugggcugaaagguucuuauagacgccgagaggaagacaccccccccccucccgcguacgucgccucccacgaggguucagaacgacccugcucugcgccugcccuugcuccggauugcucccugcgccguaacuuucccagccgccuaguucacuuucuccgaaggcuucauuuuuaggaauuaacgugagagcguuaggggauggggcuggagaagcuuucgcuggcaggcugccuuucugggaagacucacuggcugugucacaccgucucuacccuagccacccacuccgggguggggagugcguugcaacaguaggcgguuccgcgaggggauaaaagugaacgaauggcugugggcuccagcuuaaggcauuggaaucccccagcugcuuauuugaggaagaggaaugcucggaugcuucuuccucgauuucuccuuugagcugcuagcgugaggagcugguguuugugagggaaggaugguuuucuuccuucuggaaguucccagccagucuuccaacccugagaggauggaugggcuaggaagaagaaauaggauuaugugccagguacuucagagaugauggaugcugguggcuucuaggguggguggcuuaaccauggucaacgauucugagccagcaaacaggcuccuuacaaaggcgaaugcccuauuccuagcggcaggacuugugggaagaacucagcccccacccccaucccgucuacuuguugccuuaucccacagucuuucaaacuuuucugacuuuaaccugccauaucgaauuaaauuugcaucacaaccagaacauucaaacuaagggaagcccgaguuuccugauaggaaacucaguauuggcccccuccgugcuuauuaauggucaucacacauacugcccugacucauacagucaggauuugugcucagguaaaucgaggcaagcuugagagucacccgagguucagaacugggaacgagacauuaauggcuuucugacugcauaaugguagcugucuggugauagagucuagggaaaggaggggggaaggaaaucucacacuagucacagguagagcugauaaaauggauuaucgauccauuacucucauugauuacggagauugaggcccuuguaggggcucccauaucuuuccauucacagcuggugacuggcuuucugguuuauacugucugugugugaggggggaggaggggggacagacacagacacagacagaccaacagacagacagagacagagacagagacagagacagagagggggguugguuuuuauacuaagguuacuaugaaaaggcaagagcuguuacuaauacugugacauuugugcaagcauuuuacucugauuucauucuaaccacucu

SEQ ID NO: 10133 - RNA, 2501 nt, Mus musculus
cagagagccagagggcuccaagaugagauggaugcuuugagcccaauucucuugggggacagggaauagauucaggaaauagagauaguaacaagaaacaagaggacuucauaauuucagagcuaaaagaacagaaauuuaaggugagaagacagaaaacaauggcagagguggacaggacacuuugagaacuggugaaaaagucgggaaccaggagggagauuccugaccuaagugcaagguuuccucuguaacucuuggggaagaauuccuugaguauuuacagagagauucaagaauaaucggguggcagccauccgcccuugcuuacaugaacuuuugcuuuuuggguuuaggaucauagguccccccccccccccuuuuuuuaaagaagugcacugacuaggucuugggcaggaagaagcauccagcaugcagcaauagaacuggcgacaaacaaaggggauggcggucccagggacugacagguagggcugggcugccacacauccaaaguuguuaugccuucucuugggaucuugugaaacgaugagagacaggacuaggaccuguggcuaggucagaaagacaucuggaccuaucaguaauggggcaggcagagcaagcucucucggagaagagugggagcgaggggagggaggggguggccuuugaggaagagggggagcugagucagagccuuagggggcagggagauggaggggaggagaacagggaaagagguaaaagcagaggagggucuccauggaaauaaaccgggucucagaaaucaggcuuccggagaguguaguuuguuuguaauaauaauacgaauuauucucucagccugaggucacuagggcguguaggcgggagaaauugggaguuaggaaggggaaaauugggggguuugggagaggacuguacuaauguguucagcccuaaaguggaauggaugcguaggguggggguagggggcgguaguaaggcaggggcuggaaggagaggaccauuaaggaagcgccuuucuucccucccccugccaaagguaaauaaaaagccggcccugcuccgccugcccccgcugacaggugcaggcgggucccaggguuccuaggcggaccccacccucugggaagcggacucccgaccucucucggggagguaaaccuccaccuccucccugaguccacggcucuuccagagcaccccggcccaagaccauucccuccaagcguggaacccauucccucccgguggcacacgcucuucccgcccccgccccagagggaaaaugcacgugaacaaagcaaaucggggggaggcaggagcgacgggaaaaggcuaccaagagggaaaugguugggggcaaaacacacaugccauauggagaagagggugaagaugggagggggcgugcggaagaaagucagggaugaggcuggagaggagguucugagaagaggggcugcucccgaaagaagggcucggggaggcucuggcuacagcagaguagacgcgaauggccugaagguggagggauggggccaucgggaguagggaacagcgacugagccgcgaaggaugcuguggagaggcuaccagggaaggaccgcgccugcgggagggcgauggagagaaggcuaugagcugagagggauggaagcccuggaggcgcgagggcacaaggauagagggaccuuagcggauggagggaaaguaaaggcgcgaggcagggccgggcgggcgcggagggagguccccaggggcaaggauggggaugggggagggggccggaggagcgccccggggcgagcuugccccugacccgcgccgggcugcgguacccacccacaguccgcgagccgaugcagcccauggcuccgggggccgccgggucccggcccucaccgacucggggcccucgccggggggagcaccgggaaccgcgccgccgccccagccgcucugcagcgccgcggcugucuccgcucggcuccgcuccccccuccccucuccaucccuccccacggcagccuccgucgccgccgcugccgccgccgccaccgccuggcucccccgccccgcucagcucuccgcggccggggagggggcugcucggggauuggcugcgcgcagagccuccccgcccugcccccgaccgggcaccgcgcuccccgcgccccucgccgcgcugcaaccacgucccuccgccuguccuucgcaacccccgccccugagcuccucgccauccccgcugaguucucccgggagaugcugauggagaauguggauaauaacccgcuugucucaggagcccggucaggaagccagggcccacccuuaggauaugcuugauggacuuugagggcugcggggugagaaggccgagagagaaaguggggcggagaugagagaacacccugcuuggccuuggguaccaaauuccgcaaacauuuguuuucuuccugaugcugcaucugggacgcacgaaucgggau

SEQ ID NO: 10134 - RNA, 2501 nt, Mus musculus
aucccgauucgugcgucccagaugcagcaucaggaagaaaacaaauguuugcggaauuugguacccaaggccaagcaggguguucucucaucuccgccccacuuucucucucggccuucucaccccgcagcccucaaaguccaucaagcauauccuaagggugggcccuggcuuccugaccgggcuccugagacaagcggguuauuauccacauucuccaucagcaucucccgggagaacucagcggggauggcgaggagcucaggggcggggguugcgaaggacaggcggagggacgugguugcagcgcggcgaggggcgcggggagcgcggugcccggucgggggcagggcggggaggcucugcgcgcagccaauccccgagcagcccccuccccggccgcggagagcugagcggggcgggggagccaggcgguggcggcggcggcagcggcggcgacggaggcugccguggggagggauggagaggggaggggggagcggagccgagcggagacagccgcggcgcugcagagcggcuggggcggcggcgcgguucccggugcuccccccggcgagggccccgagucggugagggccgggacccggcggcccccggagccaugggcugcaucggcucgcggacuguggguggguaccgcagcccggcgcgggucaggggcaagcucgccccggggcgcuccuccggcccccucccccauccccauccuugccccuggggaccucccuccgcgcccgcccggcccugccucgcgccuuuacuuucccuccauccgcuaaggucccucuauccuugugcccucgcgccuccagggcuuccaucccucucagcucauagccuucucuccaucgcccucccgcaggcgcgguccuucccugguagccucuccacagcauccuucgcggcucagucgcuguucccuacucccgauggccccaucccuccaccuucaggccauucgcgucuacucugcuguagccagagccuccccgagcccuucuuucgggagcagccccucuucucagaaccuccucuccagccucaucccugacuuucuuccgcacgcccccucccaucuucacccucuucuccauauggcauguguguuuugcccccaaccauuucccucuugguagccuuuucccgucgcuccugccuccccccgauuugcuuuguucacgugcauuuucccucuggggcgggggcgggaagagcgugugccaccgggagggaauggguuccacgcuuggagggaauggucuugggccggggugcucuggaagagccguggacucagggaggagguggagguuuaccuccccgagagaggucgggaguccgcuucccagagggugggguccgccuaggaacccugggacccgccugcaccugucagcgggggcaggcggagcagggccggcuuuuuauuuaccuuuggcagggggagggaagaaaggcgcuuccuuaaugguccucuccuuccagccccugccuuacuaccgcccccuacccccacccuacgcauccauuccacuuuagggcugaacacauuaguacaguccucucccaaaccccccaauuuuccccuuccuaacucccaauuucucccgccuacacgcccuagugaccucaggcugagagaauaauucguauuauuauuacaaacaaacuacacucuccggaagccugauuucugagacccgguuuauuuccauggagacccuccucugcuuuuaccucuuucccuguucuccuccccuccaucucccugcccccuaaggcucugacucagcucccccucuuccucaaaggccacccccucccuccccucgcucccacucuucuccgagagagcuugcucugccugccccauuacugauagguccagaugucuuucugaccuagccacagguccuaguccugucucucaucguuucacaagaucccaagagaaggcauaacaacuuuggauguguggcagcccagcccuaccugucagucccugggaccgccauccccuuuguuugucgccaguucuauugcugcaugcuggaugcuucuuccugcccaagaccuagucagugcacuucuuuaaaaaaaggggggggggggggaccuaugauccuaaacccaaaaagcaaaaguucauguaagcaagggcggauggcugccacccgauuauucuugaaucucucuguaaauacucaaggaauucuuccccaagaguuacagaggaaaccuugcacuuaggucaggaaucucccuccugguucccgacuuuuucaccaguucucaaaguguccuguccaccucugccauuguuuucugucuucucaccuuaaauuucuguucuuuuagcucugaaauuaugaaguccucuuguuucuuguuacuaucucuauuuccugaaucuauucccugucccccaagagaauugggcucaaagcauccaucucaucuuggagcccucuggcucucug

SEQ ID NO: 10135 - RNA, 2501 nt, Mus musculus
gaauacccaaucacauggagccuccugcaaacucugcuuggcaauggauaucagcccugguccccaccugucaagucuucaaaaccguccccaaaccaucagcagucacucaccacccacugugucuuugccaggguaaguacagggaccacuuaauucucuggaccaagauggggagagggaagcuacacguggacccuucagccccuagggcaguagcuagugaaaugagagccagcccuggaggaccaguaacacuuuagggauacgggggugggaggaggugaacaagggcuauugcagagguaguaaaugacucugacuuccucucccuaaaccccuaccucaaagacucacaacccccauaggacuaaccgggcgagaacaacccccacaccaggccaggacacuccccgauuuuugcacuucucagcuccacuuccaaccgguucucugccccuccuuuagcaggcuccccucccccuucccuggcagccuucccucugccccuccccucucgcugccuuccgcccucucuccccaccaaaucuggcagccuuuuggggcuccuccucuugccccgccccuuuggcuccucccuugcgcgcacccgucgggucaacccccaggggcccccuucgagucggcccucagcagcuacggccucucccgacccuccucuaccagcagucuugggcagcgcuccccucccccuuccuccugugcccgcccgccuaguucuccgcacgccacccccuccccaggcugcacacucccucccuuccuucccccuccucuuuuccuuccuccccccccccacucccgcccuccccuucucagcugcucucccccauccgcuugccccuccccucuccucccccacucggguuucuuuuccuucuuuccucuccucaguucccucccccucccccacaccagccuccccucugcuucccucccucccgcugcucuccuuccccccucagcggcccccgccucccuucccccucugccuacccugcaagcuccggcuccgcuucucuccccucccgguccccagccuuguucuuccccucccccuccuaguccgcucccuagcuuccaggucucacgccccccaucuugggggggggaauccaagcuaaccccacauucucuggaccuacucccucguucugccccuccccauaccccuuucuucccaacacaccucccucucagcagcccccuugcccauuucugcuccccacugacuucacgcccucuccggaguuuuccuucugacuagacuccccccaauccccgccccuguuagagcuccggagucacuccgggucccggcccccugcccugcucuaggcucaccugucagcguccuucgcucccgaccagccccaucccugagcccguuuccugcccuuucgcacuggacccuuccucuaucccgaggaacccuacucccgcuccuggggauccuccccgcaggccccucccgcccucuucccaccugcucccaccgggccuccccgaguccuugcccuccccuccaguuuccuagucuccccaucugcgccaggacccucccuccugacucccuucccuccuggucugacccccccccucccccacacucgcgucugcgcgccccuucccucgggguugucaccugccgugggucggcagggcuuguaaagcuccguuuggguggcgggggagacgccugcccgggagucucggguguccuuaccuggcgggcuccugcggcuacgugccgcggcccgcuucggggacccaggcgcucgggccuccggucccgggcggccguuugcacaauggcgccggcugccugcagcuugggugcgggcugcccgaaagacuccgggacugacagcccugaaacuucgcggggaggggaaggaaagacgcggagggagaggguguggggcagcguugcgggugaucggggggaggaacccgggaagcgggaacacugcuccggggcacaggcuaaagcggagggucuucgagagaccugccgcgggagggugcacuaaugggcuugggugcaggugacggucugagggcaagaugcccggaguguggagauggaaagugggagcuuaggaccgaggaagggcagaggggagaggaaggagaagaagaggcuagaaggaagggcacucgggcuagaagggagggugcucacagccuaggagggaggagcuggagaaagguggagcgcggaacggggugguggugguaguagugaagaguuggggggaguagggagaggagggggcguguuuggggaggagagcaauguguguauggcugucuuuaaaaucgccaguggcagccgaguaagugguagcgccgcggucccgcgggagacugucuggccagcagagauugggagaaucggucaaaaaacucuccaccaggauccacccagaccggaggacgcgauccaagucucaccgcggagacugaggauuaagaac

SEQ ID NO: 10136 - RNA, 2501 nt, Mus musculus
guucuuaauccucagucuccgcggugagacuuggaucgcguccuccggucuggguggauccugguggagaguuuuuugaccgauucucccaaucucugcuggccagacagucucccgcgggaccgcggcgcuaccacuuacucggcugccacuggcgauuuuaaagacagccauacacacauugcucuccuccccaaacacgcccccuccucucccuacuccccccaacucuucacuacuaccaccaccaccccguuccgcgcuccaccuuucuccagcuccucccuccuaggcugugagcacccucccuucuagcccgagugcccuuccuucuagccucuucuucuccuuccucuccccucugcccuuccucgguccuaagcucccacuuuccaucuccacacuccgggcaucuugcccucagaccgucaccugcacccaagcccauuagugcacccucccgcggcaggucucucgaagacccuccgcuuuagccugugccccggagcaguguucccgcuucccggguuccuccccccgaucacccgcaacgcugccccacacccucucccuccgcgucuuuccuuccccuccccgcgaaguuucagggcugucagucccggagucuuucgggcagcccgcacccaagcugcaggcagccggcgccauugugcaaacggccgcccgggaccggaggcccgagcgccuggguccccgaagcgggccgcggcacguagccgcaggagcccgccagguaaggacacccgagacucccgggcaggcgucucccccgccacccaaacggagcuuuacaagcccugccgacccacggcaggugacaaccccgagggaaggggcgcgcagacgcgagugugggggagggggggggucagaccaggagggaagggagucaggagggaggguccuggcgcagauggggagacuaggaaacuggaggggagggcaaggacucggggaggcccggugggagcaggugggaagagggcgggaggggccugcggggaggauccccaggagcgggaguaggguuccucgggauagaggaaggguccagugcgaaagggcaggaaacgggcucagggauggggcuggucgggagcgaaggacgcugacaggugagccuagagcagggcagggggccgggacccggagugacuccggagcucuaacaggggcggggauuggggggagucuagucagaaggaaaacuccggagagggcgugaagucaguggggagcagaaaugggcaagggggcugcugagagggagguguguugggaagaaagggguauggggaggggcagaacgagggaguagguccagagaaugugggguuagcuuggauucccccccccaagauggggggcgugagaccuggaagcuagggagcggacuaggagggggaggggaagaacaaggcuggggaccgggaggggagagaagcggagccggagcuugcaggguaggcagagggggaagggaggcgggggccgcugaggggggaaggagagcagcgggagggagggaagcagaggggaggcuggugugggggagggggagggaacugaggagaggaaagaaggaaaagaaacccgagugggggaggagaggggaggggcaagcggaugggggagagcagcugagaaggggagggcgggaguggggggggggaggaaggaaaagaggagggggaaggaagggagggagugugcagccuggggaggggguggcgugcggagaacuaggcgggcgggcacaggaggaagggggaggggagcgcugcccaagacugcugguagaggagggucgggagaggccguagcugcugagggccgacucgaagggggccccuggggguugacccgacgggugcgcgcaagggaggagccaaaggggcggggcaagaggaggagccccaaaaggcugccagauuugguggggagagagggcggaaggcagcgagaggggaggggcagagggaaggcugccagggaagggggaggggagccugcuaaaggaggggcagagaaccgguuggaaguggagcugagaagugcaaaaaucggggaguguccuggccugguguggggguuguucucgcccgguuaguccuauggggguugugagucuuugagguagggguuuagggagaggaagucagagucauuuacuaccucugcaauagcccuuguucaccuccucccacccccguaucccuaaaguguuacugguccuccagggcuggcucucauuucacuagcuacugcccuaggggcugaaggguccacguguagcuucccucuccccaucuugguccagagaauuaaguggucccuguacuuacccuggcaaagacacaguggguggugagugacugcugaugguuuggggacgguuuugaagacuugacagguggggaccagggcugauauccauugccaagcagaguuugcaggaggcuccaugugauuggguauuc

SEQ ID NO: 10137 - RNA, 2501 nt, Mus musculus
caguagauccaaugggucuauggaagccacugggaccuugcggucccgcacaccugcaccgggagcgggaaaaaccucgcucgccugccucccucccagagcgcgcaguuaucccgcgggccccagauaugcuccccaaguagaauauucaggucccuacagacccgcacgcagagagcugacaauucccgcgacaggcaaccuaagcggucccgcuucaucucccuagcgggacucgacggucggggauagagagagggcuccgagggugcucacucuugacuguucccuucuccccgcagagcgggccgcuuagaauugggguguggguggcuccagacgccgccacucgagcggcaguggcuccagccuccucccccgccgcugggggcgggaaguggcugugggagucacccgggcgugacugcccccgaggccccuccugccgcgacaagggcgcuccauaaaagccugugggcgacccgcucuccgcaucccaccgguggaucucuucucucacagaggcacccagagcagagcacccgccgcucagcgacgacugcccgcccgccacggugagugccaggaucaacugggacaggggcgcgggcucccagacgccagugaacuugccccgcagccgguccccugagcuugcucugccagcuugacacccagcucuuuggggcgccuaaauuucacuugcuggacucagguucuacuguccaccugcccuuccccgggacccuccaaucugggcgccccgccuccgugccucuuaucuuuugaggguagggagaagaaccugggaacaccuaucccagggcagcggugggguuuuguuugguuguuuguuuguuugguugguugguugguuacaaccaggaacccagauugcaugugugcuccuagugggagauucccccaaguauugucucuagcacggugagcucuguugccuccaaaauccgaacugagccucuggguauccgacugucacagcgcuuguagccacacaaaucaaaagcaacccagaagaaaaguuuucuccuccaagggugauuuaggaacgagaggagaaaaguggucauucuuuaagauagagggcagaacuuccaauucuguucugaaaaggggaccucugccucucaccaggagaaucggaggaaguuuucugaaauauguggacggggcagaagauccaggucggggcaaguggucuucuaaagauuuggaaguggcgccugcccagucugggcuuuuauucuagggucugggaugggauuagaugagggucuagagugauagcuggaauugggacaaagacgagcaaucucagcaucuccaagucugagccuucuguauccacagaugcuagguaacaagcgaauggggcuguguggacugacccucgcucuaucucugcucguguguuugggcauucuggcugagggguaccccuccaagccggacaauccgggcgaggacgcgccagcagaggacauggccagauacuacuccgcucugcgacacuacaucaaucucaucaccagacagaggugggugcauacgcggcugguaccuagagccgggaaaacuugcgguucuggagaucuuggacaucagggaucauuucuuucuccuuguucauagggcaggaucagacauaaauucagcucuagauaaauaugugagcuggguacacacuccacaaacuggauacauugucuuugucacuagacuuucucuccaagacccaagcccaagguucagugccucuaggcuguccucugucugccacuuaccuuuccugccuuuuuugcuuacaucaguuggagauuuacccagcacauaucucgggggaaaggccugcauugggcaggggugcagaaguguaaagguguagggagaagaggaacccugauuuagaguaaacaaccacagucaaagaaaaccaaggacacaauccagcugucaaaaggguggagagaucuuugagccugcccagggcaaagggaguggcugcauuuagggaaauaaauaaauaaauaaauaaauaaauaaauaccaugggcuucuucugaacuaauaaaaaggcugacuuuucccauuuuauagcaacugaguucugaaaagaaagugccccauuaagaagaaacaaaagagaacaaagccuuuacauuagggacucugauggcuacagcuccaacugccugggaccugagagacagaccacaaucuguacuuuuaauguccagaaagucagaggcgagccuugccuuuccucucagcauuaaaaucaagcaggaaaaauaaaauccacgcuauuuuacaaacaauaugggacuuagucugcaaaauuggugcaucuuaguucuaaaucauuuaacaacacauuucaauuacugagaauuacugagaaccuugaaggaccauauaggcaagcccuuuggaggcauuaauguucuuuacuuagcauguuucaauuaugcauaguagau

SEQ ID NO: 10138 - RNA, 2501 nt, Mus musculus
aucuacuaugcauaauugaaacaugcuaaguaaagaacauuaaugccuccaaagggcuugccuauaugguccuucaagguucucaguaauucucaguaauugaaauguguuguuaaaugauuuagaacuaagaugcaccaauuuugcagacuaagucccauauuguuuguaaaauagcguggauuuuauuuuuccugcuugauuuuaaugcugagaggaaaggcaaggcucgccucugacuuucuggacauuaaaaguacagauuguggucugucucucaggucccaggcaguuggagcuguagccaucagagucccuaauguaaaggcuuuguucucuuuuguuucuucuuaauggggcacuuucuuuucagaacucaguugcuauaaaaugggaaaagucagccuuuuuauuaguucagaagaagcccaugguauuuauuuauuuauuuauuuauuuauuuauuucccuaaaugcagccacucccuuugcccugggcaggcucaaagaucucuccacccuuuugacagcuggauuguguccuugguuuucuuugacugugguuguuuacucuaaaucaggguuccucuucucccuacaccuuuacacuucugcaccccugcccaaugcaggccuuucccccgagauaugugcuggguaaaucuccaacugauguaagcaaaaaaggcaggaaagguaaguggcagacagaggacagccuagaggcacugaaccuugggcuugggucuuggagagaaagucuagugacaaagacaauguauccaguuuguggaguguguacccagcucacauauuuaucuagagcugaauuuaugucugauccugcccuaugaacaaggagaaagaaaugaucccugauguccaagaucuccagaaccgcaaguuuucccggcucuagguaccagccgcguaugcacccaccucugucuggugaugagauugauguagugucgcagagcggaguaguaucuggccauguccucugcuggcgcguccucgcccggauuguccggcuuggagggguaccccucagccagaaugcccaaacacacgagcagagauagagcgagggucaguccacacagccccauucgcuuguuaccuagcaucuguggauacagaaggcucagacuuggagaugcugagauugcucgucuuugucccaauuccagcuaucacucuagacccucaucuaaucccaucccagacccuagaauaaaagcccagacugggcaggcgccacuuccaaaucuuuagaagaccacuugccccgaccuggaucuucugccccguccacauauuucagaaaacuuccuccgauucuccuggugagaggcagagguccccuuuucagaacagaauuggaaguucugcccucuaucuuaaagaaugaccacuuuucuccucucguuccuaaaucacccuuggaggagaaaacuuuucuucuggguugcuuuugauuuguguggcuacaagcgcugugacagucggauacccagaggcucaguucggauuuuggaggcaacagagcucaccgugcuagagacaauacuugggggaaucucccacuaggagcacacaugcaaucuggguuccugguuguaaccaaccaaccaaccaaacaaacaaacaaccaaacaaaaccccaccgcugcccugggauagguguucccagguucuucucccuacccucaaaagauaagaggcacggaggcggggcgcccagauuggagggucccggggaagggcagguggacaguagaaccugaguccagcaagugaaauuuaggcgccccaaagagcugggugucaagcuggcagagcaagcucaggggaccggcugcggggcaaguucacuggcgucugggagcccgcgccccugucccaguugauccuggcacucaccguggcgggcgggcagucgucgcugagcggcgggugcucugcucugggugccucugugagagaagagauccaccggugggaugcggagagcgggucgcccacaggcuuuuauggagcgcccuugucgcggcaggaggggccucgggggcagucacgcccgggugacucccacagccacuucccgcccccagcggcgggggaggaggcuggagccacugccgcucgaguggcggcgucuggagccacccacaccccaauucuaagcggcccgcucugcggggagaagggaacagucaagagugagcacccucggagcccucucucuauccccgaccgucgagucccgcuagggagaugaagcgggaccgcuuagguugccugucgcgggaauugucagcucucugcgugcgggucuguagggaccugaauauucuacuuggggagcauaucuggggcccgcgggauaacugcgcgcucugggagggaggcaggcgagcgagguuuuucccgcucccggugcaggugugcgggaccgcaaggucccaguggcuuccauagacccauuggaucuacug

SEQ ID NO: 10139 - RNA, 2501 nt, Mus musculus
agccaggccgaaagaagggaaggaggggagagagagcuggagucaagaaagagauagaggacagaaaagagggggauagaaagaaagacugagggagagaaaaagagagggaagggaagaagggggagaggggggggagaaagagagagaauaugagaaugagaauagcggagaaacuuauuguaaaaauuccaaggcaaauggaguuaaauaaauuuacgaggaucgaacccauuaauugggccauaaaaaguuuuaugagccucauuuacauacaaugcuacgggucucuccacgcuauggcgccucagcucuaauuaaaaccagaaaggcagcgccacggggacuugcggggccgccggcuggaagccgccgggcugggcucucucagccccccgcgcccugcucccgccccuccgcuccucccgcucgccgaccccgccgaccacugagccuaccugaacugcgcauccagggguagaugcggaaacuggcuucggccgggccgugaagcacgcccucguccgccuugucgcaggcgccuuuggcgaggucacugcagagcccggggauguuuuggucguaggaggcgcagggcagguuguaggcgucggcucccaggccauagccggacgcgaaggggcucugauagagggggcuguugacauuguauaagcccggcacaguggaggcgaaggcgccggcgcccggcccguagccgcuucucugcgaguugggugcaaaggagcaagaagucggcucggcauuuuggaagagagaagcccccgccguauauuugcuaaaaagcgcguucacauaauacgaagaacucauaauuuugaccugugauuuguuguccggcagcuuucagugucgguuuuacgagguagcgugauauaugauaacauuacacccccagauuuacaccaaaccccauuuucuuuuggacggagcucgccgcggcacgugaccgcccacaugaccgccuccgccaaucucagcagcccucacagguggucccgcgccacgggccgccugccuccuagaauggaaggggaagaggcucacagacgcggccugccugcaccgggcugccagggcgcccgacgcaaucagaccccuaggcuccgccagagccccgucccagccgccgaagccuggaggcagggaucucgcccccucccccgacaaccucauaccuauuccugaaccccagauccacuguguggauucccccuguucgggcccucucugaggguccaagacccagggucucuguaaccuguccgcccaaagauggucuagagagggaaauccacucuuugcccaccucucucuauaagcagggaaaccuuuaagaccugauuugaugcuccagcgccaacaccgcaggcgcggugucuccucuagccgagcggagagaccgcugccacaaacuggaaccaugugguucgaauaaagucaacgucucucagcuuccuuucuuuaaucggcggcgcacuguuuaucugcccuaaaggaagcagugaaauauuuaucuauuaaugagccucauuugccaacagauauacuaacaugggauuccuuuucuccucccggacacugcggcccuggcaguuucucugcauuugcuccugggcaccuggcuggcuggcagcaacuccagagauagcucaacacccgcuuuguccuugccacaaccccuaguuacccccuagaugacaaaaaacugggguauccucauucaguuugggagaaacucggcuccacaaauuuuaaaacacauccgucauacacuccuggcggcucucaggcaagcaagccuuccacccugugggccgguaacaguuuuagagcuggauuagagacaggagagguaaucucaggaccugggugcuguagcucauuguggaaccccaguucuuuaggagacaauaaaagcgaauaagggagcccuuucuaggggccacccagaucccgcggcuucaccuuucuaagcacugugugcuugcuaagcacagccucguucucucccaaauaguagcccacccugggggcuuaccuugcugggcuucagacccccucccccugcaaugauaggucgggugaaggcucugcugcccaacgcucucuggaggauauuugggugaacccuuccccuaaacgccucauaaacugcucaggccaugcuggaagacuggcgaccuuuuacugcucagcucgauugcacaucauaaacccgacuucacaauggaauugccccggaaauucuccucuaaauuauagaguuugguuccugguguacaaagcacuuucuuaucacuuucaguggguccaggcugccuccaccuaccccacccccguuuaccgcauccucucaggggggucuuggaagcacaaaagacagagggauguucaaaucccgcuggaacgaaccccagcuccuaccuaguaaagggcucagguuuugguggggaggagggcaggugggagcugggcua

SEQ ID NO: 10140 - RNA, 2501 nt, Mus musculus
uagcccagcucccaccugcccuccuccccaccaaaaccugagcccuuuacuagguaggagcugggguucguuccagcgggauuugaacaucccucugucuuuugugcuuccaagaccccccugagaggaugcgguaaacgggggugggguagguggaggcagccuggacccacugaaagugauaagaaagugcuuuguacaccaggaaccaaacucuauaauuuagaggagaauuuccggggcaauuccauugugaagucggguuuaugaugugcaaucgagcugagcaguaaaaggucgccagucuuccagcauggccugagcaguuuaugaggcguuuaggggaaggguucacccaaauauccuccagagagcguugggcagcagagccuucacccgaccuaucauugcagggggagggggucugaagcccagcaagguaagcccccagggugggcuacuauuugggagagaacgaggcugugcuuagcaagcacacagugcuuagaaaggugaagccgcgggaucuggguggccccuagaaagggcucccuuauucgcuuuuauugucuccuaaagaacugggguuccacaaugagcuacagcacccagguccugagauuaccucuccugucucuaauccagcucuaaaacuguuaccggcccacaggguggaaggcuugcuugccugagagccgccaggaguguaugacggauguguuuuaaaauuuguggagccgaguuucucccaaacugaaugaggauaccccaguuuuuugucaucuaggggguaacuagggguuguggcaaggacaaagcggguguugagcuaucucuggaguugcugccagccagccaggugcccaggagcaaaugcagagaaacugccagggccgcaguguccgggaggagaaaaggaaucccauguuaguauaucuguuggcaaaugaggcucauuaauagauaaauauuucacugcuuccuuuagggcagauaaacagugcgccgccgauuaaagaaaggaagcugagagacguugacuuuauucgaaccacaugguuccaguuuguggcagcggucucuccgcucggcuagaggagacaccgcgccugcgguguuggcgcuggagcaucaaaucaggucuuaaagguuucccugcuuauagagagaggugggcaaagaguggauuucccucucuagaccaucuuugggcggacagguuacagagacccugggucuuggacccucagagagggcccgaacagggggaauccacacaguggaucugggguucaggaauagguaugagguugucgggggagggggcgagaucccugccuccaggcuucggcggcugggacggggcucuggcggagccuaggggucugauugcgucgggcgcccuggcagcccggugcaggcaggccgcgucugugagccucuuccccuuccauucuaggaggcaggcggcccguggcgcgggaccaccugugagggcugcugagauuggcggaggcggucaugugggcggucacgugccgcggcgagcuccguccaaaagaaaaugggguuugguguaaaucuggggguguaauguuaucauauaucacgcuaccucguaaaaccgacacugaaagcugccggacaacaaaucacaggucaaaauuaugaguucuucguauuaugugaacgcgcuuuuuagcaaauauacggcgggggcuucucucuuccaaaaugccgagccgacuucuugcuccuuugcacccaacucgcagagaagcggcuacgggccgggcgccggcgccuucgccuccacugugccgggcuuauacaaugucaacagcccccucuaucagagccccuucgcguccggcuauggccugggagccgacgccuacaaccugcccugcgccuccuacgaccaaaacauccccgggcucugcagugaccucgccaaaggcgccugcgacaaggcggacgagggcgugcuucacggcccggccgaagccaguuuccgcaucuaccccuggaugcgcaguucagguaggcucaguggucggcggggucggcgagcgggaggagcggaggggcgggagcagggcgcggggggcugagagagcccagcccggcggcuuccagccggcggccccgcaaguccccguggcgcugccuuucugguuuuaauuagagcugaggcgccauagcguggagagacccguagcauuguauguaaaugaggcucauaaaacuuuuuauggcccaauuaauggguucgauccucguaaauuuauuuaacuccauuugccuuggaauuuuuacaauaaguuucuccgcuauucucauucucauauucucucucuuucuccccccccucucccccuucuucccuucccucucuuuuucucucccucagucuuucuuucuaucccccucuuuucuguccucuaucucuuucuugacuccagcucucucuccccuccuucccuucuuucggccuggcu

SEQ ID NO: 10141 - RNA, 2501 nt, Mus musculus
cuaucagagguguuccaaacaccaacuucugguucucggacccuagauccagaggcacccaucgaggacgaaggcaggcuccagagaaagcugacgcgcugguagauccugguggccugcguggaggcagcggccgguuugcaggaaggagacacuuacugggaucgauggggggcuugucuccgccgcucucauucucggcauuguuuucggagaaggcgccuucgcuggguuguuuuucucuaucaacuggaggagaaccacaagcauagucagucagggacaaagugugagugucaagcgugggacagucaccccuucuggccgagagcgguucagguuuaaugccauaaggccggcuggaggguaagcccgcgaaggagagcgcaccgggcguggguuccagccaggagcgcauauaccugccguccggcgccgccgccgccacgggcgccuggggaugcacguagggguggugguggugaugauacacugcagcaggcaccgcauuggcgcccgccgcgugcacuggguuccacgaggcaccaaacaccgccgccuuggacuggaagcugcaaggacugaagucgggguguucggccagagcugccgccugccuuggggguugacccagggucccuggagcguagcgucccgcacccagcucaucagcagcgucggcgcccagcaggaaggaguccacauaguaguugcccagggccccggugguggccauugcaguagcccgcgccuggccggcccagcccgacccgccgaaauuaugaaacugcagauuucauguaacaacuugguggcaccaggggggggugaaguacagucaccuaauaaguugccggcgcccgcgcccccauuggccacgcgcgucacguguccgcccggcagaacaauaacgcguaaaucacuccgcacgcuauuaauggcccgguguuuugcagucauaauuuuuauagcaaaagccauauguuuuuaugcaaagggaucgcgcagcuccacgaucugguuuguuuuaauuguggccaacgaagauuaaaagaucaaaucuggccuugccucuguacucucccuugccacccccccaacacacacacauaccagacacacacacuucuuaagcggacuauuuuauaucacaauuaaucacgccaucaggaaggcgcgggucccgcgugugagcacggccagcagagccccucacauaaaauuagacaauaauugaagccauaaaaaagcagccaaaucgcauucucacucuacuguauuuaaaucuauauuuaugauauuucauaaggaguuauuguuucggaagccacacaggcugguggaaagucaggagcgaccaacagauucguuugccucgcuguggcucccuguaaaaauuuaugaggacuuggaaagguuaaauuagacuguuguguuugguuggugaauacccuguaaauaauccuugcaguccucagagaugugagccccccgcccgcgcgcgcccccagggccggccuagaaaagucaaauacaaggcucucuccaccucaaacagagugaccaccgccccugucgcgacgcaccgucgaugauacaaccaccuaaaaugggcuaccgacccuagucagacuggaaagccagccaggcgcuugcacaucggccagaucacccuugcuccacagggaaggccccacagagcaaccagagcaaccgccaaggagagaacugccaacccucaaggguuugugucacaaacgcccugauugugucacaagcgcccuggcccacuucuuugagcacaaacugcccagcgaauuuuauucccuagccagcggguucuaagcuccaucaucuguaugccuagucccgcuccccagacuggagauggggaaaaucgccagucaacaucaagagguguuugucuugcugaggggucaccucgccuaguuucugggcccuguaugaaccgcucugguauccuucccucuucuguuuuuuccuccuauuccucuaucaccccacuuuuuuuccccuuccuucccauuccccuuuuccuucuuuuguuacuccccucccucccuuccucucuuucccccccgcccccaucuccagcgccccugccuugguuauccuugaaacagaacaacagagaucccauagucaaacuacagcucaaguccagugcuacaaauuaacccgggaggaacacuggacauugacuuuaaucucauccuuuggucaaauggaggauguuauuuuucaccccuuagaaucuuugggaauaagagaaaaaaagugagaaggccacagccacuguuguuaaugggaggggcgguggccccaucccaaucuggaacacaaagcaacagcucuuagaaacuguguaauuaaauucacgugugaauuuugugccuuccaagaguauguuucucauuacuucacuauccacaaaaaugcugacccgagacauuuccaucuuuguuuuugcuuucuuccuc

SEQ ID NO: 10142 - RNA, 2501 nt, Mus musculus
gaggaagaaagcaaaaacaaagauggaaaugucucgggucagcauuuuuguggauagugaaguaaugagaaacauacucuuggaaggcacaaaauucacacgugaauuuaauuacacaguuucuaagagcuguugcuuuguguuccagauugggauggggccaccgccccucccauuaacaacaguggcuguggccuucucacuuuuuuucucuuauucccaaagauucuaaggggugaaaaauaacauccuccauuugaccaaaggaugagauuaaagucaauguccaguguuccucccggguuaauuuguagcacuggacuugagcuguaguuugacuaugggaucucuguuguucuguuucaaggauaaccaaggcaggggcgcuggagaugggggcgggggggaaagagaggaagggagggaggggaguaacaaaagaaggaaaaggggaaugggaaggaaggggaaaaaaaguggggugauagaggaauaggaggaaaaaacagaagagggaaggauaccagagcgguucauacagggcccagaaacuaggcgaggugaccccucagcaagacaaacaccucuugauguugacuggcgauuuuccccaucuccagucuggggagcgggacuaggcauacagaugauggagcuuagaacccgcuggcuagggaauaaaauucgcugggcaguuugugcucaaagaagugggccagggcgcuugugacacaaucagggcguuugugacacaaacccuugaggguuggcaguucucuccuuggcgguugcucugguugcucuguggggccuucccuguggagcaagggugaucuggccgaugugcaagcgccuggcuggcuuuccagucugacuagggucgguagcccauuuuaggugguuguaucaucgacggugcgucgcgacaggggcgguggucacucuguuugagguggagagagccuuguauuugacuuuucuaggccggcccugggggcgcgcgcgggcggggggcucacaucucugaggacugcaaggauuauuuacaggguauucaccaaccaaacacaacagucuaauuuaaccuuuccaaguccucauaaauuuuuacagggagccacagcgaggcaaacgaaucuguuggucgcuccugacuuuccaccagccuguguggcuuccgaaacaauaacuccuuaugaaauaucauaaauauagauuuaaauacaguagagugagaaugcgauuuggcugcuuuuuuauggcuucaauuauugucuaauuuuaugugaggggcucugcuggccgugcucacacgcgggacccgcgccuuccugauggcgugauuaauugugauauaaaauaguccgcuuaagaagugugugugucugguauguguguguguuggggggguggcaagggagaguacagaggcaaggccagauuugaucuuuuaaucuucguuggccacaauuaaaacaaaccagaucguggagcugcgcgaucccuuugcauaaaaacauauggcuuuugcuauaaaaauuaugacugcaaaacaccgggccauuaauagcgugcggagugauuuacgcguuauuguucugccgggcggacacgugacgcgcguggccaaugggggcgcgggcgccggcaacuuauuaggugacuguacuucaccccccccuggugccaccaaguuguuacaugaaaucugcaguuucauaauuucggcgggucgggcugggccggccaggcgcgggcuacugcaauggccaccaccggggcccugggcaacuacuauguggacuccuuccugcugggcgccgacgcugcugaugagcugggugcgggacgcuacgcuccagggacccugggucaacccccaaggcaggcggcagcucuggccgaacaccccgacuucaguccuugcagcuuccaguccaaggcggcgguguuuggugccucguggaacccagugcacgcggcgggcgccaaugcggugccugcugcaguguaucaucaccaccaccaccccuacgugcauccccaggcgcccguggcggcggcggcgccggacggcagguauaugcgcuccuggcuggaacccacgcccggugcgcucuccuucgcgggcuuacccuccagccggccuuauggcauuaaaccugaaccgcucucggccagaaggggugacugucccacgcuugacacucacacuuugucccugacugacuaugcuugugguucuccuccaguugauagagaaaaacaacccagcgaaggcgccuucuccgaaaacaaugccgagaaugagagcggcggagacaagccccccaucgaucccaguaagugucuccuuccugcaaaccggccgcugccuccacgcaggccaccaggaucuaccagcgcgucagcuuucucuggagccugccuucguccucgaugggugccucuggaucuaggguccgagaaccagaaguugguguuuggaacaccucugauag

SEQ ID NO: 10143 - RNA, 2501 nt, Mus musculus
gaugaaaauaaaguuugguucuuaggagggagacagaugggguuggggagaugagggaggaacggguacuuuaggcucaagcuccccagacaacugagguggaggguaccuuuucaguagcugguuaaaaaaaaaaaaaaaaaaaaaaagacaagcgguuguauuaauacucagaaaaccuggguuuguaaacagcuuccaaagaguagcuauggauucuuucauuaguauuagaucuagacaccagguuaagaaaacagaagucaaaacaacaauaaaauaaaauuucaaaagcauuuuucaauuaccaaguccuguugccccuguggaacucgcugcgcgccuuaagcgcucccuuuucugugugcggaauuccauuugcauccucugugucugggugucucccuuucccagugugugugucucucuguuuucacacucuccuccccauucgagcgaggcccacaccuggcgcaucacugccgagccauuagcugcgggucuccuuucaucuucacuguggcagacguuucuauuuauccacuugcguucgccgaguggcgucaccagcgguacuguaaugacgauugcagcaggaggaugacagcuuagaaagaagagggcaauggggcuuccucccagaggcggugcggcacagaggagcgcucgcaucacaaggugacccuagcuccccacugccaucuccgcggucgccgucgacacggcgcuggggcuacccggcgccugccuugucgccuuagcuccucuucucagccaagaucccagggagccugggauuaggagcuuacuuggggguuuucccccucccccccucuggagaguccggggauggagagccgaaaggacaugguuauguuucuggaugggggucagcuuggcacucugguugguaagagggucucuaauuuguccgaagccgugagcagcccgcugccugaaccgccagagaagauggugccccacgguugccugagcccgcgagccggcccuccgacuucccgggagcguggcgggggaggccaggaggaggagccggucgauggacuagcaggcagugcugcagggcugggcgccgagccacggucugcuggagcggccaugcuuggcccgggacccccaguccccuccgcggacagccucucuggccaagggcaaccuaguagcucagacaccgaaucggauuucuaugaagaaaucgaggugagcugcaccccagacugcgccaccgggaacgccgaguaccagcacagcaaagguagccaccuugccccuccgcuccccgguccgcccacuccacccacaguucccuucaucucaggccaggugcaagaugcuccuuucccuuggggcaggauggcuggggguugggugaguggggcgggggcaccugaacaacucuuuugcucucugcaccuuagugugugugagggcucucguguuaucccauuagagugacaguugugccuggacgaaugucagcguuggcacaagucuugacuugagggguccaaaacgcaccccaaccucccaacccccgaguuuugugggaaugauucagcuaagacggaaagacacauccgucggguagggcaagaucaaacgguuguccgggcaguuugacuggaggggagcaaggcacaaggaggcgcggaagcccggagaauauaaaggaccguaaaaucguggcggacucuggucuccggagggcugcagcccuccgaccaguuugcacgucggucagagguccaaauuaccuugucacuucccgggcuggcggcgccaggucggaaauggucccaauggucuaauugccuuuggucuccgguugcauuugaaaaggcggggauugggcccucccccucccucuuucccucagucucacuucuccacccaaaggaaaagcagcugcaggggggcuggagccccacccuccucuggggugggucuaagggguugguacuuuaauuacacugcuccuucucaccaggggcuaaugggaguggggguggauagcucagaagggagucucucuauaccaacaauauccacuccuaggaaugaaagacuggaagcccaucagcagacacaccuccacaaaaccaugggaaugggugggaaaggcuugccucuaccucuaggccuaggcagccaacaccaccuuguuaaguauccaccuccaucuccuaucaucuuaucaucuaucuaacccagcuucucuaccauaccauguccucacaacccauacucaaaauauaccacuccugcaauaggugcaacccaacacacauccccacaccugguacuggcauacuggugcacacacacacaagaucgaggaagcucacuguauguccaacaagcuacaauacauuaaccucaagaauucaguguuccggcacauccuuacccaucccuaccaacacaagcagagaguucaggggauaugcccuuugcugcacccaggggcaagcggaagggaa

SEQ ID NO: 10144 - RNA, 2501 nt, Mus musculus
uucccuuccgcuugccccugggugcagcaaagggcauauccccugaacucucugcuuguguugguagggauggguaaggaugugccggaacacugaauucuugagguuaauguauuguagcuuguuggacauacagugagcuuccucgaucuugugugugugugcaccaguaugccaguaccagguguggggauguguguuggguugcaccuauugcaggagugguauauuuugaguauggguugugaggacaugguaugguagagaagcuggguuagauagaugauaagaugauaggagauggagguggauacuuaacaaggugguguuggcugccuaggccuagagguagaggcaagccuuucccacccauucccaugguuuuguggaggugugucugcugaugggcuuccagucuuucauuccuaggaguggauauuguugguauagagagacucccuucugagcuauccacccccacucccauuagccccuggugagaaggagcaguguaauuaaaguaccaaccccuuagacccaccccagaggaggguggggcuccagccccccugcagcugcuuuuccuuuggguggagaagugagacugagggaaagagggagggggagggcccaauccccgccuuuucaaaugcaaccggagaccaaaggcaauuagaccauugggaccauuuccgaccuggcgccgccagcccgggaagugacaagguaauuuggaccucugaccgacgugcaaacuggucggagggcugcagcccuccggagaccagaguccgccacgauuuuacgguccuuuauauucuccgggcuuccgcgccuccuugugccuugcuccccuccagucaaacugcccggacaaccguuugaucuugcccuacccgacggaugugucuuuccgucuuagcugaaucauucccacaaaacucggggguugggagguuggggugcguuuuggaccccucaagucaagacuugugccaacgcugacauucguccaggcacaacugucacucuaaugggauaacacgagagcccucacacacacuaaggugcagagagcaaaagaguuguucaggugcccccgccccacucacccaacccccagccauccugccccaagggaaaggagcaucuugcaccuggccugagaugaagggaacuguggguggagugggcggaccggggagcggaggggcaagguggcuaccuuugcugugcugguacucggcguucccgguggcgcagucuggggugcagcucaccucgauuucuucauagaaauccgauucggugucugagcuacuagguugcccuuggccagagaggcuguccgcggaggggacugggggucccgggccaagcauggccgcuccagcagaccguggcucggcgcccagcccugcagcacugccugcuaguccaucgaccggcuccuccuccuggccucccccgccacgcucccgggaagucggagggccggcucgcgggcucaggcaaccguggggcaccaucuucucuggcgguucaggcagcgggcugcucacggcuucggacaaauuagagacccucuuaccaaccagagugccaagcugacccccauccagaaacauaaccauguccuuucggcucuccauccccggacucuccagagggggggagggggaaaacccccaaguaagcuccuaaucccaggcucccugggaucuuggcugagaagaggagcuaaggcgacaaggcaggcgccggguagccccagcgccgugucgacggcgaccgcggagauggcaguggggagcuagggucaccuugugaugcgagcgcuccucugugccgcaccgccucugggaggaagccccauugcccucuucuuucuaagcugucauccuccugcugcaaucgucauuacaguaccgcuggugacgccacucggcgaacgcaaguggauaaauagaaacgucugccacagugaagaugaaaggagacccgcagcuaauggcucggcagugaugcgccaggugugggccucgcucgaauggggaggagagugugaaaacagagagacacacacacugggaaagggagacacccagacacagaggaugcaaauggaauuccgcacacagaaaagggagcgcuuaaggcgcgcagcgaguuccacaggggcaacaggacuugguaauugaaaaaugcuuuugaaauuuuauuuuauuguuguuuugacuucuguuuucuuaaccuggugucuagaucuaauacuaaugaaagaauccauagcuacucuuuggaagcuguuuacaaacccagguuuucugaguauuaauacaaccgcuugucuuuuuuuuuuuuuuuuuuuuuuuaaccagcuacugaaaagguacccuccaccucaguugucuggggagcuugagccuaaaguacccguuccucccucaucuccccaaccccaucugucucccuccuaagaaccaaacuuuauuuucauc

SEQ ID NO: 10145 - RNA, 2501 nt, Mus musculus
uccccggcuucucgugcagguccaaggacuguggggcagagcccggagccgcagcagaggggcccugauggggaccugguccccgccggcucaaccuuaaugcgcugcgguugcccaccaguuccuuggcagccccaccccaggccacuccugguagaagucuuccccgcugcuggggcugcggcugcggcugcagugguagcuccugcgagaggccugcagggggcgucauccccucuucugacgauguggguagcggccacugccuacugccugcuguaggggaaggugagggauccacgcaagacccauucugcagcaguuggucauccagguaauccagguacuugccccgcagggccgggggguggcgacacugcacgaagaccguaaggaggcgacccugagaaugccaguugcccauccagcguuucagaccccgcaaccggcagucgcagguccaaccauugccgucuagauccagccgguagagagccggacuggcggcaaagauguccccagaaagggcgcugagcgcguugucgcgcaggcugagcucacggagccggcccugguggccaaagguggcagggugcagagcagaaagcucauugccacucaggucuagugccuccaagcugugcagaggcuccagcagugucagggggagcugguucagccgguuaccuuccaggcgcagcucacguagggccuccaguccccaaaaggccucuggggcgaggugcgugagcugguuuccacugagggagagcaggccuaggcguggcaggugcuggaagacgcgggggccgaggugcuguaggcuguuggcugagaggaugagaguagagagggagcgcagagggacaaagguggccgcguggcgcagagaggguugcagcucguuggccgagagauugaggaaucgaagcuuacccagcuggcugaaggcguucuugcccaaaaaacggauccgguuagauuccagguguagguagagcagguugcccaggggagcgaagaccgcguccggcagcgcucccagcacguucccguccagccguagcuugaccaaacucuccaggcccucgaaggacccgcgacucaggcguccaaucucguugccguuggcguaaaggaugcgcaacuugcgcagcggagccaacgugccaggaacgagcgccugcaagagguuguuccccagguacagcuccucuagucgugagagcuucucgaaggucuugggguggagagaacggaucugguuguacugcagauccagccgucugagcugccccagacgguggaagucgaaggcggugauguuggugaugaaguugccgccuaggcuguaggugagcacguccuggggacuaggcagcgagcuggucuuggguacagcgcgaaguccccuguuggugcauaggagauguugggggugcuggcagucgcagcgcuccgggcacacggacucggcccgcggcgggaacgccaggcagccgcacaccacgagccagaagcgcacggcacccacacccuccaucgccgcccgcccagcgcgcugcggccggaucgucuucugggccggccggcucugugucuccucugcauuccccucggccgggccugagucgcuaaaaaggccucuuucguacuucgcuggugcuccguccagcccuuccucuuugucccgguggcucgcccgggucuccgcaggccaaguucgcggagccaaaucagaaggcgcugggcgcucggcgaaucuggggugcuacuuguugcauuucugcagaaaacuguuucuucgggugagcgucgggggcgggaggagcgagcaagaguuggugcuuuuuguuugcucuggaguccggagagcuggauucccuggcgcggauucuccccgccaaacggauucccccgcugcaggcgggaucccuuccaagagcugcuggggugcggcuuggcugcagaguaccggccgcuaggcccacgucuccggcgccugcccgcucgcgauccggggggauugggagugcagccggagugagcagccugggggacgcgcaagcagcguccggaagggacccaugucggcguggagcgagcaaaccggcggaaauucguucuucccacacucugccccccgggggaugcaggcggagaaagaggagacggcggaggcaggacagaccccggcugggggaggaggaaacacuaaguggcuccgcgucuggucagcccuagcccggacgccaagugagaaaaguagggauuaaaaacagcuguacgggucggcgcgcaggcugggggcggggguggauuaccgggcgagcaaacggggauugcagacagagaccuuuuuauuuuaggccgguucgccggcggcuucggcgcagaggcagggcgccuacauuuuaccuacucuucucuucccggugccacccugcaagauguugagacaacacggaauucccuggcaucgugcuccaaguuuaggggaa

SEQ ID NO: 10146 - RNA, 2501 nt, Mus musculus
uuccccuaaacuuggagcacgaugccagggaauuccguguugucucaacaucuugcaggguggcaccgggaagagaagaguagguaaaauguaggcgcccugccucugcgccgaagccgccggcgaaccggccuaaaauaaaaaggucucugucugcaauccccguuugcucgcccgguaauccacccccgcccccagccugcgcgccgacccguacagcuguuuuuaaucccuacuuuucucacuuggcguccgggcuagggcugaccagacgcggagccacuuaguguuuccuccucccccagccggggucuguccugccuccgccgucuccucuuucuccgccugcaucccccggggggcagagugugggaagaacgaauuuccgccgguuugcucgcuccacgccgacaugggucccuuccggacgcugcuugcgcgucccccaggcugcucacuccggcugcacucccaauccccccggaucgcgagcgggcaggcgccggagacgugggccuagcggccgguacucugcagccaagccgcaccccagcagcucuuggaagggaucccgccugcagcgggggaauccguuuggcggggagaauccgcgccagggaauccagcucuccggacuccagagcaaacaaaaagcaccaacucuugcucgcuccucccgcccccgacgcucacccgaagaaacaguuuucugcagaaaugcaacaaguagcaccccagauucgccgagcgcccagcgccuucugauuuggcuccgcgaacuuggccugcggagacccgggcgagccaccgggacaaagaggaagggcuggacggagcaccagcgaaguacgaaagaggccuuuuuagcgacucaggcccggccgaggggaaugcagaggagacacagagccggccggcccagaagacgauccggccgcagcgcgcugggcgggcggcgauggagggugugggugccgugcgcuucuggcucguggugugcggcugccuggcguucccgccgcgggccgaguccgugugcccggagcgcugcgacugccagcacccccaacaucuccuaugcaccaacaggggacuucgcgcuguacccaagaccagcucgcugccuaguccccaggacgugcucaccuacagccuaggcggcaacuucaucaccaacaucaccgccuucgacuuccaccgucuggggcagcucagacggcuggaucugcaguacaaccagauccguucucuccaccccaagaccuucgagaagcucucacgacuagaggagcuguaccuggggaacaaccucuugcaggcgcucguuccuggcacguuggcuccgcugcgcaaguugcgcauccuuuacgccaacggcaacgagauuggacgccugagucgcggguccuucgagggccuggagaguuuggucaagcuacggcuggacgggaacgugcugggagcgcugccggacgcggucuucgcuccccugggcaaccugcucuaccuacaccuggaaucuaaccggauccguuuuuugggcaagaacgccuucagccagcuggguaagcuucgauuccucaaucucucggccaacgagcugcaacccucucugcgccacgcggccaccuuugucccucugcgcucccucucuacucucauccucucagccaacagccuacagcaccucggcccccgcgucuuccagcaccugccacgccuaggccugcucucccucaguggaaaccagcucacgcaccucgccccagaggccuuuuggggacuggaggcccuacgugagcugcgccuggaagguaaccggcugaaccagcucccccugacacugcuggagccucugcacagcuuggaggcacuagaccugaguggcaaugagcuuucugcucugcacccugccaccuuuggccaccagggccggcuccgugagcucagccugcgcgacaacgcgcucagcgcccuuucuggggacaucuuugccgccaguccggcucucuaccggcuggaucuagacggcaaugguuggaccugcgacugccgguugcggggucugaaacgcuggaugggcaacuggcauucucagggucgccuccuuacggucuucgugcagugucgccaccccccggcccugcggggcaaguaccuggauuaccuggaugaccaacugcugcagaaugggucuugcguggaucccucaccuuccccuacagcaggcaguaggcaguggccgcuacccacaucgucagaagaggggaugacgcccccugcaggccucucgcaggagcuaccacugcagccgcagccgcagccccagcagcggggaagacuucuaccaggaguggccugggguggggcugccaaggaacuggugggcaaccgcagcgcauuaagguugagccggcggggaccagguccccaucagggccccucugcugcggcuccgggcucugccccacaguccuuggaccugcacgagaagccgggga

SEQ ID NO: 10147 - RNA, 2501 nt, Mus musculus
caaaacaaaacaaaacaaaaaaacaaccuguccaauuaauuuauuaugcaguacucuguccggucugggacauucaauaaucuggcuuuaccuccauuucugggaaacaaccucccuguugccccagaguccuuuaaauaugacgguggccguuuccucagaccuuucuggaucagagccccacuuuugugugggguuuggcagagcucaucuucgcagccuggggacugcggugugugguccugguggugauguauggugguggccucgcgugguugcccgggcccaccgcaccgcagcgagcugcaccaacccagccgcgggcacgcguguccugacccccgacggccgcaguugggcgcggcgaccacgucccaugcccgugggccagagcggaggggguggcggcgacagccccgcccaccgggccgugcgccccgcccacgcgcgaggggaggagcuggagcggaguagggaggagaggucgggcggucccgggagcgcggagagccggacucccaggcggcggcagcagcggcggcggcggcgacgacggcgaagagugagugccaagguagcgccgggaccggacggggcggggcggucgccgcuacuucggggccgccugugggucccgcgggcuggcagcgggcuggagcuagggagcggaggaaggaagcgcgugcugcgggcgcucugggccgcggaaggggagugggagcgaggccagccggggcccacagacgcgagagcccgcuggggcgcgaguggccccugaggcugggucuccguagcugccucgcucggccucgccccgccggaggaaggcccgggaaaagccgccaggucgcgguggugcgggaggagccggucggagccgccacgcacgccccuccuccgaucucuagacgcgcguggguuggcagccucgguacugggucuucacagggggguggcggcggguaaggagcugaucguggagagaauucgggugacacuucacgagggacccugcggcggugacuggaacaggaaggucggaguucaaacuugagccuugugugcuuuuuuuauauuuuuuuuuaaauguagcgccugaagcuuagcccguggguuuaaaaaacuccucuuuauuuuaguuagggccugucaauuaaacuucauuuuaagacgccauugcuagugucuccugacacucguuuauccuuuuaagucuguggaugccuuguaaacuugacuuaacuuucacaaagggagccgugauucuuguuaaacuuuaagcaacuggaaaucagcuggaaggaucugccgaggccuguggucucgugguccuccugugcgggcguggcugugcacaaacaaguggguaggaaaggacgcagccccacgcuugagcuggaggggagaucugugcccaugugccagggcacguuuaaacgcagcuccaaguggaaacacuggggaugucuuaggccuuguuggacggacuucacaugauucgucucauuccggucaguuauuuccucuccccacugcucuuuagacacuguuuauauuuccuggggcgaucguagcgucuccugaauagauugucuauaaugaaucuuuuggauguugucagagccaggcucugugucuguguguucucaauguuuaaagcaauagcuuggcuguguuuugagagugcuggucacccugcugcaccauugcuuggcacuucaaaccauggauguaaauuaccuccggauuccagcccuuccccagggaagcugggaaagcagucacuggagaacaguaagguuaaauuuacuaugaucaagcagucacuuucaagaaaggagggccacccuccccuuuuagaacaaaaauguauaugucagcagggucauuuuccaauaaauaagcauaugguccucacauauuuuuauauuuucucuauauuuugucuguuucguacacguguacccccuuacccucucuuucaagccccucccacugaucaccucuuuccuccccaccacauuuuaaaaagcaaucaauuguagauugcuaagugggcguuuagauaaaauauucagauccuuugccucucuuaacagucagccagcaccauaaaguccugggugaaguccagugaaugcugaacacuaaguacaaugcagcuggauugagcacaagcacguuacuguguagaacccagcacagugugcagcucuuagauuuguauagaacccuauaagaauaaggaucugugcuucucaggagacgacaagugugguauacagaggaggugcagaaagcucugagcuuauuugaaagacaaaucucuugacaguuggguugcuguugucauagguuacagaacacacauggcguucaggugaugagagcaaagggccccacaguaaaaaaaaaaauuuuucagaaaaaaguuagcuaaugcccaauaauuuuuauuccaaaccucucucuaguaggaaaaaaaagucagaacgaucuca

SEQ ID NO: 10148 - RNA, 2501 nt, Mus musculus
ugagaucguucugacuuuuuuuuccuacuagagagagguuuggaauaaaaauuauugggcauuagcuaacuuuuuucugaaaaauuuuuuuuuuuacuguggggcccuuugcucucaucaccugaacgccauguguguucuguaaccuaugacaacagcaacccaacugucaagagauuugucuuucaaauaagcucagagcuuucugcaccuccucuguauaccacacuugucgucuccugagaagcacagauccuuauucuuauaggguucuauacaaaucuaagagcugcacacugugcuggguucuacacaguaacgugcuugugcucaauccagcugcauuguacuuaguguucagcauucacuggacuucacccaggacuuuauggugcuggcugacuguuaagagaggcaaaggaucugaauauuuuaucuaaacgcccacuuagcaaucuacaauugauugcuuuuuaaaaugugguggggaggaaagaggugaucagugggaggggcuugaaagagaggguaaggggguacacguguacgaaacagacaaaauauagagaaaauauaaaaauaugugaggaccauaugcuuauuuauuggaaaaugacccugcugacauauacauuuuuguucuaaaaggggaggguggcccuccuuucuugaaagugacugcuugaucauaguaaauuuaaccuuacuguucuccagugacugcuuucccagcuucccuggggaagggcuggaauccggagguaauuuacauccaugguuugaagugccaagcaauggugcagcagggugaccagcacucucaaaacacagccaagcuauugcuuuaaacauugagaacacacagacacagagccuggcucugacaacauccaaaagauucauuauagacaaucuauucaggagacgcuacgaucgccccaggaaauauaaacagugucuaaagagcaguggggagaggaaauaacugaccggaaugagacgaaucaugugaaguccguccaacaaggccuaagacauccccaguguuuccacuuggagcugcguuuaaacgugcccuggcacaugggcacagaucuccccuccagcucaagcguggggcugcguccuuuccuacccacuuguuugugcacagccacgcccgcacaggaggaccacgagaccacaggccucggcagauccuuccagcugauuuccaguugcuuaaaguuuaacaagaaucacggcucccuuugugaaaguuaagucaaguuuacaaggcauccacagacuuaaaaggauaaacgagugucaggagacacuagcaauggcgucuuaaaaugaaguuuaauugacaggcccuaacuaaaauaaagaggaguuuuuuaaacccacgggcuaagcuucaggcgcuacauuuaaaaaaaaauauaaaaaaagcacacaaggcucaaguuugaacuccgaccuuccuguuccagucaccgccgcagggucccucgugaagugucacccgaauucucuccacgaucagcuccuuacccgccgccaccccccugugaagacccaguaccgaggcugccaacccacgcgcgucuagagaucggaggaggggcgugcguggcggcuccgaccggcuccucccgcaccaccgcgaccuggcggcuuuucccgggccuuccuccggcggggcgaggccgagcgaggcagcuacggagacccagccucaggggccacucgcgccccagcgggcucucgcgucugugggccccggcuggccucgcucccacuccccuuccgcggcccagagcgcccgcagcacgcgcuuccuuccuccgcucccuagcuccagcccgcugccagcccgcgggacccacaggcggccccgaaguagcggcgaccgccccgccccguccggucccggcgcuaccuuggcacucacucuucgccgucgucgccgccgccgccgcugcugccgccgccugggaguccggcucuccgcgcucccgggaccgcccgaccucuccucccuacuccgcuccagcuccuccccucgcgcgugggcggggcgcacggcccggugggcggggcugucgccgccacccccuccgcucuggcccacgggcaugggacguggucgccgcgcccaacugcggccgucgggggucaggacacgcgugcccgcggcuggguuggugcagcucgcugcggugcggugggcccgggcaaccacgcgaggccaccaccauacaucaccaccaggaccacacaccgcaguccccaggcugcgaagaugagcucugccaaaccccacacaaaaguggggcucugauccagaaaggucugaggaaacggccaccgucauauuuaaaggacucuggggcaacagggagguuguuucccagaaauggagguaaagccagauuauugaaugucccagaccggacagaguacugcauaauaaauuaauuggacagguuguuuuuuuguuuuguuuuguuuug

SEQ ID NO: 10149 - RNA, 2501 nt, Mus musculus
cugaaggcgguuaguuuuagcaacuuccuucaaaggaacagcaaccucaaaguuuacauuuuucccucuacccacugcugaggaugggaccgagggccgggucagaugcgaggcaagcacacuagcccagucucuaggaaacaccagaguaucaacaguaaauguuaggauuucacaaggaaggaagcauuagaauuuaaaauauaaaauucaagcauuagacaaaggagaacaauaaaaugauauaaaucuggagggauuuuucacacagccuaucuuuuuaggugugccuuucccauauuuuauuaaacucgaguuguuguuuuaaaaaacagcagcauuaucaaagacacaucuguacaaacauuuuacaaaagagaacucucuaggaucagcuacaucaaggacaagcagaaaaauagaugcaguccaacaaagacauugaaaaugacuucagacguuggaaaugccuuuucuuauacaaacgauggcagaugaacacugcgcaggaucaauuagugagugaacugcucuuccuuuccugaagguugggaggcagggagcgaaugggucaccaacaacccggauagccaaaucgccgcuuucccauuucaaaccguuuaagucuuuggguagauucaagucgcugggaaacaagugggcugccuggcacuagcuucuuaaccaagcuaucuagccuuugcuuaacucucccggucagguuuccagugacuagacaaggaauuucagaaaugcguccuuaaaaaaccaagggcgagggaggugaccugagcucagcaucuagagaacuuguuuguggagagagaaggaagaggucaaagcugggaggaaaauuaccuccugacugagaauuaacaggccaacccaucuggucugaggugccgaggaagucggggcauccuacaggaaaccuacaagcuagguucgcuucucaucucccccagcuccuuaagcuccaccuuuuuguauuugcccgacuuccuccguuuggugaccaccaagaccaccacaccagccacuaccgcuaccgagacgacagcgaugacggcaaugacgccggcggugaggcgcuucauggagaacugggggggcuucucguccagguaguagaugagcguccgcuccacaugcagggguuccccacgcaccugcacguccaggccgcggcggcccaugaacagugacucgccuuuaaugucccuuucgaaguaguaggcggcaucagcgauguccacgucucucaagcccuucugcgacgcguucugccgaagcucuaucugaauggugggcuccucauaguguaccgcggauaggaagcuggggugcagcuuguagcguucuuggaagagccgccgcagcucggagucuaggucagagugguugaaggcucggucggucgggcgguggcgcaacucaaugaggaugugguggguucgcaccacuucgucgcagcgcaggcuuuggucucccuuguccgugcggcgcacgcccaccgaguuuacgcaccagcacaccgaggucugguugcacuggcgcgccuugaagcggcccuugucgucacacuccgggucguagaggccaucguuguccaguaucgcgugcucgcucggcaucaccaggcugcggccgcucuuccgggcgcucaugcgcgccuugagcagcaggcacuuggaaguuagcguggagcagucgaccaauaccugugagcccauugcccgacauuggcagaccccgccugggccauuugugucgcagaccgucaucuuguugguggggcauguacaguugcucugagccgugcaaaagcgggucgccaucgccagcaguagcaguagcagcggugcuagauccaagccccucgccauggugggguggaguagaauggaccuccaacuacagaccagaggcagggauucugaaggaucaggcuggguaggacacugcaggcgacuccugccgggcuuuucccuccagcucuuauaagcuccuguaccuguaggacugguuagcuagugacucacucaauggaauuuggguggcgcucccuauucccaggucccgcggaagaagccggcagcccugagcugccugagauagaaucaggcaggggagauugcuccugccaucugcugaccaaaaccccauagaggaaaccaguacuuaccuggccgcaccccuccucauagcucagaaccagggcgucccaccuuuccuagugcaccucaggaguuucuccagaggcccagcucccgacucucacgucccuacaauuccagaccccauaaucccguaccuucuuuuucucucaacuccuaucuucaguuucguuccuucccucucuucuugcuccagaacaccuuauaacacaguuaaacaguucacugacauaaaccugaucacaugccuuugucuguaaacccuauucuaggugagauggugcagcugaggcagggagaccugaagucacccagccacugauu

SEQ ID NO: 10150 - RNA, 2501 nt, Mus musculus
aaucaguggcugggugacuucaggucucccugccucagcugcaccaucucaccuagaauaggguuuacagacaaaggcaugugaucagguuuaugucagugaacuguuuaacuguguuauaagguguucuggagcaagaagagagggaaggaacgaaacugaagauaggaguugagagaaaaagaagguacgggauuauggggucuggaauuguagggacgugagagucgggagcugggccucuggagaaacuccugaggugcacuaggaaaggugggacgcccugguucugagcuaugaggaggggugcggccagguaaguacugguuuccucuaugggguuuuggucagcagauggcaggagcaaucuccccugccugauucuaucucaggcagcucagggcugccggcuucuuccgcgggaccugggaauagggagcgccacccaaauuccauugagugagucacuagcuaaccaguccuacagguacaggagcuuauaagagcuggagggaaaagcccggcaggagucgccugcaguguccuacccagccugauccuucagaaucccugccucuggucuguaguuggagguccauucuacuccaccccaccauggcgaggggcuuggaucuagcaccgcugcuacugcuacugcuggcgauggcgacccgcuuuugcacggcucagagcaacuguacaugccccaccaacaagaugacggucugcgacacaaauggcccaggcggggucugccaaugucgggcaaugggcucacagguauuggucgacugcuccacgcuaacuuccaagugccugcugcucaaggcgcgcaugagcgcccggaagagcggccgcagccuggugaugccgagcgagcacgcgauacuggacaacgauggccucuacgacccggagugugacgacaagggccgcuucaaggcgcgccagugcaaccagaccucggugugcuggugcguaaacucggugggcgugcgccgcacggacaagggagaccaaagccugcgcugcgacgaaguggugcgaacccaccacauccucauugaguugcgccaccgcccgaccgaccgagccuucaaccacucugaccuagacuccgagcugcggcggcucuuccaagaacgcuacaagcugcaccccagcuuccuauccgcgguacacuaugaggagcccaccauucagauagagcuucggcagaacgcgucgcagaagggcuugagagacguggacaucgcugaugccgccuacuacuucgaaagggacauuaaaggcgagucacuguucaugggccgccgcggccuggacgugcaggugcguggggaaccccugcauguggagcggacgcucaucuacuaccuggacgagaagcccccccaguucuccaugaagcgccucaccgccggcgucauugccgucaucgcugucgucucgguagcgguaguggcuggugugguggucuugguggucaccaaacggaggaagucgggcaaauacaaaaagguggagcuuaaggagcugggggagaugagaagcgaaccuagcuuguagguuuccuguaggaugccccgacuuccucggcaccucagaccagauggguuggccuguuaauucucagucaggagguaauuuuccucccagcuuugaccucuuccuucucucuccacaaacaaguucucuagaugcugagcucaggucaccucccucgcccuugguuuuuuaaggacgcauuucugaaauuccuugucuagucacuggaaaccugaccgggagaguuaagcaaaggcuagauagcuugguuaagaagcuagugccaggcagcccacuuguuucccagcgacuugaaucuacccaaagacuuaaacgguuugaaaugggaaagcggcgauuuggcuauccggguuguuggugacccauucgcucccugccucccaaccuucaggaaaggaagagcaguucacucacuaauugauccugcgcaguguucaucugccaucguuuguauaagaaaaggcauuuccaacgucugaagucauuuucaaugucuuuguuggacugcaucuauuuuucugcuuguccuugauguagcugauccuagagaguucucuuuuguaaaauguuuguacagaugugucuuugauaaugcugcuguuuuuuaaaacaacaacucgaguuuaauaaaauaugggaaaggcacaccuaaaaagauaggcugugugaaaaaucccuccagauuuauaucauuuuauuguucuccuuugucuaaugcuugaauuuuauauuuuaaauucuaaugcuuccuuccuugugaaauccuaacauuuacuguugauacucugguguuuccuagagacugggcuagugugcuugccucgcaucugacccggcccucggucccauccucagcaguggguagagggaaaaauguaaacuuugagguugcuguuccuuugaaggaaguugcuaaaacuaaccgccuucag

SEQ ID NO: 10151 - RNA, 2501 nt, Mus musculus
ugaagggacacgcggugacuggugaugggguugcagucaaagagaucgaguugggacacuagagcugucaguaggcagacacuugcugagauguugacuuaugggaugcuaguugaaggcuucagguuucuccugaggcuagcguauuaucuaagugaagaaugacagaaccucgucuagacagguguaggcaggauuucaaaguccagauucagaccucaguuuccccacuucaccuagugaaggugaggcagcccucccuggggguucggaggcccagugcacugagccaccgcaccacacgguuucacaaggagggcggaggaggacccgcccuggcugcagcucuggggcugggacgaucggagcaggggcgggucgcgcuggugcccucaccgcuagccgcccaaucgccgugggcccgcggagccccugggggcuggggcagcgggcggaacgugccgcggcugcgccaacgcgcgagcgcggggccggaccgggcgggugcgcucagucuggcggcagcggcggugcacagacagacagacgugccgggagcgcagcaccgcccgcagcccagcaauccgggccgcgccagcccgcccgcccgccauggugucguggaucaucuccaggcuggugguguaaguggccucuucuccugugucccuucuucccuucccucccgauccccauguccccuuagggccgcgcgccccugcgaaccaccagccccgggucgcuagcuauuaauacccggcggucgcuaaauuuagcagguacaguagcugccuggggacgcgggcagcgcgaggcggcguaggacgcgcgacgcuacagacccauggguagccgcgggcgcaggcggcgccuugcagggagaccggggcguggguccccgcacgaugguggaguugccggggcugggcaaugggucucgccuucucucuguugcuuuguuccauuccggguggggcggauuugcagaggccccgagugggugcuccacgcguucucucuccuuuggaagaaaaugccuugggcucgccugccgccgcgcuuugucgggugaaaaugacauacaguccagacaagccaggggcgcugccugaaggggucaucgcggagaugaguagccagauggagguggggcacucaaugaagugggaaaauacuccuuuuuagguuuuucaaauagacagaggcaaaggcagguggcaaguacauuagugugcaucuuggaguagaugucuuccuuccucuugccugcucuccuuugcagggguuugagagacaggggcaggcaucucuaggaaugcacagggaaauuuccgagugacagacagcaccccuuccccccaccccccaagggcgguggcagugauaccucccaggcggugcaggagagcagagucaucuggggugaggccuguaugaaguccuugggggaugugugauggggacuuuuguuuuauuuccaauauugccucucaccuuucuuaccuggaucuggaagauugauuuagcaccugcuuaggggaccugggacugaaaugggucugggggugggggggcuuggaugaggaacacgugcccagcauuuucuuugucuaagaaagaggggcuauuaacucccuuugacagugcagggcacacacaucucuuuucuccucuucugaacugauuugcaaagccauccaggagagccgucuuuaaaguccuggccauugucucccaggcaucauucugcccauugcucccaaagcccaucaaguuacuccacaagggucucuccaacagcuguugucagcugcuggggguuuguuuuguaccuucagguggcaugugaaauauuucgauuucuguggcauggcuggcaucaauaauagggaagccaccggcaugccuugccacgccucacgccugacuaaagcuugucuucucugcagugucaguuucuuuccuggggucuuuggauuugcuagugaccccuggaggaccucagggcggggccauggagcacuugcuugccuggugggcuuucucuguaaguccucaaccaggaucaugcaaccauucugguuuucuugucaucucccacauaggggguaacugaaaggggggacuaagaugugggaugugggaggggcugcaacaguguguugguaucuucugaagcaaccacaccuugaagaacuaagacuucggaugacguaaaugaccaagagaauugcucccggucuacaacuacccucuggcaccagagguuggugggauuugaagcaccuuuaaaagaucaaggauucuuccuacccuguuccuaauucacaacuaaacccaacaugaauuauuaacaccaguuuuaaucacauuucuauuucauauuaacaaugccuguuauauaguauuagcugguguaaauagaccaaaauccagcuacaucucugcugcagaaggaaaugucauuguaaaauaggggaguuauagucuuaagaauauua

SEQ ID NO: 10152 - RNA, 2501 nt, Mus musculus
uaauauucuuaagacuauaacuccccuauuuuacaaugacauuuccuucugcagcagagauguagcuggauuuuggucuauuuacaccagcuaauacuauauaacaggcauuguuaauaugaaauagaaaugugauuaaaacugguguuaauaauucauguuggguuuaguugugaauuaggaacaggguaggaagaauccuugaucuuuuaaaggugcuucaaaucccaccaaccucuggugccagaggguaguuguagaccgggagcaauucucuuggucauuuacgucauccgaagucuuaguucuucaaggugugguugcuucagaagauaccaacacacuguugcagccccucccacaucccacaucuuaguccccccuuucaguuacccccuaugugggagaugacaagaaaaccagaaugguugcaugauccugguugaggacuuacagagaaagcccaccaggcaagcaagugcuccauggccccgcccugagguccuccaggggucacuagcaaauccaaagaccccaggaaagaaacugacacugcagagaagacaagcuuuagucaggcgugaggcguggcaaggcaugccgguggcuucccuauuauugaugccagccaugccacagaaaucgaaauauuucacaugccaccugaagguacaaaacaaacccccagcagcugacaacagcuguuggagagacccuuguggaguaacuugaugggcuuugggagcaaugggcagaaugaugccugggagacaauggccaggacuuuaaagacggcucuccuggauggcuuugcaaaucaguucagaagaggagaaaagagaugugugugcccugcacugucaaagggaguuaauagccccucuuucuuagacaaagaaaaugcugggcacguguuccucauccaagcccccccacccccagacccauuucagucccagguccccuaagcaggugcuaaaucaaucuuccagauccagguaagaaaggugagaggcaauauuggaaauaaaacaaaaguccccaucacacaucccccaaggacuucauacaggccucaccccagaugacucugcucuccugcaccgccugggagguaucacugccaccgcccuugggggguggggggaaggggugcugucugucacucggaaauuucccugugcauuccuagagaugccugccccugucucucaaaccccugcaaaggagagcaggcaagaggaaggaagacaucuacuccaagaugcacacuaauguacuugccaccugccuuugccucugucuauuugaaaaaccuaaaaaggaguauuuucccacuucauugagugccccaccuccaucuggcuacucaucuccgcgaugaccccuucaggcagcgccccuggcuugucuggacuguaugucauuuucacccgacaaagcgcggcggcaggcgagcccaaggcauuuucuuccaaaggagagagaacgcguggagcacccacucggggccucugcaaauccgccccacccggaauggaacaaagcaacagagagaaggcgagacccauugcccagccccggcaacuccaccaucgugcggggacccacgccccggucucccugcaaggcgccgccugcgcccgcggcuacccaugggucuguagcgucgcgcguccuacgccgccucgcgcugcccgcguccccaggcagcuacuguaccugcuaaauuuagcgaccgccggguauuaauagcuagcgacccggggcuggugguucgcaggggcgcgcggcccuaaggggacauggggaucgggagggaagggaagaagggacacaggagaagaggccacuuacaccaccagccuggagaugauccacgacaccauggcgggcgggcgggcuggcgcggcccggauugcugggcugcgggcggugcugcgcucccggcacgucugucugucugugcaccgccgcugccgccagacugagcgcacccgcccgguccggccccgcgcucgcgcguuggcgcagccgcggcacguuccgcccgcugccccagcccccaggggcuccgcgggcccacggcgauugggcggcuagcggugagggcaccagcgcgacccgccccugcuccgaucgucccagccccagagcugcagccagggcggguccuccuccgcccuccuugugaaaccguguggugcgguggcucagugcacugggccuccgaacccccagggagggcugccucaccuucacuaggugaaguggggaaacugaggucugaaucuggacuuugaaauccugccuacaccugucuagacgagguucugucauucuucacuuagauaauacgcuagccucaggagaaaccugaagccuucaacuagcaucccauaagucaacaucucagcaagugucugccuacugacagcucuagugucccaacucgaucucuuugacugcaaccccaucaccagucaccgcgugucccuuca

SEQ ID NO: 10153 - RNA, 2501 nt, Mus musculus
ggagguggcacagcauagucaucgguggcaggguuguaagggagcucauagcccucuuccuucagccgagccuggcaccaccaugcaucccgaggcuccugaggcagaucauaaaggccccggggaggggcgggggccaggccuucagguucaucauagaugggguccucuuuggagucugucagcuugguuuucaguaacugcugcugcacaugcccauacaaaucccaauagagagguuucuuggaaugcaccccuuccccugccccagcaggggugcugcccagggggucugaauauacagaguccugagaagggccuggaggaauucgcaaggagucuaaaggcuccgcauauagggcuggagggcugcccaggggguccuggggaacaggagggggaacugucuuccccucugucuccccaucaugggagucaguucugaggauauccugugccuggcccaccuuuccuugggcuuucugcugcuggauggcagccucaacugccugaaagaugucauuucccugagaagucuggaaggugaaggucccagggccugaggggcagcggcgaccagcuucaaaggagaacauuaccugagggggugggggaaacacguuaggcgugucauaaaaaaugagucacaggccugaccaaguuacuguaucugcacagaagagaccaccugagaauggaauugucaccuacagcuacucaaccugguagcccucccugacgggucauccucccagacagccccaugcaccuugucccggccauagcgacgcaacagaguguagggccagaaaaggagcggcuccaggauuugacucugcgcacccaaagucaggagagucagcuucucagcuuccacccucaguauguaggagccuugcaagccgcagcguucagaagccucggucuucugcgagguuacccagaacugggauccuggaagaacacauacgaaggagaaggagcgcuggggcaaguuagggacucgguugacuccaaucacuagcuccccaagggcaccucuucaacccacuccauuccugccagacaucuaccuucccagguggggcuguacagcgaauucuccagcaucuccaaggcagaaaacuuagguugguucuccgucugcgccaaagcccagccgccuuucugcagaaaagggaacauggaagaauuauauauaauucucuugggucuaggguaggugcaagaaguccagugccucuauaauagcuccauccucgcagugucccuuaagcccagagaugcccacccccagucacucaccggaaaggcgguucugcauaaagucugcacccaggcggugcuggauacggcguccgccgccagcaggugcgagcgcugugcgguguccaggcggaaggcaacagcgccgggcucagggggacucuccacagucaccggcaccacgcucacacauucagccaggcguaucaucuugcagucuagacggcgagagccgccucgacccccucuagagcucgaccccuugugaucaaagaauuccagccgcgccacgccgugaggacuggcuggguaaagcacagcccaaguuuuccuccaccucugggaaagaacgaaagacucgagagugcgcggugguagcacgcgccccacaaggaagaagagacccaugaaggccgaucugagucuggggcuucccaggcugagcuacuuucccaaagauaauggcaucccaagaccgcaccaaggagggcacagcccgagacuuuuaagggaacgucuuggggaucuacaauugcccgcgcgccguuccgaccuucuuccggccccuucccucuuucuggauucuuucacccacuucuaguccagagggguuucgccaucccccacgccacaaacaaacuaccuuggucccgaagcgcugacucugcagaaaaagcggacccuccaucacagccccguccauggcccaggcgauuccuuccgcgcuuccuggcccggagggcugggggcggggcggggcggggcgaggcugcagggugccggaggcgugcccgccccuccccggccccugcggcggugaugggggagcggagggcuuggaggaaaacgagccaucaggaagaacucagggagagcucacuaaagccuuuaucuuuaguggugcacacaguggcaccacucagggaagcggugaucaccaaccaggggcccuagugccugggggguggaagcugagagugacgacauauguuuaacgugacaucagagugaaggccgugacaucaccugcaggcaccucgggggcgccauaaugaccaagggagccaucgggacaauaguuuucuuugugggaccuuuucucauggcccagcccgggaauuggacuggacuguuguugauacucugucuaguuggggauguggaggaacggcuacgggcuggaaagcuucccguugccacaggggccguccugcugucccgaaaccguuugcaag

SEQ ID NO: 10154 - RNA, 2501 nt, Mus musculus
cuugcaaacgguuucgggacagcaggacggccccuguggcaacgggaagcuuuccagcccguagccguuccuccacauccccaacuagacagaguaucaacaacaguccaguccaauucccgggcugggccaugagaaaaggucccacaaagaaaacuauugucccgauggcucccuuggucauuauggcgcccccgaggugccugcaggugaugucacggccuucacucugaugucacguuaaacauaugucgucacucucagcuuccaccccccaggcacuagggccccugguuggugaucaccgcuucccugaguggugccacugugugcaccacuaaagauaaaggcuuuagugagcucucccugaguucuuccugauggcucguuuuccuccaagcccuccgcucccccaucaccgccgcaggggccggggaggggcgggcacgccuccggcacccugcagccucgccccgccccgccccgcccccagcccuccgggccaggaagcgcggaaggaaucgccugggccauggacggggcugugauggaggguccgcuuuuucugcagagucagcgcuucgggaccaagguaguuuguuuguggcgugggggauggcgaaaccccucuggacuagaagugggugaaagaauccagaaagagggaaggggccggaagaaggucggaacggcgcgcgggcaauuguagauccccaagacguucccuuaaaagucucgggcugugcccuccuuggugcggucuugggaugccauuaucuuugggaaaguagcucagccugggaagccccagacucagaucggccuucaugggucucuucuuccuuguggggcgcgugcuaccaccgcgcacucucgagucuuucguucuuucccagagguggaggaaaacuugggcugugcuuuacccagccaguccucacggcguggcgcggcuggaauucuuugaucacaaggggucgagcucuagagggggucgaggcggcucucgccgucuagacugcaagaugauacgccuggcugaaugugugagcguggugccggugacuguggagagucccccugagcccggcgcuguugccuuccgccuggacaccgcacagcgcucgcaccugcuggcggcggacgccguauccagcaccgccugggugcagacuuuaugcagaaccgccuuuccggugagugacugggggugggcaucucugggcuuaagggacacugcgaggauggagcuauuauagaggcacuggacuucuugcaccuacccuagacccaagagaauuauauauaauucuuccauguucccuuuucugcagaaaggcggcugggcuuuggcgcagacggagaaccaaccuaaguuuucugccuuggagaugcuggagaauucgcuguacagccccaccugggaagguagaugucuggcaggaauggaguggguugaagaggugcccuuggggagcuagugauuggagucaaccgagucccuaacuugccccagcgcuccuucuccuucguauguguucuuccaggaucccaguucuggguaaccucgcagaagaccgaggcuucugaacgcugcggcuugcaaggcuccuacauacugaggguggaagcugagaagcugacucuccugacuuugggugcgcagagucaaauccuggagccgcuccuuuucuggcccuacacucuguugcgucgcuauggccgggacaaggugcauggggcugucugggaggaugacccgucagggagggcuaccagguugaguagcuguaggugacaauuccauucucagguggucucuucugugcagauacaguaacuuggucaggccugugacucauuuuuuaugacacgccuaacguguuucccccacccccucagguaauguucuccuuugaagcuggucgccgcugccccucaggcccugggaccuucaccuuccagacuucucagggaaaugacaucuuucaggcaguugaggcugccauccagcagcagaaagcccaaggaaaggugggccaggcacaggauauccucagaacugacucccaugauggggagacagaggggaagacaguucccccuccuguuccccaggacccccugggcagcccuccagcccuauaugcggagccuuuagacuccuugcgaauuccuccaggcccuucucaggacucuguauauucagacccccugggcagcaccccugcuggggcaggggaaggggugcauuccaagaaaccucucuauugggauuuguaugggcaugugcagcagcaguuacugaaaaccaagcugacagacuccaaagaggaccccaucuaugaugaaccugaaggccuggcccccgccccuccccggggccuuuaugaucugccucaggagccucgggaugcaugguggugccaggcucggcugaaggaagagggcuaugagcucccuuacaacccugccaccgaugacuaugcugugccaccucc

SEQ ID NO: 10155 - RNA, 2501 nt, Mus musculus
acgugacaucagagugaaggccgugacaucaccugcaggcaccucgggggcgccauaaugaccaagggagccaucgggacaauaguuuucuuugugggaccuuuucucauggcccagcccgggaauuggacuggacuguuguugauacucugucuaguuggggauguggaggaacggcuacgggcuggaaagcuucccguugccacaggggccguccugcugucccgaaaccguuugcaagucaagcacccugaauacggcugccgggccuccaaccugcgggaaaagaaagcuucauugagccgggaggagugggaggggguggcguggcugcagccagcuccacaggggaggggaagaucuagaggagggaacuggccuggccggaauggagggagaaagcggaaugugggagggcucuaggggacgugggagggaccaacgaagaggggagaggaaggggggguccagucuccccuggccgaacacuuuuuuucugagaaguccugaaaguaaucuccaggaccaggacucugcuuccagccucuggaguugugccuagucgaagguaggggaguuacugcuggccagcgggaagaggaguuggggauggagaggaugguggaccaggagaaacgcugauuugggauggagucgggaaagccaaccaacugacaguuuuauuauuggucaaggagcgaaacagaagaguggaaagcugagcaaacuguuggggauggaggcuucagggugcaauuugcaggcccuacgcugaacaccagggcuucggagccaaaugcccccagaacaaagcugucuugucugaguugggggaagcaauggagggccccccuuacuguggaggacuguuuucagccucggauagagaaggccugagcuggggagcuagcccuagcuucugguugcccagugacagaaaaagagguguuccagggagcuuggauaacuccauaccaaacccugcccagcuugaagccuaggucuccuggagucccugacccugcagcauauuugccagcccaugugcuagggaggguggcagaagguucuccuacuccgguuagccucggcccuuccugcaugggcaucugcccccauaggaaacugaagagucuucucauucauagugcugagauuuccagggcugggcucccaggcuccccuugccugugaugccaucugucugucuaacugcaugggucuugcugucauuucuccugugccugcaccuuggcuuuuauucccucuccucaugguuuuugccucucugugucauuccccauuacucugugcuuugguuuuuuugguuugauuaaaaccaucuauccauauucaaugugucucucaccccgugccuuucuguuuuuuccccuucguucccacagucucccuuccugucacauccugucugggucguccucucugugucucuucccaauaucucuguuuacccaacccauccguagacucuccaucucuaacccauacccaccccauggaugaaaguaaauagagaugaugguguuggugguaaugauggccaaaccagggaagguuauggugggacacuaaccacaaguuauaaguuuuauuauuugcaaagggaaaggagagucucccucgcccccaaucuaggucucuagggcugugccuguuuucuuuguguuccuacccucauucagugugugugucucuccuucucugucccuuagugccccccuccuugggccccacccgccaugagagcugucagugugugguauugcugcccauggggacuacugcugcuacacugucugugcagcuucaguguggggucuccgucuccuucuaucagcccagagaagaagguaggaagccaggggcugagguuccggcuggcuggcuuuccuagaaagcccuaugaaggucgaguggagauacagcgagcuggugaauggggcaccaucugugaugaugacuucacgcugcaggcugcccauguccucugccgggagcugggcuucacagaagccacaggguggacccauagugccaaauauggcccuggaacaggugagcgaugcucuggacuagcccggacauuaucuaagugcaguucaaguacauagaaaagaacaaaacaccuuaauggcacaaccaaagggacacgggacaccaagaaugggcagaaucaagcaaacccacagauuauaaaccaucuaacauacuaauuucagggccaugugaccugaagcuagccaguacucuccaggagccuccaguguuccauguguacagugagaagggggcuauguucucuuccacaaagugagacuccauagagcuaugcacaaagacagcccagugcaggggagcccugggugauccaagugcagucgacucagugauaauaugagggcaggugaaugguauccgaauguccccuagccagaacgggucauauacuacagcugacaaaaucgggacccaggucagag

SEQ ID NO: 10156 - RNA, 2501 nt, Mus musculus
cucugaccugggucccgauuuugucagcuguaguauaugacccguucuggcuaggggacauucggauaccauucaccugcccucauauuaucacugagucgacugcacuuggaucacccagggcuccccugcacugggcugucuuugugcauagcucuauggagucucacuuuguggaagagaacauagcccccuucucacuguacacauggaacacuggaggcuccuggagaguacuggcuagcuucaggucacauggcccugaaauuaguauguuagaugguuuauaaucuguggguuugcuugauucugcccauucuuggugucccgugucccuuugguugugccauuaagguguuuuguucuuuucuauguacuugaacugcacuuagauaauguccgggcuaguccagagcaucgcucaccuguuccagggccauauuuggcacuauggguccacccuguggcuucugugaagcccagcucccggcagaggacaugggcagccugcagcgugaagucaucaucacagauggugccccauucaccagcucgcuguaucuccacucgaccuucauagggcuuucuaggaaagccagccagccggaaccucagccccuggcuuccuaccuucuucucugggcugauagaaggagacggagaccccacacugaagcugcacagacaguguagcagcaguaguccccaugggcagcaauaccacacacugacagcucucauggcggguggggcccaaggaggggggcacuaagggacagagaaggagagacacacacacugaaugaggguaggaacacaaagaaaacaggcacagcccuagagaccuagauugggggcgagggagacucuccuuucccuuugcaaauaauaaaacuuauaacuugugguuagugucccaccauaaccuucccugguuuggccaucauuaccaccaacaccaucaucucuauuuacuuucauccaugggguggguauggguuagagauggagagucuacggauggguuggguaaacagagauauugggaagagacacagagaggacgacccagacaggaugugacaggaagggagacugugggaacgaaggggaaaaaacagaaaggcacggggugagagacacauugaauauggauagaugguuuuaaucaaaccaaaaaaaccaaagcacagaguaauggggaaugacacagagaggcaaaaaccaugaggagagggaauaaaagccaaggugcaggcacaggagaaaugacagcaagacccaugcaguuagacagacagauggcaucacaggcaaggggagccugggagcccagcccuggaaaucucagcacuaugaaugagaagacucuucaguuuccuaugggggcagaugcccaugcaggaagggccgaggcuaaccggaguaggagaaccuucugccacccucccuagcacaugggcuggcaaauaugcugcagggucagggacuccaggagaccuaggcuucaagcugggcaggguuugguauggaguuauccaagcucccuggaacaccucuuuuucugucacugggcaaccagaagcuagggcuagcuccccagcucaggccuucucuauccgaggcugaaaacaguccuccacaguaaggggggcccuccauugcuucccccaacucagacaagacagcuuuguucugggggcauuuggcuccgaagcccugguguucagcguagggccugcaaauugcacccugaagccuccauccccaacaguuugcucagcuuuccacucuucuguuucgcuccuugaccaauaauaaaacugucaguugguuggcuuucccgacuccaucccaaaucagcguuucuccugguccaccauccucuccauccccaacuccucuucccgcuggccagcaguaacuccccuaccuucgacuaggcacaacuccagaggcuggaagcagaguccugguccuggagauuacuuucaggacuucucagaaaaaaaguguucggccaggggagacuggacccccccuuccucuccccucuucguuggucccucccacguccccuagagcccucccacauuccgcuuucucccuccauuccggccaggccaguucccuccucuagaucuuccccuccccuguggagcuggcugcagccacgccacccccucccacuccucccggcucaaugaagcuuucuuuucccgcagguuggaggcccggcagccguauucagggugcuugacuugcaaacgguuucgggacagcaggacggccccuguggcaacgggaagcuuuccagcccguagccguuccuccacauccccaacuagacagaguaucaacaacaguccaguccaauucccgggcugggccaugagaaaaggucccacaaagaaaacuauugucccgauggcucccuuggucauuauggcgcccccgaggugccugcaggugaugucacggccuucacucugaugucacgu

SEQ ID NO: 10157 - RNA, 2501 nt, Mus musculus
ucuggguauauaagaaucuaucuuaccuauagcauaagugcguuaaaacucaagauggagaguccgcagauugggcaggagacaacuggagacugaggcuagaaggaauccuuaguuauuguuuuacagaugagggacgaggucccugucacaguaggccacauucucuacugccagcgccucuuccauuaccccucccccgcuguccuuugauaucugccuuuacaccagcucuguggucccuucccagcaggaccugagcucugagcccacucagggcaaagucgcagccuugcagggucccugcuucauccacaauccugcagguugcucuugcaacccacaucucagcgggguuuuuuuuuuuaaacaaaacaaaacaaaaccuugaagggcggagucagagugugggccaggggccacugaugaccaaagagccucagaggacggccgcgggccgcgggccuucugcuccucacucuucgcuggcgguacggcacccggccacguuggcgcucgucgggcaggugucggucacaccaccgaggcgagcccggacaccgaagccaccuuguugucuuccgcccagggcugcagauucugcagcgcgaagagcgacgaguugugcaggcaaagcggguccgguggcagcgguggccgcagcggccggggcagcgcgucuugcugcaggugcagcagcaggcgaccagcgcggugccgcucggccucgcgcuccuccgcggucuggcgccugggcgagcggagagccggggucagcgggcgucccgguccuaccccgccacucggcccgcccgcgccccgcgccucaccgccacuuggugcgucgguucuggaaccaggucuugaccugcgcguccgucaugcgcagggccuuggccagcgccgcccucucugcggaggccagguacuucuggcgcaagaagcggcgcuccagcuccagcaccugcgagcgggaaaaggaggugcgcggcuucuugcgcuucggggggguccgguuuugguagggauggccuaugcgacgugucccagagaagggcgagagcgcagcuacgggacggaagagcagggcaauguuuggggguaguccgaggugagacugagaagagagucccuaguccuuaucgggguuccucccccaaccacagaagccucaucaagaaagggcuuaggaagaaucgggguccucccaaacuucacccugccccuccucgccguaggcacggugggacugcagaggcaggggugcaugcacccgacgacagcagcucucuccuuacugccucucugcugugggaccgagaacuguggggucggggaggguccacgcggaugaacagaggggagagauaaccgggcaaugggguuggagcagaaaauggagaagcaaagaaauggggucgcgggggaaggacaccgagggguagggcaaucucacccgugagccuguccuuugcaaagcggcggccgcuguccauccaggggaaggugagucccgcuaggcccccggcgccacccaaaccagaggguccgggcacggcgggggccgcacccgaggguggcggcacgggcagcgggcggugcgcggggacgcggaucacgccgccggggcccacucccgagccucuaggcaaggaggccagcgagccggcuggagcauagcccgaggcuccguggaauccacuggaaaacgccgcacuuucuccguggcucuggcccgacugaccgggacccagaccgccccccggggguucgggaccgcucaggaucugaucgaugccgaagcugauggguucguggugcggaagguggugcgcagccaacaccgcgggcuccauggguccaagccugagagguuggaugacuggaaaagguguuucugacggcugcgggagcccggcggcggcgcgcucagggcagaggcuucaggggcccgcggggcuggccacggccaugcgccggggcccccgggacagcaacaucccugugcacagggcgcagccgcgcgugugcccgccccucccgggaguccgcucugggacucgcaucccgaaggagcgcggcgggcgggggucgcaguagcgcagguggacgcuaaguugcccaggccgcugcccgaguccgguguggagagggguggccagcucaggcaggggcagugacucgggugggcagagggggcugagggagggcaggggcggggccccgcuguuaaaggggaagggauggcuggaugugccuggugcaggcagaggagggcgcggguaucaggaaggcgcggugcgcgggaggggccgcugacucagccgggaugcucgagcgcccgcaucuucgccggccuccgccuucggacuggcucccggguuccucggcagggacuucucuccccagaccccacucuucgccucccgaugggugccgcuggccagcuccucgauucguuguggcccccacccaaaugcccucugagaccaaaucucguu

SEQ ID NO: 10158 - RNA, 2501 nt, Mus musculus
aacgagauuuggucucagagggcauuugggugggggccacaacgaaucgaggagcuggccagcggcacccaucgggaggcgaagaguggggucuggggagagaagucccugccgaggaacccgggagccaguccgaaggcggaggccggcgaagaugcgggcgcucgagcaucccggcugagucagcggccccucccgcgcaccgcgccuuccugauacccgcgcccuccucugccugcaccaggcacauccagccaucccuuccccuuuaacagcggggccccgccccugcccucccucagcccccucugcccacccgagucacugccccugccugagcuggccaccccucuccacaccggacucgggcagcggccugggcaacuuagcguccaccugcgcuacugcgacccccgcccgccgcgcuccuucgggaugcgagucccagagcggacucccgggaggggcgggcacacgcgcggcugcgcccugugcacagggauguugcugucccgggggccccggcgcauggccguggccagccccgcgggccccugaagccucugcccugagcgcgccgccgccgggcucccgcagccgucagaaacaccuuuuccagucauccaaccucucaggcuuggacccauggagcccgcgguguuggcugcgcaccaccuuccgcaccacgaacccaucagcuucggcaucgaucagauccugagcggucccgaacccccggggggcggucugggucccggucagucgggccagagccacggagaaagugcggcguuuuccaguggauuccacggagccucgggcuaugcuccagccggcucgcuggccuccuugccuagaggcucgggagugggccccggcggcgugauccgcguccccgcgcaccgcccgcugcccgugccgccacccucgggugcggcccccgccgugcccggacccucugguuuggguggcgccgggggccuagcgggacucaccuuccccuggauggacagcggccgccgcuuugcaaaggacaggcucacgggugagauugcccuaccccucgguguccuucccccgcgaccccauuucuuugcuucuccauuuucugcuccaaccccauugcccgguuaucucuccccucuguucauccgcguggacccuccccgaccccacaguucucggucccacagcagagaggcaguaaggagagagcugcugucgucgggugcaugcaccccugccucugcagucccaccgugccuacggcgaggaggggcagggugaaguuugggaggaccccgauucuuccuaagcccuuucuugaugaggcuucugugguugggggaggaaccccgauaaggacuagggacucucuucucagucucaccucggacuacccccaaacauugcccugcucuuccgucccguagcugcgcucucgcccuucucugggacacgucgcauaggccaucccuaccaaaaccggacccccccgaagcgcaagaagccgcgcaccuccuuuucccgcucgcaggugcuggagcuggagcgccgcuucuugcgccagaaguaccuggccuccgcagagagggcggcgcuggccaaggcccugcgcaugacggacgcgcaggucaagaccugguuccagaaccgacgcaccaaguggcggugaggcgcggggcgcgggcgggccgaguggcgggguaggaccgggacgcccgcugaccccggcucuccgcucgcccaggcgccagaccgcggaggagcgcgaggccgagcggcaccgcgcuggucgccugcugcugcaccugcagcaagacgcgcugccccggccgcugcggccaccgcugccaccggacccgcuuugccugcacaacucgucgcucuucgcgcugcagaaucugcagcccugggcggaagacaacaagguggcuucgguguccgggcucgccucgguggugugaccgacaccugcccgacgagcgccaacguggccgggugccguaccgccagcgaagagugaggagcagaaggcccgcggcccgcggccguccucugaggcucuuuggucaucaguggccccuggcccacacucugacuccgcccuucaagguuuuguuuuguuuuguuuaaaaaaaaaaaccccgcugagauguggguugcaagagcaaccugcaggauuguggaugaagcagggacccugcaaggcugcgacuuugcccugagugggcucagagcucagguccugcugggaagggaccacagagcugguguaaaggcagauaucaaaggacagcgggggagggguaauggaagaggcgcuggcaguagagaauguggccuacugugacagggaccucgucccucaucuguaaaacaauaacuaaggauuccuucuagccucagucuccaguugucuccugcccaaucugcggacucuccaucuugaguuuuaacgcacuuaugcuauagguaagauagauucuuauauacccaga

SEQ ID NO: 10159 - RNA, 2501 nt, Mus musculus
aucauuuuaugacagguauuccaauaggccagguucucgauccuggacccccacacuacaccaaccaucucuagccaccaucuucucuuuaagaccuuuucccaggguugggugagaaagauaggcaaaguuaggaugcugagucccuaacacaaucagcccugauccuguuucucagaacccugcaaguccccaguccuugaggccagggaaagcaauuuuauugcccuagaauuuaugagccagaguuuaaguagggagccaagcagcaugcaauccaggggaguacauccaguuugaaugugcaccucaaaaucagaagccaugggcuucuuucuacucuauagaagaaauaaggcugccaguacaccuaugggcacccgauucacugaggcccuuggaaggaggugggggugcaggaggaggggacguggggcuucaacugagcucuagggggcggguccgaggcagggggcccagaucggaagcugagcgcugggggccuaggagguugugaagccaagcgcagcagaaggcgggaucgcuacaaucccgcuugccaugaacucuguacaucagcgccggacacccuuuaguaucgcagacauccuagguccgagcaugguccccgaagcaccuucugcaccgcagcuucccgaggccggcccugaucccgcgucaccacugugugcgcuggaggagcuagcaaguaaaacuuuccugggccauuccccgcgggcuacaccacagccuucugaagguacacgccagccaaguagcggacuugaacugugugugugugugugugugugugugugugugugugugugugugugugugugugcgcgcgcgcgcgcggaucugucugucugucccugucuauaucugucucucccuccaccccccgcuucacucucucguccuuggucacaaaguuuugucuggcccuggcuggucauuuuuacccacccccugccuucugcccaagugucaggaguugcauuugacagggcucggcaggucuccugaguuaguucugagacugcaauugcuccaggggguggcaggggcugagggguaccgccaggcuggagcgaauccagggacccgcucggcugcugguacguucgcuguaugcgggguaaucaugaccaagaaaggcuguggaagagaaaaaacgcuugagcugcuggcaagaaaagacugaggcagggcuaggacaaggcagaaaauuccucccagcuaccuagccccagcuaccuagccccagccccagccccagccccagccccagccccagccccagccccagccccagccccagccccagccccagccccagccccagccccagucacuucuugagcccuguagaagauccuuugcagcacuauugggcacaggaaccgccuuccgccugccuuccuucccuuugggcucccggaaagagagcugguguuaaggacuuuauuuggccagaugggucacccgaccucaauuuggccucuaacuuacuaccacgcacagccuggagcuccaaacggcgucagagaccuucuccaaacggucuugacucucguaccagaucucuggucagucccacucacccucuacccgcuggaguaaucucaucucucugucgucagcauucccacaggccugcugcacuucgaauccggguucugacccgguguauagggaucgugaugcuggcccaccccgcucccucuaccugcuuaagccccgcgacccuaaguuuuuccauccagaccucagccuccuccaaagccgagacugacauuuccgucucauccuggcaggcagagccgccccggaggcgccgccggggccuggcgcugguguccggagacgccgcaagucucggacagcguucacugcacagcaggugcuggagcuggagcggcgauucgucuuccagaaguacuuggcaccgucagagcgcgacggacuugcugcgcgacugggccuggcuaaugcgcaaguggucacuugguuccagaaccgucgcgccaagcucaagcgggauguggaggagaugcgcgcggacguggccucccuaugcggguuguccccuggaguccuguguuacccagcacugccagacagcacuucaagcccugacccuggcccuucagggcccgauucugagcccaacuuaucagaugaggagauacagguggacgauugaaagugaagcugcugcccagcccuggauuuuagggcccuggacccccugcuagaggccuugucuggguucccggguggaggguaaacacccauuuagcucuguucugucucuuacuccacacuccuacuuuucuuacucguuaaagaauaaagccgccacucugcugcugcaagaagccucaauucggaaagcccgcaacccaaaccaaggcaagccgcuacucacugggaaauuccuugcggcuccuuuaaaacuucuuuuagcccaaguagcaagccuaaaagguaugugu

SEQ ID NO: 10160 - RNA, 2501 nt, Mus musculus
acacauaccuuuuaggcuugcuacuugggcuaaaagaaguuuuaaaggagccgcaaggaauuucccagugaguagcggcuugccuugguuuggguugcgggcuuuccgaauugaggcuucuugcagcagcagaguggcggcuuuauucuuuaacgaguaagaaaaguaggaguguggaguaagagacagaacagagcuaaauggguguuuacccuccacccgggaacccagacaaggccucuagcaggggguccagggcccuaaaauccagggcugggcagcagcuucacuuucaaucguccaccuguaucuccucaucugauaaguugggcucagaaucgggcccugaagggccagggucagggcuugaagugcugucuggcagugcuggguaacacaggacuccaggggacaacccgcauagggaggccacguccgcgcgcaucuccuccacaucccgcuugagcuuggcgcgacgguucuggaaccaagugaccacuugcgcauuagccaggcccagucgcgcagcaaguccgucgcgcucugacggugccaaguacuucuggaagacgaaucgccgcuccagcuccagcaccugcugugcagugaacgcuguccgagacuugcggcgucuccggacaccagcgccaggccccggcggcgccuccggggcggcucugccugccaggaugagacggaaaugucagucucggcuuuggaggaggcugaggucuggauggaaaaacuuagggucgcggggcuuaagcagguagagggagcggggugggccagcaucacgaucccuauacaccgggucagaacccggauucgaagugcagcaggccugugggaaugcugacgacagagagaugagauuacuccagcggguagagggugagugggacugaccagagaucugguacgagagucaagaccguuuggagaaggucucugacgccguuuggagcuccaggcugugcgugguaguaaguuagaggccaaauugaggucgggugacccaucuggccaaauaaaguccuuaacaccagcucucuuuccgggagcccaaagggaaggaaggcaggcggaaggcgguuccugugcccaauagugcugcaaaggaucuucuacagggcucaagaagugacuggggcuggggcuggggcuggggcuggggcuggggcuggggcuggggcuggggcuggggcuggggcuggggcuggggcuggggcuggggcuagguagcuggggcuagguagcugggaggaauuuucugccuuguccuagcccugccucagucuuuucuugccagcagcucaagcguuuuuucucuuccacagccuuucuuggucaugauuaccccgcauacagcgaacguaccagcagccgagcgggucccuggauucgcuccagccuggcgguaccccucagccccugccacccccuggagcaauugcagucucagaacuaacucaggagaccugccgagcccugucaaaugcaacuccugacacuugggcagaaggcaggggguggguaaaaaugaccagccagggccagacaaaacuuugugaccaaggacgagagagugaagcgggggguggagggagagacagauauagacagggacagacagacagauccgcgcgcgcgcgcgcacacacacacacacacacacacacacacacacacacacacacacacacacacaguucaaguccgcuacuuggcuggcguguaccuucagaaggcugugguguagcccgcggggaauggcccaggaaaguuuuacuugcuagcuccuccagcgcacacaguggugacgcgggaucagggccggccucgggaagcugcggugcagaaggugcuucggggaccaugcucggaccuaggaugucugcgauacuaaaggguguccggcgcugauguacagaguucauggcaagcgggauuguagcgaucccgccuucugcugcgcuuggcuucacaaccuccuaggcccccagcgcucagcuuccgaucugggcccccugccucggacccgcccccuagagcucaguugaagccccacguccccuccuccugcacccccaccuccuuccaagggccucagugaaucgggugcccauagguguacuggcagccuuauuucuucuauagaguagaaagaagcccauggcuucugauuuugaggugcacauucaaacuggauguacuccccuggauugcaugcugcuuggcucccuacuuaaacucuggcucauaaauucuagggcaauaaaauugcuuucccuggccucaaggacuggggacuugcaggguucugagaaacaggaucagggcugauuguguuagggacucagcauccuaacuuugccuaucuuucucacccaacccugggaaaaggucuuaaagagaagaugguggcuagagaugguugguguaguguggggguccaggaucgagaaccuggccuauuggaauaccugucauaaaaugau

SEQ ID NO: 10161 - RNA, 2501 nt, Mus musculus
uaugaguaggguccgaaccagcugcuucccaaaacucucagagaugacugaaagaaaacauaaaagaaguugaagcuggcugugaugacacacauacacacucuuaacuuaagccaggaagcggaggcaggcugacaacucugaguucgagaccugccuggucuacaugagaguuucaggauagcuaagaacauacacagugagauucaaagagaacugaacaacaacacgcccacaaaugaacacgaagacaacgaucaaagcaaaagcaaacugaggucucgcuuuccucuuuucuguaguagaccgccgcaggacccccagagggcagacugcaggaaggcgguacacuaggaagucagggauggcggagacaugggucuccugcugucaagucacaccuagcuugacucucccuacagcauuuagcaucagcgccaccucccguuaacggugacaggaaagucuagcuagaauuugauagucguuaagggccgggaaagaguaaguggguggccaucuuuguuaggggcagaggucguggcuacggagccccaguaagaccacgagacuuccggcuagcuggugaguccuggcgcccacgggcguggagugcgacgggaagcggggaggcggcgagcguuagguucguuugggacucgccgugcaaauggcacgggcguccagcucuaguggcccuuugccuccacucgcuaacguacccucgucgugggcgcagcccgugggcgcuggggaggagcgggacgaggggaggcguggagggcuagggcuacuggcugcggugagcgucccgugcccggacuucagcagacagccgugggcucccgcgucugcaagcggcccgaugcccuucgcucuucagcggcuccgggccacauugcuucgucugcaccgcgagcgagagcagcuccugcgggcccgggacugcgcccgccaccugcaggcggucgugcggcugcuccgcuccggcuccucggccgguucccucucccugcagcaguugcacggcgauuuacagcugugcccaucucguggggcggcucugcgccucggcuucccgggcuccagggagacgcuucuccugacucgcccugucgggcuagcugcccagcacuuggaggcugccaucgagaugcagcuucguucacugggccggacacccgcuagccugggccugacaucccagcuagccgaacuguugcuggcccuucccuucuaccacacucugcagggacauucccugaacuucguccccggggccgcgcgcccauuccccgcggcccgugugcuccagcuccuggcugcagagcgggguugucagguggcagauaagcuggcugaagcccguggcggaucgggcuugcaggagcagcuccgucggcagugcgagcaagagcgagagcugcugcccgggcugcugggccugguagggggcguggcuagcaccgacagcagcggacugaggcuugggggaccuggagcccuguggagccaguauuggaccuugcugugggcagccugugcuaaguguuuggaccuacgcgugggacccugggaggacccuagagcaauggcacaagagcugagucaggcacugugucaagguaagcgagggguccgagcuggcauuuggagguuguggugagggugucuuuuucccuuuacccucucucaacuccagccugucagcaagcgcagggccuugaaugaaugaacuuccccgaguuuaaaguauagcguuuaggguuucccaaggccacgcagcuucccauagcagucuuuauuuagguuuuaguccacacuggccugggacgcuggucucagccuccugccuccggagagccaccaugccugacuugaguggagucggcaggggcugucaccagggauuuguuuccaggcuuccuucauuucucccaucagcaccccugccucaggagugugagaaggagcuguugucucugugucacagccuguuucaccagucugucaucugcagcugggaccaagguaaggagaaaaggacauuggggugacccaaggauccuguugcgcacccccucagacuauauuuugucaugccaggguucugccaggccuuaggaucagcccuggguggucagagcagcccugcgucacugucuccuaccucugagcugcugcagcggcuuuuuccuccccucuuggauagccuucgacagcccaggccagaacuuaggcuguguccgccugcaggugagacaggagguguggaaugggagggcagggggcggggcaguuguuaucuuuugccuguccucuguucugaagcuggccuucuccuggaggugaccuaugaacccuaggguacuguccuuccccucccagguccuacgccugucgcucuggggcucuguacccugcagaccaccuugcucugguuugugggcagagcucagcagcaccuggcagcgugggaccccgguuccuucuugcuccug

SEQ ID NO: 10162 - RNA, 2501 nt, Mus musculus
caggagcaagaaggaaccggggucccacgcugccaggugcugcugagcucugcccacaaaccagagcaagguggucugcaggguacagagccccagagcgacaggcguaggaccugggaggggaaggacaguacccuaggguucauaggucaccuccaggagaaggccagcuucagaacagaggacaggcaaaagauaacaacugccccgcccccugcccucccauuccacaccuccugucucaccugcaggcggacacagccuaaguucuggccugggcugucgaaggcuauccaagaggggaggaaaaagccgcugcagcagcucagagguaggagacagugacgcagggcugcucugaccacccagggcugauccuaaggccuggcagaacccuggcaugacaaaauauagucugagggggugcgcaacaggauccuugggucaccccaauguccuuuucuccuuaccuuggucccagcugcagaugacagacuggugaaacaggcugugacacagagacaacagcuccuucucacacuccugaggcaggggugcugaugggagaaaugaaggaagccuggaaacaaaucccuggugacagccccugccgacuccacucaagucaggcaugguggcucuccggaggcaggaggcugagaccagcgucccaggccaguguggacuaaaaccuaaauaaagacugcuaugggaagcugcguggccuugggaaacccuaaacgcuauacuuuaaacucggggaaguucauucauucaaggcccugcgcuugcugacaggcuggaguugagagaggguaaagggaaaaagacacccucaccacaaccuccaaaugccagcucggaccccucgcuuaccuugacacagugccugacucagcucuugugccauugcucuaggguccucccagggucccacgcguagguccaaacacuuagcacaggcugcccacagcaagguccaauacuggcuccacagggcuccaggucccccaagccucaguccgcugcugucggugcuagccacgcccccuaccaggcccagcagcccgggcagcagcucucgcucuugcucgcacugccgacggagcugcuccugcaagcccgauccgccacgggcuucagccagcuuaucugccaccugacaaccccgcucugcagccaggagcuggagcacacgggccgcggggaaugggcgcgcggccccggggacgaaguucagggaaugucccugcagagugugguagaagggaagggccagcaacaguucggcuagcugggaugucaggcccaggcuagcggguguccggcccagugaacgaagcugcaucucgauggcagccuccaagugcugggcagcuagcccgacagggcgagucaggagaagcgucucccuggagcccgggaagccgaggcgcagagccgccccacgagaugggcacagcuguaaaucgccgugcaacugcugcagggagagggaaccggccgaggagccggagcggagcagccgcacgaccgccugcagguggcgggcgcagucccgggcccgcaggagcugcucucgcucgcggugcagacgaagcaauguggcccggagccgcugaagagcgaagggcaucgggccgcuugcagacgcgggagcccacggcugucugcugaaguccgggcacgggacgcucaccgcagccaguagcccuagcccuccacgccuccccucgucccgcuccuccccagcgcccacgggcugcgcccacgacgaggguacguuagcgaguggaggcaaagggccacuagagcuggacgcccgugccauuugcacggcgagucccaaacgaaccuaacgcucgccgccuccccgcuucccgucgcacuccacgcccgugggcgccaggacucaccagcuagccggaagucucguggucuuacuggggcuccguagccacgaccucugccccuaacaaagauggccacccacuuacucuuucccggcccuuaacgacuaucaaauucuagcuagacuuuccugucaccguuaacgggagguggcgcugaugcuaaaugcuguagggagagucaagcuaggugugacuugacagcaggagacccaugucuccgccaucccugacuuccuaguguaccgccuuccugcagucugcccucuggggguccugcggcggucuacuacagaaaagaggaaagcgagaccucaguuugcuuuugcuuugaucguugucuucguguucauuugugggcguguuguuguucaguucucuuugaaucucacuguguauguucuuagcuauccugaaacucucauguagaccaggcaggucucgaacucagaguugucagccugccuccgcuuccuggcuuaaguuaagaguguguaugugugucaucacagccagcuucaacuucuuuuauguuuucuuucagucaucucugagaguuuugggaagcagcugguucggacccuacucaua

SEQ ID NO: 10163 - RNA, 2501 nt, Mus musculus
acccaacuuuccaccucccuucucgggccuaagaagagucucuagccucuagccugagucaccacaccaccacuaccaccacuaccaccacuaccaccacuaccaccacuaccagcagcagcagcagcagcagcagcagaguaucccugucagcacguucugagcccuaugcuuaaaucucuaaacuggagaggcacuggaggcacauggcuaagucagaaaugagaggggcuuggccaccccaaagagacuuauguccccaaggucaucuucccacaugcucaaggaggucccaguuuaaagucuguaucccucacuggcccgggaaggguuaagcguggugguucuuccagcagugcaccccccucccgccugggauuccaggccuggcuuuugcccuuuccuucuaggcugcccagaacaaaggcucuuuucacgcccgugucccgcagucccaagcuuucucugagucagaagagaguggaggguuuugucauccucccgccccagcaacuuagacccaaggaacccgcgcguggccagcgucggggagucaggggcgagguuggggaccuggaggagggcucguguuccugagccuugcaaggauaugccaggccuugggagccauagcugaggagucggggcggagcugcugggccaggccugccgccggguugagugugacuccacggucccggaguaggggggugggggacagcccugcagcuggcugggacccggggcugguuuccugucuggaagggaaggggccccgagaggggaucagggccagcagcagccaggcacaccccugacuuucucccucucucucuccucccuucugcuggaaaagcgagguaauugugagcccaggguggggcgugcuggaugggggccggcauuggaaggggugacccugggagcugggcugcauuacagacucaccccuuugucccauucccugggcucaagucgccucauguccucacuucugucgcuaacuuuucucaaacuaagccagaacucccucggucgguucugaucucccgucaagccucaggauuccguagaaucagcaggaggcgucccuucccugcccccuuccagcugugccugccccucacugcccucgcagcacgcacauucucgaucggccaggccagagaugugggcgggagcgggggaggggccaaaaugggaaugaaagggccuuuuucuuccacagcugggagaacagcugccaccaacuccaggcuggacacucugugcccagagcccccucugcagcuggccucuccucccaggaaccccugcucauucuuaccucacuuucuuuccuccucugcuuggcuccuaccaaggccuuggaacagcgcuaggagagaaacuuuugucacagaagccaaaggggucuaacaggacugcagagggacagggacagacucugcauucugucccagagcuggacaccucucucgagcccggggagcagugggaggaggaacugugggacaacguggugccuaccuggccucucuccgggcagcaagggaaggggcuuuaggggacacagagaugcaggacagauugcgcauccuggaggaccucaauaugcucuacauccggcagauggcacucagccuggagguaaugccccgaccccuggacaacgugcuuccugugcugucucagccuuaguggggcuaaugagggaggggggcagggcccgguagggcccgcccacagcugggauaggugguuuuguauacaauguguugaauacguuuggggaucaaagcccacuucucugaccagaaugaacauuaugaagggcuaaggauguggcucccaugguagagcgccugccuguuugacacggacaaaguucuggguuugacucucagcagccugggcacugcaugaacugcguugcaggggcaaaugcauguaauucuggcacuuggaaaguagaagcaagagugaguuccaggccaaccugggcuaaacaacaacaauaaaaccacauguugacagcaggggcuuggcuguuaugaauagguguagauguuuguucugaggacagagguucauuuuugagacagaaugaagagauuucaguaugaaggggguuuguagaagaugaacucggaagagaagugaggagguggugugccacggugcagaugugaggucagaggucaacuuccaagagaggcugggacacuauucguacauuuauucuuuuucuuuuuaauuucccuucccuccuuucucuccuuuuuucuaaucgucuuuagacaggaucacauuuuguaguccaucuggcuauugaagucacuauguggucuaggcugguguggagcucauggcaguccuccugccuuagccuucugagugcugggauuacagaucggagccauuaugcccuacuuguucauuuuuuucucucuuuugguuuucuuguugcuuuuauuacgugugugugugugugugugugu

SEQ ID NO: 10164 - RNA, 2501 nt, Mus musculus
acacacacacacacacacacacguaauaaaagcaacaagaaaaccaaaagagagaaaaaaaugaacaaguagggcauaauggcuccgaucuguaaucccagcacucagaaggcuaaggcaggaggacugccaugagcuccacaccagccuagaccacauagugacuucaauagccagauggacuacaaaaugugauccugucuaaagacgauuagaaaaaaggagagaaaggagggaagggaaauuaaaaagaaaaagaauaaauguacgaauagugucccagccucucuuggaaguugaccucugaccucacaucugcaccguggcacaccaccuccucacuucucuuccgaguucaucuucuacaaacccccuucauacugaaaucucuucauucugucucaaaaaugaaccucuguccucagaacaaacaucuacaccuauucauaacagccaagccccugcugucaacaugugguuuuauuguuguuguuuagcccagguuggccuggaacucacucuugcuucuacuuuccaagugccagaauuacaugcauuugccccugcaacgcaguucaugcagugcccaggcugcugagagucaaacccagaacuuuguccgugucaaacaggcaggcgcucuaccaugggagccacauccuuagcccuucauaauguucauucuggucagagaagugggcuuugauccccaaacguauucaacacauuguauacaaaaccaccuaucccagcugugggcgggcccuaccgggcccugccccccucccucauuagccccacuaaggcugagacagcacaggaagcacguuguccaggggucggggcauuaccuccaggcugagugccaucugccggauguagagcauauugagguccuccaggaugcgcaaucuguccugcaucucuguguccccuaaagccccuucccuugcugcccggagagaggccagguaggcaccacguugucccacaguuccuccucccacugcuccccgggcucgagagagguguccagcucugggacagaaugcagagucugucccugucccucugcaguccuguuagaccccuuuggcuucugugacaaaaguuucucuccuagcgcuguuccaaggccuugguaggagccaagcagaggaggaaagaaagugagguaagaaugagcagggguuccugggaggagaggccagcugcagagggggcucugggcacagaguguccagccuggaguugguggcagcuguucucccagcuguggaagaaaaaggcccuuucauucccauuuuggccccucccccgcucccgcccacaucucuggccuggccgaucgagaaugugcgugcugcgagggcagugaggggcaggcacagcuggaagggggcagggaagggacgccuccugcugauucuacggaauccugaggcuugacgggagaucagaaccgaccgagggaguucuggcuuaguuugagaaaaguuagcgacagaagugaggacaugaggcgacuugagcccagggaaugggacaaaggggugagucuguaaugcagcccagcucccagggucaccccuuccaaugccggcccccauccagcacgccccacccugggcucacaauuaccucgcuuuuccagcagaagggaggagagagagagggagaaagucaggggugugccuggcugcugcuggcccugauccccucucggggccccuucccuuccagacaggaaaccagccccgggucccagccagcugcagggcugucccccaccccccuacuccgggaccguggagucacacucaacccggcggcaggccuggcccagcagcuccgccccgacuccucagcuauggcucccaaggccuggcauauccuugcaaggcucaggaacacgagcccuccuccagguccccaaccucgccccugacuccccgacgcuggccacgcgcggguuccuugggucuaaguugcuggggcgggaggaugacaaaacccuccacucucuucugacucagagaaagcuugggacugcgggacacgggcgugaaaagagccuuuguucugggcagccuagaaggaaagggcaaaagccaggccuggaaucccaggcgggaggggggugcacugcuggaagaaccaccacgcuuaacccuucccgggccagugagggauacagacuuuaaacugggaccuccuugagcaugugggaagaugaccuuggggacauaagucucuuugggguggccaagccccucucauuucugacuuagccaugugccuccagugccucuccaguuuagagauuuaagcauagggcucagaacgugcugacagggauacucugcugcugcugcugcugcugcugcugguaguggugguaguggugguaguggugguaguggugguaguggugguguggugacucaggcuagaggcuagagacucuucuuaggcccgagaagggagguggaaaguugggu

SEQ ID NO: 10165 - RNA, 2501 nt, Mus musculus
guggaagaggcagggagggcagcggggaacgagggaccggccggaccgugccgcgugcgccgagcacccggcgcccccgaccuacggggccagcuccgguuacagcgcggcgaaggagaggcccagcgaguagaagcccaggcccuugaggcgcuccuccgcgcgcgccuucugcuuuaggugcaccuugcugugccguuucuucucgucacugcgcgcgaagcggcggccacacacgucgcaggcgaagggcuucucgcccgugugggugcgcacgugcguggugagguggucgcugcggcugaaguugcgcaggcagaugcggcacuggaagggcuuguggcccguguggaugcgcagguggcgguugagcucgucggagcgcgcgaagcuccgcacgcagcucuccaccgggcaggcgaaggccuugacgugcggccgcgggcagaagcagcgcgcgcugcacuugccgccccggcgucccuugcgucgggcuuuggccgcggggaaggaugcggcgggggaugagggcgcggccacgccgcugccccccgggagaucggccaccagggguuuggagaaguccgccguggcggcaccgcgcaggccuagaggggacagcugcgccggaggggcggccaggaacucuccgccuucgccgccgcucccucccuccccgccgggaggggucagcagcgccgggaggcccucgguccccuccccuaagucaccuggggccaacgagaaggugucguaggccccugccugguagagucuggcggccgggccgggcagcucggcggggcagcugauggacagcagguccucgaccuuggucccuacugcagagaagcgggccuccgggguggucuggaagcuccccugcgacccacaguuccccgggaccccggccgacagcagcucccagggggcauagggcccuuugaaggcugaagcagcagcguccagcgcuggcgaagcgggaggcgcccgcagcccuggcuugacgucgggcggggagagcuggggcucgaacaggcacugcgagggagcgcccgccgaaggcgcugccucccaaaacgccuccggaaaggcggccgaacucagaucuggggaguagagguccggcagcaaggcaucggggcccgcggggaaagggacauccaggggggaccgagacgcugccgccucgggaccggggaagggugccaggcccaagaugccagacaugagguugaagagggccuccgggucgugcggguguucgggaaccgccuggaugaagaagcugccgcuguagcugaggcccgaagggggcgugggugcagggcccuccaggaagcaggagucuguuaagucccccccggcgccgcagcugcucaaagcccagcucaagaagucgccugccaaaggagggaccacgcaucagccccgcacaccucaaagggcgugccucggagccuacagcugcgacccccuccacccgaguccuccuggcgcaaggcacccgcagagcgccucgugcacuuccgauccugcagcagagggacccccacggacgccccagggcgcgcacacccaaggcucccgcacaggcgccuguggccuuggugggggugggaaugguacugcgcgcuuggggacccccaccccccaccccgcgcgccucuccuaucacccuucaucgcguucagagucuucgagcucccagacccgcuccuuaccuccaggauacgcggcggccgagggagcgucccuagcaggcagccggggcagcucggggcuggcgugggcgcagccuucggugggcuuggagagaagcgcgucggagccggagaagucgcucagguggagcauggcgcgguggcggcggggcgcccggggccucgcuggacuggggcgcgcgcggcuggcagggaauccgggcgccccaguuccaggcuccgggcgcuuggcuggggcacgaggguuggggggccgcggcgcccuggcucaccggcaccugccucggguggcggcuccuggcuucuccaaagugcaacagggcucccccaaccuacaguccccccacuuauauagcugcggcggcgcuggcuccgggcuuccgacuccccgggccacugccauuucgggaggccccggcccuggcgccgugacguaaaugaccaaacauggacacaggauguaugccggggacucccgaaaaggaaagcucggccugugacguugcugccgccgccgggcucgcgccgcugcgugcgcgcgaguccccagagcguggagccucgugugcguugggccacgggugcgccccgcaggggcugagcuccgugugagcacccgggaugcgcuuugcccuccaguccguagaauuacugguucgaaccugccguuucccacuuaaaacguuuguucccaccuaauaccaguuuguuuuuuuuuuucaccugugagcuugcuaaggagagaaauaacaaaauaacaugaagucccgggaacac

SEQ ID NO: 10166 - RNA, 2501 nt, Mus musculus
guguucccgggacuucauguuauuuuguuauuucucuccuuagcaagcucacaggugaaaaaaaaaaacaaacugguauuaggugggaacaaacguuuuaagugggaaacggcagguucgaaccaguaauucuacggacuggagggcaaagcgcaucccgggugcucacacggagcucagccccugcggggcgcacccguggcccaacgcacacgaggcuccacgcucuggggacucgcgcgcacgcagcggcgcgagcccggcggcggcagcaacgucacaggccgagcuuuccuuuucgggaguccccggcauacauccuguguccauguuuggucauuuacgucacggcgccagggccggggccucccgaaauggcaguggcccggggagucggaagcccggagccagcgccgccgcagcuauauaaguggggggacuguagguugggggagcccuguugcacuuuggagaagccaggagccgccacccgaggcaggugccggugagccagggcgccgcggccccccaacccucgugccccagccaagcgcccggagccuggaacuggggcgcccggauucccugccagccgcgcgcgccccaguccagcgaggccccgggcgccccgccgccaccgcgccaugcuccaccugagcgacuucuccggcuccgacgcgcuucucuccaagcccaccgaaggcugcgcccacgccagccccgagcugccccggcugccugcuagggacgcucccucggccgccgcguauccuggagguaaggagcgggucugggagcucgaagacucugaacgcgaugaagggugauaggagaggcgcgcggggugggggguggggguccccaagcgcgcaguaccauucccacccccaccaaggccacaggcgccugugcgggagccuugggugugcgcgcccuggggcguccgugggggucccucugcugcaggaucggaagugcacgaggcgcucugcgggugccuugcgccaggaggacucggguggagggggucgcagcuguaggcuccgaggcacgcccuuugaggugugcggggcugaugcguggucccuccuuuggcaggcgacuucuugagcugggcuuugagcagcugcggcgccgggggggacuuaacagacuccugcuuccuggagggcccugcacccacgcccccuucgggccucagcuacagcggcagcuucuucauccaggcgguucccgaacacccgcacgacccggaggcccucuucaaccucaugucuggcaucuugggccuggcacccuuccccggucccgaggcggcagcgucucgguccccccuggaugucccuuuccccgcgggccccgaugccuugcugccggaccucuacuccccagaucugaguucggccgccuuuccggaggcguuuugggaggcagcgccuucggcgggcgcucccucgcagugccuguucgagccccagcucuccccgcccgacgucaagccagggcugcgggcgccucccgcuucgccagcgcuggacgcugcugcuucagccuucaaagggcccuaugcccccugggagcugcugucggccggggucccggggaacugugggucgcaggggagcuuccagaccaccccggaggcccgcuucucugcaguagggaccaaggucgaggaccugcuguccaucagcugccccgccgagcugcccggcccggccgccagacucuaccaggcaggggccuacgacaccuucucguuggccccaggugacuuaggggaggggaccgagggccucccggcgcugcugaccccucccggcggggagggagggagcggcggcgaaggcggagaguuccuggccgccccuccggcgcagcuguccccucuaggccugcgcggugccgccacggcggacuucuccaaaccccugguggccgaucucccggggggcagcggcguggccgcgcccucaucccccgccgcauccuuccccgcggccaaagcccgacgcaagggacgccggggcggcaagugcagcgcgcgcugcuucugcccgcggccgcacgucaaggccuucgccugcccgguggagagcugcgugcggagcuucgcgcgcuccgacgagcucaaccgccaccugcgcauccacacgggccacaagcccuuccagugccgcaucugccugcgcaacuucagccgcagcgaccaccucaccacgcacgugcgcacccacacgggcgagaagcccuucgccugcgacguguguggccgccgcuucgcgcgcagugacgagaagaaacggcacagcaaggugcaccuaaagcagaaggcgcgcgcggaggagcgccucaagggccugggcuucuacucgcugggccucuccuucgccgcgcuguaaccggagcuggccccguaggucgggggcgccgggugcucggcgcacgcggcacgguccggccggucccucguuccccgcugcccucccugccucuuccac

SEQ ID NO: 10167 - RNA, 2501 nt, Mus musculus
ucaggccaagcaaccaccuggagcccaaagguggccgcgguagacaaccacuuuccucucaccaaaacucuaacuucauccacguccaaguuuguuuccuccucgguucuaguuacgaggagggagggagagcuuaggaagcagucuggagaagaggcagagaacggccggccgagggcugggaauugcagaacacaacagcaggcgcaggcgcuccagccucuggugacaauagcggaaaggccuggagagggcaaaagaacugagucaggaacugguuacagugauggggauggggauagggauggggagcgauggggagugcaggucaaggccauuacuagagcgcguagcuccagcgccucccaucgggacaaacacagacguccugcacaguccacgcagcugccuggauacggucccgugccucucuggccugaccguggccgcccagccccucccuccgcggacgcgggcggcugucugaaggcgccgaucugccgagagaaaccgccaggguuugggcauggagagcucggcgggugacccauaccggcgaccugcgcggcgcacucaguggcugcugagugccuuggcucaccacuacgggcuggaccgcggcguggagaaugagaucguggugcuggcuaccggucuggaucaguaucugcaggagguuuuccaccacuuggacugccggggagcgggccgccuaccgcgcgccgacuuccgugcgcucugcgcgguacuggggcugaacgcugacggggagacggccacggaggacgcaaacuccgcggaggcggccuccacgaacccggcugcugggaugaucgcuggcggggacgcggacgucagggaagaggcgcgccuggcucugcgagccgacccuccagagcucaccuuccgccaguuccacgcgcgccucugcggcuauuucaguagccgagcggggccccggcugccccgcggagcucuuagcgagcacaucgagacacagauccgccuccgccgcccgcgccgccgccgccggccuggcucaccgagccugcacgguggcgccuauggcgagcggguggcacaucuagaggaggaaaacaguagccuacgcgagcugguggaggaccuacgggcugcgcugcagagcagugacgcgcguugccuggcccuucaggugcgagggaugccucggguggagacagagacgccccaccgcggcccagccccuccucagcugguucucuccguuccccauuccacccccuucauuccaacuuccaccccaauguaucauuccuuaagaucccaacuuccuacccaagucccuucuaauccuagaaggaaccuguuuaaguagccaaguagugaugggucagcacacauccuucuucgggagguuuaaggaaaacaaaggacugacugcccuuccccaagucagcgaaacuuguugaaucccucacagccaggccucuagcccaggugagaaagacaaugauggccagcaaugagggccaggcucacucugagcuauugagguggagccauugagugagcuggucucugggaucagucaacgaacacuugagcccucgguguucaguguagcucaggugaccagcuaagggagaaaaggggcccuuauaggcguauaggaagaggaccugcguuacauuggugucuccugucuccuaguugcugcagaguacaacuaggugucaaaguggccuucgugguucauaugucugccaggagaguguaagauggggcagaaggaacccugggagugcguagaguagugugugugugugugugugugugugugcgcgcgcguguguguguguguugccugagacuaggucucucauuuaaaagggucucuccgucuuucacgcucaagugccuacugggcacauugucccagcuuccuuuaugcuuuggaacacugcagaaaacaaaacagaucaaccccguuuccaaggacaguccagagcacagaucucagaaagggcggaaauuucagucugcucuuuaaucugugccuugaguccagugaauuaggagcagcguacacuggaugcaggaauuaagccuagaaggcacgacuuugggggauuacugucaccaugcagaaaaacagaggguggacuuccugucccaacuucccucguggggggugggggugagggguauugcauacacuugcuuuagccgcuugugccaguugcucagugagcuagcuuugugguuguaaggggaugaccccguagacuucugcaguggucacucacuguggcuucccgcggacaggucggccucuggaaaagccagucggacaucccagaagcggcggcgcacgagcugcagcgagcgcagggcgcgcuggcagaggcggaggcgcgcgcccggcggcugcagcgcggacagguggaggugcggcugcgcaccgaggaggcucggcaggcggugcgacgcagcuugcaccgagugcgggagcuggaggc

SEQ ID NO: 10168 - RNA, 2501 nt, Mus musculus
gccuccagcucccgcacucggugcaagcugcgucgcaccgccugccgagccuccucggugcgcagccgcaccuccaccuguccgcgcugcagccgccgggcgcgcgccuccgccucugccagcgcgcccugcgcucgcugcagcucgugcgccgccgcuucugggauguccgacuggcuuuuccagaggccgaccuguccgcgggaagccacagugagugaccacugcagaagucuacggggucauccccuuacaaccacaaagcuagcucacugagcaacuggcacaagcggcuaaagcaaguguaugcaauaccccucacccccaccccccacgagggaaguugggacaggaaguccacccucuguuuuucugcauggugacaguaaucccccaaagucgugccuucuaggcuuaauuccugcauccaguguacgcugcuccuaauucacuggacucaaggcacagauuaaagagcagacugaaauuuccgcccuuucugagaucugugcucuggacuguccuuggaaacgggguugaucuguuuuguuuucugcaguguuccaaagcauaaaggaagcugggacaaugugcccaguaggcacuugagcgugaaagacggagagacccuuuuaaaugagagaccuagucucaggcaacacacacacacacgcgcgcgcacacacacacacacacacacacacacuacucuacgcacucccaggguuccuucugccccaucuuacacucuccuggcagacauaugaaccacgaaggccacuuugacaccuaguuguacucugcagcaacuaggagacaggagacaccaauguaacgcagguccucuuccuauacgccuauaagggccccuuuucucccuuagcuggucaccugagcuacacugaacaccgagggcucaaguguucguugacugaucccagagaccagcucacucaauggcuccaccucaauagcucagagugagccuggcccucauugcuggccaucauugucuuucucaccugggcuagaggccuggcugugagggauucaacaaguuucgcugacuuggggaagggcagucaguccuuuguuuuccuuaaaccucccgaagaaggaugugugcugacccaucacuacuuggcuacuuaaacagguuccuucuaggauuagaagggacuuggguaggaaguugggaucuuaaggaaugauacauugggguggaaguuggaaugaaggggguggaauggggaacggagagaaccagcugaggaggggcugggccgcgguggggcgucucugucuccacccgaggcaucccucgcaccugaagggccaggcaacgcgcgucacugcucugcagcgcagcccguagguccuccaccagcucgcguaggcuacuguuuuccuccucuagaugugccacccgcucgccauaggcgccaccgugcaggcucggugagccaggccggcggcggcggcgcgggcggcggaggcggaucugugucucgaugugcucgcuaagagcuccgcggggcagccggggccccgcucggcuacugaaauagccgcagaggcgcgcguggaacuggcggaaggugagcucuggagggucggcucgcagagccaggcgcgccucuucccugacguccgcguccccgccagcgaucaucccagcagccggguucguggaggccgccuccgcggaguuugcguccuccguggccgucuccccgucagcguucagccccaguaccgcgcagagcgcacggaagucggcgcgcgguaggcggcccgcuccccggcaguccaagugguggaaaaccuccugcagauacugauccagaccgguagccagcaccacgaucucauucuccacgccgcgguccagcccguaguggugagccaaggcacucagcagccacugagugcgccgcgcaggucgccgguaugggucacccgccgagcucuccaugcccaaacccuggcgguuucucucggcagaucggcgccuucagacagccgcccgcguccgcggagggaggggcugggcggccacggucaggccagagaggcacgggaccguauccaggcagcugcguggacugugcaggacgucuguguuugucccgaugggaggcgcuggagcuacgcgcucuaguaauggccuugaccugcacuccccaucgcuccccaucccuauccccauccccaucacuguaaccaguuccugacucaguucuuuugcccucuccaggccuuuccgcuauugucaccagaggcuggagcgccugcgccugcuguuguguucugcaauucccagcccucggccggccguucucugccucuucuccagacugcuuccuaagcucucccucccuccucguaacuagaaccgaggaggaaacaaacuuggacguggaugaaguuagaguuuuggugagaggaaagugguugucuaccgcggccaccuuugggcuccaggugguugcuuggccuga

SEQ ID NO: 10169 - RNA, 2501 nt, Mus musculus
agacucauguuguccagcggauccuaccagccucuugcacagcuaucccugauagaaggacagagaguuuggggagucaguuggauuugggcuggccgucguccguagcaguggagguggggcuccgcccgagaguagaaagcuguggucccagcagagagauacccagaaggugcacgucucggcuccugggaagucagggacccuauucgugccuaguugcugggagggcagagguuggaagaccugagcgucugccggaggggugcagggucugcccacggcgaagguccccuggggggggggggcguuggcaucagaggccgcagagagggcgcugguagggggccaggcagccuaggaggccagcuugcgggucauucccgaaguccagcggccaaagcggcgggagcagccaaugggggggcggaggcugggcggcgcgcggcgcugauuggcuggcgccggcuucauaggcgugcgcggcccccgcuucacgucugugcaggagucggcagcuggcgccagggcggccggaggaugcagaggggccggagccgggcgggccggaggccgagacgcgcgcugucccccaccccuaucccgugaauccgccggcccuggaacgcgcugucgcugggcccgccguacccgggcucuccuggugucucuuacucucuacugcugagcccuccccuucccgcgccgcugcgaguguaaguuugagguucagggggcuuguggacauuccuagguuggagggaucucuguggagcucagaccaggaucuccugugggcgauuacguucuuaugcuuuggggagagguuggcugacugcuagagagugcauuggggaccggcucgcagccccaggaacugcgggugcguuuuuugggguggcccgggguguuggggguuaguuuguguauauauugucaaaguguuacgggggcgugggagagcgugugccccagaguggaugucuaggcaacugucucuaacuuuuagucagaguuuauguguuugugugcccagaggacaggggcacggugugagaaccugauuucaguuccgcgugcguuuugggggggucaccgaugucaggaccuauccgugugugugaccucguguauguggaguugcgucugugggaacgcgaguuucccugcaaguguaugaggcugaaccccuuccuucaccuuccuuucguuuuaaaccuugcgcuuuccuuccacccgggacugguccucagugaagcuccgauggaacgucuuugcucucaagacacagacuuugggaaugggggugucagaaggcggcaguguccuucacauucccucuguuauccagggccgccccaccuucgccugguucccaagacacaguaguggaccauggagguggcgccugagcagccucgcuggauggcgcaccccgccguauugaaugcgcagcaccccgacucgcaccauccgggccuggcgcauaacuacauggagccagcacagcugcugccucccgacgagguggaugucuucuucaaccaucucgacucgcagggcaacccuuacuacgccaacccggcccacgcgcgcgcgcgcguuuccuacagcccggcgcauggugagcuuuggcccccgagguuucuggaagccuggcgcccgggccaggccuuggaggggggacggccuguugcugcuucccggaugugggauccacaggaaucugagcagcugcgaaaucgggccuaagaagauggaggcagggacuucuuagggagggucugggaccuguaggguuucgguccauuuccaagugucuuggcgggggugggggugggggaauccuucugggcccuguccgguggggcugcugugucacuuguccuucggccuuucacugacauugcugaugauuacaggcugagguguuacguuucugauguuuuaaaggguggggcugcugaugguaguucgcugaguugugauccugugugcccgggucauggcucugaagccccuggucauccucacccccuuucccucugcacagcccgucucaccggaggccagaugugccgaccacacuuguugcacagcccaggcuugccguggcuggacgggggcaaagcagcucucucugccgccgcugcccaucaccacagucccuggaccgucagcccguucuccaagaccccgcugcaccccucagcugcuggagcacccggagggccucugucuguuuacccaggggcugcgggugggagcgggggaggcagugggagcuccguggccucccucacccccacugcagcccacucgggcucccaucucuucggcuucccacccacgccacccaaagaagugucuccagaccccagcacaacaggagcugcuuccccggccucuucuucugcaggggguaguguagcccggggugaggacaaggauggcgucaaguaccaagugucacucuccgagagcaugaagauggaaggcgg

SEQ ID NO: 10170 - RNA, 2501 nt, Mus musculus
ccgccuuccaucuucaugcucucggagagugacacuugguacuugacgccauccuuguccucaccccgggcuacacuacccccugcagaagaagaggccggggaagcagcuccuguugugcuggggucuggagacacuucuuuggguggcgugggugggaagccgaagagaugggagcccgagugggcugcagugggggugagggaggccacggagcucccacugccucccccgcucccacccgcagccccuggguaaacagacagaggcccuccgggugcuccagcagcugaggggugcagcggggucuuggagaacgggcugacgguccagggacuguggugaugggcagcggcggcagagagagcugcuuugcccccguccagccacggcaagccugggcugugcaacaaguguggucggcacaucuggccuccggugagacgggcugugcagagggaaagggggugaggaugaccaggggcuucagagccaugacccgggcacacaggaucacaacucagcgaacuaccaucagcagccccacccuuuaaaacaucagaaacguaacaccucagccuguaaucaucagcaaugucagugaaaggccgaaggacaagugacacagcagccccaccggacagggcccagaaggauucccccacccccacccccgccaagacacuuggaaauggaccgaaacccuacaggucccagacccucccuaagaagucccugccuccaucuucuuaggcccgauuucgcagcugcucagauuccuguggaucccacauccgggaagcagcaacaggccguccccccuccaaggccuggcccgggcgccaggcuuccagaaaccucgggggccaaagcucaccaugcgccgggcuguaggaaacgcgcgcgcgcgcgugggccggguuggcguaguaaggguugcccugcgagucgagaugguugaagaagacauccaccucgucgggaggcagcagcugugcuggcuccauguaguuaugcgccaggcccggauggugcgagucggggugcugcgcauucaauacggcggggugcgccauccagcgaggcugcucaggcgccaccuccaugguccacuacugugucuugggaaccaggcgaagguggggcggcccuggauaacagagggaaugugaaggacacugccgccuucugacacccccauucccaaagucugugucuugagagcaaagacguuccaucggagcuucacugaggaccagucccggguggaaggaaagcgcaagguuuaaaacgaaaggaaggugaaggaagggguucagccucauacacuugcagggaaacucgcguucccacagacgcaacuccacauacacgaggucacacacacggauagguccugacaucggugacccccccaaaacgcacgcggaacugaaaucagguucucacaccgugccccuguccucugggcacacaaacacauaaacucugacuaaaaguuagagacaguugccuagacauccacucuggggcacacgcucucccacgcccccguaacacuuugacaauauauacacaaacuaacccccaacaccccgggccaccccaaaaaacgcacccgcaguuccuggggcugcgagccgguccccaaugcacucucuagcagucagccaaccucuccccaaagcauaagaacguaaucgcccacaggagauccuggucugagcuccacagagaucccuccaaccuaggaauguccacaagcccccugaaccucaaacuuacacucgcagcggcgcgggaaggggagggcucagcaguagagaguaagagacaccaggagagcccggguacggcgggcccagcgacagcgcguuccagggccggcggauucacgggauaggggugggggacagcgcgcgucucggccuccggcccgcccggcuccggccccucugcauccuccggccgcccuggcgccagcugccgacuccugcacagacgugaagcgggggccgcgcacgccuaugaagccggcgccagccaaucagcgccgcgcgccgcccagccuccgcccccccauuggcugcucccgccgcuuuggccgcuggacuucgggaaugacccgcaagcuggccuccuaggcugccuggcccccuaccagcgcccucucugcggccucugaugccaacgccccccccccccaggggaccuucgccgugggcagacccugcaccccuccggcagacgcucaggucuuccaaccucugcccucccagcaacuaggcacgaauagggucccugacuucccaggagccgagacgugcaccuucuggguaucucucugcugggaccacagcuuucuacucucgggcggagccccaccuccacugcuacggacgacggccagcccaaauccaacugacuccccaaacucucuguccuucuaucagggauagcugugcaagaggcugguaggauccgcuggacaacaugagucu

SEQ ID NO: 10171 - RNA, 2501 nt, Mus musculus
ugggcuugcagaugcggcggggacucugccaggggccacgcuggagcaggccuccaguggacugcagagagcugguacucugcucucucccaacucugaguaacacuaugguucuugcucagaaacaaagcccucaaaacccucacaggaggacagcuugcucccugugcccugcugcucuggagccuuaugguuguggacaggccggucuuacugacaucucaccuagugguuccccaucagcggcaagagaaggaucucccugccuugucacccugccccacccugugggaggucauaggaguuggucuccaacggucuacucucuacauggaggcccuggagucgugcucuccagaaagggugcaagcuucuagucuccccuggggucccacacucccgguccaggugcuccaagagauguggcuuuguccaccacaucuugucugguuccaaacccaagaacacauuccucagccaacacugaccacacaccccaagccuccacccaugcuguccucugugccuuuagacaccuucggugggcuccaagcugccaccuccccucugccugacagccuagcccugaagcagagucccuguuuugcaccucugccuagggcacuggcugagugcuuccccgacccagcagacucuuggccagccuaaugcagcacuaccuccuccugcucacccccaacaagcaauggagcuggaaaacugggggugcucuaggagggcuggagaagcacaggauagcaccacccugaugggacugaagacccgcagcaccugcuggaagagguagguagcaccaggagccagagccagagguaggagccuggcagaggggcagaggcucaguucguucccauccccccccaacacaccccuuucuuucaaggggcguggccccagcaccccaccgaugagacugagagggcuccggccaccuaguagccucucugaagcccucuuguauccuuccagggcagcaccugggaucucugcaggcagagggggccucccaggaaucuacacucgcccuucccuacagcagccagagucagcccaucaccgccgccguccucgccguacaccaggccugggaccguccaggaagcaagaggggaauccuccggggaaggaaugacccguggaggcccugcgcagggggaggccgaggaggcccgagccggcguccucuccgguggcaccgcaccgccccuugcagccggguggagggccugcgggccugggcuggcugcggcgcccacucgcgcgccggagccggagggggcggggguccccacgaagccuugcaacuuccaccccacugccucaggccggcccgaggcgcagccagggaccugccccgaaucccgcggcccugcccgggccugcccagcgcggcgcucgccugcggcccacguccccacccgcggcccgguccgacccggcgcaacacgggccgacaugggcacccgcagggcccuucccgcggggccacugcaaacuuucucuccugccuggaggaagggaccgcgacugcggccacagacauugcgcccccccggaucguagggccccggacgugcugcgacccgccgggacgcggcagcccauagcggagaccgcgcccggacacacgcgggcgcccggccggaaccgcaggacacgccagccgcggacacgcgcgccgcaguccccgcgcacaccccccuggccgccgccagcgccccccggccacucgggaccccgggccgcgacgagccucccgccgcccgcggggaaaguugcgccccgacucacccgccaaccccgggcgcgucccgccgcuggccaucguugcgccccgccgcucgccccucugcggggccgcccacgccgcgcaggccgcccaggccgaggccgccgcgcccgggcuccgcuccgcugcguggcugcgucgccgcugcccagcaugaauggggcgcugagcuccgcgcggcugcggaccggccucgcucucgccgccccgcggagcgccgugccgcgcgcaugcgccggccgaagccggggggcggggccgggggcgggggcgggggcggggcgggacccgcgauggccugcagggggcgcucggccccgcggcgagagcgcgcgcggcgggccccaccgcuugccuucaaagggcgauggccaccucagccuuaaaacucuggacuggggugggggugggugaggugguccggguggucccaggagucgaugcacucuuuaaggagcacaggcuggaaguacagcuuucgugcacggaaggguaaacugaguccggaggaagcacuugcccugguccuauugcucaucucugccugcgcaacgaucgcuuaggugggaccggcacugcaccccgcaggccccaggagguggcgcgugccgggaugccuaagcucagaggacgacuguccuguccgguacgcgguccugcagcggggcguguuagaacuaccccagcagga

SEQ ID NO: 10172 - RNA, 2501 nt, Mus musculus
uccugcugggguaguucuaacacgccccgcugcaggaccgcguaccggacaggacagucguccucugagcuuaggcaucccggcacgcgccaccuccuggggccugcggggugcagugccggucccaccuaagcgaucguugcgcaggcagagaugagcaauaggaccagggcaagugcuuccuccggacucaguuuacccuuccgugcacgaaagcuguacuuccagccugugcuccuuaaagagugcaucgacuccugggaccacccggaccaccucacccacccccaccccaguccagaguuuuaaggcugagguggccaucgcccuuugaaggcaagcgguggggcccgccgcgcgcgcucucgccgcggggccgagcgcccccugcaggccaucgcgggucccgccccgcccccgcccccgcccccggccccgccccccggcuucggccggcgcaugcgcgcggcacggcgcuccgcggggcggcgagagcgaggccgguccgcagccgcgcggagcucagcgccccauucaugcugggcagcggcgacgcagccacgcagcggagcggagcccgggcgcggcggccucggccugggcggccugcgcggcgugggcggccccgcagaggggcgagcggcggggcgcaacgauggccagcggcgggacgcgcccgggguuggcgggugagucggggcgcaacuuuccccgcgggcggcgggaggcucgucgcggcccggggucccgaguggccggggggcgcuggcggcggccaggggggugugcgcggggacugcggcgcgcguguccgcggcuggcguguccugcgguuccggccgggcgcccgcguguguccgggcgcggucuccgcuaugggcugccgcgucccggcgggucgcagcacguccggggcccuacgauccgggggggcgcaaugucuguggccgcagucgcggucccuuccuccaggcaggagagaaaguuugcaguggccccgcgggaagggcccugcgggugcccaugucggcccguguugcgccgggucggaccgggccgcggguggggacgugggccgcaggcgagcgccgcgcugggcaggcccgggcagggccgcgggauucggggcaggucccuggcugcgccucgggccggccugaggcagugggguggaaguugcaaggcuucguggggacccccgcccccuccggcuccggcgcgcgagugggcgccgcagccagcccaggcccgcaggcccuccacccggcugcaaggggcggugcggugccaccggagaggacgccggcucgggccuccucggccucccccugcgcagggccuccacgggucauuccuuccccggaggauuccccucuugcuuccuggacggucccaggccugguguacggcgaggacggcggcggugaugggcugacucuggcugcuguagggaagggcgaguguagauuccugggaggcccccucugccugcagagaucccaggugcugcccuggaaggauacaagagggcuucagagaggcuacuagguggccggagcccucucagucucaucgguggggugcuggggccacgccccuugaaagaaagggguguguuggggggggaugggaacgaacugagccucugccccucugccaggcuccuaccucuggcucuggcuccuggugcuaccuaccucuuccagcaggugcugcgggucuucagucccaucaggguggugcuauccugugcuucuccagcccuccuagagcacccccaguuuuccagcuccauugcuuguugggggugagcaggaggagguagugcugcauuaggcuggccaagagucugcugggucggggaagcacucagccagugcccuaggcagaggugcaaaacagggacucugcuucagggcuaggcugucaggcagaggggagguggcagcuuggagcccaccgaaggugucuaaaggcacagaggacagcauggguggaggcuugggguguguggucaguguuggcugaggaauguguucuuggguuuggaaccagacaagaugugguggacaaagccacaucucuuggagcaccuggaccgggagugugggaccccaggggagacuagaagcuugcacccuuucuggagagcacgacuccagggccuccauguagagaguagaccguuggagaccaacuccuaugaccucccacaggguggggcagggugacaaggcagggagauccuucucuugccgcugauggggaaccacuaggugagaugucaguaagaccggccuguccacaaccauaaggcuccagagcagcagggcacagggagcaagcuguccuccugugaggguuuugagggcuuuguuucugagcaagaaccauaguguuacucagaguugggagagagcagaguaccagcucucugcaguccacuggaggccugcuccagcguggccccuggcagaguccccgccgcaucugcaagccca

SEQ ID NO: 10173 - RNA, 2501 nt, Mus musculus
gaggaggagaagaagaagaagaagaagaagaagaagaagaagaagaagaaggaggaggaggaggaggaggaggaggaggaggaggaggaggaggaggaggagaaagaaagaaagaaagaaagaaagaaagaaagaaagaaagaaagaaagaaagaaagaaagaaagaaaggaaaaaaagaaaaagggcagggugaucuagacaguggagaacuaagaugggagcaugcccaugccuaguuucugcagaccugucccugggcagcuuugagccuggguaccucuggcuaucacagggugcuggguccaggaggagaagcuaaaggguggcgcaguacugagacaucugagucucaauauagccaaagcauggugagagggaguggaaagagggacucagagacccggacaggagagcgccggcuccugggcuccuauuugggcuuguugagcacuggguugggcgaagucuuagcaaaaucgaggccccgcccugaggcgggaccuguggggcggggucucaaggccuggcuagucccgcucuucuccaaccccgagccgcgcgccacccggacucuggauucaccgacggcgggugcgcggacagacugacggcggcgcagcucaacacagagcaccggguaaguacagagccuucgaucuccaccccgcgcuuccucuaggucagucacguucucuugaucgcuggcucgucucucuggcucuccagacaccagacuaguccuucagggucucccagggucacucccccagcugccccccauccccggcgggaaagauugggccucucggucugguaccaccccacccucagucacaaacugccacacaugcacucacacuagcagaaguuacugcaagcucugcagaggcacaggccaccccaacacccagcccagaaucucucgugcaggggcugugcacguucacuucucccacaucccucugcacgugagugcuuucacacacacuugcauguuuuaggcauccuucagacaugcauauguguccguguuaggcacgugugcguucgacauccauagaaaguuugguucagugccgguugguucaaugcuucgcuuaucuccauccgcuauuccacacacaucucccacacgggccuguguuggacacagagggccccacacucagguucacagacagagucauggucccuagcaucugcgguuccccugcugagugggagccucagccuagagagaaggagguggcugcugguguuagucuuggcucacucuuggaguggccuagggggcccaggaggggcuaagucuucaggggugggcuuggcuccucaccaccucuuguuuccccgcccccccucuccuaggcaagaguccauccuuucuuccucagccagccugagaucgugcccaucugcuucacggugauggccacuuggaccaguccgaaguuggucugagccagcagguguucuaugacuggccagagagacaaaaaggaauuugugguguguggguccuuguugcucagaggaugcugaaccugacccucuccaggagagcuugggugacguggguggguggcagcagagggcucccugggcuuggcauugaguggagcuaauacauauuugugauggaaugaucggagcucucgccucaccuuccagaggugccaaguaugugugugugugugugugugugugcaggacccccaagaggaaaggcaggaugggagauguugccaaggguggguaccucuugucuucccgcccaccccuucauguaguauguagaaagcaucugacuggaggugcagacccgccagccccggcugugacuagcucugcauguuuugcuuggcucucaguaugcuauuauuguuuuuaaaaauuuaauuagcugccagcauuuacuaacuggcagcuuucacagaaaaguccggauuuccgucuuuucuugaaaaaaaaaaaaaaaaaaaagcaagcucuggugguuaggauucauaugcuuuuguggagugcuucaaccagugcugcuggcugccuucccuuagggaugggccaggggcaccuuugguugcagucucuaccagaucuuucuucugggcuccugucuggccuuuggagaccuguucugguuguagccuuuuaaauccauugcuaucucaagggugagcccaggcuaggcucugccaugccuuaaguaagccuccuaccauucaggauguuggucaccacaaaggugggaguguccaggaucagguuuacaggggauucuaaugauaguauagacauuuugugcuggucugugggggugauggccugguguccccauaggaggaaggucagagcuccugguggaccugagauagaccucgcauagaauuuuccuucuuguuauucugagagcuccucuguaaagucacacugguucuccugacuggaaaagggaggcucagaaagaauucaacaagcaaaggaacauuuucauacccu

SEQ ID NO: 10174 - RNA, 2501 nt, Mus musculus
aggguaugaaaauguuccuuugcuuguugaauucuuucugagccucccuuuuccagucaggagaaccagugugacuuuacagaggagcucucagaauaacaagaaggaaaauucuaugcgaggucuaucucagguccaccaggagcucugaccuuccuccuauggggacaccaggccaucacccccacagaccagcacaaaaugucuauacuaucauuagaauccccuguaaaccugauccuggacacucccaccuuuguggugaccaacauccugaaugguaggaggcuuacuuaaggcauggcagagccuagccugggcucacccuugagauagcaauggauuuaaaaggcuacaaccagaacaggucuccaaaggccagacaggagcccagaagaaagaucugguagagacugcaaccaaaggugccccuggcccaucccuaagggaaggcagccagcagcacugguugaagcacuccacaaaagcauaugaauccuaaccaccagagcuugcuuuuuuuuuuuuuuuuuuuucaagaaaagacggaaauccggacuuuucugugaaagcugccaguuaguaaaugcuggcagcuaauuaaauuuuuaaaaacaauaauagcauacugagagccaagcaaaacaugcagagcuagucacagccggggcuggcgggucugcaccuccagucagaugcuuucuacauacuacaugaaggggugggcgggaagacaagagguacccacccuuggcaacaucucccauccugccuuuccucuuggggguccugcacacacacacacacacacacacauacuuggcaccucuggaaggugaggcgagagcuccgaucauuccaucacaaauauguauuagcuccacucaaugccaagcccagggagcccucugcugccacccacccacgucacccaagcucuccuggagagggucagguucagcauccucugagcaacaaggacccacacaccacaaauuccuuuuugucucucuggccagucauagaacaccugcuggcucagaccaacuucggacugguccaaguggccaucaccgugaagcagaugggcacgaucucaggcuggcugaggaagaaaggauggacucuugccuaggagagggggggcggggaaacaagagguggugaggagccaagcccaccccugaagacuuagccccuccugggcccccuaggccacuccaagagugagccaagacuaacaccagcagccaccuccuucucucuaggcugaggcucccacucagcaggggaaccgcagaugcuagggaccaugacucugucugugaaccugaguguggggcccucuguguccaacacaggcccgugugggagauguguguggaauagcggauggagauaagcgaagcauugaaccaaccggcacugaaccaaacuuucuauggaugucgaacgcacacgugccuaacacggacacauaugcaugucugaaggaugccuaaaacaugcaagugugugugaaagcacucacgugcagagggaugugggagaagugaacgugcacagccccugcacgagagauucugggcuggguguugggguggccugugccucugcagagcuugcaguaacuucugcuagugugagugcauguguggcaguuugugacugaggguggggugguaccagaccgagaggcccaaucuuucccgccggggauggggggcagcugggggagugacccugggagacccugaaggacuagucuggugucuggagagccagagagacgagccagcgaucaagagaacgugacugaccuagaggaagcgcgggguggagaucgaaggcucuguacuuacccggugcucuguguugagcugcgccgccgucagucuguccgcgcacccgccgucggugaauccagaguccggguggcgcgcggcucgggguuggagaagagcgggacuagccaggccuugagaccccgccccacaggucccgccucagggcggggccucgauuuugcuaagacuucgcccaacccagugcucaacaagcccaaauaggagcccaggagccggcgcucuccuguccgggucucugagucccucuuuccacucccucucaccaugcuuuggcuauauugagacucagaugucucaguacugcgccacccuuuagcuucuccuccuggacccagcacccugugauagccagagguacccaggcucaaagcugcccagggacaggucugcagaaacuaggcaugggcaugcucccaucuuaguucuccacugucuagaucacccugcccuuuuucuuuuuuuccuuucuuucuuucuuucuuucuuucuuucuuucuuucuuucuuucuuucuuucuuucuuucuuucuuucuccuccuccuccuccuccuccuccuccuccuccuccuccuccuccuccuccuucuucuucuucuucuucuucuucuucuucuucuucuucuucuccuccuc

SEQ ID NO: 10175 - RNA, 2501 nt, Mus musculus
acccagccccuaguuuucugcaaugaagccacaggugugaguuaaagccugugucaucaauuuucgcuuuuuaaaacagcaaaugucaugacugaagcuacugcuguacuacuucuguguccuaggaaagacauucaaaagcucaaaugagacgcagacuacucaagcuaggccuuucucuggaagguacuaauaguucuagagaugcuaauuacugauagcugagcaagauucgacucaaaggucuagguuuuuuugguuuuuuauuuguuuuguauuguuuuuuuuaagaauaacaaugcuauucuacuccacuuuguuuacagaaaucuaauguucccaacgaaccccaaucccagcagcacagaagugcaccuaaacugacagagcuagccaggcccccugucaccuucucccauaguagcacuacuccacaacuaacuugugccauuuauggaggagaaacucgaggguaggagcagacccagccccaguggaucaagcccaaggggaccccagggaacagacaggaagggaucuggaacacaguuccuguacuugccagccaugcggaaaagagcuaacagccacacucagacaucuccaagaacugucucaaagcuucucaacuccuggcuucuucaggacagggucccuuuugcccuggccaaugccaagucaagccaccacgauugucuggugaucaggagacugcaacacauacucacuaauacacaguauaaauagcaugaacccuggagaugugagucacugucauucauuaccaacugaagguaaguugagggaacucaagacaccuaagggcuggguuacauacagcacaggagaaaagauacagccauggaucccaaucccaacacaggcuccuacacucugccauugcguccgucucacaugcacacaaauucgcucaccuccacucuacacacacacauauuucgcgcuccacagcacucucacucaguuucaaaucacaaaccgguggcucaccuccacggcccacacucgcugacuuccagacuucacgaggcacacucgaucacccuuacaggaucacucauguccugcauccucuccacaacacacgcucgccgcaaggcaggcuccuccagaaucacgcucaccuucaaaccccagaagcagaguccucucucccgagcucccacgcgugaccuccacucggccacccacaagucuccccagcccacagagcgcacuccgcacccucuccggcugagcacaccagcagccccgucuuagugacagcgcccggacgagaggcaaaggcgauacucacaggcugcgcguccaggagggcaggucccggggcagcgucgccagcccgcgcccacugcaguccagcgaguccccggcgcaagugcaggcggccgcgcagggggcccgcgggccagccugggcgcccgcugacuccggccauugcaguagcagcaagagcagccagagcagaaggcgaggcgcaaggcgcggggcuccgagcacucccggaccgggccgcgccaucuugucuggaacgcgccgcgaagccggggagcgagggcugcgaggugcgggcggccgcgggcgcgggcugcgcucggagcuaggcuccgcgccgggacauggacgcccgacuccagucggcuccggggccgcggcgcucagccggcacgcucugcccgggccgcuucgcagcacccugcggggaccgccacccccgcgcccauccgggccgagccccgcgcgcggcgaacucuguggagucccgcagugagugcccggccgccgcugcucguccuucccgccgcgcugagagucgccuucagagcucgggcgcacgccgagagccgccgccucugaggacugaaaacgcuuagccucggccucugcgcguggcgcgggcgggcaucucacugagggcgcugagcugaugauagccguggaccccacgcgccugcccgucccggagcggccggagcgcaccgugccucagcgcugcgaacaaucagcggccagccgcuccgcgguccagccccgcggccccaggccccgccccggcugcucgcccucacacaccccuccgauggggccccggggcgcagaucggcccacguuggcugcagggcuacagcauuacgccccgcccugcccguugcucauuggcuccuggagcgccuuuuuggcguccuaacccauaagagcgcucgcucccugaggucccgccuccgcucgcuuuucccacccaaggugugaaaggcggggacggggcggggaaaaggagaggcgugcugccuccucuuaaaggagacuuguaggguuuuggcuaccaaguaccagaaucuggaaaaguggccuaagcuucgguccauugagccuaggagaagagagaaaguuuguaauccacggguuugggagcuaucuggacccaagguuuauucugcucuccuaaacuaaaaacaucaugguggauuuacagcaaacga

SEQ ID NO: 10176 - RNA, 2501 nt, Mus musculus
ucguuugcuguaaauccaccaugauguuuuuaguuuaggagagcagaauaaaccuuggguccagauagcucccaaacccguggauuacaaacuuucucucuucuccuaggcucaauggaccgaagcuuaggccacuuuuccagauucugguacuugguagccaaaacccuacaagucuccuuuaagaggaggcagcacgccucuccuuuuccccgccccguccccgccuuucacaccuugggugggaaaagcgagcggaggcgggaccucagggagcgagcgcucuuauggguuaggacgccaaaaaggcgcuccaggagccaaugagcaacgggcagggcggggcguaaugcuguagcccugcagccaacgugggccgaucugcgccccggggccccaucggaggggugugugagggcgagcagccggggcggggccuggggccgcggggcuggaccgcggagcggcuggccgcugauuguucgcagcgcugaggcacggugcgcuccggccgcuccgggacgggcaggcgcgugggguccacggcuaucaucagcucagcgcccucagugagaugcccgcccgcgccacgcgcagaggccgaggcuaagcguuuucaguccucagaggcggcggcucucggcgugcgcccgagcucugaaggcgacucucagcgcggcgggaaggacgagcagcggcggccgggcacucacugcgggacuccacagaguucgccgcgcgcggggcucggcccggaugggcgcggggguggcgguccccgcagggugcugcgaagcggcccgggcagagcgugccggcugagcgccgcggccccggagccgacuggagucgggcguccaugucccggcgcggagccuagcuccgagcgcagcccgcgcccgcggccgcccgcaccucgcagcccucgcuccccggcuucgcggcgcguuccagacaagauggcgcggcccgguccgggagugcucggagccccgcgccuugcgccucgccuucugcucuggcugcucuugcugcuacugcaauggccggagucagcgggcgcccaggcuggcccgcgggcccccugcgcggccgccugcacuugcgccggggacucgcuggacugcagugggcgcgggcuggcgacgcugccccgggaccugcccuccuggacgcgcagccugugaguaucgccuuugccucucguccgggcgcugucacuaagacggggcugcuggugugcucagccggagagggugcggagugcgcucugugggcuggggagacuuguggguggccgaguggaggucacgcgugggagcucgggagagaggacucugcuucugggguuugaaggugagcgugauucuggaggagccugccuugcggcgagcguguguuguggagaggaugcaggacaugagugauccuguaagggugaucgagugugccucgugaagucuggaagucagcgagugugggccguggaggugagccaccgguuugugauuugaaacugagugagagugcuguggagcgcgaaauauguguguguguagaguggaggugagcgaauuugugugcaugugagacggacgcaauggcagaguguaggagccuguguugggauugggauccauggcuguaucuuuucuccugugcuguauguaacccagcccuuaggugucuugaguucccucaacuuaccuucaguugguaaugaaugacagugacucacaucuccaggguucaugcuauuuauacuguguauuagugaguauguguugcagucuccugaucaccagacaaucgugguggcuugacuuggcauuggccagggcaaaagggacccuguccugaagaagccaggaguugagaagcuuugagacaguucuuggagaugucugaguguggcuguuagcucuuuuccgcauggcuggcaaguacaggaacuguguuccagaucccuuccugucuguucccugggguccccuugggcuugauccacuggggcugggucugcuccuacccucgaguuucuccuccauaaauggcacaaguuaguuguggaguagugcuacuaugggagaaggugacagggggccuggcuagcucugucaguuuaggugcacuucugugcugcugggauugggguucguugggaacauuagauuucuguaaacaaaguggaguagaauagcauuguuauucuuaaaaaaaacaauacaaaacaaauaaaaaaccaaaaaaaccuagaccuuugagucgaaucuugcucagcuaucaguaauuagcaucucuagaacuauuaguaccuuccagagaaaggccuagcuugaguagucugcgucucauuugagcuuuugaaugucuuuccuaggacacagaaguaguacagcaguagcuucagucaugacauuugcuguuuuaaaaagcgaaaauugaugacacaggcuuuaacucacaccuguggcuucauugcagaaaacuaggggcugggu

SEQ ID NO: 10177 - RNA, 2501 nt, Mus musculus
uuuggcugggaauccaaguuauucuaacuguagauugguccacguugcccuaagccuagcaguccacugcggcacagacacccuggacaugaggugggucagcuuaaguuccuggcacgaaagaaaggguacucuggcaacuuuuggaugcggcgaaacagacuguuucgucucucagguucuuauuucacggcuugugccuuugacagccccuuaguuucucuaucugcaggaugggagcauuaagcucuacgacccagccucuuuacaauucagguccaaagagcccgcccaaguuggggacugggaagaucaaaggucucagcacccagcggagccgcggacacugagggcgccaagaaggggguggguagguagggaacuggaagggcggcugcuccgcaggggaugcgcgucagagaccccagccacacuccaggcccgccccuugaugagccccgccccgccccgccugguuuucgccucuaaagcgcccagcgcucgccucccgcugccgcacuuucacucucgguccaccucgguguccucuugcuguccagcucugcagccuccggcgcgcccucccgcccacgccauggacgccaaggucgucgccgugcuggcccuggugcuggccgcgcucugcaucagugacggugagugcaauccgcggccgggcccgggaaaggcucgcagcucugcgccggagcuccuucggguccgcgguuccucugcccgcgccgaagucgcggagaaagaacucggucggcgccguucacuacaagcgaacuuggggcaguccacuuugcagggcgcacucccaccgggugcccuuucccgugucccacgggucgcaccgagguuuugugcucugcgaagugcggccauaggaccuagagagggcugcaggggaggacccgcaggauuguugggcaagaguggguucggcgcggaauggaagcgugggcgauuguguccggggcuugggccccggagcgcgccagcugcacucagcuagugucuaccggcgcccagauguuuccagaggcgaagggcagcgcggucccggaguugaccgugcaagagguucacucggguggugcgugugucagcaaacucucaaagaccggucaaguagcucgaagugcauggcuuggcuauagguucaguggugaggcugaguuucguccccugcggguguagcguguucucuuacagcacccucgaggggcucagggccaccagcagcgcagcgcagcucuugaacucgcgcugccagccagggccgcgcuucugcacaguucguugguccguagcgacgcggaccugagcacgcgucucuucacugccccuuuuucuucuuacccgggucacuagacaaaggcucagcaguuacccaagcuauaugcacaccucuccccaacccccaaacacaccugcaaacgggcgcuuuuguagccagccccggaguccucagcucuggaaugagagcugcagcggaguucagucucccagacccaggguggugucuucuuucacugggaaagggcuuucauuuuguuuucuuuuuuugacacugaagagaaaacucucagcgcuguuacaagacaccguugcugcaaaacaaaacaaaccauugccucugaacacaaaacaaaauccuacuagucgauccccugccuuccuccgcagugguguuuccuggagagaacugagggacagucggggcucuuggugagacugagcucuaaaugcugcccaaguacaccaacucguucguuuggguucuuucccugugacaacgggguacgggaaugguuggaguugccuaguccgagggaaauguucuguaaaagaauagucaguugcugaucggaguaguaaaaaaaaagaaaugaaaggcaguuucgauuuuuuuuuuuuuuuuuuuuuuuuuuuuuguuaccgagaacacccgggaggcugagccuucccacuggucccccagugccccgucauggagcacauugauuugggcauuaauaauugaaugagcuggugauguugcaagggucacagccucuggcaaguuagguauggggcaagaauguaggacucagguccucaagguuggagugcaauuauccagaguaaaaguugucucacccucaacauauucugacccuaggaagagucggauuguugacagugucuggaucagaccuguucucuaggcaggaccccauugugcugcccgaaugaacuuuuuuaccuccuagugccugugugcccucugaucuuacacagcccucaaguugcagcacggcuaaccuugcugugguuccugucuuuucccaucagcuacuccaacucagaagcuagauaguagacaccggaggcuucuuugguuaaacccagagcagcaggcuugccaggcuuguuagauugaauggaccccugguucccuaagccaagcucucuagauucccaaguccaggguggcagcagagcuggauuagacu

SEQ ID NO: 10178 - RNA, 2501 nt, Mus musculus
agucuaauccagcucugcugccacccuggacuugggaaucuagagagcuuggcuuagggaaccagggguccauucaaucuaacaagccuggcaagccugcugcucuggguuuaaccaaagaagccuccggugucuacuaucuagcuucugaguuggaguagcugaugggaaaagacaggaaccacagcaagguuagccgugcugcaacuugagggcuguguaagaucagagggcacacaggcacuaggagguaaaaaaguucauucgggcagcacaaugggguccugccuagagaacaggucugauccagacacugucaacaauccgacucuuccuagggucagaauauguugagggugagacaacuuuuacucuggauaauugcacuccaaccuugaggaccugaguccuacauucuugccccauaccuaacuugccagaggcugugacccuugcaacaucaccagcucauucaauuauuaaugcccaaaucaaugugcuccaugacggggcacugggggaccagugggaaggcucagccucccggguguucucgguaacaaaaaaaaaaaaaaaaaaaaaaaaaaaaaucgaaacugccuuucauuucuuuuuuuuuacuacuccgaucagcaacugacuauucuuuuacagaacauuucccucggacuaggcaacuccaaccauucccguaccccguugucacagggaaagaacccaaacgaacgaguugguguacuugggcagcauuuagagcucagucucaccaagagccccgacugucccucaguucucuccaggaaacaccacugcggaggaaggcaggggaucgacuaguaggauuuuguuuuguguucagaggcaaugguuuguuuuguuuugcagcaacggugucuuguaacagcgcugagaguuuucucuucagugucaaaaaaagaaaacaaaaugaaagcccuuucccagugaaagaagacaccacccugggucugggagacugaacuccgcugcagcucucauuccagagcugaggacuccggggcuggcuacaaaagcgcccguuugcagguguguuuggggguuggggagaggugugcauauagcuuggguaacugcugagccuuugucuagugacccggguaagaagaaaaaggggcagugaagagacgcgugcucagguccgcgucgcuacggaccaacgaacugugcagaagcgcggcccuggcuggcagcgcgaguucaagagcugcgcugcgcugcugguggcccugagccccucgagggugcuguaagagaacacgcuacacccgcaggggacgaaacucagccucaccacugaaccuauagccaagccaugcacuucgagcuacuugaccggucuuugagaguuugcugacacacgcaccacccgagugaaccucuugcacggucaacuccgggaccgcgcugcccuucgccucuggaaacaucugggcgccgguagacacuagcugagugcagcuggcgcgcuccggggcccaagccccggacacaaucgcccacgcuuccauuccgcgccgaacccacucuugcccaacaauccugcggguccuccccugcagcccucucuagguccuauggccgcacuucgcagagcacaaaaccucggugcgacccgugggacacgggaaagggcacccggugggagugcgcccugcaaaguggacugccccaaguucgcuuguagugaacggcgccgaccgaguucuuucuccgcgacuucggcgcgggcagaggaaccgcggacccgaaggagcuccggcgcagagcugcgagccuuucccgggcccggccgcggauugcacucaccgucacugaugcagagcgcggccagcaccagggccagcacggcgacgaccuuggcguccauggcgugggcgggagggcgcgccggaggcugcagagcuggacagcaagaggacaccgagguggaccgagagugaaagugcggcagcgggaggcgagcgcugggcgcuuuagaggcgaaaaccaggcggggcggggcggggcucaucaaggggcgggccuggaguguggcuggggucucugacgcgcauccccugcggagcagccgcccuuccaguucccuaccuacccacccccuucuuggcgcccucaguguccgcggcuccgcugggugcugagaccuuugaucuucccaguccccaacuugggcgggcucuuuggaccugaauuguaaagaggcugggucguagagcuuaaugcucccauccugcagauagagaaacuaaggggcugucaaaggcacaagccgugaaauaagaaccugagagacgaaacagucuguuucgccgcauccaaaaguugccagaguacccuuucuuucgugccaggaacuuaagcugacccaccucauguccagggugucugugccgcaguggacugcuaggcuuagggcaacguggaccaaucuacaguuagaauaacuuggauucccagccaaa

SEQ ID NO: 10179 - RNA, 2501 nt, Mus musculus
guaugauucaacgcugaaagggaaaaaauauaguuucauggacuugcuauaugagacuuaagcuacaugaucuggccaucaaaaacuagaacuuuguagaaaaaacaaaaaaaacaaaaacgagaaauaagcauuacgacgaugcgaugggcuuguuucuccauaaaaacugaaagggagauugagcaaacaaacuccuuggagucccgagucggaaauuagacuaaaaugaugaaacagaucaguguaaaccgggaggguacgauggcgaggacagucauagcuccacagcaaguugacagcggggcucggcuccuuaaaacggguuccugggcuccuaucuuacuuagcugagcaacauccaaggagagccaaagaggccaggagcacaccugggccaaggcggaggcggggccagaggaaggacagcccccacccaagccccgccccgagcggcccgcccucgggggagccggaagcgggacagaggaggccgugugaagccgacgagcgccaguccucggccgggaaagccaucgcgggcccucgcugucgcgcggagccagcugcgagcgcuccgcgaccgggccgagggcuauggcgauucggcgcugcuggccacgggucguccccgggcccgcgcugggauggcugcuucugcugcugaacguucuggccccgggccgcgccuccccgcgccuccucgacuucccggcuccggucugcgcgcaggaggugagagaagccgggcggagcggggaugcccgggccgucgggggugguggagaggacggcggaggguggugaagaggugucagaggggcgggcgucgggagggccgucgggagugcggagggcugucaaaggugcugagagccgucgcgagugcgaaggggcggacggcccaggcucuggcgggcccggggaggcugaaaguccgcccuaggggcucggaggacggucccgggcaugggcgcagcguggaggcgcgcuggcagcgacuccgggaguggagucgcggugagggggaguucuagggaaacuacgcgggcggcggagucacugguagcgcgaggcggggugacaauuccgucugggccucggaauuggaagauggaggcaccagaggcuggcagcucgggauggacauggaccuaaccuuggcaggagcugaaauaaucuggacuggccccuaacuccuugcuuccugagcagucaauccuccagcucucccaugcucaggugccccagccuggccucggggguccccacagguuggguagugcgggcgagcccagugcccaggggaaucaaacaggauguggguugaaagaugccguccaucccaucuuuuuuucaccaccacgugugucccagaaccgagccugccaaaauugaguuaacauguguggaagucugccaguuuguuacugccagggaggaccaccccacccccacgccccgcugcgcucuuaggaaacugacacaccccuggcgguugaaccuuacuuacugucaaaacaaagcauaacaaaaaaacagcgaaccugugcaaaaccuagugucuguuccacgcauaaacuuuccucccugucucccuucaagccuucucuuccuccacugguuuuuccagccccuuccccuccacuuccacagcugaccccaggaacuguguccagucgcugagucggaggauaugaaacaaaaggauaguucuuaucuaauuuuguagauuuaccaaaagaggguggggagagggugacuauuuuuacuggaaaaacuguguuuuuuaaaaaagucugagggcugcugggaaaugucauagugcuccccguacugggaaagucagagugacaucuucagacagggccaaagugucaaaacauagaggauugcuguuugugucuggcuaguccuuugccaagggccucacgauacaaguaaacugaaaguagagaaagaugauuccugggacugcaguguccaggaugaaguugucuuggauguaggaacgucuugcaagagugcuuugcacaaucggugugugcagaauccagggaggagaaaaugacccccagcugggcuguuucucacugaaaagacauuugagcaguucuguuccaaaccaggagccucagaaacauuucgcuuaaagcguucaaaaaucucacugguggaacgguaccugaaacaagcagggucaaguggaagaugggggcaucuguggaacagcagagagagaugggugggagcugagccaaaauuuuaggcugugaggucuguggaaguucacccagacccucagcuacagucccugccauaaaucuugggggucuuaguuuuuuuaguuuuuauuuauuuauuuugaguugaguuuuaguuuaguuuuaguuuuuauuuauuuauuuugaguuuuuguuuguuuguuuuuguuuuguuuuccagacaggguuucucuguguggcccuggcuguccuggaucucacucuagacuaggcugg

SEQ ID NO: 10180 - RNA, 2501 nt, Mus musculus
ccagccuagucuagagugagauccaggacagccagggccacacagagaaacccugucuggaaaacaaaacaaaaacaaacaaacaaaaacucaaaauaaauaaauaaaaacuaaaacuaaacuaaaacucaacucaaaauaaauaaauaaaaacuaaaaaaacuaagacccccaagauuuauggcagggacuguagcugagggucugggugaacuuccacagaccucacagccuaaaauuuuggcucagcucccacccaucucucucugcuguuccacagaugcccccaucuuccacuugacccugcuuguuucagguaccguuccaccagugagauuuuugaacgcuuuaagcgaaauguuucugaggcuccugguuuggaacagaacugcucaaaugucuuuucagugagaaacagcccagcugggggucauuuucuccucccuggauucugcacacaccgauugugcaaagcacucuugcaagacguuccuacauccaagacaacuucauccuggacacugcagucccaggaaucaucuuucucuacuuucaguuuacuuguaucgugaggcccuuggcaaaggacuagccagacacaaacagcaauccucuauguuuugacacuuuggcccugucugaagaugucacucugacuuucccaguacggggagcacuaugacauuucccagcagcccucagacuuuuuuaaaaaacacaguuuuuccaguaaaaauagucacccucuccccacccucuuuugguaaaucuacaaaauuagauaagaacuauccuuuuguuucauauccuccgacucagcgacuggacacaguuccuggggucagcuguggaaguggaggggaaggggcuggaaaaaccaguggaggaagagaaggcuugaagggagacagggaggaaaguuuaugcguggaacagacacuagguuuugcacagguucgcuguuuuuuuguuaugcuuuguuuugacaguaaguaagguucaaccgccaggggugugucaguuuccuaagagcgcagcggggcguggggguggggugguccucccuggcaguaacaaacuggcagacuuccacacauguuaacucaauuuuggcaggcucgguucugggacacacgugguggugaaaaaaagaugggauggacggcaucuuucaacccacauccuguuugauuccccugggcacugggcucgcccgcacuacccaaccuguggggacccccgaggccaggcuggggcaccugagcaugggagagcuggaggauugacugcucaggaagcaaggaguuaggggccaguccagauuauuucagcuccugccaagguuagguccauguccaucccgagcugccagccucuggugccuccaucuuccaauuccgaggcccagacggaauugucaccccgccucgcgcuaccagugacuccgccgcccgcguaguuucccuagaacucccccucaccgcgacuccacucccggagucgcugccagcgcgccuccacgcugcgcccaugcccgggaccguccuccgagccccuagggcggacuuucagccuccccgggcccgccagagccugggccguccgccccuucgcacucgcgacggcucucagcaccuuugacagcccuccgcacucccgacggcccucccgacgcccgccccucugacaccucuucaccacccuccgccguccucuccaccacccccgacggcccgggcauccccgcuccgcccggcuucucucaccuccugcgcgcagaccggagccgggaagucgaggaggcgcggggaggcgcggcccggggccagaacguucagcagcagaagcagccaucccagcgcgggcccggggacgacccguggccagcagcgccgaaucgccauagcccucggcccggucgcggagcgcucgcagcuggcuccgcgcgacagcgagggcccgcgauggcuuucccggccgaggacuggcgcucgucggcuucacacggccuccucugucccgcuuccggcucccccgagggcgggccgcucggggcggggcuugggugggggcuguccuuccucuggccccgccuccgccuuggcccaggugugcuccuggccucuuuggcucuccuuggauguugcucagcuaaguaagauaggagcccaggaacccguuuuaaggagccgagccccgcugucaacuugcuguggagcuaugacuguccucgccaucguacccucccgguuuacacugaucuguuucaucauuuuagucuaauuuccgacucgggacuccaaggaguuuguuugcucaaucucccuuucaguuuuuauggagaaacaagcccaucgcaucgucguaaugcuuauuucucguuuuuguuuuuuuuguuuuuucuacaaaguucuaguuuuugauggccagaucauguagcuuaagucucauauagcaaguccaugaaacuauauuuuuucccuuucagcguugaaucauac

SEQ ID NO: 10181 - RNA, 2501 nt, Mus musculus
cccccacuguugucugaggcugggugugaagcgcuggcauccuggccgggcacugacccuccuucccaguaaccccggaaagcggaggagguuaagggacaagaauagagcagccugugaaaaaggggacagacuucaaaaccuuggugucaucccuccugccccacccaggucaccuuuggggcacaggcgcacucaccacuccaggaccuccucugggaaauagauucccagcagugcugugggcagaggucugaugacggcccccguaagucucaauucgggaagcuaccaggccuuggagggggcccucauuuggaggaccaaaggcuugcauuguuucucuccugaguuacccccagaggaucauagcaccaauguccaggagaaagggggguauccccuuuucugcaagauagaaagcccaggcuggauuagugaugaacgaacgucuccacagguuggagagcaaggaaagacaagaggacagaguggggaagaagagggccagaugguggggggugugugcuaucuauaagcuaguagggggagggcagggccaggugcaugcuggguaggaacaucugcuuuauacuuaggauacauucacacuucagccucagaggaugcuguagucucaagagcagcugggagcaagggucacagaaaucucuagcacucuagauagccccagguagaaggcggucucuuguaccuagaugucuccuuuccuguauuaccuuugucaacacugcacaaacaccaugaacugggacagguaaagcugacuagagacagacaaguggguuucucauguuggaacagacuauggguuaagaacggcuuuuauuuuauuuucugauuugagauaggaggaccucuuaauauagcccaggcugacacacaguguaacccagucuaggcuaccuuccaacucugcaucccccugccucaguuucuagagugcuaugaucacagauguauucuaucaugcuuugcaacguuuacauuuuuaaauaaugggggggggcaaaaaaggaaaaauaauauuuggggaaagagaacaauacacccaguucacacuccaugaguuacagcuaguuuuaucacgguucagccagccagccacccuuacuggucggcuggccauccuuggcugcuuuucaguuagucgcaacugagacucaauagacaagagacucuacaauauagcuuuucugucccuuuacugagaagucuguacaugccuuaccuggaaaccccacacguccacguacaaucuggcgaagucaggagagcugucagacagggucuggagggaugccccuaguugaggcagcccgcuggucucccacuaagcuccuuuccuggccgccgagggcaccaccagggauagagcuggaagucagaugcaggacuccaccccuccuuucuaagccuggauggaagacccaucccuugcagugggcagggccugaagggaagaggcccuuaaugggaacuggacucaagaacccuauacagggguugguuucccaccaacugggcucuagaaaccucccauuucucucuccuagcuuacucugacuuacucgcagaggagauuguucauugugucucccgccccgggacaacaacaguccagcccccgaaggcagucccccgccccuccuucucccucccccuuacuaucucuccccacguccaccuuuucuaucuuuucccaggcccagcuuuucucccucccucguacccagccuccuucccuccuccuucugaggccccgcgacccugucccagauccccgguucccuggccgcccggcacucgcccucccaagugcucaccugugagcgcagguguccgagcuuccgcuguccuugacguccgcuggauacuguggaaaucugggucguugucagcuuccuuggcgauggcagccccacugucccagccugggacuaggaccgagcggcccgcgggaccaggcagcacggggccgggaagggaggugaagguggaggcagaggggcgggacgugggcuggcaccucccccucccugcgggccuugcagcgucgcgguccuggucacccggacagagaggguagggagccggacucuccguacaccaaccccagaccaggagugcucacuucucggugcgcaccuuucccuuucuuuugcaccugaacuaaccagcaaucugucaccuggucggggccaggggcuggaaccuugugccacccgcaggccaccagcguguccucccuucccggccagaccccugccaggcgccaggguaaugagggauaaaugaaagguugggcgccgcuaugcggaggcggugagguaaugaccaagcgaccuguggcagguacacaucccuuguuugcaccaggccccucuugccuguccuagaccguuacccugaaagggagccagccuagcaucaggaagggcggaggcccaaggauucucagccccauggcuguccucugg

SEQ ID NO: 10182 - RNA, 2501 nt, Mus musculus
ccagaggacagccauggggcugagaauccuugggccuccgcccuuccugaugcuaggcuggcucccuuucaggguaacggucuaggacaggcaagaggggccuggugcaaacaagggauguguaccugccacaggucgcuuggucauuaccucaccgccuccgcauagcggcgcccaaccuuucauuuaucccucauuacccuggcgccuggcaggggucuggccgggaagggaggacacgcugguggccugcggguggcacaagguuccagccccuggccccgaccaggugacagauugcugguuaguucaggugcaaaagaaagggaaaggugcgcaccgagaagugagcacuccuggucugggguugguguacggagaguccggcucccuacccucucuguccgggugaccaggaccgcgacgcugcaaggcccgcagggagggggaggugccagcccacgucccgccccucugccuccaccuucaccucccuucccggccccgugcugccuggucccgcgggccgcucgguccuagucccaggcugggacaguggggcugccaucgccaaggaagcugacaacgacccagauuuccacaguauccagcggacgucaaggacagcggaagcucggacaccugcgcucacaggugagcacuugggagggcgagugccgggcggccagggaaccggggaucugggacagggucgcggggccucagaaggaggagggaaggaggcuggguacgagggagggagaaaagcugggccugggaaaagauagaaaagguggacguggggagagauaguaagggggagggagaaggaggggcgggggacugccuucgggggcuggacuguuguugucccggggcgggagacacaaugaacaaucuccucugcgaguaagucagaguaagcuaggagagagaaaugggagguuucuagagcccaguuggugggaaaccaaccccuguauaggguucuugaguccaguucccauuaagggccucuucccuucaggcccugcccacugcaagggaugggucuuccauccaggcuuagaaaggagggguggaguccugcaucugacuuccagcucuaucccugguggugcccucggcggccaggaaaggagcuuagugggagaccagcgggcugccucaacuaggggcaucccuccagacccugucugacagcucuccugacuucgccagauuguacguggacgugugggguuuccagguaaggcauguacagacuucucaguaaagggacagaaaagcuauauuguagagucucuugucuauugagucucaguugcgacuaacugaaaagcagccaaggauggccagccgaccaguaaggguggcuggcuggcugaaccgugauaaaacuagcuguaacucauggagugugaacuggguguauuguucucuuuccccaaauauuauuuuuccuuuuuugcccccccccauuauuuaaaaauguaaacguugcaaagcaugauagaauacaucugugaucauagcacucuagaaacugaggcagggggaugcagaguuggaagguagccuagacuggguuacacugugugucagccugggcuauauuaagagguccuccuaucucaaaucagaaaauaaaauaaaagccguucuuaacccauagucuguuccaacaugagaaacccacuugucugucucuagucagcuuuaccugucccaguucaugguguuugugcaguguugacaaagguaauacaggaaaggagacaucuagguacaagagaccgccuucuaccuggggcuaucuagagugcuagagauuucugugacccuugcucccagcugcucuugagacuacagcauccucugaggcugaagugugaauguauccuaaguauaaagcagauguuccuacccagcaugcaccuggcccugcccucccccuacuagcuuauagauagcacacaccccccaccaucuggcccucuucuuccccacucuguccucuugucuuuccuugcucuccaaccuguggagacguucguucaucacuaauccagccugggcuuucuaucuugcagaaaaggggauaccccccuuucuccuggacauuggugcuaugauccucuggggguaacucaggagagaaacaaugcaagccuuugguccuccaaaugagggcccccuccaaggccugguagcuucccgaauugagacuuacgggggccgucaucagaccucugcccacagcacugcugggaaucuauuucccagaggagguccuggaguggugagugcgccugugccccaaaggugaccuggguggggcaggagggaugacaccaagguuuugaagucuguccccuuuuucacaggcugcucuauucuugucccuuaaccuccuccgcuuuccgggguuacugggaaggagggucagugcccggccaggaugccagcgcuucacacccagccucagacaacaguggggg

SEQ ID NO: 10183 - RNA, 2501 nt, Mus musculus
cggugggguaaauccgaagggcuccugggguucggguauucccgcaaagcugaaaaaggugaugaacuaaaaccuccacaaaccccaaggcaaagcccagagccgccgccgccugccguucccucuggcucacuucucagcacaccaacucacucuuuuuuggauuucgucaucuuuucaaaaaaucaauaaaaauauucuggaagcuccgaaagucuacuucuuggucucguucggauccucagauccuauucuaccauucccgacaauugaaaaaaauguccaggguggucucggcgguccaggggccgcuguucgguggguggguggaggagagagggggagggaggaggaggaagcgcgccucggccggccgccgcaguuggagucggagcaggggggagcaguuucaaaaaauuauuaaaaaucgagggaaaauccuagaaacgcucugugggccugaaaaccccagagaggucccaggcucccuggaaaagagguuucggguguccguaaggucgguaucuccaccccaggggcucuagaucucagugggggaaacuugcggaguguucggcugcggcccacaagggcaguagcuaggaaggcugugccugcuggggguugggugagacgaaaccagggaaccccccuccaggaggcaugcgggacucugaccucucauuugggggugcccccuagccugcucuacacaccuccucccccgcuuccuaccccacccaaaucugcgcgcucaagaagcagccaaacuguaaguaaccuuggugaaccgagggcuggggaagagggcacgaucagaaagagggugcccaggaucauggggugcugagagggggugggggcgccggcgaauguugccaguccuuguaaauggaguuugcaaagcaacauggcgaaaccacggcagguccagagcugugcauacgugggcacccugcucucucggcaaagauugcaagcaaggcuaaagcagcgguucuuucagauugcccuaaacgcacguuuuuuucaguaugacuuccggggcucuccugaauucccuguuucucccccacccccaccuccugccaaagugccaacgcggaguccuaaggcucagacgguuugccccaacccugagagucgggggcgggggggggcucuuuauauguugguauggauuguuaggucgcaacacccucuggggccucacugaaggcagccgggguugcuuccacaccacaggucagaaauggagaugggaagacgaggaagccacaugcaggcacacgcgcgggaugccaaccccccgggggggggaggacauccucacucacccaaguuuuccuccacuaguuaaucuagcaagggacagaauuagcgucucgcccaagggugcggggcuaccucgcgcacgagcgggggaggccagcgcagggguaguucucccgcaguuuuuaggaucucugcguguuggagguagggauggagcggcugggcuugccucucccugagagcgucgcccgcacaccuaccucuagcauccagguggccaccauccugcgcauguacgguuggauguccuucugcacgcacuugaaauaggaacacugcgggagguagcgcuccucgauggucaacagguucugcagaacgcggucuuccagcagguugcgguccggcacggcccugcggaccggguccaccucgcagcacagcagcuccauagccagccggccaccacucggucccgacuguaaauuuuuuuuauuauuauuauuuuuuggaggugcgggggggucggggagugcuucccuuaccuccuuccuuuggcugaaugggagauuugggagaggaaagaaauggcaaagagagagagggagagagagagagaagaguggaaggugggcgagcggagccucaagggccgccugacucgcaccgguccuucccuccgaacugcccggcucuccucagcucgcucuccucucucgcucaggcagugacgcaagcuggaagggcaguuagaucuccucccccucucagguuccuccucccccuuuccuccccuccucuagcgucccuccccuccuuucaaucuuucccucccucuccccccccccuucccucuuguuauuaaggagcacagcagcuggccugaccaaacuucaaacacgauccccgcuccccacccccaaccccucucccuacuucuccgaggcccucuccccauccagccccgcaugcuaggggccucggauaggggaacccacaaaccccauggauuccuauugauuauccuuucugacauucuguaggcauaccaugggggcauaaaggguguguacgugugugcucucuaacuucggaggcuugcaaugugaucagaaaaacagcccauuauucaagauucagguagauagauuuaccauguggaugaguucagauaacuuagaaguagaccccuaaaugaggaacaaggaaaggcuuauuugagaaaa

SEQ ID NO: 10184 - RNA, 2501 nt, Mus musculus
uuuucucaaauaagccuuuccuuguuccucauuuaggggucuacuucuaaguuaucugaacucauccacaugguaaaucuaucuaccugaaucuugaauaaugggcuguuuuucugaucacauugcaagccuccgaaguuagagagcacacacguacacacccuuuaugcccccaugguaugccuacagaaugucagaaaggauaaucaauaggaauccaugggguuuguggguuccccuauccgaggccccuagcaugcggggcuggauggggagagggccucggagaaguagggagagggguuggggguggggagcggggaucguguuugaaguuuggucaggccagcugcugugcuccuuaauaacaagagggaaggggggggggagagggagggaaagauugaaaggaggggagggacgcuagaggaggggaggaaagggggaggaggaaccugagagggggaggagaucuaacugcccuuccagcuugcgucacugccugagcgagagaggagagcgagcugaggagagccgggcaguucggagggaaggaccggugcgagucaggcggcccuugaggcuccgcucgcccaccuuccacucuucucucucucucucccucucucucuuugccauuucuuuccucucccaaaucucccauucagccaaaggaaggagguaagggaagcacuccccgacccccccgcaccuccaaaaaauaauaauaauaaaaaaaauuuacagucgggaccgagugguggccggcuggcuauggagcugcugugcugcgagguggacccgguccgcagggccgugccggaccgcaaccugcuggaagaccgcguucugcagaaccuguugaccaucgaggagcgcuaccucccgcaguguuccuauuucaagugcgugcagaaggacauccaaccguacaugcgcaggaugguggccaccuggaugcuagagguaggugugcgggcgacgcucucagggagaggcaagcccagccgcuccaucccuaccuccaacacgcagagauccuaaaaacugcgggagaacuaccccugcgcuggccucccccgcucgugcgcgagguagccccgcacccuugggcgagacgcuaauucugucccuugcuagauuaacuaguggaggaaaacuugggugagugaggauguccucccccccccgggggguuggcaucccgcgcgugugccugcauguggcuuccucgucuucccaucuccauuucugaccugugguguggaagcaaccccggcugccuucagugaggccccagaggguguugcgaccuaacaauccauaccaacauauaaagagcccccccccgcccccgacucucaggguuggggcaaaccgucugagccuuaggacuccgcguuggcacuuuggcaggaggugggggugggggagaaacagggaauucaggagagccccggaagucauacugaaaaaaacgugcguuuagggcaaucugaaagaaccgcugcuuuagccuugcuugcaaucuuugccgagagagcagggugcccacguaugcacagcucuggaccugccgugguuucgccauguugcuuugcaaacuccauuuacaaggacuggcaacauucgccggcgcccccacccccucucagcaccccaugauccugggcacccucuuucugaucgugcccucuuccccagcccucgguucaccaagguuacuuacaguuuggcugcuucuugagcgcgcagauuugggugggguaggaagcgggggaggagguguguagagcaggcuagggggcacccccaaaugagaggucagagucccgcaugccuccuggagggggguucccugguuucgucucacccaacccccagcaggcacagccuuccuagcuacugcccuugugggccgcagccgaacacuccgcaaguuucccccacugagaucuagagccccugggguggagauaccgaccuuacggacacccgaaaccucuuuuccagggagccugggaccucucugggguuuucaggcccacagagcguuucuaggauuuucccucgauuuuuaauaauuuuuugaaacugcuccccccugcuccgacuccaacugcggcggccggccgaggcgcgcuuccuccuccucccucccccucucuccuccacccacccaccgaacagcggccccuggaccgccgagaccacccuggacauuuuuuucaauugucgggaaugguagaauaggaucugaggauccgaacgagaccaagaaguagacuuucggagcuuccagaauauuuuuauugauuuuuugaaaagaugacgaaauccaaaaaagagugaguuggugugcugagaagugagccagagggaacggcaggcggcggcggcucugggcuuugccuugggguuuguggagguuuuaguucaucaccuuuuucagcuuugcgggaauacccgaaccccaggagcccuucggauuuaccccaccg

SEQ ID NO: 10185 - RNA, 2501 nt, Mus musculus
uccuacuuuuugucaugaacuggguagagaggcuggaaggcucugcuuccuaccucugcaaaacaaggggucugcauccuggggcaucgcccaagcucgggguggggguggggugagguccgccaaggagagcaagcgggcgagagagaggagagauaaagaggaaaauugggagagguaaagaaagaaagggggagggggaaaaaggggaggagggagagggaagagucggagggaguggggagacggagggggagggagggagggagggagagagaggggagagagagagagagagagagagagagagagagagagagagagagagagagagagagagaaugaauaagagaauaugcugcggggggggggggagugagggaagggggaaggggaggucagacaccuaccgucccugaacgcccaaggauggccugagcucgcccagugccccagccugccucagcaucagcggucccugagcacucagugaguugagcaaguguuaaaaucccgaaguaggaagagaccccgcaggguauaaacucuggcugaggguggagcggaggacuuuuaagagagaaaggaaaggagagagggagagggagagggagagagagagagagaaagagaaaaggagaggaguggggguugaaaauuccaaggcugauccugcuagcugccaacuugaagucuucagcucgcacucuugaguucucugcaaggcugaaacuucgcguagauccggaagaagugauuccgagagugggcucgagaagagcgcggacgcgcgagugggacggguggggguuguccgcagagcauggcagugcggggcgaggccgcccaagaccuagccaagccgggccucggaggggcgagucccgcccguguggcaagagggaaccaccgccaucguggcgaguccucuccauccccucggggcuccggcuguuguuggagagcccuggcgcugcagccgcuccggcgcucgccucaacucuccucggcgcugugcgcgggcucccuguccgugcugcuggcgcugcuggugaggcuggucggcggggaggucggaggcgagcuggagaagagucaggaggcggcggccgaggaggaggaggaggaaggagcccgagggggcgucuucccgggcccucggggaggugcucccgggggcggcgcgcagcucagcccuuggcugcagccggccgcgcugcucuucagucuccugugcgccuucuucuggaugggcuugugccugcugcgcgccggggugcgccugccucuggccgucgcgcuguuggccgccugcugcgccggggaagcgcuggugcagcucuccuugggcgugggggacggucgccugcugucgcugcccgccgcggggguccugcucagcugccuagguggcgcgacauggcuggugcugaggcugaggcugggcguccucauggucgccuggacuagcgugcuuaggacgguggcccugguuucucuggagagguucaaggucgccuggagaccuuaccuggcauacuuggcggccgugcuugggcugcugcuggccagguacgccgagcagauccugccgcagugcuccgggccggcuccgcccagggagcgguuugggucccaguugagcgcgaggaccaaggaagagauuccgggguggaagaggaggaggcgguccagcucggugguggccggcgagauguccggcugcaguggcaagucucaccggaggaccucccugcccugcauacccagggagcagguaagcuggggcugcgccuuugggguugcuccugggaaacuugaaacagucaaagugcagggaguggggcgcaagcggccgggaagccagccugccaaacaguaaaacuuuacacuguacuaagaaagauuucuuuuuucuuuuucuuuuuugcccguucucugucccuuggaguaguuuacagccagaacaacagaaaacaggaaaaaguaaaaaacagaguggccuuacccagacuuccacagcugggcccuguuuucaaaucuccuacaccugguuuuugagucccugcguuucuugaagcauuucugcccucccugaauuuuuggaaguuauuuauuuauugcaaguggcuuucagcacgugcgucuucuauauuucugugucuuuaaagagauaauaauuuuuuuuucuuaucaagugccagguaaacaguuacaaaaacuaguaaggaaguuucaguagccaggcaggcauccuggauggucagaggcuggacucgcacuccuguuuucgcagugacucuuguuuagaggcacagcaucagauggcagccagucugcuuuuagauauacuuuaguugcuacacagcacuguguugaacucugaacugaggcuuuacacuuuagggcuaugugugaacuuuagaauggcacagaauugggcgcaaugcuuuuauuguucauucagaaaaguaaccuuccucgugggcguuuauacaccc

SEQ ID NO: 10186 - RNA, 2501 nt, Mus musculus
ggguguauaaacgcccacgaggaagguuacuuuucugaaugaacaauaaaagcauugcgcccaauucugugccauucuaaaguucacacauagcccuaaaguguaaagccucaguucagaguucaacacagugcuguguagcaacuaaaguauaucuaaaagcagacuggcugccaucugaugcugugccucuaaacaagagucacugcgaaaacaggagugcgaguccagccucugaccauccaggaugccugccuggcuacugaaacuuccuuacuaguuuuuguaacuguuuaccuggcacuugauaagaaaaaaaaauuauuaucucuuuaaagacacagaaauauagaagacgcacgugcugaaagccacuugcaauaaauaaauaacuuccaaaaauucagggagggcagaaaugcuucaagaaacgcagggacucaaaaaccagguguaggagauuugaaaacagggcccagcuguggaagucuggguaaggccacucuguuuuuuacuuuuuccuguuuucuguuguucuggcuguaaacuacuccaagggacagagaacgggcaaaaaagaaaaagaaaaaagaaaucuuucuuaguacaguguaaaguuuuacuguuuggcaggcuggcuucccggccgcuugcgccccacucccugcacuuugacuguuucaaguuucccaggagcaaccccaaaggcgcagccccagcuuaccugcucccuggguaugcagggcagggagguccuccggugagacuugccacugcagccggacaucucgccggccaccaccgagcuggaccgccuccuccucuuccaccccggaaucucuuccuugguccucgcgcucaacugggacccaaaccgcucccugggcggagccggcccggagcacugcggcaggaucugcucggcguaccuggccagcagcagcccaagcacggccgccaaguaugccagguaaggucuccaggcgaccuugaaccucuccagagaaaccagggccaccguccuaagcacgcuaguccaggcgaccaugaggacgcccagccucagccucagcaccagccaugucgcgccaccuaggcagcugagcaggacccccgcggcgggcagcgacagcaggcgaccgucccccacgcccaaggagagcugcaccagcgcuuccccggcgcagcaggcggccaacagcgcgacggccagaggcaggcgcaccccggcgcgcagcaggcacaagcccauccagaagaaggcgcacaggagacugaagagcagcgcggccggcugcagccaagggcugagcugcgcgccgcccccgggagcaccuccccgagggcccgggaagacgcccccucgggcuccuuccuccuccuccuccucggccgccgccuccugacucuucuccagcucgccuccgaccuccccgccgaccagccucaccagcagcgccagcagcacggacagggagcccgcgcacagcgccgaggagaguugaggcgagcgccggagcggcugcagcgccagggcucuccaacaacagccggagccccgaggggauggagaggacucgccacgauggcggugguucccucuugccacacgggcgggacucgccccuccgaggcccggcuuggcuaggucuugggcggccucgccccgcacugccaugcucugcggacaacccccacccgucccacucgcgcguccgcgcucuucucgagcccacucucggaaucacuucuuccggaucuacgcgaaguuucagccuugcagagaacucaagagugcgagcugaagacuucaaguuggcagcuagcaggaucagccuuggaauuuucaacccccacuccucuccuuuucucuuucucucucucucucucccucucccucucccucucuccuuuccuuucucucuuaaaaguccuccgcuccacccucagccagaguuuauacccugcggggucucuuccuacuucgggauuuuaacacuugcucaacucacugagugcucagggaccgcugaugcugaggcaggcuggggcacugggcgagcucaggccauccuugggcguucagggacgguaggugucugaccuccccuucccccuucccucacuccccccccccccgcagcauauucucuuauucauucucucucucucucucucucucucucucucucucucucucucucucucucucucucucuccccucucucucccucccucccucccucccccuccgucuccccacucccuccgacucuucccucucccuccuccccuuuuucccccucccccuuucuuucuuuaccucucccaauuuuccucuuuaucucuccucucucucgcccgcuugcucuccuuggcggaccucaccccacccccaccccgagcuugggcgaugccccaggaugcagaccccuuguuuugcagagguaggaagcagagccuuccagccucucuacccaguucaugacaaaaaguagga

SEQ ID NO: 10187 - RNA, 2501 nt, Mus musculus
ggcgacgaguccccggguggcuccugcuugacggccgcgcggcccugcuccgccucgccuccguagccgcugucgguguccgugucguguuccggcuccgugccgggcugaguccgcuggaugaccggcacgcagcgggcgacgcgcucgggacccgaggcggccgcagcccccgcgcugcagggcgcgcgcccagagccccugccggagggcaccuguggcgucaggagcuggguggccacggcaugcagguggcugacgagcugugcgcagcgcggcucccuggguguccagcucucaaagcgcgcgagguauugcaagacuucuuuggcgcagguuugaaaccccgaguggaacgcauccaagucggccuggaccggcgauuucagagagcgcuccccuagggugcacgggggagggaggcgagaagaaaaaccgcggcguuaagacaucugcucaucacgugggcccugcgcugccuacagugagcucggcuuuuccugggcauuccagcgauauaauccgcagacugccgagagaggaggggguggcgcggugaggcgcucucuuccuggcugaaaaacccaacugaagaggugcagccgccacuuuaaauaaaaacggggcuccuccagcucugcgggaagccuuugggaugcucuggguacuugccaccaaagggaaagaggcgacguucaccaggagaggacgcagcgggggaguccuagcguugcgcccccagcguuacccccuuuuguaucagggcaggcuggcuuccucagacccacuuaccauucuguaaagcaauuaucuucugaugcugcugcucaguuaaggcuguuagcgcuuucaagugcuuuaaaguuaauuccaagacuacugcuuucuccaaaugccccagugucugcaguggugcgacaaagggggacagggguuacuuuaaaacacgcauuuuuauuuccacgcagcccagcaacuuaagacaggcacacacacacacacacacacacacacacaccacugggaaggaagcgcugcucagcuccccacagucaggucgucaaugaucucugccauuagcccggagccccuguucugagucucugggaaacucuuaguuacagcacaaguuagaaggcaggccucuuaauauuuacauuuauuauccuaucucugggaauuuuaucagguaaauacaccccggaguccaucaggagaaugaaaaugugcaucuuacugucaauuucagauguucgggcaguaaaucuuucagcugagcaaugcauucauuaauucggucucgucucuucuuuucuauuaaucugugcgguaacuuguagguauccuucauacacgagccagagaaaagauacagcagugagcuaaacauucauucacuuacuggauagaacccucccaccccaacccccaaacacacuauguaaugaacuaaugcccagaacucucuccucuagacuucuaaaaugcaauuuaaauucaggugcgguguugaauaucccccggaguauccagcaagccacuuaaaauucacaguuaggaaagcucagggcuggaauauauuugcgggcagaguuuccuugcgaaaucaauggcccuaauuaacuauccaggcagguuaugggaaacuuaagacuuaccuugguaucgucucgcuucaagcuccuuuuggguuuacacauauacaaagaggaauaguccagucugcaaaaacagaaaucagcaucaggcccccauuccgggaggggcucugcccucacccgcuccauaucacuuugugcaggggauuaaaaaaaaaaaagccaaaccgacgccuagacagauauucgcaacggugcguacaccuuacccuauaaaaucccuauguuccaguaacugucucucuugcaaaugagggauuccuucguccauguucaauggcuguccguuucgauuuggagguuucuguccuguaaucugugggacggucgccuggagagauuuuggggggaugugugcgucuccaggcugucucgcucucccucuucagugcaguauugaaagugugaagcaguuggccgccccuccgccccgugcucgcucgcucgcccucucgcacacccgcgcgcgcacacccgcgcgcacacacgcacugcgcugguaguuugcucucacuccgggcaguguuuggccacagggcacgcgcgucgccggccagaccagcacccagcucacgugcggaacguaccauccgcgguccagcccggaggggggcggggaggaggggccgggagggggcggggacaccugauuggggccaccuggaaggagcggccacccggcgagccguucgucuuccccgaggcgcugcagggcgcgggggcggggcgggacgaggggcucccccggcucguccagcaucucggugcagaaccgaggacguggccuuuggcuuucccaccaauugcuguugguuugggccagagaaagaacgcgaauucgug

SEQ ID NO: 10188 - RNA, 2501 nt, Mus musculus
cacgaauucgcguucuuucucuggcccaaaccaacagcaauuggugggaaagccaaaggccacguccucgguucugcaccgagaugcuggacgagccgggggagccccucgucccgccccgcccccgcgcccugcagcgccucggggaagacgaacggcucgccggguggccgcuccuuccagguggccccaaucagguguccccgcccccucccggccccuccuccccgccccccuccgggcuggaccgcggaugguacguuccgcacgugagcugggugcuggucuggccggcgacgcgcgugcccuguggccaaacacugcccggagugagagcaaacuaccagcgcagugcgugugugcgcgcgggugugcgcgcgcgggugugcgagagggcgagcgagcgagcacggggcggaggggcggccaacugcuucacacuuucaauacugcacugaagagggagagcgagacagccuggagacgcacacauccccccaaaaucucuccaggcgaccgucccacagauuacaggacagaaaccuccaaaucgaaacggacagccauugaacauggacgaaggaaucccucauuugcaagagagacaguuacuggaacauagggauuuuauaggguaagguguacgcaccguugcgaauaucugucuaggcgucgguuuggcuuuuuuuuuuuuaauccccugcacaaagugauauggagcgggugagggcagagccccucccggaaugggggccugaugcugauuucuguuuuugcagacuggacuauuccucuuuguauauguguaaacccaaaaggagcuugaagcgagacgauaccaagguaagucuuaaguuucccauaaccugccuggauaguuaauuagggccauugauuucgcaaggaaacucugcccgcaaauauauuccagcccugagcuuuccuaacugugaauuuuaaguggcuugcuggauacuccgggggauauucaacaccgcaccugaauuuaaauugcauuuuagaagucuagaggagagaguucugggcauuaguucauuacauaguguguuuggggguuggggugggaggguucuauccaguaagugaaugaauguuuagcucacugcuguaucuuuucucuggcucguguaugaaggauaccuacaaguuaccgcacagauuaauagaaaagaagagacgagaccgaauuaaugaaugcauugcucagcugaaagauuuacugcccgaacaucugaaauugacaguaagaugcacauuuucauucuccugauggacuccgggguguauuuaccugauaaaauucccagagauaggauaauaaauguaaauauuaagaggccugccuucuaacuugugcuguaacuaagaguuucccagagacucagaacaggggcuccgggcuaauggcagagaucauugacgaccugacuguggggagcugagcagcgcuuccuucccaguggugugugugugugugugugugugugugugugccugucuuaaguugcugggcugcguggaaauaaaaaugcguguuuuaaaguaaccccugucccccuuugucgcaccacugcagacacuggggcauuuggagaaagcaguagucuuggaauuaacuuuaaagcacuugaaagcgcuaacagccuuaacugagcagcagcaucagaagauaauugcuuuacagaaugguaagugggucugaggaagccagccugcccugauacaaaaggggguaacgcugggggcgcaacgcuaggacucccccgcugcguccucuccuggugaacgucgccucuuucccuuugguggcaaguacccagagcaucccaaaggcuucccgcagagcuggaggagccccguuuuuauuuaaaguggcggcugcaccucuucaguuggguuuuucagccaggaagagagcgccucaccgcgccacccccuccucucucggcagucugcggauuauaucgcuggaaugcccaggaaaagccgagcucacuguaggcagcgcagggcccacgugaugagcagaugucuuaacgccgcgguuuuucuucucgccucccucccccgugcacccuaggggagcgcucucugaaaucgccgguccaggccgacuuggaugcguuccacucgggguuucaaaccugcgccaaagaagucuugcaauaccucgcgcgcuuugagagcuggacacccagggagccgcgcugcgcacagcucgucagccaccugcaugccguggccacccagcuccugacgccacaggugcccuccggcaggggcucugggcgcgcgcccugcagcgcgggggcugcggccgccucgggucccgagcgcgucgcccgcugcgugccggucauccagcggacucagcccggcacggagccggaacacgacacggacaccgacagcggcuacggaggcgaggcggagcagggccgcgcggccgucaagcaggagccacccggggacucgucgcc

SEQ ID NO: 10189 - RNA, 2501 nt, Mus musculus
ucagcacaccaggaagcuagggacaaagaauggaaaccagggaaccguuaacacaugcaucccucagccaucagucuuucagcccucccuaucagccagcgcucaccugcaaagaucccaaugucccagcgcucauggccaaggugggcagggaguccagacugugaucuccgucagcugggaauuugucucucuggugagaaagaagcugugaggggaaccccaagcucuccccuucgucaagugcccaagagagagaagugacugucauucuauauucccugucccuccaaucuccuaccaucugugcagcuaguugccgugugucugccaggagggaucggguuaggagaacagcgcuguccagaucugcucgagggucugaagagacucgaggggagccagcugguggcccaggggcaacgacucuaucuggccagaggcucagcaccaccaggaccaggcgacaaacaccuguggacagaagggagaaaucaggccaaacucugggucugagggaguaggacuggggucuagauucuucugccucugaggaagaagggcuagagucuagaaccugggucugagugagguaagcuaggguucggaauuuuggucuugaaggacuguggucuggacuuuacggucuggaggaggagggauggauggagccuggauucugggucugagggagggcaggcugggccucgggacccuggaucugcagaauaagggcuagacucuggacuccagguucuagggagaagagcugagguuugggcuccugggucugagggaggagggcuggagucugaacgccuggaucugagggaggaggaccuggaggucuugagucucaggguggggcgccccggggcaggucgcaaagcccgagcccgggcgggcuucccucucccucccuggcucuggcugccccgcccgucggagcagacgcggcccggggcggguagacgggccgggcgucucccguccgcccccggacgccggaaucugggccccggggcggggcaugacgggggggggggagguacaggccagaaccugccccccuccccugccccgggagcccuagccggccugggaacagugguaggagucagagacuggagcugacacccgaacacacggauuccucuccaggaaggugccuggacccauucccauaugcccucaaagguggcugcagagggcugggccguugggucggggaggaccugggcgcaccuggucugagaggcgcucagggacgcacgcagcugaagacccgucgggccgcguucggggcucaggggcuagggacagcuccuuugccggcugcccaucccccagcugccccgcccaccucugagacagccagccaaucagagccccccgggccaccaagcucaaguaucacacccccagcccgcccccugguccccucuagcuaugccuaguccuucgcaagccccuccugggccgucugucggugcacccguccccuagccggugcgcaucugucuggcucuuuaagcucucuguccgcaccucucuuucgucugccuccccugccuguuucucguccucuggggcuugcugucaucugggauucucugccucaguuucccacccugagacgcgcuguuggaguucgugguugucucuguuccuagauucccacugacucccugggauacccgaucccuuaaggaucaccucccucccagcaucugucccucuguccuugucuggcugucccuugccuuguucugucucuuucucuguccaucucuucucuuaaacucccacuuuucucacuauucuuucucaaucugacuccccgugacuccucuuuucuaucccucugucccuacucugcuucgcauccuccccacucccucaauccuuccccccccccaacccuguccccucacccaugaacuggaaccaacuuacaguucauguccccacaggccagggguuccccagggcagggggcagggagccgggggggggggcuuuaacccuucccuguccgcugccgggggacccagggggucagcugggccucggccuggggaggggagguuugugagugugagcagcaagggccaggcagugagggaguguguacgccugggggguuauauagggggccggggcgggcgggcggggggcaggcagcaggggagggcggccugacacauccugacucacccucccuccugccuuuuccauucagacgagccggcugccuagcagggcucacaccgccuugcuuggaggagggcacggaaggaaaaguuggaaaaguugaaaagugaaggggggguggucugagaggggccggugaggucauuggcguccccucccuccaccuccacgggcugggacagacacacaaggcucaagagcucuauggagccuggcugugggugguggucugcauggaccaggacuaguacugagagauggugaggcaguagaagaggcaaguccag

SEQ ID NO: 10190 - RNA, 2501 nt, Mus musculus
cuggacuugccucuucuacugccucaccaucucucaguacuaguccugguccaugcagaccaccacccacagccaggcuccauagagcucuugagccuugugugucugucccagcccguggagguggagggaggggacgccaaugaccucaccggccccucucagaccacccccccuucacuuuucaacuuuuccaacuuuuccuuccgugcccuccuccaagcaaggcggugugagcccugcuaggcagccggcucgucugaauggaaaaggcaggagggagggugagucaggaugugucaggccgcccuccccugcugccugccccccgcccgcccgccccggcccccuauauaaccccccaggcguacacacucccucacugccuggcccuugcugcucacacucacaaaccuccccuccccaggccgaggcccagcugacccccugggucccccggcagcggacagggaaggguuaaagcccccccccccggcucccugcccccugcccuggggaaccccuggccuguggggacaugaacuguaaguugguuccaguucaugggugaggggacaggguuggggggggggaaggauugagggaguggggaggaugcgaagcagaguagggacagagggauagaaaagaggagucacggggagucagauugagaaagaauagugagaaaagugggaguuuaagagaagagauggacagagaaagagacagaacaaggcaagggacagccagacaaggacagagggacagaugcugggagggaggugauccuuaagggaucggguaucccagggagucagugggaaucuaggaacagagacaaccacgaacuccaacagcgcgucucagggugggaaacugaggcagagaaucccagaugacagcaagccccagaggacgagaaacaggcaggggaggcagacgaaagagaggugcggacagagagcuuaaagagccagacagaugcgcaccggcuaggggacgggugcaccgacagacggcccaggaggggcuugcgaaggacuaggcauagcuagaggggaccagggggcgggcugggggugugauacuugagcuugguggcccggggggcucugauuggcuggcugucucagaggugggcggggcagcugggggaugggcagccggcaaaggagcugucccuagccccugagccccgaacgcggcccgacgggucuucagcugcgugcgucccugagcgccucucagaccaggugcgcccagguccuccccgacccaacggcccagcccucugcagccaccuuugagggcauaugggaauggguccaggcaccuuccuggagaggaauccguguguucgggugucagcuccagucucugacuccuaccacuguucccaggccggcuagggcucccggggcaggggaggggggcagguucuggccuguaccucccccccccccgucaugccccgccccggggcccagauuccggcguccgggggcggacgggagacgcccggcccgucuacccgccccgggccgcgucugcuccgacgggcggggcagccagagccagggagggagagggaagcccgcccgggcucgggcuuugcgaccugccccggggcgccccacccugagacucaagaccuccagguccuccucccucagauccaggcguucagacuccagcccuccucccucagacccaggagcccaaaccucagcucuucucccuagaaccuggaguccagagucuagcccuuauucugcagauccagggucccgaggcccagccugcccucccucagacccagaauccaggcuccauccaucccuccuccuccagaccguaaaguccagaccacaguccuucaagaccaaaauuccgaacccuagcuuaccucacucagacccagguucuagacucuagcccuucuuccucagaggcagaagaaucuagaccccaguccuacucccucagacccagaguuuggccugauuucucccuucuguccacagguguuugucgccugguccugguggugcugagccucuggccagauagagucguugccccugggccaccagcuggcuccccucgagucucuucagacccucgagcagaucuggacagcgcuguucuccuaacccgaucccuccuggcagacacacggcaacuagcugcacagaugguaggagauuggagggacagggaauauagaaugacagucacuucucucucuugggcacuugacgaaggggagagcuugggguuccccucacagcuucuuucucaccagagagacaaauucccagcugacggagaucacagucuggacucccugcccaccuuggccaugagcgcugggacauugggaucuuugcaggugagcgcuggcugauagggagggcugaaagacugauggcugagggaugcauguguuaacgguucccugguuuccauucuuugucccuagcuuccuggugugcuga

SEQ ID NO: 10191 - RNA, 2501 nt, Mus musculus
uugcaaggggcuaucgcgcaagugcggucccgaccuccgcgcaaacggcgggccucaccugggcuccaggaagaggcgccccaggcucggcaggccugauucgguuagugcccacgucuccgcgcuccgccauccaguucucccccuccucugccgcuacgcccgcuuacuggugggugggcgcuucucuccgcgacacuuugcagacgcuccccugcgcugggcaugggcgccgccacugccgucggucccggggcuggaguccgugcgcgggugggugagagcggggccucggccccuuguacccugagcacccaaaggcggggaacggugcccacggucgacacccccaugccgguugcccauucugggacccuucgccacggucgcccccucccacuugugggacaaagggugggggcgcauccccacgcgugaccucccacgcacugcgcacgcgcccagcucccacuucggggaggggcuuuacucgcccacgcgagugcgggaggaaugggcggcugggacaggggaacgcuugcaggauggacccccuaccccaagaauggaaguuaggggugguuguuucuccauuuauggcauuggguucggagaugggccaugaugaagggcuuucucauucaggccaggucucccugugguguugaccccacgaggaaccaaagaauuuaagggccgagccccuucacaaccaagauuccucucgcugagcccccucgcucuggguacauacuuuggaagccucugacucuguccagaaguauggguccuuuccucccucagacuggugauccuuccuuacuccggagggacagguauuccaccucuccagggacugccgacuuuuggugaccugcuucuguccagugcccccaagggcucaguugcugggucugcaggaagccuccucgauaugaaugacagaaacaaccguuggcggacaagugaggcaccuggggacccuuucuuuucccauccuuggucugacauucugguucccucuguccaugggacagcaaugguuggggguggucuauaagguucaggccacuucuggggugaccucugcugaccucucugcagugaaggacgaagagaccuuugagaucuccauucccuuugaagaggcaccccacuuagacucacaaaucuuauaccgucugaguccgucucggagaaauguugagggugagcugagaaagggcauuggagggacuggagucaggugggguacugccucacccuggggcaugaccuccgucccugcuguucuuagagccuccagagggcgccuccccaacccuggcccugaugagcaguguuaaggcccagcugcacauggcacuggagaggaacucgugguugcagaagcgcauugaggaccuggaggaggagagggacuucuugcggugucagcuggacaaauucauuuccucugcccggauggaugcaggugggggcacacagucccccaggacccgcagaauucaacacccaauguugguuggaccugauggggacuuggcaucuuauccuuccacuaaggcccaugccuauuuuagggccuuccccagccauuuccuucuugauuucaaagacuucucucauuuccuaucuugugaugagacugcccuguaacucaucagccucaagcacuuggcauaacugucucccagagucuauauuuccagcccagguuccucaucuuaggggaaaugucccuuugucaguagacccauugcagucuacuggauuccucagaggggcccugccagcaccccaggauuucugaaugaugcagucaucauccauuagagguacccugaaauaccaaucaggguucugucuucccucuacccugcucuacauuaucaugccucauguuucuuauucuucaaaggcugugggggucccaguaccucugucuccuaagcuucaccuuaggguccugagcggaucccacucccuugucuugcucuaaucuacaacuaguaacagcaugguggugucaccucuucugacaggcagggcccuaucucauuaaccuguguugacugccauucccagcacauuccccacucaaggcugcccuuucccagagcuuuagcccugguuucuuggaguacuuagccuuuauucaggccauaacccuaaccucuguauccagcugagcugcuggcaggcuuucucauugcuaaccauggcaaaagcucuaguaaagggaccuagcacugggauggggacaugcauacccucucuuccuauacugagagcucuauccagggugacuccuaucuuucccugguaugacugggcagagucuugguuucaguucucaggaguucauccuucagaagaugcugagucugaguuggcucccuaucuaggggaagguaguuagcauuucccaguacccaaacugaacccugacuucuguaggagucugauauccaauccuccuacccagaggcacugucugc

SEQ ID NO: 10192 - RNA, 2501 nt, Mus musculus
gcagacagugccucuggguaggaggauuggauaucagacuccuacagaagucaggguucaguuuggguacugggaaaugcuaacuaccuuccccuagauagggagccaacucagacucagcaucuucugaaggaugaacuccugagaacugaaaccaagacucugcccagucauaccagggaaagauaggagucacccuggauagagcucucaguauaggaagagaggguaugcauguccccaucccagugcuaggucccuuuacuagagcuuuugccaugguuagcaaugagaaagccugccagcagcucagcuggauacagagguuaggguuauggccugaauaaaggcuaaguacuccaagaaaccagggcuaaagcucugggaaagggcagccuugaguggggaaugugcugggaauggcagucaacacagguuaaugagauagggcccugccugucagaagaggugacaccaccaugcuguuacuaguuguagauuagagcaagacaagggagugggauccgcucaggacccuaaggugaagcuuaggagacagagguacugggacccccacagccuuugaagaauaagaaacaugaggcaugauaauguagagcaggguagagggaagacagaacccugauugguauuucaggguaccucuaauggaugaugacugcaucauucagaaauccuggggugcuggcagggccccucugaggaauccaguagacugcaaugggucuacugacaaagggacauuuccccuaagaugaggaaccugggcuggaaauauagacucugggagacaguuaugccaagugcuugaggcugaugaguuacagggcagucucaucacaagauaggaaaugagagaagucuuugaaaucaagaaggaaauggcuggggaaggcccuaaaauaggcaugggccuuaguggaaggauaagaugccaaguccccaucagguccaaccaacauuggguguugaauucugcggguccugggggacugugugcccccaccugcauccauccgggcagaggaaaugaauuuguccagcugacaccgcaagaagucccucuccuccuccagguccucaaugcgcuucugcaaccacgaguuccucuccagugccaugugcagcugggccuuaacacugcucaucagggccaggguuggggaggcgcccucuggaggcucuaagaacagcagggacggaggucaugccccagggugaggcaguaccccaccugacuccagucccuccaaugcccuuucucagcucacccucaacauuucuccgagacggacucagacgguauaagauuugugagucuaaguggggugccucuucaaagggaauggagaucucaaaggucucuucguccuucacugcagagaggucagcagaggucaccccagaaguggccugaaccuuauagaccacccccaaccauugcugucccauggacagagggaaccagaaugucagaccaaggaugggaaaagaaaggguccccaggugccucacuuguccgccaacgguuguuucugucauucauaucgaggaggcuuccugcagacccagcaacugagcccuugggggcacuggacagaagcaggucaccaaaagucggcagucccuggagagguggaauaccugucccuccggaguaaggaaggaucaccagucugagggaggaaaggacccauacuucuggacagagucagaggcuuccaaaguauguacccagagcgagggggcucagcgagaggaaucuugguugugaaggggcucggcccuuaaauucuuugguuccucguggggucaacaccacagggagaccuggccugaaugagaaagcccuucaucauggcccaucuccgaacccaaugccauaaauggagaaacaaccaccccuaacuuccauucuugggguaggggguccauccugcaagcguuccccugucccagccgcccauuccucccgcacucgcgugggcgaguaaagccccuccccgaagugggagcugggcgcgugcgcagugcgugggaggucacgcguggggaugcgcccccacccuuugucccacaagugggagggggcgaccguggcgaagggucccagaaugggcaaccggcaugggggugucgaccgugggcaccguuccccgccuuugggugcucaggguacaaggggccgaggccccgcucucacccacccgcgcacggacuccagccccgggaccgacggcaguggcggcgcccaugcccagcgcaggggagcgucugcaaagugucgcggagagaagcgcccacccaccaguaagcgggcguagcggcagaggagggggagaacuggauggcggagcgcggagacgugggcacuaaccgaaucaggccugccgagccuggggcgccucuuccuggagcccaggugaggcccgccguuugcgcggaggucgggaccgcacuugcgcgauagccccuugcaa

SEQ ID NO: 10193 - RNA, 2501 nt, Mus musculus
ggguuccauacucccaacuccaaaaagcuaucaggguggcucugacuugucaucccagcucccuuggaauggccaaugcaggaaggucgcaaguucaaagccugccuuggccacagagaaaguucaaggccagucuagcgcaacuauaggagacugucucaaaaugaaaaaguuaaaaagggccaugggauacagcucagugguugcuuagcacauacgagauuuuggagucuaucuccgguacugccaggugggaacuaucagaggcugguaucuuuccccaccaguuuggcuucccagggcaggcugugaaaauaggguugagcugucugcaaaagaaacgcuucuccuuacuccaccccugcccaggguuccagcaucccagagagccagaaugaaaaggaacguuaaaccccgcccucacaucccuccaggccacgccccauucaacacaccccacaaagccccucccuugaucacacccacagcaugcucucucccuauaggcacggccuccgccgugugguccagcggggaaggcucccucugucucucuugucucuuggcaggcuugacucggucucugagugucugucuccaaggcucagucuguguaucugucuccuguggccucucccugugcauccaucaucuauccuucgucugucucucugugaacuuaguucuguuucucuuugcaguucucaccgcccucugaaguucucugucccauuuuccguccucucacucugaucccucacuacuuucaccuuccuagggagccaucucccucucuuauccuucuugggucccccagaucucccguuucuaucuucugcugggcggacggggacgccuagucuucgccucuucuucugcuugagcuccugcagcgacuuugguucgcgggcgccaccguguggccaauagggaguccuugauggcggcgaggcaagcaagcgaugcuguggucuggaugcgacguccagagguggugcgacccacgccaguguaagggcacgccucagagguggugugggacgccagcagaugaugugugacugugugacaaggugagauuaggaaugacaagaagggguucagugggacuguuagaguaggugugauguguggcugaccauguuauacuuguuacacuuuaucagcgagacugugggccacuguguauggcauuggaccugagagaggaccugccuggagacuguucguaagucugaccacauguaagggugaccacgcguguuacagagcguagagagucaggggagcuggaaugcccaagugaucaaaugaucgaaugcaagagggaggcucgggagagggaccuaguguggccaacuguguggaugugagacaguaugucugccacacuggugaguccugagaaacugggugaccacgugugacgcugagagguuggcuuguguuugugacugccugugcaaaggugugugauuguucuggguggcagaggugaguuuacagggucugcgagacagggaauguugaauguagaagagagaaacagugagugagugagugugacaaguguuuguaguauagacuucaaggcccagcaaaggcugugcccacaaugguguguguguguguguguguguguguaaaagaccauguuaucaaaugucaacaauguaugauaccaaaagacacugugccgcuaugauaguaauaacaugugacacaguauggggagggagaaugugggccacuguguaucaggaaauugaccaggaguaaaugugaccacacaaaggcgcuccuggaaagaaaagcacgugguucucugucacacuaggcaauggagcgcuuggcagugaggcugaaccaguaugugguugugugagacuccaagacagugugaaugcgaacuucaggagaaguuaaagcugcacugguagguaacaauguauacauuugacucucuaagauacugugccugacugugcagugaccucugcugugagaaaucaugagugucagcagugggcagguauauuaaggaccuuugucauuguguguuggguuaagugggggggugggggguggggcgggacuggguuacucagugacccagcaaaauaggaugcaucccugugugagcgacuuuugagucugugugcugugaugugcugugauggggugaggcugcuacucugauggccugugaaagagugggaggcugagugggaagaggagaggcuugugugcaugagcguauacaccuggagggcccgucuuuuagugcaagugugacagagggacuccagagaaagacaggcucuaaacaggaauggcugaaagagagagagagagaaggaggaggaggaggagggggaggaggaggaggaggaggaagauucaucagugcaaggagaggacucagagacagacccagggcauggagacagguggugcuuaggaggagaaggcgguccugaggggcugcaccccgggggagg

SEQ ID NO: 10194 - RNA, 2501 nt, Mus musculus
ccucccccggggugcagccccucaggaccgccuucuccuccuaagcaccaccugucuccaugcccugggucugucucugaguccucuccuugcacugaugaaucuuccuccuccuccuccuccucccccuccuccuccuccuccuucucucucucucucuuucagccauuccuguuuagagccugucuuucucuggagucccucugucacacuugcacuaaaagacgggcccuccagguguauacgcucaugcacacaagccucuccucuucccacucagccucccacucuuucacaggccaucagaguagcagccucaccccaucacagcacaucacagcacacagacucaaaagucgcucacacagggaugcauccuauuuugcugggucacugaguaacccagucccgccccaccccccacccccccacuuaacccaacacacaaugacaaagguccuuaauauaccugcccacugcugacacucaugauuucucacagcagaggucacugcacagucaggcacaguaucuuagagagucaaauguauacauuguuaccuaccagugcagcuuuaacuucuccugaaguucgcauucacacugucuuggagucucacacaaccacauacugguucagccucacugccaagcgcuccauugccuagugugacagagaaccacgugcuuuucuuuccaggagcgccuuuguguggucacauuuacuccuggucaauuuccugauacacaguggcccacauucucccuccccauacugugucacauguuauuacuaucauagcggcacagugucuuuugguaucauacauuguugacauuugauaacauggucuuuuacacacacacacacacacacacacaccauugugggcacagccuuugcugggccuugaagucuauacuacaaacacuugucacacucacucacucacuguuucucucuucuacauucaacauucccugucucgcagacccuguaaacucaccucugccacccagaacaaucacacaccuuugcacaggcagucacaaacacaagccaaccucucagcgucacacguggucacccaguuucucaggacucaccaguguggcagacauacugucucacauccacacaguuggccacacuaggucccucucccgagccucccucuugcauucgaucauuugaucacuugggcauuccagcuccccugacucucuacgcucuguaacacgcguggucacccuuacauguggucagacuuacgaacagucuccaggcagguccucucucagguccaaugccauacacaguggcccacagucucgcugauaaaguguaacaaguauaacauggucagccacacaucacaccuacucuaacagucccacugaaccccuucuugucauuccuaaucucaccuugucacacagucacacaucaucugcuggcgucccacaccaccucugaggcgugcccuuacacuggcgugggucgcaccaccucuggacgucgcauccagaccacagcaucgcuugcuugccucgccgccaucaaggacucccuauuggccacacgguggcgcccgcgaaccaaagucgcugcaggagcucaagcagaagaagaggcgaagacuaggcguccccguccgcccagcagaagauagaaacgggagaucugggggacccaagaaggauaagagagggagauggcucccuaggaaggugaaaguagugagggaucagagugagaggacggaaaaugggacagagaacuucagagggcggugagaacugcaaagagaaacagaacuaaguucacagagagacagacgaaggauagaugauggaugcacagggagaggccacaggagacagauacacagacugagccuuggagacagacacucagagaccgagucaagccugccaagagacaagagagacagagggagccuuccccgcuggaccacacggcggaggccgugccuauagggagagagcaugcugugggugugaucaagggaggggcuuugugggguguguugaauggggcguggccuggagggaugugagggcgggguuuaacguuccuuuucauucuggcucucugggaugcuggaacccugggcagggguggaguaaggagaagcguuucuuuugcagacagcucaacccuauuuucacagccugcccugggaagccaaacugguggggaaagauaccagccucugauaguucccaccuggcaguaccggagauagacuccaaaaucucguaugugcuaagcaaccacugagcuguaucccauggcccuuuuuaacuuuuucauuuugagacagucuccuauaguugcgcuagacuggccuugaacuuucucuguggccaaggcaggcuuugaacuugcgaccuuccugcauuggccauuccaagggagcugggaugacaagucagagccacccugauagcuuuuuggaguugggaguauggaaccc

SEQ ID NO: 10195 - RNA, 2501 nt, Mus musculus
cagaggcuguucacacacaguucaggccauggcuaagcuggagaaccacucagcacuaggaccugucuggcuuccuuggguugguggugguggugguggugguggugagguucugauacuagguaacacgaagagggacuuagauaugaaugcauuuggagagggguggggcagacagacacagagguagagacagacagacagacauagagaugagaugcuggggagggggcacguaugaaaaacagaaaagguugaguggggguggagguggcagcaggugacugugcuguggacuguaugaggaagaggcaggaggagaggcagaggcaagagacggauacucagagcaggagaugggguacaagccagggaaagcaggcagggagcccgagggggccucuggagaccagcacagggggaggagggcggggcagagaggaaaugaaaaaagcuggggcgaggaggcaagaugaggagggagggggagggcgggcccuaggagggagaagcugacagagaucuacacagacucgcacacagacaggagagacugagggacuucagaaggcagaggugcuggagggucuagaaagcagaaaugucaaggaggugacagagaaguguagaggaaagaacaggggguaggggacagggaacacugaggcacaaagggacaaggaccugacagagaaggaaagaaacaggagagggacagacacaggagaagacagaaacaaaagacagaaacacacgggcaacugggaauugacuggcagaucccagauccuaugaagaugauggccagcgauggacauccuggacccccuucugucacuccugggagcccucucagugcagguggcagagaguggcagggcauggcaggcuccugcuggaauaucaccuacguucaagacucgguaggaccugccaccagcacgcugauguucguggcugguguagugggcaacgggcuggcauugggcauccugggugcccgacggaggucacacccaucggccuuugcgguguuggucacugggcuggcggugacggaucugcugggcacgugcuucuugagcccugcaguguuuguggccuaugcucgaaacagcucucugcugggccuggcccacggugggacgaugcugugugacacuuucgccuucgccaugacguucuucggccuggccuccacgcucauccucuuugccauggcuguggagcggugccuggcacucagucaccccuaccuguacgcccagcuggacgggccgcgcugcgcccgcuuugccuugccuuccaucuacgcuuucugcugccucuucugcucacugccccugcugggccugggcgagcaucagcaguauugcccagggagcuggugcuucauccgcaugcguuccgcccagccuggcggcugugccuucucccuggccuacgccagucucauggcccuguuggugaccuccaucuucuucugcaacggcuccgucacucucagccucuaucacauguaccgccaacagagacgccaccauggcucguuuguaccgaccucucgggcacgagaggaugaaguuuaccaccugauucugcuggcccucaugaccgucaucauggccgugugcucccugccucucauggugagugucccucggagcuggggugcagggggaggaguggagggcagcauccaucugugcucuccacuugucgugucuauuugacagaugugaaaaccgaggcucagaaagggucagauggugacuuuguguuccauguacuccugaguacuccaagaagucucucugcuuucuuuuccuccacuagacaaucucuagcccuuagcuguccugucaacaccucucagccggcuccccuauccaacacaccguugugauaacaggauccacaacucacgggcacuugcuuucugccgacacaacgcuuaauggcauuccaaaugccucuucagaugaauuucaaauugaccuuacacaaucauuucagaagcacugggcaggaaaugacacugaagucccauccugucaaccucuuuauagaaagaugauagugcuugcugcccgagaucacacaggcuggcugagucuccuccauccuggcucucuccucccggagccuggccauauaaccaugagcaccccacacacucccugagccugggcccugcccuugucccccacacccuucuuucagccucacagggaccuugugcuguccccucccacuauagcagccaguggggcuagccacguuuuuaugcuggggguuggaacacgguuuggaguguauuuggggugcuggagcccuuugaggauuaacaaugucugacaaacucaucuccaaggguggcuccacacgaggcuuugggagccucagcgggcucaggcuucucugugggcuggggguggggugggguggggagucgccucagcgcaaacggugggucugguaggucaguacccacugcccca

SEQ ID NO: 10196 - RNA, 2501 nt, Mus musculus
uggggcaguggguacugaccuaccagacccaccguuugcgcugaggcgacuccccaccccaccccacccccagcccacagagaagccugagcccgcugaggcucccaaagccucguguggagccacccuuggagaugaguuugucagacauuguuaauccucaaagggcuccagcaccccaaauacacuccaaaccguguuccaacccccagcauaaaaacguggcuagccccacuggcugcuauagugggaggggacagcacaaggucccugugaggcugaaagaagggugugggggacaagggcagggcccaggcucagggaguguguggggugcucaugguuauauggccaggcuccgggaggagagagccaggauggaggagacucagccagccugugugaucucgggcagcaagcacuaucaucuuucuauaaagagguugacaggaugggacuucagugucauuuccugcccagugcuucugaaaugauuguguaaggucaauuugaaauucaucugaagaggcauuuggaaugccauuaagcguugugucggcagaaagcaagugcccgugaguuguggauccuguuaucacaacgguguguuggauaggggagccggcugagagguguugacaggacagcuaagggcuagagauugucuaguggaggaaaagaaagcagagagacuucuuggaguacucaggaguacauggaacacaaagucaccaucugacccuuucugagccucgguuuucacaucugucaaauagacacgacaaguggagagcacagauggaugcugcccuccacuccucccccugcaccccagcuccgagggacacucaccaugagaggcagggagcacacggccaugaugacggucaugagggccagcagaaucaggugguaaacuucauccucucgugcccgagaggucgguacaaacgagccaugguggcgucucuguuggcgguacaugugauagaggcugagagugacggagccguugcagaagaagauggaggucaccaacagggccaugagacuggcguaggccagggagaaggcacagccgccaggcugggcggaacgcaugcggaugaagcaccagcucccugggcaauacugcugaugcucgcccaggcccagcaggggcagugagcagaagaggcagcagaaagcguagauggaaggcaaggcaaagcgggcgcagcgcggcccguccagcugggcguacagguaggggugacugagugccaggcaccgcuccacagccauggcaaagaggaugagcguggaggccaggccgaagaacgucauggcgaaggcgaaagugucacacagcaucgucccaccgugggccaggcccagcagagagcuguuucgagcauaggccacaaacacugcagggcucaagaagcacgugcccagcagauccgucaccgccagcccagugaccaacaccgcaaaggccgaugggugugaccuccgucgggcacccaggaugcccaaugccagcccguugcccacuacaccagccacgaacaucagcgugcugguggcagguccuaccgagucuugaacguaggugauauuccagcaggagccugccaugcccugccacucucugccaccugcacugagagggcucccaggagugacagaaggggguccaggauguccaucgcuggccaucaucuucauaggaucugggaucugccagucaauucccaguugcccguguguuucugucuuuuguuucugucuucuccugugucugucccucuccuguuucuuuccuucucugucagguccuugucccuuugugccucaguguucccuguccccuacccccuguucuuuccucuacacuucucugucaccuccuugacauuucugcuuucuagacccuccagcaccucugccuucugaagucccucagucucuccugucugugugcgagucuguguagaucucugucagcuucucccuccuagggcccgcccucccccucccuccucaucuugccuccucgccccagcuuuuuucauuuccucucugccccgcccuccucccccugugcuggucuccagaggcccccucgggcucccugccugcuuucccuggcuuguaccccaucuccugcucugaguauccgucucuugccucugccucuccuccugccucuuccucauacaguccacagcacagucaccugcugccaccuccacccccacucaaccuuuucuguuuuucauacgugcccccuccccagcaucucaucucuaugucugucugucugucucuaccucugugucugucugccccaccccucuccaaaugcauucauaucuaagucccucuucguguuaccuaguaucagaaccucaccaccaccaccaccaccaccaccaacccaaggaagccagacagguccuagugcugagugguucuccagcuuagccauggccugaacugugugugaacagccucug

SEQ ID NO: 10197 - RNA, 2501 nt, Mus musculus
acgcccccagcccccacccacgcaguugucauggaaaugaagcucuucuccccuuucucaaaauaagacuuugcuuaguaggcuaaaggacuacucaaagggaagaaacuccgcuugguccuagcgcucucuucagcaucucucucucuacugcgcccgcacugggauuuaguccuggguaccaucgcaggcaaggugccagugacacgcaugcgcgcuguagguuugcacaugcgcaauugagcaccagagcccagggaaccuacuucagcgcuaaaugugcggcugcgcagcuguguccuucugguaaagcaaggcgacgggaaguucugcgcuugcgcagugcugggagacacggcucagagaacgcagcucugucaggguaucuggagaccgcguucgcccggcgcgcaugcgucuuggcucucaaugcuacugggggcggggcccagagggggagggagaaguagggggggagggaagaggccgcagaagccgaagcccugacccaccggcaggcaggggcugcggcggcacggugagugacccgcggcccaacugggguccccauccucugugcuccaucacucuuccuggaguccaaaaaaagccucggggguccccccucuuaucucggacccccguuaucuccacaacuccccuucuuuccccagcaaucccagcacccccauaaucccugcagacccucagcuuuaauauuuugccgucuuaacuagaagguuccauuucaucuuuauucuuggacauccucucucagggacccuagaacugacacccacuacccugggaacccccagcgcuccucucugaucuggaugccccgucugcugcauugcccaguuggcaucacuucccagcaucaugcauguucgacccccugggcauccccguuacucuugcccuguccuguucuacugcgcccccguucuccucuaacuccugcuguggcacccuuuucccuuccacuuuugcucauuucccuccauccuuccagaccguccguccccccaguacccaucaacuccuccgcgaggcacuagcggccgcgugaagcacaagaugggcacugggcgggugucaccuacgaggaagcaccuuugauugcauucagcaccucgccgcucccaucaccacuuuugcacaggggaccagaggagcccgugucggggcgacacggggacaccgagccaccgccagcgcuguucgcccuuugcccgcagagccggcgccccccaugcgccaggcagccgaucgguggcgucugggggcgccauggccucggcgaccgcggcggcggcgccgggcgaagcggaggagaccacccgacuccgcaagccgcgcuucuccuucgaggagaaccagauccugauccgagaggugcgcgcccacuacccucagcucuacggcgcgcagagccgucgggugagcguggccgagcggcggcgagugugggacagcaucgccaccaaaaucaacggcaucaccagcuggaaacgcacgggccaggagguucagaagcguuggaacgacuucaagcgccgcaccaaggagaagcuggcccgcgugccgcauuccacgcagggcgcggggcccgccgcugaggacgccuucucugcggaggaggagacuauuuucgccauccugggaccggguguggcggggccgggggcuggcucuggggcugaggagucccgggcagccgccucuucacagccgcaggcuucgaccgcuaguacacaacgguauguguugucagaggaccgcaggcaggaucgacgggcaggugagucccaaagccaguuucuuuaacaacuaccagcacuccugaagccuacagugcguuguucacgcccagaucggucaggcguguuuaccacauuuuugcuaaaaaguaggaggucagugcugucaggcccauuauggagcuggggcuuuaaggucagagaaaggaaagacuuagauguggugccaacaggccuguaauucuccugcuugggaguugaaggcagaagaaacgggaguucaaggcuagccugugcuacaggaggcuuggcuuaaaagggugaggaagggcgggcuggggauguccuggugguugaguacuucccagcuuucagggguuccagggucagauuuugacugcauagacccaugugguagcacaugauuuggagucucaacaccugcguuauccuuaggugcauaguguguuagaggcaaaucugagcucugugagaaccugccuuccaaaaauaauaauguagaaaacagaaaaggaaguggauugucucuggugguucuacagccacuuggugaccaucagagucguagacguggaaccgguccugggaugccuggcucagcuggaauuggcgauuucaguaggugggugggauuggucuuucuucccagcuacuguggaggucugagguaggagaaucugggagcccagggccuaccuugggcuguaugcacuaagu

SEQ ID NO: 10198 - RNA, 2501 nt, Mus musculus
acuuagugcauacagcccaagguaggcccugggcucccagauucuccuaccucagaccuccacaguagcugggaagaaagaccaaucccacccaccuacugaaaucgccaauuccagcugagccaggcaucccaggaccgguuccacgucuacgacucugauggucaccaaguggcuguagaaccaccagagacaauccacuuccuuuucuguuuucuacauuauuauuuuuggaaggcagguucucacagagcucagauuugccucuaacacacuaugcaccuaaggauaacgcagguguugagacuccaaaucaugugcuaccacaugggucuaugcagucaaaaucugacccuggaaccccugaaagcugggaaguacucaaccaccaggacauccccagcccgcccuuccucacccuuuuaagccaagccuccuguagcacaggcuagccuugaacucccguuucuucugccuucaacucccaagcaggagaauuacaggccuguuggcaccacaucuaagucuuuccuuucucugaccuuaaagccccagcuccauaaugggccugacagcacugaccuccuacuuuuuagcaaaaaugugguaaacacgccugaccgaucugggcgugaacaacgcacuguaggcuucaggagugcugguaguuguuaaagaaacuggcuuugggacucaccugcccgucgauccugccugcgguccucugacaacacauaccguuguguacuagcggucgaagccugcggcugugaagaggcggcugcccgggacuccucagccccagagccagcccccggccccgccacacccggucccaggauggcgaaaauagucuccuccuccgcagagaaggcguccucagcggcgggccccgcgcccugcguggaaugcggcacgcgggccagcuucuccuuggugcggcgcuugaagucguuccaacgcuucugaaccuccuggcccgugcguuuccagcuggugaugccguugauuuugguggcgaugcugucccacacucgccgccgcucggccacgcucacccgacggcucugcgcgccguagagcugaggguagugggcgcgcaccucucggaucaggaucugguucuccucgaaggagaagcgcggcuugcggagucggguggucuccuccgcuucgcccggcgccgccgccgcggucgccgaggccauggcgcccccagacgccaccgaucggcugccuggcgcauggggggcgccggcucugcgggcaaagggcgaacagcgcuggcgguggcucgguguccccgugucgccccgacacgggcuccucugguccccugugcaaaaguggugaugggagcggcgaggugcugaaugcaaucaaaggugcuuccucguaggugacacccgcccagugcccaucuugugcuucacgcggccgcuagugccucgcggaggaguugauggguacuggggggacggacggucuggaaggauggagggaaaugagcaaaaguggaagggaaaagggugccacagcaggaguuagaggagaacgggggcgcaguagaacaggacagggcaagaguaacggggaugcccagggggucgaacaugcaugaugcugggaagugaugccaacugggcaaugcagcagacggggcauccagaucagagaggagcgcuggggguucccaggguagugggugucaguucuagggucccugagagaggauguccaagaauaaagaugaaauggaaccuucuaguuaagacggcaaaauauuaaagcugagggucugcagggauuaugggggugcugggauugcuggggaaagaaggggaguuguggagauaacggggguccgagauaagaggggggacccccgaggcuuuuuuuggacuccaggaagagugauggagcacagaggauggggaccccaguugggccgcgggucacucaccgugccgccgcagccccugccugccggugggucagggcuucggcuucugcggccucuucccucccccccuacuucucccucccccucugggccccgcccccaguagcauugagagccaagacgcaugcgcgccgggcgaacgcggucuccagauacccugacagagcugcguucucugagccgugucucccagcacugcgcaagcgcagaacuucccgucgccuugcuuuaccagaaggacacagcugcgcagccgcacauuuagcgcugaaguagguucccugggcucuggugcucaauugcgcaugugcaaaccuacagcgcgcaugcgugucacuggcaccuugccugcgaugguacccaggacuaaaucccagugcgggcgcaguagagagagagaugcugaagagagcgcuaggaccaagcggaguuucuucccuuugaguaguccuuuagccuacuaagcaaagucuuauuuugagaaaggggagaagagcuucauuuccaugacaacugcgugggugggggcugggggcgu

SEQ ID NO: 10199 - RNA, 2501 nt, Mus musculus
ccacucaaguuuggaaaaaaguaggggguugggccagcagcgggcacaccaucuucccacugcgccugcgcaagccacgcgcauccgcuuuuuggaccgacacuccagaaaaguugcugcaaacuuucuagcgcgauuccccgccccuccucccagcuagauccaccgccuacccgcggggccgggaauuccgaggggcggagcacggcgcggagaugggaagggagggggcccuucaagggacccgggagaugggagcggcuucgcgcccuuaacccuccggacggcccauuaccuucuccguugcucugauagggaaacugaggcccugagucagaggcacacaaggggggaaggccaaaagcgcggccagagacggagggaaaacaaagaauccugacagcccgggaggggggcggacacacagggacaaggacagacccgagugcagagcugggucuagucuuugggagggggccagaagacugcaaggggaccgggggggggggcggcgaggaggacugggcggaggagggggcuggggaagcccgcgggaggcggcaaaggagggaggaacuuuccaaaguugccaaacauggcuaccucgccugcggagccgagcgcggggcccgcggcucggggggaggcggcggcggcgaccgaggagcaggaggaggaagcgcgccagcuucugcagacucugcaggcagccgagggggaggcggcggcggccggggcgggagaugcggcggcggcggcggacucuggguccccgaguggcccggggucuccccgggagaccgugaccgaggugcccacuggccuucgcuucucgcccgaacagguggcaugcgugugcgaggcgcugcugcaggcgggccacgccggccgcuugagccgcuuccugggcgcgcugcccccggccgagcgccuacguggcagcgauccggugcugcgcgcgcgggcccuaguggccuuccagcggggugaauacgccgagcucuaccaacuucucgagagccgcccuuuccccgccgcccaccacgccuuccugcaggaccucuaccugcgcgcgcgcuaccacgaggccgagcgggcccguggccgugcgcugggcgcuguggacaaauaccggcugcgcaagaaguucccucugcccaagaccaucugggauggcgaggagaccgucuauugcuucaaggagcgcucgcgagcggcgcucaaggccugcuaccgcggcaaccgcuaucccacgccugacgagaagcgccgccuggccacgcucaccggccucucgcuuacacaggucagcaacugguucaagaaccggcgacagcgcgaccgcacugggaccggcgguggagcgccuugcaaaaggugaggggggaaccgacccuccuuccucgguggccgcuggagucugcgcaagugacccuucacaucccucuucgguggcgucggcgagugcauaggcugagcguggagagaccaggcacacccuggguucucugggcaucacugccucaggggcagagguuguuccagcuacuucuaagcugggaacgcagugccaggaaugggggggggggcgggggcgggacgggcagugagaaaagugagguaucccuggaggagcgguaguaaggaagggaaaggggccuuugucuaaggcacccaggguagggacccgcuuuuggggccucugcaaccuggccccucgguaaccauuacuuacacccacccccacgcccccuccagcccaaacagcguggucugucgcuugucuuuguugugaaacgugaaccuucuccggcuccgguuucccuguaacccaagcccuuccccucccaccucagcgccaggccucuagcucuggucucugacgccguggggguggggggugaggaagaacuggaguaaaagcugcugccucacuccgcagccacgcgccugccgacccaggggacuuggggcagucugggugcucggcugcaggccaaggcgacuggaaaacuuuccuccagcuuagcauacccgccgcgcugucaaccccagcaggcuuguagagacccugggauuuggguggguucuuugaagggcuaaaauaguuaaucggagcuuggguugccucugccccuagggcgaugaaaccuucaaaccuaaaaaagacguaacccuuuuuccuuccagcgagucugaugggaaccccacuacggaggaugaguccagccgcaguccagaggaccuggagagggguguggccuccauggcugcugaggcccccgcccagaguuccaucuuccuggcgggggccaccucuccugcaacgugcccugccuccuccucuauccuagugaaugggagcuuccuggccgccagcagucccccagcagugcuccucaaugguagcccagucauuaucaauagcuuggcccuaggagagaacuccagcuuggggcccuugcuacucacaggaggaagugccccucaaccacagccca

SEQ ID NO: 10200 - RNA, 2501 nt, Mus musculus
ugggcugugguugaggggcacuuccuccugugaguagcaagggccccaagcuggaguucucuccuagggccaagcuauugauaaugacugggcuaccauugaggagcacugcugggggacugcuggcggccaggaagcucccauucacuaggauagaggaggaggcagggcacguugcaggagagguggcccccgccaggaagauggaacucugggcgggggccucagcagccauggaggccacaccccucuccagguccucuggacugcggcuggacucauccuccguagugggguucccaucagacucgcuggaaggaaaaaggguuacgucuuuuuuagguuugaagguuucaucgcccuaggggcagaggcaacccaagcuccgauuaacuauuuuagcccuucaaagaacccacccaaaucccagggucucuacaagccugcugggguugacagcgcggcggguaugcuaagcuggaggaaaguuuuccagucgccuuggccugcagccgagcacccagacugccccaaguccccugggucggcaggcgcguggcugcggagugaggcagcagcuuuuacuccaguucuuccucaccccccacccccacggcgucagagaccagagcuagaggccuggcgcugaggugggaggggaagggcuuggguuacagggaaaccggagccggagaagguucacguuucacaacaaagacaagcgacagaccacgcuguuugggcuggagggggcguggggguggguguaaguaaugguuaccgaggggccagguugcagaggccccaaaagcgggucccuacccugggugccuuagacaaaggccccuuucccuuccuuacuaccgcuccuccagggauaccucacuuuucucacugcccgucccgcccccgcccccccccccauuccuggcacugcguucccagcuuagaaguagcuggaacaaccucugccccugaggcagugaugcccagagaacccagggugugccuggucucuccacgcucagccuaugcacucgccgacgccaccgaagagggaugugaagggucacuugcgcagacuccagcggccaccgaggaaggagggucgguuccccccucaccuuuugcaaggcgcuccaccgccggucccagugcggucgcgcugucgccgguucuugaaccaguugcugaccuguguaagcgagaggccggugagcguggccaggcggcgcuucucgucaggcgugggauagcgguugccgcgguagcaggccuugagcgccgcucgcgagcgcuccuugaagcaauagacggucuccucgccaucccagauggucuugggcagagggaacuucuugcgcagccgguauuuguccacagcgcccagcgcacggccacgggcccgcucggccucgugguagcgcgcgcgcagguagagguccugcaggaaggcguggugggcggcggggaaagggcggcucucgagaaguugguagagcucggcguauucaccccgcuggaaggccacuagggcccgcgcgcgcagcaccggaucgcugccacguaggcgcucggccgggggcagcgcgcccaggaagcggcucaagcggccggcguggcccgccugcagcagcgccucgcacacgcaugccaccuguucgggcgagaagcgaaggccagugggcaccucggucacggucucccggggagaccccgggccacucggggacccagaguccgccgccgccgccgcaucucccgccccggccgccgccgccucccccucggcugccugcagagucugcagaagcuggcgcgcuuccuccuccugcuccucggucgccgccgccgccuccccccgagccgcgggccccgcgcucggcuccgcaggcgagguagccauguuuggcaacuuuggaaaguuccucccuccuuugccgccucccgcgggcuuccccagcccccuccuccgcccaguccuccucgccgcccccccccccgguccccuugcagucuucuggcccccucccaaagacuagacccagcucugcacucgggucuguccuugucccuguguguccgccccccucccgggcugucaggauucuuuguuuucccuccgucucuggccgcgcuuuuggccuuccccccuugugugccucugacucagggccucaguuucccuaucagagcaacggagaagguaaugggccguccggaggguuaagggcgcgaagccgcucccaucucccgggucccuugaagggcccccucccuucccaucuccgcgccgugcuccgccccucggaauucccggccccgcggguaggcgguggaucuagcugggaggaggggcggggaaucgcgcuagaaaguuugcagcaacuuuucuggagugucgguccaaaaagcggaugcgcguggcuugcgcaggcgcagugggaagauggugugcccgcugcuggcccaacccccuacuuuuuuccaaacuugagugg

SEQ ID NO: 10201 - RNA, 2501 nt, Mus musculus
agaacucuacacuaucgccagcuaacauccucaguccugaacuguggaucucccccuccaggaagccaauugcuuuuguuuuuguuuuuguuuuuucgagacaggguuucucuguauagcccuggcuguccuggaacucacucuguagaccaggcuggccucaaacucagaaaucugccugccucugccuccuaaaucacugccaccacugugaaugugcccugacaguacguaaaucccagcaguuggggagcuaaguccucaaccaucaccaucaccaucaccaucacagggccuuuguauuccuuugggaagaguuuaaaguggcacacaccuguaaucccaggauuugggagauggaggcaagacgaucaagaguucaaggccagccuguacugccagcaucaaaagggauagguggggggagauuuuccuaagagaagugugggaggguggagggaggagguugaaacccucccuucugcgcuguccuaccagccucacuucaacaagcugaugcgcaggaaguggcugagcaguucagaagcucuggauggcaucgugggcacacucggcgcccaggcccuggcccugcgcagaaugcaggaugaaccguaccaggugaucagaugggagggggacagagaugcucagagagcuauuguccugggggagacccuaccaaguggggagucgcuuuucuggaagcacauagguggcuccucaucuggggccugcagagggaagcauggcccuagaaaccggggugcagguucagguuggagccucugcagggaagacuuugggaaagccuagguuguggcacaccuuagggagaguggugugugugggauccgauuaaggaucuguuaggaugaggggauccguagagagucugacuuuaaaggagccgggcacuccgugaggaacagaggguucccacauguauuaggaguguuccgccugugugggcagagcuugaaacagggguccucccgaaagccuacugguugggagcggucuagagcguguccgggucucccaccguccccagguucugguggcugagcugcaccgacgggcgcugguggaguaugugcggccacugcuccgcgggcgccugcgcugucgcucugcgaggacccgcagccguguggcggggaggcuccgcgaggacgcggcgcagcugcagcgguuguuucggcggcuggugagugccaggcugggcugggcugggcaaacccgggggaagggagacagguaagagcuggaggcggggcuguccggagugggggucaguuuggcuuccaaagcaggacagggaagcuggguucgugaugaugcacaccugccgccacccaguacuagggaugcggaggcagaaggauugggaauuucaagaccaagaagaccgaaaaaagggcgggggccuggagagcccugguuacucuugcagagaacacggguucgauucgcaguccccacauggcagcucaaaaccguacuuaauucauccaacacuguauucuggcuucuugggcuccaggcauucauucacauggcgcagagagaacacccauacguuuaaaacaagucuuguuuuguuuuugagauggucucccuaugcacuccugacuguccuggaauuugcuacguagacuaaauuugccucaaacucaccuaacucugccuccugagugcugggauugaaggugugcaaccacuuugcccagcuaaaguauuucuuuuuaaagaauuacguauuuauuuuauauauaugaguacacuauagcugucuucagacacaccagaagagggcaucagauuucauuacagaugguuguaagccaccaugugguugcugagaauugaacucaggaccucuggaagagcagucagugcucuuaaccucugagccaucucuccagcccuaaaguauuuuuaaaggaaaaaaaaauauuccagcuaugguaauccuguaaucacagcacugggagggaugaggcaggagggucaugauuuagaggccaaccuggucuacacauauugagguccaggccaucagagcuaugcagugagaccuugucucaaaaacaaacaaacaaacaaacaauuuucugaauccaaauaucacuaaaugcaagaauuugcagucccaaaucuguugguccaguugucaugggcaggcaggguggcccaugaacucacgaggugcucuagggauucauagccuguguguccuugggaauuuauaguuucacuuacugaaacauuuucaagauaauuuuuguggacuuacaggcagcccucugaaagagcacacgguggcccucuggacguuuuagccaugcuuucugaaugaugacauuccaccccuuuuugguggcagagcagaagacagaacggagagccucgcacacgcuggcccucagucccaccuggaauaacucuaucuuacacuccccuuccccaucaagugucugugcucuagcucuuguuuc

SEQ ID NO: 10202 - RNA, 2501 nt, Mus musculus
gaaacaagagcuagagcacagacacuugauggggaaggggaguguaagauagaguuauuccaggugggacugagggccagcgugugcgaggcucuccguucugucuucugcucugccaccaaaaagggguggaaugucaucauucagaaagcauggcuaaaacguccagagggccaccgugugcucuuucagagggcugccuguaaguccacaaaaauuaucuugaaaauguuucaguaagugaaacuauaaauucccaaggacacacaggcuaugaaucccuagagcaccucgugaguucaugggccacccugccugcccaugacaacuggaccaacagauuugggacugcaaauucuugcauuuagugauauuuggauucagaaaauuguuuguuuguuuguuuguuuuugagacaaggucucacugcauagcucugauggccuggaccucaauauguguagaccagguuggccucuaaaucaugacccuccugccucaucccucccagugcugugauuacaggauuaccauagcuggaauauuuuuuuuuccuuuaaaaauacuuuagggcuggagagauggcucagagguuaagagcacugacugcucuuccagagguccugaguucaauucucagcaaccacaugguggcuuacaaccaucuguaaugaaaucugaugcccucuucuggugugucugaagacagcuauaguguacucauauauauaaaauaaauacguaauucuuuaaaaagaaauacuuuagcugggcaaagugguugcacaccuucaaucccagcacucaggaggcagaguuaggugaguuugaggcaaauuuagucuacguagcaaauuccaggacagucaggagugcauagggagaccaucucaaaaacaaaacaagacuuguuuuaaacguauggguguucucucugcgccaugugaaugaaugccuggagcccaagaagccagaauacaguguuggaugaauuaaguacgguuuugagcugccauguggggacugcgaaucgaacccguguucucugcaagaguaaccagggcucuccaggcccccgcccuuuuuucggucuucuuggucuugaaauucccaauccuucugccuccgcaucccuaguacuggguggcggcaggugugcaucaucacgaacccagcuucccuguccugcuuuggaagccaaacugacccccacuccggacagccccgccuccagcucuuaccugucucccuucccccggguuugcccagcccagcccagccuggcacucaccagccgccgaaacaaccgcugcagcugcgccgcguccucgcggagccuccccgccacacggcugcggguccucgcagagcgacagcgcaggcgcccgcggagcaguggccgcacauacuccaccagcgcccgucggugcagcucagccaccagaaccuggggacggugggagacccggacacgcucuagaccgcucccaaccaguaggcuuucgggaggaccccuguuucaagcucugcccacacaggcggaacacuccuaauacaugugggaacccucuguuccucacggagugcccggcuccuuuaaagucagacucucuacggauccccucauccuaacagauccuuaaucggaucccacacacaccacucucccuaaggugugccacaaccuaggcuuucccaaagucuucccugcagaggcuccaaccugaaccugcaccccgguuucuagggccaugcuucccucugcaggccccagaugaggagccaccuaugugcuuccagaaaagcgacuccccacuugguagggucucccccaggacaauagcucucugagcaucucugucccccucccaucugaucaccugguacgguucauccugcauucugcgcagggccagggccugggcgccgagugugcccacgaugccauccagagcuucugaacugcucagccacuuccugcgcaucagcuuguugaagugaggcugguaggacagcgcagaagggaggguuucaaccuccucccuccacccucccacacuucucuuaggaaaaucuccccccaccuaucccuuuugaugcuggcaguacaggcuggccuugaacucuugaucgucuugccuccaucucccaaauccugggauuacaggugugugccacuuuaaacucuucccaaaggaauacaaaggcccugugauggugauggugauggugaugguugaggacuuagcuccccaacugcugggauuuacguacugucagggcacauucacagugguggcagugauuuaggaggcagaggcaggcagauuucugaguuugaggccagccuggucuacagagugaguuccaggacagccagggcuauacagagaaacccugucucgaaaaaacaaaaacaaaaacaaaagcaauuggcuuccuggagggggagauccacaguucaggacugaggauguuagcuggcgauaguguagaguucu

SEQ ID NO: 10203 - RNA, 2501 nt, Mus musculus
cugaccacagugacuccacccccuuuccucccuguucauuccccaggcuacuuggcgauuuuacauccuaugacuucauguuaucuauauaaaacucuaggauccacaaaugaguaguguuuccguuucuggcuuguuucuuguuuucauggauggauaaaaucgaccccauauauaccacauuuuaaccauucauucgucugcagagggacacuugggcucguucuguaagguggcaauacugagugaugcugcacucugugcagauguuuggcaucuacgugguccucuggguguacauccauagcugggucaucuuacacgcguucucacgaccggccaggaagaacacaacaaaccggaaucuucugcggcaaaagcuuuauugcuuacaucuucaggagccagagagcaagagagcaagagcucuauugcuuacaucuucaggagccagagcgcaagagagcaagagcucuauugcuuacaucuuuaggagcaagagagcaagagccagagcaagagagagaauggcgaaaccccauccccuuuaaggagaauuauccuccgccuaggacgugucacucccugauuggcugcagcccaucggccgaguugucgacucggugaaggcagagcacauggaguggagaacuacccuuggcacaugcgcagauuauuuguuuaccacuuagaacacaggaugucagcgccaucuuguaacggcgagugugagggcggcuucccacagggucauaugaugguucuaguucuaggcuuuccagaaaccucucuauauugacuccauagaagcugaacgaauuuacaucccuaccagucaucguguguacauauuuccuucccucgcgccccugcauccuacccaccauuuauuuuauugauagccauugcgccuugcaugagauagaugggcaaaggaugcuuacgauuuucguguuuacuggccauugguacauuuauguucuauucauucuauuuuuuugacacagagucucacugugugagcucuggccugccagaaacucacucaauagaccaggcuggccucaaacucacagagaucugccugccugccucugccuccugagugcugggauucaaggcaagcacagccacgccccgcucaucucuuuugaucaucuuuauucuuugagaugaaauccaucaagucccauguacccuguagcugcugcaagagucugccggauucaaggggcagcuucuccaguguggguguggcagcccgccggucacuggcauaagaccguggcuucuagauucaggaagcugacuugcaucuucaccuccaauucgaggcucuuccaggucuugacgaaguccucgaaggugaugcccucauacugcuggcccgccaucagcggcugguccgacgcccuggccgccuccuucaaggcgcccugggcgauggcauuggcgacggagcgcacagugucucucuccacuugcgggugcgccgacagcaggcucuccaccacccggcgguacuccugcaggguaaugaucccaucgccguccuggucguacauguugaagaggaaccgcaucuuguccuugcgguucugcuccgccuccucuuuguugagacugggccgcagcggccggaaguaggagaugauggucaggaaguccuggaaggugaucuccuccgccagaccgcuggucccuuugcccagguuccgguugucgaagaaggcgcggacgauccuggagcggaucggauugaacuccaaguccaggauguugucgaagcucucuggcuguagggugggcugguccccgcucagcagccugaaccucuggugcagcugcuugaucugcucccagcugaagucgcacuuguucaacaccuccuggaugugcgcccaccauaagucgguccugcucucgcgcucccacuccuccuuggacgaaagggaggcgcccauggugccccgugugcucggaacgaccucaggcgcucaguggaaggguucgggcuuccuggucggucucaccuugcugccguucugauuuauuaggucaucaaagcaaccucuguuagggcagguccgucacaauccccgaaggcucuuuccucuccaaauucagugaaaugaagcauauugaaauaaauauuauauauguguuguauauuacgcauugcguauuauagauugcauauuauauauuauguuacauguuacaucuauuaugugucauauguuuauuauauauuuuauacauuauauaauuuuauauauaugaaaagagagagcacgcuuugguuuuccuaggacaaccaaagauacgugucuuugucuuacaaaagaugcuaaaauggccagugaugccaacauucaggagguaggggcaggagaaucucugugaguuugagcacaacaugaucugcacaguugaguuccaagucauucaagggaaggauggagaggggaggggaggggaggggaggggaggggagggga

SEQ ID NO: 10204 - RNA, 2501 nt, Mus musculus
uccccuccccuccccuccccuccccuccccuccccucuccauccuucccuugaaugacuuggaacucaacugugcagaucauguugugcucaaacucacagagauucuccugccccuaccuccugaauguuggcaucacuggccauuuuagcaucuuuuguaagacaaagacacguaucuuugguuguccuaggaaaaccaaagcgugcucucucuuuucauauauauaaaauuauauaauguauaaaauauauaauaaacauaugacacauaauagauguaacauguaacauaauauauaauaugcaaucuauaauacgcaaugcguaauauacaacacauauauaauauuuauuucaauaugcuucauuucacugaauuuggagaggaaagagccuucggggauugugacggaccugcccuaacagagguugcuuugaugaccuaauaaaucagaacggcagcaaggugagaccgaccaggaagcccgaacccuuccacugagcgccugaggucguuccgagcacacggggcaccaugggcgccucccuuucguccaaggaggagugggagcgcgagagcaggaccgacuuauggugggcgcacauccaggagguguugaacaagugcgacuucagcugggagcagaucaagcagcugcaccagagguucaggcugcugagcggggaccagcccacccuacagccagagagcuucgacaacauccuggacuuggaguucaauccgauccgcuccaggaucguccgcgccuucuucgacaaccggaaccugggcaaagggaccagcggucuggcggaggagaucaccuuccaggacuuccugaccaucaucuccuacuuccggccgcugcggcccagucucaacaaagaggaggcggagcagaaccgcaaggacaagaugcgguuccucuucaacauguacgaccaggacggcgaugggaucauuacccugcaggaguaccgccgggugguggagagccugcugucggcgcacccgcaaguggagagagacacugugcgcuccgucgccaaugccaucgcccagggcgccuugaaggaggcggccagggcgucggaccagccgcugauggcgggccagcaguaugagggcaucaccuucgaggacuucgucaagaccuggaagagccucgaauuggaggugaagaugcaagucagcuuccugaaucuagaagccacggucuuaugccagugaccggcgggcugccacacccacacuggagaagcugccccuugaauccggcagacucuugcagcagcuacaggguacaugggacuugauggauuucaucucaaagaauaaagaugaucaaaagagaugagcggggcguggcugugcuugccuugaaucccagcacucaggaggcagaggcaggcaggcagaucucugugaguuugaggccagccuggucuauugagugaguuucuggcaggccagagcucacacagugagacucugugucaaaaaaauagaaugaauagaacauaaauguaccaauggccaguaaacacgaaaaucguaagcauccuuugcccaucuaucucaugcaaggcgcaauggcuaucaauaaaauaaaugguggguaggaugcaggggcgcgagggaaggaaauauguacacacgaugacugguagggauguaaauucguucagcuucuauggagucaauauagagagguuucuggaaagccuagaacuagaaccaucauaugacccugugggaagccgcccucacacucgccguuacaagauggcgcugacauccuguguucuaagugguaaacaaauaaucugcgcaugugccaaggguaguucuccacuccaugugcucugccuucaccgagucgacaacucggccgaugggcugcagccaaucagggagugacacguccuaggcggaggauaauucuccuuaaaggggaugggguuucgccauucucucucuugcucuggcucuugcucucuugcuccuaaagauguaagcaauagagcucuugcucucuugcgcucuggcuccugaagauguaagcaauagagcucuugcucucuugcucucuggcuccugaagauguaagcaauaaagcuuuugccgcagaagauuccgguuuguuguguucuuccuggccggucgugagaacgcguguaagaugacccagcuauggauguacacccagaggaccacguagaugccaaacaucugcacagagugcagcaucacucaguauugccaccuuacagaacgagcccaagugucccucugcagacgaaugaaugguuaaaaugugguauauauggggucgauuuuauccauccaugaaaacaagaaacaagccagaaacggaaacacuacucauuuguggauccuagaguuuuauauagauaacaugaagucauaggauguaaaaucgccaaguagccuggggaaugaacagggaggaaaggggguggagucacuguggucag

SEQ ID NO: 10205 - RNA, 2501 nt, Mus musculus
caaggaccaaggaccaagaauguccuuacucucggauuuucaguucccgcgccaucugacagagggcgcagggcaggcaaaaggugagggcagcccagucgugcccgacggagcccuggagggugggaaagagagaaaucgagaaaggucaggagcuuuguucuggggugccagguggcgguccccagucucaauccccgcaguccccagucucaaucccuguggucugggauuggcgcgcaccuggaugugguagcgcucccucaugccggugcgcagagagugcagaccuccgggcagguagggcgcacagcagcacuccccaaagucaucggagaugcggcaggccaggcacagcggggcgaaagugccgcacagaccuggacagggcagaacggucaggucccgggccugcuguguuugcccccgaggagggcacgcacgguggcacggaggggaugcgggcuucaggagaacaguuauagagaaggaaaccaagacccaaagcgaucgggcucuggguggggugggugggggucaccgugaggaggcugaggguuggauaaugggaucccaggcagagugaagacugcaggaguguggcgugaguuucccucccuccccaucuuccucggacacucacagacgggcaugucguugcaacagucggugaggcccgugugccaaucgcugagcugugucugguagcagguguuggcgcacugaggcugacuagucacuggauaugacauggcuguggagguaagagaagggggaucaacaggcauccuggcaggaccuucugagccgcgccaccccugccgcccuuccuucugccgggcagucugggcaggccaccuggccgcccacuagaggaaacaucacuguaccuccuccccauuccuaucugucacauuuggucaucaacaccccuagucugucucugcugcuguugccaacuacacaucugguugagccaaagucaggagggaaagugggcaccacagcugggcagagccucgacuuggcuacacauaccaccaccuccuccuccaugacugggcuccaacauuuccuggggccucugggguagaagcaagugccauuuguuuucgaagccagggugcccaggguagggaggcagccagguuccuggcaccuagaggguugcuggugcauucagugaccccaccuuugccuuucacguggucgugcaucucaaacugcaucuugcuggcccugaggagguggcugcugugugaacggcugcaggggacggcuacggcaacagcaauguagucuguccaagggaugcuggauacuaggcaggggagggcaagggacuagggcacugggggagacgaacucucagggggggaagggagcugaagagaaagaggccaaguuaaccuguuggcugggauggcuaggugggcgaacuacucgcccaucguuuuaacagcugcccgacagaccccagaggacccuucuuggagcagaggcagaguuggagagagacaaauccuugucuagggagagcaaaggcagccaggaauggcagagacagaugggaaagaacucugagccaggugcucgcagagacacugugagacagccacaagcguggaacaugguaccucuacaagcugauuuuacagagggcuauaggcucagagacagaagagaaaugccugaugauggacccauccaaacaggcucugagacugggugcugggccccagaauuucuaaauccaacucuguaccagucagguuggaaaggugagacuggggaagugaagcguugagaaagaguaagaugaucccagucagcggcagucagucagaggcagucagggagacagagcugugagccagauaggcagagaaccgagcggaggugccugccagagagcagggacuuagggaggagaugguccuaccugcagauccacgugaggggauggagauagagguucuuggugacagcagacacuaaguucucagugugaggccaggagcugcuuauaugggccaggccacacagcccugggcggggcucugacagagaugccaagggagacuagccggucugccugacccucuucccuucccccuggauuuuccauccucccucuccucucuguuccccacaccccacuuccccucuugucucaucucucaggacugaagaccugcggcagagguagaaacaagagugggaagagauagaaacagagucagagauggagaauguacaggaagaaggagacuggggaagagggagcagggacccagggcaggggagauagggaagaugagugacuggagaugggaauugagaggauggagacagguagacacagauguugagagacagaaaacugcaagaucuggagaggcagggagagagugagggguuagggagggaugccugguguguuauacagagugggagcggguuccuccccaguguucgguucaaggcccggaggcaugggg

SEQ ID NO: 10206 - RNA, 2501 nt, Mus musculus
ccccaugccuccgggccuugaaccgaacacuggggaggaacccgcucccacucuguauaacacaccaggcaucccucccuaaccccucacucucucccugccucuccagaucuugcaguuuucugucucucaacaucugugucuaccugucuccauccucucaauucccaucuccagucacucaucuucccuaucuccccugcccugggucccugcucccucuuccccagucuccuucuuccuguacauucuccaucucugacucuguuucuaucucuucccacucuuguuucuaccucugccgcaggucuucaguccugagagaugagacaagaggggaagugggguguggggaacagagaggagagggaggauggaaaauccagggggaagggaagagggucaggcagaccggcuagucucccuuggcaucucugucagagccccgcccagggcuguguggccuggcccauauaagcagcuccuggccucacacugagaacuuagugucugcugucaccaagaaccucuaucuccauccccucacguggaucugcagguaggaccaucuccucccuaagucccugcucucuggcaggcaccuccgcucgguucucugccuaucuggcucacagcucugucucccugacugccucugacugacugccgcugacugggaucaucuuacucuuucucaacgcuucacuuccccagucucaccuuuccaaccugacugguacagaguuggauuuagaaauucuggggcccagcacccagucucagagccuguuuggauggguccaucaucaggcauuucucuucugucucugagccuauagcccucuguaaaaucagcuuguagagguaccauguuccacgcuuguggcugucucacagugucucugcgagcaccuggcucagaguucuuucccaucugucucugccauuccuggcugccuuugcucucccuagacaaggauuugucucucuccaacucugccucugcuccaagaaggguccucuggggucugucgggcagcuguuaaaacgaugggcgaguaguucgcccaccuagccaucccagccaacagguuaacuuggccucuuucucuucagcucccuucccccccugagaguucgucucccccagugcccuagucccuugcccuccccugccuaguauccagcaucccuuggacagacuacauugcuguugccguagccguccccugcagccguucacacagcagccaccuccucagggccagcaagaugcaguuugagaugcacgaccacgugaaaggcaaagguggggucacugaaugcaccagcaacccucuaggugccaggaaccuggcugccucccuacccugggcacccuggcuucgaaaacaaauggcacuugcuucuaccccagaggccccaggaaauguuggagcccagucauggaggaggagguggugguauguguagccaagucgaggcucugcccagcuguggugcccacuuucccuccugacuuuggcucaaccagauguguaguuggcaacagcagcagagacagacuagggguguugaugaccaaaugugacagauaggaauggggaggagguacagugauguuuccucuagugggcggccagguggccugcccagacugcccggcagaaggaagggcggcagggguggcgcggcucagaagguccugccaggaugccuguugaucccccuucucuuaccuccacagccaugucauauccagugacuagucagccucagugcgccaacaccugcuaccagacacagcucagcgauuggcacacgggccucaccgacuguugcaacgacaugcccgucugugaguguccgaggaagauggggagggagggaaacucacgccacacuccugcagucuucacucugccugggaucccauuauccaacccucagccuccucacggugacccccacccaccccacccagagcccgaucgcuuugggucuugguuuccuucucuauaacuguucuccugaagcccgcauccccuccgugccaccgugcgugcccuccucgggggcaaacacagcaggcccgggaccugaccguucugcccuguccaggucugugcggcacuuucgccccgcugugccuggccugccgcaucuccgaugacuuuggggagugcugcugugcgcccuaccugcccggaggucugcacucucugcgcaccggcaugagggagcgcuaccacauccaggugcgcgccaaucccagaccacagggauugagacuggggacugcggggauugagacuggggaccgccaccuggcaccccagaacaaagcuccugaccuuucucgauuucucucuuucccacccuccagggcuccgucgggcacgacugggcugcccucaccuuuugccugcccugcgcccucugucagauggcgcgggaacugaaaauccgagaguaaggacauucuugguccuugguccuug

SEQ ID NO: 10207 - RNA, 2501 nt, Mus musculus
agcagggcccacuguuuggacugucgggggcacuuaauaaaagcguguauuucucauggguaaggugccuccuuguauccgcuaaagcucucagacgucggucuccuuauuucacucuccuugacacucucauccgcaaagucugccccugccuuucgcucuccaccgccuagguccccacuucuaauacaggacucuguuuucucacgaagucccaauuuuuccuuugacccuucaacaacucccaaauccaccggggcgcuuugguuggucaccggcuuuaguagugcuccgccgccaggaggcagcacccuggagguggggcgaggccggggugcccgcccccuccccgcagggcugaagggaccccccuuggagcccgcccacgcuaagaugaagacagugcccccccaugcccucccccuggggcugcccccgccccgcgcgcgcuuccuggguggggccggggcggcuucaaaacccccgccgccccagccggucccgccgccgccgccgcccuucgcgccccaggccgucccccuccuccucccgccgcggauccuccagacagccaggcccccggccggggcaggggggacgccccuucggggcacccccggcucugagccgcacucggagucggccuccgcugggagccggcaaaggagcagccgaggagccguccgaggccccagagucugagaccagccgccgccgcagggaggagggggaggaggagugggaggagggacgagcugguugagagaagaggaaaaaaguuuugagacuuuuccgcugcuacugcaagucagagacguggggacuucuuggcacugcgcugucucgcaaggaggcaggaccugaggacuccagacagcccugcucaccgucguggacacucgaucgcuacccggcguuccucagacgccccuauuccggaccagcccucgggagccacaaaccccgccucccgcgaagacuucaccccaaagcuggggcgcaccccuugcacgccgcccuccccccagccugccucuugagucccucgcaucccaggacccucucucccccgagaggcagaucucccucggaccugcuggcaguagcuccccuauuuaagaacacccacuuuuggaucucagagagcgcucaucucgauuuuuacccuggugguauacugagacaccuuggugucagagccucaccgcgacuccugcugcuuucucccucaaccucaaauuauucaggacuaucaccuaccuuuccuugggagaccccaccccacaagcccugcaggggcggggccuccgcaucccaccuuugccgaggguucccgcucuccgaagugccguggggcgccgccucccccaugccgcccucggggcugcggcuacugccgcuucugcucccacucccguggcuucuagugcugacgcccgggaggccagccgcgggacucuccaccugcaagaccaucgacauggagcuggugaaacggaagcgcaucgaagccauccguggccagauccuguccaaacuaaggcucgccagucccccaagccagggggagguaccgcccggcccgcugcccgaggcggugcucgcuuuguacaacagcacccgcgaccggguggcaggcgagagcgccgacccagagccggagcccgaagcggacuacuaugcuaaagaggucacccgcgugcuaaugguggaccgcaacaacggugagcuccgaggggccggggagccaggagggagcccccagggggcgccggagugcaggggucaccgggaggaaauuacccucagaggaaacuggcuggaggaaggggagcccugggggcaccgggacaacugugugggugucccaaagaggcuggcacuuucccguaccccaggugucuuugagaggaauagacagccugccaaagugauccucuccuagaaaagcaaggucguggggagaguccccucuagaagaggagcauuuggcagguuuuguuuuaaguuccccuaauggugccuaaaaaugcagggcucgcuggguggucucuuuccagaaagguagaacccagcucaagagaauggaagguguccaacauuucggaauggagaugcaauguggaaagccgaccccagaccgggucgugagauggagagaaaaccuaggggauggguacccuagaacugccaaauaaaaucucuagugggcuuacucucagaaagcgacaggcgcacgcuagagagugugaucuguggagucacuacgggguuacaagugaaaaaggaaagcgacguuguugggagaaggacucuagagaggagcagagagggugcggaaaaugagcccggaggugucacgaguguuuugcuugggggcguaaaagagcgcgcgagccggcaggcggagcccagugaaggaagcgagcgaguccucaagaaaucuagaauacugggucauugggaaggagucauaaaaaggggagacuggcuuaggaagg

SEQ ID NO: 10208 - RNA, 2501 nt, Mus musculus
ccuuccuaagccagucuccccuuuuuaugacuccuucccaaugacccaguauucuagauuucuugaggacucgcucgcuuccuucacugggcuccgccugccggcucgcgcgcucuuuuacgcccccaagcaaaacacucgugacaccuccgggcucauuuuccgcacccucucugcuccucucuagaguccuucucccaacaacgucgcuuuccuuuuucacuuguaaccccguagugacuccacagaucacacucucuagcgugcgccugucgcuuucugagaguaagcccacuagagauuuuauuuggcaguucuaggguacccauccccuagguuuucucuccaucucacgacccggucuggggucggcuuuccacauugcaucuccauuccgaaauguuggacaccuuccauucucuugagcuggguucuaccuuucuggaaagagaccacccagcgagcccugcauuuuuaggcaccauuaggggaacuuaaaacaaaaccugccaaaugcuccucuucuagaggggacucuccccacgaccuugcuuuucuaggagaggaucacuuuggcaggcugucuauuccucucaaagacaccugggguacgggaaagugccagccucuuugggacacccacacaguugucccggugcccccagggcuccccuuccuccagccaguuuccucugaggguaauuuccucccggugaccccugcacuccggcgcccccugggggcucccuccuggcuccccggccccucggagcucaccguuguugcgguccaccauuagcacgcgggugaccucuuuagcauaguaguccgcuucgggcuccggcucugggucggcgcucucgccugccacccggucgcgggugcuguuguacaaagcgagcaccgccucgggcagcgggccgggcgguaccucccccuggcuugggggacuggcgagccuuaguuuggacaggaucuggccacggauggcuucgaugcgcuuccguuucaccagcuccaugucgauggucuugcagguggagagucccgcggcuggccucccgggcgucagcacuagaagccacgggagugggagcagaagcggcaguagccgcagccccgagggcggcaugggggaggcggcgccccacggcacuucggagagcgggaacccucggcaaaggugggaugcggaggccccgccccugcagggcuugugggguggggucucccaaggaaagguaggugauaguccugaauaauuugagguugagggagaaagcagcaggagucgcggugaggcucugacaccaaggugucucaguauaccaccaggguaaaaaucgagaugagcgcucucugagauccaaaaguggguguucuuaaauaggggagcuacugccagcagguccgagggagaucugccucucgggggagagaggguccugggaugcgagggacucaagaggcaggcuggggggagggcggcgugcaaggggugcgccccagcuuuggggugaagucuucgcgggaggcgggguuuguggcucccgagggcugguccggaauaggggcgucugaggaacgccggguagcgaucgaguguccacgacggugagcagggcugucuggaguccucagguccugccuccuugcgagacagcgcagugccaagaaguccccacgucucugacuugcaguagcagcggaaaagucucaaaacuuuuuuccucuucucucaaccagcucgucccuccucccacuccuccucccccuccucccugcggcggcggcuggucucagacucuggggccucggacggcuccucggcugcuccuuugccggcucccagcggaggccgacuccgagugcggcucagagccgggggugccccgaaggggcguccccccugccccggccgggggccuggcugucuggaggauccgcggcgggaggaggagggggacggccuggggcgcgaagggcggcggcggcggcgggaccggcuggggcggcggggguuuugaagccgccccggccccacccaggaagcgcgcgcggggcgggggcagccccagggggagggcaugggggggcacugucuucaucuuagcgugggcgggcuccaaggggggucccuucagcccugcggggagggggcgggcaccccggccucgccccaccuccagggugcugccuccuggcggcggagcacuacuaaagccggugaccaaccaaagcgccccgguggauuugggaguuguugaagggucaaaggaaaaauugggacuucgugagaaaacagaguccuguauuagaaguggggaccuaggcgguggagagcgaaaggcaggggcagacuuugcggaugagagugucaaggagagugaaauaaggagaccgacgucugagagcuuuagcggauacaaggaggcaccuuacccaugagaaauacacgcuuuuauuaagugcccccgacaguccaaacagugggcccugcu

SEQ ID NO: 10209 - RNA, 2501 nt, Mus musculus
ccaagguucuagagagaaggugguccacggucagggcucugaaugggaggggcgggaugccuggcaggguucgaaaaggggaggggccugggagccugaguaaggaaggagguuuggacgcugaaggaacugagagggugcgucacggaaggggcgggcggguggaccuucugagccaucccaggaaagacagggucuuagaaagagaugcugccuggacuuagcaaggcggagcuuggacauaaauuuccuuagugacaggucaaauaagaggcucaaaaggaggagcuauguagcaaguguuugccauggguggggguccggggaggggcuuaagagagagggguguggcauuauaaagggguggggcuuaaugagaaggggccugccuacccacuaugaagaguuuucuguauuuuucuaagggugauccagguuugaagggcugcacucaagcuggcuugcagggggcagggccucgagcucggggcggggccuagaucucgggggucguccucgcugucucgcccacuugccuucacccgcacacccguucuuuucgguuauuuucugcuacggccguuccccgcccugccuugggcccacggggcagugaucugaucuuuggucggcuggaggagucggugaguuggguccacuuaagaggcggagcugggcggagcuuuaggaaagggguggagccuaaguuaagaucugucacaaacgccaagcgggaaaaguuuaagaggcuugaggauuuguugcuggcuaggaagagggagggauccaaaugaucgacacagagagacggugggugaucggaggguuaggacugaaggacuagggaacuaauuagaucacagucccagguauuuguuaggcagagacggaccugauccggggcggugaggggcgaggauauggccggauucuugacaaucaggagcgacuagagaauggggcggggccugguuagacuaguguugaaagagaagcgugaauucauuguuggcuauugggcauaaccaucauuacccaugugguuugaaacuuucaacagagaggcuggcgagacugacuccuggagccuggagaucccgggaguggcaaaaguguuagggaugugauccaagggaucaggguuggcgccuuuguacacuaagaaguuagguucgaagaguaagaacugcagccuugagaccauggggaagggggcgugaccauggcgaaucggagaacugaagacuuaagagccgggggcugagauaauauuggaggacagggcagaccaaugcagacaggggcaguccaagaacagccugagccguggaguccccgcagaacccgccgacugacuggugaaaguuuuuuuaaccacaguccccgaccuucuucaaaaauggggaacgugcagucggagccguccgcgggcggggguucccgaaaagagcaggccucagaccgcgccuccgacucccgcaggacgccucuaguggagcccgaggugacccccucauccccugccaugcgccuggcucgagggcugggcgucugguucccuggcaguuccgggcccccgggacuccugauacccccggagccccaggccucauccucgccccugccccugaccuuagaacugcccucgccagugacacccccuccagaggaggcggcugcggucuccacaccacccccgccccccguggggacccugcugccugcgccaucuaaguggcgaaaacccacgggcacuucagugccucggauccgcggucuucuggaggcgagccaucguggucagggugacccuccaagccuccgcccgcugccaccgcugccccggcaacugaccgaaaaagacccgguccugagggccccagccccaccuccgacgccccuggaaccucggaaacaacuaccgccagcaccaucaacuugcgauccgcagccccugagccgcagaaucacucuggccucgucggccacaagccccacagaaagucaggucagacacagcagcgagggucaggcggccgggggagcccacggagggguaccuccccaagcuggagagggcgaaauggcucggucugcuacuuccgagucuggccugagucugcuguguaaagucaccuucaagucggggccccauuugucccccacaucggccucgggucccuuagcagccaaagccucacccggggccggugguggcggacuguuugccucuucuggggccaucuccuaugcugagguccugaagcaagggccccaaccuccuggagccacucgucccuugggagaggucccuccuggagccacucgucccuugggagaggucccucgugcagcucaggaaaccgaggguggugacggagauggcgaaggguguucuggucccccuucggugccugcuccccuugcccgggcucuaccgccgcccccuuacaccaccuucccagguucaaagcccaaauucgacugggugagcccuccug

SEQ ID NO: 10210 - RNA, 2501 nt, Mus musculus
caggagggcucacccagucgaauuugggcuuugaaccugggaaggugguguaagggggcggcgguagagcccgggcaaggggagcaggcaccgaagggggaccagaacacccuucgccaucuccgucaccacccucgguuuccugagcugcacgagggaccucucccaagggacgaguggcuccaggagggaccucucccaagggacgaguggcuccaggagguuggggcccuugcuucaggaccucagcauaggagauggccccagaagaggcaaacaguccgccaccaccggccccgggugaggcuuuggcugcuaagggacccgaggccgaugugggggacaaauggggccccgacuugaaggugacuuuacacagcagacucaggccagacucggaaguagcagaccgagccauuucgcccucuccagcuuggggagguaccccuccgugggcucccccggccgccugacccucgcugcugugucugaccugacuuucuguggggcuuguggccgacgaggccagagugauucugcggcucaggggcugcggaucgcaaguugauggugcuggcgguaguuguuuccgagguuccaggggcgucggagguggggcuggggcccucaggaccgggucuuuuucggucaguugccggggcagcgguggcagcgggcggaggcuuggagggucacccugaccacgauggcucgccuccagaagaccgcggauccgaggcacugaagugcccguggguuuucgccacuuagauggcgcaggcagcaggguccccacggggggcgggggugguguggagaccgcagccgccuccucuggagggggugucacuggcgagggcaguucuaaggucaggggcaggggcgaggaugaggccuggggcuccggggguaucaggagucccgggggcccggaacugccagggaaccagacgcccagcccucgagccaggcgcauggcaggggaugagggggucaccucgggcuccacuagaggcguccugcgggagucggaggcgcggucugaggccugcucuuuucgggaacccccgcccgcggacggcuccgacugcacguuccccauuuuugaagaaggucggggacugugguuaaaaaaacuuucaccagucagucggcggguucugcggggacuccacggcucaggcuguucuuggacugccccugucugcauuggucugcccuguccuccaauauuaucucagcccccggcucuuaagucuucaguucuccgauucgccauggucacgcccccuuccccauggucucaaggcugcaguucuuacucuucgaaccuaacuucuuaguguacaaaggcgccaacccugaucccuuggaucacaucccuaacacuuuugccacucccgggaucuccaggcuccaggagucagucucgccagccucucuguugaaaguuucaaaccacauggguaaugaugguuaugcccaauagccaacaaugaauucacgcuucucuuucaacacuagucuaaccaggccccgccccauucucuagucgcuccugauugucaagaauccggccauauccucgccccucaccgccccggaucagguccgucucugccuaacaaauaccugggacugugaucuaauuaguucccuaguccuucaguccuaacccuccgaucacccaccgucucucugugucgaucauuuggaucccucccucuuccuagccagcaacaaauccucaagccucuuaaacuuuucccgcuuggcguuugugacagaucuuaacuuaggcuccaccccuuuccuaaagcuccgcccagcuccgccucuuaaguggacccaacucaccgacuccuccagccgaccaaagaucagaucacugccccgugggcccaaggcagggcggggaacggccguagcagaaaauaaccgaaaagaacgggugugcgggugaaggcaagugggcgagacagcgaggacgacccccgagaucuaggccccgccccgagcucgaggcccugcccccugcaagccagcuugagugcagcccuucaaaccuggaucacccuuagaaaaauacagaaaacucuucauaguggguaggcaggccccuucucauuaagccccaccccuuuauaaugccacaccccucucucuuaagccccuccccggacccccacccauggcaaacacuugcuacauagcuccuccuuuugagccucuuauuugaccugucacuaaggaaauuuauguccaagcuccgccuugcuaaguccaggcagcaucucuuucuaagacccugucuuuccugggauggcucagaagguccacccgcccgccccuuccgugacgcacccucucaguuccuucagcguccaaaccuccuuccuuacucaggcucccaggccccuccccuuuucgaacccugccaggcaucccgccccucccauucagagcccugaccguggaccaccuucucucuagaaccuugg

SEQ ID NO: 10211 - RNA, 2501 nt, Mus musculus
guaguuucugugauugugugacaucuggaauucuggggacuuuuaaaaagguauauauaaaugcuagggcccugagagguguggugggcuguuuguuggucacuguuggcugugguuuguuauguagucaugugcaaagcagaaacaacaagaaaguggauauccugacugugaagaucaaauuugcuccaaggaacucgaugcccuaaucagcaggaagcagucuaacaauaacgcugcccccuuucugaccccugccuucagccagggaucucuuuccucucuaucccuucuuugcccuuaucuaguguuagaggguugaaaaggguggaaaaaagaacccacaaaauagccaaagacagcuacauggccaggaagagcagauagagagaauugagucuuugucuggauuguguccuggggugaggauuuguucucgcugaguagggucacagucuagagaagagauaggagucccauucaugaguuuagguguuuuguuuuuugaaguacuaaggguugaacucaggaucucacgcaugcuaggcaaguguucuaccaccgagcuacaccucagcccuccucacuugagcugaaagagacccucacuaccaguccuuggugugaaaagggcaagagaaaaaaaaaaagaaagaaagaaagaagagaaaaaaaaaagaaaagaaaaaaaagaaaaaagaaaagagcaagagguuuugcuggagguaguuagggguaggagucucaacuuggaggauuucaagcgggacagccaaucagccaaugguucuuccuugaggacgcucuggguucgcgccauucuuacagcccgcuguaggagcugcugauccaggaaucugagucuagaguggaaaacauugggagaaucccaacaacucaggggagguguaaagauggguggaggagcccuguguuagaguaggaaguccaggagagggggggagggggggaccuucagucagucuguuaguccccggaccagggaucuugcuggagagugcccaaagcggaagggauccuagaaccggucucaggucaggcuaaggucucuuccuagaagacagaccuccaguaauguugcccugcuauuacugacuagcaugcaugaaggccugaguucaacucacaguucacuggggcacugaguucaggaggaaguuaaagugggcuguuccagaaaggaccuaucuggagccagaagacaaggcuggaagagauggugugccagcccuauuguaacacagcccccgagguuagacacccaaggaaagcccuaccaaggcccuugccaaucaucuaugauaauccuaggauuaagacaagagugagccaggcuggugacccacaccuguaaucccagcauuuaggaggcugagacaggaggaugaaauuccaagccaaccugcgccuaaagguacaugcuaucucaaaaccaaacaaaaaggcaccaaaggggaugcugucugagaaaguauuccaagggaacugggguguguaguacgagggcucuccaaaugaggcagcuguggccagugugggucaguugggaauggagguuguucugagagcaccaggacgauugggaugaagguguauguuaagggguccggacacuaucugggacugggugauggauagcacucacuuacccacgguggugacaagcgugcuggcgaagaagagcgccgaggcgaagucccacgcaggguccgaagcguuggcagcucccgaggcguuggcgagcgcugcgcgccccagccguccggccgccagcacccgcuccacgaaggcauccagggcgugagccgccacgcacgggcugugcuguagcagcugcucccgcaggguccccaguucugcccgcagccgggcuucgugaggccgcuccagccgcgccacaagcagcgcgcccagcgccagguacccggcguaggcggccagggcgcuagccaggagcgcgccccgccgcauggugcccguacagccccgacacccgcugacguggcccccgccggcccaccgcccgagguccgcuuuuaguuccgggagcuccaggcgcggccaccgacgccccgaagaggaagaggaaaaggaaaaagggggaggagcggggcuggcggaacgcccugacgcugggaaacugaggcacgcccaaacaccugguguagguacagggacaccggaggguggaguucgacgcuccgggaucggggagucaaaugggaugggaagggcugcggaguccuuuccugccugaaguuccuugcaacucuccuccucgcgacuccuuaacucagaucugaaacucuccuccgaagugggagcuuucuguuuguaaccuuuuuuuuuuuuuuuuuuuuuuucucgagacaggguuucucuguguagcccuggcuguccugucucacucuguagaccaggauggccuggaacuuagaaaucugccugccucugcacuguacccaguguuugcuugaggc

SEQ ID NO: 10212 - RNA, 2501 nt, Mus musculus
gccucaagcaaacacuggguacagugcagaggcaggcagauuucuaaguuccaggccauccuggucuacagagugagacaggacagccagggcuacacagagaaacccugucucgagaaaaaaaaaaaaaaaaaaaaaaagguuacaaacagaaagcucccacuucggaggagaguuucagaucugaguuaaggagucgcgaggaggagaguugcaaggaacuucaggcaggaaaggacuccgcagcccuucccaucccauuugacuccccgaucccggagcgucgaacuccacccuccggugucccuguaccuacaccagguguuugggcgugccucaguuucccagcgucagggcguuccgccagccccgcuccucccccuuuuuccuuuuccucuuccucuucggggcgucgguggccgcgccuggagcucccggaacuaaaagcggaccucgggcggugggccggcgggggccacgucagcgggugucggggcuguacgggcaccaugcggcggggcgcgcuccuggcuagcgcccuggccgccuacgccggguaccuggcgcugggcgcgcugcuuguggcgcggcuggagcggccucacgaagcccggcugcgggcagaacuggggacccugcgggagcagcugcuacagcacagcccgugcguggcggcucacgcccuggaugccuucguggagcgggugcuggcggccggacggcuggggcgcgcagcgcucgccaacgccucgggagcugccaacgcuucggacccugcgugggacuucgccucggcgcucuucuucgccagcacgcuugucaccaccguggguaagugagugcuauccaucacccagucccagauaguguccggaccccuuaacauacaccuucaucccaaucguccuggugcucucagaacaaccuccauucccaacugacccacacuggccacagcugccucauuuggagagcccucguacuacacaccccaguucccuuggaauacuuucucagacagcauccccuuuggugccuuuuuguuugguuuugagauagcauguaccuuuaggcgcagguuggcuuggaauuucauccuccugucucagccuccuaaaugcugggauuacaggugugggucaccagccuggcucacucuugucuuaauccuaggauuaucauagaugauuggcaagggccuugguagggcuuuccuugggugucuaaccucgggggcuguguuacaauagggcuggcacaccaucucuuccagccuugucuucuggcuccagauagguccuuucuggaacagcccacuuuaacuuccuccugaacucagugccccagugaacugugaguugaacucaggccuucaugcaugcuagucaguaauagcagggcaacauuacuggaggucugucuucuaggaagagaccuuagccugaccugagaccgguucuaggaucccuuccgcuuugggcacucuccagcaagaucccugguccggggacuaacagacugacugaaggucccccccucccccccucuccuggacuuccuacucuaacacagggcuccuccacccaucuuuacaccuccccugaguuguugggauucucccaauguuuuccacucuagacucagauuccuggaucagcagcuccuacagcgggcuguaagaauggcgcgaacccagagcguccucaaggaagaaccauuggcugauuggcugucccgcuugaaauccuccaaguugagacuccuaccccuaacuaccuccagcaaaaccucuugcucuuuucuuuuuucuuuuuuuucuuuucuuuuuuuuuucucuucuuucuuucuuucuuuuuuuuuuucucuugcccuuuucacaccaaggacugguagugagggucucuuucagcucaagugaggagggcugagguguagcucggugguagaacacuugccuagcaugcgugagauccugaguucaacccuuaguacuucaaaaaacaaaacaccuaaacucaugaaugggacuccuaucucuucucuagacugugacccuacucagcgagaacaaauccucaccccaggacacaauccagacaaagacucaauucucucuaucugcucuuccuggccauguagcugucuuuggcuauuuuguggguucuuuuuuccacccuuuucaacccucuaacacuagauaagggcaaagaagggauagagaggaaagagaucccuggcugaaggcaggggucagaaagggggcagcguuauuguuagacugcuuccugcugauuagggcaucgaguuccuuggagcaaauuugaucuucacagucaggauauccacuuucuuguuguuucugcuuugcacaugacuacauaacaaaccacagccaacagugaccaacaaacagcccaccacaccucucagggcccuagcauuuauauauaccuuuuuaaaaguccccagaauuccagaugucacacaaucacagaaacuac

SEQ ID NO: 10213 - RNA, 2501 nt, Mus musculus
agucagugcucuuaaccacugagccaucucuccagcccucgaucacuuuucuuaccugggacauugucacgaguagucgcagaagucugguccgcuguaaaaauggaugugggcuuuuuuggugucugcccuggggagauaaaggcugagaguucaggagggagucucucacccccuucuccugucuucugucccaccucgccagacccacugaagacccaggggaaucagcuuuaacugggucacucuacagucuugagugugacugaagucuuccuauugccgcaggaccuuugcacacccuugcaggacagccucauugagagugcagguguuugggguaaaccagggccuuggagcacauuccacucccgaccacuuccuccucgcuccgugaccugagccacucauuugccucaucugaaaagcacgagcuaguaaaggagcagggcucucugccccauagacagacagcuaaggagggaacgggcuugcuccucaugcuucaugggcuagacccugucuccucccccccccccccgagaugccuagcagccuuugcagccagaagucacccgugaacacccaugccaggacagacagacccugcaggcucagagcccacaauuuuuaccuggucccacaucuucuuaucgauuucaccccaacccagucuucuacugacucucagauucauugggcuuaucagcagcuccuucuucuucuugugccccaccccgccuugugugcucacugaacaacaguucucuccauccacaaaaugggcauggcgaggcacagaacagaacuaacugcccacccaccugggcacuuuuacaaguacuuuccaggccagagugagggucucugagccccagcuuggaccccuuugcccaacuguauucucagaaaacccaucaguucugcuuugccuggagccugggguuuccuggcggccgaguagaaaacugacaccaaucucccagccaagucaaacucagcaaguucuucucagaggugaaagggaggaugcucagcaggacaggcuccagucagacccucuggaucacccgagcucaaaaguguccaaagagggugcuacccagagccugccucgccaaucccacuuccuggugcucgcucacucgguggggguuggcgagggaguagagugagaagaugguacccaguauuugagcuuugcaaucacccaucuagcugccuccuggagcuggauuggggcgaggggugguggugguggugucuuaccucugcugggcagaaucagggcgacaauagugaggagacacaggcgacuggacagugacaucugugggacaagcugaggcaaagguaaggcauagccccuccgcacccucccacccccucgcagccucuuuggagcaggcgucuggucucaaggacccucugguaucugccuuuggggagagauuuuuuuuuccgucucaggccaccauccccuucuuccaggagcugauccccaaagaaagccagaagcaucaggcgagccuggcuuccugacaccccugaggcaaagaugccgcucccuccuccuaaagcuggaacugauccucccgacccaugguuccugaguggaggaagccaguggcccgcugugucugcucccucgagggcaggagcccagagcagcggggccaggaggggaacaggaagggugacuaacgcagggcugcucucaaaggaaaaagugagcugguguccggcugcccugcaggcaccaccgcgcccagcacccgugaugggcagaucauagagggaccugucugcccgcaauggaggcgcucuagggagacugaggcagaaaaggugcccacagagugaauacgaggcagagaggcaucgagauccuucucuucuccucccaagcagcuucccaccugcguguguggcccagagcaauagagcaaaagagggacuuacaucugagccggagaucuccagacugaagugucagaguaccgcgugggagcugccucaggguggaggguguggccacgggcgggcgcggacgcaggcaggcggggaccagagcgucccagucauuuccucucucguuuccaggccccacaggcaggggugggagcuggggaggaggaggauggugggggacugaaggcgguggccuccacucgaggaucugagggacgcagaugggggcaaggugcagagaagggaagacccuugggugagguguggaaggaaggauguaaugagagggaggagacccuggagggaggaggaggaggaagagaaggaggggggaguggggaggggggaaaaggacaaucaacucagccucccacccaguccucuggugcccacagacgacaauacacagacagaacggggggaaaaaacgaaugcacauuuauuaagcucaagauguggacccugaggggaagcugggaagguccuggagaaggagaccaggagaugcaggagggagggacacuaggauc

SEQ ID NO: 10214 - RNA, 2501 nt, Mus musculus
gauccuagugucccucccuccugcaucuccuggucuccuucuccaggaccuucccagcuuccccucaggguccacaucuugagcuuaauaaaugugcauucguuuuuuccccccguucugucuguguauugucgucugugggcaccagaggacugggugggaggcugaguugauuguccuuuuccccccuccccacuccccccuccuucucuuccuccuccuccucccuccagggucuccucccucucauuacauccuuccuuccacaccucacccaagggucuucccuucucugcaccuugcccccaucugcgucccucagauccucgaguggaggccaccgccuucagucccccaccauccuccuccuccccagcucccaccccugccuguggggccuggaaacgagagaggaaaugacugggacgcucugguccccgccugccugcguccgcgcccgcccguggccacacccuccacccugaggcagcucccacgcgguacucugacacuucagucuggagaucuccggcucagauguaagucccucuuuugcucuauugcucugggccacacacgcaggugggaagcugcuugggaggagaagagaaggaucucgaugccucucugccucguauucacucugugggcaccuuuucugccucagucucccuagagcgccuccauugcgggcagacaggucccucuaugaucugcccaucacgggugcugggcgcgguggugccugcagggcagccggacaccagcucacuuuuuccuuugagagcagcccugcguuagucacccuuccuguuccccuccuggccccgcugcucugggcuccugcccucgagggagcagacacagcgggccacuggcuuccuccacucaggaaccaugggucgggaggaucaguuccagcuuuaggaggagggagcggcaucuuugccucaggggugucaggaagccaggcucgccugaugcuucuggcuuucuuuggggaucagcuccuggaagaaggggaugguggccugagacggaaaaaaaaaucucuccccaaaggcagauaccagaggguccuugagaccagacgccugcuccaaagaggcugcgagggggugggagggugcggaggggcuaugccuuaccuuugccucagcuugucccacagaugucacuguccagucgccugugucuccucacuauugucgcccugauucugcccagcagagguaagacaccaccaccaccaccccucgccccaauccagcuccaggaggcagcuagaugggugauugcaaagcucaaauacuggguaccaucuucucacucuacucccucgccaacccccaccgagugagcgagcaccaggaagugggauuggcgaggcaggcucuggguagcacccucuuuggacacuuuugagcucgggugauccagagggucugacuggagccuguccugcugagcauccucccuuucaccucugagaagaacuugcugaguuugacuuggcugggagauuggugucaguuuucuacucggccgccaggaaaccccaggcuccaggcaaagcagaacugauggguuuucugagaauacaguugggcaaagggguccaagcuggggcucagagacccucacucuggccuggaaaguacuuguaaaagugcccaggugggugggcaguuaguucuguucugugccucgccaugcccauuuuguggauggagagaacuguuguucagugagcacacaaggcgggguggggcacaagaagaagaaggagcugcugauaagcccaaugaaucugagagucaguagaagacuggguuggggugaaaucgauaagaagaugugggaccagguaaaaauugugggcucugagccugcagggucugucuguccuggcauggguguucacgggugacuucuggcugcaaaggcugcuaggcaucucgggggggggggggaggagacagggucuagcccaugaagcaugaggagcaagcccguucccuccuuagcugucugucuauggggcagagagcccugcuccuuuacuagcucgugcuuuucagaugaggcaaaugaguggcucaggucacggagcgaggaggaaguggucgggaguggaaugugcuccaaggcccugguuuaccccaaacaccugcacucucaaugaggcuguccugcaagggugugcaaagguccugcggcaauaggaagacuucagucacacucaagacuguagagugacccaguuaaagcugauuccccugggucuucagugggucuggcgaggugggacagaagacaggagaagggggugagagacucccuccugaacucucagccuuuaucuccccagggcagacaccaaaaaagcccacauccauuuuuacagcggaccagacuucugcgacuacucgugacaaugucccagguaagaaaagugaucgagggcuggagagauggcucagugguuaagagcacugacu

SEQ ID NO: 10215 - RNA, 2501 nt, Mus musculus
ccgcgccgcggcucuccgccacagccuuuuagaaauccgggugggagacaggccuagucccagcuuuuaacacaagucugcacuacgguagcucaaaaccaacauucucucuccaaacgcuccccaaccuccaccuccccucgcucggccucuagaugcucccgggcucccuaguguuggcuggaagugggugacuuagaggcuuaaaggaggggcgccuaaccacggaccacgugugugcgggggcgacagcgccgccgggguggggcugagcgcugcaagccggguucgccuugcagcgcaggagucagugggcguugcgccacgaucucucuccacuagcacuaugcuccccacucaccgccuuggaaagucacaggagaaggcgggcucuaagacccagcaggcaccauccuacuggcgccuucgauccgagacccguuuggacaccagggggcgaugcccgacccucuauaaaagcgguccccgcgcgggccuggccauucgcgacccgaagcugcgcgggcgcgagccaguuggggcacugggugggcggcggcgacagcggcgccacgcgcaggcuggaggccgccgaggcucgccaugccgggagaacucuaacucccccauggagucggccgacuucuacgagguggagccgcggcccccgaugagcagucaccuccagagccccccgcacgcgcccagcaacgccgccuuuggcuuuccccggggcgcgggccccgcgccgcccccagccccaccugccgccccggagccgcugggcggcaucugcgagcacgagacgucuauagacaucagcgccuacaucgacccggccgccuucaacgacgaguuccuggccgaccucuuccagcacagccgacagcaggagaaggccaaggcggcggcgggccccgcggguggcggcggugacuuugacuacccgggagccccggcgggccccggcggcgcggucauguccgcgggggcgcacgggcccccucccggcuacggcugugcggcggccggcuaccuggacggcaggcuggagccccuguacgagcgcgucggggcgcccgcgcuacggccgcuggugaucaaacaagagccccgcgaggaggacgaggcgaagcagcuggcgcuggccggccucuuccccuaccagccaccgccgccaccgccaccgccgcacccgcacgcgucucccgcgcaccuggccgccccccacuugcaguuccagaucgcgcacugcggccagaccaccaugcaccugcagccuggccaccccacaccgccgcccacgcccgugcccagcccgcacgcugcgcccgccuugggugcugcgggccugccuggccccgggagcgcgcucaagggcuuggccggugcgcaccccgaccuccgcacgggaggcggcggcgguggcagcggugccggugcgggcaaagccaagaagucgguggacaagaacagcaacgaguaccggguacggcgggaacgcaacaacaucgcggugcgcaagagccgagauaaagccaaacaacgcaacguggagacgcaacagaaggugcuggaguugaccagugacaaugaccgccugcgcaagcggguggaacagcugagccgugaacuggacacgcugcggggcaucuuccgccagcugccugagagcuccuuggucaaggccaugggcaacugcgcgugaggcgcgcggcugcgggaccgccuugggccggcccccuggcuggagacccagaggaugguuucgggucgcuggaucucuaggcugcccgggccgcgcaagccaggacuaggagauuccgguguggccugaaagccuggccugcuccgcguguccccucccuuccucugagccggacucggugcgucuaagaugagggagucaggccguggugguuucuccuugagaccgagagacuuuccgcggagcugagcugggggcccggcaguacuaguauuaaggaaguaaccuugugccuuggauacucaaaacucgcuccuuuuccuaccgaguagggggagcaaaaaugugccuugauauuuuauuuggaggauuccugcuuccucucgggccucagcuggccccgugagaaaaaugaagggugcaggcccagggcaggaggaagauacaggaagcugagaucccggcagugcccugagcugccccucagucccugucuuuagaggggagggacuuagguguuggggauuugagucuguguccucacccccagcuacagggagguggagggcuccuaaucccuugcuuuuugcaccuccaccuacauccccccccccccacucagcuuacaacaggccagguuuccugggugaguucauggagaaugggggcaccacccccagucagaccagaaagcugaguugugaguuagccaugugguaggagacagagaccuagguuucugggcuuuguggggugggggauaggaggacacggggaccauuagccuugugug

SEQ ID NO: 10216 - RNA, 2501 nt, Mus musculus
cacacaaggcuaaugguccccguguccuccuaucccccaccccacaaagcccagaaaccuaggucucugucuccuaccacauggcuaacucacaacucagcuuucuggucugacuggggguggugcccccauucuccaugaacucacccaggaaaccuggccuguuguaagcugaguggggggggggggauguagguggaggugcaaaaagcaagggauuaggagcccuccaccucccuguagcugggggugaggacacagacucaaauccccaacaccuaagucccuccccucuaaagacagggacugaggggcagcucagggcacugccgggaucucagcuuccuguaucuuccuccugcccugggccugcacccuucauuuuucucacggggccagcugaggcccgagaggaagcaggaauccuccaaauaaaauaucaaggcacauuuuugcucccccuacucgguaggaaaaggagcgaguuuugaguauccaaggcacaagguuacuuccuuaauacuaguacugccgggcccccagcucagcuccgcggaaagucucucggucucaaggagaaaccaccacggccugacucccucaucuuagacgcaccgaguccggcucagaggaagggaggggacacgcggagcaggccaggcuuucaggccacaccggaaucuccuaguccuggcuugcgcggcccgggcagccuagagauccagcgacccgaaaccauccucugggucuccagccagggggccggcccaaggcggucccgcagccgcgcgccucacgcgcaguugcccauggccuugaccaaggagcucucaggcagcuggcggaagaugccccgcagcguguccaguucacggcucagcuguuccacccgcuugcgcaggcggucauugucacuggucaacuccagcaccuucuguugcgucuccacguugcguuguuuggcuuuaucucggcucuugcgcaccgcgauguuguugcguucccgccguacccgguacucguugcuguucuuguccaccgacuucuuggcuuugcccgcaccggcaccgcugccaccgccgccgccucccgugcggaggucggggugcgcaccggccaagcccuugagcgcgcucccggggccaggcaggcccgcagcacccaaggcgggcgcagcgugcgggcugggcacgggcgugggcggcggugugggguggccaggcugcaggugcaugguggucuggccgcagugcgcgaucuggaacugcaaguggggggcggccaggugcgcgggagacgcgugcgggugcggcgguggcgguggcggcgguggcugguaggggaagaggccggccagcgccagcugcuucgccucguccuccucgcggggcucuuguuugaucaccagcggccguagcgcgggcgccccgacgcgcucguacaggggcuccagccugccguccagguagccggccgccgcacagccguagccgggagggggcccgugcgcccccgcggacaugaccgcgccgccggggcccgccggggcucccggguagucaaagucaccgccgccacccgcggggcccgccgccgccuuggccuucuccugcugucggcugugcuggaagaggucggccaggaacucgucguugaaggcggccgggucgauguaggcgcugaugucuauagacgucucgugcucgcagaugccgcccagcggcuccggggcggcagguggggcugggggcggcgcggggcccgcgccccggggaaagccaaaggcggcguugcugggcgcgugcggggggcucuggaggugacugcucaucgggggccgcggcuccaccucguagaagucggccgacuccaugggggaguuagaguucucccggcauggcgagccucggcggccuccagccugcgcguggcgccgcugucgccgccgcccacccagugccccaacuggcucgcgcccgcgcagcuucgggucgcgaauggccaggcccgcgcggggaccgcuuuuauagagggucgggcaucgcccccugguguccaaacgggucucggaucgaaggcgccaguaggauggugccugcugggucuuagagcccgccuucuccugugacuuuccaaggcggugaguggggagcauagugcuaguggagagagaucguggcgcaacgcccacugacuccugcgcugcaaggcgaacccggcuugcagcgcucagccccaccccggcggcgcugucgcccccgcacacacgugguccgugguuaggcgccccuccuuuaagccucuaagucacccacuuccagccaacacuagggagcccgggagcaucuagaggccgagcgaggggagguggagguuggggagcguuuggagagagaauguugguuuugagcuaccguagugcagacuuguguuaaaagcugggacuaggccugucucccacccggauuucuaaaaggcuguggcggagagccgcggcgcgg

SEQ ID NO: 10217 - RNA, 2501 nt, Mus musculus
cucccuacagaucucaucccacuccaggcuuccucagccccgcccuuauauaauggaagcuccgccuccuuuccaucccagauuguggaaaagacaacacuagcauuagguuugcuacuguggcugcuuugagaccuucuagcccuuuuacuuccggcucugcccccacguuuauguucccggaucacacuugaauaauuucacugcuaucucaagcucuuuuccaaauucaccucugccuauguccaccugauuaguucuggcccacaucuaaagccucguccaagcucagauuuauguuauuucaacuuggauauuacacaagcuauguccuugacuggaaaaagaaaaaaaggaaaaaucuugguuuggucuguggcuuaccugaaacccuguccuuugcucuauuguaauugggaacacaccuaauuuagcugcuucuuggcccugccuagaccccauacaggucuguccacaaacaggaggcagucaccccuacacuuggggauauucagggaggggauacugagguaagcaagcaaguagaacugagcuucuaggcagcagcgccuguagcuaaagugguagggcaggcccuagcaacauagaaggguggagcuccacugagcucugauugguagauuugggcagagggcggggcaucuuguugcugauuggcuaaggagcuaagucuaugggugcugauugguagaggguagagucuggggggcaucuaguuugauguguauuuugacccacagaaagcccaguucaacugggauccagagacugucggccucauacauggcuccuuuuucuggggcuacauugucacucagauuccuggaggauuuaucugccaaaaauucgcagccaacagguaccguuguagugucucaagguggcagaaauuggaguugugugugguggagcuagaggguguggccuuggguuuggcucugggaaauugggaggguccuuguuugagggcauaucuuggaggcagccucuaguucuguuauacacagggccugauguaggcagggaggggaaaauccuaggagcagcgggaaggcuggauggcuagcgccacacgaacaccucacuauaacuggcauggcuagacucuuuuuuucccccaccuuucucaacagggucuuuggcuuugccauuguggcuaccuccacccuaaacauguugaucccuucagcagcccgcguucacuauggcugugucaucuucgugaggauccuucagggauugguggagguaaagccugccccauuaacccugcuucucucucugaucauaccucuucuuguugaccucugugcucccucccuagggggucacauacccugcuugccauggcaucuggagcaaaugggccccucccuuagaacggagucggcuggcaacgacagccuuuugcggugagaggaaggggcuggggagcagcucuugugcgaggagggcugagcugggagcugggagcugggaucucaauguaggugcagcagagauuucagggcugaggggcugcucuccuggaucuaggaaagaccugggacuaggucuguucucuacccucguucucuccucagguuccuaugcuggggcggugguugccaugcccuuggcugggguccuugugcaguauucaggauggaguucugucuucuaugucuauggugagggacccagaugcaugauucuggguggcacucaggcuggcugagcaagucuggaugucacccuacacccauaucccugcugaccccccccccucaggcagcuucgggaucuuuugguaccuguucugguugcuugucuccuaugagucaccggcacugcaccccagcaucucugaggaggagcgcaaauacauugaggaugccaucggggagagcgccaagcucaugaacccuguuacgguugguacagggcuacaugacucugugugugugugugugugugcucaaaccugugcaaagacucagagaagauagaacugccaagcaaaaggcuggggguggggggcgaggcaggaggauugugaguucaaggucaggcuauaaaaugaguucaaggccaggccagguauuuccugaagcuuuguuucucaccuggguuagagguuuagcucagugguccauccaucguuugcccagaauccccuagugaggggcugcggguguuuuacaaugaaagagcaucugccuagcaugcauuccuacuacugaaaaaaaacgaagagaaaaaaagaaagaaagaaaauagcugggcuagauuccauauuaggugggauggaguuuaggaauggcggguacuaggugggugauuuagagccacccauaaggccuuguuggcaacagcagagaggauuagaaugugaauuuuugcuagcuauugcugugggugugucuagacuuugggggagugagugauugaauagacguuuuaccggacucgccauuuauggguuaucaugaaaccucagg

SEQ ID NO: 10218 - RNA, 2501 nt, Mus musculus
ccugagguuucaugauaacccauaaauggcgaguccgguaaaacgucuauucaaucacucacucccccaaagucuagacacacccacagcaauagcuagcaaaaauucacauucuaauccucucugcuguugccaacaaggccuuauggguggcucuaaaucacccaccuaguacccgccauuccuaaacuccaucccaccuaauauggaaucuagcccagcuauuuucuuucuuucuuuuuuucucuucguuuuuuuucaguaguaggaaugcaugcuaggcagaugcucuuucauuguaaaacacccgcagccccucacuaggggauucugggcaaacgauggauggaccacugagcuaaaccucuaacccaggugagaaacaaagcuucaggaaauaccuggccuggccuugaacucauuuuauagccugaccuugaacucacaauccuccugccucgccccccacccccagccuuuugcuuggcaguucuaucuucucugagucuuugcacagguuugagcacacacacacacacacacagagucauguagcccuguaccaaccguaacaggguucaugagcuuggcgcucuccccgauggcauccucaauguauuugcgcuccuccucagagaugcuggggugcagugccggugacucauaggagacaagcaaccagaacagguaccaaaagaucccgaagcugccugaggggggggggucagcagggauauggguguagggugacauccagacuugcucagccagccugagugccacccagaaucaugcaucugggucccucaccauagacauagaagacagaacuccauccugaauacugcacaaggaccccagccaagggcauggcaaccaccgccccagcauaggaaccugaggagagaacgaggguagagaacagaccuagucccaggucuuuccuagauccaggagagcagccccucagcccugaaaucucugcugcaccuacauugagaucccagcucccagcucccagcucagcccuccucgcacaagagcugcuccccagccccuuccucucaccgcaaaaggcugucguugccagccgacuccguucuaagggaggggcccauuugcuccagaugccauggcaagcaggguaugugacccccuagggagggagcacagaggucaacaagaagagguaugaucagagagagaagcaggguuaauggggcaggcuuuaccuccaccaaucccugaaggauccucacgaagaugacacagccauagugaacgcgggcugcugaagggaucaacauguuuaggguggagguagccacaauggcaaagccaaagacccuguugagaaaggugggggaaaaaaagagucuagccaugccaguuauagugagguguucguguggcgcuagccauccagccuucccgcugcuccuaggauuuuccccucccugccuacaucaggcccuguguauaacagaacuagaggcugccuccaagauaugcccucaaacaaggacccucccaauuucccagagccaaacccaaggccacacccucuagcuccaccacacacaacuccaauuucugccaccuugagacacuacaacgguaccuguuggcugcgaauuuuuggcagauaaauccuccaggaaucugagugacaauguagccccagaaaaaggagccauguaugaggccgacagucucuggaucccaguugaacugggcuuucugugggucaaaauacacaucaaacuagaugccccccagacucuacccucuaccaaucagcacccauagacuuagcuccuuagccaaucagcaacaagaugccccgcccucugcccaaaucuaccaaucagagcucaguggagcuccacccuucuauguugcuagggccugcccuaccacuuuagcuacaggcgcugcugccuagaagcucaguucuacuugcuugcuuaccucaguauccccucccugaauauccccaaguguaggggugacugccuccuguuuguggacagaccuguauggggucuaggcagggccaagaagcagcuaaauuagguguguucccaauuacaauagagcaaaggacaggguuucagguaagccacagaccaaaccaagauuuuuccuuuuuuucuuuuuccagucaaggacauagcuuguguaauauccaaguugaaauaacauaaaucugagcuuggacgaggcuuuagaugugggccagaacuaaucagguggacauaggcagaggugaauuuggaaaagagcuugagauagcagugaaauuauucaagugugauccgggaacauaaacgugggggcagagccggaaguaaaagggcuagaaggucucaaagcagccacaguagcaaaccuaaugcuaguguugucuuuuccacaaucugggauggaaaggaggcggagcuuccauuauauaagggcggggcugaggaagccuggagugggaugagaucuguagggag

SEQ ID NO: 10219 - RNA, 2501 nt, Mus musculus
gucucucuuucucucugucucucucuugucccuggcucucuccugaccagcuccuuuccacacccucucuucucagccuuccucucuuccuucuugcuuuucccuuccuaggcaucuugucuuugcccuucugucuggagguuauuucuuuucugucuuucucccuugugucccucugcucucuuuccugccucucucuuguguucucgacuugugcucugauggucccccucuccagucucuauuuuuaucccucugacacaccccuuguguccaccucucugucuguaccaccacccccccuucuucaguacuagcucugggucccaauuaguugguguuggccacggcagcgcagggccccaccaggcuucucauuaccgcuggcggcuccuaaugagcgugggguggagugaccccgcgcccccagcccggccugcgucacugccgccgcgggggcugugaggguauauaaaaggggcgugagcauagcugccugagcccacugcacgguaggggguccuguaggaggcugguggcaggguuggauugugggcccuaggcuucugggcgggaugaugacauugagauucuggccccuguauccacaggugauggagaccugccagauguccaggagcccccgagagcggcuguugcugcuuuugcugcugcuacugcuugugcccuggggcacuggcccugccucagguguugcccugccccucgcugguguguucagguaggugugaggucccggacacccaaagaagggaggagaggaccccccgccccaaaggaaggcaagauaccgcaugcggggaguuggggagggcaggggugcuuagcgucggacugcaguggggacccgcgguggccuguggggccuagcgcgcaaucacaucucucuucccccagccuccgcgccccgggucgugccugggcgggcuuggguagcccccugucucggcgcagccuggcgcuagcugacgacgcggccuuucgggagcgcgcgcgccugcuggccgcccuggagcgccgccgcuggcuggacucuuacaugcagaagcuguugcuacuggacgcgcccugagccuaauaaagagccugucgcacugcgacugcgccucuuugcugcgccacucucuuguggguguguggggagggggccccacagccucacugcaaccgggacccuccgcauccucgcuucuccggguucccucuugggucaucugccucgagacucuuguucucucuggauucccucgcccgugggucccugauccagcucuguuuugguccgguuuuuuuugggggggggggagggauuauucuuccgagacaggguuucucuguguagcccuggcuguccuggaacucacucuguagaccaggcuggccuugagcucgagagcuucgccugccucugccucccaagugcuaggauuaaaggcaagcgucaccauauccugcugggucgggauuucauaaccuuuuugggccucguguuuaucggccggggagggcuccagcaguuccgagcuggaccgcggcaggugccggauaaggaaacuaagcagagcccgcggcucggggaggcgcaguccccaccuguuuauucggagagcccgcggagcgagcggaccgcgcccugauuggucugaagaggagggugggguccaggagaccgcccuccaaaauuugcauuuucuggaggcggaccgagcccucauuggcuuuuaugcugugagggcggaguugccucuugcagcuccugcucggucuaccgcgcagaagcagaagcgguuagcaggaggcgcacacagaaauccggguuuccgcgaggcgacacuuaacgccccgaaaucccgaguuuugacggcugucuccagccaucaaaccgccuuagagcuuaggaugcggccaaagagcucacccaucuccaaacccuuccuccgaaaaggaggacuuuuuuuggacuacuacccuccagcagcccccuuccccugccggccagcgcuggccuguccuuccgcacaaggaccugcucagaacuaguuccauccgccgcuccacacauggcuggagucuugaucucgagugucuaggccugccuuucucaacccccuccugggcacugggaagaacuuuugggcuggagccccaggcugaccucugcauuucucagaggccgcccaggcugccagccugcccuuccugacucuccuucccauggccgagcuguucggcugacugacucuucagccuggaacacccucccgcugccaacugaauaccaacuacaccuucucucaaagcagagugcaggcggguggcaccuucuugaagagaacagcuccagagaauagugcaugcaugcguaguauguagguguguguguguguguguguguguguguguguguguucucaggcugcacccaucuuaguccaaaggcuccaagaggcuccuggcauuguaaaccauggagccagugu

SEQ ID NO: 10220 - RNA, 2501 nt, Mus musculus
acacuggcuccaugguuuacaaugccaggagccucuuggagccuuuggacuaagaugggugcagccugagaacacacacacacacacacacacacacacacacacaccuacauacuacgcaugcaugcacuauucucuggagcuguucucuucaagaaggugccacccgccugcacucugcuuugagagaagguguaguugguauucaguuggcagcgggaggguguuccaggcugaagagucagucagccgaacagcucggccaugggaaggagagucaggaagggcaggcuggcagccugggcggccucugagaaaugcagaggucagccuggggcuccagcccaaaaguucuucccagugcccaggaggggguugagaaaggcaggccuagacacucgagaucaagacuccagccauguguggagcggcggauggaacuaguucugagcagguccuugugcggaaggacaggccagcgcuggccggcaggggaagggggcugcuggaggguaguaguccaaaaaaaguccuccuuuucggaggaaggguuuggagaugggugagcucuuuggccgcauccuaagcucuaaggcgguuugauggcuggagacagccgucaaaacucgggauuucggggcguuaagugucgccucgcggaaacccggauuucugugugcgccuccugcuaaccgcuucugcuucugcgcgguagaccgagcaggagcugcaagaggcaacuccgcccucacagcauaaaagccaaugagggcucgguccgccuccagaaaaugcaaauuuuggagggcggucuccuggaccccacccuccucuucagaccaaucagggcgcgguccgcucgcuccgcgggcucuccgaauaaacagguggggacugcgccuccccgagccgcgggcucugcuuaguuuccuuauccggcaccugccgcgguccagcucggaacugcuggagcccuccccggccgauaaacacgaggcccaaaaagguuaugaaaucccgacccagcaggauauggugacgcuugccuuuaauccuagcacuugggaggcagaggcaggcgaagcucucgagcucaaggccagccuggucuacagagugaguuccaggacagccagggcuacacagagaaacccugucucggaagaauaaucccucccccccccccaaaaaaaaccggaccaaaacagagcuggaucagggacccacgggcgagggaauccagagagaacaagagucucgaggcagaugacccaagagggaacccggagaagcgaggaugcggagggucccgguugcagugaggcuguggggcccccuccccacacacccacaagagaguggcgcagcaaagaggcgcagucgcagugcgacaggcucuuuauuaggcucagggcgcguccaguagcaacagcuucugcauguaagaguccagccagcggcggcgcuccagggcggccagcaggcgcgcgcgcucccgaaaggccgcgucgucagcuagcgccaggcugcgccgagacagggggcuacccaagcccgcccaggcacgacccggggcgcggaggcugggggaagagagaugugauugcgcgcuaggccccacaggccaccgcggguccccacugcaguccgacgcuaagcaccccugcccuccccaacuccccgcaugcgguaucuugccuuccuuuggggcgggggguccucuccucccuucuuuggguguccgggaccucacaccuaccugaacacaccagcgaggggcagggcaacaccugaggcagggccagugccccagggcacaagcaguagcagcagcaaaagcagcaacagccgcucucgggggcuccuggacaucuggcaggucuccaucaccuguggauacaggggccagaaucucaaugucaucaucccgcccagaagccuagggcccacaauccaacccugccaccagccuccuacaggacccccuaccgugcagugggcucaggcagcuaugcucacgccccuuuuauauacccucacagcccccgcggcggcagugacgcaggccgggcugggggcgcggggucacuccaccccacgcucauuaggagccgccagcgguaaugagaagccugguggggcccugcgcugccguggccaacaccaacuaauugggacccagagcuaguacugaagaaggggggguggugguacagacagagagguggacacaaggggugugucagagggauaaaaauagagacuggagagggggaccaucagagcacaagucgagaacacaagagagaggcaggaaagagagcagagggacacaagggagaaagacagaaaagaaauaaccuccagacagaagggcaaagacaagaugccuaggaagggaaaagcaagaaggaagagaggaaggcugagaagagaggguguggaaaggagcuggucaggagagagccagggacaagagagagacagagagaaagagagac

SEQ ID NO: 10221 - RNA, 2501 nt, Mus musculus
uauuaaucucaaaacaccuacauaaagucuaaauucaaacuccgggacucucaguggccaaggauccggcgcacaugggcaacaguuuacaguugcaaaagaggcuccaagaacuccucaagcaccagggccgcugcggagcuccuuaggcaugguaauuagagacacaaaggaauaaacacgugaggccagacacacaaaacgauguucauucauugaaagguacuaggagagaaagaaagccagcaacaaauccagauguggugguacacaucugucaucccagcaaucgggaggcagaagcaagaguacugcaauacugagccagucugacauacauacccaaacccagugucuggaaaaaaauaauaaaaggcagagagauacagaggcucccagcagagagcaagauguggacaacugguuaaggggauacaccccccacccuccaggaggauggacaagagacagaaagacuggaaauggaaaagggaaacugaugcugcagauagucucggguggcucaugacugucacccgggcaauccgaaggaugaggcagaggauugccacaaguucgcggucagcuuaaaugacaggcugaggagacugucuaaauaacaaacaaacaaauaaauagccaugaugccauacgccugcaaucccagcauuugggagguggaggcaggaggaucauaaauucaaggucaguucagcuacauaagaccucgggucaugaauccaaaagccaaacaaauaaaauagaugacuacaagggaaagcucaagagauccacggaaaagcgccggguggcaguguuuccacaggugugggaacggcagagggcgccccuagccccgcggggguaacaccgcccccucccccgcgcccuggccggacuuuccaugcuauuuuuacccgccgacaccggacacccgacugggguggcugcggcgucggggccacacguccguucaccggucgcccgggcugugcgcgccauggagccacggugcccgccgcccugcggcugcugcgagcggcuggugcucaacguggccggguugcgcuucgagacccgcgcgcgcacgcucggccgcuucccggacacgcugcugggggacccggugcgccgcagccgcuucuacgacggcgcgcgccgcgaguauuucuucgaccgacaccggcccagcuucgaugcggugcucuacuacuaccagucgggcggccggcugagacggccggcgcacgugccccucgacgucuuccuggaggagguguccuucuacgggcugggcgcggcggcgcuggcgcggcugcgggaggacgagggcugcgcggugccgcccgagcggccgcugccccgccgcgccuuugcgcgucagcucuggcugcucuucgaauuuccugagagcucgcaggcugcgcgcgugcucgccguggucuccguacucgucauccuggucuccaucguggucuuuugccucgagacacugccagacuuccgcgacgaccgcgaugacccggggcucgcgcccguagccgcugcuacuggcccggugaggggcggggauuuggggagguccagggcggggccugggaagaccuggccagucagaagguguggcaaggggcaggaggauggaagcccuuuaaaaacaaaaacaaaaacaaaaacaaaacaaaaaaaaaaaaaaaacaaagauguaagcuggguaugguucuucauacgagaauccuagcaaggagacagaacgauugccacggguugaaagccaguguggguuacuguaugagagagucugccuggaaacagacagugagugaggaucucccucagagguagacaaccugcccagaguuuccuggugagggacuggugccgggcucagugguagaccaucugcauugcacugcacaaagugacuuggggguuauguggcgcagugguagaacuccccuaccacccuacauugagggaccuggagagauggcuaagcgauaaagagacugcucucccagaggaccuagguucaauucccggcacccacaugacggcucccaaccaucuguaucuaacuccaguuccagggaauccgaugcccuuuucugaacaccaaggcacauacacgugcacagauauauaugcaggcaaaccauucguccacauaaaauaaauaauuuuaagaaagaagaugaugaaucccccagggagggguguggcucagugacagagcuccugccuaaaaucccucaguguggggcuuggggcauggaacaauagagagcaacuugccacgcauaugcaagacccuggaguucaucccuagccaugcaaaaugaacaugugaggccaaagacacagacagacugcaguguccgugcaccuggcagagaaauaggaaagacggauggucaggcagggcugaccgccaggaaacuggaacacaguaggcugagguuuaggacugagagcagagguagcaacaggaauuugcacag

SEQ ID NO: 10222 - RNA, 2501 nt, Mus musculus
cugugcaaauuccuguugcuaccucugcucucaguccuaaaccucagccuacuguguuccaguuuccuggcggucagcccugccugaccauccgucuuuccuauuucucugccaggugcacggacacugcagucugucugugucuuuggccucacauguucauuuugcauggcuagggaugaacuccagggucuugcauaugcguggcaaguugcucucuauuguuccaugccccaagccccacacugagggauuuuaggcaggagcucugucacugagccacaccccucccugggggauucaucaucuucuuucuuaaaauuauuuauuuuauguggacgaaugguuugccugcauauauaucugugcacguguaugugccuugguguucagaaaagggcaucggauucccuggaacuggaguuagauacagaugguugggagccgucaugugggugccgggaauugaaccuagguccucugggagagcagucucuuuaucgcuuagccaucucuccaggucccucaauguagggugguaggggaguucuaccacugcgccacauaacccccaagucacuuugugcagugcaaugcagauggucuaccacugagcccggcaccagucccucaccaggaaacucugggcagguugucuaccucugagggagauccucacucacugucuguuuccaggcagacucucucauacaguaacccacacuggcuuucaacccguggcaaucguucugucuccuugcuaggauucucguaugaagaaccauacccagcuuacaucuuuguuuuuuuuuuuuuuuuguuuuguuuuuguuuuuguuuuuguuuuuaaagggcuuccauccuccugccccuugccacaccuucugacuggccaggucuucccaggccccgcccuggaccuccccaaauccccgccccucaccgggccaguagcagcggcuacgggcgcgagccccgggucaucgcggucgucgcggaagucuggcagugucucgaggcaaaagaccacgauggagaccaggaugacgaguacggagaccacggcgagcacgcgcgcagccugcgagcucucaggaaauucgaagagcagccagagcugacgcgcaaaggcgcggcggggcagcggccgcucgggcggcaccgcgcagcccucguccucccgcagccgcgccagcgccgccgcgcccagcccguagaaggacaccuccuccaggaagacgucgaggggcacgugcgccggccgucucagccggccgcccgacugguaguaguagagcaccgcaucgaagcugggccggugucggucgaagaaauacucgcggcgcgcgccgucguagaagcggcugcggcgcaccgggucccccagcagcguguccgggaagcggccgagcgugcgcgcgcgggucucgaagcgcaacccggccacguugagcaccagccgcucgcagcagccgcagggcggcgggcaccguggcuccauggcgcgcacagcccgggcgaccggugaacggacguguggccccgacgccgcagccaccccagucggguguccggugucggcggguaaaaauagcauggaaaguccggccagggcgcgggggagggggcgguguuacccccgcggggcuaggggcgcccucugccguucccacaccuguggaaacacugccacccggcgcuuuuccguggaucucuugagcuuucccuuguagucaucuauuuuauuuguuuggcuuuuggauucaugacccgaggucuuauguagcugaacugaccuugaauuuaugauccuccugccuccaccucccaaaugcugggauugcaggcguauggcaucauggcuauuuauuuguuuguuuguuauuuagacagucuccucagccugucauuuaagcugaccgcgaacuuguggcaauccucugccucauccuucggauugcccgggugacagucaugagccacccgagacuaucugcagcaucaguuucccuuuuccauuuccagucuuucugucucuuguccauccuccuggagggugggggguguauccccuuaaccaguuguccacaucuugcucucugcugggagccucuguaucucucugccuuuuauuauuuuuuuccagacacuggguuuggguauguaugucagacuggcucaguauugcaguacucuugcuucugccucccgauugcugggaugacagauguguaccaccacaucuggauuuguugcuggcuuucuuucucuccuaguaccuuucaaugaaugaacaucguuuugugugucuggccucacguguuuauuccuuugugucucuaauuaccaugccuaaggagcuccgcagcggcccuggugcuugaggaguucuuggagccucuuuugcaacuguaaacuguugcccaugugcgccggauccuuggccacugagagucccggaguuugaauuuagacuuuauguagguguuuugagauuaaua

SEQ ID NO: 10223 - RNA, 2501 nt, Mus musculus
cucccccugguccccuuucagggcaccuugucccuccuucccagcaucagcucaccuccagccuucucacccuccagucccgcaagccucugccuccccguccugaccagcugguuuucugcacgccaggccccuagcgcccgguccuuucuagccuuggcaccuggagcugggggccucgggcuccgucggcuacacugcaccucccuuuccagggcugggcccaggggugcggcccuuucuacugcggagaccccccaaccaaacaucaaaccagugggagcaaguggguggggaagagggaagcaggaccagaggugauggaagaggggguggggaagaagacgagaggagguggagauggaaagagggagaggcagcgcagggugagggaggaggugagauagaaggaagaagggaaggcagagucgaauagggaggaggaagaggacagagggaagaagagaaggcagggugagggaggaggcggagggagaggagcgcacgcggcgagugcgcggccggguucgcugguugagagcgaagaaggggugugcauuggcaccgagagggacccggggccggcgagggcgaucgcagcuucgggagguagagcgagugcagggagcgggcccaggcgggcggaggagugagcgucaaacgggcucugggguacacggucccagccccuguaucccgggagcuggggcucccguucuggugacagccaggcuggaagucccaagaggaggggagggaagagcuagggggucgggcgcugggaaagggucgcuccgaggccucuuggauggggggugccgcucgccugagcgccccucaagcgcugguacucugggccgcacugggagcggcagguaagaccuggggguccuggcagcauccucugagggagggacaggguggggugccuaggagagggaugcagcugcucucuucccagcucacaucggaccugcaccugaucccgaggacugguggagcuacaaggagaaucuccagggaaacuucgugccaggugcaaacaggguggagacccagagcccgaccccauaucccuaggcgccguuuuuccuaggcucaggagucuggguccucgaucuucucaucuuccauaggaccaaagcucccagccccugccuucuucccucaggaguggggcccagccucugaaccucagcggcucaccaugggacauuauacaugcgcauuucaaguagugagugggagugagugcaaggaaaguguggggguggagaaauguguguguuugcagccauagacagguccuauuccugcuggaaggcacacacucgguagcucgggucccugucccgcccccucgcccggggcuucgaaguccucuuuuauaacucuucuccccuaauauucuuauccagcugugggaccugggagacuaaaagaacuacaacucccauggggcuacggggcaggccggagauugaugaguuguuuucaccccugaggcuuacugggaguuguaguucuguuuucacauagcccuuuuaaagaugggaacaaggcuuggagcaguuaugagcuccuaggaagggauuccaaaauucuucgaggaaucaggauucuggcucucauguucuuucucucuuagacccaaagcuccugauuuccucccucguuuucuuccuucagcugggguuaucccugccccaauccacacagcagguccugccuggaauccagccuauuucuguucccauagggccucccuucuggggccuggugaacgcugccuggagccugugcgcuguggggaagcggcagagccccguggauguggagcugaagcggguucuuuaugacccuuuucugcccccgcucagacucagcaccgggggagagaagguaagcuuugcaguggggcgggucuaagcagaggggaccugggcugagguggauggcgaaccauggggaauaaauaguuacucucugaagaucacccggccugcccuuucccacugcuuuccucagcuucccaaugucuacccaagcagugaaaacagaagacaacucaugccaagcauugaaaagacuaaacaaacccacucaucuucacaauaaccuacuaucuuuuuagcuuucuuuuauggaccagagaguuuauguuacuugccuggggucacacagccauccggccaagugacauggucucagugucuguacucaggaagcucucugcaguacccauuucuguagaagcgcuggcaccaugagccagaagccccagcgucauuuucuccgccguaccccagugccucaggccggcuuucucacuaggcucgcgggguccuguccaccauuguccucucccauccgguccuccugcucggccuucagcucuguguccugcaguccagccaaccaaagccccccacccccuuguggaguucaccaucaucccuaccacccaaagacugaggcagggggagggacgauucaaagcc

SEQ ID NO: 10224 - RNA, 2501 nt, Mus musculus
ggcuuugaaucgucccucccccugccucagucuuugggugguagggaugauggugaacuccacaaggggguggggggcuuugguuggcuggacugcaggacacagagcugaaggccgagcaggaggaccggaugggagaggacaaugguggacaggaccccgcgagccuagugagaaagccggccugaggcacugggguacggcggagaaaaugacgcuggggcuucuggcucauggugccagcgcuucuacagaaauggguacugcagagagcuuccugaguacagacacugagaccaugucacuuggccggauggcugugugaccccaggcaaguaacauaaacucucugguccauaaaagaaagcuaaaaagauaguagguuauugugaagaugaguggguuuguuuagucuuuucaaugcuuggcaugaguugucuucuguuuucacugcuuggguagacauugggaagcugaggaaagcagugggaaagggcaggccgggugaucuucagagaguaacuauuuauuccccaugguucgccauccaccucagcccagguccccucugcuuagacccgccccacugcaaagcuuaccuucucucccccggugcugagucugagcgggggcagaaaagggucauaaagaacccgcuucagcuccacauccacggggcucugccgcuuccccacagcgcacaggcuccaggcagcguucaccaggccccagaagggaggcccuaugggaacagaaauaggcuggauuccaggcaggaccugcuguguggauuggggcagggauaaccccagcugaaggaagaaaacgagggaggaaaucaggagcuuugggucuaagagagaaagaacaugagagccagaauccugauuccucgaagaauuuuggaaucccuuccuaggagcucauaacugcuccaagccuuguucccaucuuuaaaagggcuaugugaaaacagaacuacaacucccaguaagccucaggggugaaaacaacucaucaaucuccggccugccccguagccccaugggaguuguaguucuuuuagucucccaggucccacagcuggauaagaauauuaggggagaagaguuauaaaagaggacuucgaagccccgggcgagggggcgggacagggacccgagcuaccgagugugugccuuccagcaggaauaggaccugucuauggcugcaaacacacacauuucuccacccccacacuuuccuugcacucacucccacucacuacuugaaaugcgcauguauaaugucccauggugagccgcugagguucagaggcugggccccacuccugagggaagaaggcaggggcugggagcuuugguccuauggaagaugagaagaucgaggacccagacuccugagccuaggaaaaacggcgccuagggauauggggucgggcucugggucuccacccuguuugcaccuggcacgaaguuucccuggagauucuccuuguagcuccaccaguccucgggaucaggugcagguccgaugugagcugggaagagagcagcugcaucccucuccuaggcaccccacccugucccucccucagaggaugcugccaggacccccaggucuuaccugccgcucccagugcggcccagaguaccagcgcuugaggggcgcucaggcgagcggcaccccccauccaagaggccucggagcgacccuuucccagcgcccgacccccuagcucuucccuccccuccucuugggacuuccagccuggcugucaccagaacgggagccccagcucccgggauacaggggcugggaccguguaccccagagcccguuugacgcucacuccuccgcccgccugggcccgcucccugcacucgcucuaccucccgaagcugcgaucgcccucgccggccccgggucccucucggugccaaugcacaccccuucuucgcucucaaccagcgaacccggccgcgcacucgccgcgugcgcuccucucccuccgccuccucccucacccugccuucucuucuucccucuguccucuuccuccucccuauucgacucugccuucccuucuuccuucuaucucaccuccucccucacccugcgcugccucucccucuuuccaucuccaccuccucucgucuucuuccccacccccucuuccaucaccucugguccugcuucccucuuccccacccacuugcucccacugguuugauguuugguuggggggucuccgcaguagaaagggccgcaccccugggcccagcccuggaaagggaggugcaguguagccgacggagcccgaggcccccagcuccaggugccaaggcuagaaaggaccgggcgcuaggggccuggcgugcagaaaaccagcuggucaggacggggaggcagaggcuugcgggacuggagggugagaaggcuggaggugagcugaugcugggaaggagggacaaggugcccugaaaggggaccagggggag

SEQ ID NO: 10225 - RNA, 2501 nt, Mus musculus
cccuucuugucuagggggcuucccugcuuuuuaaagcagcuuuaaaguguucgaggcaaugcuugaacacucguaguucucagcaugaaaacucuugagggugcuucuucgccuguagacuaggacccauagcgggauucugucaacuguuuccuuuuuacagaaagagcccaccggcaugauauaggguugggaaaucaaauuggcaagauaagguuggggucgcgggaggaucuagacuuccuacccuuagguaacccccaagcaucgcacacaagagggcaccccaugcggucuuguggagggaaaaaaaagcagcccugaaugaauguuaacaggaaauuagcugcggcugguagguguuuuucggcggcguggaggggcgagggccggucugcguguggcugccggaggagcuggccaauuggucacggugcugagaccuuuguggcgaaugguggccaagugcaccaacucugugggaaacggcggcaugaagggaugccaacagcuccucgccgggaagggaaccgccucaaauguggaccaugacaauucuugcuaauuuguagagcagggaauuggugcauagugucaagcagucacugcuugugcuaaaugggguaucaaauuggcgcgacggauucgugaauguuguacgccucgcaaccucugaaccagagcguaaccccgagggguggacggagaaauacgacuucgggguagggagcgaccggccgggacuggaacgggcuguccagcccggagcgggaaaaacacgaaagagaccuaccugggaaauaggaggaucugauaaaggguuggaacgagccuucgaaguauggaaaggcgaacgucuugggaggagggcucugcagcaaagcgggcgaaguuucugguagggcgagggaagagagagagagagagagagagagagagagagagagagagaaugaauuugaucauguguuugaauacuguguggagcaucgcguacacgaucuaauucacacugcagcagguaucagaggcaucuuuuagaacguauucacuaaguaaaauaaauuugcgcagcgucgucucauuugugcccccauuucaucaccauuccagagacuuaggaaaauagggagggguggggugggcuauugcagaucuauccauaauaguacaaaccaacacaauaaacguacuuguuggguuuaaagcaaaaagucucuuuccuagucuugagggcgggaacgcaggcaccaaagcgcgugcgcugagacgcccgacuaaggaacugcacucacuggcccggggcucaaguucauuuugaggauacucguaaggccugagacuuuucuuccccuuaaaaccucaguaccaucguuucauaaucaguaaccuggcccuugaggucugaguuccugcguggaaaugugcacuaacaagcgcggaggaacaaguuugugaaggauugaguggcugucaggccgcggaacgcacgucgagggcacggcuguaucuuaccucuucuaggcgccgaggaaaggauggcauucaccccaaacuucagaaacgugggcucgcuggcaggggagagggcggucuguggagaacugccucgccggcucccggacccaggagagcccaggucugagguccccgagucggcgagggcugcaggggccucuugacuggggggugacaggcuggcagcggguaugcugcgggacagguaggugggaggccggcugaugcggaucaaaucuucuacuaggaaacuagaguggccggaaaaugcggauugaagggacuggggcaguguuaaggugggcgugggucgcaggaggcuaggguaucccgcgggaggcgcaaggaggccggggaacaucaugguuagagcgggucuggcaguagcucccuuucccugggccggagggcaagcgccuggcuucccgccccucccccgaugcccucuuuggcucaguauccugguaaccguccuacuugggcgucugcgagucuucuguggcucuccgguccaggagaugguuuuauaguggcccgcccgcuccagcucuuugaaaacugacagcucugacaaugaaguucaacaaaguucuccacucgggcuucauucgcgggaggcuccaggcucucugauugguucagggaugcaauuuaugauuggauuagucuucauaagcauggcccucacaauggggcggcaacaaaggccggcgcucaucaacgcugugcaucgacggccucucugcuauacagugaguccccaaagcucucgcuggagguuuuuguucugaagcaacacccgggcuaauuaaaugccuauuuagaaguuucagaugacaucuugccucauagaaaaggaauuauuuaaagaacgcacuaaauuuaucugcggccuccugcugagacuagaaaauaaaucaauaaauauucauagaacuacaucuccaggcuaucgguaaaauaacucucccuugugugugagg

SEQ ID NO: 10226 - RNA, 2501 nt, Mus musculus
ccucacacacaagggagaguuauuuuaccgauagccuggagauguaguucuaugaauauuuauugauuuauuuucuagucucagcaggaggccgcagauaaauuuagugcguucuuuaaauaauuccuuuucuaugaggcaagaugucaucugaaacuucuaaauaggcauuuaauuagcccggguguugcuucagaacaaaaaccuccagcgagagcuuuggggacucacuguauagcagagaggccgucgaugcacagcguugaugagcgccggccuuuguugccgccccauugugagggccaugcuuaugaagacuaauccaaucauaaauugcaucccugaaccaaucagagagccuggagccucccgcgaaugaagcccgaguggagaacuuuguugaacuucauugucagagcugucaguuuucaaagagcuggagcgggcgggccacuauaaaaccaucuccuggaccggagagccacagaagacucgcagacgcccaaguaggacgguuaccaggauacugagccaaagagggcaucgggggaggggcgggaagccaggcgcuugcccuccggcccagggaaagggagcuacugccagacccgcucuaaccaugauguuccccggccuccuugcgccucccgcgggauacccuagccuccugcgacccacgcccaccuuaacacugccccagucccuucaauccgcauuuuccggccacucuaguuuccuaguagaagauuugauccgcaucagccggccucccaccuaccugucccgcagcauacccgcugccagccugucaccccccagucaagaggccccugcagcccucgccgacucggggaccucagaccugggcucuccuggguccgggagccggcgaggcaguucuccacagaccgcccucuccccugccagcgagcccacguuucugaaguuuggggugaaugccauccuuuccucggcgccuagaagagguaagauacagccgugcccucgacgugcguuccgcggccugacagccacucaauccuucacaaacuuguuccuccgcgcuuguuagugcacauuuccacgcaggaacucagaccucaagggccagguuacugauuaugaaacgaugguacugagguuuuaaggggaagaaaagucucaggccuuacgaguauccucaaaaugaacuugagccccgggccagugagugcaguuccuuagucgggcgucucagcgcacgcgcuuuggugccugcguucccgcccucaagacuaggaaagagacuuuuugcuuuaaacccaacaaguacguuuauuguguugguuuguacuauuauggauagaucugcaauagcccaccccaccccucccuauuuuccuaagucucuggaauggugaugaaaugggggcacaaaugagacgacgcugcgcaaauuuauuuuacuuagugaauacguucuaaaagaugccucugauaccugcugcagugugaauuagaucguguacgcgaugcuccacacaguauucaaacacaugaucaaauucauucucucucucucucucucucucucucucucucucucucucuucccucgcccuaccagaaacuucgcccgcuuugcugcagagcccuccucccaagacguucgccuuuccauacuucgaaggcucguuccaacccuuuaucagauccuccuauuucccagguaggucucuuucguguuuuucccgcuccgggcuggacagcccguuccagucccggccggucgcucccuaccccgaagucguauuucuccguccaccccucgggguuacgcucugguucagagguugcgaggcguacaacauucacgaauccgucgcgccaauuugauaccccauuuagcacaagcagugacugcuugacacuaugcaccaauucccugcucuacaaauuagcaagaauugucaugguccacauuugaggcgguucccuucccggcgaggagcuguuggcaucccuucaugccgccguuucccacagaguuggugcacuuggccaccauucgccacaaaggucucagcaccgugaccaauuggccagcuccuccggcagccacacgcagaccggcccucgccccuccacgccgccgaaaaacaccuaccagccgcagcuaauuuccuguuaacauucauucagggcugcuuuuuuuucccuccacaagaccgcauggggugcccucuugugugcgaugcuuggggguuaccuaaggguaggaagucuagauccucccgcgaccccaaccuuaucuugccaauuugauuucccaacccuauaucaugccggugggcucuuucuguaaaaaggaaacaguugacagaaucccgcuauggguccuagucuacaggcgaagaagcacccucaagaguuuucaugcugagaacuacgaguguucaagcauugccucgaacacuuuaaagcugcuuuaaaaagcagggaagcccccuagacaagaaggg

SEQ ID NO: 10227 - RNA, 2501 nt, Mus musculus
ucaaaucucacauggauuuaucuccagugucuguaacuacacuuuacauucuuccuuguuugaucugcauucagauauguaagaauuuaucucuauuaauaauuucucaauauuccaaucuuaaacaacucaucaucaucauaagguacagcuuuccaaaagaaaaaagaaaaaaaagucauuucuguuucucuuauucuuuuguagaaaaaccaaaaucaagaauuaagucuuucuccaggaccuucacauuuaauuugauuuugcacaaacucaguguguccgaacuuaacuucaccaucucagcuacaucuuucuccuucaacuuguuucuuucccuaccaucaucuaguucugugccauacaggagaccaggaaaucuuuuacauaagccuagugguacccucccuuagaccccagugguugggcuuugcugcuucgcuccuuuccagcccuaccacccuucuggcuucccaacacgcaugcgcaauaucgcaucagccccgcccgcccgcugcugcggaaggcgcagugcucaguaaagcgcacuuccucugcuggucuccaccgagggagugcccgcuccaagagcuccaagccgcaucgguccugcucugauccgaaggcgcagacaugucggaacaaaguaaggaccugagcgacccuaacuuugcagccgagguccccgacugugagaugcaggacagcgaugccguuccgguggggaucccuccucccgcuucucuggccgcuaaccucgcagggccaccgugcgcucccgaaggcccuauggcagcccaacaggccucgccaccgcccgaagaacggauagaagauguugacccuaaaauccugcagcaggccgcagaggagggccgcgcccaccagccccagaguccagcccggccgaucccagcaccgccagccccugcccagcuggugcagaaggcgcacgagcucaugugguacguguuggugaaggaccagaagaggaugguccucugguuuccagacauggugaaagaggucaugggcagcuacaagaaauggugcagaagcauccucaggcgcaccagcgucauccucgccagaguguucgggcugcaccugaggcugaccaaucuccacaccauggaguuugcccuggucaaagcccucagcccagaggagcuagacaggguggcgcucaacaaccguaugcccaugacaggccuccugcucaugauccugagccucaucuaugugaagggccgcggggccagagagggugcggucuggaaugugcugcgcauccuggggcugaggcccuggaagaagcacuccaccuucggagacgugaggaagauaaucaccgaggaguucguccagcagaauuaccugaaguaccagcgugugccccacaucgagccucccgaguacgaguucuucuggggguccagagcuaaccgugaaaucaccaagaugcagaucauggaguuccuggccagagucuucaagaaagauccccaggcguggccuucccgauacagggaggcucuggagcaggccagagcucugcgggaggcuaaucuugcugcccaggccccccgcagcagugucucugaggacuaaaaagguccaggggcacacugauaguuucugacccauacuagggcuguguaagggugggguugagucauuagaguaucccaaauccacagugcaguauuucauguauaauuuuuaaguuuuccauacagugcuuuuguaccuuguaaugcuauucauuuguguacucguguaguguuuaagauugaugcaugugugauaaguauuugguacuuucacuuuugugcuuucgugcauuuuuguacaagagaugugcugugcuaaacuugugaaauacauugagguguucuguaucuuguucuuuguaugggacugaugaucuguaucgacaaagaaggcccuggagaguuagcaggacuuaacagcaacgcagaccugagcaagagaaaggucaaggccuuucuccauaugacuucaacuggcacaggaagcauccauguggaauggacugauuugaacuggacuguucucaguguaggcacuuagcacccuuuacaaaacauguaugcaaccccaccauaaauaaacguuaaaaugagcauuaaagauacugugaaauaauuucuuggggggggggaggaggcauuuauuuuugaugaaagggggagugggaauggguggggaugagaaagauucucccugugugcagcauaagcaaacacgguguccuaacacagugggagaccacacgaccacucagaagaaacuugcagugcuuuaaucaauuugucacauaaaagguauaacaacaacaacaaaaaagcucauuaucacauaacauggggauaauaacagguauauggagggccugccccuuuucuguugcauuuuuuaaaauagucuuugauggacacuuuagcagaauaaacccuuaucaugcauuuucuucuuua

SEQ ID NO: 10228 - RNA, 2501 nt, Mus musculus
uaaagaagaaaaugcaugauaaggguuuauucugcuaaaguguccaucaaagacuauuuuaaaaaaugcaacagaaaaggggcaggcccuccauauaccuguuauuauccccauguuaugugauaaugagcuuuuuuguuguuguuguuauaccuuuuaugugacaaauugauuaaagcacugcaaguuucuucugaguggucguguggucucccacuguguuaggacaccguguuugcuuaugcugcacacagggagaaucuuucucauccccacccauucccacucccccuuucaucaaaaauaaaugccuccuccccccccccaagaaauuauuucacaguaucuuuaaugcucauuuuaacguuuauuuauggugggguugcauacauguuuuguaaagggugcuaagugccuacacugagaacaguccaguucaaaucaguccauuccacauggaugcuuccugugccaguugaagucauauggagaaaggccuugaccuuucucuugcucaggucugcguugcuguuaaguccugcuaacucuccagggccuucuuugucgauacagaucaucagucccauacaaagaacaagauacagaacaccucaauguauuucacaaguuuagcacagcacaucucuuguacaaaaaugcacgaaagcacaaaagugaaaguaccaaauacuuaucacacaugcaucaaucuuaaacacuacacgaguacacaaaugaauagcauuacaagguacaaaagcacuguauggaaaacuuaaaaauuauacaugaaauacugcacuguggauuugggauacucuaaugacucaaccccacccuuacacagcccuaguaugggucagaaacuaucagugugccccuggaccuuuuuaguccucagagacacugcugcggggggccugggcagcaagauuagccucccgcagagcucuggccugcuccagagccucccuguaucgggaaggccacgccuggggaucuuucuugaagacucuggccaggaacuccaugaucugcaucuuggugauuucacgguuagcucuggacccccagaagaacucguacucgggaggcucgauguggggcacacgcugguacuucagguaauucugcuggacgaacuccucggugauuaucuuccucacgucuccgaagguggagugcuucuuccagggccucagccccaggaugcgcagcacauuccagaccgcacccucucuggccccgcggcccuucacauagaugaggcucaggaucaugagcaggaggccugucaugggcauacgguuguugagcgccacccugucuagcuccucugggcugagggcuuugaccagggcaaacuccaugguguggagauuggucagccucaggugcagcccgaacacucuggcgaggaugacgcuggugcgccugaggaugcuucugcaccauuucuuguagcugcccaugaccucuuucaccaugucuggaaaccagaggaccauccucuucugguccuucaccaacacguaccacaugagcucgugcgccuucugcaccagcugggcaggggcuggcggugcugggaucggccgggcuggacucuggggcuggugggcgcggcccuccucugcggccugcugcaggauuuuagggucaacaucuucuauccguucuucgggcgguggcgaggccuguugggcugccauagggccuucgggagcgcacgguggcccugcgagguuagcggccagagaagcgggaggagggauccccaccggaacggcaucgcuguccugcaucucacagucggggaccucggcugcaaaguuagggucgcucagguccuuacuuuguuccgacaugucugcgccuucggaucagagcaggaccgaugcggcuuggagcucuuggagcgggcacucccucgguggagaccagcagaggaagugcgcuuuacugagcacugcgccuuccgcagcagcgggcgggcggggcugaugcgauauugcgcaugcguguugggaagccagaagggugguagggcuggaaaggagcgaagcagcaaagcccaaccacuggggucuaagggaggguaccacuaggcuuauguaaaagauuuccuggucuccuguauggcacagaacuagaugaugguagggaaagaaacaaguugaaggagaaagauguagcugagauggugaaguuaaguucggacacacugaguuugugcaaaaucaaauuaaaugugaagguccuggagaaagacuuaauucuugauuuugguuuuucuacaaaagaauaagagaaacagaaaugacuuuuuuuucuuuuuucuuuuggaaagcuguaccuuaugaugaugaugaguuguuuaagauuggaauauugagaaauuauuaauagagauaaauucuuacauaucugaaugcagaucaaacaaggaagaauguaaaguguaguuacagacacuggagauaaauccaugugagauuuga

SEQ ID NO: 10229 - RNA, 2501 nt, Mus musculus
cauccacuccacacauuuuagaaaaugacaucacaacaucuccaaccuucagcuccuagcugcaaacucuucucuucaaauauuucuugaaguugugcucaucuuacuccagaccaacuuccugagagccccucaucgugugauuugggaguaauuccaauucuggcugggagugagcuagguugggagccaaacacuagggccaaacugagcguccagagaauaaaucagccacagguauccgcacacaucgucagaggguuagagcucagcugcucugacauaagaaccguuuauauuagucuguaguuguaauaacaucucaccacaggguccugcuuucuccugguuuuuacacaacccagagaucugcccucagcucguacugugagcaaaacaacucugacccuuuuucuguaugacaguuacuuaguccucucgcgggaagaaacaaaaaccagaaaaauaagacaucugcucgaggagcuacaagcagcugucuccagcugggaaaucauucuggcaaacaaaaacaaaacaaaacaaaacaaaacaaaaaggugcuuggagcccucuuuaagcauggugagccuccuggggaggacuuggcagugccuugcaaccucucaauguguugccuauccaggucugaagucugggcugaguuuuggauuucaggcuacaagcucuacaaaagcgcaggaaaaagaaaaagaaaagaagagaggagaggagaggagaggagaggagaggagaggagaggagaggagaggagaggagagaacaaaaacagaacuaacaggaucguugaucaggaugugccuagacacgucuggaucuaaagguaauccaacuaacaggaugaugggcacuaggcuagccaccgggaccugucacauggcgucaguccuccgauuuaaggaucauugcaccaaccccuuauucuuagacuagcuauaugccagaaucccgucgcuucauaaauagcaaagcugcuggcagcguacgcuucccuggguggggcugaaccagcugggugucccgggaaccccugcugcucgccuacugggugcacaggggugcguguacaggcuauuagggaaggggcgcggucccugcccacggaccugccgcuccuccgccugcaucccguacuccucgcgcauccgcagcagcucauccuccagccucgcgcgcagcugcuccaacuccagcgccugguuccgcagcgcgucugccuccugcgcgcacagccgcgccucguccuccgccuggagccggcucucuuggccgcggcgcagcgccugcuccagcucgcgcaccucguccucguacagcugcacgcucucccuccacgacucggccaccagcagggcguagcugucgugcacgucccgcaggcgcggcgggggcgcggcggggcugguggcgcgggcucggaagugcauggugaggcuggcagcgcgggcucguagaucucgcacuuggcguucgugggcagcguccaagucgcggcgcucaguuuccagccggcccagcagcgccucgagggcggcgcgcgcgcccagagccuccucuagcucccgccguugcgcucccagcucggcauccaggcggcugcgggcagugccggcuuccacacccucccgcugcagcuccagcaguucccuccgcagcgcgucgcgcucgcccucggccagggcuguggaccaguucaguucaucuagcugcugucguaggcugcgcgccuccucggcguagagugccugauccucagcccagcgguccucccggcucagccggcugcgcaacuccuccuccaguagcagguucucgcgcuccagcucucgcacccggcacacguagucguaaagccgggcguugagcuccugcagcuccgccuuuucagagcccgucugcagccgccaggacagcaucuugcugggugugccggacccuuucgauuagccgcuugccuccugcccugaucuuguccccuccgccccgccgcgccgcgcccgccgcgccgcugccucggaggcccuuggacuggcgcaccgacuggcgagcuuccccacuuaguggcccggucgcgcggcuguggacuugggccaucgccuccagccaaucaggacgcggcccgcgcggccacugcggccggacagcgcccccugccggacagaucgggccauggcgaggcugcccagcacuggccccccugguggcccaggguaaucccacguggguugucggauuacugcgugcuggcuaucugggacaccuuaugaggcuccccguugcuacuccuagggcgcaacuaaggcaccccugagucccagcuuucuuuaaugaaaaauaguugccauuaaaugagagauccuuuucguagaggaagcuucuaauugguugcucuggagaugaggggcaggagguguauucuuuaaacuagaguuauaguucaacaauaaagagcuugccagauaaagaauaugccaggccug

SEQ ID NO: 10230 - RNA, 2501 nt, Mus musculus
caggccuggcauauucuuuaucuggcaagcucuuuauuguugaacuauaacucuaguuuaaagaauacaccuccugccccucaucuccagagcaaccaauuagaagcuuccucuacgaaaaggaucucucauuuaauggcaacuauuuuucauuaaagaaagcugggacucaggggugccuuaguugcgcccuaggaguagcaacggggagccucauaaggugucccagauagccagcacgcaguaauccgacaacccacgugggauuacccugggccaccaggggggccagugcugggcagccucgccauggcccgaucuguccggcagggggcgcuguccggccgcaguggccgcgcgggccgcguccugauuggcuggaggcgauggcccaaguccacagccgcgcgaccgggccacuaaguggggaagcucgccagucggugcgccaguccaagggccuccgaggcagcggcgcggcgggcgcggcgcggcggggcggaggggacaagaucagggcaggaggcaagcggcuaaucgaaaggguccggcacacccagcaagaugcuguccuggcggcugcagacgggcucugaaaaggcggagcugcaggagcucaacgcccggcuuuacgacuacgugugccgggugcgagagcuggagcgcgagaaccugcuacuggaggaggaguugcgcagccggcugagccgggaggaccgcugggcugaggaucaggcacucuacgccgaggaggcgcgcagccuacgacagcagcuagaugaacugaacugguccacagcccuggccgagggcgagcgcgacgcgcugcggagggaacugcuggagcugcagcgggaggguguggaagccggcacugcccgcagccgccuggaugccgagcugggagcgcaacggcgggagcuagaggaggcucugggcgcgcgcgccgcccucgaggcgcugcugggccggcuggaaacugagcgccgcgacuuggacgcugcccacgaacgccaagugcgagaucuacgagcccgcgcugccagccucaccaugcacuuccgagcccgcgccaccagccccgccgcgcccccgccgcgccugcgggacgugcacgacagcuacgcccugcugguggccgagucguggagggagagcgugcagcuguacgaggacgaggugcgcgagcuggagcaggcgcugcgccgcggccaagagagccggcuccaggcggaggacgaggcgcggcugugcgcgcaggaggcagacgcgcugcggaaccaggcgcuggaguuggagcagcugcgcgcgaggcuggaggaugagcugcugcggaugcgcgaggaguacgggaugcaggcggaggagcggcagguccgugggcagggaccgcgccccuucccuaauagccuguacacgcaccccugugcacccaguaggcgagcagcagggguucccgggacacccagcugguucagccccacccagggaagcguacgcugccagcagcuuugcuauuuaugaagcgacgggauucuggcauauagcuagucuaagaauaagggguuggugcaaugauccuuaaaucggaggacugacgccaugugacaggucccgguggcuagccuagugcccaucauccuguuaguuggauuaccuuuagauccagacgugucuaggcacauccugaucaacgauccuguuaguucuguuuuuguucucuccucuccucuccucuccucuccucuccucuccucuccucuccucuccucuccucucuucuuuucuuuuucuuuuuccugcgcuuuuguagagcuuguagccugaaauccaaaacucagcccagacuucagaccuggauaggcaacacauugagagguugcaaggcacugccaaguccuccccaggaggcucaccaugcuuaaagagggcuccaagcaccuuuuuguuuuguuuuguuuuguuuuguuuuuguuugccagaaugauuucccagcuggagacagcugcuuguagcuccucgagcagaugucuuauuuuucugguuuuuguuucuucccgcgagaggacuaaguaacugucauacagaaaaagggucagaguuguuuugcucacaguacgagcugagggcagaucucuggguuguguaaaaaccaggagaaagcaggacccuguggugagauguuauuacaacuacagacuaauauaaacgguucuuaugucagagcagcugagcucuaacccucugacgaugugugcggauaccuguggcugauuuauucucuggacgcucaguuuggcccuaguguuuggcucccaaccuagcucacucccagccagaauuggaauuacucccaaaucacacgaugaggggcucucaggaaguuggucuggaguaagaugagcacaacuucaagaaauauuugaagagaagaguuugcagcuaggagcugaagguuggagauguugugaugucauuuucuaaaauguguggaguggaug

SEQ ID NO: 10231 - RNA, 2501 nt, Mus musculus
acgucccugcgaucccgaacuccggcucuuggcgccugccgagucggggcccggcccucggcgcgccgggacugcggcuguagccgcuuggagugugcgcgcgggcacgugugcgcggccccgagagcgcgcgcguagagcccccaguguguggcggcggcggcggcggcgcggugaggcugagguucuuguuuaccagcauuaacuccgcugagcggaaaaaaaaaggagggggggggggaaccgaggaggagcgagcgcaccgggcgaacucgagagaggcgagcgacagggaagcugccugcgagccugucccggcgcgcccggcgcucgcagacccucggccccgcucuccggacccuccacgccucuccccgugccugcgagagcuccacggcacgcggcgugcucggcuuugaccuucagcgagccggagcccccgcgcacggagucggcggcgggcgggggccgacgcggggcggcgggagcgcugagcgcugcgcggccgccgcuuuguguguguccuggauuugggaaggagcucgcggcggcggcgcugagggaggaggcggcggcgagcggagcccagaggaggaggaggagccggaggagggggaaccgcucauucauuuccacuccgcauuucugccccucgccggccucgcccgcgcccgggacuucggaccagucucgccaacugcgucgcgcucucccgccgcguaggcuccgguggucguucccuccggggaucggguggcguuuguccucgccugcggcgauuugggcuuugcuccucuuucuguacaguuuuccuccuucuucugcaucucugcguuugcaaauggaggccgacgacgccgacagcccgccccggcgcgccccggcuucccgacuccgccgccccgugggccgcugcugccggcgcugaggggccgccccgcgccacccuccuuguccacgccgcuuuccgaggaucgucgccugcgcucuuguuuuuggacgagagugaggacugaguuggagacuuuuuuuuucuuuuuuucuuuucuuuuuuuuuuuuuuuucuauuuuugagaaaagggaauuucgucccaaauaaaaggaaugaagucuggcuccggaggaggguccccgaccucgcugugggggcucguguuucucuccgccgcgcucucucucuggccgacgaguggagaaagugaguauuugcccgccgcccgcggccacugcgggaacuuuuccuccgaggggcugcgcccuguuugggaaaacccaguugccacgggcgcagcugucggacuucggggcucgggaguggaggguggggcucucucggaaggccggaguagagcagggcccgagaguucacgacucaggagcuccuagagcccuagcucagcgcaucugcgcgcgggaagggccuuagggcuuucucuuucgcuguccggggagcgcugucccgcacgcggccuggugggugggcagugccuucucgcuggcgggucaggggcagcccccgcguaggcgcuugguggggaaguuggcgucuggguggccucgggaaccccgcuacucucgccccccccccuccggggcgcuccacuuggcaccccagcgcccaucccgcgcagcucaccaugacagcacccuuggaggcuccacgggugguugcugggguagaccuagugcuccguggcggcaauucggagccuccuacccugcgggguguaaguuguucuugagggggagauacaggaugguuggaagccucgcggccccaggacacguuuccaaacaucagggcgcagccuccuaucacccaacuuguugggcccaucgacccccucagguucuuggccuuucgcuucucuggagccugugggcgucuacccaccuaccccaaggcuugauaacuuggacaguccaguguggccuuggggugcagggugugcccaccauuuuccucuaggaaagugugaacuugggacuuucuucguggggggaggguuggaugauccucggcuuaggggcucucaguuucuauccagcucuggacacuuuuuucccagagcgucuuaguaagaggagauagguacguccacccuugugcagagucgacgugcuuuuccacacacacguguucagcgcggauuuaggugcauccacagccacacgaccgcgaggggagaaccggacucccagccugggggagagaugugugcgguggguugagcugcgacgggaucuguagugugguaguggacgggugguuguuuuguuuugcgagcgcggagcccuggccuugguuuuguuguggccaaaguuguggugcacugccaacaccucccccccccccccccccgcucugcacuuccuuuguacauacuuaauaagcaguaucgcucaugcuugcuaucgcuugcaaucugauagcuuuuguuuugguggugucggguaggaguagguggugguggggggugucucugggaaugagaacucuc

SEQ ID NO: 10232 - RNA, 2501 nt, Mus musculus
gagaguucucauucccagagacaccccccaccaccaccuacuccuacccgacaccaccaaaacaaaagcuaucagauugcaagcgauagcaagcaugagcgauacugcuuauuaaguauguacaaaggaagugcagagcgggggggggggggggggagguguuggcagugcaccacaacuuuggccacaacaaaaccaaggccagggcuccgcgcucgcaaaacaaaacaaccacccguccacuaccacacuacagaucccgucgcagcucaacccaccgcacacaucucucccccaggcugggaguccgguucuccccucgcggucguguggcuguggaugcaccuaaauccgcgcugaacacguguguguggaaaagcacgucgacucugcacaaggguggacguaccuaucuccucuuacuaagacgcucugggaaaaaaguguccagagcuggauagaaacugagagccccuaagccgaggaucauccaacccuccccccacgaagaaagucccaaguucacacuuuccuagaggaaaauggugggcacacccugcaccccaaggccacacuggacuguccaaguuaucaagccuugggguagguggguagacgcccacaggcuccagagaagcgaaaggccaagaaccugagggggucgaugggcccaacaaguugggugauaggaggcugcgcccugauguuuggaaacguguccuggggccgcgaggcuuccaaccauccuguaucucccccucaagaacaacuuacaccccgcaggguaggaggcuccgaauugccgccacggagcacuaggucuaccccagcaaccacccguggagccuccaagggugcugucauggugagcugcgcgggaugggcgcuggggugccaaguggagcgccccggaggggggggggcgagaguagcgggguucccgaggccacccagacgccaacuuccccaccaagcgccuacgcgggggcugccccugacccgccagcgagaaggcacugcccacccaccaggccgcgugcgggacagcgcuccccggacagcgaaagagaaagcccuaaggcccuucccgcgcgcagaugcgcugagcuagggcucuaggagcuccugagucgugaacucucgggcccugcucuacuccggccuuccgagagagccccacccuccacucccgagccccgaaguccgacagcugcgcccguggcaacuggguuuucccaaacagggcgcagccccucggaggaaaaguucccgcaguggccgcgggcggcgggcaaauacucacuuucuccacucgucggccagagagagagcgcggcggagagaaacacgagcccccacagcgaggucggggacccuccuccggagccagacuucauuccuuuuauuugggacgaaauucccuuuucucaaaaauagaaaaaaaaaaaaaaaagaaaagaaaaaaagaaaaaaaaagucuccaacucaguccucacucucguccaaaaacaagagcgcaggcgacgauccucggaaagcggcguggacaaggaggguggcgcggggcggccccucagcgccggcagcagcggcccacggggcggcggagucgggaagccggggcgcgccggggcgggcugucggcgucgucggccuccauuugcaaacgcagagaugcagaagaaggaggaaaacuguacagaaagaggagcaaagcccaaaucgccgcaggcgaggacaaacgccacccgauccccggagggaacgaccaccggagccuacgcggcgggagagcgcgacgcaguuggcgagacugguccgaagucccgggcgcgggcgaggccggcgaggggcagaaaugcggaguggaaaugaaugagcgguucccccuccuccggcuccuccuccuccucugggcuccgcucgccgccgccuccucccucagcgccgccgccgcgagcuccuucccaaauccaggacacacacaaagcggcggccgcgcagcgcucagcgcucccgccgccccgcgucggcccccgcccgccgccgacuccgugcgcgggggcuccggcucgcugaaggucaaagccgagcacgccgcgugccguggagcucucgcaggcacggggagaggcguggaggguccggagagcggggccgagggucugcgagcgccgggcgcgccgggacaggcucgcaggcagcuucccugucgcucgccucucucgaguucgcccggugcgcucgcuccuccucgguucccccccccccuccuuuuuuuuuccgcucagcggaguuaaugcugguaaacaagaaccucagccucaccgcgccgccgccgccgccgccacacacugggggcucuacgcgcgcgcucucggggccgcgcacacgugcccgcgcgcacacuccaagcggcuacagccgcagucccggcgcgccgagggccgggccccgacucggcaggcgccaagagccggaguucgggaucgcagggacgu

SEQ ID NO: 10233 - RNA, 2501 nt, Mus musculus
uuacacgaagaccugcuuagauauaauuuaguuugcauaugcuucgguacggagucacacuuaucaguaggaaugugcauuugccucuagagacacauguaacuucuaaguguuuuaacagucaaaucucuucuuuaaaaaagcugcuucuccaaacaucaucauccucaccaagcaaaggccacagucuacagcuuaguaugacaaccacagagaaaaggaauacguuugggaaaacagaauacucaaauguucuuuuggccccaggguucagggacaauauuauacacaagacagaaauggggaguuaaaaacuguuuaucugggaaagggugacaaaaaugcauacgauuucucaaaugcucuacaguucagucaccccaggaacagaauugacucuguagagccccacccccacuuccaagucaccacauaacuaucuuuaaccaagcgcuaugucccuucaucuuauuagccuguaggagccuugggaaacuguugagaguucuggcuacucagcgucuggcccucauuaacuuuaacccugggccaggaaugagggauucaugauagcaucaggauacacauagcucuaucucuggaugugguuauccaaccgcuuuugaaaucuuguccaauucgaucuccaucaaaugugcucacuaacacuuaaaaucuaugacauuugauuccaguuucaggucaauagccaaguaaugauuuaacacuauccacucgaagacaucuuuuccuggguagacagaauaggucuggaagugcacugucugaaacucaagugcggaccaccugagcaagacagaagaaagcgacaaaguagguacuugguaauccuuacaaguggauucccugggcauaguagguguccaugggccuuugggcaucaauaaucccuuucuggagacaaauaaagcaaauacauauuguacagaugauccacuccccgugugggcgagcgaccaugauggggaauuaagguagaacuacagaaacucgcagcugcucuccagguacuauaacuuuaucccuccacagaaagauggcuauugggaucugggugggacuagucccccugcaguuaccgcugagcucagggccacacucgggcgccuuuuaaauucccccagcaauugguggauggagaaagagccagggggaaaaaagaugcauaaugauucguucaccgggcggaugaaacggagaguagaggacgcaggaugcuaacuggcuuuuccucccaugugcaggucaccugaaccgcgaugccuuccagucucugaggaggcucccugaacucgccauauggcuccguuuucaagaggggagaagaaacaguuucaugcccaccugccugcggcaucuccuuucaggcaccccuucccuagccccugcccggcgcgcgagcugccggcauccacggucccgcccgcuccgagcuccggccggcagcucccccggcggccgccucugcaccagucgccaaccuccgugccgggccgaggucaugcccgccugcccccggagccggcgaggccccuucccggugccaggcggcaagcccgagaagcgccggcagggaaggggguccgccgcagaguuggcacccggacucaccagguaggcgcccaccguacccugcgccagcaucaaggcgcacucagacaccaggaagaucuugauguuggagaagcaggacaccuucuuuuucuucuucuuguuccucugcgccucgucccccugcagcucgccgcuccggccgccgcccgacgagccgcccggcuucuuucccugcauccuucccccgccgccgccgccgccgccgcuuucccgcucgccccgggugucguggccguugccgggcgggggugcgugccgcgaggcugcguacuguccccgccccgggcccgcggcggccgcccccguccugccgcggcuagagagguugaaggcuccgcuccucgcugccgccgcgcuagcucccuuccuccuccuccuccuucuccuccuccuccuccuccgcccucccuucgccgccuccuccggcucgggcugugccaaucacagggacuccucgcgucgcccgcugcugccgccgccuagccucucucggacucucgccguugccuucaccggcuuccccuggcccgccggcuucgcuugccuucaccccuagcgccccaagcccgggccggggccugaucgccgccuugagccccgggcugcgccgcuacuggcugcgggugcgucccugggaggcacgaggggaccugcuuggggcacuaagggcuugcugauggucaaggccggcggggucuaacuacccagcgaaacugcaaaauccaggaguccuggugggguaggaggcugagcgaggaaggugcuacccggccacuaggaggcauuguggggcccagggcaccaaggcggaaacugggugguacuaggacuagcaaugaggugcagagaugggaguauccaggcac

SEQ ID NO: 10234 - RNA, 2501 nt, Mus musculus
gugccuggauacucccaucucugcaccucauugcuaguccuaguaccacccaguuuccgccuuggugcccugggccccacaaugccuccuaguggccggguagcaccuuccucgcucagccuccuaccccaccaggacuccuggauuuugcaguuucgcuggguaguuagaccccgccggccuugaccaucagcaagcccuuagugccccaagcagguccccucgugccucccagggacgcacccgcagccaguagcggcgcagcccggggcucaaggcggcgaucaggccccggcccgggcuuggggcgcuaggggugaaggcaagcgaagccggcgggccaggggaagccggugaaggcaacggcgagaguccgagagaggcuaggcggcggcagcagcgggcgacgcgaggagucccugugauuggcacagcccgagccggaggaggcggcgaagggagggcggaggaggaggaggaggagaaggaggaggaggaggaagggagcuagcgcggcggcagcgaggagcggagccuucaaccucucuagccgcggcaggacgggggcggccgccgcgggcccggggcggggacaguacgcagccucgcggcacgcacccccgcccggcaacggccacgacacccggggcgagcgggaaagcggcggcggcggcggcggcgggggaaggaugcagggaaagaagccgggcggcucgucgggcggcggccggagcggcgagcugcagggggacgaggcgcagaggaacaagaagaagaaaaagaagguguccugcuucuccaacaucaagaucuuccuggugucugagugcgccuugaugcuggcgcaggguacggugggcgccuaccuggugaguccgggugccaacucugcggcggacccccuucccugccggcgcuucucgggcuugccgccuggcaccgggaaggggccucgccggcuccgggggcaggcgggcaugaccucggcccggcacggagguuggcgacuggugcagaggcggccgccgggggagcugccggccggagcucggagcgggcgggaccguggaugccggcagcucgcgcgccgggcaggggcuagggaaggggugccugaaaggagaugccgcaggcaggugggcaugaaacuguuucuucuccccucuugaaaacggagccauauggcgaguucagggagccuccucagagacuggaaggcaucgcgguucaggugaccugcacaugggaggaaaagccaguuagcauccugcguccucuacucuccguuucauccgcccggugaacgaaucauuaugcaucuuuuuucccccuggcucuuucuccauccaccaauugcugggggaauuuaaaaggcgcccgaguguggcccugagcucagcgguaacugcagggggacuagucccacccagaucccaauagccaucuuucuguggagggauaaaguuauaguaccuggagagcagcugcgaguuucuguaguucuaccuuaauuccccaucauggucgcucgcccacacggggaguggaucaucuguacaauauguauuugcuuuauuugucuccagaaagggauuauugaugcccaaaggcccauggacaccuacuaugcccagggaauccacuuguaaggauuaccaaguaccuacuuugucgcuuucuucugucuugcucaggugguccgcacuugaguuucagacagugcacuuccagaccuauucugucuacccaggaaaagaugucuucgaguggauaguguuaaaucauuacuuggcuauugaccugaaacuggaaucaaaugucauagauuuuaaguguuagugagcacauuugauggagaucgaauuggacaagauuucaaaagcgguuggauaaccacauccagagauagagcuauguguauccugaugcuaucaugaaucccucauuccuggcccaggguuaaaguuaaugagggccagacgcugaguagccagaacucucaacaguuucccaaggcuccuacaggcuaauaagaugaagggacauagcgcuugguuaaagauaguuauguggugacuuggaaguggggguggggcucuacagagucaauucuguuccuggggugacugaacuguagagcauuugagaaaucguaugcauuuuugucacccuuucccagauaaacaguuuuuaacuccccauuucugucuuguguauaauauugucccugaacccuggggccaaaagaacauuugaguauucuguuuucccaaacguauuccuuuucucugugguugucauacuaagcuguagacuguggccuuugcuuggugaggaugaugauguuuggagaagcagcuuuuuuaaagaagagauuugacuguuaaaacacuuagaaguuacaugugucucuagaggcaaaugcacauuccuacugauaagugugacuccguaccgaagcauaugcaaacuaaauuauaucuaagcaggucuucguguaa

SEQ ID NO: 10235 - RNA, 2501 nt, Mus musculus
cccaaaaccaaacacgggacaaauggcuuuucagacuaacuucucacggaagcuucuugggggucaggauugaggcacaaacucguggucaucuuaaauggucucucagucugucucaaacacaacacgguauccuccgaaugggcccugauaugcgcuuggguguugccuggagccuaugcaccuucccaccauagcgagccucacagaagcaggauuaagcagguugaguaaccugcacacagagggaacucagaaaauguucuccgaaccaaaccauuaagcugggcccccuacaaacgguaguccccuguugcuaacccccgacuuaccaggccgagggggauauggccaccgccaaaguggggcagguucccucugccaagcagaccuccacgucgaacaccagggcccgcuccucggggauggccacggguucggccucccccucggggccguaccggguccagcccuccgcccaggcccagcucuugggcucggggggcaauugggccuccaauaacgaggcggccgccuccaaguaaggcaggcucugcuucugggccaggaggcggaagugcugguccagguugcccccgaagagccggggcaggcgcagcuccacgucuggcaagggcguggccggcugcccccagagcccgugcuucugcaggugcucuacgcugcgcugcaccgcggccucgucgggcauuuccccgccgcacccgaagaucugcucgugcaggccucucgacaacaucuggaugagcagaggguugagccgcagcugcccauucucggaggagggcauuugcgacggcggccgcccgucgcuggggacggggucgaggacggagcuggagacccagcgcgcgguugcugguacuggcccugaggcgaccuuggcgccagccaccuucuuccagagcaggcggcucaugguuggugcagggagccccccgcugugagucggggcaccgggcuuugggcuccagcuugacugcuuuuaguggccgaaagacucagagagagacgcguccccucucugugcuccugucagugaaauaggucucaccaugccugccuuccucacacaaguccuaaaggagacagacgauaaaaguguuauuacaagugucacggacuugaacaaaccgcuuaucccgcaacaaacaucugcugcgugccaaacaagcauuuucuccacuugaucuuagccaaaaggccagagcggaguagggacauuuuucuguuacgccuccaacaaccuuaagaaauggcacugcccccucccgaggacagggccacaccggcucggcaguuaacuugggagaagccgcuggagaugcugaaauggggagacgcagacagaccaggguucuggcucuccaacugcgugaccuuggcccagcuccuuaggccccgaccuccuccucuguaaaaugggguuaagaacucuagagccacgggccacugcuguaagaguggcagagggcgcgcucgucgaguggcccuaaccccaguaggcgcucggcagacagcaguugccagucccaccccgccggcggcccgagggccuagcgccccaacuucgaaacccgccgaacgagccacagccucgggguccgcacccacacccgggcgggccuagggcgcccuggucggggcgucggcggccacccccgcacgccgggacacaggguccccgccgcagccgccgcccugcucccggcccggcuucccgaguggagagggagcagccgcgcccggcccucccccugccgagcccgccggaaaccucgguccgcuucgcgcuucccguucugcggcagcccacagccccggcgacgacgcggcguccgcggcgcgcggcccacgcagccucaggguggcgugcggucucgggagcagccgcaacuucccgucugcgcgaacugggucccgcggcuacccagaggcaggcgggagacucccccgagcguccaauaagagcgccgccaauggagccgcccgcccgcgggggugcagagggacuuccgggugagguccuccgcuacuucccuccccacggaaaagauagaccagucugacgcgagccugaaggcggcuacacgcuuuaagcuaaguaaaggcaccuucucgcuggcggccgcguggccuaauggauaaggcgucugacuucggaucagaagauugcagguucgaguccugccgcggucgacuuguauguuguuuuuaucugucaguuuguuaaucccaagauucccuuuggaaauaaagcgaaauugaccguagugguuaugaccaacuucuagucuaaacuuaauucuuggaacucaaggaucugagcaaacaacugucagggugacacauugcuuaaacggugacagcggucgagagccuugucccggauggagaguggagcaaacggagcacgugccguccgaagucuagauuugucaccuauggaccgcaaaggcuaagccucgauggagucuccu

SEQ ID NO: 10236 - RNA, 2501 nt, Mus musculus
aggagacuccaucgaggcuuagccuuugcgguccauaggugacaaaucuagacuucggacggcacgugcuccguuugcuccacucuccauccgggacaaggcucucgaccgcugucaccguuuaagcaaugugucacccugacaguuguuugcucagauccuugaguuccaagaauuaaguuuagacuagaaguuggucauaaccacuacggucaauuucgcuuuauuuccaaagggaaucuugggauuaacaaacugacagauaaaaacaacauacaagucgaccgcggcaggacucgaaccugcaaucuucugauccgaagucagacgccuuauccauuaggccacgcggccgccagcgagaaggugccuuuacuuagcuuaaagcguguagccgccuucaggcucgcgucagacuggucuaucuuuuccguggggagggaaguagcggaggaccucacccggaagucccucugcacccccgcgggcgggcggcuccauuggcggcgcucuuauuggacgcucgggggagucucccgccugccucuggguagccgcgggacccaguucgcgcagacgggaaguugcggcugcucccgagaccgcacgccacccugaggcugcgugggccgcgcgccgcggacgccgcgucgucgccggggcugugggcugccgcagaacgggaagcgcgaagcggaccgagguuuccggcgggcucggcagggggagggccgggcgcggcugcucccucuccacucgggaagccgggccgggagcagggcggcggcugcggcggggacccugugucccggcgugcggggguggccgccgacgccccgaccagggcgcccuaggcccgcccgggugugggugcggaccccgaggcuguggcucguucggcggguuucgaaguuggggcgcuaggcccucgggccgccggcggggugggacuggcaacugcugucugccgagcgccuacugggguuagggccacucgacgagcgcgcccucugccacucuuacagcaguggcccguggcucuagaguucuuaaccccauuuuacagaggaggaggucggggccuaaggagcugggccaaggucacgcaguuggagagccagaacccuggucugucugcgucuccccauuucagcaucuccagcggcuucucccaaguuaacugccgagccgguguggcccuguccucgggagggggcagugccauuucuuaagguuguuggaggcguaacagaaaaaugucccuacuccgcucuggccuuuuggcuaagaucaaguggagaaaaugcuuguuuggcacgcagcagauguuuguugcgggauaagcgguuuguucaaguccgugacacuuguaauaacacuuuuaucgucugucuccuuuaggacuugugugaggaaggcaggcauggugagaccuauuucacugacaggagcacagagaggggacgcgucucucucugagucuuucggccacuaaaagcagucaagcuggagcccaaagcccggugccccgacucacagcggggggcucccugcaccaaccaugagccgccugcucuggaagaagguggcuggcgccaaggucgccucagggccaguaccagcaaccgcgcgcugggucuccagcuccguccucgaccccguccccagcgacgggcggccgccgucgcaaaugcccuccuccgagaaugggcagcugcggcucaacccucugcucauccagauguugucgagaggccugcacgagcagaucuucgggugcggcggggaaaugcccgacgaggccgcggugcagcgcagcguagagcaccugcagaagcacgggcucugggggcagccggccacgcccuugccagacguggagcugcgccugccccggcucuucgggggcaaccuggaccagcacuuccgccuccuggcccagaagcagagccugccuuacuuggaggcggccgccucguuauuggaggcccaauugccccccgagcccaagagcugggccugggcggagggcuggacccgguacggccccgagggggaggccgaacccguggccauccccgaggagcgggcccugguguucgacguggaggucugcuuggcagagggaaccugccccacuuuggcgguggccauaucccccucggccugguaagucggggguuagcaacaggggacuaccguuuguagggggcccagcuuaaugguuugguucggagaacauuuucugaguucccucugugugcagguuacucaaccugcuuaauccugcuucugugaggcucgcuauggugggaaggugcauaggcuccaggcaacacccaagcgcauaucagggcccauucggaggauaccguguuguguuugagacagacugagagaccauuuaagaugaccacgaguuugugccucaauccugacccccaagaagcuuccgugagaaguuagucugaaaagccauuugucccguguuugguuuuggg

SEQ ID NO: 10237 - RNA, 2501 nt, Mus musculus
cgaucaacaggucccucaucgaauccuagccaggccuccaagccacaugaagaugggaagcucuagccagggagauggugcccugguguggggacggugucccagauguggcucagcugcccagaagagcagacacgccguucugcucccucccaccgcugagcauggcaaugcccaagccuuacauggcucagagucuuguccuuuaugugucugugaaauauaugcaaagguaaccaagguacaaaaacacuaaaggaguuguguuuucugguuuuauccagucccucccuacauuuaaaaaagaggaacuacuuccugucaccuucucucaggaagcuccccacuccguuucacccuaccccacccuuucagacugacccaugcagcauagauguugaccaggaaggaggguagaaggccuuuguguuuccaggcuggagauuacaagacuccuccuccacaaucccaugucagcuuucccugacacauagcagaacuuccagcaggguaugggagcauggggcaaugggggcucgugccaccaugaguuugggccagccugggccguacagugugagguucccccucccacacacccccaaauaaggaagaaagaaaaauaaacccuccaaaugacacuagcacaaucgguuuauucacaaauaaauaaauacacaccaggcaaagcuugugccugcuucaucuuuagagcguguacccuauugggcgccuccuuccaaggaggguuggaaugguacagucuggaugagggccagcucccaccccgggaugcccauguugguaucacugccgccucuuccaggaucuacucccuccgaaggugccaagaccaaaggaaaagugucugugcucagacagggugacaaucauccguugcauuguccccuccacucuucaggcaggcggccacuccugcggcggcguccagguuucuagaagagccagcaugucgcugcugaagagcugcaggaagagugaacagcgccacaaucaacaccugccccagggucagguccgcgcucauccgcuccacgcucaagguuaagcgagcaagcaaagcguccuuaaucccugccuguccaacucccacccuguucggacacccagggcacacggggaugcgcccaagggagauccugagugcagcagagaggcugguccgcgacguggggcugugcgucgcgcaccaacaguagggggcgccaccucgacagugugggggaagggguuacuaaccggagaugagggacugggcuccauuuccugccuuuccugggaugcuguuucugcguacaggaacgaugggucccacgauucugcggcgacucggggucuaggguaggcaggcggggauccccacgacaccccgcugcagacggccgggcuuaaacggggaccgagcgacugcgacugcgccaggucgcugucggggcacagcgggcagccucgaggugacaccgcgugccgcugucgccggagguuguccucgcugagucccagcacagccgacagguggccaauguagcggauggccaggcgcagcgucucgaucuuggucagguucuggccgguuggugccacggauggcggcaagaagcggcgcagcucgugcagcgcgcgggcgagugugcgcauacguagcuucucccgcucgcuggcgcucugccgcuguccgcuacccaggcggcuaccgugcgucccgcgccuacccggggucccagcacgccgggccgggcgggcgcaggguggugcagggcugcuggccugggcaccgucccacggguccgaggaccaggcuggggagcagacgcuguucccaucggaaggcaucgguggcugccgaccagcgggacucaggauccaggacucggagcgcggcucgcacaggggcugggccauggcagcggaggccugaccauuggguccgcuguagcuuuauccugagcccuaggugugaagcgggccccuuccagaauucaucagcauaucaaagccggcucgagccaggaggggggcagggccugaacccuuugaaccauagcaggggcucugaggugcaggaccccuuaguccagucugcuccaccuggaccauauuuggggccucaguaagucaggcaccuauggccaggacugccaguugaaagaaccaugcucagagaacugaagucuagcuccuaggcuuaggguacaccuucauuuauuagggacccuacgccauuuuuuuccaucacuuuaauuuacaaauuguauaacaagagacuucgggauugcauuggccaacuguggacuagggaccucuagacacggagagaacucuaguucaguccuucccagaggcuuggauguggccuguaguccucccugauguccaggcuaugggaggcacauugaagaaaccaucccgaccgaccugugagguugcugggguguccgggcagggggagaggugagccugccuccccacacuacaaguca

SEQ ID NO: 10238 - RNA, 2501 nt, Mus musculus
ugacuuguaguguggggaggcaggcucaccucucccccugcccggacaccccagcaaccucacaggucggucgggaugguuucuucaaugugccucccauagccuggacaucagggaggacuacaggccacauccaagccucugggaaggacugaacuagaguucucuccgugucuagaggucccuaguccacaguuggccaaugcaaucccgaagucucuuguuauacaauuuguaaauuaaagugauggaaaaaaauggcguagggucccuaauaaaugaagguguacccuaagccuaggagcuagacuucaguucucugagcaugguucuuucaacuggcaguccuggccauaggugccugacuuacugaggccccaaauaugguccagguggagcagacuggacuaagggguccugcaccucagagccccugcuaugguucaaaggguucaggcccugccccccuccuggcucgagccggcuuugauaugcugaugaauucuggaaggggcccgcuucacaccuagggcucaggauaaagcuacagcggacccaauggucaggccuccgcugccauggcccagccccugugcgagccgcgcuccgaguccuggauccugagucccgcuggucggcagccaccgaugccuuccgaugggaacagcgucugcuccccagccugguccucggacccgugggacggugcccaggccagcagcccugcaccacccugcgcccgcccggcccggcgugcugggaccccggguaggcgcgggacgcacgguagccgccuggguagcggacagcggcagagcgccagcgagcgggagaagcuacguaugcgcacacucgcccgcgcgcugcacgagcugcgccgcuucuugccgccauccguggcaccaaccggccagaaccugaccaagaucgagacgcugcgccuggccauccgcuacauuggccaccugucggcugugcugggacucagcgaggacaaccuccggcgacagcggcacgcggugucaccucgaggcugcccgcugugccccgacagcgaccuggcgcagucgcagucgcucgguccccguuuaagcccggccgucugcagcggggugucguggggauccccgccugccuacccuagaccccgagucgccgcagaaucgugggacccaucguuccuguacgcagaaacagcaucccaggaaaggcaggaaauggagcccagucccucaucuccgguuaguaaccccuucccccacacugucgagguggcgcccccuacuguuggugcgcgacgcacagccccacgucgcggaccagccucucugcugcacucaggaucucccuugggcgcauccccgugugcccuggguguccgaacagggugggaguuggacaggcagggauuaaggacgcuuugcuugcucgcuuaaccuugagcguggagcggaugagcgcggaccugacccuggggcagguguugauuguggcgcuguucacucuuccugcagcucuucagcagcgacaugcuggcucuucuagaaaccuggacgccgccgcaggaguggccgccugccugaagaguggaggggacaaugcaacggaugauugucacccugucugagcacagacacuuuuccuuuggucuuggcaccuucggagggaguagauccuggaagaggcggcagugauaccaacaugggcaucccggggugggagcuggcccucauccagacuguaccauuccaacccuccuuggaaggaggcgcccaauaggguacacgcucuaaagaugaagcaggcacaagcuuugccugguguguauuuauuuauuugugaauaaaccgauugugcuagugucauuuggaggguuuauuuuucuuucuuccuuauuugggggugugugggagggggaaccucacacuguacggcccaggcuggcccaaacucaugguggcacgagcccccauugccccaugcucccauacccugcuggaaguucugcuaugugucagggaaagcugacaugggauuguggaggaggagucuuguaaucuccagccuggaaacacaaaggccuucuacccuccuuccuggucaacaucuaugcugcaugggucagucugaaagggugggguagggugaaacggaguggggagcuuccugagagaaggugacaggaaguaguuccucuuuuuuaaauguagggagggacuggauaaaaccagaaaacacaacuccuuuaguguuuuuguaccuugguuaccuuugcauauauuucacagacacauaaaggacaagacucugagccauguaaggcuugggcauugccaugcucagcggugggagggagcagaacggcgugucugcucuucugggcagcugagccacaucugggacaccguccccacaccagggcaccaucucccuggcuagagcuucccaucuucauguggcuuggaggccuggcuaggauucgaugagggaccuguugaucg

SEQ ID NO: 10239 - RNA, 2501 nt, Mus musculus
gcaagacgcgguccggagcacggagcgggagucucggaugcucaacuccuggcucgcgcagccgccucggcgcuucucgacggcgcggcccgaccggagucgaggcgcucgcuccgucagcgagcggguccccagcucggagugcgggcgccgagggcugggcuccccuacgguagcccgacuaggggcgcucacccagccguccgccgggccgaggagaggcaccgccaggcgagcgagcgcccguuuccucgagagucagacgaggcgagggcggcggugcaaacgcggcgcgggcucgcggcucccgguggcgagagcgcaaaucuccacccccgacauuuccccggaagcgcggcggcugcggcgcgcgcggcgaugugagggagacagcggcggcucccgccucaggaagggcauguucggaggggcguccgcggcgcgccucucgccccagcgcccccuccccacggccgccgcgcccgcagcgcaauaaaaggggcggccgcgcuuccugacgcgagacccgcgcuugccgccgccgcccacccgccugcccgcccgcccgcucaggccgcgaugacacggcgcccgcggcggccccgaggcgccgggcgggccguuugcugaccggaucgcggcugcccgccagcgaguccgcggugccgccgccgccaguaugggcugcgccccgagcauccacacuuccgaaaaccgaacguuuagccacagcgacggcgaggacgaggacguggacguggacgucccgggccccgcgccgagaucuauucagcgauggucgaccgcgcccgggcucguggagccucagccucgggauaacggcgccucgaaggugagccgcacugggagggcggggaaacaaacgcggggcacugggggcccucuaggcagccgcccuggcguugaccgacgccagccgcccgcguuugcgggcugucgcggaccgaggcuuaacagggcuaugacgcggcgccgcgggauccgccguguccguuccuucccggccggggucggacgcggcgagucaguuuucucccagcggggugggugggggacccgggauauccccggcacguuccugacaugguaaaccagagugcacuuugcucuggcauucccagaguagaaaggcaaggguuguccgcacugggaagggucuuagaugccaccaguucccccccccccucacccccugccuagcuuaucccaaccucuguccucucauugcacaagcaguuucacuuuuccacuuuuuugggggccauugaaauguaaccuggaacauagguuuggcuucacugcacgcuuuaucugaaguucagguuuguuagcauacgugugguauuuaaagccuguguaauuagaaaauacuacuggagacgugaccgugacccucgaaggauucagcagggcgaaguuaauuuuguauggaggcagucugccugggacuugcaggguuuucuguuuuguuguuuguugcguggcuucuccagcgccuuuugccucagcuuuuaucaaaaguuuccagggcgaagguuuucugaaggaaagauaaaaguucacagaggcacccgcagcagcuucccacuuacauuugggauuuuggagugacaucucaggcguuguaaaacaaacugguaugcugggcugcaguguuugaacauagacuccucuuuacuaggaaguuuuaaguauuuugcaauuuuuaaaaauugcuuacuggguacugcacacccucccagauuugaacgauguaguugacuuacuuaacugucuuaacuuucuagcagucauagaaauaauccuuuuuuguuggaaagagacgauguuguucagcuuugcacacuggagugcuuacccugcccuaccaauugcucuaagugaaaauucaacuguguucugauuauucucaguugaauucuuucuccugggguuucuuuaaagaaaccugugauggcuagaguuuagaaggcuaggccaaacugcuuuuaauggcuuauauaacuaagucuuaacaggcuuacaaacaagcaagacacuauagauaaaguugaaugugggaaccuuaacaacugucacauuucuuacccaaaucuaacauuguuuucuuuuucauuagccaauauuaaauuccaaagccaucuuucuucagugagacaccuuucuucuuacaggccuuuuugugguggcuuagacuuccuauuaggcguccuguaaaccucuccugugcagcaguccaccucugccauccacagguccuauccccgaguacugcugugcccacagaucuuuucuugucaggacguagacagugcguccaaccucacaguguccaaccucauggcaggcacagacuaggugcuaaagaucuguuggcuuuauuuuauuuuauuuuauuuuauuuauuuauuuauuuauuuuuacuguuuacucguucauacuucugucugugcuauuuguguccauagaacauuuaagau

SEQ ID NO: 10240 - RNA, 2501 nt, Mus musculus
aucuuaaauguucuauggacacaaauagcacagacagaaguaugaacgaguaaacaguaaaaauaaauaaauaaauaaauaaaauaaaauaaaauaaaauaaagccaacagaucuuuagcaccuagucugugccugccaugagguuggacacugugagguuggacgcacugucuacguccugacaagaaaagaucugugggcacagcaguacucggggauaggaccuguggauggcagagguggacugcugcacaggagagguuuacaggacgccuaauaggaagucuaagccaccacaaaaaggccuguaagaagaaaggugucucacugaagaaagauggcuuuggaauuuaauauuggcuaaugaaaaagaaaacaauguuagauuuggguaagaaaugugacaguuguuaagguucccacauucaacuuuaucuauagugucuugcuuguuuguaagccuguuaagacuuaguuauauaagccauuaaaagcaguuuggccuagccuucuaaacucuagccaucacagguuucuuuaaagaaaccccaggagaaagaauucaacugagaauaaucagaacacaguugaauuuucacuuagagcaauugguagggcaggguaagcacuccagugugcaaagcugaacaacaucgucucuuuccaacaaaaaaggauuauuucuaugacugcuagaaaguuaagacaguuaaguaagucaacuacaucguucaaaucugggagggugugcaguacccaguaagcaauuuuuaaaaauugcaaaauacuuaaaacuuccuaguaaagaggagucuauguucaaacacugcagcccagcauaccaguuuguuuuacaacgccugagaugucacuccaaaaucccaaauguaagugggaagcugcugcgggugccucugugaacuuuuaucuuuccuucagaaaaccuucgcccuggaaacuuuugauaaaagcugaggcaaaaggcgcuggagaagccacgcaacaaacaacaaaacagaaaacccugcaagucccaggcagacugccuccauacaaaauuaacuucgcccugcugaauccuucgagggucacggucacgucuccaguaguauuuucuaauuacacaggcuuuaaauaccacacguaugcuaacaaaccugaacuucagauaaagcgugcagugaagccaaaccuauguuccagguuacauuucaauggcccccaaaaaaguggaaaagugaaacugcuugugcaaugagaggacagagguugggauaagcuaggcagggggugagggggggggggaacugguggcaucuaagacccuucccagugcggacaacccuugccuuucuacucugggaaugccagagcaaagugcacucugguuuaccaugucaggaacgugccggggauaucccgggucccccacccaccccgcugggagaaaacugacucgccgcguccgaccccggccgggaaggaacggacacggcggaucccgcggcgccgcgucauagcccuguuaagccucgguccgcgacagcccgcaaacgcgggcggcuggcgucggucaacgccagggcggcugccuagagggcccccagugccccgcguuuguuuccccgcccucccagugcggcucaccuucgaggcgccguuaucccgaggcugaggcuccacgagcccgggcgcggucgaccaucgcugaauagaucucggcgcggggcccgggacguccacguccacguccucguccucgccgucgcuguggcuaaacguucgguuuucggaaguguggaugcucggggcgcagcccauacuggcggcggcggcaccgcggacucgcuggcgggcagccgcgauccggucagcaaacggcccgcccggcgccucggggccgccgcgggcgccgugucaucgcggccugagcgggcgggcgggcaggcgggugggcggcggcggcaagcgcgggucucgcgucaggaagcgcggccgccccuuuuauugcgcugcgggcgcggcggccguggggagggggcgcuggggcgagaggcgcgccgcggacgccccuccgaacaugcccuuccugaggcgggagccgccgcugucucccucacaucgccgcgcgcgccgcagccgccgcgcuuccggggaaaugucggggguggagauuugcgcucucgccaccgggagccgcgagcccgcgccgcguuugcaccgccgcccucgccucgucugacucucgaggaaacgggcgcucgcucgccuggcggugccucuccucggcccggcggacggcugggugagcgccccuagucgggcuaccguaggggagcccagcccucggcgcccgcacuccgagcuggggacccgcucgcugacggagcgagcgccucgacuccggucgggccgcgccgucgagaagcgccgaggcggcugcgcgagccaggaguugagcauccgagacucccgcuccgugcuccggaccgcgucuugc

SEQ ID NO: 10241 - RNA, 2501 nt, Mus musculus
acaugagaguacaaauuaaguuaugcagcugucugaacacaaucugaguucucaaacucugaggagcucacaccuuaaaagaguccaucaaagugucugaggauucagcuacaacagaacacagucaacaccugaguggagacaguuacaguuucuguaaaacugaaguuugugaacuugcaacaauaaauaagauaaugagucauauuuuuuaacuaucugaaaguaugcuaaaaagaacaguuauuaaaauucuccagagaaagaagggcagcugucuguaucuauuuuaaaagaaaaauaaaauacagcacaaauuguaacacuugaaguaaugugcaaaauuacacuuugaugcauacaauuuuaagaaagguauaauaauaugcaucaacaaauuuggggaggggcgaaugagaaaguuacauguuucacuacuuaacaaaaguuuuaacgcacaaacaucaauuuguaaacuaaaccucuguuaaauucgaaaagaucccaugaaaucuaacagcacagugaagacaacgagcaaguaaaaacagacugccaaaaaagauuugccaaaaugcuguuuuucaguucaccuauacugucacaccaaaaucuuguugcuuuaauaagaaaaauuuacuucuuauuguugauauaucuguucuguguuuccaugcaguaacagguucucucucucucucucucucucucucucucucucucucucucucucucucucucucucucucucucucucacacacacacucugacagggauucccaggacaccaguggggccucuuucaagccccuuaaguguuaacagcagaggccuggcugugaccaggcgucuggcccgauuuaaaugcccucaucuucagaggucugcggugagccuagccauaaaacuaggggacauuaccgaaccccagagugucugaucuucccccccccccccgcacugcauacaacuucacucauacaauuaaggcugcuaguuggcauuccauuuaacugucaaacucaggcugguggcagccccacagccacaaagagaugccuuaaacgagaagaacauguuucuacaccgcauuugagaaaguuuggcuccgagcuauguacugauugauaucagaucucucucacuugccucuccaaucuugucacaucuggcugacaaauccccaggaguuuauccgaagucgugaggccaguaggguuaaggggcuccccuggggaagcagcgcccguggacagcggacacccgaagcggaugcugggguacgcccggcuggaaccccgcugcgggguggacagucacugggccacuaagcaccucaccucugcauugccaggaucccuuccugucacucucagguaaaccaucuccaaagagacuggaccuuggcccucuggcuuccccaucagcauccggaugcgcuccuccaagucccugagcgaccggagggcacgaacaccccucacugucccacgcucgacaagccaggcggaacgccggcaaaccaacgcacuccuucagcgcgguucaacugcgagcauccguccucuucagacacgucuaacuaagcugacgguuugcggcgcuuuuggucuuuugucucuucccuuuuaaaaaagcaaggauuugucccucaggggaccggcgcccccuccacgccccucgggcgucuccgcgacucuccucccgggaugaccgaaggucacggcuugaaauaccagacagauggacgucccugcgccaacagcgguuggacaggggcucugggguguaagagaaacggggcgccgcucacgggucaccucgcugcgaccgggcacaggcugcgaggaacugcaguucggccucccgggacgcacacacggcgccgacgacgagcagguggcccucguagggcggccccgcgcccgucgcccgcgcgaccgcuuaccucagccauccugcagccgcugcggagccggccuucccggcgcgcguccccugcccgggccgcuccgcguccgccccggcucggcgaccgccgcauccacgcucuggccgucugggccacccccgcccccccugcgcaggagaagugggcggcuccccgcggcgccgggugaccgcgccggcccuugcgccccucgugcacccucgcguccgccccgcgccccgggguccgccccuccgcucgccccgccccgcgccccuacuccggccgccgggggcugcgggcgacgcucgaggggguguggggaggccacgcagagucgccucgguugaggccaggccgcggccccccgcgcacagcggagaccucggcggccgcgggcgcggaggugucugcccccggcgggcuugaaggcacuuguugagaaggagacagacgugucgguguuugccucuccccggcgagggcgaaacgcucucugaaguucccuggcucugcucucucgggcugaugcagccucccucgccucccccggaggcgccucggguccc

SEQ ID NO: 10242 - RNA, 2501 nt, Mus musculus
gggacccgaggcgccuccgggggaggcgagggaggcugcaucagcccgagagagcagagccagggaacuucagagagcguuucgcccucgccggggagaggcaaacaccgacacgucugucuccuucucaacaagugccuucaagcccgccgggggcagacaccuccgcgcccgcggccgccgaggucuccgcugugcgcggggggccgcggccuggccucaaccgaggcgacucugcguggccuccccacacccccucgagcgucgcccgcagcccccggcggccggaguaggggcgcggggcggggcgagcggaggggcggaccccggggcgcggggcggacgcgagggugcacgaggggcgcaagggccggcgcggucacccggcgccgcggggagccgcccacuucuccugcgcagggggggcggggguggcccagacggccagagcguggaugcggcggucgccgagccggggcggacgcggagcggcccgggcaggggacgcgcgccgggaaggccggcuccgcagcggcugcaggauggcugagguaagcggucgcgcgggcgacgggcgcggggccgcccuacgagggccaccugcucgucgucggcgccgugugugcgucccgggaggccgaacugcaguuccucgcagccugugcccggucgcagcgaggugacccgugagcggcgccccguuucucuuacaccccagagccccuguccaaccgcuguuggcgcagggacguccaucugucugguauuucaagccgugaccuucggucaucccgggaggagagucgcggagacgcccgaggggcguggagggggcgccgguccccugagggacaaauccuugcuuuuuuaaaagggaagagacaaaagaccaaaagcgccgcaaaccgucagcuuaguuagacgugucugaagaggacggaugcucgcaguugaaccgcgcugaaggagugcguugguuugccggcguuccgccuggcuugucgagcgugggacagugagggguguucgugcccuccggucgcucagggacuuggaggagcgcauccggaugcugauggggaagccagagggccaagguccagucucuuuggagaugguuuaccugagagugacaggaagggauccuggcaaugcagaggugaggugcuuaguggcccagugacuguccaccccgcagcgggguuccagccgggcguaccccagcauccgcuucggguguccgcuguccacgggcgcugcuuccccaggggagccccuuaacccuacuggccucacgacuucggauaaacuccuggggauuugucagccagaugugacaagauuggagaggcaagugagagagaucugauaucaaucaguacauagcucggagccaaacuuucucaaaugcgguguagaaacauguucuucucguuuaaggcaucucuuuguggcuguggggcugccaccagccugaguuugacaguuaaauggaaugccaacuagcagccuuaauuguaugagugaaguuguaugcagugcgggggggggggggaagaucagacacucugggguucgguaauguccccuaguuuuauggcuaggcucaccgcagaccucugaagaugagggcauuuaaaucgggccagacgccuggucacagccaggccucugcuguuaacacuuaaggggcuugaaagaggccccacugguguccugggaaucccugucagagugugugugugagagagagagagagagagagagagagagagagagagagagagagagagagagagagagagagagagagaaccuguuacugcauggaaacacagaacagauauaucaacaauaagaaguaaauuuuucuuauuaaagcaacaagauuuuggugugacaguauaggugaacugaaaaacagcauuuuggcaaaucuuuuuuggcagucuguuuuuacuugcucguugucuucacugugcuguuagauuucaugggaucuuuucgaauuuaacagagguuuaguuuacaaauugauguuugugcguuaaaacuuuuguuaaguagugaaacauguaacuuucucauucgccccuccccaaauuuguugaugcauauuauuauaccuuucuuaaaauuguaugcaucaaaguguaauuuugcacauuacuucaaguguuacaauuugugcuguauuuuauuuuucuuuuaaaauagauacagacagcugcccuucuuucucuggagaauuuuaauaacuguucuuuuuagcauacuuucagauaguuaaaaaauaugacucauuaucuuauuuauuguugcaaguucacaaacuucaguuuuacagaaacuguaacugucuccacucagguguugacuguguucuguuguagcugaauccucagacacuuugauggacucuuuuaaggugugagcuccucagaguuugagaacucagauuguguucagacagcugcauaacuuaauuuguacucucaugu

SEQ ID NO: 10243 - RNA, 2501 nt, Mus musculus
acccagucacaguauggcuuaagaaugauggucuuguaaggaaacgggaggggacuuaagaagcccagcaaaucaaguacaaucucauggucacacagagcuuaacuucucuaucagguuuuaggcaaaaugagccauccuaguaaucccaagacagccuagcagcagagcaauuacagagugcugucaauggugagaccaugagaaacgaaaucccuggaguuauuuggaauuaugcaugaauaaugcccggugcauuaacuccuaaaacauccaugggagggaugcucaggagaaccugagacuauuagcacagcagaccugggccaacaauguucucagacacacuaaugggaacuuuggcacuuaggccacaggcagaaaaauauaccuacauccacugucuaccugaauagucaucagugagacagaaaugaaauccauauuaauuaccuuggaagacugcuuccuuccaaggucagagaaagcaugacaagcugccuacugccuguuuauaauaauggaaaauacaagugaagauuuauucauauauuuauggcacacucagaaaaaaaaugaauguagugccuucaaaagaauccucggucucuuuaucccguccccaauccaguucuaagagacucuuuaaaaauguucacugaauaacacaggcuagccucaaguucacuggccuuccccagccuucgaaguguuaggauucacaggcaugcacuacuguaccucacuccuaggagacuccuagaaagacagguaauaguucuuuuaaacacuuuccccccccgaaacaaugucuaacaauauccugauacuaauuugcaauagggauuuuggaaaaaccuaacuucaacuauaaaucaaacucuucucacagagccugauaaggcuauuuuguauugaccuaucuguccuuaaggcauucgcuaggaccucucaaguucacuuacaagaccugggaguagcaauuucuauacuaaccgagauccugaaucaucuggaacuuuccacaggcuacgggcuguuucuaaauucucguggaugucacccaauggacaauaaaacaaacaggauuuuaaucagaggcuuuucucaagggaugcucugagggaggugggagggagaaucggcuccauuucaggagggggugguauugcuccaucuaaacacaucuuccucucuuaaaaguucuaggggagggcaaaucuuuucuuucaguuagcaauuugugauaaauggcuacaugcugaagaaauauuugcuuccaacaacuguugauagcccaggcauaauuuucuagauuuagcacucagagcaaagucggcacccagcacagagccugaucccaacuuguguuugcugacuuuuucuugcuuguuaagguguguucauagucacgugccagguuaaaaauuaaugcucagagcacgaugaagucagauacaguaggcgcaaaacucaaagaaagaaaaugguagagguuacaguguguguucgugggggagagccuaccuugaccucuccagggacaccuugccauacacagcuccacuugaccccuagacaacaccuugcauccaagacagcgcuuucaaaaccuucuuuuccccauccacuuuaagagagacacugagugaauccaaacgcuguacagagccgguguccggggagggaggcucuuucaggcucuuguccuaagcccagagucugugcggaagccacggcaaacuccccgguguuacccgcagccaccccaccccgcgcgcacccgacucuuuguccggcuccggcacacgccugguccuucggacccagcgggagacgccggguccccgcaucgcacucacccgcguggagcagcccgccggggccgcggccgugcgccgcucagacaggugugggcgcccggaggacgcgcgcggcucccaugccugcuccgcagaguggccgagugcgagccugagguccagcagagccugcagcacccgguccgccccccauccccuccccuucgccucccgggcccucccgccccgcccccagccgcgagccgcgcagcccgccggccgucgccuccccuuccccuagccgccugccuccagccagcgucacccugcuauucagagguccagaacccucgggccccgcgcaggugggucuccgcagcgcgucaccaccagcggguccccguacucgaugccccugcaccguguccgaugaacggcuccuaccagugacucuugcacucucccgcucuagacaacuucacaccaaguucuaggggucuacauugcccagagucugcuaaagcaaugcuccagagugggcggucccuuccaaccuuccaguccuccagcaccccgggugcguggagcgccgcuaggcaaguuugcaaagcagaauucaaacuuguaagcuccucacccgugcgcauucugugcgccuugaauagugacgaccgagcuccuuuccaccuuaguuccucc

SEQ ID NO: 10244 - RNA, 2501 nt, Mus musculus
ggaggaacuaagguggaaaggagcucggucgucacuauucaaggcgcacagaaugcgcacgggugaggagcuuacaaguuugaauucugcuuugcaaacuugccuagcggcgcuccacgcacccggggugcuggaggacuggaagguuggaagggaccgcccacucuggagcauugcuuuagcagacucugggcaauguagaccccuagaacuuggugugaaguugucuagagcgggagagugcaagagucacugguaggagccguucaucggacacggugcaggggcaucgaguacggggacccgcugguggugacgcgcugcggagacccaccugcgcggggcccgaggguucuggaccucugaauagcagggugacgcuggcuggaggcaggcggcuaggggaaggggaggcgacggccggcgggcugcgcggcucgcggcugggggcggggcgggagggcccgggaggcgaaggggaggggauggggggcggaccgggugcugcaggcucugcuggaccucaggcucgcacucggccacucugcggagcaggcaugggagccgcgcgcguccuccgggcgcccacaccugucugagcggcgcacggccgcggccccggcgggcugcuccacgcgggugagugcgaugcggggacccggcgucucccgcuggguccgaaggaccaggcgugugccggagccggacaaagagucgggugcgcgcggggugggguggcugcggguaacaccggggaguuugccguggcuuccgcacagacucugggcuuaggacaagagccugaaagagccucccuccccggacaccggcucuguacagcguuuggauucacucagugucucucuuaaaguggauggggaaaagaagguuuugaaagcgcugucuuggaugcaagguguugucuaggggucaaguggagcuguguauggcaaggugucccuggagaggucaagguaggcucucccccacgaacacacacuguaaccucuaccauuuucuuucuuugaguuuugcgccuacuguaucugacuucaucgugcucugagcauuaauuuuuaaccuggcacgugacuaugaacacaccuuaacaagcaagaaaaagucagcaaacacaaguugggaucaggcucugugcugggugccgacuuugcucugagugcuaaaucuagaaaauuaugccugggcuaucaacaguuguuggaagcaaauauuucuucagcauguagccauuuaucacaaauugcuaacugaaagaaaagauuugcccuccccuagaacuuuuaagagaggaagauguguuuagauggagcaauaccacccccuccugaaauggagccgauucucccucccaccucccucagagcaucccuugagaaaagccucugauuaaaauccuguuuguuuuauuguccauugggugacauccacgagaauuuagaaacagcccguagccuguggaaaguuccagaugauucaggaucucgguuaguauagaaauugcuacucccaggucuuguaagugaacuugagagguccuagcgaaugccuuaaggacagauaggucaauacaaaauagccuuaucaggcucugugagaagaguuugauuuauaguugaaguuagguuuuuccaaaaucccuauugcaaauuaguaucaggauauuguuagacauuguuucggggggggaaaguguuuaaaagaacuauuaccugucuuucuaggagucuccuaggagugagguacaguagugcaugccugugaauccuaacacuucgaaggcuggggaaggccagugaacuugaggcuagccuguguuauucagugaacauuuuuaaagagucucuuagaacuggauuggggacgggauaaagagaccgaggauucuuuugaaggcacuacauucauuuuuuuucugagugugccauaaauauaugaauaaaucuucacuuguauuuuccauuauuauaaacaggcaguaggcagcuugucaugcuuucucugaccuuggaaggaagcagucuuccaagguaauuaauauggauuucauuucugucucacugaugacuauucagguagacaguggauguagguauauuuuucugccuguggccuaagugccaaaguucccauuagugugucugagaacauuguuggcccaggucugcugugcuaauagucucagguucuccugagcaucccucccauggauguuuuaggaguuaaugcaccgggcauuauucaugcauaauuccaaauaacuccagggauuucguuucucauggucucaccauugacagcacucuguaauugcucugcugcuaggcugucuugggauuacuaggauggcucauuuugccuaaaaccugauagagaaguuaagcucugugugaccaugagauuguacuugauuugcugggcuucuuaaguccccucccguuuccuuacaagaccaucauucuuaagccauacugugacugggu

SEQ ID NO: 10245 - RNA, 2501 nt, Mus musculus
cagcuguuacauguggggcagcagugcuggcaggaacgccggccgggagcggccgggagccggagcccggcgugcgcgcgcggcuggaggcucgcuggggcuccgcuccccgcgggagcuauuguuggucucaccggagcugagcucagaaccgggaccugcuccgucuugggugccucaauacaacucgcggagcggcggagccagcggcgcggugccucgccuccccgccguccucguccacgcuuccccggcgguggcagccugcagccacgguaaggcggcgugaucagcucuacggaaaaagcgccuuggggaccacggcggaggcucgccaguucugucgccccucucugcauucgcagguccgggcagcucaagcagcuugcugggggcuccgggagaugcuagccugcuucccugcuccgcacuggggagggagggaggaagagaaggagagcggggcguccagguugccgacaaggcaaggagccuggagcccagagccuccgccaccgcagccccgggaguccgccgcguacuggagccugggaaccaguguugggggagagcggagaggugggagccggccccagacucuggaccgcgggugggauggagguuagcucgauccagguucgugugcuacgccgggauccccuucccugccacggcccagucuccugcagccccucugcagacucgcccgccccagacucacggcgggcgcuggaggagcccacgaggcggcgccgggcucccgcucugcaaccugcccugcggggcgagagcuggcugcagcggccccggugcgcgcugcgguuagagccgguaacccggggacgcgacccccaagccgcacgcccucugccacccgcuuggcuccugcccaucuucgccggucgcgucguuucucguucgguuugucucggaacgaguugaggacugcaggcgccggguggacucucuaggggugcagggcugugagugugugacuacuugcaccuccagcuucgggaaauaugcuguguauugaaaugugaucucugagcuccuuagucauuuuccuagugauuuaaaaaugcagucuuugcaucggagaagcggaagaagguggugucgcggaguguguguguguguccacaccuaacccaggaauaucccaauaacuauugggggagggggguaaaggguguuaugaauggucaaugccucuuggcggguccguagguggguuucucuggccacugcccucuucuucuaugcccuacccgcccccuccccaucccccgccuaaaccagguuggaaaguacuggaaauucaauugcguggucucuaacuuuggaauuugguaucccuuucagcaggagacguuaagacgauuucugcacuugggucuguguggacgagaguuuugcucagguuagauguagaauccgccucagaccugcaccaguccccuacccagucgccaccucuccuccaccccccacgcacauacaacacaacccuggagagaagguuuguacacaugcaguuaaccguaagccaccaacgcagcuauaaggacgcagagucagcccggguuuugcgggcaucugagcgcacuauuggcguuugauuagcccuggagaucacccugcugcuuuguagaggcgcugguggggcaugcucgugauccccagcgccggggcuagagggugucccugugcugagcuguacggccgugcucggaggauguucgcugaacaguaucaugggcaauuauauaagcugccucagugaucucccagaucuguauugcaagcacccggcucuugaaagacaacccugaaaguuuuacugcuuggggacuguaaguaccugggagacccacuuggggaauggggagcuggguaccuugugccgaggugcccacuucugagaugugggcuuugggugcuaaagcucuguccccaaggaaccgguuaccgaagcagggacugaguggguggagauccaagauuaaccugugaagaagaacgggucaggacucagauuucuuugaguccguggagcccugagauucagguguuggagguguuguguggggggguguuggauggccuuccagggaacguaguuuucggaaaaucgguguucuaggcagccccaagacucuuuucuuggccccucccuggcuuuaaauccagcguccuucaccuguuuagaaaccugccuccagucccuuuuagaaaugcccagagacgccaggcauccaggcccagguuugggguguuugugguggguuaggaaguagaguacuggccucuauggggugcggggguggacagaaaaaauuauuauaccuaaugcggaugcuaugggaaugggugccugauauggcuucuguucccucgccucccuccaggacugaaaacaguuugguuucaacugcgcuccuuuccaccccccucccuccuaucucgcugccucccuucgcugccgcagccugucgcac

SEQ ID NO: 10246 - RNA, 2501 nt, Mus musculus
gugcgacaggcugcggcagcgaagggaggcagcgagauaggagggagggggguggaaaggagcgcaguugaaaccaaacuguuuucaguccuggagggaggcgagggaacagaagccauaucaggcacccauucccauagcauccgcauuagguauaauaauuuuuucuguccacccccgcaccccauagaggccaguacucuacuuccuaacccaccacaaacaccccaaaccugggccuggaugccuggcgucucugggcauuucuaaaagggacuggaggcagguuucuaaacaggugaaggacgcuggauuuaaagccagggaggggccaagaaaagagucuuggggcugccuagaacaccgauuuuccgaaaacuacguucccuggaaggccauccaacacccccccacacaacaccuccaacaccugaaucucagggcuccacggacucaaagaaaucugaguccugacccguucuucuucacagguuaaucuuggaucuccacccacucagucccugcuucgguaaccgguuccuuggggacagagcuuuagcacccaaagcccacaucucagaagugggcaccucggcacaagguacccagcuccccauuccccaagugggucucccagguacuuacaguccccaagcaguaaaacuuucaggguugucuuucaagagccgggugcuugcaauacagaucugggagaucacugaggcagcuuauauaauugcccaugauacuguucagcgaacauccuccgagcacggccguacagcucagcacagggacacccucuagccccggcgcuggggaucacgagcaugccccaccagcgccucuacaaagcagcagggugaucuccagggcuaaucaaacgccaauagugcgcucagaugcccgcaaaacccgggcugacucugcguccuuauagcugcguugguggcuuacgguuaacugcauguguacaaaccuucucuccaggguuguguuguaugugcgugggggguggaggagagguggcgacuggguaggggacuggugcaggucugaggcggauucuacaucuaaccugagcaaaacucucguccacacagacccaagugcagaaaucgucuuaacgucuccugcugaaagggauaccaaauuccaaaguuagagaccacgcaauugaauuuccaguacuuuccaaccugguuuaggcgggggauggggagggggcggguagggcauagaagaagagggcaguggccagagaaacccaccuacggacccgccaagaggcauugaccauucauaacacccuuuaccccccucccccaauaguuauugggauauuccuggguuagguguggacacacacacacacuccgcgacaccaccuucuuccgcuucuccgaugcaaagacugcauuuuuaaaucacuaggaaaaugacuaaggagcucagagaucacauuucaauacacagcauauuucccgaagcuggaggugcaaguagucacacacucacagcccugcaccccuagagaguccacccggcgccugcaguccucaacucguuccgagacaaaccgaacgagaaacgacgcgaccggcgaagaugggcaggagccaagcggguggcagagggcgugcggcuugggggucgcguccccggguuaccggcucuaaccgcagcgcgcaccggggccgcugcagccagcucucgccccgcagggcagguugcagagcgggagcccggcgccgccucgugggcuccuccagcgcccgccgugagucuggggcgggcgagucugcagaggggcugcaggagacugggccguggcagggaaggggaucccggcguagcacacgaaccuggaucgagcuaaccuccaucccacccgcgguccagagucuggggccggcucccaccucuccgcucucccccaacacugguucccaggcuccaguacgcggcggacucccggggcugcgguggcggaggcucugggcuccaggcuccuugccuugucggcaaccuggacgccccgcucuccuucucuuccucccucccuccccagugcggagcagggaagcaggcuagcaucucccggagcccccagcaagcugcuugagcugcccggaccugcgaaugcagagaggggcgacagaacuggcgagccuccgccgugguccccaaggcgcuuuuuccguagagcugaucacgccgccuuaccguggcugcaggcugccaccgccggggaagcguggacgaggacggcggggaggcgaggcaccgcgccgcuggcuccgccgcuccgcgaguuguauugaggcacccaagacggagcaggucccgguucugagcucagcuccggugagaccaacaauagcucccgcggggagcggagccccagcgagccuccagccgcgcgcgcacgccgggcuccggcucccggccgcucccggccggcguuccugccagcacugcugccccacauguaacagcug

SEQ ID NO: 10247 - RNA, 2501 nt, Mus musculus
aggagcuugggacuugaaccuaucaaggacccaguucugcuguugccugggaacagagaagggaggagcugccagagagaagggaggaggggacagggagagggcaaccucucagcugcgcgcccugacgacagcaggugauuuuuuuuuuuuuuucugcagcgcgcauacucucagcaucuuuucuugaucaccccaccucccuugcugagccgcaaaaaaggguggggccgccucucugcagcagaagacgacagcggcagcggcugcggcaucaccggggguauagauagaggccguuuugcucucugcucugucuggguuggaggugaccgcugccaagccucgcuaggcggccggcugaaccagacggaaaggagauaaaagccugcuugcggauccuucccugcgccauggcuuaagcccacagccucuuugccaagcaucuccuugcucugccggggucugcuagacaccgcagucgcagagagggcgcgcccagacgcccuaggccuggacucugggacgcugagccucgcuccuauucuucacugcccacagcagcuccucugcagcaggcguuugcagccggcaaucgagggacuuuacggacuuuaucucagcgguaccuuguccccgggugcucuuugaggguggaggacgaggcaaagggcuucuaagggaaggaagcggugggaaccacauuggcgggucuggguugggguuaaagggagauuggagauuugauuuaggaccacaaaaaggcuuuguggcuaacauggcguggccgugcaucacaagggccugcugcaucgcccgcuucuggaaccagcuggacaaggcggacauugcggugccgcugguuuucaccaaguacucggaggccaccgaacacccaggcgccccuccgcagccgccagcuccgcugcagcccgcguuagcgccccccucgcgugcugucgccauagagacgcagccagcccagggagagucggaugcaguugcccgggcaacagggccugcgcccgggcccagcgucgaccgcgagacuguagccgcccccggccggagcgggcugggcuugggcgcggccucagccuccacuuccggcucaggccccgcggacucggugaugcgacaggacuaccgcgccuggaaagugcagcggcccgagccaagcugccggccgcgcagcgaguaccagccguccgacgcgcccuucgagcgcgagacccaguaccagaaggacuuccgcgccuggccgcugccccggcgcggggaccaucccuggauccccaagccggugcaaaucccugcgacuucgcagccuucccaaccuguucucggggugcccaagcgucggccucagagccaagagcgcgggcccaugcaacuuucugcugaugcccgggacccggagggugcuggaggagccggggugcuggcggcaggaaaggcguccgguguagaccagcgcgacacacguaggaaggcagggccagcauggauggugacucgcaacgaagggcacgaagagaagccucugcccccagcccaaucccagacccaggagggugguccugcagcuggaaaggcguccggugcagaucagcgugacacacgcaggaaggcagggccagcauggauggugacucgcagcgaagggcacgaagagaagccucugcccccagcccaaucccagacccaggagggugguccugcagcuggaaaggcguccggugcagaucagcgugacacacgcaggaaggcuggacccgcguggauggugacucgcacggaagggcacgaggagacgccgcugccacccgcccagucucagacccaggagggcggccccgcagcuggaaaggcaucuggugcagacgagcgcgacacgaggaggaaggcggggccggccuggauggugcgucgcucggaggggcacgaacagacacccgcugcccaugcccaaggcacagggccugaaggaggcaaggggcgcgcgguggcagaugcccucaacaggcaaauccgggaggagguggcgaguacaguaagcagcucuuacaggugagacuggggcagcaggugaugcuggucacccucauccccucgcgaggaccacccauucuacccccacaccgaaagcuucgcauucagcuucuucuccagggccagaccacacccucuucagccacauuccagaacccuuucaacccagacuuuacugccccacccugucggaaagcccuuaacaguuuccacacugguuuucccagcuuguuuuuugugccaccccuaagccacauuuuccucuuggcugccuagcucagcucccuaucugccccacagagacccugucaguuucccccugucucaucaguucgccugcugucccagccuggcucccguccccuagucgccuccacucauucacuucucacuuacuuccccgugagacccuuucuccuccccagucucuuacauuguccuggucucuu

SEQ ID NO: 10248 - RNA, 2501 nt, Mus musculus
aagagaccaggacaauguaagagacuggggaggagaaagggucucacggggaaguaagugagaagugaaugaguggaggcgacuaggggacgggagccaggcugggacagcaggcgaacugaugagacagggggaaacugacagggucucuguggggcagauagggagcugagcuaggcagccaagaggaaaauguggcuuagggguggcacaaaaaacaagcugggaaaaccaguguggaaacuguuaagggcuuuccgacaggguggggcaguaaagucuggguugaaaggguucuggaauguggcugaagaggguguggucuggcccuggagaagaagcugaaugcgaagcuuucgguguggggguagaaugggugguccucgcgaggggaugagggugaccagcaucaccugcugccccagucucaccuguaagagcugcuuacuguacucgccaccuccucccggauuugccuguugagggcaucugccaccgcgcgccccuugccuccuucaggcccugugccuugggcaugggcagcgggugucuguucgugccccuccgagcgacgcaccauccaggccggccccgccuuccuccucgugucgcgcucgucugcaccagaugccuuuccagcugcggggccgcccuccugggucugagacugggcggguggcagcggcgucuccucgugcccuuccgugcgagucaccauccacgcggguccagccuuccugcgugugucacgcugaucugcaccggacgccuuuccagcugcaggaccacccuccugggucugggauugggcugggggcagaggcuucucuucgugcccuucgcugcgagucaccauccaugcuggcccugccuuccugcgugugucacgcugaucugcaccggacgccuuuccagcugcaggaccacccuccugggucugggauugggcugggggcagaggcuucucuucgugcccuucguugcgagucaccauccaugcuggcccugccuuccuacgugugucgcgcuggucuacaccggacgccuuuccugccgccagcaccccggcuccuccagcacccuccgggucccgggcaucagcagaaaguugcaugggcccgcgcucuuggcucugaggccgacgcuugggcaccccgagaacagguugggaaggcugcgaagucgcagggauuugcaccggcuuggggauccagggaugguccccgcgccggggcagcggccaggcgcggaaguccuucugguacugggucucgcgcucgaagggcgcgucggacggcugguacucgcugcgcggccggcagcuuggcucgggccgcugcacuuuccaggcgcgguaguccugucgcaucaccgaguccgcggggccugagccggaaguggaggcugaggccgcgcccaagcccagcccgcuccggccgggggcggcuacagucucgcggucgacgcugggcccgggcgcaggcccuguugcccgggcaacugcauccgacucucccugggcuggcugcgucucuauggcgacagcacgcgaggggggcgcuaacgcgggcugcagcggagcuggcggcugcggaggggcgccuggguguucgguggccuccgaguacuuggugaaaaccagcggcaccgcaauguccgccuuguccagcugguuccagaagcgggcgaugcagcaggcccuugugaugcacggccacgccauguuagccacaaagccuuuuugugguccuaaaucaaaucuccaaucucccuuuaaccccaacccagacccgccaaugugguucccaccgcuuccuucccuuagaagcccuuugccucguccuccacccucaaagagcacccggggacaagguaccgcugagauaaaguccguaaagucccucgauugccggcugcaaacgccugcugcagaggagcugcugugggcagugaagaauaggagcgaggcucagcgucccagaguccaggccuagggcgucugggcgcgcccucucugcgacugcggugucuagcagaccccggcagagcaaggagaugcuuggcaaagaggcugugggcuuaagccauggcgcagggaaggauccgcaagcaggcuuuuaucuccuuuccgucugguucagccggccgccuagcgaggcuuggcagcggucaccuccaacccagacagagcagagagcaaaacggccucuaucuauacccccggugaugccgcagccgcugccgcugucgucuucugcugcagagaggcggccccacccuuuuuugcggcucagcaagggagguggggugaucaagaaaagaugcugagaguaugcgcgcugcagaaaaaaaaaaaaaaaucaccugcugucgucagggcgcgcagcugagagguugcccucucccuguccccuccucccuucucucuggcagcuccucccuucucuguucccaggcaacagcagaacuggguccuugauagguucaagucccaagcuccu

SEQ ID NO: 10249 - RNA, 2501 nt, Mus musculus
uugagggugggccggguggugggugacguuggacuuugagacaguguggacuccgauuguuccauugggcuaccugcugauggugagucucugccaucuaggggccuguucccagggcccccacugggcuuucggacccucaguucugaaaggucugaacgaaggaaacugagcagcgucaggguuucagaggcgauaucuggauucgauagggacuuucguugucgguucuuaucuagguccaguccuccaucccucagcggccuggcagugccuacaggucccuuacugcgggaccucgucuggggccgcagaagaagcccaucuccaguuccaaaacuuggggaucgauauacaccccagcccacagaacuacggcuugaccauaggucgucaucuuugagggucucugugcuggaauagcgacuacuuccucgggagccagcugggcuggccagguacgcaggaaagcucaccuuagccacacggaaaggugcacccccagugucggacauaggccuuaagcucucuuggggaccugggaggcauggcuguguaccaguaccccacucauccauugagguucuuggagacgucggagguucggggcucccgacaccccccgcugaucccaagccucccggauuuagcucgucacuguccuggcugcagccgugaaccaacugagagcguccaggccggagaccucucccucuccagcgacggccauccucaccauuuggguccucgucacugcccgaagaguggccgccgagguaggccggacucugaggcccaagcugcgacugcggucccuccucuuccuccucgcuggaacuagcagcccggcugcggcugacaggauaggaggaggcaauggaggaggaggaggaggcccgggccccggccugcgguugggagaagcuaugccaagaauguaaaccauccgccggacgcugcgcccgcuccuguugcuggugcugccgacgucgccuccccucgaucccgggcccggacagcggccgcgcagaacgcaggccagccagaggaaagcacguucgaggagguggcgucggagguugccggggaucgcgaguugggggcucccacgaaacucugucggggcuggucgaccccagggccucagaguccauacugggucgucuggagcucggaccgccgaagaguuugcgcaucucugugacgcugggccaggccccacguucagagccuuccgcagcuucuucuguggugccggaggagcagcccccgucccggguaccaguggagucgucguccagacccgccgcgucgaagcgccgggagagcuggcgcaccgauggcgagaggcugcggagcgggcgcggcugcgcgggggcggccgggggccccgacgccagcuuggacacgcgccgggagggcuggcccgggacugccgcggcuggccggcacgaagcucggcgccgcaacccagggguguccgcguccuccucccucggccccgguccgccgcuccagcgcuccagcaguuuaaacgagacgcugcgauaaagugggggucgaggugacccguccgccaugguuggugcuagucacuccgggggggcuggccucgggacgccgcggccaacccccccugcacucccacuccgagggcgcgcaguggccacgguccgagagccuggguccugcacccgcagcgugcggcggcuguggaggagggugcggagacgugagcagagguuuaucagucgaagaucaaguuuccgcggcuacaaaaggcaggaguuccauccugggcggccccucucgccccugcggcgaccccaggcccagccuuagccucugcgggagaggccagggacaucgcgguccugccggugaggggccuaaggcucgguuccugcacucaaaguccgccugccaagcccggcggcccgccugccuccccucgagcucccgcuccagcucccuuucccucccucuaagcagcuagcucucugcucccuuuuguugcaaauaaacuuugaggcagaggaaagggggcggggggcggggccuggcgcccaaaagagggggugggcuccgggagcgcgcgaggcugggaacacuguggggggagggaaucggggaggagccgaaggagaaacaggaugcuaggacuuuuguagaccaaaacgacccucuaggggagucggcugcgaaagccgcgggcugauccucccuggggacuccuucagauacccacaggagcugagaguggacagcucugcauaaaguaguccccgcuuucacgcgggaaccucugccgcaggggcuccaacauggcaacccaagacccaaaaacucagguacacaccgaaacucagguacacgcagaaacucuccuggccggaaaagagguggggcccagggagacguagguggggcaggcccaccggagcgcuugugguuccccaccuugcucagaccacgccccguacucauccuucaguggcgaa

SEQ ID NO: 10250 - RNA, 2501 nt, Mus musculus
uucgccacugaaggaugaguacggggcguggucugagcaagguggggaaccacaagcgcuccggugggccugccccaccuacgucucccugggccccaccucuuuuccggccaggagaguuucugcguguaccugaguuucgguguguaccugaguuuuugggucuuggguugccauguuggagccccugcggcagagguucccgcgugaaagcggggacuacuuuaugcagagcuguccacucucagcuccuguggguaucugaaggaguccccagggaggaucagcccgcggcuuucgcagccgacuccccuagagggucguuuuggucuacaaaaguccuagcauccuguuucuccuucggcuccuccccgauucccuccccccacaguguucccagccucgcgcgcucccggagcccacccccucuuuugggcgccaggccccgccccccgcccccuuuccucugccucaaaguuuauuugcaacaaaagggagcagagagcuagcugcuuagagggagggaaagggagcuggagcgggagcucgaggggaggcaggcgggccgccgggcuuggcaggcggacuuugagugcaggaaccgagccuuaggccccucaccggcaggaccgcgaugucccuggccucucccgcagaggcuaaggcugggccuggggucgccgcaggggcgagaggggccgcccaggauggaacuccugccuuuuguagccgcggaaacuugaucuucgacugauaaaccucugcucacgucuccgcacccuccuccacagccgccgcacgcugcgggugcaggacccaggcucucggaccguggccacugcgcgcccucggagugggagugcaggggggguuggccgcggcgucccgaggccagcccccccggagugacuagcaccaaccauggcggacgggucaccucgacccccacuuuaucgcagcgucucguuuaaacugcuggagcgcuggagcggcggaccggggccgagggaggaggacgcggacaccccuggguugcggcgccgagcuucgugccggccagccgcggcagucccgggccagcccucccggcgcguguccaagcuggcgucggggcccccggccgcccccgcgcagccgcgcccgcuccgcagccucucgccaucggugcgccagcucucccggcgcuucgacgcggcgggucuggacgacgacuccacugguacccgggacgggggcugcuccuccggcaccacagaagaagcugcggaaggcucugaacguggggccuggcccagcgucacagagaugcgcaaacucuucggcgguccgagcuccagacgacccaguauggacucugaggcccuggggucgaccagccccgacagaguuucgugggagcccccaacucgcgauccccggcaaccuccgacgccaccuccucgaacgugcuuuccucuggcuggccugcguucugcgcggccgcuguccgggcccgggaucgaggggaggcgacgucggcagcaccagcaacaggagcgggcgcagcguccggcggaugguuuacauucuuggcauagcuucucccaaccgcaggccggggcccgggccuccuccuccuccuccauugccuccuccuauccugucagccgcagccgggcugcuaguuccagcgaggaggaagaggagggaccgcagucgcagcuugggccucagaguccggccuaccucggcggccacucuucgggcagugacgaggacccaaauggugaggauggccgucgcuggagagggagaggucuccggccuggacgcucucaguugguucacggcugcagccaggacagugacgagcuaaauccgggaggcuugggaucagcggggggugucgggagccccgaaccuccgacgucuccaagaaccucaauggaugagugggguacugguacacagccaugccucccagguccccaagagagcuuaaggccuauguccgacacugggggugcaccuuuccguguggcuaaggugagcuuuccugcguaccuggccagcccagcuggcucccgaggaaguagucgcuauuccagcacagagacccucaaagaugacgaccuauggucaagccguaguucugugggcugggguguauaucgauccccaaguuuuggaacuggagaugggcuucuucugcggccccagacgaggucccgcaguaagggaccuguaggcacugccaggccgcugagggauggaggacuggaccuagauaagaaccgacaacgaaagucccuaucgaauccagauaucgccucugaaacccugacgcugcucaguuuccuucguucagaccuuucagaacugaggguccgaaagcccagugggggcccugggaacaggccccuagauggcagagacucaccaucagcagguagcccaauggaacaaucggaguccacacugucucaaaguccaacgucacccaccacccggcccacccucaa

SEQ ID NO: 10251 - RNA, 2767 nt, Mus musculus
ugaaguggaaauuuugccaaauucuggccagccuuugaaccuugagccuuuaaagucggaucaacuuccggcuggguuugcacacccuacuggaaaauugaguuggguguguggaggaggcuuguuaugcucuugguucuuggggcuugcaggcugucgccauuucuaauuuaguuacugaggggcugucaucccuauuccugcuaguuagucuuucaauugucaugagggugugugcccacccuugaaucucugaaguguugugugugugaauaagcuguugcagaagcguguaccugcaagggugggagcgaagaguagagaagaggcucucaguuaacuuccagaaucucucuuggcaccucaaccuuacucugagagcccaggcuacuuuguuacuucgcuaugugguuccugcucacagguccccgguccucugauagucuacaucucuccccggacuuugccccuuccccggggcuuacgggggcgggcgcuaggacccggcggggcggggcggggcggggcucggugcucccgcaguucuuaccuccgcagccuggaaaauaccgagcgaggcgagcggagcccgggagccccgagccuagcgggagggaggagggcggagggggcgcgcggggcggggggcgcggagcggggcggggccggcggcgggacccacugcuccuccccccaggguccccgcgcggcccccggucgcccgggcagcggaggcagcggcggcggcggaagagcucgcacaccggccccggcgggccccggcagagaagcccgcacaggugagacuccgccaccacacccgcccccaccacggccccgcgcggcuugcugcugaguuaguugugcgaguccggccagcaccgcgcgaggacuccgugccagacccgcacuugcgaucccccagagucccgcccggcucucgcgggcuccugcacccgcuacgcagcaauccuacugccgcuccagggaaguaugaggucgcuccuugugggaggguggcccaagugacuguccugugccggugcacaaccgccuggggccaguaccugcccuuuucaagcuguccgcugguccgggaccccggcuagccccacccgcgcccccagcgcacugacucugguccccaaaccggucuugcaggucccaggaagguggcgucagcaucugcagccgcgucgacguugucugagccuccgcggaggacccaggagagucggacuaggaccagggccccgggccuccccacgcucccuauggaaaagccagcugccucaacagaaccccaagggucucggcccgccuugggccgugaaaguguccaggugcccgaugaccaggacuuccgcaguuuccggucagagugugaggccgaggugggcuggaaccugaccuacagcaaggccggcgugucugugugggugcaggcuguggagauggaucgaacucugcacaagaucaagguaggauugcccugugguaccugcagccuccacuccucccgaacugucucucacaggaaucuccucgcccauacucagaccagggacccauagaggggugcaugugagcucagagucuccuaauauaaaccagaggacacacaugggccauaugacccggguucuaaccuaggcaugccuguguguuugggagaugggugauggccagguacacuuaggggaauagugucucucaaaggucugucuuucagaguagcuucugcuuggacccuuaguuugacccacuagguaggugaacggcccacuuccuccuucacccgggguucucuagcccgcgaugggucuucugcucuacuuucugcacucuugggugcagaggaugagauuccuuccuucucaauuccucuaguccucucugucccugcccaguggcucuaucaggcucugagccugcagcaggccuuuaggacuguggcuggcagcuccugacugcugucuugcccugagccacccugggggugcacuagaggaggcagggucuuagugucaagggaaaccagcucagaaggcagauacguacucaucagccccucacugccaucccccuccucccugccccaugauucucuucucucugucauggcaggguagcuugggguuugauggaggcagagauucuggucuagggggucucaguagcuguuuguuacacgugugguuugguugugagugccacauugcagggugugaacuuccccuuagagagcucuuggaaggccauucccuugcacccuccugcugcucuggaucugucacggaugcauuccuauucuuaggguccagggcacuggacugucuuaacagggucccuucugucuaggaccuuuauaccagagccugaggugcuggccuuuuuccucuggcccuaugcuucuuuuugccuugcccuaaucauuuauagcuuuauccaccugccccccccccccacacacacacaacuggcuugcucuuccugcugucccuuugcccucugugucugucuccgucugcccuugcuaacugacucuuucugcguuuccguggcuaccuccuugcucugagucucuucccaggcuuaaagacccugggcuggagcuucuucaaggccuaguguaggucugagccugaggaguagggcgggcagggcagcuggcagugucagcauguugcugauugcaugugggcuccuccccacaguguccaccaggguagugguguuggggaaagaugaaccugggaaccgagug

SEQ ID NO: 10252 - RNA, 2767 nt, Mus musculus
cacucgguucccagguucaucuuuccccaacaccacuacccugguggacacuguggggaggagcccacaugcaaucagcaacaugcugacacugccagcugcccugcccgcccuacuccucaggcucagaccuacacuaggccuugaagaagcuccagcccagggucuuuaagccugggaagagacucagagcaaggagguagccacggaaacgcagaaagagucaguuagcaagggcagacggagacagacacagagggcaaagggacagcaggaagagcaagccaguuguguguguguggggggggggggcagguggauaaagcuauaaaugauuagggcaaggcaaaaagaagcauagggccagaggaaaaaggccagcaccucaggcucugguauaaagguccuagacagaagggacccuguuaagacaguccagugcccuggacccuaagaauaggaaugcauccgugacagauccagagcagcaggagggugcaagggaauggccuuccaagagcucucuaaggggaaguucacacccugcaauguggcacucacaaccaaaccacacguguaacaaacagcuacugagacccccuagaccagaaucucugccuccaucaaaccccaagcuacccugccaugacagagagaagagaaucauggggcagggaggagggggauggcagugaggggcugaugaguacguaucugccuucugagcugguuucccuugacacuaagacccugccuccucuagugcacccccaggguggcucagggcaagacagcagucaggagcugccagccacaguccuaaaggccugcugcaggcucagagccugauagagccacugggcagggacagagaggacuagaggaauugagaaggaaggaaucucauccucugcacccaagagugcagaaaguagagcagaagacccaucgcgggcuagagaaccccgggugaaggaggaagugggccguucaccuaccuagugggucaaacuaaggguccaagcagaagcuacucugaaagacagaccuuugagagacacuauuccccuaaguguaccuggccaucacccaucucccaaacacacaggcaugccuagguuagaacccgggucauauggcccauguguguccucugguuuauauuaggagacucugagcucacaugcaccccucuaugggucccuggucugaguaugggcgaggagauuccugugagagacaguucgggaggaguggaggcugcagguaccacagggcaauccuaccuugaucuugugcagaguucgauccaucuccacagccugcacccacacagacacgccggccuugcuguaggucagguuccagcccaccucggccucacacucugaccggaaacugcggaaguccuggucaucgggcaccuggacacuuucacggcccaaggcgggccgagacccuugggguucuguugaggcagcuggcuuuuccauagggagcguggggaggcccggggcccugguccuaguccgacucuccuggguccuccgcggaggcucagacaacgucgacgcggcugcagaugcugacgccaccuuccugggaccugcaagaccgguuuggggaccagagucagugcgcugggggcgcggguggggcuagccggggucccggaccagcggacagcuugaaaagggcagguacuggccccaggcgguugugcaccggcacaggacagucacuugggccacccucccacaaggagcgaccucauacuucccuggagcggcaguaggauugcugcguagcgggugcaggagcccgcgagagccgggcgggacucugggggaucgcaagugcgggucuggcacggaguccucgcgcggugcuggccggacucgcacaacuaacucagcagcaagccgcgcggggccguggugggggcgggugugguggcggagucucaccugugcgggcuucucugccggggcccgccggggccggugugcgagcucuuccgccgccgccgcugccuccgcugcccgggcgaccgggggccgcgcggggacccuggggggaggagcagugggucccgccgccggccccgccccgcuccgcgccccccgccccgcgcgcccccuccgcccuccucccucccgcuaggcucggggcucccgggcuccgcucgccucgcucgguauuuuccaggcugcggagguaagaacugcgggagcaccgagccccgccccgccccgccccgccggguccuagcgcccgcccccguaagccccggggaaggggcaaaguccggggagagauguagacuaucagaggaccggggaccugugagcaggaaccacauagcgaaguaacaaaguagccugggcucucagaguaagguugaggugccaagagagauucuggaaguuaacugagagccucuucucuacucuucgcucccacccuugcagguacacgcuucugcaacagcuuauucacacacacaacacuucagagauucaagggugggcacacacccucaugacaauugaaagacuaacuagcaggaauagggaugacagccccucaguaacuaaauuagaaauggcgacagccugcaagccccaagaaccaagagcauaacaagccuccuccacacacccaacucaauuuuccaguagggugugcaaacccagccggaaguugauccgacuuuaaaggcucaagguucaaaggcuggccagaauuuggcaaaauuuccacuuca

SEQ ID NO: 10253 - RNA, 2501 nt, Mus musculus
caggacccuccgagucuuugaagaaaaggccuggguuugggguuucagauaggaggugggauguacaaaggcagaagcuagccuucacgaaagagcuaagguagcugauacugugguuaucacugcggccacugcggcagaacucgguaacugcggcuccagacaaacuaaggcaccugcucuguagcggggacccugggacucaaaccggaucaccaccgccaucaccacgucuucuaaaccaccaaagaaagaugcuggaccgcacagcagcuaccccaucacaccauccccuccagcaggcgcacguguaaacacacacacacacacacacacgaauuuccagaacuggggacauugguaugagaggugggcagaaaagacauuucuaagagaaggagaaccuagcgcgggggcgagccugccuggagugcagucacccaggagcgcgcgcacggaacucuggagccaaggaggcgcgccaagagucaccuggugggacaaaagccgcccagagcuugggaccggcugggucuaagggaaggcugguggcagaguggaggaguaggggccagggcagggggcggaaacuaggaggggcuggcgauguggugggcgggagccugagcgagcagcgccgcgggagcagguggaaccggugcuggagcuagcuuaguuggagcugagugggacuucacaggagccauggaucugcucaagcugaaccgcagcuugcagggaccaggacccgggucagggucuucuuugugccgcccgggugucucccuccucaacagcaguagcgccggcaaccucagcugcgagaccccucguauccgcggaaccgggaccagaggugggugccucccuaagcccuucucacugcaccacacagcacuauucgagaaccccuuugaccucuacacugucagcugcccauagcuuacccugauaggacuuccucagcucccaccuaggucccuccccuccacacacuggcucccaagcucuccugacuccaacaccuucacaccaugcuucagagcccuggccucauacuugcccugccauuagcuaccuagaucauucucaaguuaagcaucacacagcugggaagcaaggaccucuucuugucagagggucuagcuuucuuuuccaguuuacagagccaguacugagggagaggcaggaaccagggaaagaaaggcaaaagaaggaggcugggccggugaggguagaagcucucuggacugcaugaauaagaguuguaaucaucccccucuaccccaaccuuccgaaugaaauauucucagaucugaauuuagcaggcacugggggaaguuaccuuucuuguuucauuuguccccaaacuccucugcucccaggguccuucauccaccuaugugcuuucucugucucucugaagguccccaagucccuuccaaagcuccccaaauaucccuuuucucacuugccuagaacuaacuuccccuggcaacagucaccccauuccuuugugucaccuucccuucguacugcuuucccucaucccagcuucaaaaugacucauuccuuccaucaguagcaucuucauugcuucaaugaacaucuuuaaauguaugccccccccaucccuauauuugcuugcaauguuuaaugaacguuuguuaggcuuagcacuggggacacggaaugaacuagacacagacugcagucucagcagucugcagccaaguacacagggacagagaccacggguaacaaucacugccuggaaaucccacaagagggucugauugggauguggacauccaaaguaauugggggucugguaacuucacugggggugggagguggaaccuaggagcuuggguucaguaaauggaaagggaaggaguuggauucuauguucaagauguaaacauugaaauaaauuauaaaucuacauauuuacucagcuuaugaaacaauucaugcuuucucaguuuggcuuuuacccacugucacuuagacucuuucauucagaaaauguuuauugaaccagaaacugugcuaggcaacaagggucgaguuuaacaaaacugacacagcccugcuccgaguuucuaggggaaacagacaaguaagccaggaguggcagcaggaagagaagaaagacaguguauauacaagaggggcaucuccagccugcucugcccuuggggaugaaggcagguuuccugagauagggauacgaucaaguagggaaauaagacaaagagcuaagugacugagcagaagaggcauaaaaugucuuaggcgaagacagccuaucuaaaaaacuucaaguuuaaggccauagcauguuuguucaguacaacacaguuuuugaaugacuggaacauguaccauugaagguagcuaauaauacuuaggcuagaccagccuagaguauauuuggagagcuuuauagcccuugcuauaguguguagauuuuauccugaggcauugggauccacgga

SEQ ID NO: 10254 - RNA, 2501 nt, Mus musculus
uccguggaucccaaugccucaggauaaaaucuacacacuauagcaagggcuauaaagcucuccaaauauacucuaggcuggucuagccuaaguauuauuagcuaccuucaaugguacauguuccagucauucaaaaacuguguuguacugaacaaacaugcuauggccuuaaacuugaaguuuuuuagauaggcugucuucgccuaagacauuuuaugccucuucugcucagucacuuagcucuuugucuuauuucccuacuugaucguaucccuaucucaggaaaccugccuucauccccaagggcagagcaggcuggagaugccccucuuguauauacacugucuuucuucucuuccugcugccacuccuggcuuacuugucuguuuccccuagaaacucggagcagggcugugucaguuuuguuaaacucgacccuuguugccuagcacaguuucugguucaauaaacauuuucugaaugaaagagucuaagugacaguggguaaaagccaaacugagaaagcaugaauuguuucauaagcugaguaaauauguagauuuauaauuuauuucaauguuuacaucuugaacauagaauccaacuccuucccuuuccauuuacugaacccaagcuccuagguuccaccucccacccccagugaaguuaccagacccccaauuacuuuggauguccacaucccaaucagacccucuugugggauuuccaggcagugauuguuacccguggucucugucccuguguacuuggcugcagacugcugagacugcagucugugucuaguucauuccguguccccagugcuaagccuaacaaacguucauuaaacauugcaagcaaauauagggauggggggggcauacauuuaaagauguucauugaagcaaugaagaugcuacugauggaaggaaugagucauuuugaagcugggaugagggaaagcaguacgaagggaaggugacacaaaggaauggggugacuguugccaggggaaguuaguucuaggcaagugagaaaagggauauuuggggagcuuuggaagggacuuggggaccuucagagagacagagaaagcacauagguggaugaaggacccugggagcagaggaguuuggggacaaaugaaacaagaaagguaacuucccccagugccugcuaaauucagaucugagaauauuucauucggaagguugggguagagggggaugauuacaacucuuauucaugcaguccagagagcuucuacccucaccggcccagccuccuucuuuugccuuucuuucccugguuccugccucucccucaguacuggcucuguaaacuggaaaagaaagcuagacccucugacaagaagagguccuugcuucccagcugugugaugcuuaacuugagaaugaucuagguagcuaauggcagggcaaguaugaggccagggcucugaagcauggugugaagguguuggagucaggagagcuugggagccaguguguggaggggagggaccuaggugggagcugaggaaguccuaucaggguaagcuaugggcagcugacaguguagaggucaaagggguucucgaauagugcuguguggugcagugagaagggcuuagggaggcacccaccucuggucccgguuccgcggauacgaggggucucgcagcugagguugccggcgcuacugcuguugaggagggagacacccgggcggcacaaagaagacccugacccggguccuggucccugcaagcugcgguucagcuugagcagauccauggcuccugugaagucccacucagcuccaacuaagcuagcuccagcaccgguuccaccugcucccgcggcgcugcucgcucaggcucccgcccaccacaucgccagccccuccuaguuuccgcccccugcccuggccccuacuccuccacucugccaccagccuucccuuagacccagccggucccaagcucugggcggcuuuugucccaccaggugacucuuggcgcgccuccuuggcuccagaguuccgugcgcgcgcuccugggugacugcacuccaggcaggcucgcccccgcgcuagguucuccuucucuuagaaaugucuuuucugcccaccucucauaccaauguccccaguucuggaaauucguguguguguguguguguguguuuacacgugcgccugcuggaggggauggugugaugggguagcugcugugcgguccagcaucuuucuuuggugguuuagaagacguggugauggcgguggugauccgguuugagucccaggguccccgcuacagagcaggugccuuaguuugucuggagccgcaguuaccgaguucugccgcaguggccgcagugauaaccacaguaucagcuaccuuagcucuuucgugaaggcuagcuucugccuuuguacaucccaccuccuaucugaaaccccaaacccaggccuuuucuucaaagacucggaggguccug

SEQ ID NO: 10255 - RNA, 2501 nt, Mus musculus
gauuacucauuugguuuugaaaacaaugagugcuuugugugcuuuguuuuguuuuguuggcagaaggaaaguagaccaagggcuguuuuuggauugcuuucuaaaugcaccccaacccaauggugugagcugucugugagugucagacaccagaaguaggaagagugcauuagcugacauuaacuagggcguuuucuucaaagaacugcauacugccccgccccaggccgggccccaaaguuguacuuauguguccccaagaggaauguauuuaagcaguaaguggccaauauuucuccgugccaauggaggacccaggauucggugaaaagugagaacguuugucauucagcccauuccuuccccaagccaugcgcauugucgcucgcccuuucucauugagucuggguuagagaaaauugcuuuuauugguggugaaccuaaauuaggcugaaagcuccucugucagaggacacaggguucagacuggaaagccaggaaggaagcuuuggagcugggcaguggaugcaggauucucuccuuauuuggauguaagugcugcacucuauaaguacuuauuuugggacaaggcuuaagcaccgaaugggacaggcagccccagggaucaggcugcgcucucuauuugaagcacggguuucucaggaucuuccuugguagguugaggagguucuggcuccagggcagucucgagcucggacuccauuucaggcugagcugcaggcuggccuucugaugggccuucagagcuccggacaggcccuacgcguggcggcuugacuggugugggcugugcugcuuuacgacuggaaagagcccuuuucaggcuuugaacuuucuguaaaccagugcggcgcagccgcugagcccuggacuccacuggcuccucuucagaacucucuccaacuucauccucuggcugaucugggcccagcaccaacugguccuccggacccaagagcucugggacuuucuggaaggcgcgggcuggaauuucagucuccuccuaaaugugaugacacagcuuuugauucucugauuugacccuggcacuuagccaggaccagccugaaacucucuugcccgcccgccaagggaagcuacuccacccuuugcaucugcacuaggaauuggggccaaaauagaggaaugggaagaugggggauggggaggauggaggagcagagagaugagcaaagagggggaaaguggaccuugcaaguuugcaaaguggaugaaaccguguagaguguaacagcuguauaggcgcuuggaggaggcagaguaacaccuaacaguuaguuccaugugggugcgacugaccaaauccgcagacuggccugaguuagggagggcguggguuggccaggcugggagugagaaagggauaaggucgcuguugugagaaagugggugcggcucugagagucuuccacaagugagggcagcacgcugggucaggaauguggagaugcggacggguggguggcaggaguccuucccucggugguaaccuagaggcgaggguugggggcgggagagggaugccugaggucacugaccuugaagagcaggacgugcagcuucccgcgcgccaccagcagcccgugguuggccuccaaccgcugcaccugagcagcgcgacgcacggcccgcuccugggcugcgucggcgugcgagcccacgcgcuccgccuuggccagcagcugcgucaguguguugcugguggugucguggcugcgacucagcgcacccaggccacucuguaugcgacgcacggagcccgccaggccgcccugccucucagccaggccgccuugccgcucccgcagagccuccagcaugguggccaauuucuccagcaaggucaccacggugacugcgugcaccggacccccugcgggcgucucaggcacagguccgggcuccagugcgcucucccccaugaucucugaccaccgggccugcucucccugagaccgauggcugcgaucugggcuggggcugccuuuccccgccuccuccccuaguucaggccgugacucagccgggcgggaguuggcaucuuccgcggugggaaaaggaggaggccgagcaagggggcggaauguccaaagggggcucuuucgaaggcuccgccccgggaucugcgaguaagacaguccugcccagaggcaccucuuuucugaguuugugcuccuuuucccccauuuuccuggugggcuucuuucaggccuguguucuucacagcaaaaggcaaaccacugaaaauuucauuuaucuaucuagugaucagagaaggggguggggguggaaggcagggguguuaaaggcauagccuaagccgucaaagcugcugagccccaacgcugggcggaggccuguaaaguuuggaauguucugccucagacccaagacugccuaggcccaaggcagggcuuugugucuaggcgggcugggcggggcauccucugauauuuucc

SEQ ID NO: 10256 - RNA, 2501 nt, Mus musculus
ggaaaauaucagaggaugccccgcccagcccgccuagacacaaagcccugccuugggccuaggcagucuugggucugaggcagaacauuccaaacuuuacaggccuccgcccagcguuggggcucagcagcuuugacggcuuaggcuaugccuuuaacaccccugccuuccacccccacccccuucucugaucacuagauagauaaaugaaauuuucagugguuugccuuuugcugugaagaacacaggccugaaagaagcccaccaggaaaaugggggaaaaggagcacaaacucagaaaagaggugccucugggcaggacugucuuacucgcagaucccggggcggagccuucgaaagagcccccuuuggacauuccgcccccuugcucggccuccuccuuuucccaccgcggaagaugccaacucccgcccggcugagucacggccugaacuaggggaggaggcggggaaaggcagccccagcccagaucgcagccaucggucucagggagagcaggcccgguggucagagaucaugggggagagcgcacuggagcccggaccugugccugagacgcccgcaggggguccggugcacgcagucaccguggugaccuugcuggagaaauuggccaccaugcuggaggcucugcgggagcggcaaggcggccuggcugagaggcagggcggccuggcgggcuccgugcgucgcauacagaguggccugggugcgcugagucgcagccacgacaccaccagcaacacacugacgcagcugcuggccaaggcggagcgcgugggcucgcacgccgacgcagcccaggagcgggccgugcgucgcgcugcucaggugcagcgguuggaggccaaccacgggcugcugguggcgcgcgggaagcugcacguccugcucuucaaggucagugaccucaggcaucccucucccgcccccaacccucgccucuagguuaccaccgagggaaggacuccugccacccacccguccgcaucuccacauuccugacccagcgugcugcccucacuuguggaagacucucagagccgcacccacuuucucacaacagcgaccuuaucccuuucucacucccagccuggccaacccacgcccucccuaacucaggccagucugcggauuuggucagucgcacccacauggaacuaacuguuagguguuacucugccuccuccaagcgccuauacagcuguuacacucuacacgguuucauccacuuugcaaacuugcaagguccacuuucccccucuuugcucaucucucugcuccuccauccuccccaucccccaucuucccauuccucuauuuuggccccaauuccuagugcagaugcaaaggguggaguagcuucccuuggcgggcgggcaagagaguuucaggcugguccuggcuaagugccagggucaaaucagagaaucaaaagcugugucaucacauuuaggaggagacugaaauuccagcccgcgccuuccagaaagucccagagcucuuggguccggaggaccaguuggugcugggcccagaucagccagaggaugaaguuggagagaguucugaagaggagccaguggaguccagggcucagcggcugcgccgcacugguuuacagaaaguucaaagccugaaaagggcucuuuccagucguaaagcagcacagcccacaccagucaagccgccacgcguagggccuguccggagcucugaaggcccaucagaaggccagccugcagcucagccugaaauggaguccgagcucgagacugcccuggagccagaaccuccucaaccuaccaaggaagauccugagaaacccgugcuucaaauagagagcgcagccugaucccuggggcugccugucccauucggugcuuaagccuugucccaaaauaaguacuuauagagugcagcacuuacauccaaauaaggagagaauccugcauccacugcccagcuccaaagcuuccuuccuggcuuuccagucugaacccuguguccucugacagaggagcuuucagccuaauuuagguucaccaccaauaaaagcaauuuucucuaacccagacucaaugagaaagggcgagcgacaaugcgcauggcuuggggaaggaaugggcugaaugacaaacguucucacuuuucaccgaauccuggguccuccauuggcacggagaaauauuggccacuuacugcuuaaauacauuccucuuggggacacauaaguacaacuuuggggcccggccuggggcggggcaguaugcaguucuuugaagaaaacgcccuaguuaaugucagcuaaugcacucuuccuacuucuggugucugacacucacagacagcucacaccauuggguuggggugcauuuagaaagcaauccaaaaacagcccuuggucuacuuuccuucugccaacaaaacaaaacaaagcacacaaagcacucauuguuuucaaaaccaaaugaguaauc

SEQ ID NO: 10257 - RNA, 2501 nt, Mus musculus
caaggagucagaagagaauuauccuuacauaguucaaagcaggauauggaaucuuaggaagaaggaaguugugguaauucuuauuagggaacaucucagccacucaaaccaaacauuagugccuucgauccaacauucuaaaaguccgcauuuugauucuucuaauaauacccuccacuuuauugaauaggauuaguuuguucugaaggugagaagauucggacugaauuugcuaaaugaaucaugaaugcuuuaaagugaaagaaggaagaaagagcuaucucuuugguaggaauaaacuuuaaugagaucacucucaguuaacaugacuagaucaccuauacccaggcacaacagaaaaacagcuuuuaaaaacagaguaagauaacuggaguaauuuucccuucauaaguguaucuaauggcaggcagggaaaaucuuugguauugaugaauuguuagaacuauugaugggggaaggagcucuugccucuguugccauacuggggccagaaauagcaauuucagugaaccuaggccaacaaccacaauuaagcauuucagaagcucaaaauauaaaaauacuaggaagauuauccagagcauuuauuucuauugcaaaagacauuuaauugauguuucacaaaauuuuccacagauaauaaggaaacuauaaauaaaaaaaacccacaaagcuaggagugaugauauacaccuuauaaucucagcaaucaugaggcugagacaggagaauuaaaaauuagaagccaauaugggcuaugugaugagauucaagccagccuagauuauacagaucaagauucugaugucucauuaaaaaaaaucuuuuuccaaauaacaacaacuccaaaugaagcuacaaaguuacauauaaauuugugagcaggggaagagaauuaaauauaggucacaucccucagccauucacccuuauucaauggauggaggacaauaugguuuuggauucuggcccacauccugaacuucuacuuaauaccaagaauaauacugccagaaauaaaaagacugcaacagccccagcuccaacuaucuacaugcauuaucuggucugugagaugaagcagucagggcuuccuccaucuucccagucuuuagagggaagagggagagcugagagugugaagagauguuuagguucuggaaagauuugcgcuugaccccuauuccccucucucaccccacucccccauccaggguagaaaaucaaagguagauuaagacuaaacuaaguacauuuggggcggcggggagggggucacaauagaauuaaccaaagcauauauauauauucagcaacugugaagaaaccucgcuuuucacuguuucucaaucaccuuagucugggacacaacuggccacgcacgcagccugugaggaggcagugggaggcaggacuugugaugaagcuccagcuccaggagccaaauuuuagauucuagauaagccaguggagaggagauuugagggcaauaagguagggucucuuucuuccuuacacaugaaggggagagucgggagagaggagacugcgccaaaggagaacaggcaagaaaagcaccuugauagauagauagggagggguuuugccggagcacccgccagggaguggauagcgacaagccuggucggugacucagugaaagugacaguaagggccugggcggcagugguggcccagaggcccgugacggguguggccgauguggggagcucaccguguccuuggacgagcccagcuuuuugaggccguccaggggcagcaggucggcugaguccuuguggaugaacugcaccgccugcuucauccggcgcugcugccgcagggacgccgcuucccgcaugucugucuccuugcggccgcccucggugaggaguccugaguaaaacaucgcugaaacgcccgcggccgggcggccggguguccccugccaagcaccuucaaccucgagcuccuggacagcgccgcgggagccggcucccgcgccuuuuauauccgagcgugacgucauggggagcagccagugcgcgcgggagaaggcguggccagcaaagcgucccgccccucuggcgcagguucaggaacgaggguggggucuaucagcgucaaccacccaccuuuacuccaucacccauccugaggaaaaagcuagcucggagcagccuacggccgacagacugaccccggggcgcugagggucuagcggaaccgcuucgcccaacuguccccucucccgcguggguugcccugcccugcacgcauugcauagaaugggcuguggggcccugugcuccggcagccuagccccuuccacccuagucggcuccuucgggcucucagcucaccuguccacgccgcggccgaucccgggaugacugacagcugagccaugcucggcuucucagaguuguaccucugugcucugaaguugggagagcuccggauuccuccaacuucagguc

SEQ ID NO: 10258 - RNA, 2501 nt, Mus musculus
gaccugaaguuggaggaauccggagcucucccaacuucagagcacagagguacaacucugagaagccgagcauggcucagcugucagucaucccgggaucggccgcggcguggacaggugagcugagagcccgaaggagccgacuaggguggaaggggcuaggcugccggagcacagggccccacagcccauucuaugcaaugcgugcagggcagggcaacccacgcgggagaggggacaguugggcgaagcgguuccgcuagacccucagcgccccggggucagucugucggccguaggcugcuccgagcuagcuuuuuccucaggaugggugauggaguaaaggugggugguugacgcugauagaccccacccucguuccugaaccugcgccagaggggcgggacgcuuugcuggccacgccuucucccgcgcgcacuggcugcuccccaugacgucacgcucggauauaaaaggcgcgggagccggcucccgcggcgcuguccaggagcucgagguugaaggugcuuggcaggggacacccggccgcccggccgcgggcguuucagcgauguuuuacucaggacuccucaccgagggcggccgcaaggagacagacaugcgggaagcggcgucccugcggcagcagcgccggaugaagcaggcggugcaguucauccacaaggacucagccgaccugcugccccuggacggccucaaaaagcugggcucguccaaggacacggugagcuccccacaucggccacacccgucacgggccucugggccaccacugccgcccaggcccuuacugucacuuucacugagucaccgaccaggcuugucgcuauccacucccuggcgggugcuccggcaaaaccccucccuaucuaucuaucaaggugcuuuucuugccuguucuccuuuggcgcagucuccucucucccgacucuccccuucauguguaaggaagaaagagacccuaccuuauugcccucaaaucuccucuccacuggcuuaucuagaaucuaaaauuuggcuccuggagcuggagcuucaucacaaguccugccucccacugccuccucacaggcugcgugcguggccaguugugucccagacuaaggugauugagaaacagugaaaagcgagguuucuucacaguugcugaauauauauauaugcuuugguuaauucuauugugacccccuccccgccgccccaaauguacuuaguuuagucuuaaucuaccuuugauuuucuacccuggaugggggaguggggugagagaggggaauaggggucaagcgcaaaucuuuccagaaccuaaacaucucuucacacucucagcucucccucuucccucuaaagacugggaagauggaggaagcccugacugcuucaucucacagaccagauaaugcauguagauaguuggagcuggggcuguugcagucuuuuuauuucuggcaguauuauucuugguauuaaguagaaguucaggaugugggccagaauccaaaaccauauuguccuccauccauugaauaagggugaauggcugagggaugugaccuauauuuaauucucuuccccugcucacaaauuuauauguaacuuuguagcuucauuuggaguuguuguuauuuggaaaaagauuuuuuuuaaugagacaucagaaucuugaucuguauaaucuaggcuggcuugaaucucaucacauagcccauauuggcuucuaauuuuuaauucuccugucucagccucaugauugcugagauuauaagguguauaucaucacuccuagcuuuguggguuuuuuuuauuuauaguuuccuuauuaucuguggaaaauuuugugaaacaucaauuaaaugucuuuugcaauagaaauaaaugcucuggauaaucuuccuaguauuuuuauauuuugagcuucugaaaugcuuaauugugguuguuggccuagguucacugaaauugcuauuucuggccccaguauggcaacagaggcaagagcuccuucccccaucaauaguucuaacaauucaucaauaccaaagauuuucccugccugccauuagauacacuuaugaagggaaaauuacuccaguuaucuuacucuguuuuuaaaagcuguuuuucuguugugccuggguauaggugaucuagucauguuaacugagagugaucucauuaaaguuuauuccuaccaaagagauagcucuuucuuccuucuuucacuuuaaagcauucaugauucauuuagcaaauucaguccgaaucuucucaccuucagaacaaacuaauccuauucaauaaaguggaggguauuauuagaagaaucaaaaugcggacuuuuagaauguuggaucgaaggcacuaauguuugguuugaguggcugagauguucccuaauaagaauuaccacaacuuccuucuuccuaagauuccauauccugcuuugaacuauguaaggauaauucucuucugacuccuug

SEQ ID NO: 10259 - RNA, 2501 nt, Mus musculus
cagguguacccugcgggcacagaugggggucgaggcucagucaggugcuaagccggcagggggcgcgguccauuugaggucacagcuccccaaguccgggguuuugguuauccaugugucccacccgucucccgguucuugcagcacuguccaggaagcucagaucagcacucuggguuguacacauuaugggcaaaggauucaccccacccgaguuguucugguuccccuucccuucucacuguuugaacucuaugcugggaaauuagggcaagggaaguccugcuccagucuaaucucucagagcggaucucugagaugucuagccacaggggaccucuuaccccuaccccccauacccacaggcaagcugcagggcaggucugguuuuagaagcaagcacgcuggagagggaggacuccagggcaaaucugaccacgcccaccguccgccccugagcgcuuauaagacgcuggagcuggugcucacuagucagugguuucuuggugacacuagacagagcaacuccagcguuaccgcucccgcuccugguuucucggcuucucaucgcagucaaucuuggacuuugggguuuugcuacugucagaaggacuucuuucugcuucaagugcuugacaacgcaccccuuuaucagguaggaaccgcuggccuccagcauguuagggagggggacggcuuugccaaagccccaaaacuugcagagcuggacaagggggaacaacccacuuuaggguauccaauguagagaacaccucauugcccaggucuagcucaugcgcacagcuggagcucucuugagauccccccuccuccuugggcugagauccugggacuuuaguuggaaaccucuggaagccuggcacuucucaauggcuuccuuugccuugcuugucacccacccggccagcgcaaaaaucuccgguguuucucugcgccagugggggagauaagcagcugagccaggaagagcgcugccaagcggcuccccguccugccgccacccuucgcgugcugacgggaucgugcugcuggcccgguugcucacacucggugucuuguuccuuuccaggguaucagagcaucgccacagaaugaagcugguuuccaucacccugauguuauuggguucacucgcuuuccuaggcgcggacacugcagggccagauacuccuucgcaguuccgaaagaagugaguuugggccgugcuuucuuucuucacuuugaauaccuggcaaugagagaaaacugagagauggucuggagguguuacaaagggaguggagcuggcugggacaucacuugaacuuaggccaaacgcaucugcuuguguuuucuagguggaauaagugggcgcuaagucgugggaagagggaacuacaagcauccagcagcuacccuacgggacucgcugaugagacgacaguuccuacccagacucuugauccauuccuggacgagcagaacacaacuggcccccuacaagccagguaacuaugcucucugcagaggaugugcccucuccacuacucugacccuggggauuguccuggcugcacugcagcugaggcuccggcggagggaacggguuccaggucccucggguacugcauggcuccggucccaggugguugggaccaaagccccgguugaugagguguccuuccuucuucacagcaaucagagcgaagcccacauucgugucaaacgcuaccgccagagcaugaaccaggguucccgcagcaauggaugccgcuucgggaccugcacauuucagaaauuggcccaccagaucuaccagcuaacagacaaagacaaggacggcauggcucccagaaacaagaucagcccucaaggcuauggccgccggcgccggcguucccugcuggagguccuccggucccggacuguggaguccucccaggagcagacacacacagccccaggccccugggcgcacaucuccagacucuuuaggauauaggugcgggugacagcauugaacagucgggcgaguaucccguuggcgccugcggaaucagagaacuucgcaccggggcggacugagacaauccugcagagaucugccuggcugccccuaggggaggcagaggaacccaagaccaagccaggcucaugccagaaaccgagacuuacaggcugauacucuccgggcaggggucugagccacugccuugcccgcucauaaacugguuucucacggggcauaagccucauuacuacuugaacuuuccaaaaccuagcgaggaacgugcaaugcuuguuguccagccaaagguaacuauaguauuuaaguuuguugcugucaagguuuuuuuuuuuguaacuucaaauauauagagauauuuuuguacguuauauauuguauuaagggcauuuuaaagugauuauauugucaccuuccccuauuuuaagacgugaaugucucagcaagguguaagguuguuugguuccgugugugu

SEQ ID NO: 10260 - RNA, 2501 nt, Mus musculus
acacacacggaaccaaacaaccuuacaccuugcugagacauucacgucuuaaaauaggggaaggugacaauauaaucacuuuaaaaugcccuuaauacaauauauaacguacaaaaauaucucuauauauuugaaguuacaaaaaaaaaaaccuugacagcaacaaacuuaaauacuauaguuaccuuuggcuggacaacaagcauugcacguuccucgcuagguuuuggaaaguucaaguaguaaugaggcuuaugccccgugagaaaccaguuuaugagcgggcaaggcaguggcucagaccccugcccggagaguaucagccuguaagucucgguuucuggcaugagccuggcuuggucuuggguuccucugccuccccuaggggcagccaggcagaucucugcaggauugucucaguccgccccggugcgaaguucucugauuccgcaggcgccaacgggauacucgcccgacuguucaaugcugucacccgcaccuauauccuaaagagucuggagaugugcgcccaggggccuggggcugugugugucugcuccugggaggacuccacaguccgggaccggaggaccuccagcagggaacgccggcgccggcggccauagccuugagggcugaucuuguuucugggagccaugccguccuugucuuugucuguuagcugguagaucuggugggccaauuucugaaaugugcaggucccgaagcggcauccauugcugcgggaacccugguucaugcucuggcgguagcguuugacacgaaugugggcuucgcucugauugcugugaagaaggaaggacaccucaucaaccggggcuuuggucccaaccaccugggaccggagccaugcaguacccgagggaccuggaacccguucccuccgccggagccucagcugcagugcagccaggacaauccccagggucagaguaguggagagggcacauccucugcagagagcauaguuaccuggcuuguagggggccaguuguguucugcucguccaggaauggaucaagagucuggguaggaacugucgucucaucagcgagucccguaggguagcugcuggaugcuuguaguucccucuucccacgacuuagcgcccacuuauuccaccuagaaaacacaagcagaugcguuuggccuaaguucaagugaugucccagccagcuccacucccuuuguaacaccuccagaccaucucucaguuuucucucauugccagguauucaaagugaagaaagaaagcacggcccaaacucacuucuuucggaacugcgaaggaguaucuggcccugcaguguccgcgccuaggaaagcgagugaacccaauaacaucagggugauggaaaccagcuucauucuguggcgaugcucugauacccuggaaaggaacaagacaccgagugugagcaaccgggccagcagcacgaucccgucagcacgcgaaggguggcggcaggacggggagccgcuuggcagcgcucuuccuggcucagcugcuuaucucccccacuggcgcagagaaacaccggagauuuuugcgcuggccgggugggugacaagcaaggcaaaggaagccauugagaagugccaggcuuccagagguuuccaacuaaagucccaggaucucagcccaaggaggaggggggaucucaagagagcuccagcugugcgcaugagcuagaccugggcaaugagguguucucuacauuggauacccuaaaguggguuguucccccuuguccagcucugcaaguuuuggggcuuuggcaaagccgucccccucccuaacaugcuggaggccagcgguuccuaccugauaaaggggugcguugucaagcacuugaagcagaaagaaguccuucugacaguagcaaaaccccaaaguccaagauugacugcgaugagaagccgagaaaccaggagcgggagcgguaacgcuggaguugcucugucuagugucaccaagaaaccacugacuagugagcaccagcuccagcgucuuauaagcgcucaggggcggacggugggcguggucagauuugcccuggaguccucccucuccagcgugcuugcuucuaaaaccagaccugcccugcagcuugccuguggguaugggggguagggguaagagguccccuguggcuagacaucucagagauccgcucugagagauuagacuggagcaggacuucccuugcccuaauuucccagcauagaguucaaacagugagaagggaaggggaaccagaacaacucggguggggugaauccuuugcccauaauguguacaacccagagugcugaucugagcuuccuggacagugcugcaagaaccgggagacgggugggacacauggauaaccaaaaccccggacuuggggagcugugaccucaaauggaccgcgcccccugccggcuuagcaccugacugagccucgacccccaucugugcccgcaggguacaccug

SEQ ID NO: 10261 - RNA, 2501 nt, Mus musculus
accccacugugguugaggaagacuggaagguuuagaggcagcgcuuacaaaggugagcuggucagguaguggaucacaacgucucuaguagaaacuguuaggugccucaguuuccccgucugugcaaagugcauuguacagaaggcacaagaccacgcacaucggguuaagguguuuccaaccaagucuagaggcaaggcguagcugagcccagggaggcgcagaggugcgggcuccaggcgcagagcugaugccuagaggugaaggcuccaggccuuguaucagaaaggucccgggaguccaucuuugcucugaguggaaaaaacuaggaacuggacgccaguaaccugagccaggggcagacccguccgcagggcugggaggggcgaguuugggcgccccgccugcggugcucucagcagcggcucagggcgcuggggggcgggaagagguggagccagguggggaggagcaaaacccggaggccucgggcaccgcgggcagagccagagccgcuggaaccugagccccggcgugcugcuuugggagaguccgccguccgagccgaaagcagccgcugcccgauuucaguacauaguccgggagaaaggcuagugaggccggagacagggucacggauucuacugcaguucgggagcugccagguugcccgcgcuggcccugcugcccuaauugcaccuagccggacuugcuccucacgucccgguugcgccauggauccuucggagaagaagauaucgguguggaucugccaggaggagaagcugguguccggccucucccgccgcaccaccugcucggacguggugcgggugcuuuuggaggacggcugccggcggcgcugcaggcagcggcggggccagcgacggggcuugacggaagacccuucgggccaguuggagcugcccgagcccccggacgaaaacgacgaggaugacgacgacgcgaugcccccgggcaugcuaugugggcccccgcagugcuauugcauuguggagaaguggcgcggcuuugagcgcauccugcccaacaagacgcggaucuugcgccucuggacugcuuggggcgacgagcaggagaauguacgcuucgugcuggugcgcagcgaagcgucgcugcccaacgccggaccgcgcagcgccgaggcgcggguagugcucagccgcgagcgccccugcuuggcccggggcgccccagcacggcccagccuggccuugacccaggagaagcagcggcgggugguacgcaaggccuuccgcaaacuggccaagcucaaccggaggcgccagcagcagccgucgucaccuuguucguccacgucgucguccaccgccucguccugcucgucgucugcucggacccacgagagcgcgucgguagaacguauggagacgcuggugcaucuggugcugucgcaggaccacacgauucgccagcaggugcagcggcuccgggagcuggaccgcgagauagaccgcuacgaagccaaggugcaccuagaccgcaugcggaggcacggagucaacuacgugcaggauaccuaucuagugggggccggcaucgaccuggacggacaaacuccugaaggggagccggaagaugcgacacuggaggagaaggggacagaaccggcggcaccccuggacagcgaggcgcaggcggcagcguuggaggagcuggccaggcgcugugacgaccuggugcggcugcaggaggagcgcgcccagcaggaggaguugcuagagcgccuguccgccgagauccaggaggaacugaaccagcgcuggaugcagcggcgcaaugaggagcuggcggcucgagaggagucccuagagcccgauggugguccggauggcgagcugcugcuggagcaggagcgggucaggacgcagcucagcaccagccuuuacaucgggcugaggcucagcacggaccuggaggccgucaaggcggacuuggauuacagccagcagcagagggacauuaaggagcgcgagcuucagggccuucuccagaguuugcacacuuuugagcagacgguggugcaugauggggcucuggguuccagcggacccucucgcgaaccucagccucagaccugugcagaaauguggguagaccaggcccggggacuggcuaagaguugcccgggcaacgaugaggacucagauacugggcugagcuccaugcauagccaagacucagacucgguacccccugugugugaaucccuuguguagaaguaguagggagcaagcuuagacgcuugcagaaugcacugguuuggccugcucagggacaugaagugaggccaugggggugagcucagaguucccacggaugggucuggagagugagugugaaggaggguccuggacaaggaagcccuaagcuucuaagcuuuagagggaaguggagucaggaggugagaaccccucccuguuuuuuaaaaacacauuagguaagugaugagguccaag

SEQ ID NO: 10262 - RNA, 2501 nt, Mus musculus
cuuggaccucaucacuuaccuaauguguuuuuaaaaaacagggagggguucucaccuccugacuccacuucccucuaaagcuuagaagcuuagggcuuccuuguccaggacccuccuucacacucacucuccagacccauccgugggaacucugagcucacccccauggccucacuucaugucccugagcaggccaaaccagugcauucugcaagcgucuaagcuugcucccuacuacuucuacacaagggauucacacacaggggguaccgagucugagucuuggcuaugcauggagcucagcccaguaucugaguccucaucguugcccgggcaacucuuagccaguccccgggccuggucuacccacauuucugcacaggucugaggcugagguucgcgagaggguccgcuggaacccagagccccaucaugcaccaccgucugcucaaaagugugcaaacucuggagaaggcccugaagcucgcgcuccuuaaugucccucugcugcuggcuguaauccaaguccgccuugacggccuccagguccgugcugagccucagcccgauguaaaggcuggugcugagcugcguccugacccgcuccugcuccagcagcagcucgccauccggaccaccaucgggcucuagggacuccucucgagccgccagcuccucauugcgccgcugcauccagcgcugguucaguuccuccuggaucucggcggacaggcgcucuagcaacuccuccugcugggcgcgcuccuccugcagccgcaccaggucgucacagcgccuggccagcuccuccaacgcugccgccugcgccucgcuguccaggggugccgccgguucuguccccuucuccuccagugucgcaucuuccggcuccccuucaggaguuuguccguccaggucgaugccggcccccacuagauagguauccugcacguaguugacuccgugccuccgcaugcggucuaggugcaccuuggcuucguagcggucuaucucgcgguccagcucccggagccgcugcaccugcuggcgaaucgugugguccugcgacagcaccagaugcaccagcgucuccauacguucuaccgacgcgcucucguggguccgagcagacgacgagcaggacgaggcgguggacgacgacguggacgaacaaggugacgacggcugcugcuggcgccuccgguugagcuuggccaguuugcggaaggccuugcguaccacccgccgcugcuucuccugggucaaggccaggcugggccgugcuggggcgccccgggccaagcaggggcgcucgcggcugagcacuacccgcgccucggcgcugcgcgguccggcguugggcagcgacgcuucgcugcgcaccagcacgaagcguacauucuccugcucgucgccccaagcaguccagaggcgcaagauccgcgucuuguugggcaggaugcgcucaaagccgcgccacuucuccacaaugcaauagcacugcgggggcccacauagcaugcccgggggcaucgcgucgucgucauccucgucguuuucguccgggggcucgggcagcuccaacuggcccgaagggucuuccgucaagccccgucgcuggccccgccgcugccugcagcgccgccggcagccguccuccaaaagcacccgcaccacguccgagcagguggugcggcgggagaggccggacaccagcuucuccuccuggcagauccacaccgauaucuucuucuccgaaggauccauggcgcaaccgggacgugaggagcaaguccggcuaggugcaauuagggcagcagggccagcgcgggcaaccuggcagcucccgaacugcaguagaauccgugacccugucuccggccucacuagccuuucucccggacuauguacugaaaucgggcagcggcugcuuucggcucggacggcggacucucccaaagcagcacgccggggcucagguuccagcggcucuggcucugcccgcggugcccgaggccuccggguuuugcuccuccccaccuggcuccaccucuucccgccccccagcgcccugagccgcugcugagagcaccgcaggcggggcgcccaaacucgccccucccagcccugcggacgggucugccccuggcucagguuacuggcguccaguuccuaguuuuuuccacucagagcaaagauggacucccgggaccuuucugauacaaggccuggagccuucaccucuaggcaucagcucugcgccuggagcccgcaccucugcgccucccugggcucagcuacgccuugccucuagacuugguuggaaacaccuuaacccgaugugcguggucuugugccuucuguacaaugcacuuugcacagacggggaaacugaggcaccuaacaguuucuacuagagacguugugauccacuaccugaccagcucaccuuuguaagcgcugccucuaaaccuuccagucuuccucaaccacaguggggu

SEQ ID NO: 10263 - RNA, 2501 nt, Mus musculus
aauaaauuuuuuuaagugugauuuaacuacagucucacccgaugacuucugucuucuuucagccugagaguagcugagccucguguccugcuaaacagcagccaggcggacagugcgcucucuccuaccuucuggauuccgccuuccuguggaugggcuaggcaggguaaggggccuuaccuagagcccucagccuccugcucuuccuccugcuccagcucccuggcuuucaucugcauauaguccugcaccagugcagccagcaggcgaacuucuucuucacugagaguggccaugccugggcugcuuuccaagauugaccuguggagaggaagcaagucuagcaccgucucugauucccugccugccgcuuacacuagaggcuugagucagcguccucauaaguuuaggaauuuugcaaguuaaaugauaagugcaggcaaauugaaugacaaaauaauuacuguugaaucugaauugggggcucauuuuaauaaauacaguuuguaaaguagaugagaaauagauuaacagauuauaaauuagagucaguaauauuuauuggcaaguuagcagauuagaguaaaauucaugucucauaaggaaugaauugaacaaaaagguuuaacucuugauacuaaauaugggggggaaguggugaaagcauuuuguuaguuaaagggcuacuugaaauuuaagcuuauagugaacuuacaugugugucuauguacauguauauauuuuuccaccagauaguuggguuuuaaacauucgguacucugugguuaacaggaaguuggccagucccaggacacuaggacuccugucuuuacacguaccucaaaggcacugccuggaggcugcaugccugguacaggagcaagaugcugacaaccaggaaaggggagaacuucaggaagcccaugaugccuuccugcaagagaagaaugucuauuuauucauuuguuuauuuauaucaguucaagguucuauaagcccauggaccuggcuuucugugugcuuaugccugugacuccccgacauuuuggcuucauacugauaaccacauuucucaucaucuuuguucccucauuguccagugugcauguagccuauacgguuuggaaagaaucuuagcccuaaagauggaggagggggagggugcggggggucgggggugguggugguggugguggugguggugguaaaggaguggugguggugagaucagucucaaggauucuacgaaucccaggugucuccugucucuacaucugucuccacagggaaguguagaguugucuucucuuugugaguuuuuuuacagacaccuaagaaugugagaaagaaagucuauggagagggaaucuuucugccuugaaaucugagaaacugacggcugcacugcucagcugcuccacccucuggcaacucaguugccuacaagaaccaaucuaaaguugagguggaaaacacuucucuguuaaucccagggucccaaaucgggguuugcaauugcggcaacugacucuuguucgcuacauauuggcccuaggcucggacucaggaccaauuucucaggaaacgagaauacugaaagcaccaucuaagaagagcuacgcccgacugcgcgcgugaagccuaggagcucagcgucccaagauugguggaucagguguacagagagagagaaacgugagacuggagccugcgcuccagcgaaacugaaggaaggcucugcggaccaguucuguagggaccuaucuggaucgggaucuaacacgaaccacgcuaggacuaaugacuaacggggacugggauugucaggaaagacaaaccaaggacuaacagcgagagcgggagagaagagggagaggaagagaaaaguagaacuacacaccugaacaggaauuuuagggcucaccuggugagcggugccuuggagcugagccugcggggauccugauggagccaggcagugcuugcgaagcggugacucuugauccuggcaguggcuccugugccucccagcgccugcagcugcucuuauucccgccguggugagucgggaggggucucggggcuccaggcagccaauagguggaagggccccaugccccagacagauugcgucaccucugugcuuccagaacucagagcaucuagcaagaugacaccauuugaauuuaaauugaggucauugguggaagugggggagaugauacggaucagugagagccacccuuaaaauuagcgggaauuuggagggccuuuugacaucaagauaaauuucaucucuucuuuccuucuugacuuugaauauuccugacuccaaucucagaaucuuggagaguagaguccaguaucucaagcacuccuugcugcaugucugauucuaaucguacccccacccccaccuaaguccgugccuaaucuagaauaguuuagugcaccugagggaugaauucuugaucugcaaggcuaguucuggcagcguggca

SEQ ID NO: 10264 - RNA, 2501 nt, Mus musculus
ugccacgcugccagaacuagccuugcagaucaagaauucaucccucaggugcacuaaacuauucuagauuaggcacggacuuagguggggguggggguacgauuagaaucagacaugcagcaaggagugcuugagauacuggacucuacucuccaagauucugagauuggagucaggaauauucaaagucaagaaggaaagaagagaugaaauuuaucuugaugucaaaaggcccuccaaauucccgcuaauuuuaaggguggcucucacugauccguaucaucucccccacuuccaccaaugaccucaauuuaaauucaaauggugucaucuugcuagaugcucugaguucuggaagcacagaggugacgcaaucugucuggggcauggggcccuuccaccuauuggcugccuggagccccgagaccccucccgacucaccacggcgggaauaagagcagcugcaggcgcugggaggcacaggagccacugccaggaucaagagucaccgcuucgcaagcacugccuggcuccaucaggauccccgcaggcucagcuccaaggcaccgcucaccaggugagcccuaaaauuccuguucagguguguaguucuacuuuucucuuccucucccucuucucucccgcucucgcuguuaguccuugguuugucuuuccugacaaucccaguccccguuagucauuaguccuagcgugguucguguuagaucccgauccagauaggucccuacagaacugguccgcagagccuuccuucaguuucgcuggagcgcaggcuccagucucacguuucucucucucuguacaccugauccaccaaucuugggacgcugagcuccuaggcuucacgcgcgcagucgggcguagcucuucuuagauggugcuuucaguauucucguuuccugagaaauugguccugaguccgagccuagggccaauauguagcgaacaagagucaguugccgcaauugcaaaccccgauuugggacccugggauuaacagagaaguguuuuccaccucaacuuuagauugguucuuguaggcaacugaguugccagaggguggagcagcugagcagugcagccgucaguuucucagauuucaaggcagaaagauucccucuccauagacuuucuuucucacauucuuaggugucuguaaaaaaacucacaaagagaagacaacucuacacuucccuguggagacagauguagagacaggagacaccugggauucguagaauccuugagacugaucucaccaccaccacuccuuuaccaccaccaccaccaccaccaccaccacccccgaccccccgcacccucccccuccuccaucuuuagggcuaagauucuuuccaaaccguauaggcuacaugcacacuggacaaugagggaacaaagaugaugagaaaugugguuaucaguaugaagccaaaaugucggggagucacaggcauaagcacacagaaagccagguccaugggcuuauagaaccuugaacugauauaaauaaacaaaugaauaaauagacauucuucucuugcaggaaggcaucaugggcuuccugaaguucuccccuuuccugguugucagcaucuugcuccuguaccaggcaugcagccuccaggcagugccuuugagguacguguaaagacaggaguccuaguguccugggacuggccaacuuccuguuaaccacagaguaccgaauguuuaaaacccaacuaucugguggaaaaauauauacauguacauagacacacauguaaguucacuauaagcuuaaauuucaaguagcccuuuaacuaacaaaaugcuuucaccacuucccccccauauuuaguaucaagaguuaaaccuuuuuguucaauucauuccuuaugagacaugaauuuuacucuaaucugcuaacuugccaauaaauauuacugacucuaauuuauaaucuguuaaucuauuucucaucuacuuuacaaacuguauuuauuaaaaugagcccccaauucagauucaacaguaauuauuuugucauucaauuugccugcacuuaucauuuaacuugcaaaauuccuaaacuuaugaggacgcugacucaagccucuaguguaagcggcaggcagggaaucagagacggugcuagacuugcuuccucuccacaggucaaucuuggaaagcagcccaggcauggccacucucagugaagaagaaguucgccugcuggcugcacuggugcaggacuauaugcagaugaaagccagggagcuggagcaggaggaagagcaggaggcugagggcucuagguaaggccccuuacccugccuagcccauccacaggaaggcggaauccagaagguaggagagagcgcacuguccgccuggcugcuguuuagcaggacacgaggcucagcuacucucaggcugaaagaagacagaagucaucgggugagacuguaguuaaaucacacuuaaaaaaauuuauu

SEQ ID NO: 10265 - RNA, 2501 nt, Mus musculus
caauggaagagaucucggcgucucagcaggcagucccuaaggaacuucaccaacuucuccaagcacucacucaggugugccucgucccagcugggcguugggcugcccucguucagaagcaccuccagcaccgccguuuugagcacguaagaggacaggauacguccccaguguguagcagccaucggguccagcccgcgggcacccaagucucgaagagccuuaagcagcugcaggcacuugagauagcaggcaccuggaggcgcccguuccugaagccagcccagcaguuucugcuccugacgugcuguguucacaccccacagagccucggcgcgcaggccacccgggagcucugacagggccccgcuaggcgagggugguggugguggugccacaaggaagacgccaucacccagguggacagcagggaugaggcgcacggccauggaaaggcggcagcagccauaguccgugcggcaaggaaggauguggaggguggggggcugcuccagacugccuggggucaggcugacccgacagcgacccuccaagcuguagcgcacaguggccaaggagcgcuguaggugcgccuggaaccagcgcaguaccaggguagcugagagguggcgacggcccugcacauccacacagaagccuucagcgaaggguuugcagucgcgaugccacuggcccgucgaggcccccgauggcgaggguggugccuugagggcgcacacgaagcagcugcggaaggcuggggucagcgaggguucgguccccaggcuccgcggcuccagcgccaccugcggcgggagucgcaguggcaccaacacgucgaagcugucgggucggcggauuuuaugcuguucauaggcgcugcccaccuggaugaagucuccccggaaggccaaagccagugcucccccggugaugaggccuggagacccucgggcccggccagcuugcacuaguucccccacaauccggcucacaugugccuugcugugaccuagcacaugcggcgacaggcgcacuucgugcucauaguaacucuccaguaagaugcucaggccuggcucuugcaaggaucuggcugagaaguuggcaugaccacgcgggcgggaagagccuggcaacaggcgcuggcggauggcguggcgacaucguaggaggauguagccgaggagaagaaggauggccaccuugagcaacgggaaaccgcugucugcgccgucgggggacucggcccgggcauccucgcugcugcguagggcaugguagaggcacaccagcgccgugcacagcccggucaccaagggccagaagacccgcagguugagcguguaccgcacggacaugccgggagaccgggcggcccagggcgcgagcccgggugguguccccugcccagcaugcgcgcagcgucccggaggccccgaggcccccguguccuuggccuugaaggaggcuccccgcucgcagcgccggggccagcagccccgcugcucugccuccacucuuagcucaaguuccccuuccaggcgccgcccgcgcagcucgcuccggccccugaccgcgcccugucccugucccgcucagucccagccgcgcugcccugggcuggcuucugccccggacuccuacccuacccugggcggcccuccuggcuccgccacagcugugcacaggggcgaucggccggguuacucgggucccgggauuuucuucuuucggaggggaaggccgcgccgggcagccgggaggaaaugccggagucuggagccucgcggggagggcggcccccucccagccuccgccugguucgacgucggguggccagagggacuucgggacuugcgggagacugcacucccgagggcuacuccugggcccccuccuggaaggcagaacggggaaggccugguuccggggcgguggcugcaucugaucccgcacuuacugggaaguugcuggaggaaggcuugcagccccaccgcccggcccucccuucgcccggccccacccccaacgagucccgcuggcggcguggcaggcucgggcggaaguggccccuagcugucugccgcugugcugucuuguaaaccucuguagaguaccuacuaagcacuagacaggagccuaagggcugggaaugcaguugauaguguggagguucucuugccuguuauucaagcucacagucugguaaaacgggacuacgaacagagaaggguggugaugacugccucugaucccgaggcuggagucaugaguucaagacuagucugggcuacauagacugucucaaaaacaaagauucccaccagcagauguucugaaaggaagcugaaugaaggaguacagguugaucuuccaaaggaugauccucagaguccugccccaaacuguagggugucugacgagguaguguuggaucugagaccugggagagcuggugcaaagcgauaaugauaguuuuugcaggacaggagacaggu

SEQ ID NO: 10266 - RNA, 2501 nt, Mus musculus
accugucuccuguccugcaaaaacuaucauuaucgcuuugcaccagcucucccaggucucagauccaacacuaccucgucagacacccuacaguuuggggcaggacucugaggaucauccuuuggaagaucaaccuguacuccuucauucagcuuccuuucagaacaucugcuggugggaaucuuuguuuuugagacagucuauguagcccagacuagucuugaacucaugacuccagccucgggaucagaggcagucaucaccacccuucucuguucguagucccguuuuaccagacugugagcuugaauaacaggcaagagaaccuccacacuaucaacugcauucccagcccuuaggcuccugucuagugcuuaguagguacucuacagagguuuacaagacagcacagcggcagacagcuaggggccacuuccgcccgagccugccacgccgccagcgggacucguuggggguggggccgggcgaagggagggccgggcgguggggcugcaagccuuccuccagcaacuucccaguaagugcgggaucagaugcagccaccgccccggaaccaggccuuccccguucugccuuccaggagggggcccaggaguagcccucgggagugcagucucccgcaagucccgaagucccucuggccacccgacgucgaaccaggcggaggcugggagggggccgcccuccccgcgaggcuccagacuccggcauuuccucccggcugcccggcgcggccuuccccuccgaaagaagaaaaucccgggacccgaguaacccggccgaucgccccugugcacagcuguggcggagccaggagggccgcccaggguaggguaggaguccggggcagaagccagcccagggcagcgcggcugggacugagcgggacagggacagggcgcggucaggggccggagcgagcugcgcgggcggcgccuggaaggggaacuugagcuaagaguggaggcagagcagcggggcugcuggccccggcgcugcgagcggggagccuccuucaaggccaaggacacgggggccucggggccuccgggacgcugcgcgcaugcugggcaggggacaccacccgggcucgcgcccugggccgcccggucucccggcauguccgugcgguacacgcucaaccugcgggucuucuggcccuuggugaccgggcugugcacggcgcuggugugccucuaccaugcccuacgcagcagcgaggaugcccgggccgagucccccgacggcgcagacagcgguuucccguugcucaagguggccauccuucuucuccucggcuacauccuccuacgaugucgccacgccauccgccagcgccuguugccaggcucuucccgcccgcguggucaugccaacuucucagccagauccuugcaagagccaggccugagcaucuuacuggagaguuacuaugagcacgaagugcgccugucgccgcaugugcuaggucacagcaaggcacaugugagccggauugugggggaacuagugcaagcuggccgggcccgagggucuccaggccucaucaccgggggagcacuggcuuuggccuuccggggagacuucauccaggugggcagcgccuaugaacagcauaaaauccgccgacccgacagcuucgacguguuggugccacugcgacucccgccgcagguggcgcuggagccgcggagccuggggaccgaacccucgcugaccccagccuuccgcagcugcuucgugugcgcccucaaggcaccacccucgccaucgggggccucgacgggccaguggcaucgcgacugcaaacccuucgcugaaggcuucuguguggaugugcagggccgucgccaccucucagcuacccugguacugcgcugguuccaggcgcaccuacagcgcuccuuggccacugugcgcuacagcuuggagggucgcugucgggucagccugaccccaggcagucuggagcagccccccacccuccacauccuuccuugccgcacggacuauggcugcugccgccuuuccauggccgugcgccucaucccugcuguccaccugggugauggcgucuuccuuguggcaccaccaccaccacccucgccuagcggggcccugucagagcucccggguggccugcgcgccgaggcucuguggggugugaacacagcacgucaggagcagaaacugcugggcuggcuucaggaacgggcgccuccaggugccugcuaucucaagugccugcagcugcuuaaggcucuucgagacuugggugcccgcgggcuggacccgauggcugcuacacacuggggacguauccuguccucuuacgugcucaaaacggcggugcuggaggugcuucugaacgagggcagcccaacgcccagcugggacgaggcacaccugagugagugcuuggagaaguuggugaaguuccuuagggacugccugcugagacgccgagaucucuuccauug

SEQ ID NO: 10267 - RNA, 2501 nt, Mus musculus
guccagagccuccugccuccucucuagcucuaaauccgcccacacacucuggcuacaaugaccuuugugucccuuucaccaagucuauucccaucuccaaccuucuccagccuggaugcccuccccccccccaccccccucaagucgcucucucaguggaggaccccucuugcuggguccacucuuaaaugccauuccccacaaguccuggucacuuuauuuuccaggcagcccugucccagcagguguaguagguauuugcucacuuagagaguuucuuccucuacuucucugcgcacuuccauggcccccccuccagucuggaccuuuucauuuuacacaagauauuuccuuuagcacucggauauguguucaccacauguguuaaaaaccaaccaaccaacaacccaguaaacauuagagucuaucuuuauaaagaaagcccucuucuuggcugccugggccccaaacuuuaacuccuucccaucccaucuuccccucuugcgacccagcugacccuuuuuagacuuagaagcgagaggaucagggaaacaguguucacagcccagauagaaaacuagcccagaggaggguuuccaaccaacagaugccaauuugcauucuauuuacauguaauuugcaugcaguuuaacuccaagugcgguuauucccaaagcucugagugcccaccaaagaaacuuaggaaauaacguucucaagugcuuugucuacggggugugcuuagccucuucugcauccucuugucuuuguggggacccccggagcuuucuggacgcugcucaggugcccccaccccggcgcaguccggcggccgaugcggcgcgugugcuugggggccccaggcagggacgauggugcccgccacacucccggggccuuugucccucuuccaaagagccgcccccuuggcgaacagaagaagaaggggguaacuggcuaggccgagcuagaacagggggaugaacacucugaucugggggcguccucuggagcaaggucggugggccgauccaaaacuguuuaaucagcuaccgccggccaaggaggggugcuggauccucaucugugcucaucucucccaccagguccaugaaaugugugggguccuuuggggcuucgagccccaguccccuaggaagaggggacguugcacuggguaguccuuaccccuagccuggcugcuuuccucagaggcccaagugcccucgccugggauagaaauucuuccgcuucaccauaagcagccgccccuagauugccagcccacuauuugucccccagcuucagauucccucccuguggugcccacccucucgcgccuuuuuccaagagugcguggccacugcgggcugcaagcuggguuccccagacccugcggcaggugagauuucaggucuccaaaggccggccccugccucaggccauguagugcuuaguucaggaccagcacccuggcuguccucgcaccccaccaaccgccaggcccccuggaaccugcaggcgacgucccucacaggggucacuagcacagggccagauuccccuuuauucccagacgcuuguagucuguccucaccccggaccauagucagagccuuaguucguggauucccccaccagauaaagguccccaaaccacugcccucggucgguccaaugcggcuccucucccgccgcacuguggcaccccucacucgaaccccacggcuucugcagauguaccccaaggaggaggaggagggggagaagggagaacagaaaaagcacgagccaggauccgcuccggaucuuuccaaaaucacggcgggaaaaguuucuggggucccuacggcgcccuccccgugcccgcgcuggcugguacucaccgacccucgcguccccgcagcgccgacgcuccugcuggcccugggcccaagucacaucucugcagcgcgcccgcggcccccgcuccgcgcacgcccgccagccgagcccgccucacugcaucgcccuuccgagcugcggccgcgcgaggcgcccccuggcccggcccgcgcugcagcagccgcggccccgccucuccguuaggccccgccccagcaagccccgccccugccgggucugcagcucugcucaccaccaggaccagagccacagcuugcucgcauccccaggcgccuuccuggcuugcucggagcgcuaagacggcuuucucacccaaaacuccuggugccccaaauucgaggacaucuccuccucccuauuaagaguccagacgcacaguugcucagauugaucuguagaaacauccucagccacauaggacgcaauauuccuacgaggauccuagaggggcacuccccucacacaccggcagcaggucuuggacaagguucuacugcaugcguucuaaagucaccaaagccucgcugugaugcacuuaggaagguccccgaugagcacauucccugcccucuuccacccugcuccagcccguccuu

SEQ ID NO: 10268 - RNA, 2501 nt, Mus musculus
aaggacgggcuggagcaggguggaagagggcagggaaugugcucaucggggaccuuccuaagugcaucacagcgaggcuuuggugacuuuagaacgcaugcaguagaaccuuguccaagaccugcugccggugugugaggggagugccccucuaggauccucguaggaauauugcguccuauguggcugaggauguuucuacagaucaaucugagcaacugugcgucuggacucuuaauagggaggaggagauguccucgaauuuggggcaccaggaguuuugggugagaaagccgucuuagcgcuccgagcaagccaggaaggcgccuggggaugcgagcaagcuguggcucugguccugguggugagcagagcugcagacccggcaggggcggggcuugcuggggcggggccuaacggagaggcggggccgcggcugcugcagcgcgggccgggccagggggcgccucgcgcggccgcagcucggaagggcgaugcagugaggcgggcucggcuggcgggcgugcgcggagcgggggccgcgggcgcgcugcagagaugugacuugggcccagggccagcaggagcgucggcgcugcggggacgcgagggucggugaguaccagccagcgcgggcacggggagggcgccguagggaccccagaaacuuuucccgccgugauuuuggaaagauccggagcggauccuggcucgugcuuuuucuguucucccuucucccccuccuccuccuccuugggguacaucugcagaagccgugggguucgagugaggggugccacagugcggcgggagaggagccgcauuggaccgaccgagggcagugguuuggggaccuuuaucuggugggggaauccacgaacuaaggcucugacuaugguccggggugaggacagacuacaagcgucugggaauaaaggggaaucuggcccugugcuagugaccccugugagggacgucgccugcagguuccagggggccuggcgguugguggggugcgaggacagccagggugcugguccugaacuaagcacuacauggccugaggcaggggccggccuuuggagaccugaaaucucaccugccgcagggucuggggaacccagcuugcagcccgcaguggccacgcacucuuggaaaaaggcgcgagagggugggcaccacagggagggaaucugaagcugggggacaaauagugggcuggcaaucuaggggcggcugcuuauggugaagcggaagaauuucuaucccaggcgagggcacuugggccucugaggaaagcagccaggcuagggguaaggacuacccagugcaacguccccucuuccuaggggacuggggcucgaagccccaaaggaccccacacauuucauggaccuggugggagagaugagcacagaugaggauccagcaccccuccuuggccggcgguagcugauuaaacaguuuuggaucggcccaccgaccuugcuccagaggacgcccccagaucagaguguucaucccccuguucuagcucggccuagccaguuacccccuucuucuucuguucgccaagggggcggcucuuuggaagagggacaaaggccccgggaguguggcgggcaccaucgucccugccuggggcccccaagcacacgcgccgcaucggccgccggacugcgccggggugggggcaccugagcagcguccagaaagcuccggggguccccacaaagacaagaggaugcagaagaggcuaagcacaccccguagacaaagcacuugagaacguuauuuccuaaguuucuuuggugggcacucagagcuuugggaauaaccgcacuuggaguuaaacugcaugcaaauuacauguaaauagaaugcaaauuggcaucuguugguuggaaacccuccucugggcuaguuuucuaucugggcugugaacacuguuucccugauccucucgcuucuaagucuaaaaagggucagcugggucgcaagaggggaagaugggaugggaaggaguuaaaguuuggggcccaggcagccaagaagagggcuuucuuuauaaagauagacucuaauguuuacuggguuguugguugguugguuuuuaacacauguggugaacacauauccgagugcuaaaggaaauaucuuguguaaaaugaaaagguccagacuggagggggggccauggaagugcgcagagaaguagaggaagaaacucucuaagugagcaaauaccuacuacaccugcugggacagggcugccuggaaaauaaagugaccaggacuuguggggaauggcauuuaagaguggacccagcaagagggguccuccacugagagagcgacuugagggggguggggggggggagggcauccaggcuggagaagguuggagaugggaauagacuuggugaaagggacacaaaggucauuguagccagagugugugggcggauuuagagcuagagaggaggcaggaggcucuggac

SEQ ID NO: 10269 - RNA, 2501 nt, Mus musculus
uucuagggauagaucuugcacucucaggcuugcgggccaucucaucaacccuuaagcaaguuuccuaacagauccaugccucagcuucuucaucugaaaagggauaguugcgcaugacucccucuugguaguagcagcaagguuccugccugaaccuagcaggagacacucgcucuuaauugaugaguuguuuugcuuucuggcacagacgcugaguaaacauugggaaaaugagcaacagccgcaaacacaagccaagcuggucuguagggaaagggcaaagauucgagucccgcagucgugggacuuaaaagcuggagcucuggacagcugcggacgcgugggguggggcaugcaaauaagccagcgaucaggcaaaguccggaggacugcgggugaaaaugagcugggugaggggcggggcauguaaaugaccgugcacgggguggggcgucgcauguaaauaagggacaccaggcggcguaggaagcggggcgagguccuucucgcaggaaagccccgcgcggcgcguggagccugaacucgcagguaggaacgggcgguggggaagccuggggaccgggcagugguggcuacagaaccgaucuggccugaaaccagagcccgcggaaccuggggugggcauggggcugcugggcuccucgcucagccagggucggcugccuucgggcgcgggucaagcaaguagacaacucacgcgcuagaacucagggagccucggcgguccgguccccacaaagacguccuagggaucuuuguguagaagcccggacuaccaggcuccucccagguuccgguucaguaacccagaaaccugacuauuguggcaaacuggacguuguauaagccagcuagucugugauuccgucugcccccaagccagcacuccuggguccugcccuucuccagcccuuugggaggugugaggcucaauguggccuuccuucuacagguggucuuuugagagucugggggcauuugcugggacauuugucccauccuaaagucuuauggggaaacugagacuugagaauauguuuggccagaagagaguaaugggauuccacaguccugguaaggccucuaggaaucagccagggaagucaugaccgcuuaaggggacauugaggcagagaggggaggugaccacuguguguguguuccccagcucgucugugcucugcuugcuguuuuaggcugugcucucugacugagggauagacacacaagacagggaguguauugggcaagcagggcaccucuuccuugggcaguacagcuccugagucaguuuggggugugggagaacacuuuggcaggucgagaaucagagacaagagaaggcaugcugaacuguggguacagcaugggcaaaaacuagaaggugggacggcuccgugugccaccucgcugacauaagaggggcuagauauguggaaagggagacagcgcugcaggagccccugaauuccuugcuuugaggcucagggaagucguaggaaggauucguaguccuggcccugcuccuggaucuucaggguaaggauggggaaacccaagugagucgcccaaaugaucacacacugguaauugggcaagguugugaccaucugaggguuugcaguauuugggcugugcuggggucuuaauacagugccaucccagacuggggagggccagguggccagggagacugucccugaggcaggcacaaugacugccacaaucggggaugaaagaagagaaugcuugcauucacccacgccacacccuacuuuucugccuuugggggcuggggcugggaccuagcugggguacacacucacacuuggcauguguacaaaggagcuugccacgguccccauggcacaggaggcccacauggcaagugaggcguggagguugaaagccagagcuccugaccaagcaaaggcuugauuuguuccuuguguguuccuucaucagagacugacagaggcaggggcaccaccgugagugugccugccgugacaggacacuguuggguauuccucggguugagccucugagaccagccuggauggagaccagccuagcuguguauggcuggauucccagcuucaugaggcuugccugggugggcacagacucacagugacccagauucagacacccagcauggaucagaguccguuguuccaguucucagaaccagaggcagggaauggggcuagaacugaagaugggaggcaggggggcagaucugcguucggaucuguuuggaucucaagaaaaaucacuccacauccccacaccucccguuugucagagguaucugggaugaaaauguucaugaaauggcuuuucuaaaccauugcucauggacaggcaaggcaguugauugucuccucccacuuaggauggcauugcuuugccaagcugccccuagcgcuucuuggcucugagggacgaggagugccaggugcuguaucaggccaaag

SEQ ID NO: 10270 - RNA, 2501 nt, Mus musculus
cuuuggccugauacagcaccuggcacuccucgucccucagagccaagaagcgcuaggggcagcuuggcaaagcaaugccauccuaagugggaggagacaaucaacugccuugccuguccaugagcaaugguuuagaaaagccauuucaugaacauuuucaucccagauaccucugacaaacgggagguguggggauguggagugauuuuucuugagauccaaacagauccgaacgcagaucugccccccugccucccaucuucaguucuagccccauucccugccucugguucugagaacuggaacaacggacucugauccaugcugggugucugaaucugggucacugugagucugugcccacccaggcaagccucaugaagcugggaauccagccauacacagcuaggcuggucuccauccaggcuggucucagaggcucaacccgaggaauacccaacaguguccugucacggcaggcacacucacgguggugccccugccucugucagucucugaugaaggaacacacaaggaacaaaucaagccuuugcuuggucaggagcucuggcuuucaaccuccacgccucacuugccaugugggccuccugugccauggggaccguggcaagcuccuuuguacacaugccaagugugaguguguaccccagcuaggucccagccccagcccccaaaggcagaaaaguaggguguggcgugggugaaugcaagcauucucuucuuucauccccgauuguggcagucauugugccugccucagggacagucucccuggccaccuggcccuccccagucugggauggcacuguauuaagaccccagcacagcccaaauacugcaaacccucagauggucacaaccuugcccaauuaccagugugugaucauuugggcgacucacuuggguuuccccauccuuacccugaagauccaggagcagggccaggacuacgaauccuuccuacgacuucccugagccucaaagcaaggaauucaggggcuccugcagcgcugucucccuuuccacauaucuagccccucuuaugucagcgagguggcacacggagccgucccaccuucuaguuuuugcccaugcuguacccacaguucagcaugccuucucuugucucugauucucgaccugccaaaguguucucccacaccccaaacugacucaggagcuguacugcccaaggaagaggugcccugcuugcccaauacacucccugucuugugugucuaucccucagucagagagcacagccuaaaacagcaagcagagcacagacgagcuggggaacacacacacaguggucaccuccccucucugccucaauguccccuuaagcggucaugacuucccuggcugauuccuagaggccuuaccaggacuguggaaucccauuacucucuucuggccaaacauauucucaagucucaguuuccccauaagacuuuaggaugggacaaaugucccagcaaaugcccccagacucucaaaagaccaccuguagaaggaaggccacauugagccucacaccucccaaagggcuggagaagggcaggacccaggagugcuggcuugggggcagacggaaucacagacuagcuggcuuauacaacguccaguuugccacaauagucagguuucuggguuacugaaccggaaccugggaggagccugguaguccgggcuucuacacaaagaucccuaggacgucuuuguggggaccggaccgccgaggcucccugaguucuagcgcgugaguugucuacuugcuugacccgcgcccgaaggcagccgacccuggcugagcgaggagcccagcagccccaugcccaccccagguuccgcgggcucugguuucaggccagaucgguucuguagccaccacugcccgguccccaggcuuccccaccgcccguuccuaccugcgaguucaggcuccacgcgccgcgcggggcuuuccugcgagaaggaccucgccccgcuuccuacgccgccuggugucccuuauuuacaugcgacgccccaccccgugcacggucauuuacaugccccgccccucacccagcucauuuucacccgcaguccuccggacuuugccugaucgcuggcuuauuugcaugccccaccccacgcguccgcagcuguccagagcuccagcuuuuaagucccacgacugcgggacucgaaucuuugcccuuucccuacagaccagcuuggcuuguguuugcggcuguugcucauuuucccaauguuuacucagcgucugugccagaaagcaaaacaacucaucaauuaagagcgagugucuccugcuagguucaggcaggaaccuugcugcuacuaccaagagggagucaugcgcaacuaucccuuuucagaugaagaagcugaggcauggaucuguuaggaaacuugcuuaaggguugaugagauggcccgcaagccugagagugcaagaucuaucccuagaa

SEQ ID NO: 10271 - RNA, 2501 nt, Mus musculus
uuggcuugaagggccucucugaggauuuggucuuuccaggagguaaguucaggacgcaagaaaaucaaagguuaggguugaagccuccuguuagcacacagccuguaaucccagugagguaggagagucaggaguucaaggccaacccaagcuucccaucuggcuaaugcccauuaagauauuuaaaaaacaagacagaaggcuaguggcgagaggcaggaggcaguucgugguaacugaagguucgagggacagaacuggagaugacagaggguggugggagaugugggucugauaaagagaccuagguucuaagggcugaguugaaucacaagauggaaggagggaugggaaagccagucuucuuccgaaugugguuccccagagcggcaggagcaggucucuccucuuucgccggcgggucccuaggucacugcggaucucuaagccacacccacggacacccagggguaggacagcugcccuuuccuuuccccucuggugcuuucuaggaugggggugugaguggaaaccagcgucgcuauggcaaccaggccggguggucgggcccuggagcccugggagccagcgaaggcgagaggcggggcagcgggaggcgccagggcugcgcggcggggcgggggccugggucucccgggaggagcuggggaacaccgggcgccucucgcggaggugcacgccaaguucucgggugagugugcacgcgugugagcuggcccaaggcucacgggcgggcgugagcacgagcacacgugucgagugugcacucgcgugcguucuggggcccgugucuggcccucugcgccccgcgccccucccggccgcccgcagcagcucccgccacucccgccccgcgccgcuucucgcucgguccucgcccgccgcgccgcagucgccgccgccgcccagccugcgcccacgggccgcccgugccgggcaccuguuggaggcucagggacaggugcgggggcuggacuggccaggggagcgcgggugagggugagaggcggagaaaacgaggcagggggucccuaccuugggagaacggaugacccggguuagggauaggcaggcaggcaggcaggcaggcagaagcuugggcugagugaagagaagccuagaggggugggugacacccuggccagccccgcgccuggugcagaagauggccagagcuucagagcaagcagcaaaggagggaagcuguggggucccuggaggacuugaggggauggggacagagggagagcccaggaugagaggaaaacccuggaaaggugacagagggacaaugugcagguagugagcaggguuaagggggagucacgaccugucugcuuuaggacugaucuggcaacccacccagcccuuugugaagccaggccuccugccugcccaccagccagcgcagaucaucuuuucccucgacacccaggaagggagggcagugagguuccuacagaccccagccggccacuccagcucuacacccgucucccagucagaggugcugcaugaggggccgcaggggcgaucgcaugaccaucaacauccaggagcacauggccaucaacgugugcccuggacccaucaggcccauccgccagaucuccgacuacuucccucgcagggggccaggaccagaggguggcggcggcggcgguggcacgggcugcggggaagccccagcucaucuggccccucuggcucuggcccccccugcggcucuccuuggggccacuacacccgacgauggagcugagguagacagcuacgacucggaugauaccagugagucugggggcucagugagcuugugggagagagcagccuccugaaugugugcguggaggauggggaggagggagggcagucccgccaccacagcugcagucugggugcagauuacagcuucagcaaggcucaauauucaauauuucugcugagacacuccaccacccacacagacaguugcggccgagccagggaccuagacgcaggcaugcacauggcugcucagccuccugcacauacacuggcaggccagcagagauguggacacauccuuuuagccaccaggucucacaccuugaccuggaccaaagacucauacuaccuucucucucucuccuugcccuuuuucugcagccgcccugggcacacuggaauuugaccuucucuaugaucaggcuuccugcaugcugcacuguagaauccucagggccaagguguguaucccuccuuccuaggcugucacccuuggggagagguuccaucuuccccccaaucagagguacuccuuccugcuccuucugcaucucuggaacuguacucuguggggaaucuaguccugcaggaggcgggagaaaggcuugggggucuaaaguccccuuugcauccuguccuccagggccucaagcccauggauuucaauggccuggcugaccccuauguaaagcuucaccuccugccaggagccu

SEQ ID NO: 10272 - RNA, 2501 nt, Mus musculus
aggcuccuggcaggaggugaagcuuuacauaggggucagccaggccauugaaauccaugggcuugaggcccuggaggacaggaugcaaaggggacuuuagacccccaagccuuucucccgccuccugcaggacuagauuccccacagaguacaguuccagagaugcagaaggagcaggaaggaguaccucugauuggggggaagauggaaccucuccccaagggugacagccuaggaaggagggauacacaccuuggcccugaggauucuacagugcagcaugcaggaagccugaucauagagaaggucaaauuccagugugcccagggcggcugcagaaaaagggcaaggagagagagagaagguaguaugagucuuugguccaggucaaggugugagaccugguggcuaaaaggauguguccacaucucugcuggccugccaguguaugugcaggaggcugagcagccaugugcaugccugcgucuaggucccuggcucggccgcaacugucugugugggugguggagugucucagcagaaauauugaauauugagccuugcugaagcuguaaucugcacccagacugcagcugugguggcgggacugcccucccuccuccccauccuccacgcacacauucaggaggcugcucucucccacaagcucacugagcccccagacucacugguaucauccgagucguagcugucuaccucagcuccaucgucggguguaguggccccaaggagagccgcagggggggccagagccagaggggccagaugagcuggggcuuccccgcagcccgugccaccgccgccgccgccacccucugguccuggcccccugcgagggaaguagucggagaucuggcggaugggccugauggguccagggcacacguugauggccaugugcuccuggauguugauggucaugcgaucgccccugcggccccucaugcagcaccucugacugggagacggguguagagcuggaguggccggcuggggucuguaggaaccucacugcccucccuuccugggugucgagggaaaagaugaucugcgcuggcuggugggcaggcaggaggccuggcuucacaaagggcuggguggguugccagaucaguccuaaagcagacaggucgugacucccccuuaacccugcucacuaccugcacauugucccucugucaccuuuccaggguuuuccucucauccugggcucucccucuguccccauccccucaaguccuccagggaccccacagcuucccuccuuugcugcuugcucugaagcucuggccaucuucugcaccaggcgcggggcuggccagggugucacccaccccucuaggcuucucuucacucagcccaagcuucugccugccugccugccugccugccuaucccuaacccgggucauccguucucccaagguagggacccccugccucguuuucuccgccucucacccucacccgcgcuccccuggccaguccagcccccgcaccugucccugagccuccaacaggugcccggcacgggcggcccgugggcgcaggcugggcggcggcggcgacugcggcgcggcgggcgaggaccgagcgagaagcggcgcggggcgggaguggcgggagcugcugcgggcggccgggaggggcgcggggcgcagagggccagacacgggccccagaacgcacgcgagugcacacucgacacgugugcucgugcucacgcccgcccgugagccuugggccagcucacacgcgugcacacucacccgagaacuuggcgugcaccuccgcgagaggcgcccgguguuccccagcuccucccgggagacccaggcccccgccccgccgcgcagcccuggcgccucccgcugccccgccucucgccuucgcuggcucccagggcuccagggcccgaccacccggccugguugccauagcgacgcugguuuccacucacacccccauccuagaaagcaccagaggggaaaggaaagggcagcuguccuaccccuggguguccguggguguggcuuagagauccgcagugaccuagggacccgccggcgaaagaggagagaccugcuccugccgcucuggggaaccacauucggaagaagacuggcuuucccaucccuccuuccaucuugugauucaacucagcccuuagaaccuaggucucuuuaucagacccacaucucccaccacccucugucaucuccaguucugucccucgaaccuucaguuaccacgaacugccuccugccucucgccacuagccuucugucuuguuuuuuaaauaucuuaaugggcauuagccagaugggaagcuuggguuggccuugaacuccugacucuccuaccucacugggauuacaggcugugugcuaacaggaggcuucaacccuaaccuuugauuuucuugcguccugaacuuaccuccuggaaagaccaaauccucagagaggcccuucaagccaa

SEQ ID NO: 10273 - RNA, 2501 nt, Mus musculus
cagcaaccacacgguggcucacaauuaucuguagugagauccgacgcccucuucuggugugucugaaaacagaaaaugccagguuggugcuauugaacaccccacuaacauugcuacuuaucagcgaagaagccuaaauaaaguaggcuaccuacugcucacaccuuugaucccagaacucaggagguagugggaggcagaucuuagugaguuugaggccaacuggccuguauuuagauuccaggccaguacuacauagugagauguagauuaucucacuauacucccuagacuaaauaaaagagaaauaagacccaggcuugccucagacuugugauccucgccucagucucccaggugcugagauuacaggcaugcaagaccaugcccugcuccaagcagucucuuuuuacaauuuaaaauucauuuucuggguauuuccucuucagggcaaguaacacugaccacuuacauuucagugagaauuucuuuuaaguuaaaaggggggaggguggcuggugguuggagacaaagagucagcgugggacacuguguaagccaccacugacuggauagaugcauaaaaacagaacucagaucugguuggggaagauucugagaaaagaaccaaagugcagaaagagguaguaaaguaggaaagauggaagguuuguagacaggcuauacucacccagauggcaucuaacccgagcauugguggguccacagcggcccucaagccgggccccaggcaguagaacggaaaagccagcauugccgaagguauuggcacucaugaagcuccguagcccccucagugcccgauaggcuccugggcaccgccggcaguugcuggguuggcaucggccugcuugguacagcaggagcugguagcacccaggggccagggguggggaccagccccgaggcagaggaguaguuccugagaagucccagcucacagccccgaagucccgcaaaauggcgggaaagcugcucuguaggagcuccacgucaugccucugggcaucacgugguacaaagggggacgaaggcaggucugguagaaaaaguaagccagggcgcugaaugcccaugaccccugccccuccugugaggccagagccucccugagcugcccgccucacccuacccaucccagcccaggaguaacgccuggcauaggcccgaagccgccugcucacuagaccuucugcccuggguccuucuccagaauccccaaggccccuugggccagucugagaacauacaucaggcauaccacuaacacccccagcucggcucccgguccccagggccugcaugucuugggaacccagucgguagcaauaccaaaggaacagagaagugagggcuccgaggagcauaguaagggcugaggagccuagaggcaguggccauggaaacaugauaggcaaagaggcccuggcuaaguggcaagcugcaucuugcagaccccagcucccugguacccccaguucuccaccugaccccucgaugacugcuuccugauucccucccuuccacauccccacuccuguucacuccuccuacaggccccccaacaaaccuuccccucacuucccucuuucuuucuccccuuccuuuucuauuugucuccacucggagaucacucuuguucucucuuccuucugugguuccucucuccuuuccccuucccgcagucuccucuuccuuuccucucuccacccucagucucccagucucagcugguuucuccucccuccacuccagccccccuuuccuuaucgaccccuucuuuuucuucuagcuuccccugacaacagcgguuccuacuccaccuggcccgcagccccacucuauagcggcucuuucucuuuccucucuccuugaccugucuucucccucgaaagggucgggucuguccucuccgauucccgaccuccuacacaccccuucuugggcgcccacucacccugacgucacuccuucccgcaacccucucuguuuagcuacccaggaccccucccagaggcagccgcagcccagcccugcaagggggguggggggagacuucucucuggauuugccgcuccagacccccucccccagcccugaccgagcgccacgugggguacagggacacagugccaaccucuagccgccccgcaaugcgaaaagaagggcagggcagacucgggggcggggcgagagcccugacccgcucgugaggccggugcucuggaacugcgaguccggccgugggccugcgggucccuggagaggucggccugugacuccccuuuccccuggcuuggcuacgccagagccagcacagagcaagacgcggguucgcgaaagcggcuucagccaaucaguggcuucaaggccgcccgugcaggcggggccgggagcuguccucgcgcccaggugcugaaagggcacucgcuugcucaguggcagagccaguagaucacgggugguagccgcuaggcugc

SEQ ID NO: 10274 - RNA, 2501 nt, Mus musculus
gcagccuagcggcuaccacccgugaucuacuggcucugccacugagcaagcgagugcccuuucagcaccugggcgcgaggacagcucccggccccgccugcacgggcggccuugaagccacugauuggcugaagccgcuuucgcgaacccgcgucuugcucugugcuggcucuggcguagccaagccaggggaaaggggagucacaggccgaccucuccagggacccgcaggcccacggccggacucgcaguuccagagcaccggccucacgagcgggucagggcucucgccccgcccccgagucugcccugcccuucuuuucgcauugcggggcggcuagagguuggcacugugucccuguaccccacguggcgcucggucagggcugggggagggggucuggagcggcaaauccagagagaagucuccccccaccccccuugcagggcugggcugcggcugccucugggagggguccuggguagcuaaacagagaggguugcgggaaggagugacgucagggugagugggcgcccaagaagggguguguaggaggucgggaaucggagaggacagacccgacccuuucgagggagaagacaggucaaggagagaggaaagagaaagagccgcuauagaguggggcugcgggccagguggaguaggaaccgcuguugucaggggaagcuagaagaaaaagaaggggucgauaaggaaaggggggcuggaguggagggaggagaaaccagcugagacugggagacugaggguggagagaggaaaggaagaggagacugcgggaaggggaaaggagagaggaaccacagaaggaagagagaacaagagugaucuccgaguggagacaaauagaaaaggaaggggagaaagaaagagggaagugaggggaagguuuguuggggggccuguaggaggagugaacaggaguggggauguggaagggagggaaucaggaagcagucaucgaggggucagguggagaacuggggguaccagggagcuggggucugcaagaugcagcuugccacuuagccagggccucuuugccuaucauguuuccauggccacugccucuaggcuccucagcccuuacuaugcuccucggagcccucacuucucuguuccuuugguauugcuaccgacuggguucccaagacaugcaggcccuggggaccgggagccgagcuggggguguuagugguaugccugauguauguucucagacuggcccaaggggccuuggggauucuggagaaggacccagggcagaaggucuagugagcaggcggcuucgggccuaugccaggcguuacuccugggcugggauggguagggugaggcgggcagcucagggaggcucuggccucacaggaggggcaggggucaugggcauucagcgcccuggcuuacuuuuucuaccagaccugccuucgucccccuuuguaccacgugaugcccagaggcaugacguggagcuccuacagagcagcuuucccgccauuuugcgggacuucggggcugugagcugggacuucucaggaacuacuccucugccucggggcugguccccaccccuggccccugggugcuaccagcuccugcuguaccaagcaggccgaugccaacccagcaacugccggcggugcccaggagccuaucgggcacugagggggcuacggagcuucaugagugccaauaccuucggcaaugcuggcuuuuccguucuacugccuggggcccggcuugagggccgcuguggacccaccaaugcucggguuagaugccaucugggugaguauagccugucuacaaaccuuccaucuuuccuacuuuacuaccucuuucugcacuuugguucuuuucucagaaucuuccccaaccagaucugaguucuguuuuuaugcaucuauccagucagugguggcuuacacagugucccacgcugacucuuugucuccaaccaccagccacccuccccccuuuuaacuuaaaagaaauucucacugaaauguaaguggucaguguuacuugcccugaagaggaaauacccagaaaaugaauuuuaaauuguaaaaagagacugcuuggagcagggcauggucuugcaugccuguaaucucagcaccugggagacugaggcgaggaucacaagucugaggcaagccugggucuuauuucucuuuuauuuagucuagggaguauagugagauaaucuacaucucacuauguaguacuggccuggaaucuaaauacaggccaguuggccucaaacucacuaagaucugccucccacuaccuccugaguucugggaucaaaggugugagcaguagguagccuacuuuauuuaggcuucuucgcugauaaguagcaauguuagugggguguucaauagcaccaaccuggcauuuucuguuuucagacacaccagaagagggcgucggaucucacuacagauaauugugagccaccgugugguugcug

SEQ ID NO: 10275 - RNA, 2501 nt, Mus musculus
agaaggccuuuccacagucaucacacuuauaaggucgcuccccacuaugcacgcgauggugcuguagcagcguggaggagcgacagaagcccuugccacacacagcgcagcgguacggccucucgccugugugggaacgcuggugcugaaugaguguagaggagcgguugaaggucuugccacaaucggggcagcuguacgugcggccuggcaggugggugcgggcauggauggccagaacugagcucuggccgaagcgcuugccgcacucugggcacuugaagggcuuuucacgggcguggcugcgggcgugggggauaagugcugaccguugggagaagcuuuugccacagaugccacagcugaaaggccguugcccagugugcacccuuuggugacugcgcagggacgaguucuggcuauagcacuugccacacucggggcagcuguagggccucucguggcugugggugcgcuggugucgcaggagguaggagcugucgccaaaggccuucccacaguguggacauuuguagggcuucuggccagaguggguacgcugguggcggaguagguaagagcuaucagcgaaggccuugccgcaccugggacacuuguagggccgcucgccuguaugcgugcgcugguguuugaugaggucagagcucugggaaaaggccuugcugcaaaccucacauuuguaaggcuucucgccgguauggaugcgcuggugcuggaucagggucgagccucguccaaagcucuucccgcagaugccacagauguuaggucgagggccuugcccaccccuggcccggccaccccuacggccuggcccacgcaggguuccugucagauucaguggauucuggagcaucucaaacuggggugcagccagcagagcccccgaaggcaugucaaauggaggcagcgcuccugugggcugcuccccaaacccuugaguaaaggaauccaggggguggacuccuagggagaugcucaagggauucuuuuccucggggcucagaggcaucucugcaccuuccuggaauuuggaacuuugaguuucaaacucagggcuauggguuuugaacucagaauucugaacgccaucuccagaguucugcgguucauacccggggcucugagauucauacccuggacuuugagauucaaauucggggcucuuugaaccguacccagggcuuuuggguucauaccuaggacucccagguucacagccagggcuccugggauggcagccagggcuucggggcucauacuuaggacucugggauucaaacuccgggcucugaggaucugauucaggacuucugggugcaaacucagggcuugggggcacaaacccagggcuucgggauucaaacccugggcuuucaggcucaaaccuggggcucugggauucaaauucugggcuuuguggcucaaacucugggcuuugggguucaagcccaaaagguauuucuucaacuucauaguccccauugccuucucgcugagaaauuuccccuucuucauucucacuuguguugccugcaggaucugagaauuacagaaaauccagauugaaugggggucuggaaggucauuggguccauuaauugucccaaaauucucuucccacuccccaagcagggucauuggccccuacaagugaggugacaaaauguaccaccuccccucuaaagacccggggcacucagucuccacccuccaccccacuuccaaguguuuaagauuccggccuuauuucccucccgcaggccacagcccaguuuucuggcacacuccuaagaggcgcgguccuucccucaccuuugagagacccuucggggcugcccacugcguugggacugugcacaucccgggacuccaggccccacgacgacgccucccgcuccaucccugccaguucccagugcggcggcgguggcgauggcggacgauccuacgacccaguucgagugccuggagccccgagcccucgccacccgcgcguucagagccuccgaggagaccgggcggccuggcuucggccgcgaaggccggacgucuugacccugggccucuccggccccgccccuguccgcugccccgccccccucccaagguccccgauugucucguggcccucaccggcccccgcgcgucguggccucggaggugaggggcgaggcgacuccuccggccgucccccagccacaacucccagcccgagacccucuagucucggccccuagccccggccgggcuacugcgccccugcccccuccccccgcacaggaaguguccgucccuggccaguuccccccgcuggcucgcgccgcggccucucuaggagcggcuggagguggaaacucguuggcauuaacccuggacuggaucucccgggccucggggggugggggcgacccgacgccccggagccggcgggaagggcaacagcaguuugugugucuguaucgcgggucucggccuaa

SEQ ID NO: 10276 - RNA, 2501 nt, Mus musculus
uuaggccgagacccgcgauacagacacacaaacugcuguugcccuucccgccggcuccggggcgucgggucgcccccaccccccgaggcccgggagauccaguccaggguuaaugccaacgaguuuccaccuccagccgcuccuagagaggccgcggcgcgagccagcggggggaacuggccagggacggacacuuccugugcggggggagggggcaggggcgcaguagcccggccggggcuaggggccgagacuagagggucucgggcugggaguuguggcugggggacggccggaggagucgccucgccccucaccuccgaggccacgacgcgcgggggccggugagggccacgagacaaucggggaccuugggaggggggcggggcagcggacaggggcggggccggagaggcccagggucaagacguccggccuucgcggccgaagccaggccgcccggucuccucggaggcucugaacgcgcggguggcgagggcucggggcuccaggcacucgaacugggucguaggaucguccgccaucgccaccgccgccgcacugggaacuggcagggauggagcgggaggcgucgucguggggccuggagucccgggaugugcacagucccaacgcagugggcagccccgaagggucucucaaaggugagggaaggaccgcgccucuuaggagugugccagaaaacugggcuguggccugcgggagggaaauaaggccggaaucuuaaacacuuggaagugggguggaggguggagacugagugccccgggucuuuagaggggaggugguacauuuugucaccucacuuguaggggccaaugacccugcuuggggagugggaagagaauuuugggacaauuaauggacccaaugaccuuccagacccccauucaaucuggauuuucuguaauucucagauccugcaggcaacacaagugagaaugaagaaggggaaauuucucagcgagaaggcaauggggacuaugaaguugaagaaauaccuuuugggcuugaaccccaaagcccagaguuugagccacaaagcccagaauuugaaucccagagccccagguuugagccugaaagcccaggguuugaaucccgaagcccuggguuugugcccccaagcccugaguuugcacccagaaguccugaaucagauccucagagcccggaguuugaaucccagaguccuaaguaugagccccgaagcccuggcugccaucccaggagcccuggcugugaaccugggaguccuagguaugaacccaaaagcccuggguacgguucaaagagccccgaauuugaaucucaaaguccaggguaugaaucucagagccccggguaugaaccgcagaacucuggagauggcguucagaauucugaguucaaaacccauagcccugaguuugaaacucaaaguuccaaauuccaggaaggugcagagaugccucugagccccgaggaaaagaaucccuugagcaucucccuaggaguccacccccuggauuccuuuacucaaggguuuggggagcagcccacaggagcgcugccuccauuugacaugccuucgggggcucugcuggcugcaccccaguuugagaugcuccagaauccacugaaucugacaggaacccugcgugggccaggccguagggguggccgggccaggggugggcaaggcccucgaccuaacaucuguggcaucugcgggaagagcuuuggacgaggcucgacccugauccagcaccagcgcauccauaccggcgagaagccuuacaaaugugagguuugcagcaaggccuuuucccagagcucugaccucaucaaacaccagcgcacgcauacaggcgagcggcccuacaagugucccaggugcggcaaggccuucgcugauagcucuuaccuacuccgccaccagcguacccacucuggccagaagcccuacaaauguccacacugugggaaggccuuuggcgacagcuccuaccuccugcgacaccagcgcacccacagccacgagaggcccuacagcugccccgaguguggcaagugcuauagccagaacucgucccugcgcagucaccaaagggugcacacugggcaacggccuuucagcuguggcaucuguggcaaaagcuucucccaacggucagcacuuaucccccacgcccgcagccacgcccgugaaaagcccuucaagugcccagagugcggcaagcgcuucggccagagcucaguucuggccauccaugcccgcacccaccugccaggccgcacguacagcugccccgauuguggcaagaccuucaaccgcuccucuacacucauucagcaccagcguucccacacaggcgagaggccguaccgcugcgcuguguguggcaagggcuucugucgcuccuccacgcugcuacagcaccaucgcgugcauaguggggagcgaccuuauaagugugaugacuguggaaaggccuucu

SEQ ID NO: 10277 - RNA, 2501 nt, Mus musculus
uacacugucauucgccaaugcuuuuugcuucucucacuugaaacuaggucugggcacuggguuucugccaguccugcugacgcugccuucccacggcggcgucaaguucacagccacagucccccaagcugggcaccgguccauugcagcuguggccggggucgaugugaccgcccuccgcacuggacgaccugggaacuuuccaggcgauugcgcagugcuaggcagguuucccucuguuaagugccacuuuggucuuaaggucuucaaucucugaggaaaaagaauccuagaaugagaaacugagccagccggaggguggagucgcggcccgccccgccucguccccgcaggcaguccccgaucggccccccucccgggagcggugcccgucccccuggcgcuucgucaccgccgcuaggccaaugggcuuaaccguacggccgcgcacacucgcacccgcuguccccaagaccccgacacaccgucccgagcgcgguuuuucggcugugguccagcccguggccgucggagucgucaugcagucccugcguaccacgcuccugucuuugcuacugcugcugcuagcggcuccuuccuuggcguugccgucggggaccggccgcucggccccagcugccaccgucugucccgagcacugcgaucccacccgcugcgccccgccgcccacggacugcgaggguggccgcguccgcgacgcgugcggcugcugcgaggugugcggcgcgcucgagggugcagcgugcggccugcaggagggucccugcggcgaggggcugcaaugcguagugcccuucggggugccggccucggccacaguacgacggcgcgcacaggccggccugugcgugugugccagcagcgagccggugugugguagcgacgccaagaccuacaccaaccugugccagcugcgcgccgccagccgccgcuccgagaagcuucgccagccgccggucaucguccugcagcgcggcgccugcggccaagguacccgccccgcccugcgcugcacuccuggguggcuccccacucucgccaacucagcccgaccagucaggaccgucgggaggggaugcggaggugcagagaagcacugcgggguguucuaggcauccaguuagugggagagagagacgauggggcucgggguagcuguguuucaaaggcucccuccggcccuauuucugcgccaagcaucgggucguuucgagaaacgccaagcaggugcuuugcgcgcuuugguccagcacccccuggccggggugacuaggcaucgcgcuggggaaagccgcguaucauaccagggaucuuggcaauguugagauacauggcuuugggaucgcaagaacucuugucgccuucccuuccuucucccuuucugcugaguccucucuucuuggaacuaucuaagcaguguuuuucuuauagaaccucuucgugaaaacuuucacuuuggggagagggaacaucucugcucaacucagcaagcauuuuucucaccccgccuccuaagcagaaaacgauuuaguaacuccggcccucuuccuccauugauuuaaaucaacuuuacaaaaacgcccacgauuugguccuuuuuugguccuuugguccuuuugccugaguucaaccagguaguggaccgugaaauuugagguagaggaggggcccacuggggaugaagaaaaaaaugcacccucuacccucucucuccuugugggaccuuucuguacccacaagagcuggacguggugguggcgacaggguaaaggggcuuggagaacugcccagcucccugcaggaccuuccagagaaaagcuucgguuaaauccagagauacccuguggaaaaacaguaaauucauacuggccacuacagcgcuguggggaccagccagcugggcuccaguacauuuggcuucagcuacagggcuccugcccaaaccuagcaccucccuccccuccgcccccccaccccccaugugguggggaggacaggaaagcacgggagagggaaagagagauugagcuagauuuuucuuuauaggaauauggucgccuaugaccacuuugaauuuggcaaaacuuuacucgaaugcacaggaaaguacuccaggugguguaggaagaggugggcugguguuuauauucuuaccacaggagcacaggacuggaccucagucccaggaaacucagccuccauagagagaagaaaaggguuuuuguuuguuuguuuguuuguuuguuuguuuguuuucagagaggacugaucccggggucccuaccuacuaagucccagcccaugugacaagugaguuauccugugacucuauuuggucuccuagacccgggaggaggaagcuccuggccucgucuuugucuuagaugagguggaacuggggaugaauaacuuguccaaggucacucagcuggaaccugaaugcuggcaaacucagaacaggccagagcuagaccucaagg

SEQ ID NO: 10278 - RNA, 2501 nt, Mus musculus
ccuugaggucuagcucuggccuguucugaguuugccagcauucagguuccagcugagugaccuuggacaaguuauucauccccaguuccaccucaucuaagacaaagacgaggccaggagcuuccuccucccgggucuaggagaccaaauagagucacaggauaacucacuugucacaugggcugggacuuaguagguagggaccccgggaucaguccucucugaaaacaaacaaacaaacaaacaaacaaacaaacaaaaacccuuuucuucucucuauggaggcugaguuuccugggacugagguccaguccugugcuccugugguaagaauauaaacaccagcccaccucuuccuacaccaccuggaguacuuuccugugcauucgaguaaaguuuugccaaauucaaaguggucauaggcgaccauauuccuauaaagaaaaaucuagcucaaucucucuuucccucucccgugcuuuccuguccuccccaccacauggggggugggggggcggaggggagggaggugcuagguuugggcaggagcccuguagcugaagccaaauguacuggagcccagcuggcugguccccacagcgcuguaguggccaguaugaauuuacuguuuuuccacaggguaucucuggauuuaaccgaagcuuuucucuggaagguccugcagggagcugggcaguucuccaagccccuuuacccugucgccaccaccacguccagcucuuguggguacagaaaggucccacaaggagagagaggguagagggugcauuuuuuucuucauccccagugggccccuccucuaccucaaauuucacgguccacuaccugguugaacucaggcaaaaggaccaaaggaccaaaaaaggaccaaaucgugggcguuuuuguaaaguugauuuaaaucaauggaggaagagggccggaguuacuaaaucguuuucugcuuaggaggcggggugagaaaaaugcuugcugaguugagcagagauguucccucuccccaaagugaaaguuuucacgaagagguucuauaagaaaaacacugcuuagauaguuccaagaagagaggacucagcagaaagggagaaggaagggaaggcgacaagaguucuugcgaucccaaagccauguaucucaacauugccaagaucccugguaugauacgcggcuuuccccagcgcgaugccuagucaccccggccagggggugcuggaccaaagcgcgcaaagcaccugcuuggcguuucucgaaacgacccgaugcuuggcgcagaaauagggccggagggagccuuugaaacacagcuaccccgagccccaucgucucucucucccacuaacuggaugccuagaacaccccgcagugcuucucugcaccuccgcauccccucccgacgguccugacuggucgggcugaguuggcgagaguggggagccacccaggagugcagcgcagggcggggcggguaccuuggccgcaggcgccgcgcugcaggacgaugaccggcggcuggcgaagcuucucggagcggcggcuggcggcgcgcagcuggcacagguugguguaggucuuggcgucgcuaccacacaccggcucgcugcuggcacacacgcacaggccggccugugcgcgccgucguacuguggccgaggccggcaccccgaagggcacuacgcauugcagccccucgccgcagggacccuccugcaggccgcacgcugcacccucgagcgcgccgcacaccucgcagcagccgcacgcgucgcggacgcggccacccucgcaguccgugggcggcggggcgcagcgggugggaucgcagugcucgggacagacgguggcagcuggggccgagcggccgguccccgacggcaacgccaaggaaggagccgcuagcagcagcaguagcaaagacaggagcgugguacgcagggacugcaugacgacuccgacggccacgggcuggaccacagccgaaaaaccgcgcucgggacggugugucggggucuuggggacagcgggugcgagugugcgcggccguacgguuaagcccauuggccuagcggcggugacgaagcgccagggggacgggcaccgcucccgggaggggggccgaucggggacugccugcggggacgaggcggggcgggccgcgacuccacccuccggcuggcucaguuucucauucuaggauucuuuuuccucagagauugaagaccuuaagaccaaaguggcacuuaacagagggaaaccugccuagcacugcgcaaucgccuggaaaguucccaggucguccagugcggagggcggucacaucgaccccggccacagcugcaauggaccggugcccagcuugggggacuguggcugugaacuugacgccgccgugggaaggcagcgucagcaggacuggcagaaacccagugcccagaccuaguuucaagugagagaagcaaaaagcauuggcgaaugacagugua

SEQ ID NO: 10279 - RNA, 2501 nt, Mus musculus
ugggaugguuauuuuacugcucuggauguuuucugagcuaugacaucauugggaccugcucugggcaggugguuagcaccugacauuucucacacugcagucuaagugaaugcucucuucaucaacuauaagucccucugguuccaugggaggcucaaggucuuugggggcuuuaguggcagaaucagacgggcccacccaaggauggccucuucuuggcggucagcauuguucauguccucgugucagggugggcaagcagacaggcaugccugcuugggcaguucuggagagucaagggcagccugccucucugguaguagggcuguuaguuccugccagaguggaagacugggaaacugggaugggcaagagaguaaacuacauccacaaauugcaagaggccuugugggcccagaauggccagacucuucucugggcuggggaaucauaguuagcaaaaugaaguuacccccugggcaggaggccauuagggugggcccuaggggccuuaagacaggcuaggagcuagaccugggauggaguuuagccuggucuaaggccgaagcaguucuagggcaccaagggugccgcccagaagcagacaaauacgugggcugugcacggacccugagccggaaguccaggcccaguagcuguagacuccucggucgguuccguugccucccauugccccauucucaucguccuccaggccuagcucuccaggcccugagguccuccuccagccagagccgguagcaaggcccgcagccacacccgcugcagccccugcugcugccccugcagccgccacgcgcagagaggagccguagcggggcgccggccuuacgcguacucuugaugccccgcgugcaccuccgcgcaccccccgggcacugccucgagcgccuccgcggccgcccuuggcggaacagcugucacagaggaaggcggcggccagcagcagagcccagcacguggcagcaguccaguucauccuacugggcagaaucugcgagaagaggguggaaggggcuucagcuucugugcagggguggagcgugguuuaggaccagggcaagaggguaucagggcuugggaauaggcucaucuggaccuggggacaccuacuucagccucugguuuugugguaauccgauagagggcucccagcaucuuggaggacagugggcucaggguuggggaagggguucuuuaaacuccagcaucaggacuuugguuuuggguuccugcuguauaaccagguggagauggggugguggggaaaggguuucacuacagggcggccguuuuacuauugugguaggguggagaugggucccagaaugggguuuguggagcuccuacaguggggcucaggccugggggggggggggcacaaaucccccgcucugcacacgagucucuggaaggggauggauuaguggauuaggauucuaguuuggaauggagagccuucaauacccccagauuaugguuagaauggacagccuugugacuuuugcucuggcaucuggaucuccugaugccuuaagagauagucuuucagccaguggcugcggcugaaugcacugggugagggugggggucagaauccagaucagcgauuccuugcaacgcaaacaacuagcgaugggugaaccgcccagcaggcccagacccuagguaauuacgucucuuccccgcuccagcuccacccuuuuuggguuugcccaggccaguagccuggacagguaaaccgaucaggauggguucuggcuggcuguggaccagccaucucgguggcggcagcuccauccuccucagguccucucuccccucccccucccucccagcaucacuggguucauccaccuccccuacuuacuggucacaagccuaggucggaugagcgauuuaggggccgugaccggccaagcggaaaggugcggcagcgaggacccuuuuccuuaggcagagcucacgacuggauuuugcugaagccuccgccugaagauuaggggcgggcagccgcggaggcucagccccgggagacgugaagggaggagauacugaaagcucagaaaagcacagccacagcccuucucguugcccggcccccauccucgcugcacugcacacagcacccucucaucccauccccccaucuucccauccccgccacagcccugcccaaucucucuuuccccuauggccacuagccccagcccccaggauagacaguguguuuuuguuccaguagguccagcguuuuuguucauggccucuuccucuccauucucccuaccugcccaccgcaucgauucuuacgguucuuaugaauuaucuaccuccucucccauucuucugauggaaccucagcuccacuuacuccucuucgccagccauaaggaccacugggcugacuuucuaggcgcguaguguagggcuuccaacauccugccagauggcucuccuggaaguuugauguacagcca

SEQ ID NO: 10280 - RNA, 2501 nt, Mus musculus
uggcuguacaucaaacuuccaggagagccaucuggcaggauguuggaagcccuacacuacgcgccuagaaagucagcccagugguccuuauggcuggcgaagaggaguaaguggagcugagguuccaucagaagaaugggagaggagguagauaauucauaagaaccguaagaaucgaugcggugggcagguagggagaauggagaggaagaggccaugaacaaaaacgcuggaccuacuggaacaaaaacacacugucuauccugggggcuggggcuaguggccauaggggaaagagagauugggcagggcuguggcggggaugggaagauggggggaugggaugagagggugcugugugcagugcagcgaggaugggggccgggcaacgagaagggcuguggcugugcuuuucugagcuuucaguaucuccucccuucacgucucccggggcugagccuccgcggcugcccgccccuaaucuucaggcggaggcuucagcaaaauccagucgugagcucugccuaaggaaaaggguccucgcugccgcaccuuuccgcuuggccggucacggccccuaaaucgcucauccgaccuaggcuugugaccaguaaguaggggagguggaugaacccagugaugcugggagggagggggaggggagagaggaccugaggaggauggagcugccgccaccgagauggcugguccacagccagccagaacccauccugaucgguuuaccuguccaggcuacuggccugggcaaacccaaaaaggguggagcuggagcggggaagagacguaauuaccuagggucugggccugcugggcgguucacccaucgcuaguuguuugcguugcaaggaaucgcugaucuggauucugacccccacccucacccagugcauucagccgcagccacuggcugaaagacuaucucuuaaggcaucaggagauccagaugccagagcaaaagucacaaggcuguccauucuaaccauaaucuggggguauugaaggcucuccauuccaaacuagaauccuaauccacuaauccauccccuuccagagacucgugugcagagcgggggauuugugcccccccccccccaggccugagccccacuguaggagcuccacaaaccccauucugggacccaucuccacccuaccacaauaguaaaacggccgcccuguagugaaacccuuuccccaccaccccaucuccaccugguuauacagcaggaacccaaaaccaaaguccugaugcuggaguuuaaagaaccccuuccccaacccugagcccacuguccuccaagaugcugggagcccucuaucggauuaccacaaaaccagaggcugaaguagguguccccagguccagaugagccuauucccaagcccugauacccucuugcccugguccuaaaccacgcuccaccccugcacagaagcugaagccccuuccacccucuucucgcagauucugcccaguaggaugaacuggacugcugccacgugcugggcucugcugcuggccgccgccuuccucugugacagcuguuccgccaagggcggccgcggaggcgcucgaggcagugcccggggggugcgcggaggugcacgcggggcaucaagaguacgcguaaggccggcgccccgcuacggcuccucucugcgcguggcggcugcaggggcagcagcaggggcugcagcggguguggcugcgggccuugcuaccggcucuggcuggaggaggaccucagggccuggagagcuaggccuggaggacgaugagaauggggcaaugggaggcaacggaaccgaccgaggagucuacagcuacugggccuggacuuccggcucaggguccgugcacagcccacguauuugucugcuucugggcggcacccuuggugcccuagaacugcuucggccuuagaccaggcuaaacuccaucccaggucuagcuccuagccugucuuaaggccccuagggcccacccuaauggccuccugcccaggggguaacuucauuuugcuaacuaugauuccccagcccagagaagagucuggccauucugggcccacaaggccucuugcaauuuguggauguaguuuacucucuugcccaucccaguuucccagucuuccacucuggcaggaacuaacagcccuacuaccagagaggcaggcugcccuugacucuccagaacugcccaagcaggcaugccugucugcuugcccacccugacacgaggacaugaacaaugcugaccgccaagaagaggccauccuugggugggcccgucugauucugccacuaaagcccccaaagaccuugagccucccauggaaccagagggacuuauaguugaugaagagagcauucacuuagacugcagugugagaaaugucaggugcuaaccaccugcccagagcaggucccaaugaugucauagcucagaaaacauccagagcaguaaaauaaccauccca

SEQ ID NO: 10281 - RNA, 2501 nt, Mus musculus
caggugcauaugcccuuuccuguacuguaaccauaccugcuucccgccagaaccuugggagagaucagaaguacugaggcaaaguagaguucaccaugguuuccugaaguauccugugcuguguuuguguguguuguaauagucuuggaggaaggggaacucugagugggggugagcuuaacuguccaguuggaggacuuagcuuaguccuccgagcucagcacccacuugcuccucccaaaggggugggcuuagcugucuauuuguagaacuuagcuuaguccuccgagcucagcacccacuugccccucccaaaaggagcacaguggcugcgguugcagccccuagccaacaauaacgguuguucugguuaugggaccugggacagcaggacugggcgagccggccaggcaggucccuggccuaggugccaggggccgccccuugucuccagguccugucccauacagcaagccuguugugguucugcuugagacgcacagggcccccagcgccucugcagccugugauagccaggccagcuuuucaggucaguuugggggcuugguugggggcauacucuuggaaauagauggguuuccucuuaaguaggacuuuggcagcaucuucagaaguuccucuaggcccagagaagcccccgauuaggacugugccccaugaggagugcugagggcagacugagguggucucgcccggucccauacucacuucccccacacaggagagcugcuaacuuauaugucauucucuaguauuaaaacuuagaagacucuaaauugggaaaguaaagaaaagaaagucuaguguccacagcccuggauacagccacugaaaguauuugguuuauuuccugcuccgcauuuuccuacacaacacuucuuggcacccuaagucuggauacuccgggcgggguggggguuggcaucugcaccuccccagccuugauuuuguucuaaaagggucuuggggggagcuggggagauggugggagugagggauacaacuuugcugcccccuguggcucuccggggagagcuagccacucugggucgggucaccaggauaagagaggcgggacaaaacuacagcagcgcucugguggaggauccacccggacgugcuaucccggggucuccgggccuguaaggccgcaaggucgcucuggguacgcgccccucgcgggcuaucgggguccaggcaggggcggggcgcgccgcgcgcguuuccgggaggagcggcccgccugcggcaggugcggcggcgcggcucgcagguaggcauuuauuugcucgcaggucccgcgacuggggucccagcgccgcgcccucugggcuuccccacccccaaccccgggccccuagcuccaguggucgcaccuuccgagcgcuguguagagcagccaucgcacgcaucucugucuggaacggcuguguuccucgggugaaggcagcuagcccagacgugcguggaugagauuugccugugggcccacccgcugccuuucgucuggacucccuggagccuggcggcagcgcggcuuccggccaggauggaccuccggucccgaggaacacuggagcgguuggugggguggugaccgugccugguugaagugaggguagccaucaggggugccaaugauuacuccagguugcccuaccaugcucuuccucacguuugcuuguuguuccuccucccaccccccgaauauggguagggggaagaugaccucaaagacugaaaagugagauaggaaucggucagugucaccgaguuguagcuuugggaaaugugggguuaauacacugugggacugacagguggcucuaauuagaggugggauguccauuccaggaggugagaggggaggccccaggggaggagaaagcugcagagacuguguuaaaccaagauguggggguguuucuuaaaagcuguccagugcccaagccugggaccuugcaccugcacccuuaaggccugccugaguggcaggugggagggacugauggaguuuacucgcagcuugcuugccagcugucagaaguccaggguaucacaggcucaggccugaggcuaaggacuuggucuuggucagaagugguuuagcucucaaccuuaggcaguccuagcuugggaucucccaaguccaggauguggcagacucuacucucuguucacuacagaaucucugcuggcugccaagagcuuuuacuguuggaguaaggucacacuuuuuuuuuuuuuuuuuuuuuggagacagggucucacuauauggcccugacuguccuggaacccacuuuguagaccugacuggccuuaaaacucacagagacccaccugccucugucuccugaguguugggacuaaaggcaugcaccacuaacgccuggucacacuuucuuuuuuuguuuugagguagaaucucucuauguagcuccggaugucuuggaacuugcuauguagaccggccuggcccc

SEQ ID NO: 10282 - RNA, 2501 nt, Mus musculus
ggggccaggccggucuacauagcaaguuccaagacauccggagcuacauagagagauucuaccucaaaacaaaaaaagaaagugugaccaggcguuaguggugcaugccuuuagucccaacacucaggagacagaggcaggugggucucugugaguuuuaaggccagucaggucuacaaaguggguuccaggacagucagggccauauagugagacccugucuccaaaaaaaaaaaaaaaaaaaaagugugaccuuacuccaacaguaaaagcucuuggcagccagcagagauucuguagugaacagagaguagagucugccacauccuggacuugggagaucccaagcuaggacugccuaagguugagagcuaaaccacuucugaccaagaccaaguccuuagccucaggccugagccugugauacccuggacuucugacagcuggcaagcaagcugcgaguaaacuccaucagucccucccaccugccacucaggcaggccuuaagggugcaggugcaaggucccaggcuugggcacuggacagcuuuuaagaaacacccccacaucuugguuuaacacagucucugcagcuuucuccuccccuggggccuccccucucaccuccuggaauggacaucccaccucuaauuagagccaccugucagucccacaguguauuaaccccacauuucccaaagcuacaacucggugacacugaccgauuccuaucucacuuuucagucuuugaggucaucuucccccuacccauauucggggggugggaggaggaacaacaagcaaacgugaggaagagcaugguagggcaaccuggaguaaucauuggcaccccugauggcuacccucacuucaaccaggcacggucaccaccccaccaaccgcuccaguguuccucgggaccggagguccauccuggccggaagccgcgcugccgccaggcuccagggaguccagacgaaaggcagcgggugggcccacaggcaaaucucauccacgcacgucugggcuagcugccuucacccgaggaacacagccguuccagacagagaugcgugcgauggcugcucuacacagcgcucggaaggugcgaccacuggagcuaggggcccgggguuggggguggggaagcccagagggcgcggcgcugggaccccagucgcgggaccugcgagcaaauaaaugccuaccugcgagccgcgccgccgcaccugccgcaggcgggccgcuccucccggaaacgcgcgcggcgcgccccgccccugccuggaccccgauagcccgcgaggggcgcguacccagagcgaccuugcggccuuacaggcccggagaccccgggauagcacguccggguggauccuccaccagagcgcugcuguaguuuugucccgccucucuuauccuggugacccgacccagaguggcuagcucuccccggagagccacagggggcagcaaaguuguaucccucacucccaccaucuccccagcuccccccaagacccuuuuagaacaaaaucaaggcuggggaggugcagaugccaacccccaccccgcccggaguauccagacuuagggugccaagaaguguuguguaggaaaaugcggagcaggaaauaaaccaaauacuuucaguggcuguauccagggcuguggacacuagacuuucuuuucuuuacuuucccaauuuagagucuucuaaguuuuaauacuagagaaugacauauaaguuagcagcucuccugugugggggaagugaguaugggaccgggcgagaccaccucagucugcccucagcacuccucauggggcacaguccuaaucgggggcuucucugggccuagaggaacuucugaagaugcugccaaaguccuacuuaagaggaaacccaucuauuuccaagaguaugcccccaaccaagcccccaaacugaccugaaaagcuggccuggcuaucacaggcugcagaggcgcugggggcccugugcgucucaagcagaaccacaacaggcuugcuguaugggacaggaccuggagacaaggggcggccccuggcaccuaggccagggaccugccuggccggcucgcccaguccugcugucccaggucccauaaccagaacaaccguuauuguuggcuaggggcugcaaccgcagccacugugcuccuuuugggaggggcaagugggugcugagcucggaggacuaagcuaaguucuacaaauagacagcuaagcccaccccuuugggaggagcaagugggugcugagcucggaggacuaagcuaaguccuccaacuggacaguuaagcucacccccacucagaguuccccuuccuccaagacuauuacaacacacacaaacacagcacaggauacuucaggaaaccauggugaacucuacuuugccucaguacuucugaucucucccaagguucuggcgggaagcagguaugguuacaguacaggaaagggcauaugcaccug

SEQ ID NO: 10283 - RNA, 2501 nt, Mus musculus
gucagugccuccgcuuuuuaugucugaguggcuccucccagucccggcuccacccuaccccccacccccucccugcugaccacuccccccgcccccuuugcacccgcccccucccuccuuccagccagucccuuuucuccugcacccccaagagcuagccuuggaccauuccuuagcaaagcaccaccagugggaggggggccucaucgugcgcccccagcccuuucugcacagaccaauggggggagggagggggcuccuucccacauccuccuauggaaaguuacacccaguaaaaggcaggggcaguuauuucucuuugaacuguaacauuucugcccuucugagcccgaaaccguccccucuccccccaacauuccagguugggaauguuggggacagaguugggguguguggguggggggaaaagcuaacuguggggucuggcuugacucuuuuaccaauuuuggggggcucuuggccccgcccacccacuuuuccuuccugucucauuggcacaaagucaacauaccagggugggcuucggagacucugccccccuccucaucacucagcacccuuggggggggguguacagggccugcacagcacgaaucguacauuuuaugcagcucauccaucccccccuuccccaacacacaguaaagcaccaggaagucuccugugaguucaacuuacacacccccuccccaacagcccccauacccccgccccuucccccacuccauggcgcaagggggaacaaaaguuugcuuagggaacgagcccccagccccccacccaccgcaccagucccgccaugcccaagccgggcucugcgcaccccccacucccagggccccugagagcccuuaccuggaagccggcgacgcugccgcccaucucccugcugcggguaugcaaaccgaacagcgggcgaaggcccuucugccgggcacuccucugccagcgccgcucugcccgagucgcagaggccgaaugugcgacgggacagaacggggagauggcuuuuuugguggggaggggggcgucucuucugcuucuuuaggguaucuuagggcuggggcgggccagauauuguacuuucgggggggaaaagguaucgggaaaugaggucagcuguuguaucaaggauaguuggggggcagagauagugagagagacagagugaacgugaaagggggggaccacagagagggagagagggagagaggacagcgagaggcggguaggcucacagcgggagaggacagcacggagagaaacagaaagcguauaauuaauccacuuggguaggcgaaggcagagggcggacgugagggggagggagucugaggcgaggaggaacggggagggggcaggaggggagcuuaggaaagguggcggguaagcgggugcgcgagggggggcgcacccuaagcagaggagaggaugcaacuucgaaggaccgaggacgguguugaggggggaggaauggaggcgucaccccggccacgggcacccagcucgguuagggucgacggagcccucagccgucguaagcccgggcuucuugugggggggacaggcguggcggcgccucagcugcucgggacugcagcgaaaagaggggagcagccgggcugcgcaccggggagggcugggaggggaagcgcgggggaugacaacgccggcgaccugcaagccggacugccugcgguggggaccgccuccucuggcgaagcaggaaugggguguugagguagauagaggaggaggcgguggggagauccgcaggcccgacggagcgcggccccgccgacggcgcccugcacaggaguuagcagcagcgagguggcggacggcgucgacgcggggccgccagcccggauggaggcgcuggcgggccgagcgcgggcgggcgugggccaggaggcgggggcggccggaagggggggccgggggccggccuggccucacgcagcuccgccggagagcaggcgaacuccgggcgccaacgcccgguucuuauagccgcgccaccccgcggcucggcgcccgcucgggccccgcuggccuuacgcccgcgccaaugggcguccgcagggcccucgccccgccccgggaccgcccccgcaacucgagccacgcggggaaugcgggucgggggcccugggcacggggguugccgguggggggggggaguggagugccugguggcaaagaugggggggggcugugcgccccaacaggcccacuaaauccugggugucuaucccuaaaaaucgaggucccaugucauguuuccggggugcccugugcuugugcaacaugggcgcguggugcgaaccaacgugcguggcacccuaggccucagugguaguggcaggaccugugcucaguuagaggguuacaagguaggcgcaucccggccgacugaguuaaggcgcagguagcuggguagaggguucucacagggaccuacuugcuaagcaggggac

SEQ ID NO: 10284 - RNA, 2501 nt, Mus musculus
guccccugcuuagcaaguaggucccugugagaacccucuacccagcuaccugcgccuuaacucagucggccgggaugcgccuaccuuguaacccucuaacugagcacagguccugccacuaccacugaggccuagggugccacgcacguugguucgcaccacgcgcccauguugcacaagcacagggcaccccggaaacaugacaugggaccucgauuuuuagggauagacacccaggauuuagugggccuguuggggcgcacagcccccccccaucuuugccaccaggcacuccacuccccccccccaccggcaacccccgugcccagggcccccgacccgcauuccccgcguggcucgaguugcgggggcggucccggggcggggcgagggcccugcggacgcccauuggcgcgggcguaaggccagcggggcccgagcgggcgccgagccgcgggguggcgcggcuauaagaaccgggcguuggcgcccggaguucgccugcucuccggcggagcugcgugaggccaggccggcccccggcccccccuuccggccgcccccgccuccuggcccacgcccgcccgcgcucggcccgccagcgccuccauccgggcuggcggccccgcgucgacgccguccgccaccucgcugcugcuaacuccugugcagggcgccgucggcggggccgcgcuccgucgggccugcggaucuccccaccgccuccuccucuaucuaccucaacaccccauuccugcuucgccagaggaggcgguccccaccgcaggcaguccggcuugcaggucgccggcguugucaucccccgcgcuuccccucccagcccuccccggugcgcagcccggcugcuccccucuuuucgcugcagucccgagcagcugaggcgccgccacgccugucccccccacaagaagcccgggcuuacgacggcugagggcuccgucgacccuaaccgagcugggugcccguggccggggugacgccuccauuccuccccccucaacaccguccucgguccuucgaaguugcauccucuccucugcuuagggugcgcccccccucgcgcacccgcuuacccgccaccuuuccuaagcuccccuccugcccccuccccguuccuccucgccucagacucccucccccucacguccgcccucugccuucgccuacccaaguggauuaauuauacgcuuucuguuucucuccgugcuguccucucccgcugugagccuacccgccucucgcuguccucucucccucucucccucucuguggucccccccuuucacguucacucugucucucucacuaucucugccccccaacuauccuugauacaacagcugaccucauuucccgauaccuuuucccccccgaaaguacaauaucuggcccgccccagcccuaagauacccuaaagaagcagaagagacgccccccuccccaccaaaaaagccaucuccccguucugucccgucgcacauucggccucugcgacucgggcagagcggcgcuggcagaggagugcccggcagaagggccuucgcccgcuguucgguuugcauacccgcagcagggagaugggcggcagcgucgccggcuuccagguaagggcucucaggggcccugggaguggggggugcgcagagcccggcuugggcauggcgggacuggugcgguggguggggggcugggggcucguucccuaagcaaacuuuuguucccccuugcgccauggagugggggaaggggcggggguaugggggcuguuggggaggggguguguaaguugaacucacaggagacuuccuggugcuuuacuguguguuggggaagggggggauggaugagcugcauaaaauguacgauucgugcugugcaggcccuguacacccccccccaagggugcugagugaugaggaggggggcagagucuccgaagcccacccugguauguugacuuugugccaaugagacaggaaggaaaagugggugggcggggccaagagccccccaaaauugguaaaagagucaagccagaccccacaguuagcuuuuccccccacccacacaccccaacucuguccccaacauucccaaccuggaauguuggggggagaggggacgguuucgggcucagaagggcagaaauguuacaguucaaagagaaauaacugccccugccuuuuacuggguguaacuuuccauaggaggaugugggaaggagcccccucccuccccccauuggucugugcagaaagggcugggggcgcacgaugaggccccccucccacugguggugcuuugcuaaggaaugguccaaggcuagcucuugggggugcaggagaaaagggacuggcuggaaggagggagggggcgggugcaaagggggcggggggaguggucagcagggagggggugggggguaggguggagccgggacugggaggagccacucagacauaaaaagcggaggcacugac

SEQ ID NO: 10285 - RNA, 2501 nt, Mus musculus
ucagucagcacuuggcauuuggucaggcugcacuagacagcauggguaaggcauaggcccagguuucuugggcuagaagcagguagguccaccaggagucacccagggaugcagcugugaagaagauaaaaggugucaauguguacggacaccgccccaccucccaaggcgcaguaggcaguuucguuugcuugauuaguuuuggagucucaacucaugggugccucgauccgcucagaggcgccgacgggggcggggcgcacgcucagaaccugcccgccgugacucaggggcccgcuccagccgacucacuccgcaccccggccuaggacgcgauuugcaaugcaaacucaccccgccuccagcacccgacucggccaggcucugacagcacugggaccucgccggcccggcccugaggccgcuccccuccccuggccuccccuucccccacccacagcagagcucugagaggaaguuuugcaaucccggacaaacaaacgccggucuugcucaggcuugaaaaagguugaggaaaaaugaagcgugcgcgaaauccaagugaucgccccagcugaguccuggcugcacaggguccccguggcgcuaagugucaggcccgcccaccacgugucucccuuacugcuucgccuccccgccguccuggaacuuaccuuaggggggugggaugcucaguagcccccuaaccaacuggaaaagucaagcagcuccugcuccaucgggcuuagcucucccucgcagcugcuuuccuccgacgaguaggcggagcgcggggagguaggcucagagcagcccaggcgguccggggacggagacguagaggcgcaggacagagacgcgcuggcaggggaggcagagggcugcgcgcacucaucggacggcggaguagcggguguuaacagccccccagcgagcgcggcacgcaccgcgucgugcucugcgagcagccgcugcagcgcacgaauguacucuaccgcggagcgcagcgucuccaccuuacucagcuucuuguuggcgccgccgugcggcacgugcugccgcagcgccuggaagcccaaguuuaccagcuuuacgcgguugcgcucgcgcucauugcggcgugccacggcagccgagcugcugcuggccucgguugcuccagaucgccgccgccggcugcagcgcagcaauuccggagacgcuugucuccgccgagcagcgcaggcuccagcgacuccagacgaggugggcaugagucugggcagcgcgccgccguccaucaagcuugcauucagccccugggccccugcuacgaguucuggugcggcacaggaaaagugcucgcgaggaaccgggugcggugggaaguggacguuugcaccuucacgggccucaggcagggcacugcugcaggacucccuagggcacgcgucgcuggccuccugcaguccugggaccccguaccagucaaggucugaaagaguagggaagcgugguacucucgugucccgcgcgugcugucaggcgcuccccaagucucccuuuacgcggcucaagcggcuccuuuuuuuuaaaaaguauagauaacucuccuccgcccgccaccgccuccuuucucacgcccuccuuccuucgccucgcccucccgccacgcuucacccuccccuuggcguacacauucugcaaagcugacaccgugcgcuuccacccccaccccucccgggugcaguucauggccuacugacgugcuuccaugcuccgggcagaugcuuagcuuauugcguccucgaaaaauccucgagugcagaucccgaacugcgcuccgcaggucccgcacacucaggggcugagagaggguccgagagaggguccgaauguacucuacaggcaccuccacccguccuggugcucagcccuuaagccccaagagcugccaggucuccgcacaccuagcgcuugcagccggaugaagaaccggaccaagcuuugcggugaccaagagguaggaggcagaagagcgcgacccccuaggguagcacgagccucaaacccgcacccacgucccucccccuggcggaggaggcgggagccggggucucagccaaucugggaucgcccguuuggccaaugacaauuggcgcgguccuaugccggggccagaaggaagcguacgccuggcgcguggcuccagagaugggggagugucucgcacaaggcuccacgcccacuccgccccacccugcuccuccaccaggacccgguguccacgcauugcaggagcacaccugugccccuugagugugagaagggcuugaggagugguucagaccaguaaugggaaauuucauguuccugggcaccuguacccauuuagccccucaugcacaccccaugccucuguguuuucaagaauccccaggaccgguugcccugaccugagagaauacaaucaaguccacuccuuucucacacugucacccaucugcaccuuacagccagcu

SEQ ID NO: 10286 - RNA, 2501 nt, Mus musculus
agcuggcuguaaggugcagaugggugacagugugagaaaggaguggacuugauuguauucucucaggucagggcaaccgguccuggggauucuugaaaacacagaggcauggggugugcaugaggggcuaaauggguacaggugcccaggaacaugaaauuucccauuacuggucugaaccacuccucaagcccuucucacacucaaggggcacaggugugcuccugcaaugcguggacaccggguccugguggaggagcaggguggggcggagugggcguggagccuugugcgagacacucccccaucucuggagccacgcgccaggcguacgcuuccuucuggccccggcauaggaccgcgccaauugucauuggccaaacgggcgaucccagauuggcugagaccccggcucccgccuccuccgccagggggagggacgugggugcggguuugaggcucgugcuacccuagggggucgcgcucuucugccuccuaccucuuggucaccgcaaagcuugguccgguucuucauccggcugcaagcgcuaggugugcggagaccuggcagcucuuggggcuuaagggcugagcaccaggacggguggaggugccuguagaguacauucggacccucucucggacccucucucagccccugagugugcgggaccugcggagcgcaguucgggaucugcacucgaggauuuuucgaggacgcaauaagcuaagcaucugcccggagcauggaagcacgucaguaggccaugaacugcacccgggagggguggggguggaagcgcacggugucagcuuugcagaauguguacgccaaggggagggugaagcguggcgggagggcgaggcgaaggaaggagggcgugagaaaggaggcgguggcgggcggaggagaguuaucuauacuuuuuaaaaaaaaggagccgcuugagccgcguaaagggagacuuggggagcgccugacagcacgcgcgggacacgagaguaccacgcuucccuacucuuucagaccuugacugguacggggucccaggacugcaggaggccagcgacgcgugcccuagggaguccugcagcagugcccugccugaggcccgugaaggugcaaacguccacuucccaccgcacccgguuccucgcgagcacuuuuccugugccgcaccagaacucguagcaggggcccaggggcugaaugcaagcuugauggacggcggcgcgcugcccagacucaugcccaccucgucuggagucgcuggagccugcgcugcucggcggagacaagcgucuccggaauugcugcgcugcagccggcggcggcgaucuggagcaaccgaggccagcagcagcucggcugccguggcacgccgcaaugagcgcgagcgcaaccgcguaaagcugguaaacuugggcuuccaggcgcugcggcagcacgugccgcacggcggcgccaacaagaagcugaguaagguggagacgcugcgcuccgcgguagaguacauucgugcgcugcagcggcugcucgcagagcacgacgcggugcgugccgcgcucgcuggggggcuguuaacacccgcuacuccgccguccgaugagugcgcgcagcccucugccuccccugccagcgcgucucuguccugcgccucuacgucuccguccccggaccgccugggcugcucugagccuaccuccccgcgcuccgccuacucgucggaggaaagcagcugcgagggagagcuaagcccgauggagcaggagcugcuugacuuuuccaguugguuagggggcuacugagcaucccaccccccuaagguaaguuccaggacggcggggaggcgaagcaguaagggagacacguggugggcgggccugacacuuagcgccacggggacccugugcagccaggacucagcuggggcgaucacuuggauuucgcgcacgcuucauuuuuccucaaccuuuuucaagccugagcaagaccggcguuuguuuguccgggauugcaaaacuuccucucagagcucugcugugggugggggaaggggaggccaggggaggggagcggccucagggccgggccggcgaggucccagugcugucagagccuggccgagucgggugcuggaggcggggugaguuugcauugcaaaucgcguccuaggccggggugcggagugagucggcuggagcgggccccugagucacggcgggcagguucugagcgugcgccccgcccccgucggcgccucugagcggaucgaggcacccaugaguugagacuccaaaacuaaucaagcaaacgaaacugccuacugcgccuugggagguggggcgguguccguacacauugacaccuuuuaucuucuucacagcugcaucccugggugacuccugguggaccuaccugcuucuagcccaagaaaccugggccuaugccuuacccaugcugucuagugcagccugaccaaaugccaagugcugacuga

SEQ ID NO: 10287 - RNA, 2501 nt, Mus musculus
aucccgcugucuuaugggcugcgauuaacuacugggaagagauuuucgcauucuccgccgccaacagaggcuucuggacacccaagggugcucaguguccgcugggcuaacacuuccucauucugugccggaaaguguccaugcguggccugggaugcccuuuucugccucccgcucccucucuaggguagguucagauagcgagaaaaagggugcuugugauucgugguggugguaucugcuggucccagguuggaggacccuagagccaagcaggcgggcgguccucggggugcggggaagcacgugcgcccagcaggugcgcccagcccggaacgcggagauagccugacuuggcuuggcggagcagguaacccgcuggcugagcaaggccgcagguaggcgcgcgguggcgcccaggggcggggcguccugggggcgggacaugccauccccggggaccaaccccgcccccgcccccaggcggagcagacagcggccccccguggcugggcuggcagcaguggcuacccgcgcugcgcccugcgcucugcgcugccuucaccucagcuccgaggagcagcggggucagggguccugucuggccauggacacggccucguccccgcccagugcugaaaggaagcgcgcggguuggagccgccugcuaggcgcccggcggggcagcgcgguggucaagaagugucccuucucacuggagcuggccgaagguggcccugagggcagcacggucuaugcgcccaucgcgccaaccggagcccccgggcucgcgccccccaugucgaccccagugucgcccgccccggccccugcagaccucggcccacguccgcgggugagccuugacccgcgggucuccaucuacagugcgcgccgcccgcugcuggcgcgcacccacauccagggccgagucuacaacuuccucgagcgccccacggguuggaaguguuucguguaccacuucaccgugugaguaaccucccugcacgcacgacucuuagggcuggugccacuaugacccuaggggaggcaaggaagggcuaaucacagaaagcagaaaccagacugagagucggucccuuaaacucagggacucugcuguggcuuguggagggggacacuugcaguacaccaaccuaggagaucccccagggcauucacuugggauagagggacagcgcuuagauguuagucucuacaggaggaguaagcaagcuggaagccgaccuuuuggugugggucaguugugacaagagagacucaggagccuccaggagugacuggugucugugugcaagcccauccaggccuuggcuggugucugugucuuaggcacucagagcaacaggauagauuagcaggugcacugguguugcccaagauguccacagggagugcccacagcuucaauaacccaggcugaugaaagcaggcuugaugcccugagcgagcccaguagacauuguccgagaacagcaccugcuuuagggaacaggagagggagcugagcugcaccuggcccucacugcuaccagguggcucuuauucucacaggcugccugagaggggcagggcacuucauuuuucaagggcagggucacagaaagucaucuccaggaaugggcuggcugcccuccuugcugccuccccuggccaccucgaggcagcacuuccuggcugccuaguuucuuggugcccugccagccucuggcucaggauucuacucaaccgaccccgcagcuaauugcuuuagauguuccacuaggugaccuccuuguggcuagucuugccaccugggcaggggaggaccuccacugguuguccagaggucuguuuaugccucugaggcacagcaagaaccaggcucacaaaagugaauucggauggcuguuugccuugcaaagggagacgauugcccaggguauccagggcaagucucuggacacccuguccccacuggcauucuugguauguccuuaaggccacccaacccccugccuuaccucccaaagugccaggaccccugaggcuucauugcuggucuuucgaggauggaggcacugcauguguuugcagcaggagugggcuuuucucagggcauaaagaccccaaagggccuuaaccuuaaccacuguaggaaugucuagcaaacauggcuugcugcuuucuauaacuugccugcuggauccuaagaucccugagaugaaaggugcuggagaagccgcuacucuguuaccuuuuugugcaggagccccauuugccaaggugggcagccuucagacacuugcauggaauccuccuggggaugcaggucauuagaaugagcguuguuaaguuccugacucugguggccuggaccugguggaggaagagggcuuguccugccccagaggaagucugugcuuacacugugcuuucuuccugaauuggauuguucagcccucgggaaguuugcucagcagagcuugccuuugcccagc

SEQ ID NO: 10288 - RNA, 2501 nt, Mus musculus
gcugggcaaaggcaagcucugcugagcaaacuucccgagggcugaacaauccaauucaggaagaaagcacaguguaagcacagacuuccucuggggcaggacaagcccucuuccuccaccagguccaggccaccagagucaggaacuuaacaacgcucauucuaaugaccugcauccccaggaggauuccaugcaagugucugaaggcugcccaccuuggcaaauggggcuccugcacaaaaagguaacagaguagcggcuucuccagcaccuuucaucucagggaucuuaggauccagcaggcaaguuauagaaagcagcaagccauguuugcuagacauuccuacagugguuaagguuaaggcccuuuggggucuuuaugcccugagaaaagcccacuccugcugcaaacacaugcagugccuccauccucgaaagaccagcaaugaagccucagggguccuggcacuuugggagguaaggcaggggguuggguggccuuaaggacauaccaagaaugccaguggggacaggguguccagagacuugcccuggauacccugggcaaucgucucccuuugcaaggcaaacagccauccgaauucacuuuugugagccugguucuugcugugccucagaggcauaaacagaccucuggacaaccaguggagguccuccccugcccagguggcaagacuagccacaaggaggucaccuaguggaacaucuaaagcaauuagcugcggggucgguugaguagaauccugagccagaggcuggcagggcaccaagaaacuaggcagccaggaagugcugccucgagguggccaggggaggcagcaaggagggcagccagcccauuccuggagaugacuuucugugacccugcccuugaaaaaugaagugcccugccccucucaggcagccugugagaauaagagccaccugguagcagugagggccaggugcagcucagcucccucuccuguucccuaaagcaggugcuguucucggacaaugucuacugggcucgcucagggcaucaagccugcuuucaucagccuggguuauugaagcugugggcacucccuguggacaucuugggcaacaccagugcaccugcuaaucuauccuguugcucugagugccuaagacacagacaccagccaaggccuggaugggcuugcacacagacaccagucacuccuggaggcuccugagucucucuugucacaacugacccacaccaaaaggucggcuuccagcuugcuuacuccuccuguagagacuaacaucuaagcgcugucccucuaucccaagugaaugcccugggggaucuccuagguugguguacugcaagugucccccuccacaagccacagcagagucccugaguuuaagggaccgacucucagucugguuucugcuuucugugauuagcccuuccuugccuccccuagggucauaguggcaccagcccuaagagucgugcgugcagggagguuacucacacggugaagugguacacgaaacacuuccaacccguggggcgcucgaggaaguuguagacucggcccuggaugugggugcgcgccagcagcgggcggcgcgcacuguagauggagacccgcgggucaaggcucacccgcggacgugggccgaggucugcaggggccggggcgggcgacacuggggucgacauggggggcgcgagcccgggggcuccgguuggcgcgaugggcgcauagaccgugcugcccucagggccaccuucggccagcuccagugagaagggacacuucuugaccaccgcgcugccccgccgggcgccuagcaggcggcuccaacccgcgcgcuuccuuucagcacugggcggggacgaggccguguccauggccagacaggaccccugaccccgcugcuccucggagcugaggugaaggcagcgcagagcgcagggcgcagcgcggguagccacugcugccagcccagccacggggggccgcugucugcuccgccugggggcgggggcgggguugguccccggggauggcaugucccgcccccaggacgccccgccccugggcgccaccgcgcgccuaccugcggccuugcucagccagcggguuaccugcuccgccaagccaagucaggcuaucuccgcguuccgggcugggcgcaccugcugggcgcacgugcuuccccgcaccccgaggaccgcccgccugcuuggcucuaggguccuccaaccugggaccagcagauaccaccaccacgaaucacaagcacccuuuuucucgcuaucugaaccuacccuagagagggagcgggaggcagaaaagggcaucccaggccacgcauggacacuuuccggcacagaaugaggaaguguuagcccagcggacacugagcacccuuggguguccagaagccucuguuggcggcggagaaugcgaaaaucucuucccaguaguuaaucgcagcccauaagacagcgggau

SEQ ID NO: 10289 - RNA, 2501 nt, Mus musculus
aguucucucuggccguuagccucuaaacugugggaagagggacucaggugagcaggcauagcgggaaccccccgggggcggccccuccgcgacccccgugggggacgccagacucaccuaacucaucucagacguuugcgcggggucugcuccaccgcgcccaccccaggagccacguuuggagagggacacccuggagggacgucguucgacgccuuguucuccugcgcaguucucuugcgcuuggcgaagaagucugcgggcgacaacgcgcgucggucagggcggggccggcccagagacccgcgaggagacccgcggagugcgcagggcgcggggccggggugggggcgccauccccgcccgcgccgagguccgcggcgggucagcuuuguuuacgucgccgcgcaaugugcuguguaagcauuuccccuugucccgcggccaagccccccggggcugccgccgcacuuaacccccuccaugccgcacacacggcucccuaaggggcucccgcggcccgagccaaagaccgcgauccgagugggucgcggccaggcucgcccucccacugcacgcucgggagccuuagcugcaccccuaccaguaggaaaggggugcgggcgcaaccgcgcccuaagcgccgcgggcccuuuaaugccacgggaggaggcggggaccgggcgaggcccccgagggcgagggagagcccggccggccggacaaagcgaggccgggccggggcggggccgugcggggcucaccggagaugagaggccccgacagcuucuugaucgcaccguucgcauuggccgcagcagucccgggugcaggacguccuggaauccccgagagaggcugguccuucagcuccuggccgcgcugcucuugauucucguccugcuccucgaccggcuccccauucugcuccucgaccggcuccgcacccugcuccucgaccggcuccgcgcccugcuccuccuccggcuccucguccuucuccucgaccggcucugcgcccugcuccucgcccugcucagagaccggcucaguucccagcucaucacccggcucagcacccgacuccucgcccugcucagagaccugcucagggaccuguuccucgccgucccgagucgccacguccggguucgcguccgggaucggguccggagucgggucggaggucgcgaccagggucaccuccggaauugggucugaggucagaucugaagccggggccggggucgcggguggggugggcuccgcgaccacggccgaggcuggggcgcugggcggcugcucaggcgccuccucuaggccgucgggggccucgccagccggcggcccagaacgcgggaugacagccacggccaccggggguggccggggccccagcugcaggcgacagcgccccaccugcaccgucucgcgguagaaggcgggcacagacucgcuguccaccuccauccacugcagacgaccagggccucgaagaggcacauccugcuggaaguugaagucccagcgguucugguccucggcguucagcucggccaggcgcauccgcagcucgcggcccagcuccucguggucuacaggcccgaagaggcugcggcaggcgcugcuacgcgcuaucacugggaagguaucgcuggaggccaagcguuccaucgcuguucugcugcggagguacacgucggacaugcccauggucgaaggcugugcaaacgcgggcagcgagaaagaagggaacgggaggagaaggaagaggggagaggaggagggcggaggcugggcgugggugagaccccuugcacagcccgcguccgccucugccuaaggacgcagcggcuaccuggcugauuggugauggacggcuccugcgucuggaucgcuuguccuguccagcuugggccgcgcccccucggagcuugccugccuguucgcuugcucucagucgggccuagccggcaccccucgagcacagcgcacucggccuguggaacgcccagcccgcugcgccccuuuauacgcgcuggccccacccccgcgcgcgcgggccuccucacgauuagcauaauguaguauuuucaguuucaacaacaccgcggcgauuggagggugcagcccgccccgcccacagaggcccugcccccgcgccacgcucauuggcugcgcgcacacacccccggggccgggcggggcgggugacgggcgggcgcugauuggcggccgcacggcgagcgggcugcgcgggacaaggggcggggcucgaguuaaagagcucugcgggcgguaacgugacaccgcgacgccccucccccucgccccauccccccccccgccccccgcgggcuccuuugucugcaggcgggggcucgcgcagccgcgacgcgcgcgcccccucggaccauggagcugggcacagccccucggcgaugccgacgucggugaaggucccucgguccccgcagcccgcgcuagcccuaggacugcac

SEQ ID NO: 10290 - RNA, 2501 nt, Mus musculus
gugcaguccuagggcuagcgcgggcugcggggaccgagggaccuucaccgacgucggcaucgccgaggggcugugcccagcuccaugguccgagggggcgcgcgcgucgcggcugcgcgagcccccgccugcagacaaaggagcccgcggggggcggggggggggauggggcgagggggaggggcgucgcggugucacguuaccgcccgcagagcucuuuaacucgagccccgccccuugucccgcgcagcccgcucgccgugcggccgccaaucagcgcccgcccgucacccgccccgcccggccccgggggugugugcgcgcagccaaugagcguggcgcgggggcagggccucugugggcggggcgggcugcacccuccaaucgccgcgguguuguugaaacugaaaauacuacauuaugcuaaucgugaggaggcccgcgcgcgcggggguggggccagcgcguauaaaggggcgcagcgggcugggcguuccacaggccgagugcgcugugcucgaggggugccggcuaggcccgacugagagcaagcgaacaggcaggcaagcuccgagggggcgcggcccaagcuggacaggacaagcgauccagacgcaggagccguccaucaccaaucagccagguagccgcugcguccuuaggcagaggcggacgcgggcugugcaaggggucucacccacgcccagccuccgcccuccuccucuccccucuuccuucuccucccguucccuucuuucucgcugcccgcguuugcacagccuucgaccaugggcauguccgacguguaccuccgcagcagaacagcgauggaacgcuuggccuccagcgauaccuucccagugauagcgcguagcagcgccugccgcagccucuucgggccuguagaccacgaggagcugggccgcgagcugcggaugcgccuggccgagcugaacgccgaggaccagaaccgcugggacuucaacuuccagcaggaugugccucuucgaggcccuggucgucugcaguggauggagguggacagcgagucugugcccgccuucuaccgcgagacggugcagguggggcgcugucgccugcagcuggggccccggccacccccgguggccguggcugucaucccgcguucugggccgccggcuggcgaggcccccgacggccuagaggaggcgccugagcagccgcccagcgccccagccucggccguggucgcggagcccaccccacccgcgaccccggccccggcuucagaucugaccucagacccaauuccggaggugacccuggucgcgaccuccgacccgacuccggacccgaucccggacgcgaacccggacguggcgacucgggacggcgaggaacaggucccugagcaggucucugagcagggcgaggagucgggugcugagccgggugaugagcugggaacugagccggucucugagcagggcgaggagcagggcgcagagccggucgaggagaaggacgaggagccggaggaggagcagggcgcggagccggucgaggagcagggugcggagccggucgaggagcagaauggggagccggucgaggagcaggacgagaaucaagagcagcgcggccaggagcugaaggaccagccucucucggggauuccaggacguccugcacccgggacugcugcggccaaugcgaacggugcgaucaagaagcugucggggccucucaucuccggugagccccgcacggccccgccccggcccggccucgcuuuguccggccggccgggcucucccucgcccucgggggccucgcccgguccccgccuccucccguggcauuaaagggcccgcggcgcuuagggcgcgguugcgcccgcaccccuuuccuacugguaggggugcagcuaaggcucccgagcgugcagugggagggcgagccuggccgcgacccacucggaucgcggucuuuggcucgggccgcgggagccccuuagggagccgugugugcggcauggaggggguuaagugcggcggcagccccggggggcuuggccgcgggacaaggggaaaugcuuacacagcacauugcgcggcgacguaaacaaagcugacccgccgcggaccucggcgcgggcggggauggcgcccccaccccggccccgcgcccugcgcacuccgcgggucuccucgcgggucucugggccggccccgcccugaccgacgcgcguugucgcccgcagacuucuucgccaagcgcaagagaacugcgcaggagaacaaggcgucgaacgacgucccuccagggugucccucuccaaacguggcuccuggggugggcgcgguggagcagaccccgcgcaaacgucugagaugaguuaggugagucuggcgucccccacgggggucgcggaggggccgcccccgggggguucccgcuaugccugcucaccugagucccucuucccacaguuuagaggcuaacggccagagagaacu

SEQ ID NO: 10291 - RNA, 2501 nt, Mus musculus
gcggggaccuuucagaggcgggagggggcucagggcgcacggcggaggagcggcggcccgacggcucuggcccgggagcugugcgcaggcgacgcccggccugagucccgcgcccccgccagggaccacggccgccuuuuguugucaagcgcccuuucuucagaacuguguucggcaaagaaacacgacccccauuccugggugaaaauucaaagucuucuuucuccaucucccucuccucuuucuugucuucucuccacuaucucuuccccucuccugcuccacccguccuuaucuccaucuccaccucucuccaccucucccugucuccccuccucuuccucccuccccugucucccaccucuucccggucccccucucccucccuuccucuccuagccacagucgagccggccuggcgcgcgggcgugugcucccagcgccgcgccuucgugagacccgcgcuggcgcagcagccgcugcgggcgggcgcgaugccgggaugggccugaucuggcuucugcugcucagcuugcuggaacccagcuggccaacuacggggcccgggacgcgacuacgacgcgaugcgggcggccgugguggcguuuacgagcaccucggcggggcgccacggcgccgcaagcucuacugcgcuaccaaguaccaccuccagcugcacccaagcggccgcgugaacggcagccuugagaacagcgccuauagugaguguucagguccggacagggaggggaggguggcggaagagaccggagggcucgguccccugccgccacguccuagauagaggcagagcugaggucaguccgaagacgccgccgcggucccagcuaccgaacucagcaagcugccccgcccgucccgcucccccaggagcugcgcgggaggcgaccccgguucugacacguuucuauuacucaaugaaaagccguuggacaaggauuuaucgcccucuuuauuguuuugacgaccccggggugcauggccagucccuuucguucucuuugcucucagccgaugcgcggaggacacuccacuaggcagagcucgguuuccgcaacgcggcaucugacgacaggcuugucccgcguccugcgcccugcaagagagcgcgacaggacaaacaggcguccccucguguuccggaugcugcugacacgcacccacagcccgcagcucgaucauacccagggccaguucccgaguauugcaggguuuggcuucuucaguuggguacccacgagcggagcuggaccaggagcguugcucgcugcgugggagggaggccgcgcaaaacucaccgcgcccggggcgcaggaagccgaacggggggcgcgggcggcgggggggaaccgcagcuuccuccugcaaagccgcagccccgcgggggcguccuggggacuagacccugucgggccuggagcgcggggcuccucaugcgcaccacuccccauuugcuggaucccgggaggucccagauguagaggaggggcacauucgcugccaccuaggggcacucagucuggugcucgucuggcgccagcuguagaggccucauccugcaccccuccaaaccguggcuagggcagaaucucaacugaguccgguaaucuggaccaugcugggucccagcggccgcucccuagaaagggagugaauccucgacccacuaucccgggggucuuugaccuccgcuccccucccaaaagcacuauacuguucacggcaaaggcugguagaaguuugguuguuuuuguauuuuguuuguuuugugugccacagugaguguguggaggucauugagccacuagcuggagucuggucucuacuuccaucauguggguuccucgaucaaacucuggugaucagucucugcaacuucucugucaucugcgcugagagauuguuaacuuuuguaccuacucuuaggccugggugagcccugucaccuuuccucagcacccaggcccuuuucuguggcaggcuaccucucagcacacaucuuuggaucacuugcugccaguggggggcugggcugcaaacccuggcuucccuaagagucuuggccaccuccccuucugggucuccaucugcucugggguuuggaucucccaaaccauuauguguggcuuaaguuacuugaugcuugcgagaccgaggcauucacaagauugcacaaaauacagacugggucgaucuguccagguugcacccaaggugcauggcaggggcagaacauucccaucaugucuucuccugagguuaggauuaaggucucccgcacaguggcaggaugccccuuuccuuaccaccugcucaauguuuucuuccuaccaggacuuccaaccagaccugucccagcuuccugagccuagagggggaagcuggcucaggcugagguucugcuuagguugagacguugauggacucuuccugacucuuuccaggcauccuggagauuacugcgguggaagugggcgugg

SEQ ID NO: 10292 - RNA, 2501 nt, Mus musculus
ccacgcccacuuccaccgcaguaaucuccaggaugccuggaaagagucaggaagaguccaucaacgucucaaccuaagcagaaccucagccugagccagcuucccccucuaggcucaggaagcugggacaggucugguuggaaguccugguaggaagaaaacauugagcaggugguaaggaaaggggcauccugccacugugcgggagaccuuaauccuaaccucaggagaagacaugaugggaauguucugccccugccaugcaccuugggugcaaccuggacagaucgacccagucuguauuuugugcaaucuugugaaugccucggucucgcaagcaucaaguaacuuaagccacacauaaugguuugggagauccaaaccccagagcagauggagacccagaaggggagguggccaagacucuuagggaagccaggguuugcagcccagccccccacuggcagcaagugauccaaagaugugugcugagagguagccugccacagaaaagggccugggugcugaggaaaggugacagggcucacccaggccuaagaguagguacaaaaguuaacaaucucucagcgcagaugacagagaaguugcagagacugaucaccagaguuugaucgaggaacccacaugauggaaguagagaccagacuccagcuaguggcucaaugaccuccacacacucacuguggcacacaaaacaaacaaaauacaaaaacaaccaaacuucuaccagccuuugccgugaacaguauagugcuuuugggaggggagcggaggucaaagacccccgggauagugggucgaggauucacucccuuucuagggagcggccgcugggacccagcaugguccagauuaccggacucaguugagauucugcccuagccacgguuuggaggggugcaggaugaggccucuacagcuggcgccagacgagcaccagacugagugccccuagguggcagcgaaugugccccuccucuacaucugggaccucccgggauccagcaaauggggaguggugcgcaugaggagccccgcgcuccaggcccgacagggucuaguccccaggacgcccccgcggggcugcggcuuugcaggaggaagcugcgguucccccccgccgcccgcgccccccguucggcuuccugcgccccgggcgcggugaguuuugcgcggccucccucccacgcagcgagcaacgcuccugguccagcuccgcucguggguacccaacugaagaagccaaacccugcaauacucgggaacuggcccuggguaugaucgagcugcgggcugugggugcgugucagcagcauccggaacacgaggggacgccuguuuguccugucgcgcucucuugcagggcgcaggacgcgggacaagccugucgucagaugccgcguugcggaaaccgagcucugccuaguggaguguccuccgcgcaucggcugagagcaaagagaacgaaagggacuggccaugcaccccggggucgucaaaacaauaaagagggcgauaaauccuuguccaacggcuuuucauugaguaauagaaacgugucagaaccggggucgccucccgcgcagcuccugggggagcgggacgggcggggcagcuugcugaguucgguagcugggaccgcggcggcgucuucggacugaccucagcucugccucuaucuaggacguggcggcaggggaccgagcccuccggucucuuccgccacccuccccucccuguccggaccugaacacucacuauaggcgcuguucucaaggcugccguucacgcggccgcuugggugcagcuggaggugguacuugguagcgcaguagagcuugcggcgccguggcgccccgccgaggugcucguaaacgccaccacggccgcccgcaucgcgucguagucgcgucccgggccccguaguuggccagcuggguuccagcaagcugagcagcagaagccagaucaggcccaucccggcaucgcgcccgcccgcagcggcugcugcgccagcgcgggucucacgaaggcgcggcgcugggagcacacgcccgcgcgccaggccggcucgacuguggcuaggagaggaagggagggagagggggaccgggaagaggugggagacaggggagggaggaagaggaggggagacagggagagguggagagagguggagauggagauaaggacggguggagcaggagaggggaagagauaguggagagaagacaagaaagaggagagggagauggagaaagaagacuuugaauuuucacccaggaaugggggucguguuucuuugccgaacacaguucugaagaaagggcgcuugacaacaaaaggcggccguggucccuggcgggggcgcgggacucaggccgggcgucgccugcgcacagcucccgggccagagccgucgggccgccgcuccuccgccgugcgcccugagcccccucccgccucugaaagguccccgc

SEQ ID NO: 10293 - RNA, 2501 nt, Mus musculus
ugcgacacguucucacgaggucuccaccuuguagggcaaauauccaugaaaagggagccuaggucuggggccgggagaaugagggaggguaggaucugcgauagcgugcuaaaggagagauucaagacucaaacagggggcuacggaggcagagcucugcgugccuucuagucucugugacugucccacgcgcaucccucugaaagcccagggccugaagaccucaauaauuaauaguaaaauuaaaauagccuauucaauaaccaccaagauacugugcauugaacacuugcuccccaggccagggucgcaaagggggggcuccuccucugccagaucuggccggccugggcggggucacuggguuggggcuugaaugggugugugcggggggcggagacuugaugcaauuaggaggagaaaugcucugaugcccgggucaccuacccgcggggcccgcgggacgaaacguauauaaggccgcgugcccggagccaccccacugucggagcaguaacucugugcgccccacgccacaagcgcccaguugcuuuguggguugugccugcccugcgccugcaacuugaguccccgccgcaucgcagucuccgcgccaccuuuguaacggccuucaggaccccgaggugucauggcgagaaaguggaacgggcgugcgguggcccgagcccugguccuggccacucuguggcuggcugugucugggcguccccuggcucagcaaucccagucugugucagaugaagauccacucuuucucuacggcuggggcaagauuacccgccugcaguaccuguacuccgcuggucccuaugucuccaacugcuuccuccgaauccggagcgacggcucuguggacugcgaggaggaccaaaacgaacgaagugaguaucauucagcccguccccuccggucccuuaggacccagaagcacgugggugugucgccguggccuuaacauccucccaccccugacuuccagacuggagcuggggaagggcgaugcaguguggccccgcuguacucacguguugcuggggcccggcaacaucuuucucuugcucgcagauuuguuggaauuccgcgcggucgcucugaagacgauugccaucaaggacgucagcagcgugcgguaccucugcaugagcgcggacggcaagauauacgggcuggugaguguuccuccacgcggcgggaugcucgcggccgcguuggguccguauuguuuuuguuuguuuguuuguucuuucgccuccugcucagguccaaaaggaacuucgagggcaagguaccaaugauaguggggcuaauauugcucuugcccgcccugcguaaagugauggccccaggcuguagcgggggagcagggagaccagagaagcugucuaaucuucccaaagacugggcuaacugcugagucccauucagcuuucggccccuuugauacugaacaggaaagccuccucuccuggcuuugcguguucgugguccucgauuuccucccccucccucaaauaaaaaagaaaagaaaaaggaaagaagggucuuuucaaucaauuuuucuuagguccauggugugaugcaaaaauuagauacuuuagaaaguacccaagaugcucaucugcuugugaccugggggaacuggagugaggcgagauggcuagguucacauaaccccuaaaaaucgguagucaugaaguauguaggcuagugcucuguaggaauagaggcuggguucaaagaagccuucagcccuaccucuggcaguaccagugcgaggucccccaguggggaaggauggcuaccggacuuaacguuuuuguuguuuuguuucuuuaagaguccccaaauugucuguggcucugaaguugauuuaucuacaugaaaagaccacagagaaaggaaagaaagaaagaaagaaagaaagaaagaaagaaagaaagaaggaaagaaagaaaggggucugcagagaaaggaaggggcuucagaggaggggguccccugccuggcugaaagcugacacccaggcccaagcaaaucuccugccuguaucuuccugaagucuuuauuugugcugggcaaggaguccgaccuccauucugcacuaauguaaauaguguaggaaggccccaugggagcuuugccccccaauucuagugccacccuggaucuggugggcauaauucauuucagacucuccuuuuuaaaaauagaagccccauaauccauuguuucuauauggaaaaaaaaaagagugaccaguuguccauaugaauucuccaggagaaauacauccuguguuuaucuacaguucacauuuuuuuucagggaacauggccccuccugccugguggcucugucucagugccaucagccagggcaggagcaauugguuccuggaauuagccuguuaucagagccuuaucugccaacugucuucuaccugcaguucaaugaccucugcaugcuuaggcagacacagc

SEQ ID NO: 10294 - RNA, 2501 nt, Mus musculus
gcugugucugccuaagcaugcagaggucauugaacugcagguagaagacaguuggcagauaaggcucugauaacaggcuaauuccaggaaccaauugcuccugcccuggcugauggcacugagacagagccaccaggcaggaggggccauguucccugaaaaaaaaugugaacuguagauaaacacaggauguauuucuccuggagaauucauauggacaacuggucacucuuuuuuuuuuccauauagaaacaauggauuauggggcuucuauuuuuaaaaaggagagucugaaaugaauuaugcccaccagauccaggguggcacuagaauuggggggcaaagcucccauggggccuuccuacacuauuuacauuagugcagaauggaggucggacuccuugcccagcacaaauaaagacuucaggaagauacaggcaggagauuugcuugggccugggugucagcuuucagccaggcaggggacccccuccucugaagccccuuccuuucucugcagaccccuuucuuucuuuccuucuuucuuucuuucuuucuuucuuucuuucuuucuuucuuuccuuucucuguggucuuuucauguagauaaaucaacuucagagccacagacaauuuggggacucuuaaagaaacaaaacaacaaaaacguuaaguccgguagccauccuuccccacugggggaccucgcacugguacugccagagguagggcugaaggcuucuuugaacccagccucuauuccuacagagcacuagccuacauacuucaugacuaccgauuuuuagggguuaugugaaccuagccaucucgccucacuccaguucccccaggucacaagcagaugagcaucuuggguacuuucuaaaguaucuaauuuuugcaucacaccauggaccuaagaaaaauugauugaaaagacccuucuuuccuuuuucuuuucuuuuuuauuugagggagggggaggaaaucgaggaccacgaacacgcaaagccaggagaggaggcuuuccuguucaguaucaaaggggccgaaagcugaaugggacucagcaguuagcccagucuuugggaagauuagacagcuucucuggucucccugcucccccgcuacagccuggggccaucacuuuacgcagggcgggcaagagcaauauuagccccacuaucauugguaccuugcccucgaaguuccuuuuggaccugagcaggaggcgaaagaacaaacaaacaaacaaaaacaauacggacccaacgcggccgcgagcaucccgccgcguggaggaacacucaccagcccguauaucuugccguccgcgcucaugcagagguaccgcacgcugcugacguccuugauggcaaucgucuucagagcgaccgcgcggaauuccaacaaaucugcgagcaagagaaagauguugccgggccccagcaacacgugaguacagcggggccacacugcaucgcccuuccccagcuccagucuggaagucaggggugggaggauguuaaggccacggcgacacacccacgugcuucuggguccuaagggaccggaggggacgggcugaaugauacucacuucguucguuuugguccuccucgcaguccacagagccgucgcuccggauucggaggaagcaguuggagacauagggaccagcggaguacagguacugcaggcggguaaucuugccccagccguagagaaagaguggaucuucaucugacacagacugggauugcugagccaggggacgcccagacacagccagccacagaguggccaggaccagggcucgggccaccgcacgcccguuccacuuucucgccaugacaccucgggguccugaaggccguuacaaagguggcgcggagacugcgaugcggcggggacucaaguugcaggcgcagggcaggcacaacccacaaagcaacugggcgcuuguggcguggggcgcacagaguuacugcuccgacagugggguggcuccgggcacgcggccuuauauacguuucgucccgcgggccccgcggguaggugacccgggcaucagagcauuucuccuccuaauugcaucaagucuccgccccccgcacacacccauucaagccccaacccagugaccccgcccaggccggccagaucuggcagaggaggagcccccccuuugcgacccuggccuggggagcaaguguucaaugcacaguaucuuggugguuauugaauaggcuauuuuaauuuuacuauuaauuauugaggucuucaggcccugggcuuucagagggaugcgcgugggacagucacagagacuagaaggcacgcagagcucugccuccguagcccccuguuugagucuugaaucucuccuuuagcacgcuaucgcagauccuacccucccucauucucccggccccagaccuaggcucccuuuucauggauauuugcccuacaagguggagaccucgugagaacgugucgca

SEQ ID NO: 10295 - RNA, 2501 nt, Mus musculus
guagagaaggagaauggggaaaaaaggaggacuggagagauaguucagcauguaaaagugcacggccaagccugcagacccugguucuaucccugggauggaauaaggagagaacggacuccuggaacuuaucuacugauuuccccaugcgcaacacggcaugcauaggcacugaauccauuuuuuaaagaagauaaugaaagagauggagaggaggggacagaauggaagaaagauggacagauggagacagagauacagauggagagucaagaucgggggucggagaaggggcccgaaaagucacaugggugcauggaggguuaggguggcgcggguugguagggcgcaaacaaagacuggacgcgcgccagcucggguggcccuggucgggacaaaggcuuggcccgggggcgggggggugggguggggcggcgcgggggcagcgauggcgccggccgcggagggcucgagcgaacuacaagucccagcagcucccgcagcggcccucggccggccccucucgcuccccgggagugccuggcggggccgcugggccgagggggccgccagcgggucuggcgaucggugggguuuccugcaagccuggggcggggagacaccggcuggccagcgcgagugcagccaggccgggcaggggcgaggggcaucgggugagugaccccgaaagcggaucgggcuggauuggggaaggcuggacaaaagggggaggugguugggaggagaccccucaacacuaagagcagggugcggggcgcggccccaggcuaucucuacgcaccccuugcagaguacauggugccagcgcucuacuuggggggucaagguggcggacgcggugggaaggggguccggaggagcucaggccuaguacguuuauccggccaacggcgggaccacccccuaaucuacagugaaucugagauccggauggguggaggcgcccgcuagcucggaacccacagaacagaacaccuccuuguuucagaaggggguucuuuuuuucuggaaaccaagagaagcuuggggcauuguucuuccuaugugggacuuuauacuccauaguguguguguguucagaagggaggugucguguuaccucaagaaucccaagaaaaaucccaguuauuguuaucuuccacauucagucuuaggauguagagcucuggaagcucauuuucccaagagaugaucggggugcaccugcccucugcacaucuacgagacagaugugaguuuccauucaagaugggaguucaugaggcugcuuccuucgaaggcaaucuaaaaauaccuugucuccagaaaucugggcggagaccccgggguacugcccacuaaucuccagcaguugggccuagguagagaaacuguugggggaaacucagcgccccucuguguacuaucuccugacugugagguuggggucagguaggucucccuaguccccuggagcccagcccaacaaagaguucacuuagccccaagguagagagguguuacucuuucuccacaucugccucuuucccuaaaacagucuucauacccuaaucaaggagugugugguucaggaacucccuucccuugaagacauuccuccucagcccucugugccccaccccccaguucucucuguaaccccccagaggcccccccccaagcuauaguuaucaccggcucuucaccaagggguuaaaauccacaaucuuauaagccaauuggaaaauugcuauauuaacugcucucuccacccucuggcuguggaguucuuagugauccuucugccccuuuccccagaagggggccauguaugcaccccuccuuaguuuugaaaaacguuauuauuuuguagcccaggcugaucagaucugccagccucauccucaaaagaugcugggauaacagaugugugccaccacugcuagcucagguuuccacucccuguccucugguuuaagacagaacauaucucacucaagcuagaauucuagagaggucuagaauucuuuccuggaagcaaacaaggagcccugcaguuuucaccgugacagagaaggacuacuagguauccuuaacuucccauccuuaccacuacccauucuacuucgguaagacaagucacacacauuccccucuuuaucagggacccccagaucuaccaguuugcaggguggggcaagaauucagaccaugaccucaugaaaaaagaaccacaacacccuuucccccagauuuaggguaucagaucugagaaccgccuuccauaacacccaaguccacguacuacauagagcucgggaugggggucugggaugccgcucagaggguggagugcucaucuaccauucaggaaaccaguaccacauaagcugaauaugcuugugcacucccuguacuuccgcacaggagguugaggcaggaguauaaguaguuuaacauccuccuugauuacgaguugagagacagcuggagcuaugcaa

SEQ ID NO: 10296 - RNA, 2501 nt, Mus musculus
uugcauagcuccagcugucucucaacucguaaucaaggaggauguuaaacuacuuauacuccugccucaaccuccugugcggaaguacagggagugcacaagcauauucagcuuaugugguacugguuuccugaaugguagaugagcacuccacccucugagcggcaucccagacccccaucccgagcucuauguaguacguggacuuggguguuauggaaggcgguucucagaucugauacccuaaaucugggggaaaggguguugugguucuuuuuucaugaggucauggucugaauucuugccccacccugcaaacugguagaucugggggucccugauaaagaggggaaugugugugacuugucuuaccgaaguagaauggguagugguaaggaugggaaguuaaggauaccuaguaguccuucucugucacggugaaaacugcagggcuccuuguuugcuuccaggaaagaauucuagaccucucuagaauucuagcuugagugagauauguucugucuuaaaccagaggacagggaguggaaaccugagcuagcagugguggcacacaucuguuaucccagcaucuuuugaggaugaggcuggcagaucugaucagccugggcuacaaaauaauaacguuuuucaaaacuaaggaggggugcauacauggcccccuucuggggaaaggggcagaaggaucacuaagaacuccacagccagaggguggagagagcaguuaauauagcaauuuuccaauuggcuuauaagauuguggauuuuaaccccuuggugaagagccggugauaacuauagcuugggggggggccucugggggguuacagagagaacugggggguggggcacagagggcugaggaggaaugucuucaagggaagggaguuccugaaccacacacuccuugauuaggguaugaagacuguuuuagggaaagaggcagauguggagaaagaguaacaccucucuaccuuggggcuaagugaacucuuuguugggcugggcuccaggggacuagggagaccuaccugaccccaaccucacagucaggagauaguacacagaggggcgcugaguuucccccaacaguuucucuaccuaggcccaacugcuggagauuagugggcaguaccccggggucuccgcccagauuucuggagacaagguauuuuuagauugccuucgaaggaagcagccucaugaacucccaucuugaauggaaacucacaucugucucguagaugugcagagggcaggugcaccccgaucaucucuugggaaaaugagcuuccagagcucuacauccuaagacugaauguggaagauaacaauaacugggauuuuucuugggauucuugagguaacacgacaccucccuucugaacacacacacacuauggaguauaaagucccacauaggaagaacaaugccccaagcuucucuugguuuccagaaaaaaagaacccccuucugaaacaaggagguguucuguucuguggguuccgagcuagcgggcgccuccacccauccggaucucagauucacuguagauuaggggguggucccgccguuggccggauaaacguacuaggccugagcuccuccggacccccuucccaccgcguccgccaccuugaccccccaaguagagcgcuggcaccauguacucugcaaggggugcguagagauagccuggggccgcgccccgcacccugcucuuaguguugaggggucuccucccaaccaccucccccuuuuguccagccuuccccaauccagcccgauccgcuuucggggucacucacccgaugccccucgccccugcccggccuggcugcacucgcgcuggccagccggugucuccccgccccaggcuugcaggaaaccccaccgaucgccagacccgcuggcggcccccucggcccagcggccccgccaggcacucccggggagcgagaggggccggccgagggccgcugcgggagcugcugggacuuguaguucgcucgagcccuccgcggccggcgccaucgcugcccccgcgccgccccaccccacccccccgcccccgggccaagccuuugucccgaccagggccacccgagcuggcgcgcguccagucuuuguuugcgcccuaccaacccgcgccacccuaacccuccaugcacccaugugacuuuucgggccccuucuccgacccccgaucuugacucuccaucuguaucucugucuccaucuguccaucuuucuuccauucuguccccuccucuccaucucuuucauuaucuucuuuaaaaaauggauucagugccuaugcaugccguguugcgcauggggaaaucaguagauaaguuccaggaguccguucucuccuuauuccaucccagggauagaaccagggucugcaggcuuggccgugcacuuuuacaugcugaacuaucucuccaguccuccuuuuuuccccauucuccuucucuac

SEQ ID NO: 10297 - RNA, 2501 nt, Mus musculus
caauuucacauuuucccaucugugaaauagaguugcuugacuuucugugacccaaccaauaauggcuuuugcccaauuuguguccauuaucugcaaguguuccugagcuaucucauauguaauauuuuuguguaugugugugcacauguguauacaguuguacucacccaucgccccccauugccugugcauguggaggccagagauaaacaccaacauuuagcuggacccauuuuucugccuuguuuuauuuucuguuuugcuuauuauuacuauguggacuguguaggcuggccuugaacuuacagagauccacaugccucuggcuucuaagagcugggauuaacagcaagugcuacuacacuuggcuauuuuuugggggacaggaucucucacagaaacugauguuugacacuuccucugcugagcaccagaaacacaccucuuuucuucccacccagagcugagguuacagugauacaucaagaucagcuuuuacauaggugcugaaguuucaaacucaggaccucauauuugugcagcaagcacuuuagcacaccaagcuaccuuuccagcccauucaugucuaagaucaaaagguuccaaauugcuaacccuugcuuggggaauuagggaguugggggaauuaacuuauuaccuggcaaucccacugcuggcacgcccggggcuagaaauagagcccuggccaggggucuucauaggggcccucucuccuuucccagaagcugggggccuguuggcuucagggagaagacaaaaaucagugguacuucugaaaaagaggaguaucuaagaaggaagagagaagguaagcagagugcagauggaggucacaaauaaagcugaguaccugggcuacgaggaccugccccagcacugcgcgcuggugccccgugaauaguggucuguggaagagcugcuuugcuggucuguggaagagcugcuuugcuggucuguggaagagcggcuuugcuggucuguggaagagcggcuuugcuggucuguggaagagcggcuuugcagacgccuggggcucgcuccaccagggaccuucgccccauagcuccguuugcuuccaagacucgaagggcagcaguggucacagggggaggaggucgagcggacccagaaggaggccuaggggucagaaggccagggggucgugaagacggcauucgcggggcaguuccugauuugacgcuaucccucuuguccauaccgcaccuaaugaggaagacaggaggcuugguaucccagguccugaaccaaucacuacaaaccauccugaagccucccugugcuuccuucuagcaucgccacccaugggugccuaaaccucagccuaaagagccucgauuuguuuuucuucuaagcacccacacccgcucaccaaccuggccgcuuucaaguccuacggcuaccuccauccccaaggcuaagacgcccuguucaguccccacccuccgacccccgaccccgccucugcccuauuacaagaacaacauccacuccccuacccccucgccucuugaaaaccuaaaugaccaauccggcaaacagggaaaugccuccggcuuccagauucaggggccucagugugcacgccgauggggcuucgccagcguccuuccucagguuccacaggcaccugcacagagaaaaagaguggccuuguugcccgcgaacgggcucugggagacaaagagcugaccccucccccagucugguccccuaugccaacgauccgcccgauccaccugcucacagcacgcguucaccuccgccucugggcaccagccgcuccacacagggucgcuugggguggggcugggccggagagcaguagcggggagcagcgaaaaggcaaggggagggggcuucaagcgacagagccuagggagcuuggccacggccccgccccccagcuucggguggggagaguagaggaugcgcgcacucgcucucgguccagagccgagagcgugccgagagggcuaagaaaagaggcgcgccuccgagggaggugcgggugcugccucccuguaauaccccagaagaggccgauuucaauggucgugucuagcaaccacagaacucgagaggcucagugggggaauccuugaagacccucacaguccucuacucaagcucuugcaccugcuccgacaccccccuucucuagcacuuggagacagacacucuccuagacaagggauaggcugggccuuggcaaccaguagggcgggaucauugugccucuggcccaccaaccaauccagccauuuugugugcccugguccucuuuuccugcacuugaugacuauggaggcuagauaguccugcgacaccugugccaggucaccuauuuuguaacuuugacuuuucucacagcccuuaccugauacgguuggugggagaaugagaacccugggaguuacuuuguauuacauuuuauuuggugugugugugugugugugugu

SEQ ID NO: 10298 - RNA, 2501 nt, Mus musculus
acacacacacacacacacacaccaaauaaaauguaauacaaaguaacucccaggguucucauucucccaccaaccguaucagguaagggcugugagaaaagucaaaguuacaaaauaggugaccuggcacaggugucgcaggacuaucuagccuccauagucaucaagugcaggaaaagaggaccagggcacacaaaauggcuggauugguuggugggccagaggcacaaugaucccgcccuacugguugccaaggcccagccuaucccuugucuaggagagugucugucuccaagugcuagagaaggggggugucggagcaggugcaagagcuugaguagaggacugugagggucuucaaggauucccccacugagccucucgaguucugugguugcuagacacgaccauugaaaucggccucuucugggguauuacagggaggcagcacccgcaccucccucggaggcgcgccucuuuucuuagcccucucggcacgcucucggcucuggaccgagagcgagugcgcgcauccucuacucuccccacccgaagcuggggggcggggccguggccaagcucccuaggcucugucgcuugaagcccccuccccuugccuuuucgcugcuccccgcuacugcucuccggcccagccccaccccaagcgacccuguguggagcggcuggugcccagaggcggaggugaacgcgugcugugagcagguggaucgggcggaucguuggcauaggggaccagacugggggaggggucagcucuuugucucccagagcccguucgcgggcaacaaggccacucuuuuucucugugcaggugccuguggaaccugaggaaggacgcuggcgaagccccaucggcgugcacacugaggccccugaaucuggaagccggaggcauuucccuguuugccggauuggucauuuagguuuucaagaggcgaggggguaggggaguggauguuguucuuguaauagggcagaggcggggucgggggucggaggguggggacugaacagggcgucuuagccuuggggauggagguagccguaggacuugaaagcggccagguuggugagcgggugugggugcuuagaagaaaaacaaaucgaggcucuuuaggcugagguuuaggcacccauggguggcgaugcuagaaggaagcacagggaggcuucaggaugguuuguagugauugguucaggaccugggauaccaagccuccugucuuccucauuaggugcgguauggacaagagggauagcgucaaaucaggaacugccccgcgaaugccgucuucacgacccccuggccuucugaccccuaggccuccuucuggguccgcucgaccuccucccccugugaccacugcugcccuucgagucuuggaagcaaacggagcuauggggcgaaggucccugguggagcgagccccaggcgucugcaaagccgcucuuccacagaccagcaaagccgcucuuccacagaccagcaaagccgcucuuccacagaccagcaaagcagcucuuccacagaccagcaaagcagcucuuccacagaccacuauucacggggcaccagcgcgcagugcuggggcagguccucguagcccagguacucagcuuuauuugugaccuccaucugcacucugcuuaccuucucucuuccuucuuagauacuccucuuuuucagaaguaccacugauuuuugucuucucccugaagccaacaggcccccagcuucugggaaaggagagagggccccuaugaagaccccuggccagggcucuauuucuagccccgggcgugccagcagugggauugccagguaauaaguuaauucccccaacucccuaauuccccaagcaaggguuagcaauuuggaaccuuuugaucuuagacaugaaugggcuggaaagguagcuuggugugcuaaagugcuugcugcacaaauaugagguccugaguuugaaacuucagcaccuauguaaaagcugaucuugauguaucacuguaaccucagcucugggugggaagaaaagagguguguuucuggugcucagcagaggaagugucaaacaucaguuucugugagagauccugucccccaaaaaauagccaaguguaguagcacuugcuguuaaucccagcucuuagaagccagaggcauguggaucucuguaaguucaaggccagccuacacaguccacauaguaauaauaagcaaaacagaaaauaaaacaaggcagaaaaauggguccagcuaaauguugguguuuaucucuggccuccacaugcacaggcaauggggggcgaugggugaguacaacuguauacacaugugcacacacauacacaaaaauauuacauaugagauagcucaggaacacuugcagauaauggacacaaauugggcaaaagccauuauugguugggucacagaaagucaagcaacucuauuucacagaugggaaaaugugaaauug

SEQ ID NO: 10299 - RNA, 2501 nt, Mus musculus
aguuugaagagaagggguggggaaguaagaaguaguuccaggcuccccuacccccucgccugcaugcccaacucuacuaccuggaacaguccagguugaggaaaagaguuaguuccuacuccagcccuccaaaauucaggaugggccacaagcuucagcagagacagucaagaccuuggguuagcuuccuguggcugggcacagcuccugauggcaggccagcucuggaagagggauaguccucugcucuuggucuuccccugccggccggaagccuguggugccugugccuccacugagcuuuagugccagcuggggaugcuuagggguugaaggaaauucuccccagaaccacuucgcugacaccuguccagguggagcaucuacaggauaccaguuugcccccacagccaggagguagagggacugcagacuucuacagacccuugucucaggaauaucucuccuuguuagcgaucgcguggcguggaguggggucgaccugauagcgucuguagugaggcggggccgaacaaucccgggggcggggcggggcggcuccuggcccagcccgcccugacucacccucucuggcccgcccgggaacucugcgggaguccgggucgaucuacucccaggcaucuagaaguugggccccggaguuccaucccugagcagugaguaaguagcgggggcuugggaggcuuucgucccaccguguagaucaaccuggacccagggaauggcccggaggaguggagggagucgcucaggugugggugguuccguggccuuggccggagcaaucccacacacauugaaagcccgggcugggagaggggugcgguaauccccagcuuggccccagggagcugguguccugggauccaggcaguucgggaucaagcgaaggaagagagaucaacaggcaggagucgacuuugacagucuuuggcagccugucccagcguggggugguggagguagcugagaaagacagagcucaucuucaugagcgcccuaaaagcugcagaaccccacccucacaagccugcucccuuacauuucaagguucuuauauuugaagacuacaaaaaacccuuccaaaucccagcagaauaagcuugggaaggggcuagccuaggagucuauaggcccccaagacuuuccucuaggggugucuuucccuuaccucuuuaucccccuugugagaaguguagggauuaguuuuucaagagcuuaauuuuuuucuuuacuaguuaguuaguuaguuagugugugugugcauacaugccacggcacucucaucgaggucagagacaacuuguaguaauugguucucuccuuccaccuaugggucccugagauugcacugaggucuucuagcuuggcaacaggugccuuuguccaaugagccaccuccgcagcccuguguuuugggguguugcuguuguuguuguugguuuguuggagacaaggucauauaaugcuggccuguuucuaacaagcuugcuugcuacacagcuuagggugagcucaauguguuggucgucuugccucuauccuaaggaguaugauagagaugugcacccaccauuccagguuuuaugagaugcugggaauugaacccagggccugaauaagcacucuaucaacuaggccacauuccuaguucugacuuuguauucuaaaaguugaaaacucuucugucucuucucggcccuuagcauaugagcuacagcuggggagacaggcugagguugggaacauccccugccuccauugcaucagcaggagcagugcuaaggcuuagcugugggaaggagcuugcaagauaggaaggggguguugguagaucuaggcuacccugcccacuucuaugugggugcugggaauaucacucggauccucgugcuugugcaucagauauuucacuuacugaaccauuuccccaaagcgcacuccuuacauacauagaggcugcaucucaaugaggggugcuuucaguggguggaaacagaguuggugccaucaaacaggagguagacuuuggcugggcaggcucaagugauacuuguagcagugaaauccucagcgaguuauguucauccuccaagaugaaaggacaaagacccucacacuuauacuucccaaacugggauaaaacucagcauuaggcuagacaugguggcacaccucuguaaucccaguacauuuucgguucaucuuguucuacauagccagcaccagccuagacaaggcuacauaguaagaccuuguuucaaaaaacuugagggauacaagagggcuggaggguggaccaguggguaaagugcuugcugcaaaggcaggcgcaccugaguuugcaucucaugcccacauuaaaggaacucuagccaaccugagcauggcaagcauggcuguggcaggccuugccguucucccccgacccccauuuccaucugcuuugcuaaaaacuguuagauuacauuucugaagcu

SEQ ID NO: 10300 - RNA, 2501 nt, Mus musculus
agcuucagaaauguaaucuaacaguuuuuagcaaagcagauggaaaugggggucgggggagaacggcaaggccugccacagccaugcuugccaugcucagguuggcuagaguuccuuuaaugugggcaugagaugcaaacucaggugcgccugccuuugcagcaagcacuuuacccacugguccacccuccagcccucuuguaucccucaaguuuuuugaaacaaggucuuacuauguagccuugucuaggcuggugcuggcuauguagaacaagaugaaccgaaaauguacugggauuacagaggugugccaccaugucuagccuaaugcugaguuuuaucccaguuugggaaguauaagugugagggucuuuguccuuucaucuuggaggaugaacauaacucgcugaggauuucacugcuacaaguaucacuugagccugcccagccaaagucuaccuccuguuugauggcaccaacucuguuuccacccacugaaagcaccccucauugagaugcagccucuauguauguaaggagugcgcuuuggggaaaugguucaguaagugaaauaucugaugcacaagcacgaggauccgagugauauucccagcacccacauagaagugggcaggguagccuagaucuaccaacacccccuuccuaucuugcaagcuccuucccacagcuaagccuuagcacugcuccugcugaugcaauggaggcaggggauguucccaaccucagccugucuccccagcuguagcucauaugcuaagggccgagaagagacagaagaguuuucaacuuuuagaauacaaagucagaacuaggaauguggccuaguugauagagugcuuauucaggcccuggguucaauucccagcaucucauaaaaccuggaauggugggugcacaucucuaucauacuccuuaggauagaggcaagacgaccaacacauugagcucacccuaagcuguguagcaagcaagcuuguuagaaacaggccagcauuauaugaccuugucuccaacaaaccaacaacaacaacagcaacaccccaaaacacagggcugcggagguggcucauuggacaaaggcaccuguugccaagcuagaagaccucagugcaaucucagggacccauagguggaaggagagaaccaauuacuacaaguugucucugaccucgaugagagugccguggcauguaugcacacacacacuaacuaacuaacuaacuaguaaagaaaaaaauuaagcucuugaaaaacuaaucccuacacuucucacaagggggauaaagagguaagggaaagacaccccuagaggaaagucuugggggccuauagacuccuaggcuagccccuucccaagcuuauucugcugggauuuggaaggguuuuuuguagucuucaaauauaagaaccuugaaauguaagggagcaggcuugugagggugggguucugcagcuuuuagggcgcucaugaagaugagcucugucuuucucagcuaccuccaccaccccacgcugggacaggcugccaaagacugucaaagucgacuccugccuguugaucucucuuccuucgcuugaucccgaacugccuggaucccaggacaccagcucccuggggccaagcuggggauuaccgcaccccucucccagcccgggcuuucaaugugugugggauugcuccggccaaggccacggaaccacccacaccugagcgacucccuccacuccuccgggccauucccuggguccagguugaucuacacggugggacgaaagccucccaagcccccgcuacuuacucacugcucagggauggaacuccggggcccaacuucuagaugccugggaguagaucgacccggacucccgcagaguucccgggcgggccagagagggugagucagggcgggcugggccaggagccgccccgccccgcccccgggauuguucggccccgccucacuacagacgcuaucaggucgaccccacuccacgccacgcgaucgcuaacaaggagagauauuccugagacaagggucuguagaagucugcagucccucuaccuccuggcugugggggcaaacugguauccuguagaugcuccaccuggacaggugucagcgaagugguucuggggagaauuuccuucaaccccuaagcauccccagcuggcacuaaagcucaguggaggcacaggcaccacaggcuuccggccggcaggggaagaccaagagcagaggacuaucccucuuccagagcuggccugccaucaggagcugugcccagccacaggaagcuaacccaaggucuugacugucucugcugaagcuuguggcccauccugaauuuuggagggcuggaguaggaacuaacucuuuuccucaaccuggacuguuccagguaguagaguugggcaugcaggcgaggggguaggggagccuggaacuacuucuuacuuccccaccccuucucuucaaacu

SEQ ID NO: 10301 - RNA, 2501 nt, Mus musculus
acagagcgagcauccagaaauguacuuggucuuacaggacaauuaguaggaaauacaucaaugucaagccucaacccuggcugguuugacuuuccaaguaagaucaggaguucauguggcugacucaacgguuuaaaguccugagggucuggacgugagaucucacaguuagcuuugcuaacacgaucguucagaaaaaccuaaguccaaacaguggcucaugcuuuuccaucacagugauccccuuagaaggccuaggucuuuugguaaauauuuuccacccuggggaaugaacccagggcuauguucaugcuggguaagcacuuugcccgucagccucuuuuuacuuuauuauuauuauuauuauuauuauuauuauuauuauuauuauuauuauagcgagagucucccuauguugccugggcuagccuugaacucauucuguugcccaggcuagccuugaacuugagaucccccugcuucggguguccaagaagcaagaacuacaagaccugcaccgccagcagguccagccuaucaagccugcucuuuugagaaacuacccucagcaagagaauggguaguuaaaaggcuaccugcggugaaggugaagacuggagaggagggaacucucugaaguugguugcugauguaauuaaucauccuucuucagaaagggaggcaaaacccaauuaagaaaaccccuaguaacguuaccaguuuauucuaguauguaacaguuaauaauuuauagcauaguugaucaguaucgcuccugcaggaaagaggugaaauucuuaaaaggaaaggaaaaugcacaauuaagcaacgguuucuuuuaaaacuuggaagcuucggugagaagcaaacgucguuuuuuaggcauuugaggggaaggcaaacuguggagaggccacaccuuguggccuuugggccugcauggcugucacagcagcagcagcagcugaaguguauucucuaggggcgaaggcagaaagucuggccggguuccuccagagcuggaagucuggcucuugcaaacaucucccagcgcccuccuggccaagcacagcaccagaggaaacaaaaacuuaaaaaaaacaauuugcgcagggaacaaugcgacggaguuucgcuuugguuucacacucaagucuaaaugugguuauaauuuucaggcacgcacucauaaaaggcaagagucgaggcagagacuuuuaggaugcggagaagagccccgcgucuguucucaagcgugccguaggcuacacaaaagucgugggaaagcaaaaauacagauguuuccaggcaaacggcccaaagcuguucagccucaaccaucacggucuccaaacaaccagaaacacacccaaagcgguucccccugcacaugaguguaggacucugaguggcguggggugugccuggccacccuuccagccccgacccacucgcgcgccccgccgcugagagccuuggcgaugaggguucaaaucucacuggcuccucgguacccucaccccgccgugguacacgcuaagcuucagucccuuccuaacucucccgcacccaguguauaacaaaggagguuccguaauggaugugcgaucgcugcccacagggacuaggagagggagacccgggggaagaaugcaccuggccgugccacccgcgguacccucgagggccaggcggcuugacugcgccaggcgcuggacaaagaggccucgcggggcgucaggggugcagggagggaggcuggggagcgcagcccgcagggaacucaccuucgcagcugcucggcugcgcuccucguggagcagaagggcggcgaagagcagcagaagccagacgcugagccggggccccaugguggcgcgcccggggcggcaggggaccagcagagacggcggggaaaugcagcccaguucccgugggccacggcgaggugcucagucucggagggcccgggcgugagcccugcucaccgucccgggugcggugacucugcgcagagaccugagcgcgccgcccgaggagcuccccaauuuguuggcgcugcccccuccccucggcagugcgcgggcggcgucuccaaggggaggacccugcggcgcggguaagaggcggaggcugcgcgccgcucgggacuuggugucgcagggaguccgaacgccggggcucugcgcuccgcacccagcuccucccgcgccccgauuccacgagccccuuggcucgccaaucccgggcaagcaccagcaaggcacgccggggccgagaguccggcgcccacggagcagagccaggccggccuggccgccggugugccacgggccaacgcuucuucaggggcccaugcgcgcgggcagcagcuccugacccugaggugagagcgacccccgggaggcacagagagccaggccccaagucgcggaccuguagcgccggaguaggcugaggcugcgcgcuccguuggaucggagcugggggaauagggaucg

SEQ ID NO: 10302 - RNA, 2501 nt, Mus musculus
cgaucccuauucccccagcuccgauccaacggagcgcgcagccucagccuacuccggcgcuacagguccgcgacuuggggccuggcucucugugccucccgggggucgcucucaccucagggucaggagcugcugcccgcgcgcaugggccccugaagaagcguuggcccguggcacaccggcggccaggccggccuggcucugcuccgugggcgccggacucucggccccggcgugccuugcuggugcuugcccgggauuggcgagccaaggggcucguggaaucggggcgcgggaggagcugggugcggagcgcagagccccggcguucggacucccugcgacaccaagucccgagcggcgcgcagccuccgccucuuacccgcgccgcaggguccuccccuuggagacgccgcccgcgcacugccgaggggagggggcagcgccaacaaauuggggagcuccucgggcggcgcgcucaggucucugcgcagagucaccgcacccgggacggugagcagggcucacgcccgggcccuccgagacugagcaccucgccguggcccacgggaacugggcugcauuuccccgccgucucugcugguccccugccgccccgggcgcgccaccauggggccccggcucagcgucuggcuucugcugcucuucgccgcccuucugcuccacgaggagcgcagccgagcagcugcgaaggugaguucccugcgggcugcgcuccccagccucccucccugcaccccugacgccccgcgaggccucuuuguccagcgccuggcgcagucaagccgccuggcccucgaggguaccgcggguggcacggccaggugcauucuucccccgggucucccucuccuagucccugugggcagcgaucgcacauccauuacggaaccuccuuuguuauacacugggugcgggagaguuaggaagggacugaagcuuagcguguaccacggcggggugaggguaccgaggagccagugagauuugaacccucaucgccaaggcucucagcggcggggcgcgcgagugggucggggcuggaaggguggccaggcacaccccacgccacucagaguccuacacucaugugcagggggaaccgcuuuggguguguuucugguuguuuggagaccgugaugguugaggcugaacagcuuugggccguuugccuggaaacaucuguauuuuugcuuucccacgacuuuuguguagccuacggcacgcuugagaacagacgcggggcucuucuccgcauccuaaaagucucugccucgacucuugccuuuuaugagugcgugccugaaaauuauaaccacauuuagacuugagugugaaaccaaagcgaaacuccgucgcauuguucccugcgcaaauuguuuuuuuuaaguuuuuguuuccucuggugcugugcuuggccaggagggcgcugggagauguuugcaagagccagacuuccagcucuggaggaacccggccagacuuucugccuucgccccuagagaauacacuucagcugcugcugcugcugugacagccaugcaggcccaaaggccacaagguguggccucuccacaguuugccuuccccucaaaugccuaaaaaacgacguuugcuucucaccgaagcuuccaaguuuuaaaagaaaccguugcuuaauugugcauuuuccuuuccuuuuaagaauuucaccucuuuccugcaggagcgauacugaucaacuaugcuauaaauuauuaacuguuacauacuagaauaaacugguaacguuacuagggguuuucuuaauuggguuuugccucccuuucugaagaaggaugauuaauuacaucagcaaccaacuucagagaguucccuccucuccagucuucaccuucaccgcagguagccuuuuaacuacccauucucuugcugaggguaguuucucaaaagagcaggcuugauaggcuggaccugcuggcggugcaggucuuguaguucuugcuucuuggacacccgaagcagggggaucucaaguucaaggcuagccugggcaacagaaugaguucaaggcuagcccaggcaacauagggagacucucgcuauaauaauaauaauaauaauaauaauaauaauaauaauaauaauaauaaaguaaaaagaggcugacgggcaaagugcuuacccagcaugaacauagcccuggguucauuccccaggguggaaaauauuuaccaaaagaccuaggccuucuaaggggaucacugugauggaaaagcaugagccacuguuuggacuuagguuuuucugaacgaucguguuagcaaagcuaacugugagaucucacguccagacccucaggacuuuaaaccguugagucagccacaugaacuccugaucuuacuuggaaagucaaaccagccaggguugaggcuugacauugauguauuuccuacuaauuguccuguaagaccaaguacauuucuggaugcucgcucugu

SEQ ID NO: 10303 - RNA, 2501 nt, Mus musculus
agcugcucggcugcgcuccucguggagcagaagggcggcgaagagcagcagaagccagacgcugagccggggccccaugguggcgcgcccggggcggcaggggaccagcagagacggcggggaaaugcagcccaguucccgugggccacggcgaggugcucagucucggagggcccgggcgugagcccugcucaccgucccgggugcggugacucugcgcagagaccugagcgcgccgcccgaggagcuccccaauuuguuggcgcugcccccuccccucggcagugcgcgggcggcgucuccaaggggaggacccugcggcgcggguaagaggcggaggcugcgcgccgcucgggacuuggugucgcagggaguccgaacgccggggcucugcgcuccgcacccagcuccucccgcgccccgauuccacgagccccuuggcucgccaaucccgggcaagcaccagcaaggcacgccggggccgagaguccggcgcccacggagcagagccaggccggccuggccgccggugugccacgggccaacgcuucuucaggggcccaugcgcgcgggcagcagcuccugacccugaggugagagcgacccccgggaggcacagagagccaggccccaagucgcggaccuguagcgccggaguaggcugaggcugcgcgcuccguuggaucggagcugggggaauagggaucgcgcugcaugggcugaggagcuccaggcagggccuacggagaagaaucucccuuuuucugucuccugaugggacagaacuuuggucaccccgcaaggaaacgagggacauuaugcggagucagggugcuaagaugacgaugcucucucugccugccaccuuugcuaacccgcuuugucucuugccuccagguuaggaagggaucgagccgagucuagagcucaaagacugggaucauggaccgagugcgguucaaagcgucuggcccuccccugcgaggguaagucgccuucugccuggucuccuaggugaaggggaccuugcaugcauauuucaggaguugacaaguuggggcccgcauguuuuggucgcuuucuuacccucccucccucuccugugcagguggcugcugcuagcaacugugacagugggacuccuggcucagagcgucuuggggguaaguaccgcuugaacuccacggcgcuuggaguuccgcgcccgugacggguugggacgcucgcggagccucguggaagacaggcucgucgagcccaccugagugugcgugugcauuguaggugugugcuacugugucugccagccgcucgucccgugcagugcaggagucggcccucucuagggagcuaauaauuaaaacguagccucaggcaccuuuugcugccaagcuuuggccuuagcagcaagggaagaaugucuaucacuaggccacgaggcgcacggacagagggggcugggagcaaagaguuuccagaaacucagaggugguguccaggcacuguggugggcagagagcaucuugcuuaaauaugagucucuggggaggggcggggcaaggaggagacagccuccugcuuuaagguuguucggggacaaagggauagaaaccgcggucucuuccaaaccuugaguaggcccugaagagccacagaccagagggaggccuguggucccuggcuucugugacuuguuuacuguaccuguugcuccuugaaagaccaaaccaggccugccagaacagccuuugaacugaacuggagagaugcucuggggcucccucgcauuuuaaauguagccacuccuuauaccaguaccagugugugugugugggggggggggucuucucauagguagugcuguuuaaaagaaacaugaaaauugagaacccuggccagguguccuaugugcccuguuuacuugucuguggaauaccugaguuccaaguagacacagcuugggacaccaguacacucugugucuggaaccaacacaccuuuggggaaggagcccugcuucagccuccuucccuucccucaccuagcuggaaccaucagugguucucaggcuugcagaaagugggcacugguuccaccacacaguuggucuccugcucugcugggaugcagagcccagcaugaggagaaagcggagcucugaccagacuggccgcucagcccuggccagucuuauagcuugagucugucuccuuccugccccaguccucaguccugacauaagagcagaaccuaaauguuggaacagcccauuacuuaugggcccucaugcaugacucccacuuggccgggauccguagaccacagccgcacuuaaacccacguuccuagaaagugacacccaguguggugacucccacaguccugagccgcugcacagccaucuaugucuuuuauccugagaacaaagaccuuaccuggcaucguuuuguuuuguuuuuuccaacucccaaaaggguuugcuauggaaaagcaauuuaccc

SEQ ID NO: 10304 - RNA, 2501 nt, Mus musculus
ggguaaauugcuuuuccauagcaaacccuuuugggaguuggaaaaaacaaaacaaaacgaugccagguaaggucuuuguucucaggauaaaagacauagauggcugugcagcggcucaggacugugggagucaccacacugggugucacuuucuaggaacguggguuuaagugcggcuguggucuacggaucccggccaagugggagucaugcaugagggcccauaaguaaugggcuguuccaacauuuagguucugcucuuaugucaggacugaggacuggggcaggaaggagacagacucaagcuauaagacuggccagggcugagcggccagucuggucagagcuccgcuuucuccucaugcugggcucugcaucccagcagagcaggagaccaacugugugguggaaccagugcccacuuucugcaagccugagaaccacugaugguuccagcuaggugagggaagggaaggaggcugaagcagggcuccuuccccaaagguguguugguuccagacacagaguguacuggugucccaagcugugucuacuuggaacucagguauuccacagacaaguaaacagggcacauaggacaccuggccaggguucucaauuuucauguuucuuuuaaacagcacuaccuaugagaagacccccccccccacacacacacacugguacugguauaaggaguggcuacauuuaaaaugcgagggagccccagagcaucucuccaguucaguucaaaggcuguucuggcaggccugguuuggucuuucaaggagcaacagguacaguaaacaagucacagaagccagggaccacaggccucccucuggucuguggcucuucagggccuacucaagguuuggaagagaccgcgguuucuaucccuuuguccccgaacaaccuuaaagcaggaggcugucuccuccuugccccgccccuccccagagacucauauuuaagcaagaugcucucugcccaccacagugccuggacaccaccucugaguuucuggaaacucuuugcucccagcccccucuguccgugcgccucguggccuagugauagacauucuucccuugcugcuaaggccaaagcuuggcagcaaaaggugccugaggcuacguuuuaauuauuagcucccuagagagggccgacuccugcacugcacgggacgagcggcuggcagacacaguagcacacaccuacaaugcacacgcacacucaggugggcucgacgagccugucuuccacgaggcuccgcgagcgucccaacccgucacgggcgcggaacuccaagcgccguggaguucaagcgguacuuacccccaagacgcucugagccaggagucccacugucacaguugcuagcagcagccaccugcacaggagagggagggaggguaagaaagcgaccaaaacaugcgggccccaacuugucaacuccugaaauaugcaugcaagguccccuucaccuaggagaccaggcagaaggcgacuuacccucgcaggggagggccagacgcuuugaaccgcacucgguccaugaucccagucuuugagcucuagacucggcucgaucccuuccuaaccuggaggcaagagacaaagcggguuagcaaagguggcaggcagagagagcaucgucaucuuagcacccugacuccgcauaaugucccucguuuccuugcggggugaccaaaguucugucccaucaggagacagaaaaagggagauucuucuccguaggcccugccuggagcuccucagcccaugcagcgcgaucccuauucccccagcuccgauccaacggagcgcgcagccucagccuacuccggcgcuacagguccgcgacuuggggccuggcucucugugccucccgggggucgcucucaccucagggucaggagcugcugcccgcgcgcaugggccccugaagaagcguuggcccguggcacaccggcggccaggccggccuggcucugcuccgugggcgccggacucucggccccggcgugccuugcuggugcuugcccgggauuggcgagccaaggggcucguggaaucggggcgcgggaggagcugggugcggagcgcagagccccggcguucggacucccugcgacaccaagucccgagcggcgcgcagccuccgccucuuacccgcgccgcaggguccuccccuuggagacgccgcccgcgcacugccgaggggagggggcagcgccaacaaauuggggagcuccucgggcggcgcgcucaggucucugcgcagagucaccgcacccgggacggugagcagggcucacgcccgggcccuccgagacugagcaccucgccguggcccacgggaacugggcugcauuuccccgccgucucugcugguccccugccgccccgggcgcgccaccauggggccccggcucagcgucuggcuucugcugcucuucgccgcccuucugcuccacgaggagcgcagccgagcagcu

SEQ ID NO: 10305 - RNA, 2501 nt, Mus musculus
agcugguuuugguuugcuaugcuaaagggucaauuggggagagggcagggauuuuaaacaguacacaaugcaggaaaagguaacccuuuaggguagauguuccacacagaaucccgaacaauauuaacccgucuucucugcucccuccaggcgacuggcagcccagcaaagcaggcacaaaguuggugauauggaccacuguugacucuguaccuuguuccccugagcauguguacacagacaucaagaaugugaagagggggccuggccacccggcaaggcucccgucaucugccuucacacuuaggcuuccaggaacacaaaagcagccgaggaggccuggaaaugaguugaacggcucccgcccccacagagggaaucagcaaguucucaggcaguguuacaaaauccccugcugaccaacauuccggauucaucauauccucggccuugacgaagaaaguggcuccacccaccaaauugaaacagcuagcggggacacaguuacccugugcugugucggccacacaucuaucgcuacuccagaaacauuaagagguguggggaaagcugaccaauucugcuuucuccucuuacaaacccagagcagcaggcaagccauuuaagccaagcguagaggcggagcucugucggaggcuggaaaaggaguccagagucugacuagucuugacucugagauauugcauucaugagugcucaguggcagguagacagccugagaaaacucggaggcucugccugcaacgcggaguaaagaccagagccaaaggaaagacagggaaaguagaaaucaguccauuucccacgguggcuaaguaaggaacggggaagacagaggagggagggaagcuccccagaccuucacuaacucagcuugaucagaauguauuacauagccaacagauugauacgcgcaagacaaggagucagggauuaggagcgaggcuuuugaguacaucacucuuuuuugguuuuucaagacggguuucucuguauagcccuggcuguccuggaacucacucuguagaccaggguggccucgaacucagaaauccuccugccucugccucccaagugcugggauuaaaggcgugcgccaccacacuuuacacaacauaaaaagucagaacuugggaguuucauacauuggaaaccucucucccugaaacuauaccauacuauuuccggguucguuuguuucacuuaaaguaucuuauuucuuuaucauggaaaagggagaagacagaagcaaauuaaucgggaaaguccaagacgaaguuguacacgcacuaaaaauaauucacuaccuaucuuaaaaaugccaguacaggaagcuauuccacucacgugacuugcgcaccagccaagacucggcacuggguaaauaaccgugagucgaggaggcugggcgauuccaacucuacuucccagucgccuuacauccagcagagugguccaacgcucucugacucaguuuccucguucauaaagaagucgguaauagcagcggugcucaacucccaaggcugcuuuguacaccaaaggagggcacccugagggggacauuaaagcaccuaagaagcgagagucguacugaucggagaucucucccaggauaacccgaaucuucgcgaagacgcacagagugcugcugaacuggagauuuucucaaucggcaaagcaaggcaagugggaacagaggugcaaugaaugucacagcccaaaguggagaccccgcggcugcccacagacgacuccucgaccccgcagagccccgaagcccgccugucccggcggcgccgcccucaccugcggugucccauauggagauguugaaggaacgccacugcuucagguagaaggcgccgcccacggugcugaccguguccgggaagcgacgcuccauguagcgcugcagcagcgacguuuuacccacguucaugucccccagcaguacgaucuucccauccggcuuccgcauagccgcggaggagaugaccccugcgcuucucggucacccgcccaggaugccaggggacgcggaccccggccuccagggaccccgaacucuaguggcccuggccugagauccgaacucgaugaagugccaaagaggaagcgcgccacagcucuguaccggagugugaacgcagcccugcgaccacgugggugcccggccgccacgcccaccccacgcccccugguccgccuaggccccgcccccagucuucucccaagccccuuccacacuccccaucaccccugccucguuccuauuacucccuaucucuccuuccccaaauucccuuucucugccugcuaaaucucagccccacgcccaccccuccccauucuuucccauucccccucccucaaggaccguccugcguccgucccuauaaucccaaacuccguuccuccuuuauuuuucugcccuucccagagcccuggccccuaccucccgccccagcuccuuccca

SEQ ID NO: 10306 - RNA, 2501 nt, Mus musculus
ugggaaggagcuggggcgggagguaggggccagggcucugggaagggcagaaaaauaaaggaggaacggaguuugggauuauagggacggacgcaggacgguccuugagggagggggaaugggaaagaauggggaggggugggcguggggcugagauuuagcaggcagagaaagggaauuuggggaaggagagauagggaguaauaggaacgaggcaggggugauggggaguguggaaggggcuugggagaagacugggggcggggccuaggcggaccagggggcguggggugggcguggcggccgggcacccacguggucgcagggcugcguucacacuccgguacagagcuguggcgcgcuuccucuuuggcacuucaucgaguucggaucucaggccagggccacuagaguucggggucccuggaggccgggguccgcguccccuggcauccugggcgggugaccgagaagcgcaggggucaucuccuccgcggcuaugcggaagccggaugggaagaucguacugcugggggacaugaacguggguaaaacgucgcugcugcagcgcuacauggagcgucgcuucccggacacggucagcaccgugggcggcgccuucuaccugaagcaguggcguuccuucaacaucuccauaugggacaccgcaggugagggcggcgccgccgggacaggcgggcuucggggcucugcggggucgaggagucgucugugggcagccgcggggucuccacuuugggcugugacauucauugcaccucuguucccacuugccuugcuuugccgauugagaaaaucuccaguucagcagcacucugugcgucuucgcgaagauucggguuauccugggagagaucuccgaucaguacgacucucgcuucuuaggugcuuuaaugucccccucagggugcccuccuuugguguacaaagcagccuugggaguugagcaccgcugcuauuaccgacuucuuuaugaacgaggaaacugagucagagagcguuggaccacucugcuggauguaaggcgacugggaaguagaguuggaaucgcccagccuccucgacucacgguuauuuacccagugccgagucuuggcuggugcgcaagucacgugaguggaauagcuuccuguacuggcauuuuuaagauagguagugaauuauuuuuagugcguguacaacuucgucuuggacuuucccgauuaauuugcuucugucuucucccuuuuccaugauaaagaaauaagauacuuuaagugaaacaaacgaacccggaaauaguaugguauaguuucagggagagagguuuccaauguaugaaacucccaaguucugacuuuuuauguuguguaaagugugguggcgcacgccuuuaaucccagcacuugggaggcagaggcaggaggauuucugaguucgaggccacccuggucuacagagugaguuccaggacagccagggcuauacagagaaacccgucuugaaaaaccaaaaaagagugauguacucaaaagccucgcuccuaaucccugacuccuugucuugcgcguaucaaucuguuggcuauguaauacauucugaucaagcugaguuagugaaggucuggggagcuucccucccuccucugucuuccccguuccuuacuuagccaccgugggaaauggacugauuucuacuuucccugucuuuccuuuggcucuggucuuuacuccgcguugcaggcagagccuccgaguuuucucaggcugucuaccugccacugagcacucaugaaugcaauaucucagagucaagacuagucagacucuggacuccuuuuccagccuccgacagagcuccgccucuacgcuuggcuuaaauggcuugccugcugcucuggguuuguaagaggagaaagcagaauuggucagcuuuccccacaccucuuaauguuucuggaguagcgauagauguguggccgacacagcacaggguaacuguguccccgcuagcuguuucaauuugguggguggagccacuuucuucgucaaggccgaggauaugaugaauccggaauguuggucagcaggggauuuuguaacacugccugagaacuugcugauucccucugugggggcgggagccguucaacucauuuccaggccuccucggcugcuuuuguguuccuggaagccuaagugugaaggcagaugacgggagccuugccggguggccaggcccccucuucacauucuugaugucuguguacacaugcucaggggaacaagguacagagucaacagugguccauaucaccaacuuugugccugcuuugcugggcugccagucgccuggagggagcagagaagacggguuaauauuguucgggauucuguguggaacaucuacccuaaaggguuaccuuuuccugcauuguguacuguuuaaaaucccugcccucuccccaauugacccuuuagcauagcaaaccaaaaccagcu

SEQ ID NO: 10307 - RNA, 2501 nt, Mus musculus
gggacuuacccuagaaugccgauggcagaacucauugggucgagagcaaucaucaaaacagagaagcagcagcaaggguagaaaaagaucagccaucugccccauccugcuguagaugccuggggcagcaccauggugaggggagggugggagguggggugggggaggggggagcagggguggggcacagcuugucaccugaucuuggcuuccacacuggguaacagugccaaagcagcuauggugacacucaacagcuguagcaccgcuaucaggaaagcagcuuugacagggauuguccagucagccgauuagacacaagucaaagcaaaggccccaauggcucacacagcgccauccuaacaucaugugauccuuacuucaccccagaagaauucuuugaagggaaaaugccagcggaacccaacauugugaaaccauaccgauuuggcagguguugggggggggaguggggggggggcucugcaucacuacggagacccgugggccaguccagaucucaaucaaccucacgcaugcccuacgcugggguguguuccccucaugaauccacucagcccccacgcgcaccuucuggggagaguccugugcauacauaggcugcuggcugcaguuggcuguacgccugcuccauuccccaaggacauuauuaauagaaguuuguccugggccagcacagcccuugcagaggcaggugccggcccucuuccucacguugcuccccacccgcccguaugcauguucuuagcacaauuccagccaucguauuuuuggaccugcugcagcaagcaauuccagcuuugagaucuuucaauuccucuuucaggaaaacccugggucccuccggaggaagaccaaagaggagccccaccccucaccuccaauccaauaaagggacuggcagucuuaggaagccuuugaguuucaaaucacugcggauuuuucccacggguacuuucuuuucgaggguaggggaagauuuaguuucagagucuacugaagggaucucaguggagcccacucaaggauacgcuuucuacuccugaagaggagaggacuugugggucaacugagaaacuugggcucaagaauggagaagugcaagggggugcgaagaaggcucagugucuaagaguucuggggugcacgugguggugcgguccacacaaggauccuuacaucuccagaaaggauguuugggauucgacaguccccgggucuccuggacccucacagggugggagucggaacuugcggcccccaaaaguauggguucugggacgcccaggacccaccccgcgaccccuggcgcacgcucaccgucucggggucguucucgaacaccucucuggccuccucuuugcugcacaccuccuccacgcacucccguuccagguggcccugcuuggccuccucgaagacuugguaggcgcggcgcugccugggccgcagaaacugcgccgccucacgcgcccgcaacagcacagcugcagaaagaaggguguacggucaaccuacacccacucggggcuggaauguagggggucugggaugcuggggaucguaaugccugugugucugggaugcuccggguccgugaugccuagagcucagagguccggggacaggaugccagggugucugggguacccggcaccaggaugcugcgccgggguacaggccuggagccccacaccacgggguaguggguuugggggaccccugcgguacucacugugagaagacucggaagccagcaggagcagcagaagcgcagugcccagggcggcggcgggcccgggcgguggcggcauggcgaggccggugccggggagccuagcagccgggagcgugcggucagagcacccgggaggcugaagcgaggcgcggacgccgcgagacacgggcuccggucauccuggcuaagcgacggugaaggucacaucccugcggcggcagcgccgcacccggcgcucgcugcgguucugggccgugaaggaggcagcgggugagggcggggcuuagggcggguggggguggggccuagugugaguagggcggggccuuugggggcggggccgagcugggugaggcaaggcaggcugacugguucgacuccaguauccucaaaauuucacugcuagaaugcgguaaaaugaaaggagaauuguaucugggcaucugcccagguacaauuugaccguuuucuauccuccucugcagacaucguuuucggaaucuucauucuugggcacauuuucuaaagagaugcaacauccacuaaggaaacaauaacuguggccacacccaguggcguggagguccacggugcaagauguuauucccucugaaaucugauuuccacaccacaggcugaaagcagcauuguguauuuuccaguaccaaagcuuucuggcucuugucucagggcacuuugcaaggucauagaugcacacacacacacacacacacacacacac

SEQ ID NO: 10308 - RNA, 2501 nt, Mus musculus
gugugugugugugugugugugugugugugcaucuaugaccuugcaaagugcccugagacaagagccagaaagcuuugguacuggaaaauacacaaugcugcuuucagccugugguguggaaaucagauuucagagggaauaacaucuugcaccguggaccuccacgccacuggguguggccacaguuauuguuuccuuaguggauguugcaucucuuuagaaaaugugcccaagaaugaagauuccgaaaacgaugucugcagaggaggauagaaaacggucaaauuguaccugggcagaugcccagauacaauucuccuuucauuuuaccgcauucuagcagugaaauuuugaggauacuggagucgaaccagucagccugccuugccucacccagcucggccccgcccccaaaggccccgcccuacucacacuaggccccacccccacccgcccuaagccccgcccucacccgcugccuccuucacggcccagaaccgcagcgagcgccgggugcggcgcugccgccgcagggaugugaccuucaccgucgcuuagccaggaugaccggagcccgugucucgcggcguccgcgccucgcuucagccucccgggugcucugaccgcacgcucccggcugcuaggcuccccggcaccggccucgccaugccgccaccgcccgggcccgccgccgcccugggcacugcgcuucugcugcuccugcuggcuuccgagucuucucacagugaguaccgcaggggucccccaaacccacuaccccgugguguggggcuccaggccuguaccccggcgcagcauccuggugccggguaccccagacacccuggcauccuguccccggaccucugagcucuaggcaucacggacccggagcaucccagacacacaggcauuacgauccccagcaucccagacccccuacauuccagccccgaguggguguagguugaccguacacccuucuuucugcagcugugcuguugcgggcgcgugaggcggcgcaguuucugcggcccaggcagcgccgcgccuaccaagucuucgaggaggccaagcagggccaccuggaacgggagugcguggaggaggugugcagcaaagaggaggccagagagguguucgagaacgaccccgagacggugagcgugcgccaggggucgcgggguggguccugggcgucccagaacccauacuuuugggggccgcaaguuccgacucccacccugugaggguccaggagacccggggacugucgaaucccaaacauccuuucuggagauguaaggauccuuguguggaccgcaccaccacgugcaccccagaacucuuagacacugagccuucuucgcacccccuugcacuucuccauucuugagcccaaguuucucaguugacccacaaguccucuccucuucaggaguagaaagcguauccuugagugggcuccacugagaucccuucaguagacucugaaacuaaaucuuccccuacccucgaaaagaaaguacccgugggaaaaauccgcagugauuugaaacucaaaggcuuccuaagacugccagucccuuuauuggauuggaggugagggguggggcuccucuuuggucuuccuccggagggacccaggguuuuccugaaagaggaauugaaagaucucaaagcuggaauugcuugcugcagcagguccaaaaauacgauggcuggaauugugcuaagaacaugcauacgggcggguggggagcaacgugaggaagagggccggcaccugccucugcaagggcugugcuggcccaggacaaacuucuauuaauaauguccuuggggaauggagcaggcguacagccaacugcagccagcagccuauguaugcacaggacucuccccagaaggugcgcgugggggcugaguggauucaugaggggaacacaccccagcguagggcaugcgugagguugauugagaucuggacuggcccacgggucuccguagugaugcagagccccccccccacucccccccccaacaccugccaaaucgguaugguuucacaauguuggguuccgcuggcauuuucccuucaaagaauucuucuggggugaaguaaggaucacaugauguuaggauggcgcugugugagccauuggggccuuugcuuugacuugugucuaaucggcugacuggacaaucccugucaaagcugcuuuccugauagcggugcuacagcuguugagugucaccauagcugcuuuggcacuguuacccaguguggaagccaagaucaggugacaagcugugccccaccccugcuccccccucccccaccccaccucccacccuccccucaccauggugcugccccaggcaucuacagcaggauggggcagauggcugaucuuuuucuacccuugcugcugcuucucuguuuugaugauugcucucgacccaaugaguucugccaucggcauucuaggguaaguccc

SEQ ID NO: 10309 - RNA, 2501 nt, Mus musculus
ugacucagcagcucucucagguacucacaucuggcucgaucuuaaucagugcaagguccaguuuauggucgaugucuuugacgguggcuucauaccgggccccgcucuggagcucuaccuggaucuucugcugguuggugaggacgugggcauuggugacaaugagcccauccucagacacuaugaacccagagccgcuggaggaagggauuuccugguuggugagaggugaucuguuccggaacaagucaguagcgugagcagaagggagggaaaucagggaauccagccuuugugugugagucgcaggaagccucacguuuaucagcuacguuuccaguuuucucaugcauuuacucuugccuuacccacuuccaugugcuuugugagcugccugaagcucguccuggccaucuuuucugaacacaacugagaucuggguccaggauggugucuccuccuuuagaucagugugggaaccugugugucugucaucugcagcgaacaggccaaaccuggugcuaacccugugcucacacuacugccacagccucagaaucuagcucuuaguucccacuaccaacuggcguugugacucagaacaaacuaaguuugcucuccauuuggguuuccuugcaugcaagcgagugcuaaggcuaaacaagcccaccaaaugcucacuacuagcuccuacagucagccuuuaguuuugcugugggauaccggggagaaagaaacaccagucaccaauacgcacugcuguagcuucaauuuagaagccagaauccuugcgcuuggcucuuugcucuuuagcgaaauaacucuuagcaagucaggucuccugcaggcuuugcggaauucuacugcccaccuacaccccagccaacucuuugaaucuguguuuccucacagcgguuuuaauggucagaaaucuggcaaccagcaggugagguaguugauccuagaugggaccuuuaccugcggaacagcugcaaguggaccacagacggcgccaccuucuccaccacugcggcgaugaaguuguacuuucuccggagccgcccugcucuuguggucccugugaauaaacgguccacggugagugcgucccuggaugcaggugucgcaucucaaaauuccccagcaucuccccgucccucuuucucugaagguucuccagaccaggagaugaaaggacccucccuguccuaccagagggaagaaaaggagaaagggaagcccaguggcagccaguaaagagaccaaaauuaaccaggcaagaacaccaggaacaaccacaacagguugaaucccuagagauggcgaaggaaggcccacugaauucgcgagcgagcgaaguuagagcacucacuucaucucccucugaaaaguaagagaagugucaggagauucgcccgcgccccgcucaccugcuuccucgcaggcacccuucugcacuggcacagccgggagcgcgccccgcuggcgagcggcucgguucuccuugcggagcgcacauaggcugggguaggugcgcccaucgcugccgcacacuaccgcauccucagcacccuccgcgcagccgcaggugcccagccacgcgccccccgagggaucccgggagaacggggcgccgcagcgcagccuuggggcgcacggccggccccgcgccccgccacacuccuggcccucggccgcggcgcacacucggcagcagccgcagcgaucgggaaccggcgccaagccggccgagcagguaggcagagucgggcagcgcgugggaucgcaggcaucgggacagggcagcgagacucuggaccuccuggccucggcccacggaacaggcacggcugguagcagcaaccacagcaggagaaacuguguucgcacagcccacaaccgcuggaagcucaucuugcucccugaccucgucgauucgacuguuuuuccuggccuggaugcugccucagccagccuucggacuuuauaaaggucagagucuggcucacuucuacacacacacacccauauaucacccaccacccaugccaucccaggacaagggccacccaccccaaagccaugaagggagggguccacucaaaaaccagucuuggggcaagggagaaacgugaccacccacccacggccacgagaucugaccaggaaaacacacaaccagauuuccuauuucacauguuuuuauuacaaaacaagcaaccaaccaguuuuuagaaaaugacguuuugcuacauaccaauuaggagcucacacaacguaagaagcuggaguuuccaugcacuaagcucagugcuugcaggagguguuucacggcucaaacacuggcucaaacggggcaugccacaccuucauaaacagagggcccagcagucacacuguguguuuuugccaaauauucacuugauucaacgccuaccugguauaagugacuauaauugacucaggcaggcaauaacacagagagagaacgagggacugag

SEQ ID NO: 10310 - RNA, 2501 nt, Mus musculus
cucagucccucguucucucucuguguuauugccugccugagucaauuauagucacuuauaccagguaggcguugaaucaagugaauauuuggcaaaaacacacagugugacugcugggcccucuguuuaugaagguguggcaugccccguuugagccaguguuugagccgugaaacaccuccugcaagcacugagcuuagugcauggaaacuccagcuucuuacguugugugagcuccuaauugguauguagcaaaacgucauuuucuaaaaacugguugguugcuuguuuuguaauaaaaacaugugaaauaggaaaucugguuguguguuuuccuggucagaucucguggccguggguggguggucacguuucucccuugccccaagacugguuuuugaguggaccccucccuucauggcuuugggguggguggcccuuguccugggauggcauggguggugggugauauauggguguguguguguagaagugagccagacucugaccuuuauaaaguccgaaggcuggcugaggcagcauccaggccaggaaaaacagucgaaucgacgaggucagggagcaagaugagcuuccagcgguugugggcugugcgaacacaguuucuccugcugugguugcugcuaccagccgugccuguuccgugggccgaggccaggagguccagagucucgcugcccugucccgaugccugcgaucccacgcgcugcccgacucugccuaccugcucggccggcuuggcgccgguucccgaucgcugcggcugcugccgagugugcgccgcggccgagggccaggaguguggcggggcgcggggccggccgugcgccccaaggcugcgcugcggcgccccguucucccgggaucccucggggggcgcguggcugggcaccugcggcugcgcggagggugcugaggaugcgguagugugcggcagcgaugggcgcaccuaccccagccuaugugcgcuccgcaaggagaaccgagccgcucgccagcggggcgcgcucccggcugugccagugcagaagggugccugcgaggaagcaggugagcggggcgcgggcgaaucuccugacacuucucuuacuuuucagagggagaugaagugagugcucuaacuucgcucgcucgcgaauucagugggccuuccuucgccaucucuagggauucaaccuguugugguuguuccugguguucuugccugguuaauuuuggucucuuuacuggcugccacugggcuucccuuucuccuuuucuucccucugguaggacagggaggguccuuucaucuccuggucuggagaaccuucagagaaagagggacggggagaugcuggggaauuuugagaugcgacaccugcauccagggacgcacucaccguggaccguuuauucacagggaccacaagagcagggcggcuccggagaaaguacaacuucaucgccgcagugguggagaagguggcgccgucugugguccacuugcagcuguuccgcagguaaaggucccaucuaggaucaacuaccucaccugcugguugccagauuucugaccauuaaaaccgcugugaggaaacacagauucaaagaguuggcugggguguaggugggcaguagaauuccgcaaagccugcaggagaccugacuugcuaagaguuauuucgcuaaagagcaaagagccaagcgcaaggauucuggcuucuaaauugaagcuacagcagugcguauuggugacugguguuucuuucuccccgguaucccacagcaaaacuaaaggcugacuguaggagcuaguagugagcauuuggugggcuuguuuagccuuagcacucgcuugcaugcaaggaaacccaaauggagagcaaacuuaguuuguucugagucacaacgccaguugguagugggaacuaagagcuagauucugaggcuguggcaguagugugagcacaggguuagcaccagguuuggccuguucgcugcagaugacagacacacagguucccacacugaucuaaaggaggagacaccauccuggacccagaucucaguuguguucagaaaagauggccaggacgagcuucaggcagcucacaaagcacauggaaguggguaaggcaagaguaaaugcaugagaaaacuggaaacguagcugauaaacgugaggcuuccugcgacucacacacaaaggcuggauucccugauuucccucccuucugcucacgcuacugacuuguuccggaacagaucaccucucaccaaccaggaaaucccuuccuccagcggcucuggguucauagugucugaggaugggcucauugucaccaaugcccacguccucaccaaccagcagaagauccagguagagcuccagagcggggcccgguaugaagccaccgucaaagacaucgaccauaaacuggaccuugcacugauuaagaucgagccagaugugaguaccugagagagcugcugaguca

SEQ ID NO: 10311 - RNA, 2501 nt, Mus musculus
gaaugggccuggcagccagcaccgagcgcccuguuuacuccucucuuugugacgucgaguccccgugacugggugcgagggggccggcgcuccauucacgagccggggugggggcggggcgggaagcuugcguugggggcggggccuggcgagguaguaaugacucuucccucccccgggagagccggcgagcauuaauaaaucucuaagccagaggaggaaacucuggcuggggcagugcgugcagcuccggcggugcagcggugggggaaacggcggagcccacggcagaagcagcccuagcuagcaaaacacaccagaggcgacaaaccgagaggagcccucucucguaaacacacuccccugcucgaucgcuugccccgggugccgcgcgcccgccagcuuuggcgccagagaaggcugggacugcuauguaacguugaggcugcgggagguggaagcagggguguuagagggagaagagccuggggccaaguuugcgggucacuucugcaggcgcccucuuagcccucgccugguuccuucuuguuagccuagcuggcuccggugcccuuggccuucuccagcuagcuccccagcuuacugcguuuugccggcgacauggugacgauggaggaacugcgggagauggacugcagcgugcucaaaaggcugaugaaccgggaugagaacggcggcggcggcagcgcgggcggcaacggcagcggcagccacggcgccuuggggcugcugagcggcggcaagugccugcugcuggacugcaggccguuucuggcucacagcgcgggcuacauccgaggcucggugaacgugcgcugcaauaccaucgugcggcggagggccaagggcuccgugagccuggagcagauccugcccgccgaggaagaggugcgugcccgccugcgcucuggccucuacucggcugucaucgucuacgacgagcgcagcccgcgcgccgagagucuccgggaggacagcacggugucgcuggucgugcaggcguugcgccggaacgcggagcgcacggacaucugccugcuuaaagguaaacgugggugcccgggagagcgaggugggaggguagguaguguaagggacuuggcggccugagcccugcugggcauugggaggaaaguacccgagugacuacggggugcuggaguccccuuccucgcgugucuuugugcgugucagugugaacgguuuugcugugguuuggagccugagucccggggaggccgugcuggcgcguuuccccaaucaccugcaauccgcacgcgucuuggaguuuccguguuuguuuacgcgaacgguucuggccuggaugcuggcagcgguuccucugcgcagcccagcuucaaguacugagaacgcgcucuuaggucccacggggacgagagaggccugguucgguauaaccccgggaacccuagaggggggugaaggaaggugaaugcuaggguaggagcugucucaggaguucauacacaucggucaaugaggaaaggagaauuggggugcagaccuggggagcuaucucuuuuuuuccccgcugccuaaacucagagcuuucuuggauggcggccaacccccacuugccccggucuaagggaggcugaagugcuguauuuggggggguggggggacaccaggcacaaccgcgccugcuccugcuaaucccgggagcagagaguuaccaccuuuuguucacacaucauucucgacucugccagcggcgcgugccugguucgagcgaacccuggcguaggaaauuagguggccggagagaggguggcuugucacauugagaagucagacaccccaaaaggaucgcgcaguaucucagacguuggcaaaggggagggaccgcucgccgcaccugccagcucgcucggugugccggccaccgguuggggagcacuguagggugcggggugugugugugugugggggggucgggcgcccccugcugcgcugcuccccuaccuccggccaccgcauuccgugcauucuuucgcgcgggucuggucuuugcuuccaaagccuggagguuuguccgaccuccgccuuccaagagccgcccauuucccugccgaggcucuucgccccgucuuccagacuuuuccucuuagugucuugucuuccuuaaggaagggaggccgggagcgaaacccuuucucgcguccccuccgaacggcacccggugcgggcgagccaggcuggccgugcggaacagcggggggcuuuguucuccgcaguuguuuccugaccauuugacccgucagcugcuggggaaacgcugcuguugaucugaggcugaacugccagggcgauuuuuuucuuuucuuuucuuuuuuuuucuuccuuuucuuucuuuucuuuucuuuucuuuuuuuuuuuuuuuugcaaggaccgccuguggcuccugcagccgagccccagucucucagccggcucccuaaaacgcuuuaggagcgacg

SEQ ID NO: 10312 - RNA, 2501 nt, Mus musculus
cgucgcuccuaaagcguuuuagggagccggcugagagacuggggcucggcugcaggagccacaggcgguccuugcaaaaaaaaaaaaaaaagaaaagaaaagaaaagaaagaaaaggaagaaaaaaaaagaaaagaaaagaaaaaaaucgcccuggcaguucagccucagaucaacagcagcguuuccccagcagcugacgggucaaauggucaggaaacaacugcggagaacaaagccccccgcuguuccgcacggccagccuggcucgcccgcaccgggugccguucggaggggacgcgagaaaggguuucgcucccggccucccuuccuuaaggaagacaagacacuaagaggaaaagucuggaagacggggcgaagagccucggcagggaaaugggcggcucuuggaaggcggaggucggacaaaccuccaggcuuuggaagcaaagaccagacccgcgcgaaagaaugcacggaaugcgguggccggagguaggggagcagcgcagcagggggcgcccgacccccccacacacacacacaccccgcacccuacagugcuccccaaccgguggccggcacaccgagcgagcuggcaggugcggcgagcggucccuccccuuugccaacgucugagauacugcgcgauccuuuuggggugucugacuucucaaugugacaagccacccucucuccggccaccuaauuuccuacgccaggguucgcucgaaccaggcacgcgccgcuggcagagucgagaaugaugugugaacaaaaggugguaacucucugcucccgggauuagcaggagcaggcgcgguugugccugguguccccccacccccccaaauacagcacuucagccucccuuagaccggggcaaguggggguuggccgccauccaagaaagcucugaguuuaggcagcggggaaaaaaagagauagcuccccaggucugcaccccaauucuccuuuccucauugaccgauguguaugaacuccugagacagcuccuacccuagcauucaccuuccuucaccccccucuaggguucccgggguuauaccgaaccaggccucucucguccccgugggaccuaagagcgcguucucaguacuugaagcugggcugcgcagaggaaccgcugccagcauccaggccagaaccguucgcguaaacaaacacggaaacuccaagacgcgugcggauugcaggugauuggggaaacgcgccagcacggccuccccgggacucaggcuccaaaccacagcaaaaccguucacacugacacgcacaaagacacgcgaggaaggggacuccagcaccccguagucacucggguacuuuccucccaaugcccagcagggcucaggccgccaagucccuuacacuaccuacccucccaccucgcucucccgggcacccacguuuaccuuuaagcaggcagauguccgugcgcuccgcguuccggcgcaacgccugcacgaccagcgacaccgugcuguccucccggagacucucggcgcgcgggcugcgcucgucguagacgaugacagccgaguagaggccagagcgcaggcgggcacgcaccucuuccucggcgggcaggaucugcuccaggcucacggagcccuuggcccuccgccgcacgaugguauugcagcgcacguucaccgagccucggauguagcccgcgcugugagccagaaacggccugcaguccagcagcaggcacuugccgccgcucagcagccccaaggcgccguggcugccgcugccguugccgcccgcgcugccgccgccgccguucucaucccgguucaucagccuuuugagcacgcugcaguccaucucccgcaguuccuccaucgucaccaugucgccggcaaaacgcaguaagcuggggagcuagcuggagaaggccaagggcaccggagccagcuaggcuaacaagaaggaaccaggcgagggcuaagagggcgccugcagaagugacccgcaaacuuggccccaggcucuucucccucuaacaccccugcuuccaccucccgcagccucaacguuacauagcagucccagccuucucuggcgccaaagcuggcgggcgcgcggcacccggggcaagcgaucgagcaggggaguguguuuacgagagagggcuccucucgguuugucgccucugguguguuuugcuagcuagggcugcuucugccgugggcuccgccguuucccccaccgcugcaccgccggagcugcacgcacugccccagccagaguuuccuccucuggcuuagagauuuauuaaugcucgccggcucucccgggggagggaagagucauuacuaccucgccaggccccgcccccaacgcaagcuucccgccccgcccccaccccggcucgugaauggagcgccggcccccucgcacccagucacggggacucgacgucacaaagagaggaguaaacagggcgcucggugcuggcugccaggcccauuc

SEQ ID NO: 10313 - RNA, 2501 nt, Mus musculus
cugcagauaaaaucaaaauggggagagaacacuugcuucugggcauucugagaaggucauggccaucugugaacccuggggcuuuuuguccuaagagggcgggagaaggaggggccaaaggaaagacaacacugccuuccacacuugggagucuaccaucuagcuagaacuuuguuagcaguggggaacuuugcacacagccugugcuccucaguccgucucucuacagccggaccuucuaccguaggaaaucgccuccaccccuuggcauggguaccccgguuccugaugaaauugugacccgcuguccccuucccagauccuggacuccagcccugucacucgccacacacugcagaucacgugguagagugcuguucgccccaaguguagcuauuggucugcggcucaugucccggaagcucauuggcugaguccugcguucacguggggguggggguaagguggucuuggauagcacccuuaguggggagagguggcuggaaaguuaaagugagccacagauugcuggagcuggaauccagagugcugcaauccagugagcaggugagagggcugcuguugcguggaccaagccgagugccugccccacuuuugccgucgugguugcugucacugucacccagcucagaugguggggcgggcugaagggucuccccuccguacucaagagugguaccggguacguaccuccucaagccucuaguucaagguccagagccaggaaaucugcggugaggggcacgcgggggaguucuccgacacuuaccauuugucccacuaacacugacucccagguaguagaauccccuagcugggcucggguggcuugucgcuucagcgugcagaaacaucucaggcaccggagcugggauggagccuagaggggacccccgagaucccuaagcgaguuagccugcgaaacguguccugaacagaaaggaugucucgaguccuaacguggcacauccccaaccugagaugugacacuuuggaagauaauucuaguuuuuuguggcagaaucuggaguccaaauacaagcucccggggcuucaguuucccguuacgaaauagacgcgagaaacccgugucccagcccugacuccaucaaguagugcggaccagucccuacuacuccccacuuagguucagaucuccuuuugcugcacacaggcaagaggcacacgcugugucgucucgggucucggaaggcaaugggcucgaggcgagcuccacccgggaacggggcagcccgcgugggggugcucgcgaggcgcugcccccaucugggcugucccgccgccaggucccgcccugaugugauaacuugggcuccuccuccuuguucgucuccgggaacuaagcccaggcccuacccccgggacaccccgacgcucacguaguucaguggcagcaaucaacccugacacuucucucaggcucucccaugaggccagcgagcagcggccccggcugcggcgccgccgggagagguaggugcagacccagucuaagcuggggcgagggcgggugcaggcacacccugugucuggugggauggggacucgcugaccuucccccagggacuuguucacagcuaccguuuugaacccagaggagaggcucugaaccggacggcagcuucagaacaggggauggcaggcccacggggaaacagagaaaguugaaaaagacuugagugggggaacuugcagaguugcuggaauguggcccugucucagcuugcggguccaggagaaagaaaggcuucuucagccuaggcagggaaggaacuggucccuuuggcaagaacguccaggagccagggagaaaguagagacagcugaaguaaacuagggccauuuaggggaaaguuaguagaaagagaagcaucggggcccuauuagcaaccuugaaggucaaagcugcaagugaccucagaagaaacccuuaaacccggagaguucuucguuuguuaaagcucagcugggcagaggccuucuuaggccugagcuucuugcugucuuuggcccuuauuagcuggugugggcugccucauucaaagcuaccugacugcucauuaugcggcccuauucaaaaacauuucucuucaaggauugagggguguauacauuaaaacuguaauaauuagggucuguauacaaaagggggccaaugucaacuucauacauauaaaaguaucagcuagacauuuggggagagaaccgagauuugcugaaagggggggggaggaguggaugguggugucuugaauugguugaggauauuuaucuaauguaguguugcgguggguuauuguuaacuugguuuugacaucagcgaggaagaguugcagaaagaaggucucagucagaaacucagucgcucaacugccugaagcuaggcagguuguggguuuugguuuuuuuuguuuuguuuuguuuuguuuuguuuuuuguuuuuuuugguuuuugguuuu

SEQ ID NO: 10314 - RNA, 2501 nt, Mus musculus
aaaaccaaaaaccaaaaaaaacaaaaaacaaaacaaaacaaaacaaaacaaaaaaaaccaaaacccacaaccugccuagcuucaggcaguugagcgacugaguuucugacugagaccuucuuucugcaacucuuccucgcugaugucaaaaccaaguuaacaauaacccaccgcaacacuacauuagauaaauauccucaaccaauucaagacaccaccauccacuccucccccccccuuucagcaaaucucgguucucuccccaaaugucuagcugauacuuuuauauguaugaaguugacauuggcccccuuuuguauacagacccuaauuauuacaguuuuaauguauacaccccucaauccuugaagagaaauguuuuugaauagggccgcauaaugagcagucagguagcuuugaaugaggcagcccacaccagcuaauaagggccaaagacagcaagaagcucaggccuaagaaggccucugcccagcugagcuuuaacaaacgaagaacucuccggguuuaaggguuucuucugaggucacuugcagcuuugaccuucaagguugcuaauagggccccgaugcuucucuuucuacuaacuuuccccuaaauggcccuaguuuacuucagcugucucuacuuucucccuggcuccuggacguucuugccaaagggaccaguuccuucccugccuaggcugaagaagccuuucuuucuccuggacccgcaagcugagacagggccacauuccagcaacucugcaaguucccccacucaagucuuuuucaacuuucucuguuuccccgugggccugccauccccuguucugaagcugccguccgguucagagccucuccucuggguucaaaacgguagcugugaacaagucccugggggaaggucagcgaguccccaucccaccagacacagggugugccugcacccgcccucgccccagcuuagacugggucugcaccuaccucucccggcggcgccgcagccggggccgcugcucgcuggccucaugggagagccugagagaagugucaggguugauugcugccacugaacuacgugagcgucggggugucccggggguagggccugggcuuaguucccggagacgaacaaggaggaggagcccaaguuaucacaucagggcgggaccuggcggcgggacagcccagaugggggcagcgccucgcgagcacccccacgcgggcugccccguucccggguggagcucgccucgagcccauugccuuccgagacccgagacgacacagcgugugccucuugccugugugcagcaaaaggagaucugaaccuaaguggggaguaguagggacugguccgcacuacuugauggagucagggcugggacacggguuucucgcgucuauuucguaacgggaaacugaagccccgggagcuuguauuuggacuccagauucugccacaaaaaacuagaauuaucuuccaaagugucacaucucagguuggggaugugccacguuaggacucgagacauccuuucuguucaggacacguuucgcaggcuaacucgcuuagggaucucggggguccccucuaggcuccaucccagcuccggugccugagauguuucugcacgcugaagcgacaagccacccgagcccagcuaggggauucuacuaccugggagucaguguuagugggacaaaugguaagugucggagaacucccccgcgugccccucaccgcagauuuccuggcucuggaccuugaacuagaggcuugaggagguacguacccgguaccacucuugaguacggaggggagacccuucagcccgccccaccaucugagcugggugacagugacagcaaccacgacggcaaaaguggggcaggcacucggcuugguccacgcaacagcagcccucucaccugcucacuggauugcagcacucuggauuccagcuccagcaaucuguggcucacuuuaacuuuccagccaccucuccccacuaagggugcuauccaagaccaccuuacccccacccccacgugaacgcaggacucagccaaugagcuuccgggacaugagccgcagaccaauagcuacacuuggggcgaacagcacucuaccacgugaucugcaguguguggcgagugacagggcuggaguccaggaucugggaaggggacagcgggucacaauuucaucaggaaccgggguacccaugccaagggguggaggcgauuuccuacgguagaagguccggcuguagagagacggacugaggagcacaggcugugugcaaaguuccccacugcuaacaaaguucuagcuagaugguagacucccaaguguggaaggcaguguugucuuuccuuuggccccuccuucucccgcccucuuaggacaaaaagccccaggguucacagauggccaugaccuucucagaaugcccagaagcaaguguucucuccccauuuugauuuuaucugcag

SEQ ID NO: 10315 - RNA, 2501 nt, Mus musculus
caaagccaauggggauuuaaguggggccccuuggcuccuuuuaguaaucuuaggcggagaagggcgaagaugugagugcucgauugcagacagguggcucagaugccaggaaacugcugagugacaaaugcugagauuccccacagacgccggagacaggcuuuuuuguagggauaccgaaacugacauuuacaauuuuuauuuauaaauaagauauauacauauggauguuagccaaaggcaacuuaacaguucauuuuguacaaaauauaucucuguucagggcgagguaucucgggaacaggacaguguagcaucgccuuggcuuuuggaagacaagcucaaccuccuacacagaaacaagugauuagaaaagauaaauacuauauaugcacagagaaauauaaauaggaguuaaacaagucacuucacuucauaaaagccauuaaagcugcuggcuuuaugucauaaccuucaaauauagccagacuuaacauuuuuggccauuuauguucucuggagacugaagcagggagaaaagcaaaaaaccucgagaaugauguuugugaaggcucacgguaacuuagaauacuguacguucagggacguuuuaaagccuguuggcugauugcaauuuuguugcuacugcgaugaacaguaugcaaagaaaacacuacgcacucuugucacugcauaagaagaccuggucccucuggagagaaaaguaaaacuccuuaaaagauaaaugaacccaaccuaguauuuggagaggaguuuggcccuagaaaaggaaggcuugcccuccaguuagaggaaggcgaccaggguucuaguugcagauguacuggcagaaguucaagucacccucagacuccaggcagagcucaggugaacccugucuacaggucggagucacagggcagcgaauuuuggcagggccgagugcugcgagaggaggaaccaccuugggagguggcugucuucuuuucuucucccucaagcacauccaucggguugguguaggacuuggguggcggucguggcaucgggaauccaaccuugagcuugcuggugucccugugcucugcggugggaggaggccgaugcuguccgucgcuguaguacuugauggcaggugugagcgcugguuccggccaguccacguagacggugcugaugcugcugcggcgcgggccugcugggggcgccuugcgacagcggcgacaacgcucuucacaccagggcgcaaagcugagcgccagagagaagccgcccagaagcagcaggcagcugccuagguagcccagcaccaggcuguagcugaccugcaccgugaccggcgagcucggggcggccaggacgucgggaucugacaagaagugguuauaccaggagaccgggaugaggcugaagaggccagcgacgaaaaacaccacgccagagaggcccgcuagcccguaguggggcucaucuugccaacagcgcacaccgagggaagccagcagcagcccuagggcgguaguggccagugacgugaucaugaguccccgggccaccugcacaggcugggucuggaaguaguuccacucgucgggcuggccgcacucgcguucgcgacugcucugcucgcgacauaugucccacagccccugguacagcaccacguccacuggcugguccagaaagcccuucaccagccgccagcccggggccaguguacugacaagauuaagcagcaacccgcagggcgugagcaccaugcccagcgucaucaccaccggcguccgcauccugcguagccucuugggucccuagcagcuguggcugcuccgcugcgcacccuguccucgaaucugcgagguugccgggcuggguagcagcgaugcucgcugcgcucucugggcgcucuuugucucucgcgcggaacuguccccacugagccucucacaccaaguccccuccucucucgcgucccaaccgcuccgcccucucgcccagccgcugucccuaaucgaaaccagcuccgaguccggucagaccgaaaccgcgcgcccaggugcggcccccaaggccaaacccuaccgggugggaggggcgggagcgccagggccacuuggcaaggaggcgaccucggacucugaggacccggacaccccacccuagcccagccgcuccuccuagcccggccacuccucccagcccgcccggaugguuuagggcucgagcaaaggucgccccgcccucgcucucucgcacugccugcgcgcuuguaggcgggacaaagggggcgggccgcuagugucgucucaccugucgccuagcuacaccuuccccucuucccuuuccuucucagguccggucagaaagcaaagcgucccuacacugccuccaauucuccccaacucugcccgugggcccugccaacacaagucucuuuucacucccagcuggugaccagcaucccucgaaaguuuugcgcugccaucugcagccacguaggg

SEQ ID NO: 10316 - RNA, 2501 nt, Mus musculus
cccuacguggcugcagauggcagcgcaaaacuuucgagggaugcuggucaccagcugggagugaaaagagacuuguguuggcagggcccacgggcagaguuggggagaauuggaggcaguguagggacgcuuugcuuucugaccggaccugagaaggaaagggaagaggggaagguguagcuaggcgacaggugagacgacacuagcggcccgcccccuuugucccgccuacaagcgcgcaggcagugcgagagagcgagggcggggcgaccuuugcucgagcccuaaaccauccgggcgggcugggaggaguggccgggcuaggaggagcggcugggcuagggugggguguccggguccucagaguccgaggucgccuccuugccaaguggcccuggcgcucccgccccucccacccgguaggguuuggccuugggggccgcaccugggcgcgcgguuucggucugaccggacucggagcugguuucgauuagggacagcggcugggcgagagggcggagcgguugggacgcgagagaggaggggacuuggugugagaggcucaguggggacaguuccgcgcgagagacaaagagcgcccagagagcgcagcgagcaucgcugcuacccagcccggcaaccucgcagauucgaggacagggugcgcagcggagcagccacagcugcuagggacccaagaggcuacgcaggaugcggacgccgguggugaugacgcugggcauggugcucacgcccugcggguugcugcuuaaucuugucaguacacuggccccgggcuggcggcuggugaagggcuuucuggaccagccaguggacguggugcuguaccaggggcugugggacauaugucgcgagcagagcagucgcgaacgcgagugcggccagcccgacgaguggaacuacuuccagacccagccugugcagguggcccggggacucaugaucacgucacuggccacuaccgcccuagggcugcugcuggcuucccucggugugcgcuguuggcaagaugagccccacuacgggcuagcgggccucucuggcgugguguuuuucgucgcuggccucuucagccucaucccggucuccugguauaaccacuucuugucagaucccgacguccuggccgccccgagcucgccggucacggugcaggucagcuacagccuggugcugggcuaccuaggcagcugccugcugcuucugggcggcuucucucuggcgcucagcuuugcgcccuggugugaagagcguugucgccgcugucgcaaggcgcccccagcaggcccgcgccgcagcagcaucagcaccgucuacguggacuggccggaaccagcgcucacaccugccaucaaguacuacagcgacggacagcaucggccuccucccaccgcagagcacagggacaccagcaagcucaagguuggauucccgaugccacgaccgccacccaaguccuacaccaacccgauggaugugcuugagggagaagaaaagaagacagccaccucccaaggugguuccuccucucgcagcacucggcccugccaaaauucgcugcccugugacuccgaccuguagacaggguucaccugagcucugccuggagucugagggugacuugaacuucugccaguacaucugcaacuagaacccuggucgccuuccucuaacuggagggcaagccuuccuuuucuagggccaaacuccucuccaaauacuagguuggguucauuuaucuuuuaaggaguuuuacuuuucucuccagagggaccaggucuucuuaugcagugacaagagugcguaguguuuucuuugcauacuguucaucgcaguagcaacaaaauugcaaucagccaacaggcuuuaaaacgucccugaacguacaguauucuaaguuaccgugagccuucacaaacaucauucucgagguuuuuugcuuuucucccugcuucagucuccagagaacauaaauggccaaaaauguuaagucuggcuauauuugaagguuaugacauaaagccagcagcuuuaauggcuuuuaugaagugaagugacuuguuuaacuccuauuuauauuucucugugcauauauaguauuuaucuuuucuaaucacuuguuucuguguaggagguugagcuugucuuccaaaagccaaggcgaugcuacacuguccuguucccgagauaccucgcccugaacagagauauauuuuguacaaaaugaacuguuaaguugccuuuggcuaacauccauauguauauaucuuauuuauaaauaaaaauuguaaaugucaguuucgguaucccuacaaaaaagccugucuccggcgucuguggggaaucucagcauuugucacucagcaguuuccuggcaucugagccaccugucugcaaucgagcacucacaucuucgcccuucuccgccuaagauuacuaaaaggagccaaggggccccacuuaaauccccauuggcuuug

SEQ ID NO: 10317 - RNA, 2501 nt, Mus musculus
cucucugguccaucuccacccuucagguaggauguagagucaggucaucuccuuccuucccuacggccaccaccagcugguggccagcucccaagccagcgccccguccaccacuucuggugccccacagucccagcguggccccggugaaaagcgcgcgcccuucggcgcgauccccacgcucacacgcgcugccgcuuguugcuccccgcagccgcgacguggggaagugaaaaugaaauugacuuuuccgagaaaugaugaaagccgugccggccgccaaugaacagcggcggcgaacuuccgcaccuccaggcuggcggcuggagcccucccucugccuccaccuccggguugcacaagcuugaaacaaacacuggggaggaagggcggggagggaggagggcggagggggagcgagggagggagcggggccgggagagggcgggggugggggggauuuccagccucggcuccucgcaguuuccucuccuuguuuugcuuucgaucuggacuguucucaggcaagccggggacuaacuuuuaguuuugcuccugcgauuauucaacugacgggcuuucauuuccauuuuacacacccuaacaacacucacaccuugcgggauuguauugguagcguggaaaaaaaaaagcacauugagagguaacauuuuuuuuuuucaaauaauaguuguggcugugcguguguuuucucucgagggcauguugacggggacaggaggagcuauguauguaugugcguccugaugcuuugacacgauguuuugcagacggaaaaaugccgggguucauaaauauuaauaccgauuuuuggaggaagagucggcgcaguuauggaucaucugauuuuaggggaagcaggggucugcugcuguugccgcugguacuggggcugcugaggcugcaaagaggaggagguagagagggaggaggaggagguuagugaagguuuaauuucacuuuuggauuugcagaugagaagagguggcuccauggacacagaucugcucugugugauucugcgcuccaggugucguguguuguggguacagguccguuggaguccggccucauuuaaaauaaaauugguguguguguguguguguguguguuguauguguaugaguguuuacagacacugucgccaccagguccgaggaagggaaccggguucuucucggugcccagcggcccuucuuucccggcggucucugguguaaauagacuggcacccgcggucccuagaugcccgugcccgggcagugaccacuguaaacuugaaggcugcccuaaggcggucccaggaugcgcucgcccgcggggcuuggggucgggugaccggcgucuggugccaguggacacucgggccgggcgggcuccgcgcgcggcugggcgcgggccuggccggcgcgcccggcuuccuggggacugggccgccgccacacgccaggaacgucgcguccuccuccccgccggccagcgucuggccuggccuccgggcuuugucacugcacuugucccagcgcgugaggcgccucggaggcgcguccccggagggcuccgcgcucaggggucacccaccccggcgcggccuagcugcgagugccuccggguccccgcgggcgcccccggggccggccuggcgcgcugggccccgacccgccuuggcuacggaacgggcgaggugugggggcggggaaccuccggggaccgagcggcgcccggcgggcuagcaugggguugggggugaggcugacgaacgcuuggggucuccgggacguggugggaaugagugcccgcccugugcccuccgacccgcuccgggcgccgggugacauucgcccgccggccgaacaugguuggugcagagcggcagccaccacuuccucuccgccccgccggcccggcucucugggcgagcgaugcgggccgcggccaaucgcggugcccagcuagucccugucgcucggccuugggggccggcuccccugagcggcccgggaagccuucgcgagagcucagggccccggcuccccggacgcuguccgcugggccccggcucucggaccguuugccacccucagucccucgccccuuaggagcagggaagggaaggaggcuaguagccuccgccgcgagccaggacugugcucgggccccaggugagacgcccggaucagucgguggaggcgagauccuugguggucggauguaaauaagaccccugggauuggcaggccaccuugucacucguuugcgagcggguuugcagguccuuaagcccaguguguuugaaacuugggggacauguuucuuguccccuccucccucccgcgugggcacuccuuguccuuccuugguugugucuguaccagggaggcaaaguaguccugggguuagcuuucugccacucgccucccuguggcugggacuccgggcugcucuugaugaauggcuccugaggguggaggacaguuaca

SEQ ID NO: 10318 - RNA, 2501 nt, Mus musculus
uguaacuguccuccacccucaggagccauucaucaagagcagcccggagucccagccacagggaggcgaguggcagaaagcuaaccccaggacuacuuugccucccugguacagacacaaccaaggaaggacaaggagugcccacgcgggagggaggaggggacaagaaacaugucccccaaguuucaaacacacugggcuuaaggaccugcaaacccgcucgcaaacgagugacaagguggccugccaaucccaggggucuuauuuacauccgaccaccaaggaucucgccuccaccgacugauccgggcgucucaccuggggcccgagcacaguccuggcucgcggcggaggcuacuagccuccuucccuucccugcuccuaaggggcgagggacugaggguggcaaacgguccgagagccggggcccagcggacagcguccggggagccggggcccugagcucucgcgaaggcuucccgggccgcucaggggagccggcccccaaggccgagcgacagggacuagcugggcaccgcgauuggccgcggcccgcaucgcucgcccagagagccgggccggcggggcggagaggaagugguggcugccgcucugcaccaaccauguucggccggcgggcgaaugucacccggcgcccggagcgggucggagggcacagggcgggcacucauucccaccacgucccggagaccccaagcguucgucagccucacccccaaccccaugcuagcccgccgggcgccgcucgguccccggagguuccccgcccccacaccucgcccguuccguagccaaggcgggucggggcccagcgcgccaggccggccccgggggcgcccgcggggacccggaggcacucgcagcuaggccgcgccggggugggugaccccugagcgcggagcccuccggggacgcgccuccgaggcgccucacgcgcugggacaagugcagugacaaagcccggaggccaggccagacgcuggccggcggggaggaggacgcgacguuccuggcguguggcggcggcccaguccccaggaagccgggcgcgccggccaggcccgcgcccagccgcgcgcggagcccgcccggcccgaguguccacuggcaccagacgccggucacccgaccccaagccccgcgggcgagcgcauccugggaccgccuuagggcagccuucaaguuuacaguggucacugcccgggcacgggcaucuagggaccgcgggugccagucuauuuacaccagagaccgccgggaaagaagggccgcugggcaccgagaagaacccgguucccuuccucggaccugguggcgacagugucuguaaacacucauacacauacaacacacacacacacacacacacaccaauuuuauuuuaaaugaggccggacuccaacggaccuguacccacaacacacgacaccuggagcgcagaaucacacagagcagaucuguguccauggagccaccucuucucaucugcaaauccaaaagugaaauuaaaccuucacuaaccuccuccuccucccucucuaccuccuccucuuugcagccucagcagccccaguaccagcggcaacagcagcagaccccugcuuccccuaaaaucagaugauccauaacugcgccgacucuuccuccaaaaaucgguauuaauauuuaugaaccccggcauuuuuccgucugcaaaacaucgugucaaagcaucaggacgcacauacauacauagcuccuccuguccccgucaacaugcccucgagagaaaacacacgcacagccacaacuauuauuugaaaaaaaaaaauguuaccucucaaugugcuuuuuuuuuuccacgcuaccaauacaaucccgcaaggugugaguguuguuaggguguguaaaauggaaaugaaagcccgucaguugaauaaucgcaggagcaaaacuaaaaguuaguccccggcuugccugagaacaguccagaucgaaagcaaaacaaggagaggaaacugcgaggagccgaggcuggaaaucccccccacccccgcccucucccggccccgcucccucccucgcucccccuccgcccuccucccuccccgcccuuccuccccaguguuuguuucaagcuugugcaacccggagguggaggcagagggagggcuccagccgccagccuggaggugcggaaguucgccgccgcuguucauuggcggccggcacggcuuucaucauuucucggaaaagucaauuucauuuucacuuccccacgucgcggcugcggggagcaacaagcggcagcgcgugugagcguggggaucgcgccgaagggcgcgcgcuuuucaccggggccacgcugggacuguggggcaccagaagugguggacggggcgcuggcuugggagcuggccaccagcuggugguggccguagggaaggaaggagaugaccugacucuacauccuaccugaaggguggagauggaccagagag

SEQ ID NO: 10319 - RNA, 2501 nt, Mus musculus
cuccuuauacuuuuucucuauaugcccccaaacagugcauaucuaacccauucuccuggcccccuugcccugacugguacuuaccugaugcuccgcggguucugcagauuucaccagguguuuauccuuguacaaagaccagagaccaauguugggcaggaaaauuaaagccacggugaauaacaaagucauuugcagaaaccucuucuguuuccucuucauugcaaaggauaacaauggagaaaaguuagagaugucucccagacuacuucuugaguuuaaugccaaaguccuuuccucuuuccugggaagcaccagaaacugaggggaagcaaaaaacuuuuguugugugcucagcaccaaucugcaggguucagagggaguuggccaucugcagaacaaacgcacaguuacuuucccccagaaaacuaugacgacggcauuaucuauuggcuuagaaauaaacgagucaacugaggaaaucguuaaaucuauugaccuccauuaauauaaagcaguggaguaaauacgaucguuucauagaauaaugguaaguuaugaggaagucgagagcaugcuagaucuaucaguaaauaggagguguuugucugucgcuguuugcccaccaucccccgcccuuagugugggagguccgggauguagagucggagaugaaaagcgagaacugaaugggagggaguggcuugguccagucaagugucuggaagaaaaguguccgcuuuugacauuggcacaacaccuuccuuaucuuccccgaacagcuuuuuauuugcuugcuuugggauaacccaccugaacucaaguucaacucccuuggaagccagcuugucaggcaagauccagggacaccauaaccaggucagaacuauguuuggauagggguucacaaacuccuggaucuucaugcgccgucagaacacuccucugcaggcagcaucuaggcgaccugggaaccuggcuggaaggaggcuacagaugucagcggaguccagccaggaagugcaggcgcaaagacgucccuuccuccaagugcaguccugggaaugagagccucagagaagugugcucucuacccaucaaucucgcccccuuccucugcugacgcucucacgcuccacuguucauguuaccauucuuuuccagcaacugaacgaacccagcgaagcaucaccagcacccccagggcaguauuucugaucuccacuucacggcaagggacggauggcaggcggcgaaugucaagugugaccgggcuuuacaggcaagugggagagggcgcgcggaggaugagugaggacggcgagaacgcgcguggagcuggcacccagggguccgccucccgcuggcugucuccugccugcuggcgaugauacuggugucuaccacgugcgggagccuagaagccgggaggggagggcgagucacggccggaagguaguggccacugccucgcggcugccagaugcuacauaaacaaacccagaggcuagggggaaggagaggaggaugaaggcggggacagagaaaucgauuugcagcuccgggacaaucggauccucucuucucggguaaucucgaaccggcagggagacugguucgucucugagcucacccgaaaggcgccaggccagaaauuccggaguacaagucgcccugagcgggagggcaauggaagaauuccuccaugguccugaugggaucgcagcgaggaaggcgcggcagcgacagcgagcagaggcaacccagucuggacuggucccugagaggaggguuuccccagaaccuacagcucaagccagguacguagcguggaaggagaaagaggauucccacgccgcguggacagcguuguuagccgcagcuuccagacaacacuguggagaacagaggcagcucagcgggagucggccagcaccuggggcccagguuuagauuuggcuucacuaacugaugcuucuccgcccuaccaugccugcaccucccacugcugauagcugagaggucuucugguuccucgcuuagcucacacaccccucccugguuauccagaaaccuuagaacugagauaagucuccagcagaugggacccuucccuccccguagaaaacggagucaacacacacaggagaaccuguggccucucuaaggaaccuuugugccugccuggcucaggauccagagcgccuaacuccuggugugaacuuaaguaaggugauggauggccaugccaugcugcgcagcaucaggcuauccagagccucccaaaacacuguggucgccuccuuguuacagucuagagagugaugcccauaugcuugagauauagagaccucacuccagaugguuuucuccuucauccacuuuuuccccuuucccccucucucuaauuucccucccccaucccccgccuuuuuuuuuuuuuuucucuuccccuagucuucucuauccacagggacucaagccucucaagacccagauuu

SEQ ID NO: 10320 - RNA, 2501 nt, Mus musculus
aaaucugggucuugagaggcuugagucccuguggauagagaagacuaggggaagagaaaaaaaaaaaaaaaggcgggggaugggggagggaaauuagagagagggggaaaggggaaaaaguggaugaaggagaaaaccaucuggagugaggucucuauaucucaagcauaugggcaucacucucuagacuguaacaaggaggcgaccacaguguuuugggaggcucuggauagccugaugcugcgcagcauggcauggccauccaucaccuuacuuaaguucacaccaggaguuaggcgcucuggauccugagccaggcaggcacaaagguuccuuagagaggccacagguucuccuguguguguugacuccguuuucuacggggagggaagggucccaucugcuggagacuuaucucaguucuaagguuucuggauaaccagggaggggugugugagcuaagcgaggaaccagaagaccucucagcuaucagcagugggaggugcaggcaugguagggcggagaagcaucaguuagugaagccaaaucuaaaccugggccccaggugcuggccgacucccgcugagcugccucuguucuccacaguguugucuggaagcugcggcuaacaacgcuguccacgcggcgugggaauccucuuucuccuuccacgcuacguaccuggcuugagcuguagguucuggggaaacccuccucucagggaccaguccagacuggguugccucugcucgcugucgcugccgcgccuuccucgcugcgaucccaucaggaccauggaggaauucuuccauugcccucccgcucagggcgacuuguacuccggaauuucuggccuggcgccuuucgggugagcucagagacgaaccagucucccugccgguucgagauuacccgagaagagaggauccgauugucccggagcugcaaaucgauuucucuguccccgccuucauccuccucuccuucccccuagccucuggguuuguuuauguagcaucuggcagccgcgaggcaguggccacuaccuuccggccgugacucgcccuccccucccggcuucuaggcucccgcacgugguagacaccaguaucaucgccagcaggcaggagacagccagcgggaggcggaccccugggugccagcuccacgcgcguucucgccguccucacucauccuccgcgcgcccucucccacuugccuguaaagcccggucacacuugacauucgccgccugccauccgucccuugccgugaaguggagaucagaaauacugcccugggggugcuggugaugcuucgcuggguucguucaguugcuggaaaagaaugguaacaugaacaguggagcgugagagcgucagcagaggaagggggcgagauugauggguagagagcacacuucucugaggcucucauucccaggacugcacuuggaggaagggacgucuuugcgccugcacuuccuggcuggacuccgcugacaucuguagccuccuuccagccagguucccaggucgccuagaugcugccugcagaggaguguucugacggcgcaugaagauccaggaguuugugaaccccuauccaaacauaguucugaccugguuauggugucccuggaucuugccugacaagcuggcuuccaagggaguugaacuugaguucagguggguuaucccaaagcaagcaaauaaaaagcuguucggggaagauaaggaagguguugugccaaugucaaaagcggacacuuuucuuccagacacuugacuggaccaagccacucccucccauucaguucucgcuuuucaucuccgacucuacaucccggaccucccacacuaagggcgggggauggugggcaaacagcgacagacaaacaccuccuauuuacugauagaucuagcaugcucucgacuuccucauaacuuaccauuauucuaugaaacgaucguauuuacuccacugcuuuauauuaauggaggucaauagauuuaacgauuuccucaguugacucguuuauuucuaagccaauagauaaugccgucgucauaguuuucugggggaaaguaacugugcguuuguucugcagauggccaacucccucugaacccugcagauuggugcugagcacacaacaaaaguuuuuugcuuccccucaguuucuggugcuucccaggaaagaggaaaggacuuuggcauuaaacucaagaaguagucugggagacaucucuaacuuuucuccauuguuauccuuugcaaugaagaggaaacagaagagguuucugcaaaugacuuuguuauucaccguggcuuuaauuuuccugcccaacauuggucucuggucuuuguacaaggauaaacaccuggugaaaucugcagaacccgcggagcaucagguaaguaccagucagggcaagggggccaggagaauggguuagauaugcacuguuugggggcauauagagaaaaaguauaaggag

SEQ ID NO: 10321 - RNA, 2501 nt, Mus musculus
aagauaacuuuaaacugcugguucuccuuucucccuccagaauacuugaguaacaguugugugucucuaccauaaaauaaaguguguugggguggcagggaggcucguggacuugagucuuuccugugcuggcaggagcuggaagacuugauuaaggagcuuggccgaccaucuuaguuuacccuucugcucacugggugguuauaugggacuccuaugcggcagcacgccugucaucccagguguggaguaccagcucaguccagugaaacuagucaacuuaguccucgugggugagagguugggaugggucacuauuacagugcucucaauuccccgugcuggggggugaggguugucccacccccaccccgugcugugcgugcgcacgcgcgcgcggcaccuuuaaagcgcccuccucugcuugcaggcagacgcccggauugcgcgaccggcaggaccagcuggccagaccgcugugcgcgugcgcaguuggggaagcgcacuggccgcucagcaagggccacgaccaggauggugagugccacgcugcacugguuuucgaaucucacauuugucucugucucucuucucucugccucucuccgcccucucuuuuccucuugccuccucuuucucuuucuuuggcacuuucccuuucucugccucuucaaugucucccccauguuuggggguggugguggagaagagcgcucacuuauucuuuuuccgugucucucccacuaguaucuccuuccucuaccucugagucucugcaucucugauccuacaccucuauuuuugcgucucugggucacugucucugagucucugggucacugucucugcgucucuauuuaugaguuucuaucucugcgucucuaucucugugucucugcaucucugugucucugagugcaucuuugcgucucugucuccgagucucugggucucucucugucuuugccgcugucuccgggugucugucucugagucucuaucucugaaucucuuccucugaguuccugugucucugucucugucucugugucucaacucugggucucgcucccucuaucucuccuggccuggcucaguagcccguugccccccaccucuccaauccugucccucuauccccaacccccgcucgugcugccgggcuugcugcagucuccuggcgcgcugauaaccuugcggccccgguccgcgcugcugcucccccucccgugcgcucccguaacgggggcagggacuuagggaagacgaaaggaaaucuccugacccuccgucaguuccacgguugauucgcgccugagacccuuuuggggagggcuggcagagcuaggggcuguuggggcaguacagcuggaagcagcuccuguacccgcaggcgugugcuccaggagcccucggucaccgcgcacucugggccguggccuggggacuccugcugcugguccccgugcucgcaggggcgcagcguggcaggaagaaagucgugcacgugcugggugaguuuugugggaagcucuggucauccccugcaauccccaauacacgcgugcgcgcgcgcgcgcgcgcacacacacacacacacagcgguggccuagagugaacgaugggagugggaugggguggcggauugccaugguccccuacauucaaucucugagcuccuuucccauccuagacccacauccucucccugagggacccuaccgcaccuuugaccccugauuggucgccccgcagagggcgaguccgguuccgugguggugcagacggcgccggggcagguggugagccaccgcggugguaccauugucuuacccugccguuaccacuacgaggcggccgcccacggucacgacggcguccgccucaaguggacgaaagugguagacccuuuggcuuucgccgaugucuucguggcucuggguccccagcaucgagccuucggucccuaccgagggcgggccgaacugcagaaugacggaccuggggaugccucccugguccuccgaaaugucacccuucaggacuacgggcgcuacgagugcgaggucaccaaugagcuggaggaugacgucggcauggucaagcuggaucuggaaggugaccacagcaugggcagagaaaaagggguacaguggggggcaaacugaaugagguuguuucgguagagauuuugucaggcaggggaauagcucauuuaaaaauuacagcucuuauuuaauguauguguauacuaauauaugccugugguuagggccagaagaggccucccuuccccuggaguuggaguuacaggugguugagagcugccuggugucaguguggggaacagaacucuuuuuggcuggaagagaaacaaggaagaaagagguccccccccuuuuuuuucuucccuucuagacaaggucucaccauguagcccuggcugccuuggaacccacuacauagaucacgcuaacuuuuguugggauaaucuuuuggug

SEQ ID NO: 10322 - RNA, 2501 nt, Mus musculus
caccaaaagauuaucccaacaaaaguuagcgugaucuauguaguggguuccaaggcagccagggcuacauggugagaccuugucuagaagggaagaaaaaaaaggggggggaccucuuucuuccuuguuucucuuccagccaaaaagaguucuguuccccacacugacaccaggcagcucucaaccaccuguaacuccaacuccaggggaagggaggccucuucuggcccuaaccacaggcauauauuaguauacacauacauuaaauaagagcuguaauuuuuaaaugagcuauuccccugccugacaaaaucucuaccgaaacaaccucauucaguuugccccccacuguaccccuuuuucucugcccaugcuguggucaccuuccagauccagcuugaccaugccgacgucauccuccagcucauuggugaccucgcacucguagcgcccguaguccugaagggugacauuucggaggaccagggaggcauccccagguccgucauucugcaguucggcccgcccucgguagggaccgaaggcucgaugcuggggacccagagccacgaagacaucggcgaaagccaaagggucuaccacuuucguccacuugaggcggacgccgucgugaccgugggcggccgccucguagugguaacggcaggguaagacaaugguaccaccgcgguggcucaccaccugccccggcgccgucugcaccaccacggaaccggacucgcccucugcggggcgaccaaucaggggucaaaggugcgguagggucccucagggagaggaugugggucuaggaugggaaaggagcucagagauugaauguaggggaccauggcaauccgccaccccaucccacucccaucguucacucuaggccaccgcugugugugugugugugugcgcgcgcgcgcgcgcgcacgcguguauuggggauugcaggggaugaccagagcuucccacaaaacucacccagcacgugcacgacuuucuuccugccacgcugcgccccugcgagcacggggaccagcagcaggaguccccaggccacggcccagagugcgcggugaccgagggcuccuggagcacacgccugcggguacaggagcugcuuccagcuguacugccccaacagccccuagcucugccagcccuccccaaaagggucucaggcgcgaaucaaccguggaacugacggagggucaggagauuuccuuucgucuucccuaagucccugcccccguuacgggagcgcacgggagggggagcagcagcgcggaccggggccgcaagguuaucagcgcgccaggagacugcagcaagcccggcagcacgagcggggguuggggauagagggacaggauuggagagguggggggcaacgggcuacugagccaggccaggagagauagagggagcgagacccagaguugagacacagagacagagacagagacacaggaacucagaggaagagauucagagauagagacucagagacagacacccggagacagcggcaaagacagagagagacccagagacucggagacagagacgcaaagaugcacucagagacacagagaugcagagacacagagauagagacgcagagauagaaacucauaaauagagacgcagagacagugacccagagacucagagacagugacccagagacgcaaaaauagagguguaggaucagagaugcagagacucagagguagaggaaggagauacuagugggagagacacggaaaaagaauaagugagcgcucuucuccaccaccacccccaaacaugggggagacauugaagaggcagagaaagggaaagugccaaagaaagagaaagaggaggcaagaggaaaagagagggcggagagaggcagagagaagagagacagagacaaaugugagauucgaaaaccagugcagcguggcacucaccauccuggucguggcccuugcugagcggccagugcgcuuccccaacugcgcacgcgcacagcggucuggccagcugguccugccggucgcgcaauccgggcgucugccugcaagcagaggagggcgcuuuaaaggugccgcgcgcgcgugcgcacgcacagcacggggugggggugggacaacccucaccccccagcacggggaauugagagcacuguaauagugacccaucccaaccucucacccacgaggacuaaguugacuaguuucacuggacugagcugguacuccacaccugggaugacaggcgugcugccgcauaggagucccauauaaccacccagugagcagaaggguaaacuaagauggucggccaagcuccuuaaucaagucuuccagcuccugccagcacaggaaagacucaaguccacgagccucccugccaccccaacacacuuuauuuuaugguagagacacacaacuguuacucaaguauucuggagggagaaaggagaaccagcaguuuaaaguuaucuu

SEQ ID NO: 10323 - RNA, 2501 nt, Mus musculus
agaaacaggaagaugcccaagccaacgacacagaauuacaggauugaccuacauggucaugugacccaaccagccagugccaaucagaguaaacccuuuucagguaaagccccaaacagagggcagguaauauggcucagugaacuaagguaauggcugccaggccgcaugaacugaguucagucaccgggaccuacauggauagcaagaacaguguuccuggauguaauguugccugaaguucucucaugaggacuucauauaccaugaggcaaccacgggaugccacuccgguucacugugccauuguucucucaccuggaacaccaccacuuuccgguugucugucugaagggaauauguccaggaggaggauagaaagcccugggcagaacucaucaggucgcuacagagcauggaaaacagguaccgaagggagaggcgcccccugggcggguccaaagccaaguccuaggaagaggaagcccaagacaaacuggugcuggaaaacugggcugugcugauuuagacaacuaguguaagaaaaccugaguuucaguauccaacagggaccccugcccugccauaugucagcuguguucacuuaaggggaagaagccacacagucuuucuuugagugcuugguuuugagauggggauuuauagguuaggggguucaccuucugcuccagcugggucucagguucagggaucuggccccagcaccccucacugcaggcccguugcuccgcugccuucacguaagcuucugugcaggcugugggccacaggauggagucacugggagcugcuucccaggauaccucugcugcaggcacccccaaagugcacccagcccuggaggacucaccugcuucacauucugucucuguggcauugggccuagagcucuuggccacaaagcggcagauggagaaaagccgacagccacgcucacaagcacugaucaggauagccuuguuauucggggacucugagggacccucuggcucaggcugggaagggagauaagagacucaggcaaagguacucggggaagaaggcuggggucccccuaagaauccacgagacugaagucagguuucagaaagccaggaucaucauggggggaggggugccuucugagaaacagcaagcagcuuucuaagcaggcuggauaguggccugcacaguggccucuccaggauggaggcuggcagagggcuucucagagagaggcagagcuugcacuugggaacagccuggagcagaacugucuccaagaaggcagugaggaacgugggaagagaagagagcccaugggggaaggagggacagcaccaaguagccuuggacuguggguggggugugcuccaggaccucucaggugcaggucucagccucccuuuggcauguccccacuuacaguguucaccccaggugccaauugaucccuuccuagaaggaagggcaguucugagagaccccucccccuucaagacacccucauugcaggcaccucaguuccucccacuccugaagauccuccauccugucgccccacuauuucuagaggacucucuggcucccacaucucuuuagggacucucagaaucccgcaucccucugccaaccugaggaaccccacgucagcucuuuucucauccgagguucccccauccaggccccuucccaggaccccaaucugcacuagcauaccagguacucgcauccccucuuccaucugaggguccuacacucaggucccucuccuuuuccagucacuggguuccugagaguccaucuguuaccugcgcaggaggcgagccaggguggugcuggcgacaccgcugcuggcaccucugaguguccccgagcugcggagcgaaggggucacgcgcugggguuggggugaccagugacgccaacaacagcagcagcggcaaugcuaccgcagccauggcugaagaugcgcagcgcgggcccugggaugcgggaccggguguugacgucacugagcgaggcagccugggaagggggggggggugugcugcggcgagcggggcgggcaggugaaucucuacuccggucggggacauauucuugauacucaugguccggcucuuugaccggacuuggaucugcgugccgggaaugacaaagaggaccuggcuagauacggugacaggccuaucucaggccacucagggaugaaggccaagagcaacggggcagggagcaucuaagauccuuagucaaggaauuuuuuaaaaagggaagaggaguauggacagggcaaugaaagaagagagagagagagagagagagagagagagagagagagagagagagagagagagagagagagagagagagaaagagagagagagagagagagagagagagagagagagagagagagagagagagagagagagagaccaagaggaugaggagguugaaggccugggaggauggagggggagguagaaugagaagag

SEQ ID NO: 10324 - RNA, 2501 nt, Mus musculus
cucuucucauucuaccucccccuccauccucccaggccuucaaccuccucauccucuuggucucucucucucucucucucucucucucucucucucucucucucucucucucucucucucucuuucucucucucucucucucucucucucucucucucucucucucucucucucucucucucucucucucucucuucuuucauugcccuguccauacuccucuucccuuuuuaaaaaauuccuugacuaaggaucuuagaugcucccugccccguugcucuuggccuucaucccugaguggccugagauaggccugucaccguaucuagccagguccucuuugucauucccggcacgcagauccaaguccggucaaagagccggaccaugaguaucaagaauauguccccgaccggaguagagauucaccugcccgccccgcucgccgcagcacacccccccccccuucccaggcugccucgcucagugacgucaacacccggucccgcaucccagggcccgcgcugcgcaucuucagccauggcugcgguagcauugccgcugcugcuguuguuggcgucacuggucaccccaaccccagcgcgugaccccuucgcuccgcagcucggggacacucagaggugccagcagcggugucgccagcaccacccuggcucgccuccugcgcagguaacagauggacucucaggaacccagugacuggaaaaggagagggaccugaguguaggacccucagauggaagaggggaugcgaguaccugguaugcuagugcagauugggguccugggaaggggccuggaugggggaaccucggaugagaaaagagcugacgugggguuccucagguuggcagagggaugcgggauucugagagucccuaaagagaugugggagccagagaguccucuagaaauaguggggcgacaggauggaggaucuucaggagugggaggaacugaggugccugcaaugagggugucuugaagggggaggggucucucagaacugcccuuccuucuaggaagggaucaauuggcaccuggggugaacacuguaaguggggacaugccaaagggaggcugagaccugcaccugagagguccuggagcacaccccacccacaguccaaggcuacuuggugcugucccuccuucccccaugggcucucuucucuucccacguuccucacugccuucuuggagacaguucugcuccaggcuguucccaagugcaagcucugccucucucugagaagcccucugccagccuccauccuggagaggccacugugcaggccacuauccagccugcuuagaaagcugcuugcuguuucucagaaggcaccccuccccccaugaugauccuggcuuucugaaaccugacuucagucucguggauucuuagggggaccccagccuucuuccccgaguaccuuugccugagucucuuaucucccuucccagccugagccagagggucccucagaguccccgaauaacaaggcuauccugaucagugcuugugagcguggcugucggcuuuucuccaucugccgcuuuguggccaagagcucuaggcccaaugccacagagacagaaugugaagcaggugaguccuccagggcugggugcacuuugggggugccugcagcagagguauccugggaagcagcucccagugacuccauccuguggcccacagccugcacagaagcuuacgugaaggcagcggagcaacgggccugcagugaggggugcuggggccagaucccugaaccugagacccagcuggagcagaaggugaacccccuaaccuauaaauccccaucucaaaaccaagcacucaaagaaagacuguguggcuucuuccccuuaagugaacacagcugacauauggcagggcaggggucccuguuggauacugaaacucagguuuucuuacacuaguugucuaaaucagcacagcccaguuuuccagcaccaguuugucuugggcuuccucuuccuaggacuuggcuuuggacccgcccagggggcgccucucccuucgguaccuguuuuccaugcucuguagcgaccugaugaguucugcccagggcuuucuauccuccuccuggacauauucccuucagacagacaaccggaaaguggugguguuccaggugagagaacaauggcacagugaaccggaguggcaucccgugguugccucaugguauaugaaguccucaugagagaacuucaggcaacauuacauccaggaacacuguucuugcuauccauguaggucccggugacugaacucaguucaugcggccuggcagccauuaccuuaguucacugagccauauuaccugcccucuguuuggggcuuuaccugaaaaggguuuacucugauuggcacuggcugguugggucacaugaccauguaggucaauccuguaauucugugucguuggcuugggcaucuuccuguuucu

SEQ ID NO: 10325 - RNA, 2501 nt, Mus musculus
uucucccugccauucauagaaaucugagccuccaucgccguacauaaacagcaaccagaacaugccagucccuuagguggcacagccaaucaggggaccaggagaagacuaggccagagucucaggcagauccagcugaaaccaguucacugcugggcaggagccaggaaaggcagggggccaguuuuggcaccagagugaccaugggaagguaaagcucugucagggcugcuggauccagccgcaccugaagcucacaugucuaucagucuuuauguaggagaggacacgggcacaguuaggcaggcugcggcuaccucaggugccaggaagcuggaguggugcugccugccugagguuuuccgcgugucagccaccacaacccacuuaccacggucguguacaaggugcagaugauuccuguggacaggagcgaugcccagauguccaacccggucacugcaaaacacacccccugucaggucucccucauccugccugcucauguaggguccagccugggcuccuggccccucccgcucccgacagccagaccuugguucaggaugagcgcaggugcguagaucacgaugccaguauacagcaucuguggguggggaggucggugauggcaaggggcgggcaaacggguuggaggcagaaagaagagagcgcggaucaggcagaaagggcggagccagguugcaagaagguguuuuuagguaggaugggguggagcuaggugagagggugcccauaggcagaaugagggcagagcuauaggcgugguccuuguaugucccagagaagcuuagcucaagcuggaagggggcggggccagguaggaugagggguguggcgugaggucagguuggagcgggcuaugauaauugcucgugugggcguggcagggcgggcagcucgcucaccguggccaccaaguacugcagcgucccgcagagccggaccgcucggcugaagcgcaguucuagguacugcagagggagccaagggcuggagguuaccgggcaagugaccccucagccauccucacuguuucuacucuguuccggagugcccaacugagcuuacagagucucuguguagguuaagccggcuuggaacucgcagcaauccuccugccaaagcuucucuaguacugagauaucacacaugggacuucauauugucgcuacacuuguuggaccguuguuucagggugccuaguugcgcccucagauuugaaacugggguaucccuagggaguccaaacuggccugguacucauggcaauccuccugccucaaucucccuagugcugaaacugcaaguggaugcuauuccguuuucacuacaguuguugagcguuugggaaauccuacaccucacugcaggcguuugaacucugucgggcgccgguggguggcugguacgggcacucgcagggacaggugucagcgggaggccacugccccgaggcugcugcgagcuguggggcccggacuggcucuuccuccuuccuggcccugcccggugcccgcggcaucuucccggaaccuucccaugggaccaaguccccuaccugguaggugcugguaaggcccaggcgguagaagaucggcaagaagagcaaggcugugagcagcgaauugagcaacuggcccacgcacauccacagaaacuugagaccguagcgcgcugccuccgcggggaccccgagcaccugcacagccgacaugaagcuagcggccagcgacagccccacaggcacugccgccagcugccggcccccggugaagaagucgucggcgcugcgcuggccgccgcgggccaggccgacccacagaccgaugcccguggacaccagcagcauggucgcgaacacgccguagucccaggggccgaagguggcccgggccccugccuccgcgcccuccauggagacagguaacucggaacggagaggaugcggaggacgucggggacucucagagcgagcgucgucgcagcgcgaguuccugcugggccgucgacccacaagcuuuucgcgcggcggauuuauugggcuccggggucagcgcggccccgcccccagccugggaggcgggcgcgacccgcacccuuuccguccuggggcgagcgggccuucaggggugcgggcaacgggguuggggggacacuagcgucuccugacacuuucucccacaucuagggcuuguuccguguagaguugugaacagacaggaagggccuuggacggcucagaccuccgcuccccucuguucacacagccugcgggaguuaggaaccagagcuacgaggaacccaggacugggguucacuuucggggacuuccgggccccauaaggaaaaacgagacucgagccuuccccccagagagcaucugccuuucuccgcagcgugggagaaggaacuguccacccuugcuaacccggugggaggcacucagguucucuuuggagaauuucuuccuucuguuu

SEQ ID NO: 10326 - RNA, 2501 nt, Mus musculus
aaacagaaggaagaaauucuccaaagagaaccugagugccucccaccggguuagcaaggguggacaguuccuucucccacgcugcggagaaaggcagaugcucucuggggggaaggcucgagucucguuuuuccuuauggggcccggaaguccccgaaagugaaccccaguccuggguuccucguagcucugguuccuaacucccgcaggcugugugaacagaggggagcggaggucugagccguccaaggcccuuccugucuguucacaacucuacacggaacaagcccuagaugugggagaaagugucaggagacgcuaguguccccccaaccccguugcccgcaccccugaaggcccgcucgccccaggacggaaagggugcgggucgcgcccgccucccaggcugggggcggggccgcgcugaccccggagcccaauaaauccgccgcgcgaaaagcuugugggucgacggcccagcaggaacucgcgcugcgacgacgcucgcucugagaguccccgacguccuccgcauccucuccguuccgaguuaccugucuccauggagggcgcggaggcaggggcccgggccaccuucggccccugggacuacggcguguucgcgaccaugcugcugguguccacgggcaucggucugugggucggccuggcccgcggcggccagcgcagcgccgacgacuucuucaccgggggccggcagcuggcggcagugccuguggggcugucgcuggccgcuagcuucaugucggcugugcaggugcucgggguccccgcggaggcagcgcgcuacggucucaaguuucuguggaugugcgugggccaguugcucaauucgcugcucacagccuugcucuucuugccgaucuucuaccgccugggccuuaccagcaccuaccagguaggggacuuggucccaugggaagguuccgggaagaugccgcgggcaccgggcagggccaggaaggaggaagagccaguccgggccccacagcucgcagcagccucggggcaguggccucccgcugacaccugucccugcgagugcccguaccagccacccaccggcgcccgacagaguucaaacgccugcagugagguguaggauuucccaaacgcucaacaacuguagugaaaacggaauagcauccacuugcaguuucagcacuagggagauugaggcaggaggauugccaugaguaccaggccaguuuggacucccuagggauaccccaguuucaaaucugagggcgcaacuaggcacccugaaacaacgguccaacaaguguagcgacaauaugaagucccaugugugauaucucaguacuagagaagcuuuggcaggaggauugcugcgaguuccaagccggcuuaaccuacacagagacucuguaagcucaguugggcacuccggaacagaguagaaacagugaggauggcugaggggucacuugcccgguaaccuccagcccuuggcucccucugcaguaccuagaacugcgcuucagccgagcgguccggcucugcgggacgcugcaguacuugguggccacggugagcgagcugcccgcccugccacgcccacacgagcaauuaucauagcccgcuccaaccugaccucacgccacaccccucauccuaccuggccccgcccccuuccagcuugagcuaagcuucucugggacauacaaggaccacgccuauagcucugcccucauucugccuaugggcacccucucaccuagcuccaccccauccuaccuaaaaacaccuucuugcaaccuggcuccgcccuuucugccugauccgcgcucucuucuuucugccuccaacccguuugcccgccccuugccaucaccgaccuccccacccacagaugcuguauacuggcaucgugaucuacgcaccugcgcucauccugaaccaaggucuggcugucgggagcgggaggggccaggagcccaggcuggacccuacaugagcaggcaggaugagggagaccugacaggggguguguuuugcagugaccggguuggacaucugggcaucgcuccuguccacaggaaucaucugcaccuuguacacgaccgugguaaguggguugugguggcugacacgcggaaaaccucaggcaggcagcaccacuccagcuuccuggcaccugagguagccgcagccugccuaacugugcccguguccucuccuacauaaagacugauagacaugugagcuucaggugcggcuggauccagcagcccugacagagcuuuaccuucccauggucacucuggugccaaaacuggcccccugccuuuccuggcuccugcccagcagugaacugguuucagcuggaucugccugagacucuggccuagucuucuccugguccccugauuggcugugccaccuaagggacuggcauguucugguugcuguuuauguacggcgauggaggcucagauuucuaugaauggcagggagaa

SEQ ID NO: 10327 - RNA, 2501 nt, Mus musculus
ccggagccacugcggccuugcaggucggcacgaggcgcucggcccagguucuccaccaccagccucccguugcgguacacugugauacggcgcuggcagcgcacaaggcccgucuugaccccuggaucaucuucaggagguggugguggcggcguggggaugggcgcgggccccgcaugcuuuacccgcagcacccggccuggcuugaccuccacgaauguguagccgucacuggacucgacacucuccaguggccgcacggcguuagggggaguccccagcaggcagcagaaaaagccaucugucaccccagucagcaugguguguucuggagagaggaacaguggcuagcucaguguugguggcucuggucuugcaucggguaagcaggaccuggaagccccuuccagguuuccccagacaccccaaugccagacaaguucucagggugucccuuaguacaauacugaagagagcaugggggaggggggcuuccagaaggagaaaacauuaaagcaagagcccauugcaaggagacccuugccccaccagcuggaguuuaucauuuauucacaaauccguaucuuuauguacaaauucauccacacacugauuuaugcaagcauggaugcaagcugguuugcaugcuuacuuuugagaaagaaacucauguagcccaggcuggcuuggaaauccucaugcugcccagacugaccuugcucugccuuccaccuccggaguuguagcagguugagcauacagguguuccuaagaccaaagggaaccucgaacucccacaguccuccugccucuaccuucccaaguguuggggugacagaugugcaucaacaugaugccauugguuuguuuuugaaacaaggucucauucugucguccugggcuguacacuggucucaaacuccuugcaauccuccugccuccaccucugccaguacuagaaugacuagugugaaccccgaucacugccaaccuuuuacacgggguuucauucuguaguccaugcuggccucaaccuugugcccaagcuccuggguggugagaugacagcccauaaagccuggcucuuauucuaaaaugucaaaguucuuagcucaggccucuaguguuaaucugacuagugacgaaugaggcgggggaaggauguuggccacuagaacucggguuguauccggcuccagguucagaagagagcuagagcugacuugcacaguaucgagaacugauggagguugcugcccucagcauccuguguucaaaggguacacaacccuaguggcagccaggaagauaaaggcagaaccugacugggggcucugggccuccauccgguucccuuggccaccccccccgguguccaugacaaccacaggcgguuacauaacuccaggggauaccggagcagcacacccccauugucugaggcauagggauggggccagcuucguuuuuccaucacggccugggcgccgcuggagugauggucauuaaauaccccgcucgugauagccccggaugcacuugaggggaaagcaggccuugcuccucauuucuaaggcuguggaaccccgacuguggcggcuucucuaaagcgcagcgccaguccuguuucccagcccgacccgcuuuucccuggaguucgucacccccgcgguggggucaaggcuaccgggguuccgcagcauccuagcaguacgaaugcggagcuuggcgguuauccacccccggcagcgacaccccccaccccucaguggaggccuggcagccuggugacuccucucucggggaacagagccagcucaccugaggucaucgaggggcccggggcccgaggcaggacgcaggggucccgggcggagaagccagcguccaccugcaggugccgcuuacaugguggugcgggguuggccgcauuagcgcggacaggcgcgggcccggacggucaacgcaggggcaucccgcagccgcguagcaaaccggcccuguaagucccacccagcgugggcggggccuggagcagaugggcaggcaucucggccuauggcagcggcgagccgucuggccuagauaaccguccaaccagaggcuucucuucccaggaucagcgcgcggucugcaagcagcagccccaccccugugaagaguuuggggggaaugagggagggaugggcuagagccuggaccgagaagggcuugcagucgagggacagcgaguagcuugggggugugguggaugugcucugucugggacagggucuccucagccagcuucugccucccgcaaggcgguaugcccucugucucuugaccuucucguucugcacacuuccaaaucucuacacuuucaggucgggaaacagacaaaacaucaaggcaggcauuugaaccagaggcugugucagaagugucagagcugcugcagaacuagcgaaugggaauugcauccuagugauggggucucugcuacaccaagacugagcccc

SEQ ID NO: 10328 - RNA, 2501 nt, Mus musculus
ggggcucagucuugguguagcagagaccccaucacuaggaugcaauucccauucgcuaguucugcagcagcucugacacuucugacacagccucugguucaaaugccugccuugauguuuugucuguuucccgaccugaaaguguagagauuuggaagugugcagaacgagaaggucaagagacagagggcauaccgccuugcgggaggcagaagcuggcugaggagacccugucccagacagagcacauccaccacacccccaagcuacucgcugucccucgacugcaagcccuucucgguccaggcucuagcccaucccucccucauuccccccaaacucuucacagggguggggcugcugcuugcagaccgcgcgcugauccugggaagagaagccucugguuggacgguuaucuaggccagacggcucgccgcugccauaggccgagaugccugcccaucugcuccaggccccgcccacgcugggugggacuuacagggccgguuugcuacgcggcugcgggaugccccugcguugaccguccgggcccgcgccuguccgcgcuaaugcggccaaccccgcaccaccauguaagcggcaccugcagguggacgcuggcuucuccgcccgggaccccugcguccugccucgggccccgggccccucgaugaccucaggugagcuggcucuguuccccgagagaggagucaccaggcugccaggccuccacugagggguggggggugucgcugccggggguggauaaccgccaagcuccgcauucguacugcuaggaugcugcggaaccccgguagccuugaccccaccgcgggggugacgaacuccagggaaaagcgggucgggcugggaaacaggacuggcgcugcgcuuuagagaagccgccacagucgggguuccacagccuuagaaaugaggagcaaggccugcuuuccccucaagugcauccggggcuaucacgagcgggguauuuaaugaccaucacuccagcggcgcccaggccgugauggaaaaacgaagcuggccccaucccuaugccucagacaaugggggugugcugcuccgguauccccuggaguuauguaaccgccugugguugucauggacaccgggggggguggccaagggaaccggauggaggcccagagcccccagucagguucugccuuuaucuuccuggcugccacuaggguuguguacccuuugaacacaggaugcugagggcagcaaccuccaucaguucucgauacugugcaagucagcucuagcucucuucugaaccuggagccggauacaacccgaguucuaguggccaacauccuucccccgccucauucgucacuagucagauuaacacuagaggccugagcuaagaacuuugacauuuuagaauaagagccaggcuuuaugggcugucaucucaccacccaggagcuugggcacaagguugaggccagcauggacuacagaaugaaaccccguguaaaagguuggcagugaucgggguucacacuagucauucuaguacuggcagagguggaggcaggaggauugcaaggaguuugagaccaguguacagcccaggacgacagaaugagaccuuguuucaaaaacaaaccaauggcaucauguugaugcacaucugucaccccaacacuugggaagguagaggcaggaggacugugggaguucgagguucccuuuggucuuaggaacaccuguaugcucaaccugcuacaacuccggagguggaaggcagagcaaggucagucugggcagcaugaggauuuccaagccagccugggcuacaugaguuucuuucucaaaaguaagcaugcaaaccagcuugcauccaugcuugcauaaaucaguguguggaugaauuuguacauaaagauacggauuugugaauaaaugauaaacuccagcugguggggcaagggucuccuugcaaugggcucuugcuuuaauguuuucuccuucuggaagccccccucccccaugcucucuucaguauuguacuaagggacacccugagaacuugucuggcauuggggugucuggggaaaccuggaaggggcuuccagguccugcuuacccgaugcaagaccagagccaccaacacugagcuagccacuguuccucucuccagaacacaccaugcugacuggggugacagauggcuuuuucugcugccugcuggggacucccccuaacgccgugcggccacuggagagugucgaguccagugacggcuacacauucguggaggucaagccaggccgggugcugcggguaaagcaugcggggcccgcgcccauccccacgccgccaccaccaccuccugaagaugauccaggggucaagacgggccuugugcgcugccagcgccguaucacaguguaccgcaacgggaggcuggugguggagaaccugggccgagcgccucgugccgaccugcaaggccgcaguggcuccgg

SEQ ID NO: 10329 - RNA, 2501 nt, Mus musculus
ccgggcagaggcgguucuaggggcagaggccaaggcuggagcuagacugagccagcccugugcaccccaggacagugccugccgucacccagaacaguccggagguggugaaacaggaaaggaaccauuuagacuuauccuucugucuuccagccuuaauuucccucuuugacaaaaccaagucauaaauaccuccucccaccuccuuuacaaccuaaacugccuccaacucacagcaauucuccugccucaacuuuuucagugcuaguaagacaugugggcuucacccuuacaaaggggcgcuuggcuuguuuuaaauguuggggagcggcuccuggcacagcgccgcaccugggagaggacuucaaggucccaagcuggacacacagccccugaccgugacucgagccucgaccuuuugggugcugcuugccuguguucccgccaaggcccaugggcggcgcgaggcaguuauaaggagcaucccugcccacugccuccugccaccaugcgcgcgccgcugcuacugaugcuccuggcucugggguccgcgcugcgcuccccgcagccccccgaggcacgcgccaagcucugcggccaccaccuggugcgcacgcuggugcgggugugcggcggcccacgcuggucgcccgaggccacgcagccuguggagacccgggaccgugaguggggacaagcggggcgguuggacacgcguggauaaccgagggggagacgcuggcacgguggcgcccccuccugauagcaaagacuggaguccucauggauuuuuagauuuuaauuuuucccuauuuuuggauuuuugggacgggggucucauguggaccaggcuggauucaaacuuacaauguagucaagcugagcuguuugccuuacuuaggcuugaguacuuagcugacuggcauaagccaccacucgguuuauaagccaccacucgguuuauuauuuauuaaagacagacucuuauuagagucaaccuaaagucauuucaaagucgcggaauccuccugccucggcaguucuggggucacugggauauggcccuuucuggggauucugggcaggaacucuaccuccaggcccagaggacggaagaggacagaggucccugugucccugugcacagccguggguggcgauuguaggaauguaugguccccuccugaaacagagagugccguccagggguucacagggcgaacccgggacugcgugcaguucuagggacucucacccuuccauggccacaaacuggggugcacaggagguauaugggcacacgcaguugggaggugaguguggcaccaggugagaguuacaugguauucagcaggcgcucuaugugugcuccuaugucucuggccggugugggggagggacuuaagcugacuucuguuccaggggagcugcugcaguggcuagagcagagacaucuccugcacgcgcugguggccgacguggacccagcgcuagacccgcagcuuccucuccaggcuucucagcgccagcgccgcagugccgccaccaacgcugugcaccgcugcugucuuacuggcugcacccagcaagaccuguugggucuguguccccacugaaggggcacagggcucaggcggugcguccuuaauugcuccccaccuccuggcuaugucauugcaacaauccaguuugccuuggaggaucccuaguuuauucauagaucgcaguaagcaaggaccacaggcccuguccccaagaagccccaucaugaccugugcccaccuccucccugugucccaaaaagucuaaauaaaaaagcaacuucauacuuuuuuuccccccugggaaaagcaacaaggaggggggggcaggaggaugugacucugcucuggucacacacagaccagaccggaggcaccaccaggaucuacuggggcaaccaaggcgugucaggagcucuuuacaaggcugugaaguacacaguaggugcacaauagacaguacaagcacuccugaagcaccaaacacaccagguauguuguacaauguuauccuaggcuggugagguggaggcaaggggauuaggaguuuaagaucauucuuggcucuaagggucagccuuggcuaucaaggccagccuggacaaaugagacccugugucuaaagaaaaacaaacaaacaaaauaacuacaaggugguaggcaguguaggaucagaacugagcucaaccagggcugaggcagccagguggggagaccagauuggucuggaagguucccuguucuacagcugagguuucaggagcuaugaagggugcgagagcugggcuggggagagcagagaugcgcugagauucacuacaagguauccaccaugucuuuugggaaagaaccucaaaagugaaugggggagcauaaugagaauucggguuucuuuuaaaaaacagaaauauuaccgggcgguggugguguacacuuuuaaucccaguacucaggaggcag

SEQ ID NO: 10330 - RNA, 2501 nt, Mus musculus
cugccuccugaguacugggauuaaaaguguacaccaccaccgcccgguaauauuucuguuuuuuaaaagaaacccgaauucucauuaugcucccccauucacuuuugagguucuuucccaaaagacaugguggauaccuuguagugaaucucagcgcaucucugcucuccccagcccagcucucgcacccuucauagcuccugaaaccucagcuguagaacagggaaccuuccagaccaaucuggucuccccaccuggcugccucagcccugguugagcucaguucugauccuacacugccuaccaccuuguaguuauuuuguuuguuuguuuuucuuuagacacagggucucauuuguccaggcuggccuugauagccaaggcugacccuuagagccaagaaugaucuuaaacuccuaauccccuugccuccaccucaccagccuaggauaacauuguacaacauaccugguguguuuggugcuucaggagugcuuguacugucuauugugcaccuacuguguacuucacagccuuguaaagagcuccugacacgccuugguugccccaguagauccugguggugccuccggucuggucugugugugaccagagcagagucacauccuccugccccccccuccuuguugcuuuucccaggggggaaaaaaaguaugaaguugcuuuuuuauuuagacuuuuugggacacagggaggaggugggcacaggucaugauggggcuucuuggggacagggccugugguccuugcuuacugcgaucuaugaauaaacuagggauccuccaaggcaaacuggauuguugcaaugacauagccaggagguggggagcaauuaaggacgcaccgccugagcccugugccccuucaguggggacacagacccaacaggucuugcugggugcagccaguaagacagcagcggugcacagcguugguggcggcacugcggcgcuggcgcugagaagccuggagaggaagcugcgggucuagcgcuggguccacgucggccaccagcgcgugcaggagaugucucugcucuagccacugcagcagcuccccuggaacagaagucagcuuaagucccucccccacaccggccagagacauaggagcacacauagagcgccugcugaauaccauguaacucucaccuggugccacacucaccucccaacugcgugugcccauauaccuccugugcaccccaguuuguggccauggaagggugagagucccuagaacugcacgcagucccggguucgcccugugaaccccuggacggcacucucuguuucaggaggggaccauacauuccuacaaucgccacccacggcugugcacagggacacagggaccucuguccucuuccguccucugggccuggagguagaguuccugcccagaauccccagaaagggccauaucccagugaccccagaacugccgaggcaggaggauuccgcgacuuugaaaugacuuuagguugacucuaauaagagucugucuuuaauaaauaauaaaccgagugguggcuuauaaaccgagugguggcuuaugccagucagcuaaguacucaagccuaaguaaggcaaacagcucagcuugacuacauuguaaguuugaauccagccugguccacaugagacccccgucccaaaaauccaaaaauagggaaaaauuaaaaucuaaaaauccaugaggacuccagucuuugcuaucaggagggggcgccaccgugccagcgucucccccucgguuauccacgcguguccaaccgccccgcuuguccccacucacggucccgggucuccacaggcugcguggccucgggcgaccagcgugggccgccgcacacccgcaccagcgugcgcaccaggugguggccgcagagcuuggcgcgugccucggggggcugcggggagcgcagcgcggaccccagagccaggagcaucaguagcagcggcgcgcgcaugguggcaggaggcagugggcagggaugcuccuuauaacugccucgcgccgcccaugggccuuggcgggaacacaggcaagcagcacccaaaaggucgaggcucgagucacggucaggggcuguguguccagcuugggaccuugaaguccucucccaggugcggcgcugugccaggagccgcuccccaacauuuaaaacaagccaagcgccccuuuguaagggugaagcccacaugucuuacuagcacugaaaaaguugaggcaggagaauugcugugaguuggaggcaguuuagguuguaaaggaggugggaggagguauuuaugacuugguuuugucaaagagggaaauuaaggcuggaagacagaaggauaagucuaaaugguuccuuuccuguuucaccaccuccggacuguucugggugacggcaggcacuguccuggggugcacagggcuggcucagucuagcuccagccuuggccucugccccuagaaccgccucugcccgg

SEQ ID NO: 10331 - RNA, 2501 nt, Mus musculus
aaaguugaacuggaugccucaucagucgacaugcacgcacaggucgauggccaaugaccugacuuuuggcucacagaccgagguucauagcgcugcugcugugacuauuaaugaacuucaucggaauauuaaugacuuuagcuaaauauuaaugagauucaucuugauauuaaugacccauagaaugcucauuacuaugugugguucaaacacugagucuuaaugaugggcuugguuauuucuuuaugaauauucaugagcccuggcucccccugcccuggguggaaacggucuugugcccuuggcccugacuuggcagcggccuucagaaggcuacugagguagaggaaugacacgugcucaaagaggcaucaggguggauacugacacgcucagacguucuggaucauucucccagagugagggaugcggaggaugcugggugcuucagggacaguuccuucugugcgucccagcuggacgugggguccccagguugguguuugucccugugacccugagcccggggucacccagcgcuuagcuggguaggacgagcugaucaacugaccccauggcagcuccguucagguuuguacuagcuccuuaacccugggcaauuuucuuuuuacgaggaacuuggaauuuuaccgacaaaaagagaguuccuauaaagauaaagcuucggaggcccaggucuugauggcccugcuuucacaccccagcuuuccggagguaacgcccugccuucacacagcuucuccgaggcuacacagcgucccccagccccccacccccaaccgggaaagaaagcccagcccggcccacuucccagacaaggaaacggaggcugggaaggugcuggccauuuccuugcccuuccaauuagcagagcagccucauaggccuggcgucuggggucacccuagaucccuacccucuaagcgggucccauucucucgucccucuuccggugacguuuacaccaggauuacaauaaccucuuuaauuuuuacaaucaagauaaaaugucacagacacaagaucccuguaaucaagaguaaaguaaacacgccggccccagccccacccuugcugggcuguuagcgccuccugaggggacccgaggcaggggaucagcuuagcacagggacuuggaccaggcacccacuucugccuccagcgccccuccacgcaggacagggaacaaaaguccgcgggguuccagaccucggagggggcagcagaguagucuccuggggccccuacaggaucuucgcaaucucagcuauugaggggaaacgccacgcccaggggaagggauccggccugggcuggcugcgcaaacacugaccagaugggcaccaacuaauguccccuaagcggccgcaccuucuccuccugacuccacagagugugacaggccaggaugagaaagugaaaguggggacccgagaccaagcacucaggaggaagguagacuguucaaagacagucucagaaaaaaaaggagaaaaaagaaaagaaugggaaauuuaccccaaagcgucagaaccucgguuagcaauacagacuaucaauuuaacuaugcugccaccaccacgccucgcaguuuacuucaccacagccuaacucccauacagggaaaguuucacaaacucgaacaggggaaaccgagucagagccgaggccacccggcugugcagacacuggggaaaacgcgggcuucugauccuggaaaguagcggggcuacuucgcggcgucuaagagacccggagcccaggaguauggccggggcugcggagcaucuucagcacggugcagcuagaaagcgccacagauuucaacuucgcaccaccccacccgagacccuggcacucacugcgaucgcgggcuccagacaaccccggaggccacacuguuuaccugggcgaccgccuugagcuggcucuuggcuacucgccuuccuccgcuucuucccuguucucccuuucccgcuccucccuccagugagucgagcuuccuaguagccaaggagaaagucucccuccuuccgcccucaccccccccccccccccgucuaguuccuuucccuugccccuccccguccuguucuucacuguggucauguucuuccccaccugucuuucuaccuggacuuuggcccuuccccucccucuaggcgccacccugcguccagauuuacccgagaagguccacgucuccacccuccuucccucuuucuuggccaugcccauucacuuuuaucccuaacccccaccuccuccaguggaccucuauucccaaccugaccucuuccuccuccaguccuaccccuccccugggagucuaacucccuccaaccccuccuucauuuagagccccaucuuccucuuccacgccacgagagggagcaggagcuccccuguccugagcaagucugucugucuguccccuacugcagcgccucucccacagcucagcccaggcuucaaccucc

SEQ ID NO: 10332 - RNA, 2501 nt, Mus musculus
ggagguugaagccugggcugagcugugggagaggcgcugcaguaggggacagacagacagacuugcucaggacaggggagcuccugcucccucucguggcguggaagaggaagauggggcucuaaaugaaggagggguuggagggaguuagacucccaggggagggguaggacuggaggaggaagaggucagguugggaauagagguccacuggaggagguggggguuagggauaaaagugaaugggcauggccaagaaagagggaaggaggguggagacguggaccuucucggguaaaucuggacgcaggguggcgccuagagggaggggaagggccaaaguccagguagaaagacagguggggaagaacaugaccacagugaagaacaggacggggaggggcaagggaaaggaacuagacggggggggggggggggugagggcggaaggagggagacuuucuccuuggcuacuaggaagcucgacucacuggagggaggagcgggaaagggagaacagggaagaagcggaggaaggcgaguagccaagagccagcucaaggcggucgcccagguaaacaguguggccuccgggguugucuggagcccgcgaucgcagugagugccagggucucgggugggguggugcgaaguugaaaucuguggcgcuuucuagcugcaccgugcugaagaugcuccgcagccccggccauacuccugggcuccgggucucuuagacgccgcgaaguagccccgcuacuuuccaggaucagaagcccgcguuuuccccagugucugcacagccggguggccucggcucugacucgguuuccccuguucgaguuugugaaacuuucccuguaugggaguuaggcuguggugaaguaaacugcgaggcguggugguggcagcauaguuaaauugauagucuguauugcuaaccgagguucugacgcuuugggguaaauuucccauucuuuucuuuuuucuccuuuuuuuucugagacugucuuugaacagucuaccuuccuccugagugcuuggucucggguccccacuuucacuuucucauccuggccugucacacucuguggagucaggaggagaaggugcggccgcuuaggggacauuaguuggugcccaucuggucaguguuugcgcagccagcccaggccggaucccuuccccugggcguggcguuuccccucaauagcugagauugcgaagauccuguaggggccccaggagacuacucugcugcccccuccgaggucuggaaccccgcggacuuuuguucccuguccugcguggaggggcgcuggaggcagaagugggugccugguccaagucccugugcuaagcugauccccugccucggguccccucaggaggcgcuaacagcccagcaaggguggggcuggggccggcguguuuacuuuacucuugauuacagggaucuugugucugugacauuuuaucuugauuguaaaaauuaaagagguuauuguaauccugguguaaacgucaccggaagagggacgagagaaugggacccgcuuagaggguagggaucuagggugaccccagacgccaggccuaugaggcugcucugcuaauuggaagggcaaggaaauggccagcaccuucccagccuccguuuccuugucugggaagugggccgggcugggcuuucuuucccgguuggggguggggggcugggggacgcuguguagccucggagaagcugugugaaggcagggcguuaccuccggaaagcuggggugugaaagcagggccaucaagaccugggccuccgaagcuuuaucuuuauaggaacucucuuuuugucgguaaaauuccaaguuccucguaaaaagaaaauugcccaggguuaaggagcuaguacaaaccugaacggagcugccauggggucaguugaucagcucguccuacccagcuaagcgcugggugaccccgggcucagggucacagggacaaacaccaaccuggggaccccacguccagcugggacgcacagaaggaacugucccugaagcacccagcauccuccgcaucccucacucugggagaaugauccagaacgucugagcgugucaguauccacccugaugccucuuugagcacgugucauuccucuaccucaguagccuucugaaggccgcugccaagucagggccaagggcacaagaccguuuccacccagggcagggggagccagggcucaugaauauucauaaagaaauaaccaagcccaucauuaagacucaguguuugaaccacacauaguaaugagcauucuaugggucauuaauaucaagaugaaucucauuaauauuuagcuaaagucauuaauauuccgaugaaguucauuaauagucacagcagcagcgcuaugaaccucggucugugagccaaaagucaggucauuggccaucgaccugugcgugcaugucgacugaugaggcauccaguucaacuuu

SEQ ID NO: 10333 - RNA, 2501 nt, Mus musculus
aguagaaaggaaagaggcagaagagacaagaaggggguuagaaaaaaagagggcgaagggaaagggccaucccuggagaagggucccuaaaugccggcagaguauuucauucucuucuguuucugccucugguugcagaaccagacgcgcaccacauuuuucuugagauccagcuuuucggcgauggccgcgaucuucuccgaggagggccuuggcuggauggcgaaguaggcuuccagagagcgcuucuccggcgccgcgauggacgugcgcuugcgcuucuucuccgcgccauugaagagcuccggcuuagugagcuucucgcggugggauuucucagcuuccuccagccacgccugcaggaugggcuugagcgcgaucauguuguugugugacagcgugagagacucaaaccugcagauggugcucuggcugagcgagcccacgcccgggaucuugagguuggccagcgccgagcccacaucugccugggucacucccagcuugaugcgucgcugcuugaaacgcucggcgaacgccuccaggucccgcgggucugcauccacgucgcucaugcagcccaugugcgagggcagcccaugugcgugggccaugcucagggcugcuuggugcaugggguucaugguggccauguguggugcgugagccggaguggacaccaccgugccgucggggcccgccauagcucccagggccagcccggggcuuaggugcucaagcagcucgcccuccagcgccuggugcggcuggugaugguggugaugguggugguggugguggugaugggugccagccagagcggacgggugcgagaugggcacagaagaagaggaggcugccgacgugcacgggaugguguucauggugugguaaguggcguccggcuugaaggggcugugguggggcggaugguggugguggcucuuacucugggagacgauguccacggcggccagagccucggcacgggccagcagacucucauccagcccgccgaauauauugcucugcaauuguaaguagaaggcacacauuacgcucagcagggaauugugagcgcucucuccggaagcccccggcccagggcucgccaccgccaccgugccuacagcauucccagaacguuaaaauaauaauaaugacagugauccugaaacucggcagcgagaagagaggggaagccugcgcgagaagccaaugugcagggggaggaaaagugagccacagacaacacaacacaacacaacacaacacgcgcacaggcagcaucccaggucauaaaaauuaauaugaaaggcaagacccguugaauacuuaagagaggggggauugguuggagguguggggugauuugcugugcagacaugaaaaaaacaucaagcagauaaaggaggcugucaaaaugugccuuuaagcggugauuaugcagacauacgcaccggugggguuggaagacaagcucuccgcaucgccuccgagcccccgccgccgccgcugccgccgcugccacugcugcuggaacugcugcuccggccgccgccgccuccgccuccgccgccaccgccgccgccgccagcguugcuggagcugcuaggggaacuggccgagggcgccgcgggcgcagaggagcccggggaggcacuguguagcgccgaguacuugggcuccacgugcaggcugccugcgugaggcaugcugaacgccugcuugcuguucagggacaucaucaucaucuuuccuugcgcggcgcgcucgucgcuggcgcacuccggucccagcuacccgacccuccggagaaguacccggccggagcagcagagggaacaacacugcaaaguugugcucagccgccacugcuuccaggcccgguucucccaguguggccgcuagcuccgcuccugugucucccgcuaggucugcccgagagguugcccugcuccggguggcucuggcuucagaccucagcaccccaaagugccccagcucaucgaggcgguggaguuauaguccccucuucccgcgccugacccccgcccgcccucccccuccuucccucccccgcccucuccugccaggacgcacugcucuggguggguuucuccccgcccuggcuccccgcaggcuccgguccuuucaguucucccugcacccgccccucucucucugccacgggacccgcagccuucccugccccggcaggcgcucugcuguuaccacuccuacgccgcgccugcaacuccugauucuaaucgcgccccagcucaaccccacccaacuagccaggucggugcuucgggccacccccacccggcagugccagucaccuaaaugacagucuccagaucuucccgccucccucgggaaaaaaaaaaaaaaaacucccccuaaaaguugcguuccaagccaaucuuggaagcgacuagcccugaacugugaggugcaccuuaccuggccaccugcucuccugcccucugcuuacc

SEQ ID NO: 10334 - RNA, 2501 nt, Mus musculus
gguaagcagagggcaggagagcagguggccagguaaggugcaccucacaguucagggcuagucgcuuccaagauuggcuuggaacgcaacuuuuagggggaguuuuuuuuuuuuuuuucccgagggaggcgggaagaucuggagacugucauuuaggugacuggcacugccggguggggguggcccgaagcaccgaccuggcuaguugggugggguugagcuggggcgcgauuagaaucaggaguugcaggcgcggcguaggagugguaacagcagagcgccugccggggcagggaaggcugcgggucccguggcagagagagaggggcgggugcagggagaacugaaaggaccggagccugcggggagccagggcggggagaaacccacccagagcagugcguccuggcaggagagggcgggggagggaaggagggggagggcgggcgggggucaggcgcgggaagaggggacuauaacuccaccgccucgaugagcuggggcacuuuggggugcugaggucugaagccagagccacccggagcagggcaaccucucgggcagaccuagcgggagacacaggagcggagcuagcggccacacugggagaaccgggccuggaagcaguggcggcugagcacaacuuugcaguguuguucccucugcugcuccggccggguacuucuccggagggucggguagcugggaccggagugcgccagcgacgagcgcgccgcgcaaggaaagaugaugaugaugucccugaacagcaagcaggcguucagcaugccucacgcaggcagccugcacguggagcccaaguacucggcgcuacacagugccuccccgggcuccucugcgcccgcggcgcccucggccaguuccccuagcagcuccagcaacgcuggcggcggcggcgguggcggcggaggcggaggcggcggcggccggagcagcaguuccagcagcaguggcagcggcggcagcggcggcggcgggggcucggaggcgaugcggagagcuugucuuccaaccccaccggugcguaugucugcauaaucaccgcuuaaaggcacauuuugacagccuccuuuaucugcuugauguuuuuuucaugucugcacagcaaaucaccccacaccuccaaccaauccccccucucuuaaguauucaacgggucuugccuuucauauuaauuuuuaugaccugggaugcugccugugcgcguguuguguuguguuguguuguguugucuguggcucacuuuuccucccccugcacauuggcuucucgcgcaggcuuccccucucuucucgcugccgaguuucaggaucacugucauuauuauuauuuuaacguucugggaaugcuguaggcacgguggcgguggcgagcccugggccgggggcuuccggagagagcgcucacaauucccugcugagcguaaugugugccuucuacuuacaauugcagagcaauauauucggcgggcuggaugagagucugcuggcccgugccgaggcucuggccgccguggacaucgucucccagaguaagagccaccaccaccauccgccccaccacagccccuucaagccggacgccacuuaccacaccaugaacaccaucccgugcacgucggcagccuccucuucuucugugcccaucucgcacccguccgcucuggcuggcacccaucaccaccaccaccaccaccaucaccaccaucaccagccgcaccaggcgcuggagggcgagcugcuugagcaccuaagccccgggcuggcccugggagcuauggcgggccccgacggcacggugguguccacuccggcucacgcaccacacauggccaccaugaaccccaugcaccaagcagcccugagcauggcccacgcacaugggcugcccucgcacaugggcugcaugagcgacguggaugcagacccgcgggaccuggaggcguucgccgagcguuucaagcagcgacgcaucaagcugggagugacccaggcagaugugggcucggcgcuggccaaccucaagaucccgggcgugggcucgcucagccagagcaccaucugcagguuugagucucucacgcugucacacaacaacaugaucgcgcucaagcccauccugcaggcguggcuggaggaagcugagaaaucccaccgcgagaagcucacuaagccggagcucuucaauggcgcggagaagaagcgcaagcgcacguccaucgcggcgccggagaagcgcucucuggaagccuacuucgccauccagccaaggcccuccucggagaagaucgcggccaucgccgaaaagcuggaucucaagaaaaauguggugcgcgucugguucugcaaccagaggcagaaacagaagagaaugaaauacucugccggcauuuagggacccuucuccagggauggcccuuucccuucgcccucuuuuuuucuaacccccuucuugucucuucugccucuuuccuuucuacu

SEQ ID NO: 10335 - RNA, 2501 nt, Mus musculus
augguugugagccauaacaaagugugagcccuuuacaaaaccaacaugugcuguuagccacgaagccaucucuccagucucuagguuuccagaauucagaagaucacuccagaauaccuggcagugagggauaccaccuaguugugguauggcugaguagcaucuuggggaacuugggagcaacuucugggaaacucagauauggcuuugacacucaucucacccgccugggcuuggaaauacguuagcagugccacagguucgggacaccugcaccucggugucaggacacggcaaggccacauuaccagaauugucuccuuccggagcccuauuccuggguguguguguggggggggggggugcaguccacagggggaucuguaaaaaaagaggaacuaggcugaggcucaugggucauggggccucagaggaccggaaaggggccccuuccacccccaucagcauagggggugggguucaaagcuagaccaaccucagaggacaucagaggcagccuugccaccuuuccccuuugcacacguuuggcgcugggcuccugaggguuggggggucuuccagugcugugggagcagcaaaccccgaagggugacuagccgggguggaucaggaggugcgcgcuccgugaucccugcccgcugguuuccuccggggucagcauugcuucuuaucagccgcggccaggcagccagacccuuaucugcacaggcccagcauccucuggccucugcgccagcggguaagagggaggaagccaggcugucgggggcgggggaaagggcgggucgguccaggagcagcucacuuucucuuggagguacccaccacgacgccuccgaagcuacucaggcccuccggagcccgggagguggcgcagcccagcucugaggcccaacgggagggauuaccuggagcacaccggccgaacuggacaguggaaacugucuccugaccuggacugacaaaccugaccacacagccggguucuccaagcuguggaaacugcuacaggguaagaaagacgcuuuaaacauuaaggagugucugugccuguauucgguguuuguuacuucauuuauuuauucauucacuggaagugaggaggcacugaaauguccucaguuggggaaaacagggcagcaaugugggaagucacacacuggcaggauaccccagaccuuagagcccagcaaacgugguaaguagggugcugaugggguugggggccaguaagaggaacuuucagcaaggguagaggccccuggaauagccauggagagguggcagagggugacucuuggagacuuaggaggucuuagaguuaguccggagauuccuaucuuauucccagcugcagguaggagagauucugaaagaugggaacuaguucagagacugaagaugcccauuacaaacaauucauagggucaacgcugccuaguaucugauagacacccccucuuguggaggaggcuccccucuuguggaggaggcccuccuuuuagguccuagcaguuucuaggaccacuuuucuaccuuugauuauugaacccccaaucccuuucucgccuaagggugcucuuacauugaaaagcucagguuaaacaggugggagaaagauggucuuuggccuuccuuccccuuaacuucacucucucccacagguuagcauucuauccgugggguccaugugcccgccccaggccagagcagagguggguuccgccaugacugagaaaacugagaugguaugugccuccagcccagcaccugccccucccucuaagccggccucaccugggccccuuucuacagaggagguggaccaccgaaacacgugcacucccugguugccucccggcgugccagugauaaaccugggacacaccaggcccauaggggcagccaugcccaccacagagcucagugccuuucggcccuccuugcugcagcuaacugccuugggaagagcuccaccuacccuggcuguacauuaccacccucaccccuuccucaacaggucagugggcagcucggacuaugggcagugcuuagguuugggggccagggucuuugccuacaaaguguucaugacccacaaccccuuacagugucuacauugggccagcaggacccuucagcaucuucccuaacagccggcugaagcgcagaccaagccauagugagcuggacuuggcugacggugaguuugugucucgguguguacuuguggggugccugcagcucaugucugauuggccuguacucugccacaggaagaaguauuuugggaaguucacauacaccccaacacaggacaacucacacaagugauagcuaaugcaagacuacaguacggagccuagcuugggggauuacccuguaauccagacugacacaggagaaccaguucagaagccaaccugggcuaugugaguccccaacaagcaagcauuauaaccagagacauggccacaaua

SEQ ID NO: 10336 - RNA, 2501 nt, Mus musculus
uauuguggccaugucucugguuauaaugcuugcuuguuggggacucacauagcccagguuggcuucugaacugguucuccugugucagucuggauuacaggguaaucccccaagcuaggcuccguacuguagucuugcauuagcuaucacuugugugaguuguccuguguugggguguaugugaacuucccaaaauacuucuuccuguggcagaguacaggccaaucagacaugagcugcaggcaccccacaaguacacaccgagacacaaacucaccgucagccaaguccagcucacuauggcuuggucugcgcuucagccggcuguuagggaagaugcugaaggguccugcuggcccaauguagacacuguaagggguugugggucaugaacacuuuguaggcaaagacccuggcccccaaaccuaagcacugcccauaguccgagcugcccacugaccuguugaggaaggggugagggugguaauguacagccaggguagguggagcucuucccaaggcaguuagcugcagcaaggagggccgaaaggcacugagcucuguggugggcauggcugccccuaugggccuggugugucccagguuuaucacuggcacgccgggaggcaaccagggagugcacguguuucggugguccaccuccucuguagaaaggggcccaggugaggccggcuuagagggaggggcaggugcugggcuggaggcacauaccaucucaguuuucucagucauggcggaacccaccucugcucuggccuggggcgggcacauggaccccacggauagaaugcuaaccugugggagagagugaaguuaaggggaaggaaggccaaagaccaucuuucucccaccuguuuaaccugagcuuuucaauguaagagcacccuuaggcgagaaagggauuggggguucaauaaucaaagguagaaaagugguccuagaaacugcuaggaccuaaaaggagggccuccuccacaagaggggagccuccuccacaagagggggugucuaucagauacuaggcagcguugacccuaugaauuguuuguaaugggcaucuucagucucugaacuaguucccaucuuucagaaucucuccuaccugcagcugggaauaagauaggaaucuccggacuaacucuaagaccuccuaagucuccaagagucacccucugccaccucuccauggcuauuccaggggccucuacccuugcugaaaguuccucuuacuggcccccaaccccaucagcacccuacuuaccacguuugcugggcucuaaggucugggguauccugccagugugugacuucccacauugcugcccuguuuuccccaacugaggacauuucagugccuccucacuuccagugaaugaauaaauaaaugaaguaacaaacaccgaauacaggcacagacacuccuuaauguuuaaagcgucuuucuuacccuguagcaguuuccacagcuuggagaacccggcuguguggucagguuugucaguccaggucaggagacaguuuccacuguccaguucggccggugugcuccagguaaucccucccguugggccucagagcugggcugcgccaccucccgggcuccggagggccugaguagcuucggaggcgucgugguggguaccuccaagagaaagugagcugcuccuggaccgacccgcccuuucccccgcccccgacagccuggcuuccucccucuuacccgcuggcgcagaggccagaggaugcugggccugugcagauaagggucuggcugccuggccgcggcugauaagaagcaaugcugaccccggaggaaaccagcgggcagggaucacggagcgcgcaccuccugauccaccccggcuagucacccuucgggguuugcugcucccacagcacuggaagaccccccaacccucaggagcccagcgccaaacgugugcaaaggggaaagguggcaaggcugccucugauguccucugagguuggucuagcuuugaaccccacccccuaugcugauggggguggaaggggccccuuuccgguccucugaggccccaugacccaugagccucagccuaguuccucuuuuuuuacagaucccccuguggacugcaccccccccccccacacacacacccaggaauagggcuccggaaggagacaauucugguaauguggccuugccguguccugacaccgaggugcaggugucccgaaccuguggcacugcuaacguauuuccaagcccaggcgggugagaugagugucaaagccauaucugaguuucccagaaguugcucccaaguuccccaagaugcuacucagccauaccacaacuaggugguaucccucacugccagguauucuggagugaucuucugaauucuggaaaccuagagacuggagagauggcuucguggcuaacagcacauguugguuuuguaaagggcucacacuuuguuauggcucacaaccau

SEQ ID NO: 10337 - RNA, 2501 nt, Mus musculus
gucacguagaagccuggggacaagccggagauggaaacucagcaaggaugcaagggccaagagucugggagcucaagcucugggacugauacagucuuugcaucagugaccuuagaaaaggcuggucacccugaccacacaggccaucuggucugagaacguggggauuuagcccugaagccaaagagacuggagcagguugagguacccugagauggggaguugugguccuaauauggaaguggagauccuaggauccagaagguacauuccucugaccccagggaaccacugggcuugcuuggguuaucuggacuggaaacaaggugaggacacuggugugugaagguggaauguacaccgaggacaucuagauagauuuaccacagcagccacauguaguccccaaaccaggaauuuauaaaagaguuuaagccuggaagccuggcugugguggcacaaucccagcacuugggaggcagaggcagguggaucucugaguuugaggccaacuuggucuacagagugaguuucaggacagccagggcuacacagagaaaccuugacagagagagagagagagagagagagagagagagagagagagagagagagagacagagacagagacagagacagagacagagacagagacagagacacagagagagacagagagagacagagagagagacacacagagagacacacagagagagacacacagagagagacacacacagagagacagagagaaacaaaaagagaaacagagagagagagagagacagagagagucagagagagacacagagagacacagagagagagagagagagaguuuaguccucagccuguuuuacugagggaauuucaggccagccgagacuacauaguaagagaccuugucccaaacaaacagacaaacaaagaaacaaaaccaccaccaccaccaccaccaccaccaccaccaccaccaccaccaccaaaccccacacauagaaagagugugggccugugugagcggggaaggggaagcugggcaggcaguucaucccauccacgugaugcaagggaugugagcuuucuguagggcuaggggccaggcuggauuugaauggaauaauaucuauuuccuggggggagggugcucagaauggguguguguguggaggauaguaaccugacgcagauacaacuugugaugucugugggugaggugaugcucccaaggggcaccuuagaggacaucauaaaaaaugucucaggauguagggucauauggucaucuuucagguguggauuuggaagugggaagcucuggagguuagauuccccaccccccaccacgagacaggguuucucuguguaacccuggcuguccuggaacucacucuguagaccaggcuggccucgaacucagaaauccuccugccucugccucccaagugcugggauuaaaggcgugcgccaccacacccagcuuuggagguuagauuugagucuuagagggguaggaaugggggucuccaagaagcauggauggaaaacagauuucucccuuacguaggaauaagauucucagggggcccaaccucaccaaguacgaaagagacggggaugaggcuggcguacuggucgcaguauaugacaagcuucucgaaguagcgcuucugcucuucugccaguaagaagcugugggguagggaaugcaguagcuacaggucuccccuccacucccagucccuuccgcagggcucagauccccagccccaacuccaggucuucucaccgauaggcggcgcuuagugccauguagagucccaggaaacauaacagcucucgccacaggagcuuguagaugcuuccgcgccacagcagcagcagcugcgagaagccaccgaagcgggcauucgccacucuggcuguguaggugacggucaucgcugcgccuggccaguguggccaauggagaagguuuuagccuggguccgggccugugagccaagggaagaugcugggaggggcugauccuggggcuuucaguugaagguggaggugcgggcgacagcgcagcaggugaugauauccaaugucucagcacccuagcaccucguugcccuagggcgguccucacucccguccugguaccacccuaccccaacccccaaacgcccccccccuuuucccggguccuggcccuuucucgaguucccaucucccagucuugcucugccuuccuucucuagacugaugguccaagccccuuggacuuuaucuuaggucccucacuccuaaaccuuuggaugaaucuagucacuuuuugaccuuccucccacacacccuccuaucccuuucaccuguacaacacucaaucuuuuugacuuccugagucuucaguuucuaauccucaggguucaauauccccccucuuguugcccacucucccaaguuuggcuuucucucuguccucucuugagacuacagucugccccggcaga

SEQ ID NO: 10338 - RNA, 2501 nt, Mus musculus
ucugccggggcagacuguagucucaagagaggacagagagaaagccaaacuugggagagugggcaacaagaggggggauauugaacccugaggauuagaaacugaagacucaggaagucaaaaagauugaguguuguacaggugaaagggauaggagggugugugggaggaaggucaaaaagugacuagauucauccaaagguuuaggagugagggaccuaagauaaaguccaaggggcuuggaccaucagucuagagaaggaaggcagagcaagacugggagaugggaacucgagaaagggccaggacccgggaaaagggggggggcguuuggggguugggguagggugguaccaggacgggagugaggaccgcccuagggcaacgaggugcuagggugcugagacauuggauaucaucaccugcugcgcugucgcccgcaccuccaccuucaacugaaagccccaggaucagccccucccagcaucuucccuuggcucacaggcccggacccaggcuaaaaccuucuccauuggccacacuggccaggcgcagcgaugaccgucaccuacacagccagaguggcgaaugcccgcuucgguggcuucucgcagcugcugcugcuguggcgcggaagcaucuacaagcuccuguggcgagagcuguuauguuuccugggacucuacauggcacuaagcgccgccuaucggugagaagaccuggaguuggggcuggggaucugagcccugcggaagggacugggaguggaggggagaccuguagcuacugcauucccuaccccacagcuucuuacuggcagaagagcagaagcgcuacuucgagaagcuugucauauacugcgaccaguacgccagccucauccccgucucuuucguacuuggugagguugggcccccugagaaucuuauuccuacguaagggagaaaucuguuuuccauccaugcuucuuggagacccccauuccuaccccucuaagacucaaaucuaaccuccaaagcugggugugguggcgcacgccuuuaaucccagcacuugggaggcagaggcaggaggauuucugaguucgaggccagccuggucuacagagugaguuccaggacagccaggguuacacagagaaacccugucucguggugggggguggggaaucuaaccuccagagcuucccacuuccaaauccacaccugaaagaugaccauaugacccuacauccugagacauuuuuuaugauguccucuaaggugccccuugggagcaucaccucacccacagacaucacaaguuguaucugcgucagguuacuauccuccacacacacacccauucugagcacccuccccccaggaaauagauauuauuccauucaaauccagccuggccccuagcccuacagaaagcucacaucccuugcaucacguggaugggaugaacugccugcccagcuuccccuuccccgcucacacaggcccacacucuuucuaugugugggguuuggugguggugguggugguggugguggugguggugguggugguggugguuuuguuucuuuguuugucuguuuguuugggacaaggucucuuacuauguagucucggcuggccugaaauucccucaguaaaacaggcugaggacuaaacucucucucucucucucucugugucucucugugucucucucugacucucucugucucucucucucucucuguuucucuuuuuguuucucucugucucucugugugugucucucucugugugucucucucugugugucucucugugugucucucucucugucucucucugucucucucugugucucugucucugucucugucucugucucugucucugucucugucucucucucucucucucucucucucucucucucucucucucucucucucugucaagguuucucuguguagcccuggcuguccugaaacucacucuguagaccaaguuggccucaaacucagagauccaccugccucugccucccaagugcugggauugugccaccacagccaggcuuccaggcuuaaacucuuuuauaaauuccugguuuggggacuacauguggcugcugugguaaaucuaucuagauguccucgguguacauuccaccuucacacaccaguguccucaccuuguuuccaguccagauaacccaagcaagcccagugguucccuggggucagaggaauguaccuucuggauccuaggaucuccacuuccauauuaggaccacaacuccccaucucaggguaccucaaccugcuccagucucuuuggcuucagggcuaaauccccacguucucagaccagauggccuguguggucagggugaccagccuuuucuaaggucacugaugcaaagacuguaucagucccagagcuugagcucccagacucuuggcccuugcauccuugcugaguuuccaucuccggcuuguccccaggcuucuacgugac

SEQ ID NO: 10339 - RNA, 2501 nt, Mus musculus
cacuguggaggcucuaacagggacccacgccguaucuagguaguggaagggucugccucuccagaacgggcggucaggcuccuuucuguuucucaaacgagcgggccaagcgaaucccgauuggacacgauccaauuuagugaacccgcagguggcuguagagucccgagaccuuuggccucucgccagcuuaccaggagcaacucugcuccaggagcgcccugaauuacuaaacaaauaccuucaccccgggccucucccggggucuguggucaggacagauuagaagcagccaggaguggcuguccgcacuuccgagauccgcgaaacugcacuagugcuucguucccaagucacccucucaauucuugccccagauccugccgcgcccgccaucgccuguuugugcccuugcagugccagcgucggccuagggccaggcgcccuguccccagucgcguuuucggccucugcgggugcucuaaggaaacgcagacaucuuuggggaccuggcuagcgggugggugcuggcucugaaguggcuggcccgggagggcguagcaccaccucucccacccccaccucaaccccuuuucucuguccacccuacgagauucaaguuuaaaaacaagucugcaaaggaaggaugugggguuagugaacgcgauucuguccgcggugggggaagaaaaaaacaaaaaacaaaaaaaggaaaaagcaggcagaaaggcuuugggcuggagccugauuguugagccuagaaagcgagaaggugagcguggaggagaccuuacagaggccuuagcugucugugaagcuaacaguccuuaugagaagucccuaaagucccuaagggaaacccagggaucuuuacaaaaugguucagaaggagaaggcaggaaacugucucugcggaugcucucacaggaaccuuggacaguuuaaggggcagugcaagccaaagagcaauguaugaggcccugcuaccacguucccggagcagugggagcuuaugccacugauuucugacgcuugcuuccacagagcccuacugccagggacccccucuacugcgacccuggcccccagguggcagcugaccuggauggucugucuguuguagacuuucaccacguggaaguuaaaacuguagaugccuuugcgcggggcgaugaaagugcugcguucugagucaaaguuguucccgauguucacuaguaccuacaagaagacaggaacgaaaagggguagaccggaguccgcccgagcguggccucgcgcuucugcagagucccuggagaguauaucccacauccgccuuccaagcucucccugucacccccucaccaauccauucugggugcugcaaaagaauggggaacucaccuggucgaaguagaugaucauggugcgauuacucaucucggacggcucaugguuggugcuccugauggcagagaaagccaccuuggcgcugccggagcgcacagagaugcccagagcagugcccguagggucagacgugggguuggagucacacaccaccaggcacuugcccuccaguacgaugggcucugucucauucugcccgcgggcugggccugccagccacgcaguccccaacagcagcagcuccacgacgcccagcaucgcgccuccggcgcccaccccgccccccaccccgggggcugccagcgccagccgccccccuccccagcccugcuccgaagcccccuccucagcucugugcgcagcucugccgacgccucccgggccacuacgccucucccucgcacuccagaacaaauguccccgcgugccgugugcccgaagccccgcccgggccucaggggugccgcggccgcccagccgcacuuggaugcauagccucugcugccugguccccgcuguugccgccgccuccuguccgcacucgccgcugcugcugccgccgccgcucugaauuauugaugcagcgggcgcugcagccggagcgggcggagagcgcgcgccgggcacaaaggcgcggaucaagccuggccccgcccccgccccucccagccagccucucugagcggccccgccccuccucugccgaagccccacccuccagccaaucgcgacgcaccgcgcuccccgccgagccaaugguugcccuguccgcgcgcggccaccugaccuagggcgccguuguuauuaggagcggcgaggcgggaggcgcggggcagcggggcugggcuccggccgggagucagacgagggagcgcgcgcgcgcucccggacaguucuccgcagccgcucgcccgagccuucuacuuggccaacacagcugccucuaccaccucgcgugcccgguucgugggcuuucagguaggaggcggcgcgcggcgggucgggagugcagcaucgcgccgaccgaggggcgcggcguggauguggggggcgggcaggagcgcccccccguggacacgagcgcgcggggcagcgacagcggcgggcug

SEQ ID NO: 10340 - RNA, 2501 nt, Mus musculus
cagcccgccgcugucgcugccccgcgcgcucguguccacgggggggcgcuccugcccgccccccacauccacgccgcgccccucggucggcgcgaugcugcacucccgacccgccgcgcgccgccuccuaccugaaagcccacgaaccgggcacgcgaggugguagaggcagcuguguuggccaaguagaaggcucgggcgagcggcugcggagaacuguccgggagcgcgcgcgcgcucccucgucugacucccggccggagcccagccccgcugccccgcgccucccgccucgccgcuccuaauaacaacggcgcccuaggucagguggccgcgcgcggacagggcaaccauuggcucggcggggagcgcggugcgucgcgauuggcuggaggguggggcuucggcagaggaggggcggggccgcucagagaggcuggcugggaggggcgggggcggggccaggcuugauccgcgccuuugugcccggcgcgcgcucuccgcccgcuccggcugcagcgcccgcugcaucaauaauucagagcggcggcggcagcagcagcggcgagugcggacaggaggcggcggcaacagcggggaccaggcagcagaggcuaugcauccaagugcggcugggcggccgcggcaccccugaggcccgggcggggcuucgggcacacggcacgcggggacauuuguucuggagugcgagggagaggcguaguggcccgggaggcgucggcagagcugcgcacagagcugaggagggggcuucggagcagggcuggggaggggggcggcuggcgcuggcagcccccgggguggggggcggggugggcgccggaggcgcgaugcugggcgucguggagcugcugcuguuggggacugcguggcuggcaggcccagcccgcgggcagaaugagacagagcccaucguacuggagggcaagugccugguggugugugacuccaaccccacgucugacccuacgggcacugcucugggcaucucugugcgcuccggcagcgccaagguggcuuucucugccaucaggagcaccaaccaugagccguccgagaugaguaaucgcaccaugaucaucuacuucgaccaggugaguuccccauucuuuugcagcacccagaauggauuggugagggggugacagggagagcuuggaaggcggaugugggauauacucuccagggacucugcagaagcgcgaggccacgcucgggcggacuccggucuaccccuuuucguuccugucuucuuguagguacuagugaacaucgggaacaacuuugacucagaacgcagcacuuucaucgccccgcgcaaaggcaucuacaguuuuaacuuccacguggugaaagucuacaacagacagaccauccaggucagcugccaccugggggccagggucgcaguagagggggucccuggcaguagggcucuguggaagcaagcgucagaaaucaguggcauaagcucccacugcuccgggaacgugguagcagggccucauacauugcucuuuggcuugcacugccccuuaaacuguccaagguuccugugagagcauccgcagagacaguuuccugccuucuccuucugaaccauuuuguaaagaucccuggguuucccuuagggacuuuagggacuucucauaaggacuguuagcuucacagacagcuaaggccucuguaaggucuccuccacgcucaccuucucgcuuucuaggcucaacaaucaggcuccagcccaaagccuuucugccugcuuuuuccuuuuuuuguuuuuuguuuuuuucuucccccaccgcggacagaaucgcguucacuaaccccacauccuuccuuugcagacuuguuuuuaaacuugaaucucguaggguggacagagaaaagggguugaggugggggugggagagguggugcuacgcccucccgggccagccacuucagagccagcacccacccgcuagccagguccccaaagaugucugcguuuccuuagagcacccgcagaggccgaaaacgcgacuggggacagggcgccuggcccuaggccgacgcuggcacugcaagggcacaaacaggcgauggcgggcgcggcaggaucuggggcaagaauugagagggugacuugggaacgaagcacuagugcaguuucgcggaucucggaagugcggacagccacuccuggcugcuucuaaucuguccugaccacagaccccgggagaggcccggggugaagguauuuguuuaguaauucagggcgcuccuggagcagaguugcuccugguaagcuggcgagaggccaaaggucucgggacucuacagccaccugcggguucacuaaauuggaucguguccaaucgggauucgcuuggcccgcucguuugagaaacagaaaggagccugaccgcccguucuggagaggcagacccuuccacuaccuagauacggcgugggucccuguuagagccuccacagug

SEQ ID NO: 10341 - RNA, 2501 nt, Mus musculus
ggucucccacuaugcuucccaaauucggagucucuuaccgccuuggcaccggcuggaaagcugucuugaguaacuuuuucuccacuuccaaggcacuacagcgaucuguaggaaacagagggaagaaaaaggaggccuuuaaaacacaggcuccaggccuccagggcagcugcacccgccugcgagcaaagaggaaaacaccggcgucccacacacccccaaagccccguucuuucccuuuagucuaggcgagagccccaccaacacccucccacugugccccuacauuuuucuugucaccuguuccacucuccggcucggcaggccgagcauaggcggcugcggccgcagcgggaugaccugcggcuccgggaagucccagcaggugcuguggggccgagcccagcauggacagcgggugcggccgcggaccggccggcggcccugggaaaggccuguugguccaagcggggaauuugccaagcggcgccgacacgagucugugugccgcugcagccgcugcagcggccgcgggcgagagcugcagcgucgggggcgcaacggcugcgccgggaggcgaaccuccggcuccgggaggcgagcggcguggguuguccgggcugguggccgucucggccagugaccagaucuugggcuucuggagggcggaggagggcgccggggccggagcgcagggauccaggcuggaggguggagaagguggagaugcaggagcccuggccacgggcgguggcgguggggccaggcucaggaccgacaguggucgguccuccaagccuucggagcugucguccgagucgcuaguuuugcaguccgaaaugggucccaggccgaagucgccguuccugugcgccgccccagccagggucagcuccgacccggcugccgcgcugucuaaguuuuccaaaucgaucuccucauccucgucgucgucggccagccccucgccccccguguccuccuccucuccugcgagcuccuccuccuccaucuccagcucgcguuugcucucuuccucgucuuccucuucguccuccuccucccgcucgcucccauaagcauugcccuccucguccgugcgacuacggggagcccacgucaucuuguucuccuucuugaggcgccggcgcgcguuggcgaaccagguggacaccugggugagggucaucuuggugaugauggccaacaugaucuucucgcccuuggugggguacggguucuugcggugcucguugagccaggccuugagcgugcucgugcuuucccggguggcguucuugggacgggacggguccccgaacugguacuggccauagggguagaaggcggggugcgggugcgggaacgcggcggccguggccggaugcuggacgccagggcuguccuucagcucauacugagcgcccuguacgcacauggaaaaggaaggggacacgcgcgcagggagcgcgagugagcuccugccguccccaccuuuauccucccgccgggaccccagcuuucuucugcacgcucaccuugccccacaccccaacuccaaccccucucucccggguuucucuggcucuuaccagcugugggaagaugggcagcuccguggcguagggcaggaaggcgccguaacccugagcggcggcggcggcagcugcggcagcggcguagggugccccguacacugaugaaagcacauuggauagggacccagaggcggccaacucggaggcuccggcgccgggaccgcuccggcccccagcgcuacugccgccuccaccgccgcccgcagcucccgggcguucggguggguagagagggcggauguacugguauccgagcugggggaaggacaugguggcccgcggcgcaccuacggacugggggcccggacccccgagccgccgugcucagcuccggaccccggcuccggagcgcaucgggggcugggccgagcccgggccgcgcugcgucgcgcuccgcguucgccuauugaucugcuccgcggcgggcggcggcggcggcagcggcggcagcgaggagucaggucagguccgaacagauuggccgagauucccugggcuccgggcucugauugacauuucuacggggccucaagccccuccucucugcgcagcacucccuccucuaggccgggcgagccgcucugcgcuaggcgcucaguucugcccuccucuccgggagcugugucgcgccucgcuuccuucgcccuccucuaguuuacacucuccuccuguccuguccucuccccuccccucgcugcguccccccucaccccaccccuggccgcuuccgcucccgaggcuccuucgcaguccuggacgcugggaaacugcgguucuuuuugcucuuucuguuucucacgguugcuuuugcucaccuuucugcucucuucacuuuuccuagucugacuccucucuuuuaaaucucuuuacucucucguucucucuuccccucuuccccggucu

SEQ ID NO: 10342 - RNA, 2501 nt, Mus musculus
agaccggggaagaggggaagagagaacgagagaguaaagagauuuaaaagagaggagucagacuaggaaaagugaagagagcagaaaggugagcaaaagcaaccgugagaaacagaaagagcaaaaagaaccgcaguuucccagcguccaggacugcgaaggagccucgggagcggaagcggccagggguggggugaggggggacgcagcgaggggaggggagaggacaggacaggaggagaguguaaacuagaggagggcgaaggaagcgaggcgcgacacagcucccggagaggagggcagaacugagcgccuagcgcagagcggcucgcccggccuagaggagggagugcugcgcagagaggaggggcuugaggccccguagaaaugucaaucagagcccggagcccagggaaucucggccaaucuguucggaccugaccugacuccucgcugccgccgcugccgccgccgccgcccgccgcggagcagaucaauaggcgaacgcggagcgcgacgcagcgcggcccgggcucggcccagcccccgaugcgcuccggagccgggguccggagcugagcacggcggcucggggguccgggcccccaguccguaggugcgccgcgggccaccauguccuucccccagcucggauaccaguacauccgcccucucuacccacccgaacgcccgggagcugcgggcggcgguggaggcggcaguagcgcugggggccggagcggucccggcgccggagccuccgaguuggccgccucugggucccuauccaaugugcuuucaucaguguacggggcacccuacgccgcugccgcagcugccgccgccgccgcucaggguuacggcgccuuccugcccuacgccacggagcugcccaucuucccacagcugguaagagccagagaaacccgggagagagggguuggaguugggguguggggcaaggugagcgugcagaagaaagcuggggucccggcgggaggauaaagguggggacggcaggagcucacucgcgcucccugcgcgcguguccccuuccuuuuccaugugcguacagggcgcucaguaugagcugaaggacagcccuggcguccagcauccggccacggccgccgcguucccgcacccgcaccccgccuucuaccccuauggccaguaccaguucggggacccgucccgucccaagaacgccacccgggaaagcacgagcacgcucaaggccuggcucaacgagcaccgcaagaacccguaccccaccaagggcgagaagaucauguuggccaucaucaccaagaugacccucacccagguguccaccugguucgccaacgcgcgccggcgccucaagaaggagaacaagaugacgugggcuccccguagucgcacggacgaggagggcaaugcuuaugggagcgagcgggaggaggaggacgaagaggaagacgaggaagagagcaaacgcgagcuggagauggaggaggaggagcucgcaggagaggaggaggacacggggggcgaggggcuggccgacgacgacgaggaugaggagaucgauuuggaaaacuuagacagcgcggcagccgggucggagcugacccuggcuggggcggcgcacaggaacggcgacuucggccugggacccauuucggacugcaaaacuagcgacucggacgacagcuccgaaggcuuggaggaccgaccacugucgguccugagccuggccccaccgccaccgcccguggccagggcuccugcaucuccaccuucuccacccuccagccuggaucccugcgcuccggccccggcgcccuccuccgcccuccagaagcccaagaucuggucacuggccgagacggccaccagcccggacaacccacgccgcucgccucccggagccggagguucgccucccggcgcagccguugcgcccccgacgcugcagcucucgcccgcggccgcugcagcggcugcagcggcacacagacucgugucggcgccgcuuggcaaauuccccgcuuggaccaacaggccuuucccagggccgccggccgguccgcggccgcacccgcuguccaugcugggcucggccccacagcaccugcugggacuucccggagccgcaggucaucccgcugcggccgcagccgccuaugcucggccugccgagccggagaguggaacaggugacaagaaaaauguaggggcacagugggaggguguugguggggcucucgccuagacuaaagggaaagaacggggcuuugggggugugugggacgccgguguuuuccucuuugcucgcaggcgggugcagcugcccuggaggccuggagccuguguuuuaaaggccuccuuuuucuucccucuguuuccuacagaucgcuguagugccuuggaaguggagaaaaaguuacucaagacagcuuuccagccggugccaaggcgguaagagacuccgaauuugggaagcauagugggagacc

SEQ ID NO: 10343 - RNA, 2501 nt, Mus musculus
gagggagaagccacuguggagcguggagggagaaaaaccaccucccagcccagcucucgggagaacaagacguccgccaacuucgcuauucgcacuggcgaggagggcgcagagcguucucccgagcgcagcccgcugcaucuuucccuuuguguucccgaacggcccgagccaagacuaaggccaguuguacgucgagauugccgcuccgcccagaguuagcaaaaggagagcaaaguuggaagcgaucggcgcgcuugggaugugauugucauccuggggccggcgcucgagagucugagaaagagagaaggagaggaagagucgggagggaggagggggaggccgggcagaggaggagagggggguggcggaggagaggcgggcgcuagggaggggcgaggggagcgccagugagcgggagaggagccggggaggaacagggagagggcgagacgcgccuggcggccggguuggcugccgccggccagaggcuccugccaguccccccaccgacuacaccccgggaaggaggagcuucgcgcgcacacaaggcgucagaauccucaauuuccaacuuagcaucuuggcaggaccuuugcaaagccaaaagcagagccccccggugcaaagagcgagggagggggguggggggagagaaagccuagcccgggcaagcggggcgcgcagaggagcgggcgcggcggucgcagccagaggcgcgcgggaagccaaccaggaggcgccgcgggccggagcccgggagccggggcucgaagagcugcggcccggggcagccagaagccaggugcccucucgcucgcccucgcagggcgccgcccggcucguuggccgccgcggcgcggcgcgccccaugcccguguguggccauguccuacccgcagggcuacuuguaccagccguccgccucgcuggcgcucuacucgugccccgcauacagcaccagcgucauuucggggccccgcacggaugagcucggccgcucuucuucgggcuccgcguucucgcccuacgcuggcuccacugccuucacggcucccucgcccggcuacaacucgcaccuccaguacggcgccgaccccgcggcugcggccgccgcugccuucucuuacguggugagugugagcuggguccgaggcgggcgggcgggcgggcgagcgagcgggcagccggggccaggccugcagagcccgguugcgguggacacgggccuaggcgccaccucacccgccaagcuucgcggcccuugcaaacuugagcaauugucuaauucagcuucacucgagccgcgggcuccggaguggcucuggcgaaagccgcgucuugcugggaucgccgagcugaagggaaggcuuuggggcgcggggagggggggggauugauuggucuuuacuauaaagaacggcauuuggcucaaagcucugggacaacccgcaaauuucuucuucuucuuccuccucuuucuuuugguuuugccauguuggaaaaaguaguucaaaagaagccgaccggaauuccaaacaguaguagugugcuaaaucuauguaaauguguuuggccucgccuuuaauuaauccccaaaauguugcaaauccguaauccuaucuucgcaauccgauuuggaaguauuaaauuucugaaacggccagcgagaugcgguguauccggguuuuuacggcggggugugauuucuggaaaagcgcaacggcuucgguuagggauagcauuuuuagaccgucggugugcaagcuaaggcucagcuugucuaucgcauuucuuugaagauuaaagaaagagccuuuccuucccuuguuguaccccuugcgcccaacaugcggccgcucuggagcagagcucugaguuguugcugaggcugcucaggccucuaagagaaccgugggcccuuccgcagaggccagaucugagaccugggcaccgaggucccccagcagaugguggccuccaagguggugugcuaaacccugaacagccucaggggucccgaagggccagaaucagaauuggggggcccugcugccuucugaggagggggaagguggucacucuugcguuuaaaccagccagcucugccucaggggaagcuggagugcgggcccgcgcuggcacucaaaaccaaggacagagggaaaguggguuucagucuuuuggguggcuauguagcccacacccucacucacuuaaccucugccugucccucacagggcucucccuacgaccacacucccgguauggcagguuccuugggauaucacccuuaugcagcaccucugggcuccuauccuuauggggaccccgcguaccggaagaaugccacucgggacgcuacagccacucucaaggccuggcucaacgagcaccgcaagaacccguaccccaccaagggagagaagaucaugcuggccauuaucaccaagaugacccucacccagguguccaccugguuugccaacgcgcgccgg

SEQ ID NO: 10344 - RNA, 2501 nt, Mus musculus
ccggcgcgcguuggcaaaccagguggacaccugggugagggucaucuuggugauaauggccagcaugaucuucucucccuuggugggguacggguucuugcggugcucguugagccaggccuugagaguggcuguagcgucccgaguggcauucuuccgguacgcgggguccccauaaggauaggagcccagaggugcugcauaagggugauaucccaaggaaccugccauaccgggaguguggucguagggagagcccugugagggacaggcagagguuaagugagugagggugugggcuacauagccacccaaaagacugaaacccacuuucccucuguccuugguuuugagugccagcgcgggcccgcacuccagcuuccccugaggcagagcuggcugguuuaaacgcaagagugaccaccuucccccuccucagaaggcagcagggccccccaauucugauucuggcccuucgggaccccugaggcuguucaggguuuagcacaccaccuuggaggccaccaucugcugggggaccucggugcccaggucucagaucuggccucugcggaagggcccacgguucucuuagaggccugagcagccucagcaacaacucagagcucugcuccagagcggccgcauguugggcgcaagggguacaacaagggaaggaaaggcucuuucuuuaaucuucaaagaaaugcgauagacaagcugagccuuagcuugcacaccgacggucuaaaaaugcuaucccuaaccgaagccguugcgcuuuuccagaaaucacaccccgccguaaaaacccggauacaccgcaucucgcuggccguuucagaaauuuaauacuuccaaaucggauugcgaagauaggauuacggauuugcaacauuuuggggauuaauuaaaggcgaggccaaacacauuuacauagauuuagcacacuacuacuguuuggaauuccggucggcuucuuuugaacuacuuuuuccaacauggcaaaaccaaaagaaagaggaggaagaagaagaagaaauuugcggguugucccagagcuuugagccaaaugccguucuuuauaguaaagaccaaucaaucccccccccuccccgcgccccaaagccuucccuucagcucggcgaucccagcaagacgcggcuuucgccagagccacuccggagcccgcggcucgagugaagcugaauuagacaauugcucaaguuugcaagggccgcgaagcuuggcgggugagguggcgccuaggcccguguccaccgcaaccgggcucugcaggccuggccccggcugcccgcucgcucgcccgcccgcccgcccgccucggacccagcucacacucaccacguaagagaaggcagcggcggccgcagccgcggggucggcgccguacuggaggugcgaguuguagccgggcgagggagccgugaaggcaguggagccagcguagggcgagaacgcggagcccgaagaagagcggccgagcucauccgugcggggccccgaaaugacgcuggugcuguaugcggggcacgaguagagcgccagcgaggcggacggcugguacaaguagcccugcggguaggacauggccacacacgggcauggggcgcgccgcgccgcggcggccaacgagccgggcggcgcccugcgagggcgagcgagagggcaccuggcuucuggcugccccgggccgcagcucuucgagccccggcucccgggcuccggcccgcggcgccuccugguuggcuucccgcgcgccucuggcugcgaccgccgcgcccgcuccucugcgcgccccgcuugcccgggcuaggcuuucucuccccccaccccccucccucgcucuuugcaccggggggcucugcuuuuggcuuugcaaagguccugccaagaugcuaaguuggaaauugaggauucugacgccuugugugcgcgcgaagcuccuccuucccgggguguagucgguggggggacuggcaggagccucuggccggcggcagccaacccggccgccaggcgcgucucgcccucucccuguuccuccccggcuccucucccgcucacuggcgcuccccucgccccucccuagcgcccgccucuccuccgccaccccccucuccuccucugcccggccucccccuccucccucccgacucuuccucuccuucucucuuucucagacucucgagcgccggccccaggaugacaaucacaucccaagcgcgccgaucgcuuccaacuuugcucuccuuuugcuaacucugggcggagcggcaaucucgacguacaacuggccuuagucuuggcucgggccguucgggaacacaaagggaaagaugcagcgggcugcgcucgggagaacgcucugcgcccuccucgccagugcgaauagcgaaguuggcggacgucuuguucucccgagagcugggcugggaggugguuuuucucccuccacgcuccacaguggcuucucccuc

SEQ ID NO: 10345 - RNA, 2501 nt, Mus musculus
ggggcagaagauagguggggcagguaaaggaggugggggggggcaguagagggggugaagaaugagaagugaccggaggauagagggccaaggauagucggaggggcaguguagugcaaagauucauggguggggaagugagaagagcagggucggagggacuguggggugcgccgggguuggugggcgggacaggaucgagggggaacugagaaugaaaggacaaggugcagggaaggauccuaaggcuagugaagaggcagaggaaguaaguggaaauagagaagacagagagagacagacuggacuacaucugaggggcaaugaggagugguuggaaggauggagcaggauaugggcaggacguaggcagagggggagugggggaggaggagaugggaggauccacaggacggauggguaaggcagcguccacggaacacgggggcugcguagagaauggucggagggaggaugggcggggcaggguucgaggggcaguuguggguggggaugggggaggugggcgggacagcggaggaugaguccccggccuagucuaacuccacuuuuucuucuuccgcacagcggguuuccgcuucccuccagggcggugggugaggcagugaggcccaggcucgaccagauagcgccgcuauguggcccccggacgcagagccagagcccgauccagaguccgcgcauggcccccgaaguggcaggacagugccgggacuccgagcccuguugcccgcgcgcgccuuccucugcucucucaaaggccgccuccugcuggccgagucggugagugcgugugcuccccgggugcgugaagcccgguacccgcgccccagccuggggccuugcaccuccagcccaggagaauuuggaccaccgcccccaagcuugcuacgacuucucuguagcggagcucgagucagaaucaggcccgagccguguucuucccggauucuccagucugcgaggcccucgaaagggaccagaagucaaggguuugggguccugguccccgcuggagccgcagcucggcugcugugugaccucgagcgccuccgcccucucugaguccccgggacugcugcgcucgcuaagcuucuucuggccucgcccgcccugcacacccucccaccuccuaggcugagaccuagccgccuguguggugaagauccuacggagugggaugugcccccggggagugggugaggcaggggccacguagugaagacacaggcggaccacuguuucaggguggcgagccugcggggugacuucaugcccuccuuccccccucccgcgcuguacuccuuccuccucccugcuuguccccacccggauaggaaggucuccuuuguccucccaacacucaucaucacguguggggcgggaacuggcauggagccuauggagauggggagaggggugggaggagggacgguggaaggaggaaacagaccauagugacagccacuuguugcucagauaccuagcaacuuaauauccgaccugcucccacuucgaguuggggauaggagagacagugucuuuaacugcuaggaaacuuggcaggugacucauccagugaccuugaggauauccuugagggcaaaagggggguucugccccaggaccucuccguuguaccccaggaccuacuaaggagcaucaacccugaggucuccgguagaaccuaauacuuuguuccuaaaugaggugccaagcggaccuagagcccauuuucuggccguuucagaucucuggaagccucugggaggcguggggcgggucuuugaaucuacuggccacuggcuucaguccuaccugcccaguaccccuucauggaaaaggagugagugccaaccagaagucacaagauguccuugcccuagcugggugccagaaagacaggccuaagaaaauaugaaggguaguaagcucauaggguauaggggagccucccccagucauuccucccccuuggucucaugcaaguagggagucugaccuggauagaaagcuggaggaagaagcagccaccaagaacuggggagugagaaaacaggagugggggagggaggagguuggggcaggggagugccaccagaaccagacuuuuucuuuuuuuuuuuuuuucaaauuuauuuauuauauguaaguacacuguagcugucuucagccaggccagaagaggcgucagaucucauuauagaugguugugagccaccaugugguugcugggauuugaacucaggaccuggggaagagcagucagugcucuugccugcugagccaucucgccagcccagaaccagacuuuuuugaggggaauggguacagaaaagaggagagccauacgagcagccuuuggcaaggaaauacaguaggagcugauagcaaccucaaaacgccuuucucuaagccuuaguuuccuguuugcccaaaggaagcuccucuucccccaugacuuguucaguaaaagagau

SEQ ID NO: 10346 - RNA, 2501 nt, Mus musculus
aucucuuuuacugaacaagucaugggggaagaggagcuuccuuugggcaaacaggaaacuaaggcuuagagaaaggcguuuugagguugcuaucagcuccuacuguauuuccuugccaaaggcugcucguauggcucuccucuuuucuguacccauuccccucaaaaaagucugguucugggcuggcgagauggcucagcaggcaagagcacugacugcucuuccccagguccugaguucaaaucccagcaaccacaugguggcucacaaccaucuauaaugagaucugacgccucuucuggccuggcugaagacagcuacaguguacuuacauauaauaaauaaauuugaaaaaaaaaaaaaaagaaaaagucugguucugguggcacuccccugccccaaccuccucccucccccacuccuguuuucucacuccccaguucuugguggcugcuucuuccuccagcuuucuauccaggucagacucccuacuugcaugagaccaagggggaggaaugacugggggaggcuccccuauacccuaugagcuuacuacccuucauauuuucuuaggccugucuuucuggcacccagcuagggcaaggacaucuugugacuucugguuggcacucacuccuuuuccaugaagggguacugggcagguaggacugaagccaguggccaguagauucaaagacccgccccacgccucccagaggcuuccagagaucugaaacggccagaaaaugggcucuagguccgcuuggcaccucauuuaggaacaaaguauuagguucuaccggagaccucaggguugaugcuccuuaguagguccugggguacaacggagagguccuggggcagaaccccccuuuugcccucaaggauauccucaaggucacuggaugagucaccugccaaguuuccuagcaguuaaagacacugucucuccuauccccaacucgaagugggagcaggucggauauuaaguugcuagguaucugagcaacaaguggcugucacuauggucuguuuccuccuuccaccgucccuccucccaccccucuccccaucuccauaggcuccaugccaguucccgccccacacgugaugaugaguguugggaggacaaaggagaccuuccuauccggguggggacaagcagggaggaggaaggaguacagcgcgggaggggggaaggagggcaugaagucaccccgcaggcucgccacccugaaacagugguccgccugugucuucacuacguggccccugccucacccacuccccgggggcacaucccacuccguaggaucuucaccacacaggcggcuaggucucagccuaggaggugggagggugugcagggcgggcgaggccagaagaagcuuagcgagcgcagcagucccggggacucagagagggcggaggcgcucgaggucacacagcagccgagcugcggcuccagcggggaccaggaccccaaacccuugacuucuggucccuuucgagggccucgcagacuggagaauccgggaagaacacggcucgggccugauucugacucgagcuccgcuacagagaagucguagcaagcuugggggcggugguccaaauucuccugggcuggaggugcaaggccccaggcuggggcgcggguaccgggcuucacgcacccggggagcacacgcacucaccgacucggccagcaggaggcggccuuugagagagcagaggaaggcgcgcgcgggcaacagggcucggagucccggcacuguccugccacuucgggggccaugcgcggacucuggaucgggcucuggcucugcguccgggggccacauagcggcgcuaucuggucgagccugggccucacugccucacccaccgcccuggagggaagcggaaacccgcugugcggaagaagaaaaaguggaguuagacuaggccggggacucauccuccgcugucccgcccaccucccccauccccacccacaacugccccucgaacccugccccgcccauccucccuccgaccauucucuacgcagcccccguguuccguggacgcugccuuacccauccguccuguggauccucccaucuccuccucccccacucccccucugccuacguccugcccauauccugcuccauccuuccaaccacuccucauugccccucagauguaguccagucugucucucucugucuucucuauuuccacuuacuuccucugccucuucacuagccuuaggauccuucccugcaccuuguccuuucauucucaguucccccucgauccugucccgcccaccaaccccggcgcaccccacagucccuccgacccugcucuucucacuuccccacccaugaaucuuugcacuacacugccccuccgacuauccuuggcccucuauccuccggucacuucucauucuucacccccucuacugcccccccccaccuccuuuaccugccccaccuaucuucugcccc

SEQ ID NO: 10347 - RNA, 2501 nt, Mus musculus
gguucauucuucuccuuuguuuuagguaggccuuugggggccugauggaccagcaacaccucccccacccuccaacaccaaguuuucuuccugaacauuuuuagccacugaugauccccagggacucaagcugagccaagaccaacuggcccacagcccagccaggaucucccucccuuuccugacccgaugccugcuuaccauccacagagaccucacgagagcgcaccaggucacucuuguugcccacgagaaugaugggcacgucgucugucugccgggcccgccgcagcuggacccggaguucugaggcuuucucaaagcugcccuuguccgugauggaguacacgaugacguaugcaucccccauggccaugcaguggccaggcagccagcagcccccauccuggaggggacacaaacacacacacaacccuguaauuaccagcaagacccuucuccagcuuugcuuccucuuguguccugugacccggccugcguccuaccuguucccaaaugucauagaccaauagugacgcuucuucuccauccacagugauagaacggucauaugugugcccuagaaaggaagccaagaagccaguuaucagucggcugucaacguucccagugucugccuucuucuccugaccacgccuccugcugcuucucccaguccucugauaauucuccucuguuagcagaugguugcuaugcccaaacaauaugacaagcccgggagucagggacuggaggacacgaccuccaucucuuuguccccaaacuagagaaguacugggugucuagggauccugcugccugggucaaggguggguguggucauauugggugaaguuaguauaguggcugucacaaacccuggagacuuuggccaccuaacuuuccucucccagaaauguccucagaauuuguuccugccagccccgguaggcaggaaagugcugcuacgagccacaggaaaaaaaucauaucuagcacucuacucuucuauucuggacacuuuuuuccuaucaacgacugguacguggguaggagagagguggaggggguggagugaguagggaguaagucuccuucaguuucuccaucuuggacgcggaaauaacauaauuucgaaaacgccuugaaauuucauaguauuugccacuuuuaguccagcuccaccgccccccaacugucuuuaucuaaacagcucagcucucucaccugcugcuucugcuucagguccgucuucuauaccaccaaagaugcgcgccagagcgcuuuugcccacaccaggcgccccgagcagcagcaccuuguaaacgcccuccucugacccacugccuccagaacugagcgagucggaggagccuucgggccaguccagccucuggcccuguguccgaguuccagcggcagucguugccagggagcccggggcuagcgccgccugaaggucucgcucguccaccggcaugcuccugcggugcagugggggugccgggccccauggggugcugccucgacggcggucgcgcucccggcccgcaccacggcucccgcuugcuccgcugccaccauucagggucaucguguuggacgccgucuggggaacgaagaauugggauggcagcucuaucgcgggagcagguaggacucuggagucaagaaagaugcucaggaugaaggaaccuacugccaaccaggaggucucuacgucuuaaccaguaacccagcuggaccugcauccacauucagccccagaugguguuguccaccccgcuuagucaggacacucaccaacucucacacagauguuaucaggacuugaucagcgcugcgacacagaccacugggggaucugauagaacccacucguagaccccuguucagacucagacccuugucgcugucacgacugcagucuuuuucuccucugcugcuuucucagccccucagcuggcgcugggucgcuguucuagggccuccuauuuaaaccucuaccagucagacuuccgcccuuaccccuacccccgcucccgcccccgcccccgcccccgcccccgcccccgccccuguccucccgggcugcugcaaaggcugacgcauccacucgcccucgggaaucccccaccucccuucuaggaccgcaaacccgccaggggcggggcagguagcuggaaggaggcucgcgcgggaugggggguaguuuagagggguguuggaggggagggauggggagugugcguugaggagggugcaccagugugugugugugugugugugugugugugugugugugugugcauugauacagaggcugccaguaguggguaaaguggagugaacuaccacuccaucuuuaaagaugaauuuucccuucugcucacuccuggccuauuacccaagucaguagacguauuauggacacgcucagaaccuaugaagcccguuccuccagguauggaccuaaccagaauuuagaggguccuaaacug

SEQ ID NO: 10348 - RNA, 2501 nt, Mus musculus
caguuuaggacccucuaaauucugguuagguccauaccuggaggaacgggcuucauagguucugagcguguccauaauacgucuacugacuuggguaauaggccaggagugagcagaagggaaaauucaucuuuaaagauggagugguaguucacuccacuuuacccacuacuggcagccucuguaucaaugcacacacacacacacacacacacacacacacacacacacacuggugcacccuccucaacgcacacuccccaucccuccccuccaacaccccucuaaacuaccccccaucccgcgcgagccuccuuccagcuaccugccccgccccuggcggguuugcgguccuagaagggaggugggggauucccgagggcgaguggaugcgucagccuuugcagcagcccgggaggacaggggcgggggcgggggcgggggcgggggcgggggcgggagcggggguagggguaagggcggaagucugacugguagagguuuaaauaggaggcccuagaacagcgacccagcgccagcugaggggcugagaaagcagcagaggagaaaaagacugcagucgugacagcgacaagggucugagucugaacaggggucuacgaguggguucuaucagaucccccaguggucugugucgcagcgcugaucaaguccugauaacaucugugugagaguuggugaguguccugacuaagcgggguggacaacaccaucuggggcugaauguggaugcagguccagcuggguuacugguuaagacguagagaccuccugguuggcaguagguuccuucauccugagcaucuuucuugacuccagaguccuaccugcucccgcgauagagcugccaucccaauucuucguuccccagacggcguccaacacgaugacccugaaugguggcagcggagcaagcgggagccguggugcgggccgggagcgcgaccgccgucgaggcagcaccccauggggcccggcacccccacugcaccgcaggagcaugccgguggacgagcgagaccuucaggcggcgcuagccccgggcucccuggcaacgacugccgcuggaacucggacacagggccagaggcuggacuggcccgaaggcuccuccgacucgcucaguucuggaggcagugggucagaggagggcguuuacaaggugcugcugcucggggcgccuggugugggcaaaagcgcucuggcgcgcaucuuuggugguauagaagacggaccugaagcagaagcagcaggugagagagcugagcuguuuagauaaagacaguuggggggcgguggagcuggacuaaaaguggcaaauacuaugaaauuucaaggcguuuucgaaauuauguuauuuccgcguccaagauggagaaacugaaggagacuuacucccuacucacuccacccccuccaccucucuccuacccacguaccagucguugauaggaaaaaaguguccagaauagaagaguagagugcuagauaugauuuuuuuccuguggcucguagcagcacuuuccugccuaccggggcuggcaggaacaaauucugaggacauuucugggagaggaaaguuagguggccaaagucuccaggguuugugacagccacuauacuaacuucacccaauaugaccacacccacccuugacccaggcagcaggaucccuagacacccaguacuucucuaguuuggggacaaagagauggaggucguguccuccagucccugacucccgggcuugucauauuguuugggcauagcaaccaucugcuaacagaggagaauuaucagaggacugggagaagcagcaggaggcguggucaggagaagaaggcagacacugggaacguugacagccgacugauaacuggcuucuuggcuuccuuucuagggcacacauaugaccguucuaucacuguggauggagaagaagcgucacuauuggucuaugacauuugggaacagguaggacgcaggccgggucacaggacacaagaggaagcaaagcuggagaagggucuugcugguaauuacaggguuguguguguguuuguguccccuccaggaugggggcugcuggcugccuggccacugcauggccaugggggaugcauacgucaucguguacuccaucacggacaagggcagcuuugagaaagccucagaacuccggguccagcugcggcgggcccggcagacagacgacgugcccaucauucucgugggcaacaagagugaccuggugcgcucucgugaggucucuguggaugguaagcaggcaucgggucaggaaagggagggagauccuggcugggcugugggccaguuggucuuggcucagcuugagucccuggggaucaucaguggcuaaaaauguucaggaagaaaacuugguguuggagggugggggagguguugcugguccaucaggcccccaaaggccuaccuaaaacaaaggagaagaaugaacc

SEQ ID NO: 10349 - RNA, 2501 nt, Mus musculus
cccuucagaaguacacuggcaugguuuuguguguguguguauagugggcaagacggugacacaugauggccccgccccacaugcuacaggcaaaccucgaccugaagggcuuaguuagcucuaacaccagaccucaaagggaacagauaagauauggccacugggaauccaaugagagaaggaaggaagcuaguaacuauacgaaaaugccugccagguccacgagggcugaggccuggcuauggguauauccacuuguguuuguuucaucccagcccuagcucucucagugagugaucuggagaaaagucauguacaccauaaacccacauggaaaaccccuuuggguucuuucauguucuguccugcagcugaguaagagaaguuugauaccgugagagauaacuaagaauuccauuggaagggaccuguugccacaggcugcggaugugcacagacugggcccugaggcccaugcaacaagcgccacauaagccagaugucagcugcagacagcccauguacuaccaccaguucucgguagaaacaggggucaaagguucgaagaugaggugcagcugaaggcugggagaugccaaaggugcgaaacgcuggaugaggcucuggugugagccgcaagcgcugcaaacacaugccuagaaagacaucgucuaugggaaagagcucaacuugugagcaagcaucagcuaggcggcggagcguggcucccgaaagaacaaagccgccgccaccugcguaggcaggguaaacgggcaguccauacacagcccggggaaugaaguacuugcuggcucuagcucggauuggccuugccugcacaaucacaucacccgcaagaagguccugugcgggaucccggagcuccagaaacugcagcagguuccucacgugcacgaacacaucugcaucgcccuuaaaaacaaaguguacaucuggacagaaugcugaggcccaagauagaaagugaaucuccuucagcguuagauugaaaaaggugucuucgaaagcccagagcagaaugucugcauaagcucggcucuccgccuccagcagggugcgccagugcgaacgggugccugccccgccagagcccgcccccuugggcacgcccaacaagaacacucggcgcacgagugcccccugcacgcgacccucggcuccccaagucuggcgaacggcuucccgccgcucaaaguccgcagccacagacuugacagcgaugagcagguccggcgaaccgccggaugcgccgucgcugcggcauuugcgacgcugguuaaugagcagcgggaagcgccguugguccuuggcgcgcagauacccgccgaagucaaagggguccguaggugugggcggcaccggagugucccccucguaggccagcggggccgcgcgggcgguguuagggagcucgcgugcucggaggcuaggagugggccgcgggagcugggguccucgcgcugguggucuggucgugggggaugccacgucgcgcugcgcguagagcaggaguccgagggcggcgcugagcagcagcguaagccacgcgucugggcaaaggcgcggccuccuccuccuccucauguccagccccgcccuucacagggcccucuauccuuccuucauccacucugucgaccuccgucccugccccugcccccaccgcagcagccuaagggacaaaaaguucagcuucuaaccucagcuccagcccagaaaggaugccaaagucuggacagggugacgcaggccucuccccuaccgcccccuuacccacccauccagugcaucaaagcugggucccuucuaccuuucccccuccccgccucugaccuugguccuuaggaccccagcacucacgcuugaccgcgggggaggggugacaaccccugaaacugucaguucagggucccaagggcagccaugaccccggcuugagccaaaugcagcguuggcaggaagggggcugaggccgugccacgugauccuccagcuguguacgccccgacaucuggagcucagcuccgccuuggugcagggagugccaucucugacugugggcuggucccugagagggccucucacgggagacucuugcugagaaagccuaguauuuuugauaggacgcuggaacuccgaguuucuaagcucaagaaguagacagcugauaggcccccaaccccuaagccugagugcuuuaacuuucagcucuucuggccgccauaccgggccaucuuucagaaaaucucuuucagcagcccugguucaccaagcaggagccacgaauugccccaauaauauaaagcugucuccuuacuccucgcgcugguggucuggucgugggggaugcccuccgaacucugcccugcuugccaccaguaaacacaagcauacacacccgaacaaucaagacagcaaguucuguuccugcagacuuaccagcagcucuacccaaagaggaccaauacuuagugagcuaa

SEQ ID NO: 10350 - RNA, 2501 nt, Mus musculus
uuagcucacuaaguauugguccucuuuggguagagcugcugguaagucugcaggaacagaacuugcugucuugauuguucggguguguaugcuuguguuuacugguggcaagcagggcagaguucggagggcaucccccacgaccagaccaccagcgcgaggaguaaggagacagcuuuauauuauuggggcaauucguggcuccugcuuggugaaccagggcugcugaaagagauuuucugaaagauggcccgguauggcggccagaagagcugaaaguuaaagcacucaggcuuagggguugggggccuaucagcugucuacuucuugagcuuagaaacucggaguuccagcguccuaucaaaaauacuaggcuuucucagcaagagucucccgugagaggcccucucagggaccagcccacagucagagauggcacucccugcaccaaggcggagcugagcuccagaugucggggcguacacagcuggaggaucacguggcacggccucagcccccuuccugccaacgcugcauuuggcucaagccggggucauggcugcccuugggacccugaacugacaguuucagggguugucaccccucccccgcggucaagcgugagugcugggguccuaaggaccaaggucagaggcggggagggggaaagguagaagggacccagcuuugaugcacuggauggguggguaagggggcgguaggggagaggccugcgucacccuguccagacuuuggcauccuuucugggcuggagcugagguuagaagcugaacuuuuugucccuuaggcugcugcggugggggcaggggcagggacggaggucgacagaguggaugaaggaaggauagagggcccugugaagggcggggcuggacaugaggaggaggaggaggccgcgccuuugcccagacgcguggcuuacgcugcugcucagcgccgcccucggacuccugcucuacgcgcagcgcgacguggcaucccccacgaccagaccaccagcgcgaggaccccagcucccgcggcccacuccuagccuccgagcacgcgagcucccuaacaccgcccgcgcggccccgcuggccuacgagggggacacuccggugccgcccacaccuacggaccccuuugacuucggcggguaucugcgcgccaaggaccaacggcgcuucccgcugcucauuaaccagcgucgcaaaugccgcagcgacggcgcauccggcgguucgccggaccugcucaucgcugucaagucuguggcugcggacuuugagcggcgggaagccguucgccagacuuggggagccgagggucgcgugcagggggcacucgugcgccgaguguucuuguugggcgugcccaagggggcgggcucuggcggggcaggcacccguucgcacuggcgcacccugcuggaggcggagagccgagcuuaugcagacauucugcucugggcuuucgaagacaccuuuuucaaucuaacgcugaaggagauucacuuucuaucuugggccucagcauucuguccagauguacacuuuguuuuuaagggcgaugcagauguguucgugcacgugaggaaccugcugcaguuucuggagcuccgggaucccgcacaggaccuucuugcgggugaugugauugugcaggcaaggccaauccgagcuagagccagcaaguacuucauuccccgggcuguguauggacugcccguuuacccugccuacgcagguggcggcggcuuuguucuuucgggagccacgcuccgccgccuagcugaugcuugcucacaaguugagcucuuucccauagacgaugucuuucuaggcauguguuugcagcgcuugcggcucacaccagagccucauccagcguuucgcaccuuuggcaucucccagccuucagcugcaccucaucuucgaaccuuugaccccuguuucuaccgagaacuggugguaguacaugggcugucugcagcugacaucuggcuuauguggcgcuuguugcaugggccucagggcccagucugugcacauccgcagccuguggcaacaggucccuuccaauggaauucuuaguuaucucucacgguaucaaacuucucuuacucagcugcaggacagaacaugaaagaacccaaagggguuuuccauguggguuuaugguguacaugacuuuucuccagaucacucacugagagagcuagggcugggaugaaacaaacacaaguggauauacccauagccaggccucagcccucguggaccuggcaggcauuuucguauaguuacuagcuuccuuccuucucucauuggauucccaguggccauaucuuaucuguucccuuugaggucugguguuagagcuaacuaagcccuucaggucgagguuugccuguagcauguggggcggggccaucaugugucaccgucuugcccacuauacacacacacacaaaaccaugccaguguacuucugaaggg

SEQ ID NO: 10351 - RNA, 2501 nt, Mus musculus
aacaucuauacgcucggacuuucauggaagagaaagagccaguguacuuggagagccagugccuaacuuuccuacuugcaccgagauguuggccugccccggccacuguaaccuccaggaagcaggaguuucugugccacauccagcucaauacacgugugucugauucugggcaagucggcuccuuucucuaaacuuaccugugacaggcagauggaggagucguggaaaggaaaauuaaaagcaccuagcaauuagaagguccagagagggcuggacaagugagacugugagcuguacccacccccugacucaaauccgggugcuuugggacagggaaggguagcggacuaugugaccaccccugccagcacgccuccaccagcgucgccaccagaguucgcagagccagugaagcaugcccuucccccacgccauucccagcagcccuggccgccccgccccuguugcagcugcuguucgcguacccaccccgcucgcucgcucgcuuggcccuuucugcacugucaucugccccggugaggcucaacuccggagugggacuauccgaaacgcuccggaccacaagcccgacuccacccagcagggagggaaaggagacagauugggcagaaucccaggccucaccaccagcagcggaguucgaaggucugugggccccacccuuccgcgggacugaagcucuaggacugaguggagggcuggugaggguacccuugcagucgcgcaugcgugaccagcucccgcuccugguuucccacccacaauaacaaaucucauucagccagcaagcuagggaucccaaaaaauuaccaggucuuacuucuccaccuggggcucaggguacuauuuagacuuguucuuugaugcacugaacagggcauagccagcauucaccuuagagcugugauaaccucagagaaacacagcuaacauaaacucaggguacagaggggggaaagaggaggccaauccugccucgaagucgggccagaacaggagcugacaucacccccuucucuguaaccaguggugggagacagucuuuggaagccucauugaggacagcagagguccugaauacaguguaguguggaucccaguaaacacaguagugaggaccaaggcacacagaaggagcuccgaaccuuugaacucucaggaauugggguagacaugggagcauuugaguguuaagggcuggguccacagaguagaggggagagacaaguaucccaggcccagggaccagcguuggcaaaggcuaaagugcuaggaccauaguucucacaggacugaaugguuggauggaaaccuagcuguccagaguggugggaggggguuaaaauagccagacuaguagcuuagauucuuuggugaguacuggagacaaagggugggugucuacgccugccauucagcuagacaaggaacauuauaguuuaggcuagggcaagucagauuccaguuguacuggguuccuccgaaccugccucuucauccauaaaaccggaaagauaaauucuaccccagaguugucaaaagucacaauguuggagugaagggaggcguggggugugagagaagugcgcagagauauuuauugucccgggaggcaaucggcugcugcuggguuuaaggagaagaagcuaauggagacugauuaaaagacaucugacagggauggggcaugaagggagauguggguuggaggaguacccugucugcgcuuaguggccuugggggagaaggaccaacagauaugagggauggagacccaaggugugaagugcccagggacaggacagugugaguacugaggcaugggacuuuugauauguguggggcagggguugggggauaugacucaaugggccaggaagaagguagaaacaggaacauuuaaggcagaggagaccagggcuugggaggcagaggcaggcggauuucugaguucgagaccagccuggucuacagagugaguuccaggacagccagggcuacacagagaaauccugucucgaaaacaaaaagcaaacaaauaaacaaacaaaaaggcaggggagacuuagaaggaugcuguaugaauaaagagaaggcagagggaauggccagguuucuuuuuuccuuaaagucagggcccuuauuggcuggguuaggacacccaacucguugggagguagucaugauaggcaggagcugauaaaaaaugagcagaggagauuaauucauacuugguuccuacgguuugguacaggcagccucucaaaauggguaauccauggaggggaagcuaaaagucugguaagcacuccuaguggcuuuuaagagcugggcauuucaaggucaaauaagaaauggcuguaagugacugccgggccauuagggaaacaagugggucccugauaccaggagaucucucaaaauuaaaguucaguugugcuacgauaaccuggaagagucccaagacuauguugagg

SEQ ID NO: 10352 - RNA, 2501 nt, Mus musculus
ccucaacauagucuugggacucuuccagguuaucguagcacaacugaacuuuaauuuugagagaucuccugguaucagggacccacuuguuucccuaauggcccggcagucacuuacagccauuucuuauuugaccuugaaaugcccagcucuuaaaagccacuaggagugcuuaccagacuuuuagcuuccccuccauggauuacccauuuugagaggcugccuguaccaaaccguaggaaccaaguaugaauuaaucuccucugcucauuuuuuaucagcuccugccuaucaugacuaccucccaacgaguuggguguccuaacccagccaauaagggcccugacuuuaaggaaaaaagaaaccuggccauucccucugccuucucuuuauucauacagcauccuucuaagucuccccugccuuuuuguuuguuuauuuguuugcuuuuuguuuucgagacaggauuucucuguguagcccuggcuguccuggaacucacucuguagaccaggcuggucucgaacucagaaauccgccugccucugccucccaagcccuggucuccucugccuuaaauguuccuguuucuaccuucuuccuggcccauugagucauaucccccaaccccugccccacacauaucaaaagucccaugccucaguacucacacuguccugucccugggcacuucacaccuugggucuccaucccucauaucuguugguccuucucccccaaggccacuaagcgcagacaggguacuccuccaacccacaucucccuucaugccccaucccugucagaugucuuuuaaucagucuccauuagcuucuucuccuuaaacccagcagcagccgauugccucccgggacaauaaauaucucugcgcacuucucucacaccccacgccucccuucacuccaacauugugacuuuugacaacucugggguagaauuuaucuuuccgguuuuauggaugaagaggcagguucggaggaacccaguacaacuggaaucugacuugcccuagccuaaacuauaauguuccuugucuagcugaauggcaggcguagacacccacccuuugucuccaguacucaccaaagaaucuaagcuacuagucuggcuauuuuaacccccucccaccacucuggacagcuagguuuccauccaaccauucaguccugugagaacuaugguccuagcacuuuagccuuugccaacgcuggucccugggccugggauacuugucucuccccucuacucuguggacccagcccuuaacacucaaaugcucccaugucuaccccaauuccugagaguucaaagguucggagcuccuucugugugccuugguccucacuacuguguuuacugggauccacacuacacuguauucaggaccucugcuguccucaaugaggcuuccaaagacugucucccaccacugguuacagagaagggggugaugucagcuccuguucuggcccgacuucgaggcaggauuggccuccucuuuccccccucuguacccugaguuuauguuagcuguguuucucugagguuaucacagcucuaaggugaaugcuggcuaugcccuguucagugcaucaaagaacaagucuaaauaguacccugagccccagguggagaaguaagaccugguaauuuuuugggaucccuagcuugcuggcugaaugagauuuguuauugugggugggaaaccaggagcgggagcuggucacgcaugcgcgacugcaaggguacccucaccagcccuccacucaguccuagagcuucagucccgcggaaggguggggcccacagaccuucgaacuccgcugcugguggugaggccugggauucugcccaaucugucuccuuucccucccugcuggguggagucgggcuugugguccggagcguuucggauagucccacuccggaguugagccucaccggggcagaugacagugcagaaagggccaagcgagcgagcgagcgggguggguacgcgaacagcagcugcaacaggggcggggcggccagggcugcugggaauggcgugggggaagggcaugcuucacuggcucugcgaacucugguggcgacgcugguggaggcgugcuggcagggguggucacauaguccgcuacccuucccugucccaaagcacccggauuugagucaggggguggguacagcucacagucucacuuguccagcccucucuggaccuucuaauugcuaggugcuuuuaauuuuccuuuccacgacuccuccaucugccugucacagguaaguuuagagaaaggagccgacuugcccagaaucagacacacguguauugagcuggauguggcacagaaacuccugcuuccuggagguuacaguggccggggcaggccaacaucucggugcaaguaggaaaguuaggcacuggcucuccaaguacacuggcucuuucucuuccaugaaaguccgagcguauagauguu

SEQ ID NO: 10353 - RNA, 2501 nt, Mus musculus
uuggcacaagcgaaagggucggugucuuccagguacugcacucucacaguuaccacggauacuggguccccauccccgcgcucuuccucgcccgccauggcucugccaccggcuaccgcuggacgccucuuguguccccugcaaaugcugcaacuucaacucgacuaaacuuugcuguuagggccgggccaggcugggccggacgcucgcggcucgaggggcggagccagaugaagguaggaccaaggaaggggguggagccaagacugagcggcgagcgcgcgcucgggguuaaccaccgccggaggcggcgcuugggccagccacucagagagcuggugaucccguuaguuccauugcuaggagggcgggaaaacccgagcucccgcuccgccucagagcagagggcggggagacuuucuuuagauuugguaugggcgaggcugcagcggaucuuuguaaggauuuuuagggcagauggggggggggggguaaaucucuucggauaaucuggguagcugggccacucucaagggacgagaugggacuaauugcuagcuugaaagacaaaugaaagcauuucucucauuuggggaaagcaguaagaagaaucucuuucaauguggaauaagaaguggaaauagauuuuauauuugaaagaagagguggauucaguccccuuuagcugugggggcaaaaaaaaagaggacgggugcucuuucucgaaaaagaaugggaugagucacugugaggaggcagguagcacauguuuuuucggcuugggugaugaaugaaaaguggagacauucuucgguuuggggcgagaugagucaaaugccccaaguuguuccuaauuuaaagggaauuccauaagguccucucagauccauggaauaggcaaacaguucccuguaguuugaaggaaagggaaggcggcgccucugggcucuggagagaugaggaauagccagcuuuucagccuggaaagagccggguccgucccggccuugagguuucuggguacguugagagcaccguuguccauuaggcuuucugggugugcccagugcgcgugcgcagcugugguccgguaggggggucccagguuuuggagaucgugcuggaaggcggcagcgcaccgcccccugcgguuuucucagcuuagcacugggacccgcagccugagcaccugggacggguggcccgcugcugggcgguguucugcaguagcugcgcuugucucugcuucccgagacccccguccuucuuggugcuccgggacgcgguggcuggucaccuuucugaauccggaggagaggcgguuuaggagagcacacucgaaagaguggguuucaggacucgagggguuaggaggguuaugcuggggaauuuccggagaugagauuaaccuagaagagauggaggaggggauccuaacugcuaggauccugggcagggucucgggguccggaccuggccuggggguaucggagcucggauuggggggagugagccccacgugccugugacgcgggggcgccggguaggcggcggcagcggcggcggcggcggcggcagcgacgcggggccggcggccgugcagugcccggaggacagcaagaugcugagcgccgcacugcuucuucugcccggguugccccuggcgggggcgggggccacagaagaacccacccaggaguccgggccguugggugagccuccuccaggcuuggcgcucuuccgcuggcaguggcacgagguggaggcgcccuaccugguggcccuguggauccugguggccagcuuagccaaaaucggugaguguguguguguguguguguguguguguguguguguguguguguguguguguguucgcgcgcccgcacgccaggcuagcggcccgcagaggacccgcccccaagccccuaggucuccagauuugcgucuugcauugugcggggacuuaggcuccaauuccacaaaucuggguucucucccauuuccugcucucuugugggucucccuucuugguugguaguucaggggauuugccuuccuaagagcugccugucgccgcucuccucucaccguuccauccuuagacucuuucccccaguuuccccuuccccuugcaguuagcucuccucaauaaacgucaguaaggccucuccuccagacguccagcuucucagaaaccugucagcaaugaggacgcaaggggacacugaagggaugauauucuccuggaaacccuaggcauucugguucugagaaauuuuccugcccuggagagacggccaagagucugagauuuuaauaucuccugagauagcuaaaaggccacuuuuccuauagcauaucucucuacuccacuuaaagcuguugccaccuucuauagcccauuugcaaccucacccuccaauucacauuccucuuuucgauguuuaaaaaacuugcguuuauuggaucuugacugugugcuggcuacccugggugcu

SEQ ID NO: 10354 - RNA, 2501 nt, Mus musculus
agcacccaggguagccagcacacagucaagauccaauaaacgcaaguuuuuuaaacaucgaaaagaggaaugugaauuggagggugagguugcaaaugggcuauagaagguggcaacagcuuuaaguggaguagagagauaugcuauaggaaaaguggccuuuuagcuaucucaggagauauuaaaaucucagacucuuggccgucucuccagggcaggaaaauuucucagaaccagaaugccuaggguuuccaggagaauaucaucccuucaguguccccuugcguccucauugcugacagguuucugagaagcuggacgucuggaggagaggccuuacugacguuuauugaggagagcuaacugcaaggggaaggggaaacugggggaaagagucuaaggauggaacggugagaggagagcggcgacaggcagcucuuaggaaggcaaauccccugaacuaccaaccaagaagggagacccacaagagagcaggaaaugggagagaacccagauuuguggaauuggagccuaaguccccgcacaaugcaagacgcaaaucuggagaccuaggggcuugggggcggguccucugcgggccgcuagccuggcgugcgggcgcgcgaacacacacacacacacacacacacacacacacacacacacacacacacacacacucaccgauuuuggcuaagcuggccaccaggauccacagggccaccagguagggcgccuccaccucgugccacugccagcggaagagcgccaagccuggaggaggcucacccaacggcccggacuccuggguggguucuucuguggcccccgcccccgccaggggcaacccgggcagaagaagcagugcggcgcucagcaucuugcuguccuccgggcacugcacggccgccggccccgcgucgcugccgccgccgccgccgccgcugccgccgccuacccggcgcccccgcgucacaggcacguggggcucacuccccccaauccgagcuccgauacccccaggccagguccggaccccgagacccugcccaggauccuagcaguuaggauccccuccuccaucucuucuagguuaaucucaucuccggaaauuccccagcauaacccuccuaaccccucgaguccugaaacccacucuuucgagugugcucuccuaaaccgccucuccuccggauucagaaaggugaccagccaccgcgucccggagcaccaagaaggacgggggucucgggaagcagagacaagcgcagcuacugcagaacaccgcccagcagcgggccacccgucccaggugcucaggcugcgggucccagugcuaagcugagaaaaccgcagggggcggugcgcugccgccuuccagcacgaucuccaaaaccugggaccccccuaccggaccacagcugcgcacgcgcacugggcacacccagaaagccuaauggacaacggugcucucaacguacccagaaaccucaaggccgggacggacccggcucuuuccaggcugaaaagcuggcuauuccucaucucuccagagcccagaggcgccgccuucccuuuccuucaaacuacagggaacuguuugccuauuccauggaucugagaggaccuuauggaauucccuuuaaauuaggaacaacuuggggcauuugacucaucucgccccaaaccgaagaaugucuccacuuuucauucaucacccaagccgaaaaaacaugugcuaccugccuccucacagugacucaucccauucuuuuucgagaaagagcacccguccucuuuuuuuuugcccccacagcuaaaggggacugaauccaccucuucuuucaaauauaaaaucuauuuccacuucuuauuccacauugaaagagauucuucuuacugcuuuccccaaaugagagaaaugcuuucauuugucuuucaagcuagcaauuagucccaucucgucccuugagaguggcccagcuacccagauuauccgaagagauuuacccccccccccccaucugcccuaaaaauccuuacaaagauccgcugcagccucgcccauaccaaaucuaaagaaagucuccccgcccucugcucugaggcggagcgggagcucggguuuucccgcccuccuagcaauggaacuaacgggaucaccagcucucugaguggcuggcccaagcgccgccuccggcggugguuaaccccgagcgcgcgcucgccgcucagucuuggcuccacccccuuccuugguccuaccuucaucuggcuccgccccucgagccgcgagcguccggcccagccuggcccggcccuaacagcaaaguuuagucgaguugaaguugcagcauuugcaggggacacaagaggcguccagcgguagccgguggcagagccauggcgggcgaggaagagcgcggggauggggacccaguauccgugguaacugugagagugcaguaccuggaagacaccgacccuuucgcuugugccaa

SEQ ID NO: 10355 - RNA, 2501 nt, Mus musculus
cugcaugcgggggcggguguggcuggcagcagacucuggcugcuuccaugcaguguucuggaagucauggcagucacagccacagcaauguggaauacuugaaugaaaguugguggugguggugcugauguuggugguauguguguguuaaguaucccugaggaagcgugagcaggaugugcacuccugagcucggaggcucagaguccuuggcaugccaauaggcgcacaggagugaaugagauguaaggcacaggguugggcagacuggcccuuucccgggcgaagcuggcgacugacggcuccgccucaugcaacuuggggacuuuguuccggcuucuucgaaaacggaucuagacaggggggcugggcgggggggcaccugccuggcguggggugcuaagauagaaguggaggaaagccccacccuagccccgccuucgcaccgccccaaccccgcccccagggcgcuuuauaagcuggguccgaggaccccgcaaagaaagcgaguaucccucccaccccaggccgguguuccucugcauuccguguccuagccucgagucccucucggcgcuccccaaccaggcccccgccccgccccagcccggccccgaagucauggagcgcuggccuuggccgucgggcggcgccuggcugcugguggcugcccgcgcgcugcugcagcugcugcgcucagaccugcgucugggccgcccguuguuggcggcacuggcccugcuggcugcucucgacuggcugugccagcgccugcugcccccgccggcggcacucguggugcuggcuggugcuggcuggaucgcguugucccgccuagcgcgcccuccucgccugccgguggccacucgcgcggugcucaucaccggugagugugcagagcgcagggacuccaggcuggagggcgggaccgcacaccuagaggguuucccuugggcgccaucaaggggaacuccgcagcucagacguaagaguccuucucuaaacgcaagaaagugagccaaguaggaagcuccgggcaccucaccaagucuggguuaacuaccugcgaccgcgaggauuauuggugagaaaguagagagugggcaggugcucaaaggaaacuagugacugaaagaggagaaacuuaguuuaugcugagcuccuuaagagaucagguguggagcagaagacaguacuuuaggggacuucagaagacccgagacggggauaaugccaucucuugaacucugccugacaucccccacaucacuagaacacaguaucugcuauucucugggggcagagugcuuagauggugaguucugcuccccgaccuccucuggcuggaauccuuggaguucagaaccgccugaguucacagcagcuggagaguagcugcuucuuagauccagcuacccacugccaaaacugcagccgccugcagucuacaccuaacaccucauccugcccagcccugggugcccaggaaaggguccucagagagcuggacucaggugucucuagugccugccugugcuuucuuugucuggagcagggaauaaaucugucaucaggagggaaggggaggggaggggggcugcagacccagcaggaaauggggagggggaggaaggccagggggcauugguccauugcauggggggaggggcagcuguuucucccccaaccaccauggcuucuuggaggucuugguccuuuauggguggucugcaugauaggauagggccgggagacuuuaggaggaaauccuugaacuggaccuuggagggaguuggguagugacagguggaaucugaaaggugucuuggauccuagaaagggcgugagacaaagguuuaagacagaaagaaauaagcacgguuugggaaggggacagucaauaaccagucuggcuggggggggggggggaugugaaguuuccuugggaggagacccgaaugucaggugagaaaccagauugcacuaaggugauauggcuucggaagagaggguggagguugaguaggacucaggugauauggaagagacuuccagagugagugugaagccacggcaagcccccccccccccccccuuucaggagccugaggaaggaaagcuacugaauucccuugaaaugaagcagggacucguuauaggcucugccuucaaacauggaacagaucucuuccuguccugugugagcggcuuucaccagauccuaugccacuucagguucuacugauacagcuggggcauccugagaucucaccucaggucuuugcuacuggucuagucuugagccugagcaagaggugagaagagggaugcuuucugugccccaggcuccuuccaucucugcaaaccucaguguuugggagaagagaauuuggccccagccuacucccguguaagcacuggaaguuggcuucuagcuuccugaugccugaaaacucugggguuuuccgagucaccaccaagcagcaagagcacuuaaguga

SEQ ID NO: 10356 - RNA, 2501 nt, Mus musculus
ucacuuaagugcucuugcugcuugguggugacucggaaaaccccagaguuuucaggcaucaggaagcuagaagccaacuuccagugcuuacacgggaguaggcuggggccaaauucucuucucccaaacacugagguuugcagagauggaaggagccuggggcacagaaagcaucccucuucucaccucuugcucaggcucaagacuagaccaguagcaaagaccugaggugagaucucaggaugccccagcuguaucaguagaaccugaaguggcauaggaucuggugaaagccgcucacacaggacaggaagagaucuguuccauguuugaaggcagagccuauaacgagucccugcuucauuucaagggaauucaguagcuuuccuuccucaggcuccugaaagggggggggggggggggcuugccguggcuucacacucacucuggaagucucuuccauaucaccugaguccuacucaaccuccacccucucuuccgaagccauaucaccuuagugcaaucugguuucucaccugacauucgggucuccucccaaggaaacuucacauccccccccccccccagccagacugguuauugacuguccccuucccaaaccgugcuuauuucuuucugucuuaaaccuuugucucacgcccuuucuaggauccaagacaccuuucagauuccaccugucacuacccaacucccuccaagguccaguucaaggauuuccuccuaaagucucccggcccuauccuaucaugcagaccacccauaaaggaccaagaccuccaagaagccauggugguugggggagaaacagcugccccuccccccaugcaauggaccaaugcccccuggccuuccucccccuccccauuuccugcugggucugcagccccccuccccuccccuucccuccugaugacagauuuauucccugcuccagacaaagaaagcacaggcaggcacuagagacaccugaguccagcucucugaggacccuuuccugggcacccagggcugggcaggaugagguguuagguguagacugcaggcggcugcaguuuuggcaguggguagcuggaucuaagaagcagcuacucuccagcugcugugaacucaggcgguucugaacuccaaggauuccagccagaggaggucggggagcagaacucaccaucuaagcacucugcccccagagaauagcagauacuguguucuagugaugugggggaugucaggcagaguucaagagauggcauuauccccgucucgggucuucugaaguccccuaaaguacugucuucugcuccacaccugaucucuuaaggagcucagcauaaacuaaguuucuccucuuucagucacuaguuuccuuugagcaccugcccacucucuacuuucucaccaauaauccucgcggucgcagguaguuaacccagacuuggugaggugcccggagcuuccuacuuggcucacuuucuugcguuuagagaaggacucuuacgucugagcugcggaguuccccuugauggcgcccaagggaaacccucuaggugugcggucccgcccuccagccuggagucccugcgcucugcacacucaccggugaugagcaccgcgcgaguggccaccggcaggcgaggagggcgcgcuaggcgggacaacgcgauccagccagcaccagccagcaccacgagugccgccggcgggggcagcaggcgcuggcacagccagucgagagcagccagcagggccagugccgccaacaacgggcggcccagacgcaggucugagcgcagcagcugcagcagcgcgcgggcagccaccagcagccaggcgccgcccgacggccaaggccagcgcuccaugacuucggggccgggcuggggcggggcgggggccugguuggggagcgccgagagggacucgaggcuaggacacggaaugcagaggaacaccggccuggggugggagggauacucgcuuucuuugcgggguccucggacccagcuuauaaagcgcccugggggcgggguuggggcggugcgaaggcggggcuaggguggggcuuuccuccacuucuaucuuagcaccccacgccaggcaggugcccccccgcccagccccccugucuagauccguuuucgaagaagccggaacaaaguccccaaguugcaugaggcggagccgucagucgccagcuucgcccgggaaagggccagucugcccaacccugugccuuacaucucauucacuccugugcgccuauuggcaugccaaggacucugagccuccgagcucaggagugcacauccugcucacgcuuccucagggauacuuaacacacacauaccaccaacaucagcaccaccaccaccaacuuucauucaaguauuccacauugcuguggcugugacugccaugacuuccagaacacugcauggaagcagccagagucugcugccagccacacccgcccccgcaugcag

SEQ ID NO: 10357 - RNA, 2501 nt, Mus musculus
cagcuagacagcugaaacugggggggagggguagcaggagggagggacucaggcugcaaagcugguucaucaggauguucaacccuacccugccugggaaguaaaaggccuugcccuaaaucccaggcuccuaauccccaccccuagccuaguucccugucaccuccucuaggccaaaugagagcagucgcacauaacccaagcccccauuaaacacacuccaggagucuggagucgggccagagcaaacaccugguggagugaggcaagcagguggggaggggaggagcaaagcagguuaaaccuguccuggaccaggcaccacccucagacaggugggggagguucacaccugcccgagggccaaaaggcccauggucaauggcagccccgccccuugguccgaccaacccaggaacagagccaccaaggacagagcuucauacuuggccacucgcagcagccugagcuuugacccacaccccaucgaccaacuggcacagaacuguuugcucguagagggggguggguggcacucugaaggcuauccagcacgauccggcccuuucccuuggcaauucugugacacuuuccaaucuaaggccgacagagcaaggcaaccagauuuuuuucuacagcacccucccaggugagcagugggccuggagcccuucuguaaccuggcaucuguaggucuucucauuaagaacgagagucagaagaggaaaggacuuaacacucauuacaacucagucauggggugagugagcaaugcaaacagggaaaacucacucccacuuggccagggugcgggguggguaugggagggggcaugcgccuaggccuuugcgcucauugggcagguagccccuagauaauguucggacagcacccacucacccacgccuggccagucagcugggacaggcaggccuaaaccagccggccucaccuagaggcgucugcccccgaggcagacaccgcccgacgcccucgcuucagcgguucccaggagagcaggcggcagagaccaagugaucuaccgcuaaaccugagcccaccucgacccuauuucugacguguccucugcuagcggggggagugggagggagaggaaggggccucggggggauggaucccuuagccgcuauugucaacuuccucggcaggaguggaugucuguaaagguuggaagguaagguggcucugggaauggccuagcacgcuuccacgcgguagucgcucaaaaguuucaaacaagaccuuguccuacuggccgugccacugggucgcgucgcuccaggucuccccuccuccccucccccucgaaguagugucccugccacuccgcaguuccaccacccacgcgggcccccacgcucaccuguugcagcacuuuguccagggacuccgcccgcgcuaggcugucugcgcugaguccacucgccucgcggcauuguggacucagggcagccgccucggcgcgaacuagcgacuugugcagcguccccaccuaaaagcaccgaggguaaccccaugagccgcugugccucaacaggcucugaagcgucccgagguccccucuuucccacccuaccugucggcugcgcggcuccaccacuugccaaacuaggaggauuaagucggucucguccgagccuagguccggccccagcgcaccggcaguggccccgaacaaaaccaccagcgacugagguucgggacaagggucuguggccgagucuacugcgggaucugggcccgggggugggggcggcggcggcggcggagucauggccgcagaggaagggggcgcucggccacacacgcggaccgacgaggcgcacacacguaccgaccgacagcagacagacgagcuugggcgggauccgguguguugggggcggcaccugcggccggguguagugggagcugcagagacccgcccgcggugcccuuuggggcugggcggugcggcugccuaucccugccuacuccggcgaguuaccugcggcccggagaggccacgugaucaggacggcccagggaaccccgcgggagggccaaaacccugcccaggaggcaagagcucacuucugcugaggcgugcgcucgccggcuggagucccaccucuugcugcaguccggcgagacuccugggacgaauccauucuuucuccuacuuccucucuagcaggcacucugaguccuccgcaaaagaaugugcaggaucagaggccucuuuccauucugcaagggucacgcaagacccauggaauucaacaggaggcaaucuagggacuauaaaaggucgcgacgucuggcuugagguuaauggaaguuacaaagggucaaaagccgacagugagcgcuaccagguauccacuggaagucggugagagagauccguuggggaaagggagggagguaaagaucaaggguucuuagaacugugggcggucacuagagaucacagagaaggacgugcccauacagguguc

SEQ ID NO: 10358 - RNA, 2501 nt, Mus musculus
gacaccuguaugggcacguccuucucugugaucucuagugaccgcccacaguucuaagaacccuugaucuuuaccucccucccuuuccccaacggaucucucucaccgacuuccaguggauaccugguagcgcucacugucggcuuuugacccuuuguaacuuccauuaaccucaagccagacgucgcgaccuuuuauagucccuagauugccuccuguugaauuccaugggucuugcgugacccuugcagaauggaaagaggccucugauccugcacauucuuuugcggaggacucagagugccugcuagagaggaaguaggagaaagaauggauucgucccaggagucucgccggacugcagcaagaggugggacuccagccggcgagcgcacgccucagcagaagugagcucuugccuccugggcaggguuuuggcccucccgcgggguucccugggccguccugaucacguggccucuccgggccgcagguaacucgccggaguaggcagggauaggcagccgcaccgcccagccccaaagggcaccgcgggcgggucucugcagcucccacuacacccggccgcaggugccgcccccaacacaccggaucccgcccaagcucgucugucugcugucggucgguacgugugugcgccucgucgguccgcguguguggccgagcgcccccuuccucugcggccaugacuccgccgccgccgccgcccccacccccgggcccagaucccgcaguagacucggccacagacccuugucccgaaccucagucgcuggugguuuuguucggggccacugccggugcgcuggggccggaccuaggcucggacgagaccgacuuaauccuccuaguuuggcaagugguggagccgcgcagccgacagguagggugggaaagaggggaccucgggacgcuucagagccuguugaggcacagcggcucaugggguuacccucggugcuuuuagguggggacgcugcacaagucgcuaguucgcgccgaggcggcugcccugaguccacaaugccgcgaggcgaguggacucagcgcagacagccuagcgcgggcggagucccuggacaaagugcugcaacaggugagcgugggggcccgcgugggugguggaacugcggaguggcagggacacuacuucgagggggaggggaggaggggagaccuggagcgacgcgacccaguggcacggccaguaggacaaggucuuguuugaaacuuuugagcgacuaccgcguggaagcgugcuaggccauucccagagccaccuuaccuuccaaccuuuacagacauccacuccugccgaggaaguugacaauagcggcuaagggauccauccccccgaggccccuuccucucccucccacuccccccgcuagcagaggacacgucagaaauagggucgaggugggcucagguuuagcgguagaucacuuggucucugccgccugcucuccugggaaccgcugaagcgagggcgucgggcggugucugccucgggggcagacgccucuaggugaggccggcugguuuaggccugccugucccagcugacuggccaggcgugggugagugggugcuguccgaacauuaucuaggggcuaccugcccaaugagcgcaaaggccuaggcgcaugcccccucccauacccaccccgcacccuggccaagugggagugaguuuucccuguuugcauugcucacucaccccaugacugaguuguaaugaguguuaaguccuuuccucuucugacucucguucuuaaugagaagaccuacagaugccagguuacagaagggcuccaggcccacugcucaccugggagggugcuguagaaaaaaaucugguugccuugcucugucggccuuagauuggaaagugucacagaauugccaagggaaagggccggaucgugcuggauagccuucagagugccacccaccccccucuacgagcaaacaguucugugccaguuggucgauggggugugggucaaagcucaggcugcugcgaguggccaaguaugaagcucuguccuugguggcucuguuccuggguuggucggaccaaggggcggggcugccauugaccaugggccuuuuggcccucgggcaggugugaaccucccccaccugucugaggguggugccugguccaggacagguuuaaccugcuuugcuccuccccuccccaccugcuugccucacuccaccagguguuugcucuggcccgacuccagacuccuggaguguguuuaaugggggcuuggguuaugugcgacugcucucauuuggccuagaggaggugacagggaacuaggcuagggguggggauuaggagccugggauuuagggcaaggccuuuuacuucccaggcaggguaggguugaacauccugaugaaccagcuuugcagccugagucccucccuccugcuaccccucccccccaguuucagcugucuagcug

SEQ ID NO: 10359 - RNA, 2501 nt, Mus musculus
gagcaggggcccaggguggcuguguuguggauucuguggcuaagugaccuaugggcaugucugagagggauggcuuccugacuggagcagcucacaugccuauuaaauuguuuccgccugcgaaguuaucucugacgguuggaggacccauaaauucauuuuuaaaacuagucuuuaauuacaauuucucuucagguuuuucugagauguaaaaccucgagaucuccagcugguucuagaguuucuaccucuaacaaacacucuucuccccuggacucccucucggcuucaccucaccggaggagucuacaccaacuuccagggaccacggaacugccagcgaggaugucggauggggaccuaagaggucgggacgugggaaagaaagguggggaggaagagccguuugggcuuuaagaccggaaccuccuggauuccugcuagaccaaucugcagcuuuugcaaacagccuuaaagucaucagcgccccgcugcggaauucaaagcucagcuugucauaauaguuaacaccuucuuugaccagccuccuuuuauuugacaauuuuucuuuucugucccucucuguugccaccgggaagguuuuuagggaguccccucacauagcgagccgccccuuggcguucagaagauuuucugggguagcccguuugcagggugaguagguuuccagguuucgggagcggggcgugggggcggggauggacaugaacgauuuuguagguccccacuggucauccggaaaguuaacgaugcuucagguacuaggcuagggacaaugacagccuuuccaaggcugcuggcccggaggucggcguggagcagcugagccuugggcugcacugggggucccuaguuuucuagaggcagagguugcgacucucgauucggaggggcuagguccacgacagaccccgagucuggcgagcgccagccgguggccgggcaccgggcgcucccgcgggcuccgggagcccucccacucuugccaacuuucccugcccuggugccggaggagggcgccuuucccagugggucgcgcgcgauacuuaaggcggcucugcugggcaaggcggucgucagucggagccccagcggcaccguggaggcagugcgcggcggcgggagccggaggaggagcauggagccgccgcgggccugcugagcaccggaacgccggcagccggcggcacggugagcgcacccaaggggccggagccucuuaccgcgaccuggggacccuggggcuccggccgcucaaugcuucccggcggcagucgcuugcaccauguucccuacccccuccucccuuucuuccgacauccugggcucccgcagccucuccucccuuccucccuugcggcucuuguuuugugaaugaauuggggguggagggaggcugugcggggagcgaggcuagagugccccuccccccaacucacgcccgcaggggguucacaccugcggggacaccgagaucuccagcgaucuggucccuacagcacagguuugugagaugaguuccuccuccuugccgguucagagagguccaagggugccuaggagagauuggaggagcuccagccgcuagugcaaguuucuguacugccgugcgugagcccggcugcagggcgcaccugucagugggagaguugcuguuaaucuugcagcccucaaaguucuacugcuggguagggaggugugcguccuugccuggagguuuuuauuucuuuucauuguccuaugggacauggaucccguaaagcgcccccacccucgugcccuugaaucuaagugcgccuuagcuagccugggcgagcuuucuuggaucucuuuugagaggauggaggaagcggcccaggauauaagaucacauucugguuaaccggcuuggggaaauacaguguccucucugggcagaggaccucaacaagagcccgugccagagccugacuguacauagaauauccagcugcagaaccuuccugggucuucuguagggagauggguaccucuuaauuccugagggggagggggucuggcccccggauggagggggcuggcaacugcagggaugcugccuuuguuugcaggcacuccuuugccaagguaccuggggcccugagaagaugaguagggucugggcuggcaguuguuccuuggcuuuuccguuccuucccagcagagucgugggaaaccugcacguggguguggcuguguggcuuuagccagcggggugaagcucaagccgggugaggagcguggcgagagcuuccuuagcugccuuggaccugaccggacagccucuggaacugcaccgaggcggggcgccaggacgcagguugcugggccagccacagcaccucccgucccuucccagaacgaggcgggcaguagggcccgcagcguccccuauguaucagcucuagcuggagacuaggcaggggacguaugccuggggcucccugagcugggugugugca

SEQ ID NO: 10360 - RNA, 2501 nt, Mus musculus
ugcacacacccagcucagggagccccaggcauacguccccugccuagucuccagcuagagcugauacauaggggacgcugcgggcccuacugcccgccucguucugggaagggacgggaggugcuguggcuggcccagcaaccugcguccuggcgccccgccucggugcaguuccagaggcuguccggucagguccaaggcagcuaaggaagcucucgccacgcuccucacccggcuugagcuucaccccgcuggcuaaagccacacagccacacccacgugcagguuucccacgacucugcugggaaggaacggaaaagccaaggaacaacugccagcccagacccuacucaucuucucagggccccagguaccuuggcaaaggagugccugcaaacaaaggcagcaucccugcaguugccagcccccuccauccgggggccagacccccucccccucaggaauuaagagguacccaucucccuacagaagacccaggaagguucugcagcuggauauucuauguacagucaggcucuggcacgggcucuuguugagguccucugcccagagaggacacuguauuuccccaagccgguuaaccagaaugugaucuuauauccugggccgcuuccuccauccucucaaaagagauccaagaaagcucgcccaggcuagcuaaggcgcacuuagauucaagggcacgagggugggggcgcuuuacgggauccaugucccauaggacaaugaaaagaaauaaaaaccuccaggcaaggacgcacaccucccuacccagcaguagaacuuugagggcugcaagauuaacagcaacucucccacugacaggugcgcccugcagccgggcucacgcacggcaguacagaaacuugcacuagcggcuggagcuccuccaaucucuccuaggcacccuuggaccucucugaaccggcaaggaggaggaacucaucucacaaaccugugcuguagggaccagaucgcuggagaucucgguguccccgcaggugugaacccccugcgggcgugaguuggggggaggggcacucuagccucgcuccccgcacagccucccuccacccccaauucauucacaaaacaagagccgcaagggaggaagggaggagaggcugcgggagcccaggaugucggaagaaagggaggaggggguagggaacauggugcaagcgacugccgccgggaagcauugagcggccggagccccaggguccccaggucgcgguaagaggcuccggccccuugggugcgcucaccgugccgccggcugccggcguuccggugcucagcaggcccgcggcggcuccaugcuccuccuccggcucccgccgccgcgcacugccuccacggugccgcuggggcuccgacugacgaccgccuugcccagcagagccgccuuaaguaucgcgcgcgacccacugggaaaggcgcccuccuccggcaccagggcagggaaaguuggcaagagugggagggcucccggagcccgcgggagcgcccggugcccggccaccggcuggcgcucgccagacucggggucugucguggaccuagccccuccgaaucgagagucgcaaccucugccucuagaaaacuagggacccccagugcagcccaaggcucagcugcuccacgccgaccuccgggccagcagccuuggaaaggcugucauugucccuagccuaguaccugaagcaucguuaacuuuccggaugaccaguggggaccuacaaaaucguucauguccauccccgcccccacgccccgcucccgaaaccuggaaaccuacucacccugcaaacgggcuaccccagaaaaucuucugaacgccaaggggcggcucgcuaugugaggggacucccuaaaaaccuucccgguggcaacagagagggacagaaaagaaaaauugucaaauaaaaggaggcuggucaaagaagguguuaacuauuaugacaagcugagcuuugaauuccgcagcggggcgcugaugacuuuaaggcuguuugcaaaagcugcagauuggucuagcaggaauccaggagguuccggucuuaaagcccaaacggcucuuccuccccaccuuucuuucccacgucccgaccucuuagguccccauccgacauccucgcuggcaguuccguggucccuggaaguugguguagacuccuccggugaggugaagccgagagggaguccaggggagaagaguguuuguuagagguagaaacucuagaaccagcuggagaucucgagguuuuacaucucagaaaaaccugaagagaaauuguaauuaaagacuaguuuuaaaaaugaauuuauggguccuccaaccgucagagauaacuucgcaggcggaaacaauuuaauaggcaugugagcugcuccagucaggaagccaucccucucagacaugcccauaggucacuuagccacagaauccacaacacagccacccugggccccugcuc

SEQ ID NO: 10361 - RNA, 2501 nt, Mus musculus
ccaccccuggcaccuucuguuuccauuugccuaacauaugccaggcucugcccaagauucaacaagaggcugcauucugcuuuggggacauagaagccaccccaucucucuuugguuugaaaucuuuaaaccuuucaucagcacacaggagacucugguacugugcacacuuacgaccuaggcguaccgagccagccgcagugagcugcccuucaccacuaaagaacccaggcuucuggggcacagaggaagcgguuuuucuacuugaaucgccuucuacugucuucugucuuccuuccacagaacucagcucuaggucaccuuccuuggcauccugagccucugguggcuguuuucacugccagucagucucugaacgcugacaguaaguuacugcaugcgggucccugcauucccucccuccaauaaaugcuuaggaggagagcagacagagagaagcugcccuuuggccucaaaccuuuaaauaagccacgaacaauugcaugucuuuuauucacucuggggugaggcgggguaaugaggacucugguuuuaagaggaaacgcacaaauguaccucuuguuuuucuacuccugugguugcaguccaagaugggugcagccagggaaacaauagcuagugucaaagaccgaaagagcagcccaaaucugggcgcagcuuucgcgaggugaguuggcuuuagauaauguaacauaaacucaugauagcagcuuucccugauguguggaagucuaauggcagaggcuccaagucuaauggcagaggcuggggaucaucagcuagaagaguugucuccagggaaaagaaugcacaguuuugacaaccacacacacacacacacacacacacacacacacacacacacacacacacacuuuuugcccucagggacaccuauuuuauucuauuuacccaguccccagagccugguuccacaucugugcaacuggauggcgcgcugagucucuaggaggggguaugacgaccgguccccugcuaguccuuuccacccucauucacaaaaccuucaaagacacaggggaauuucgggaccuacagaccaaguucgucuauucaugagggugggguuuaaacaaaccuacggucugaaacaagcugcugagaaagaccucacugacuuuguuacacaucaccggagaaugaacguuuaggugggcuuaguuucguguuuaaaacggcggcuucugcuagcagucugcugcgcauacauagccuugucaggaagagcgaguccaacuauuaacucuucguugggcuaacuuuauucagccccccccccaaccuggaagcuggacuuugaaagguauagagggaaggcuagggaacaagacuuaagagucuguggcccuccggcuagccccaccuaccuagccuucuaaaccguuccaguuucaguccugaaacucuccuccuuccucugguucucgggcuuucccacuuuuucuuuuaugucaucucuccuccacccucggcggucccuggucccuagcaggugcaccccucaccucuccaacccgcggcgcccgaggccaugcuucugcgacagcucugggggcccccagggugcgggucccggagucggggcugcgucccaacuggguccccagggcucgggccgcgcacggcuuugacgggacuucuccaaggcucuuuguucggaugcgcgauggcccgcgucccugugucuguccuggcgcuggucucgguccguucucuguucccggcccgcccgacgguccccguuuccucucacgucaccguuccucucccugugccuguccccgccucggucccgcgaccgcucgacgugguggucucgguccgggugcgggcgccgguccgggucucuuucucuaggacggguccggggcucacggugccccgaaguauuuuucauggccggauuccuguccccgcccggaaacgauccgagggcgacaaccaaccauaaguuucccaggcagguggccaagcucaaggacggggcgguacagcucaccugugcgcacgcgcacuugcccuccagcggcccggagagggcgcaccugccacuggccgccagggggcagucguggugcggccagaggggaugggggugggagugggguggacgagggcuggagagugggagguggauucuugcugaaauagaugucaguccuagguuuuauaggauuaucaaagggaaauggcccagggagcaggcaaaaggaugugaccaaaucagcucagccuucaaaggcugucucuugcuagagcuauuaggacgccagaccaaucauuuauuucuuuacuuucaugguacuggguuugaaucccagggccuugcaugucuaggugagcaugguaccacugagcuauauucccagccccaaacgaagaucauuaaacccacuaauacaguuccgggcauggauuugagcuuuucgauagagagcucauuagggggaggaguuggu

SEQ ID NO: 10362 - RNA, 2501 nt, Mus musculus
accaacuccucccccuaaugagcucucuaucgaaaagcucaaauccaugcccggaacuguauuaguggguuuaaugaucuucguuuggggcugggaauauagcucagugguaccaugcucaccuagacaugcaaggcccugggauucaaacccaguaccaugaaaguaaagaaauaaaugauuggucuggcguccuaauagcucuagcaagagacagccuuugaaggcugagcugauuuggucacauccuuuugccugcucccugggccauuucccuuugauaauccuauaaaaccuaggacugacaucuauuucagcaagaauccaccucccacucuccagcccucguccaccccacucccacccccauccccucuggccgcaccacgacugcccccuggcggccaguggcaggugcgcccucuccgggccgcuggagggcaagugcgcgugcgcacaggugagcuguaccgccccguccuugagcuuggccaccugccugggaaacuuaugguugguugucgcccucggaucguuuccgggcggggacaggaauccggccaugaaaaauacuucggggcaccgugagccccggacccguccuagagaaagagacccggaccggcgcccgcacccggaccgagaccaccacgucgagcggucgcgggaccgaggcggggacaggcacagggagaggaacggugacgugagaggaaacggggaccgucgggcgggccgggaacagagaacggaccgagaccagcgccaggacagacacagggacgcgggccaucgcgcauccgaacaaagagccuuggagaagucccgucaaagccgugcgcggcccgagcccuggggacccaguugggacgcagccccgacuccgggacccgcacccugggggcccccagagcugucgcagaagcauggccucgggcgccgcggguuggagaggugaggggugcaccugcuagggaccagggaccgccgaggguggaggagagaugacauaaaagaaaaagugggaaagcccgagaaccagaggaaggaggagaguuucaggacugaaacuggaacgguuuagaaggcuagguagguggggcuagccggagggccacagacucuuaagucuuguucccuagccuucccucuauaccuuucaaaguccagcuuccagguuggggggggggcugaauaaaguuagcccaacgaagaguuaauaguuggacucgcucuuccugacaaggcuauguaugcgcagcagacugcuagcagaagccgccguuuuaaacacgaaacuaagcccaccuaaacguucauucuccggugauguguaacaaagucagugaggucuuucucagcagcuuguuucagaccguagguuuguuuaaaccccacccucaugaauagacgaacuuggucuguaggucccgaaauuccccugugucuuugaagguuuugugaaugaggguggaaaggacuagcaggggaccggucgucauacccccuccuagagacucagcgcgccauccaguugcacagauguggaaccaggcucuggggacuggguaaauagaauaaaauaggugucccugagggcaaaaagugugugugugugugugugugugugugugugugugugugugugugugugugguugucaaaacugugcauucuuuucccuggagacaacucuucuagcugaugauccccagccucugccauuagacuuggagccucugccauuagacuuccacacaucagggaaagcugcuaucaugaguuuauguuacauuaucuaaagccaacucaccucgcgaaagcugcgcccagauuugggcugcucuuucggucuuugacacuagcuauuguuucccuggcugcacccaucuuggacugcaaccacaggaguagaaaaacaagagguacauuugugcguuuccucuuaaaaccagaguccucauuaccccgccucaccccagagugaauaaaagacaugcaauuguucguggcuuauuuaaagguuugaggccaaagggcagcuucucucugucugcucuccuccuaagcauuuauuggagggagggaaugcagggacccgcaugcaguaacuuacugucagcguucagagacugacuggcagugaaaacagccaccagaggcucaggaugccaaggaaggugaccuagagcugaguucuguggaaggaagacagaagacaguagaaggcgauucaaguagaaaaaccgcuuccucugugccccagaagccuggguucuuuaguggugaagggcagcucacugcggcuggcucgguacgccuaggucguaagugugcacaguaccagagucuccugugugcugaugaaagguuuaaagauuucaaaccaaagagagaugggguggcuucuauguccccaaagcagaaugcagccucuuguugaaucuugggcagagccuggcauauguuaggcaaauggaaacagaaggugccaggggugg

SEQ ID NO: 10363 - RNA, 2501 nt, Mus musculus
caggugacaccgguacuacuuagaaaaggaacugaaggacauuugugcaggaggguuggacuuuauggauggucugugguggacagcuccaaugcggccaguucccguuccccucugcacgaugcucagugcuauucaucaggccgggaugcacuaaggacugcauccuuggcggguuucaucuuggucgagcccaaggccuugaaggugcaaacccggguccgcucccgcuggaggguggggggcuggcccggccccgccccugcgccgccccgacccgcggcggcgcccgcucccgccggccccucuugccggaccagucuggcagcgccagagcucggauuucaaagcccugguuucuggccgugaauggguccucgcccgcccggccuuucccacagcccccuccugugcucccuccccgcggcccucccuccgccgcgcccacgugacgcccgagcuucggcggcucggauuaccgccgccgccgcuccagugcccgcgccgaggcugcgccgcgaacugcccgcgccgcgcccccagccccaccgagccauggcccgcgcugccggcccacggcccgcaaccccggagcgcggcgcggccggccgcugagagcgcggccccgaggcagggagccccggcgcggccucggagcagcgcccgcggcgguccggccccuccccugcacggcuccccgcgccccuugcgcgcccugccgccgcgcgcccggccccagcauggagacggcggagaaggaguguggcgccuugggcgggcucuuccaggccaucgucaacgacaugaagguaccccgggcaagcuccgggcauacgggucuccucugagggacgcguggcgggcagugugugugugugugugugugugugugugugugugugcgcgcgggcagugugugugugugugugugcgggcagugugugugugugugugugugugcgggcaguguguguguguguguguguguguguguguguguguguguguguguguguguguguguguguguuucaucugagccuguccuccugcgcccgccuugcgcccaaugccugucuggguccgaagggugggagugagugcucgcagguugggauguccgagaggucgccccguaggaucccgauccaaagcugagcguccgcaaacacucgguaccccagacccccaaacuaugaauuggguuuaucuuuaggaccgaccuuuaaggcccuuuaacggauccaaggucucucgggccuccgcccccuuucaccacagugcccccccacacacacacacacacauacccccgacgccccgaagcccagacaaugcugucaccgccaaagcaggaaaaaaauaauaaagcaaagaacuguuaacucuugccccgccagccucgggccucugcauggaugcagccccaccuacacacacacacacacacacacacacacacacacacacacaccaacagauccagcaagcuccauuacuccaauccucgggugggguccucccugcagcccaaggguaggacugaauccaccuuggggaggagguaggcuguguguuggcuaagcaaccuggggagcgcuuucagcaacccccccuuccugaucacucaaggucagacugagcaggcacccuguucagauggggaaacugaggccugcgaauggcucaaggucauaaggagaccauuggauccugcuucgggaccucagccauuauuauccaucugguaauuuacugaauucucccugacccccagaggccaguguuugacgaggcugauccgaauugacuaggcagggaaagcuucaguggcaaggugggcaucgagugccaguguuccuguccugcacuguaccccuuggucuaggaacacgauggaaaacggaagaaacuaggcccugugcugagccuccucacauccuuacccuaggcucgcacuuagcaagaacaaaucagaauccugcuagacccugggggcuguggaacccacguacagguacacccuacccaagggcuccagaaaaaugcuuuaggaaagugaugccuugcagagaggcaagaaguuggggcuccccuccuaguacugccaagaaacacccccaguaagggaaggcaucugucagauacuugcccccuaaaaagaggccugaaaccacacuggccugggacuuacaaguuagcagcacgucagcgccuucccauaguucuauacuuuucccugggguuccucccucgccacaacacacacacacacacacacacacacacacaccccuggcaacuccaccugagggccucaucacuagcccucagcaucuugguaccagcuccucuggcaacuccaccugagggccucaucacuagcccucagcauuuugguaccagcuccucucugaaacuguguaacccagaccaccuccccuagcugacacuccugggcuggcagagggugggagccacccacacugccucccacugca

SEQ ID NO: 10364 - RNA, 2501 nt, Mus musculus
ugcagugggaggcaguguggguggcucccacccucugccagcccaggagugucagcuaggggagguggucuggguuacacaguuucagagaggagcugguaccaaaaugcugagggcuagugaugaggcccucagguggaguugccagaggagcugguaccaagaugcugagggcuagugaugaggcccucagguggaguugccagggguguguguguguguguguguguguguguguguuguggcgagggaggaaccccagggaaaaguauagaacuaugggaaggcgcugacgugcugcuaacuuguaagucccaggccagugugguuucaggccucuuuuuagggggcaaguaucugacagaugccuucccuuacuggggguguuucuuggcaguacuaggaggggagccccaacuucuugccucucugcaaggcaucacuuuccuaaagcauuuuucuggagcccuuggguaggguguaccuguacguggguuccacagcccccagggucuagcaggauucugauuuguucuugcuaagugcgagccuaggguaaggaugugaggaggcucagcacagggccuaguuucuuccguuuuccaucguguuccuagaccaagggguacagugcaggacaggaacacuggcacucgaugcccaccuugccacugaagcuuucccugccuagucaauucggaucagccucgucaaacacuggccucugggggucagggagaauucaguaaauuaccagauggauaauaauggcugaggucccgaagcaggauccaauggucuccuuaugaccuugagccauucgcaggccucaguuuccccaucugaacagggugccugcucagucugaccuugagugaucaggaaggggggguugcugaaagcgcuccccagguugcuuagccaacacacagccuaccuccuccccaagguggauucaguccuacccuugggcugcagggaggaccccacccgaggauuggaguaauggagcuugcuggaucuguugguguguguguguguguguguguguguguguguguguguguguagguggggcugcauccaugcagaggcccgaggcuggcggggcaagaguuaacaguucuuugcuuuauuauuuuuuuccugcuuuggcggugacagcauugucugggcuucggggcgucggggguaugugugugugugugugugggggggcacuguggugaaagggggcggaggcccgagagaccuuggauccguuaaagggccuuaaaggucgguccuaaagauaaacccaauucauaguuugggggucugggguaccgaguguuugcggacgcucagcuuuggaucgggauccuacggggcgaccucucggacaucccaaccugcgagcacucacucccacccuucggacccagacaggcauugggcgcaaggcgggcgcaggaggacaggcucagaugaaacacacacacacacacacacacacacacacacacacacacacacacacacacacacacacacacugcccgcacacacacacacacacacacacugcccgcacacacacacacacacacugcccgcgcgcacacacacacacacacacacacacacacacacacacugcccgccacgcgucccucagaggagacccguaugcccggagcuugcccgggguaccuucaugucguugacgauggccuggaagagcccgcccaaggcgccacacuccuucuccgccgucuccaugcuggggccgggcgcgcggcggcagggcgcgcaaggggcgcggggagccgugcaggggaggggccggaccgccgcgggcgcugcuccgaggccgcgccggggcucccugccucggggccgcgcucucagcggccggccgcgccgcgcuccgggguugcgggccgugggccggcagcgcgggccauggcucgguggggcugggggcgcggcgcgggcaguucgcggcgcagccucggcgcgggcacuggagcggcggcggcgguaauccgagccgccgaagcucgggcgucacgugggcgcggcggagggagggccgcggggagggagcacaggagggggcugugggaaaggccgggcgggcgaggacccauucacggccagaaaccagggcuuugaaauccgagcucuggcgcugccagacugguccggcaagaggggccggcgggagcgggcgccgccgcgggucggggcggcgcaggggcggggccgggccagccccccacccuccagcgggagcggacccggguuugcaccuucaaggccuugggcucgaccaagaugaaacccgccaaggaugcaguccuuagugcaucccggccugaugaauagcacugagcaucgugcagaggggaacgggaacuggccgcauuggagcuguccaccacagaccauccauaaaguccaacccuccugcacaaauguccuucaguuccuuuucuaaguaguaccggugucaccug

SEQ ID NO: 10365 - RNA, 2501 nt, Mus musculus
auggaccguuaagcggaaaaauacauuuuuuuuuccccagaaaaaaaagcaacgaguuuuaaagaacacagucuuccaauuuaaaagccaagauuucaguucucuagugcccaguuacucuuugaaacaaacuuuugagccuggcacuguuuugcagagauggaaacugaggcugcggcauuuaagauaggaaacaauguacuacuaaauucagcucugucaaccccgagugggugaagauaaucaaugcaugcaugguaucuguaugcaguaggcgccccauaaacucugauauucuugggaaauuucuguucucuuggcuaagcgaucgcggccaggcaggugguacuggggcugccucaguuucccccuggucgggcaaggcaugacucuuuuaggaugcucuggcgggucgggacccgccuugagacagggcggcgcguuaaggggggcggccccgaggagucacguggcgcggccgccuccaaagcagaaguaaggagcgccgcugagcaagaccugcgcugccggacugcccgggccccaggcggcugcugcacgagggacccccgaguccccccaacccguggcuggcaggcccagggauugugcggguggcugcgcuccggggguaccgccaggugaguagccaggauggauggagcuccccggggacuugcgcgugugcggggacccuagagcuggcaccgcguuggguggggacugcgccggagcccaagagggcgcgggcagggcuggggugcgcgauccgggcagguggccgggugugcccuggggaacccuugcuuagggacagccgggcccggcccagccgccggccacuuccucuccuggggcuggcgccaccucuccagggugagcaguggccaacuaggguuugaaugagagacgcggcuccgggugcugggguggccgaagcgucuaccucgccaccgagaguccuacgcgggagccgcgucccugcuugcggggacuugauuuugaacaguacuucccaguaguacacagguggcuccgggguggggcggagcagcucuuucuccacacgcgauucugggacccgccccucccgcaauucaguucaguuuggggaucucaaagaggucauuugccucgcggggagccagaauucgaagggaagguggguuguauccggaccuaggagguugauaccuggaaagucaggagcaggcccuguccguacccugaucucgaacuguugagagagaggcuggcagggcgaggggccgacacgcccuggaaacagguggcuuucucucugagaccuaaauuugaauuucaguuccauuuaugugacacagcacacagagaggagcccccccacccccaccccccgaguccagguuucucucuugggucccguacuagaccagagccuguuuuccggggcaucaaagagacucccugcaguuccugacccugguggcaaaggcccuuccuggugggcacaggucauggccccugcucuuugcuucugcgggacacuuacaggauguuggggucgggacuagcccuaggcuguuacccauuuugcacgguugugggcagcaguguagcagucccaggggauuuuggcuguggauuuuuauugaugcuuaaaauuacucggugcuuggccucccaggcaaggcggcgugugugggguacucugaaggagccccagcggggacccuuuugcaccuccugggcgaaguuggugggaaguuacuggugggaaaacuucugcaaauaauuaauuucgaaaauaggcaacccucucccugcccugucuccgcaaaagggcuuuucuguuucaacuaacagaguggacccauucauaugucuugucccauccucucucauuggcccccucuagauuuacaagcaaugcuuucgagauauauauauauauauauaucacuaauaacauuuauauuauaacucauuaauuuguaaguuucuuuuuuuuuaaaucaaaauagcucacaaaucucccaagaucaaaauuggcgugugauaauuuauaaauccacucuuuuccguagcuucuguacauuuuaaauuuuuuaaaauuauuuuugagacaaucucauuauauaguucagguuagccuugaacuucugaucuuccuguguccaccucccaagugcugggaugaucagugugugccaauacucuuggccuguaggggaugcccuccccccaccccuccccaccccaccccccaccccccaccccccaaccccccuuccccccguaccccccccccguaucccccaccgcccacuucccagagaugaggagcccaaguguuucugguuuuaugguccuguaaggaucuuuccggaugucucauuuugcacaagagugcuugcuggaucaacuuuauacuuuagaggugcuuaccagugcccuuaaaaaaaaaaaaaagucaacccuguuuucacuuccacguguacagguggacauuguugguucuu

SEQ ID NO: 10366 - RNA, 2501 nt, Mus musculus
aagaaccaacaauguccaccuguacacguggaagugaaaacaggguugacuuuuuuuuuuuuuuaagggcacugguaagcaccucuaaaguauaaaguugauccagcaagcacucuugugcaaaaugagacauccggaaagauccuuacaggaccauaaaaccagaaacacuugggcuccucaucucugggaagugggcggugggggauacgggggggggguacggggggaagggggguuggggggugggggguggggggugggguggggagggguggggggagggcauccccuacaggccaagaguauuggcacacacugaucaucccagcacuugggagguggacacaggaagaucagaaguucaaggcuaaccugaacuauauaaugagauugucucaaaaauaauuuuaaaaaauuuaaaauguacagaagcuacggaaaagaguggauuuauaaauuaucacacgccaauuuugaucuugggagauuugugagcuauuuugauuuaaaaaaaaagaaacuuacaaauuaaugaguuauaauauaaauguuauuagugauauauauauauauauauaucucgaaagcauugcuuguaaaucuagagggggccaaugagagaggaugggacaagacauaugaauggguccacucuguuaguugaaacagaaaagcccuuuugcggagacagggcagggagaggguugccuauuuucgaaauuaauuauuugcagaaguuuucccaccaguaacuucccaccaacuucgcccaggaggugcaaaaggguccccgcuggggcuccuucagaguaccccacacacgccgccuugccugggaggccaagcaccgaguaauuuuaagcaucaauaaaaauccacagccaaaauccccugggacugcuacacugcugcccacaaccgugcaaaauggguaacagccuagggcuagucccgaccccaacauccuguaagugucccgcagaagcaaagagcaggggccaugaccugugcccaccaggaagggccuuugccaccagggucaggaacugcagggagucucuuugaugccccggaaaacaggcucuggucuaguacgggacccaagagagaaaccuggacucggggggugggggugggggggcuccucucugugugcugugucacauaaauggaacugaaauucaaauuuaggucucagagagaaagccaccuguuuccagggcgugucggccccucgcccugccagccucucucucaacaguucgagaucaggguacggacagggccugcuccugacuuuccagguaucaaccuccuagguccggauacaacccaccuucccuucgaauucuggcuccccgcgaggcaaaugaccucuuugagauccccaaacugaacugaauugcgggaggggcgggucccagaaucgcguguggagaaagagcugcuccgccccaccccggagccaccuguguacuacugggaaguacuguucaaaaucaaguccccgcaagcagggacgcggcucccgcguaggacucucgguggcgagguagacgcuucggccaccccagcacccggagccgcgucucucauucaaacccuaguuggccacugcucacccuggagagguggcgccagccccaggagaggaaguggccggcggcugggccgggcccggcugucccuaagcaaggguuccccagggcacacccggccaccugcccggaucgcgcaccccagcccugcccgcgcccucuugggcuccggcgcaguccccacccaacgcggugccagcucuaggguccccgcacacgcgcaaguccccggggagcuccauccauccuggcuacucaccuggcgguacccccggagcgcagccacccgcacaaucccugggccugccagccacggguuggggggacucgggggucccucgugcagcagccgccuggggcccgggcaguccggcagcgcaggucuugcucagcggcgcuccuuacuucugcuuuggaggcggccgcgccacgugacuccucggggccgccccccuuaacgcgccgcccugucucaaggcgggucccgacccgccagagcauccuaaaagagucaugccuugcccgaccagggggaaacugaggcagccccaguaccaccugccuggccgcgaucgcuuagccaagagaacagaaauuucccaagaauaucagaguuuauggggcgccuacugcauacagauaccaugcaugcauugauuaucuucacccacucgggguugacagagcugaauuuaguaguacauuguuuccuaucuuaaaugccgcagccucaguuuccaucucugcaaaacagugccaggcucaaaaguuuguuucaaagaguaacugggcacuagagaacugaaaucuuggcuuuuaaauuggaagacuguguucuuuaaaacucguugcuuuuuuuucuggggaaaaaaaaauguauuuuuccgcuuaacgguccau

SEQ ID NO: 10367 - RNA, 2501 nt, Mus musculus
uuucaccaucagaucuguaauaaaaccagcugugccuccacugugccugaggagucugugcuugggaaguggcuaggcaaauagaccgcgcacugggccccuggguaaagcccgcagcuccaggagaacaagcgauagggccccagaguggagcauccauaggcacagggcuagacucuauggagucugggucaggaaugaggcuuccagaagccugaugcagcccuguccacucuguccccuggucugcccauuugagucucaccucccgccucagggccuuugagcaggcugguguccagucccgggaccccuauucaggugucuugagucugagucacuugcacaagucugcgucuugcucuaccuucugggcaacuagcgcccgcggguggaggaggggaggaagggacucggggagaaucauccggcagagggcgcucggggcucaccggacaccaguaccaaggggggaggggaccgggggucagcgagacccuggcggggacgggggcacaaucccggggcccccacccuccuccacacccgcccuaaguucugcgugaacgaagccaucccccucgggggccgugccaggguccggucgcugggccccgcguccccgcgggcaguccccugccuccgcucuuggccggcgggguggggguggcgggcgcggagcacguggcucgggguccggguagcccccccacccccggcacuggcgguccccgcgguguccgggccgcggggccggcggcgggagcggcgugcgcgggcgggcgggcgcgggcagggggcgcgcgggggcgcggccgggcgggggucggcgggcgagaugugcgagcgggcggcgcgccugugcagggccggcgcgcacaggcugcuccgggagccgccgccgcagggccgcgcgcugggcgggcugcugcgcugggugggcgccaggaugggggaaccccgugcaccgcucguccccgacauccccuccgcggaccccggccccgggcccgccgcaucgcgagggggcacagccgucauccuggacgugaguacgcgcgggacccuccgcccagcgcggcugggugccaguccacacccgggaccuaaggacccucuccaccauucgcucccugccuguucccgcauccccgcauccuauugcugagacccuccuuggcgcggggaccccgagcgcaagccccaacucucacugccgcugagacgccugucccccaacccagaccucaagauccucuccauuccucccuccacuuuaucucaucuccacaucccauagcugggaccucuucuucccgcagggacacccccguccaagaccccaacuccacccggaccguauuacccucacuuccauccucuucuuccgcuuccuugcauccccauaucucauagccugggacccuccuccgcguggggaucuccagagcgagcccucccaccaccccaucgcggcugaggcuuggguccgcacccaccgaggacccucuccucagucgccccccuccacguucccgcuuccacuaauuacauagcacggacccacgcuacuccccuuccaucguggcuggggcaccgguccccacuggaaccgcacgacccucuacaucuccuccuucacauucccgcauccccgcauccgauagcccaguccccgagaacugcuguaagucuggccgcuauuccccucuucagguccuaaccaaaccaucacuugagucccuacgauagggacaagaacugggcacugcuagcccccuccucucuauccuggauucuucccugcacuuccccacacacagcccggaaccaccacuguucucuucucugcggauguagaugagcccccgugcugugccgcuuugcgagugaagccccuuccccagcuccucucuuuccauagaaucagaaucauugccuggaccuaggcguccucacccccccccccagcuccacccugagcaacuguccuccuucacugucuuccuguccucacucuuggaccccagacucacuccucaucccaccucgugccucaugcaccacaccgcucuccccaccccagcccugcagagugggguggcauauaggcaggaaagaguuggugguccguggaggggcuucugggggaugggacugguccuggggggggugccuguacauguuaugggguucugagagaaucgggguauuuuugaguguguucaugaguucaugugugugugugugugugugugugugugugcacacgcacgcgcgcgcccacgcaugccagugggugccacauaccccuacaagugucaggggacuggaaacccuauuccccacuuggcuucccuugcuagaucucagaaccugugggugugucugagcaggagggcuuuggaaauggguguucuagugccucugggaacaagcaagagaugccuguacacacagaugugcacacacagagaugugcacacacagggcaggaggau

SEQ ID NO: 10368 - RNA, 2501 nt, Mus musculus
auccuccugcccugugugugcacaucucugugugugcacaucuguguguacaggcaucucuugcuuguucccagaggcacuagaacacccauuuccaaagcccuccugcucagacacacccacagguucugagaucuagcaagggaagccaaguggggaauaggguuuccaguccccugacacuuguagggguauguggcacccacuggcaugcgugggcgcgcgcgugcgugugcacacacacacacacacacacacacacacaugaacucaugaacacacucaaaaauaccccgauucucucagaaccccauaacauguacaggcaccccccccaggaccagucccaucccccagaagccccuccacggaccaccaacucuuuccugccuauaugccaccccacucugcagggcugggguggggagagcgguguggugcaugaggcacgaggugggaugaggagugagucugggguccaagagugaggacaggaagacagugaaggaggacaguugcucaggguggagcugggggggggggugaggacgccuagguccaggcaaugauucugauucuauggaaagagaggagcuggggaaggggcuucacucgcaaagcggcacagcacgggggcucaucuacauccgcagagaagagaacaguggugguuccgggcuguguguggggaagugcagggaagaauccaggauagagaggagggggcuagcagugcccaguucuugucccuaucguagggacucaagugaugguuugguuaggaccugaagaggggaauagcggccagacuuacagcaguucucggggacugggcuaucggaugcggggaugcgggaaugugaaggaggagauguagagggucgugcgguuccaguggggaccggugccccagccacgauggaaggggaguagcguggguccgugcuauguaauuaguggaagcgggaacguggaggggggcgacugaggagaggguccucggugggugcggacccaagccucagccgcgaugggguggugggagggcucgcucuggagauccccacgcggaggagggucccaggcuaugagauauggggaugcaaggaagcggaagaagaggauggaagugaggguaauacgguccggguggaguuggggucuuggacgggggugucccugcgggaagaagaggucccagcuaugggauguggagaugagauaaaguggagggaggaauggagaggaucuugaggucuggguugggggacaggcgucucagcggcagugagaguuggggcuugcgcucgggguccccgcgccaaggagggucucagcaauaggaugcggggaugcgggaacaggcagggagcgaaugguggagaggguccuuaggucccggguguggacuggcacccagccgcgcugggcggagggucccgcgcguacucacguccaggaugacggcugugcccccucgcgaugcggcgggcccggggccgggguccgcggaggggaugucggggacgagcggugcacgggguucccccauccuggcgcccacccagcgcagcagcccgcccagcgcgcggcccugcggcggcggcucccggagcagccugugcgcgccggcccugcacaggcgcgccgcccgcucgcacaucucgcccgccgacccccgcccggccgcgcccccgcgcgcccccugcccgcgcccgcccgcccgcgcacgccgcucccgccgccggccccgcggcccggacaccgcggggaccgccagugccgggggugggggggcuacccggaccccgagccacgugcuccgcgcccgccacccccaccccgccggccaagagcggaggcaggggacugcccgcggggacgcggggcccagcgaccggacccuggcacggcccccgagggggauggcuucguucacgcagaacuuagggcggguguggaggagggugggggccccgggauugugcccccguccccgccagggucucgcugacccccgguccccuccccccuugguacugguguccggugagccccgagcgcccucugccggaugauucuccccgagucccuuccuccccuccuccacccgcgggcgcuaguugcccagaagguagagcaagacgcagacuugugcaagugacucagacucaagacaccugaauaggggucccgggacuggacaccagccugcucaaaggcccugaggcgggaggugagacucaaaugggcagaccaggggacagaguggacagggcugcaucaggcuucuggaagccucauuccugacccagacuccauagagucuagcccugugccuauggaugcuccacucuggggcccuaucgcuuguucuccuggagcugcgggcuuuacccaggggcccagugcgcggucuauuugccuagccacuucccaagcacagacuccucaggcacaguggaggcacagcugguuuuauuacagaucugauggugaaa

SEQ ID NO: 10369 - RNA, 2501 nt, Mus musculus
ugcccuugcaaacccugacauuccagggguuccuuacccuccuccaucuauuuuaaucaccgauugaaucgacaaugagauggagaaaaaagaacagcaacauaggaaccggaacccaggacucugacccaagagccaauaccccugagccccaggucuccaccuaggcacagggaauuaaggcaagugcaggccacuccuaggcucucauccaaaauaagugacaguuuuugcuugcauuaaaauuuuacaaagugggcuccuaucagccuaacucacacuagccgaaagaugaaaacugcccaaacguccguccagcaaugaacaaaacguggcccgugcacgacacuguggaauacugagcucugaaaaggaauggggcaugagcgcacacuaugacaugaaaacaugagguugggggacacaaaagaccauucagcauacggucacauguauaaagcguguuugcaauaaggaaauccagagacacagaaaacacaaggggcaagaugagcccaaacugcagcccaugagguggaaucccuuuuugugguuguggaaauuaucuggaaauagggcggugaaaccuaccuaacuacaaaguucugaauuguacauuucaaaauggcuaaaaugauggaucucguuacaugaauuuugccucaauuaaaaaaauaugcacuggggacugguuagauggcucagcagauuguuuuugcugugcaagcuuaaggaccugagcugagguccccagcaguaucuaagaguggguauguaagcagaaccaauuuguaauuucaguauugggaagaaaggagcagacgagaggacccugggggccagucagucagucaaacauaaagaaaacucuugaguucugugagagacguuuucucgaaaaauaagguugcaagugacagacacugacccguagccuccacacccacacauaaauaaacaacacuccccccgccccaacacacacacacacccuccacugauaaaguaacguuggacauggcgcgucuguaauauuuuagcaaugacuagggucacucugaaaaagccaucccacccuugggaaugaaguuacaacaccaccaccuguaaaaagcggcuaacgcuucuccccuacaacgagaauucgaugaggugacgcauaaaaagcauuugcaacagugccuucccgccaccccucaauaaaccggagccacuaggcaggaucaucgcucaggguucgaugcuagcgaccccuauucguacugacccgaguuuaugaagaagcuaagagcgcuguccccgcggcuucacuuuauccccuuccucaaucgcacccggguguacuacacaagaggaaggaaacggacgcaacgacaucccaggaucucagcgaaggcucggcccagagcccuggcagguggucguugagacuccccgugggaacccgaacccgcugcggucaccgcccaggggugcggcugaguccugguagcagaacagggacucccugcuagugucccaucccuccccaguggcgccgggcacggcccagcgacucugcaaaacccaccgggcucugcagaagcugcgcgcuuucuucagcagcgcggccauucugcaucaguccugagacuuagaaccuacuuagaccuagcgaccaggaauaaaggaggauaaagagacaccgacaaaagggccgucccggggcgugucgccugugcgagccuccugccgaggaccaggcccgggacaccugcucagggagcugagcggcugccuagagcgcggaaccagaguuccccgcuacggggcgcggcgggggggagggcguucccgagggucgggguccagggggcguggccagggacggaagcggggcgcgaggggcgugaggggcgcgggcgcaauaccugcagcgagaggcgcggucuccgaagcccgucccgcccgcugcccgcgcggccgccgccccgggacaccaccgcagguccgcuacccacgugauccgcgcacgcgcccgggugcaguuucccccguggcccccccucggcuaggcccgcccucggcggcguaacugacugcgcgugcgcacugguugccgcggcgaccgggaaagcguuggacagccaacgacgcggaccguagaguauuagggcugaguggucgggccaggagugagcaugcaccccgaagucucugagccgccgguggacagcguggcggagcccagucuggaggagucggcaggcgaucacggcgacgcggggccagggauccguaaagaaggugccuuagcgcugggaagccaaaggggcgagggcucgugucccucacacaugcccauuucacucagcuggggacaaccagcaccccucacacauacccauccauacagcuacaagaacagcaccuuuauugauaugaucaauccaguacauauagaagacccauuauuuauuccaugauaauuuauuagauaccuuccuguggcugggaauugu

SEQ ID NO: 10370 - RNA, 2501 nt, Mus musculus
acaauucccagccacaggaagguaucuaauaaauuaucauggaauaaauaaugggucuucuauauguacuggauugaucauaucaauaaaggugcuguucuuguagcuguauggauggguaugugugaggggugcugguuguccccagcugagugaaaugggcaugugugagggacacgagcccucgccccuuuggcuucccagcgcuaaggcaccuucuuuacggaucccuggccccgcgucgccgugaucgccugccgacuccuccagacugggcuccgccacgcuguccaccggcggcucagagacuucggggugcaugcucacuccuggcccgaccacucagcccuaauacucuacgguccgcgucguuggcuguccaacgcuuucccggucgccgcggcaaccagugcgcacgcgcagucaguuacgccgccgagggcgggccuagccgagggggggccacgggggaaacugcacccgggcgcgugcgcggaucacguggguagcggaccugcgguggugucccggggcggcggccgcgcgggcagcgggcgggacgggcuucggagaccgcgccucucgcugcagguauugcgcccgcgccccucacgccccucgcgccccgcuuccgucccuggccacgcccccuggaccccgacccucgggaacgcccucccccccgccgcgccccguagcggggaacucugguuccgcgcucuaggcagccgcucagcucccugagcaggugucccgggccugguccucggcaggaggcucgcacaggcgacacgccccgggacggcccuuuugucggugucucuuuauccuccuuuauuccuggucgcuaggucuaaguagguucuaagucucaggacugaugcagaauggccgcgcugcugaagaaagcgcgcagcuucugcagagcccgguggguuuugcagagucgcugggccgugcccggcgccacuggggagggaugggacacuagcagggagucccuguucugcuaccaggacucagccgcaccccugggcggugaccgcagcggguucggguucccacggggagucucaacgaccaccugccagggcucugggccgagccuucgcugagauccugggaugucguugcguccguuuccuuccucuuguguaguacacccgggugcgauugaggaaggggauaaagugaagccgcggggacagcgcucuuagcuucuucauaaacucgggucaguacgaauaggggucgcuagcaucgaacccugagcgaugauccugccuaguggcuccgguuuauugagggguggcgggaaggcacuguugcaaaugcuuuuuaugcgucaccucaucgaauucucguuguaggggagaagcguuagccgcuuuuuacagguggugguguuguaacuucauucccaagggugggauggcuuuuucagagugacccuagucauugcuaaaauauuacagacgcgccauguccaacguuacuuuaucaguggaggguguguguguguguuggggcggggggaguguuguuuauuuauguguggguguggaggcuacgggucagugucugucacuugcaaccuuauuuuucgagaaaacgucucucacagaacucaagaguuuucuuuauguuugacugacugacuggcccccaggguccucucgucugcuccuuucuucccaauacugaaauuacaaauugguucugcuuacauacccacucuuagauacugcuggggaccucagcucagguccuuaagcuugcacagcaaaaacaaucugcugagccaucuaaccaguccccagugcauauuuuuuuaauugaggcaaaauucauguaacgagauccaucauuuuagccauuuugaaauguacaauucagaacuuuguaguuagguagguuucaccgcccuauuuccagauaauuuccacaaccacaaaaagggauuccaccucaugggcugcaguuugggcucaucuugccccuuguguuuucugugucucuggauuuccuuauugcaaacacgcuuuauacaugugaccguaugcugaauggucuuuugugucccccaaccucauguuuucaugucauagugugcgcucaugccccauuccuuuucagagcucaguauuccacagugucgugcacgggccacguuuuguucauugcuggacggacguuugggcaguuuucaucuuucggcuagugugaguuaggcugauaggagcccacuuuguaaaauuuuaaugcaagcaaaaacugucacuuauuuuggaugagagccuaggaguggccugcacuugccuuaauucccugugccuagguggagaccuggggcucagggguauuggcucuugggucagaguccuggguuccgguuccuauguugcuguucuuuuuucuccaucucauugucgauucaaucggugauuaaaauagauggaggaggguaaggaaccccuggaaugucaggguuugcaagggca

SEQ ID NO: 10371 - RNA, 2501 nt, Mus musculus
gggaccggcacaccggguccaggucggcagaggcggggcaggcuucgcaguccggggagcggggguggaggggggcuggggacgcguggggagggaccuggggggcuugagcccacugaauagcuacgggggaucggacacugcaggcugcgggggcgcaaaggcgugcaccggcggggggggggaguaggcggggggggcggugccgggcccccugaugcgcguggccucccgcagggaggaggaggagaauagcgcgccuggggagggcgggcuugcgggggaggcgcgcucgggagccgcagugacggcagaggugcagccgccccgcgcagcccccuccccucccuccccuccugcuccuccuccuccucccggcucggcagcgcagagcagcggcggcagcggcggcggcagcagccacccgauguccgcgcccgacaagcagcagccgccgcacggcgggggcacaggaggaggcggcggcgcgggcggccaggccauggaccccgcggcggcgggccccaccaaggccaagaagaccaacgccggcgugcggcggccggagaagccgcccuacucguacaucgcgcucaucgucauggcuauccagagcucgcccagcaagcgccugacccucagcgagaucuaccaguuucuucaggcgcgcuuccccuucuuccgcggcgccuaccagggcuggaagaacuccgugcgccacaaccugucgcucaacgagugcuucaucaaacugcccaagggccucgggcgacccggcaagggccacuacuggaccaucgauccggcuagcgaguuuauguucgaggagggcucguuccgccggcggccgcgcggcuuccgaaggaaaugccaggcgcucaagccuguguacagcauggugaacgggcugggcuucaaccaccuccccgacaccuacggcuuccagggcuccggaggccucucgugcgcgcccaacagccuggcgcuggagggcggcuugggcaugaugaauggccauuuggcuggcaacguggacggcauggcuuugcccagccacucggugccacaccugcccuccaacggcggccacucguacauggguggcugcgguggcucugcggccggggaguacccgcaccacgacagcucggugcccgcuucaccgcugcugccggccggcgccggcggagucauggagccgcacgccguuuacuccagcucugcagcagccuggccgcccgcggccuccgcggcucucaacagcggggccuccuacaucaagcaacagccucuguccccuugcaacccagccgccaacccccugucuggcagcaucuccacgcacucccuggagcagccauaccuucaccaaaacagucacaacgggccggcagaacugcaaggugagugcagggggcuccaaccccagacccaagccaugacagccacugugaaccgaucuugcuucuagagcauuagccccaauucuuuggguaccaacugcucucucucucuaaggagaguuuugauguccccaguuuagacuggucgaguuucguuucuuguuucucuuuucuggcugccccuagccugaccagguaggccccauucacaccaaaaagacucagaccccaggcucucuuaaguccagggaacaucuggguuccuucgccucuagcaaaggcccuguguaucuagccagcggccuagcccuggccaacaaacccaccuuucugauacuucccaugcaaagaaucugugucaggcaagaacggaaaaguuaggcccaaagcaagaguuaggcccaaagaggccuggaccaaacacugagaggcccagcccaggcccuucaggaaaccugguuuggugaguccaggggcauuuugugcagacuuaagcuggguccugugugguggccaggccuggaguugggggucagagucauaagccccaaugcucuuugucuuucaggauccagguuucaaggccccucagagcccaccccagacucccccacugaaaaagaagauagcuuucagccuccaagccuaguucuggaaggaaaagucgguagagggauagccauaaauaagcugucagggccaccccagggaggcagaccagaggagagaggugguuagcuguugguccaccucuccacagggucaccccacacacacacauauacacacaccuuaugccuguccuuaaggggacucuucagcugccugaaccuugaugugggcuuugaauucuguugacccugcauugggcuucuggcuccaccaggguggaaauggcaacugcagaaaucucagcguuccaggcucuggggcaugaggccaugacggacggacgggccgccuccuaggccuuccccuuccgcaucaaagaagcccucugccaggcaaggaguccagacuggagaggcccaagcggcaggaagcaaccucgagcaggacuuggaguuagugauuuaguccaaauccaggaaggcacag

SEQ ID NO: 10372 - RNA, 2501 nt, Mus musculus
cugugccuuccuggauuuggacuaaaucacuaacuccaaguccugcucgagguugcuuccugccgcuugggccucuccagucuggacuccuugccuggcagagggcuucuuugaugcggaaggggaaggccuaggaggcggcccguccguccgucauggccucaugccccagagccuggaacgcugagauuucugcaguugccauuuccacccugguggagccagaagcccaaugcagggucaacagaauucaaagcccacaucaagguucaggcagcugaagaguccccuuaaggacaggcauaagguguguguauauguguguguguggggugacccuguggagagguggaccaacagcuaaccaccucucuccucuggucugccucccugggguggcccugacagcuuauuuauggcuaucccucuaccgacuuuuccuuccagaacuaggcuuggaggcugaaagcuaucuucuuuuucagugggggagucuggggugggcucugaggggccuugaaaccuggauccugaaagacaaagagcauuggggcuuaugacucugacccccaacuccaggccuggccaccacacaggacccagcuuaagucugcacaaaaugccccuggacucaccaaaccagguuuccugaagggccugggcugggccucucaguguuugguccaggccucuuugggccuaacucuugcuuugggccuaacuuuuccguucuugccugacacagauucuuugcaugggaaguaucagaaagguggguuuguuggccagggcuaggccgcuggcuagauacacagggccuuugcuagaggcgaaggaacccagauguucccuggacuuaagagagccuggggucugagucuuuuuggugugaauggggccuaccuggucaggcuaggggcagccagaaaagagaaacaagaaacgaaacucgaccagucuaaacuggggacaucaaaacucuccuuagagagagagagcaguugguacccaaagaauuggggcuaaugcucuagaagcaagaucgguucacaguggcugucauggcuugggucugggguuggagcccccugcacucaccuugcaguucugccggcccguugugacuguuuuggugaagguauggcugcuccagggagugcguggagaugcugccagacaggggguuggcggcuggguugcaaggggacagaggcuguugcuugauguaggaggccccgcuguugagagccgcggaggccgcgggcggccaggcugcugcagagcuggaguaaacggcgugcggcuccaugacuccgccggcgccggccggcagcagcggugaagcgggcaccgagcugucguggugcggguacuccccggccgcagagccaccgcagccacccauguacgaguggccgccguuggagggcagguguggcaccgaguggcugggcaaagccaugccguccacguugccagccaaauggccauucaucaugcccaagccgcccuccagcgccaggcuguugggcgcgcacgagaggccuccggagcccuggaagccguaggugucggggaggugguugaagcccagcccguucaccaugcuguacacaggcuugagcgccuggcauuuccuucggaagccgcgcggccgccggcggaacgagcccuccucgaacauaaacucgcuagccggaucgaugguccaguaguggcccuugccgggucgcccgaggcccuugggcaguuugaugaagcacucguugagcgacagguuguggcgcacggaguucuuccagcccugguaggcgccgcggaagaaggggaagcgcgccugaagaaacugguagaucucgcugagggucaggcgcuugcugggcgagcucuggauagccaugacgaugagcgcgauguacgaguagggcggcuucuccggccgccgcacgccggcguuggucuucuuggccuugguggggcccgccgccgcgggguccauggccuggccgcccgcgccgccgccuccuccugugcccccgccgugcggcggcugcugcuugucgggcgcggacaucggguggcugcugccgccgccgcugccgccgcugcucugcgcugccgagccgggaggaggaggaggagcaggaggggagggaggggagggggcugcgcggggcggcugcaccucugccgucacugcggcucccgagcgcgccucccccgcaagcccgcccuccccaggcgcgcuauucuccuccuccucccugcgggaggccacgcgcaucagggggcccggcaccgccccccccgccuacuccccccccccgccggugcacgccuuugcgcccccgcagccugcaguguccgaucccccguagcuauucagugggcucaagccccccaggucccuccccacgcguccccagccccccuccacccccgcuccccggacugcgaagccugccccgccucugccgaccuggacccggugugccgguccc

SEQ ID NO: 10373 - RNA, 2501 nt, Mus musculus
aguguagcugaggagcagggucacugugagggcggggcaggggcagggacaacguggggaggacaacugauaggcgggaucaggguaauaagguugcugagggacagggucgacgaaaggaggacggcugaggagcgggggucaaugugaggaggacggcugaggggcggggucaacgcgaggagggacggccgaagggcgggaccaaugugggaagaaucggcugaagggcggggucagcgcgaggagcacagaugagggguggagccagcgcgaggacagaaggcccggcccaggcugggugaguacgcggaagucggugcaagcagagaaaagacgagcgcuaguuuggggcggggccagugggaaggacggccugagggcggggucagcacgggugggaaggcgcuaccgcggaggacgguccggggcguggcgagaggcggggcccgccgccagcuacgcgaaggccccgcccgccuggccagccugcggggagcgcccuggcggcggccgccgguucgccgcucgcggcucgcagguuccauugagaaaagcugagcggcggcggcggcggcgucugcgccggagcagagaagccgccaccagcccgccgcccgccgggcaguccgcgcgcccgagcgcagggccguggccucgggccuccgcggcggcgccggcggcccacgcgcggcgcggcgggcugggggcgcgggccgaggcagccguggagcccgcgggccgggggcaugagccgccccgcuaccccgccgcgccccugccgcccgccgccgcccgccaggggcuagaggcggccgccgcgagggcgcgcggcgccggagacauguccaggaggaaacagagcaauccccggcagaucaagcgugagucaaacuuugcccguggugcccgccagacccccgcuggcgccccgccgccccgcgccgccccugcgcggccgcccaaccccgcugcgcccgcgaccuucaccccgcgccgcgccccccgcgccgagugccaagcgcgccguaaucuaaucucugccggcgggcagggcccccgcgucucagcaugggcacccaggggguccgggccccagagaggguggcgggucccgagagccggaaggagagugucugggggcgcggcuccagcagagccgggccaccucgcagccugcaccucccccgcauccgagauggugcggcgauagggcggccccgaucugggcucagauaaaguuuaaaauauuccauucugcaagucccauccugauaagaucgcucugucgggacgggcugaaauugugaucuuaucuggcgugcuugacucucccaggcuuuguaucuagaggcagaaggagaaagaccugggaguaagggggacuugggacugcggggaccggccggcgcccaccgcagcgcuuuggcugcagagcgacaaggcagcggaauagguaguggaggcugcuccaaccuaggcauuuggcacuggcugaccaaacccccuuuauccgcuccggcucuggaguuuucgauccgaccucugccugcugggggacauguggagauccgacccaccaacugccccuaacaacgcuacacgaauggaugcccaugggcaccgcucucuccaccuccauccgagggguuauccugaaccauccagggaccucaggcacucaaacguuguucccgagugaaguuucucgcagguucucccgugggcacuuucccgagcaaggcagacccuauaauccuacaucauccgugccccccuacaguaagacccuccugggcucuuggggcuaccagguugcggggccucuuggcugcucuaggagcgaguaagcacacaggaagagcuccuccccacgccacaccaauaauaacuucgcgccucucccggcagggcgcggggcuuccuccccggagcuucccuuuggcgagagcgacaggucaucugggcugcccaggaggugacgggaggggggcugggcauccggcuuuccagcuccagacgccugagcuaccuccucuguccacaucacacugccaccaggaccaagugugcauuuuagcuugugagaguacccccuacugaaguggggggggacggggaggaaucuggguucugguaacccgacuccccaaaugcgugcuggaccuguuuuccgaaagucuccuucuaucaugucagcugaagaauuaaagccacccacaggucccgaucugugcugguucucugguuucuuuuuccccuccucgccugugcgccucugcuggguucuguucucgcguguaugugugugugcgugagcgugagcgugugcguguguguguguguguguguguguguguguguguguguguguguguuucaguuugaugagaaaugcagauagcuagggcagggagaucucagguugggaacggaucgccagcgcugauaagcccgcaggagcccagcagagcccaacccacuugggucagcgaaacccc

SEQ ID NO: 10374 - RNA, 2501 nt, Mus musculus
gggguuucgcugacccaaguggguugggcucugcugggcuccugcgggcuuaucagcgcuggcgauccguucccaaccugagaucucccugcccuagcuaucugcauuucucaucaaacugaaacacacacacacacacacacacacacacacacacacacacacacacgcacacgcucacgcucacgcacacacacauacacgcgagaacagaacccagcagaggcgcacaggcgaggaggggaaaaagaaaccagagaaccagcacagaucgggaccuguggguggcuuuaauucuucagcugacaugauagaaggagacuuucggaaaacagguccagcacgcauuuggggagucggguuaccagaacccagauuccuccccguccccccccacuucaguaggggguacucucacaagcuaaaaugcacacuugguccugguggcagugugauguggacagaggagguagcucaggcgucuggagcuggaaagccggaugcccagccccccucccgucaccuccugggcagcccagaugaccugucgcucucgccaaagggaagcuccggggaggaagccccgcgcccugccgggagaggcgcgaaguuauuauugguguggcguggggaggagcucuuccugugugcuuacucgcuccuagagcagccaagaggccccgcaaccugguagccccaagagcccaggagggucuuacuguaggggggcacggaugauguaggauuauagggucugccuugcucgggaaagugcccacgggagaaccugcgagaaacuucacucgggaacaacguuugagugccugaggucccuggaugguucaggauaaccccucggauggagguggagagagcggugcccaugggcauccauucguguagcguuguuaggggcaguuggugggucggaucuccacaugucccccagcaggcagaggucggaucgaaaacuccagagccggagcggauaaaggggguuuggucagccagugccaaaugccuagguuggagcagccuccacuaccuauuccgcugccuugucgcucugcagccaaagcgcugcggugggcgccggccgguccccgcagucccaagucccccuuacucccaggucuuucuccuucugccucuagauacaaagccugggagagucaagcacgccagauaagaucacaauuucagcccgucccgacagagcgaucuuaucaggaugggacuugcagaauggaauauuuuaaacuuuaucugagcccagaucggggccgcccuaucgccgcaccaucucggaugcgggggaggugcaggcugcgagguggcccggcucugcuggagccgcgcccccagacacucuccuuccggcucucgggacccgccacccucucuggggcccggacccccugggugcccaugcugagacgcgggggcccugcccgccggcagagauuagauuacggcgcgcuuggcacucggcgcggggggcgcggcgcggggugaaggucgcgggcgcagcgggguugggcggccgcgcaggggcggcgcggggcggcggggcgccagcgggggucuggcgggcaccacgggcaaaguuugacucacgcuugaucugccggggauugcucuguuuccuccuggacaugucuccggcgccgcgcgcccucgcggcggccgccucuagccccuggcgggcggcggcgggcggcaggggcgcggcgggguagcggggcggcucaugcccccggcccgcgggcuccacggcugccucggcccgcgcccccagcccgccgcgccgcgcgugggccgccggcgccgccgcggaggcccgaggccacggcccugcgcucgggcgcgcggacugcccggcgggcggcgggcugguggcggcuucucugcuccggcgcagacgccgccgccgccgccgcucagcuuuucucaauggaaccugcgagccgcgagcggcgaaccggcggccgccgccagggcgcuccccgcaggcuggccaggcgggcggggccuucgcguagcuggcggcgggccccgccucucgccacgccccggaccguccuccgcgguagcgccuucccacccgugcugaccccgcccucaggccguccuucccacuggccccgccccaaacuagcgcucgucuuuucucugcuugcaccgacuuccgcguacucacccagccugggccgggccuucuguccucgcgcuggcuccaccccucaucugugcuccucgcgcugaccccgcccuucagccgauucuucccacauuggucccgcccuucggccgucccuccucgcguugaccccgccccucagccguccuccucacauugacccccgcuccucagccguccuccuuucgucgacccugucccucagcaaccuuauuacccugaucccgccuaucaguuguccuccccacguugucccugccccugccccgcccucacagugacccugcuccucagcuacacu

SEQ ID NO: 10375 - RNA, 2501 nt, Mus musculus
acacccuucagcacaugcacauagcccccugagaaggucuguaaggaaggguccuggucagacaugcacuuccauaaagguuccuagauguagccuauguggguugagccugccuugaccucggugcacuucugaagcuccuguccacccccugauacaguuucuaucugucuggagugagcuuggaugucagacauuguuuuccuccaagggagaaccuaaacccuuguguaugcuaagcaagcauuguggucgagacaagguccuuguuguauagcccagcuugaccccaaacucaccauccuccugccucagccuacaggaauauuccacuguaccucgcuggcagguagccucccacgacuguaguauuccagaaaguccaaugugcuuucuagauccaagcuaccaauggaaucaaagcuccaggguuuaagcuugggucuuucuaagugugaccgucuacaacagcucuaggcuuccuuggagcacuucugugcauagcacccuuagggagaggaugucuacacacaaggagcacuggccagaacacccuccuuagggcguugcaccucgacuuaagagaaaaggggcuuuucccuaaaaccacacagcuaggaggcucuauccuugccagcuccaccccaacacuauuucugaacuauucagugugaaggccacgccuggcugccucuguccucuggggcggaugggugggcuucuagcuugacagaacugaaugaaaguccugagaucucagguauucccguggagcagcaggcuggugggguguggagggggagacguuaccaugacaaccgguggagguuuaccucgcccacgugcauucugacgucauugccuucccacucaaaauuagcucagagcggcccuacccccucuaaguggucugccaucugaccuaaggacuaggccagcccuggaccuggccgccuaaccuggacccaggcaggaauaagaucccugcuguucugaucugcuguucucuucccagucuuagcagccuccuuuuacagauggggaccaguccacaucuuagaggaguuaggaugaccauaggacaucaaguaccucccucacccacccacgucuacccuagaauuuccauggcaacuagggcagugagacuacuuugaggacagccauauaaguucuaggugaaugacugguaggcaugcaucccaacacgcccacgagcccucaacgcagaacccuccccugaagaggaucugcagcccucaaacagccuggacaaggacgggagugaaggagcaccacugaugccauaccuugauaguggugaacuccuuucuccagggcagcagguacaggugcacagcggccagcucuaggagcucaaaggcgcgggccagaucuuggagggccggugccaggucagcccgcccccacaggccaucagugaacagggcuagcgcaucguccuguagcgccccgugcaggucaaagucuuccaccagaaucugccagagcaccgcgcgcagcgaggggucgccgcaaacgcccgcgcggccgcgccgcagcucgcgcuccaggcacuggcgauaguccucggacagugagcugcugcccauccugaucagguccgggaugaggugucaaacuagagaccaugucaucucagcugugugugcgacucucaaccccgcacccagcaagcccagggcucccuccaaccuggaaauagggaccuuggcagcuuagccaacucucggaaucuauggucccugagacguggacgcugacagcucagugaccacaguauuuguagccuccccuccccaggacaccuucagccccgcuugcugagcguccucguaucaacagcuccgcucccacuagcugaaccucuugcagccagagccccucucccacugacgguccccgugggcggcggugcuaccugcuagucgccagcuauuccagagagcuccgcuugggccugggucucuccucgcucuuccgcagaaagucaagcccgccccuuggccuuggucgugacguuggugggcgaggcuggagucgggugccgcccuuucggcuaaguaggaggguggagguguaggcguggccugggcgaagcugggcguggcccuccccugcagcucaccuuuugaaguucucucagauucacuaguuagucuuucagcuagucugagugggaguacacaguggguguaugaucacuggucgccaagaugugccuagcggaaccggucugaaccaggcuggacuuuggcuccucaagccaacccacagaauagccaaauaccggcuaggcggggccugucuuggcagaucauggaccaaaggaggucaaacacacguauuuaaguacaauuuaaaacggguggggugguggacugcccaguggguaugagcaccugcguggcagcucauuuuuuugucuuuaacuccaguucccaacauccacuucuggccccugcaucugguguuuuuga

SEQ ID NO: 10376 - RNA, 2501 nt, Mus musculus
ucaaaaacaccagaugcaggggccagaaguggauguugggaacuggaguuaaagacaaaaaaaugagcugccacgcaggugcucauacccacugggcaguccaccaccccacccguuuuaaauuguacuuaaauacguguguuugaccuccuuugguccaugaucugccaagacaggccccgccuagccgguauuuggcuauucuguggguuggcuugaggagccaaaguccagccugguucagaccgguuccgcuaggcacaucuuggcgaccagugaucauacacccacuguguacucccacucagacuagcugaaagacuaacuagugaaucugagagaacuucaaaaggugagcugcaggggagggccacgcccagcuucgcccaggccacgccuacaccuccacccuccuacuuagccgaaagggcggcacccgacuccagccucgcccaccaacgucacgaccaaggccaaggggcgggcuugacuuucugcggaagagcgaggagagacccaggcccaagcggagcucucuggaauagcuggcgacuagcagguagcaccgccgcccacggggaccgucagugggagaggggcucuggcugcaagagguucagcuagugggagcggagcuguugauacgaggacgcucagcaagcggggcugaagguguccuggggaggggaggcuacaaauacuguggucacugagcugucagcguccacgucucagggaccauagauuccgagaguuggcuaagcugccaaggucccuauuuccagguuggagggagcccugggcuugcugggugcgggguugagagucgcacacacagcugagaugacauggucucuaguuugacaccucaucccggaccugaucaggaugggcagcagcucacuguccgaggacuaucgccagugccuggagcgcgagcugcggcgcggccgcgcgggcguuugcggcgaccccucgcugcgcgcggugcucuggcagauucugguggaagacuuugaccugcacggggcgcuacaggacgaugcgcuagcccuguucacugauggccugugggggcgggcugaccuggcaccggcccuccaagaucuggcccgcgccuuugagcuccuagagcuggccgcugugcaccuguaccugcugcccuggagaaaggaguucaccacuaucaagguauggcaucaguggugcuccuucacucccguccuuguccaggcuguuugagggcugcagauccucuucaggggaggguucugcguugagggcucgugggcguguugggaugcaugccuaccagucauucaccuagaacuuauauggcuguccucaaaguagucucacugcccuaguugccauggaaauucuaggguagacgugggugggugagggagguacuugauguccuauggucauccuaacuccucuaagauguggacugguccccaucuguaaaaggaggcugcuaagacugggaagagaacagcagaucagaacagcagggaucuuauuccugccuggguccagguuaggcggccagguccagggcuggccuaguccuuaggucagauggcagaccacuuagaggggguagggccgcucugagcuaauuuugagugggaaggcaaugacgucagaaugcacgugggcgagguaaaccuccaccgguugucaugguaacgucucccccuccacaccccaccagccugcugcuccacgggaauaccugagaucucaggacuuucauucaguucugucaagcuagaagcccacccauccgccccagaggacagaggcagccaggcguggccuucacacugaauaguucagaaauaguguugggguggagcuggcaaggauagagccuccuagcugugugguuuuagggaaaagccccuuuucucuuaagucgaggugcaacgcccuaaggaggguguucuggccagugcuccuuguguguagacauccucucccuaagggugcuaugcacagaagugcuccaaggaagccuagagcuguuguagacggucacacuuagaaagacccaagcuuaaacccuggagcuuugauuccauugguagcuuggaucuagaaagcacauuggacuuucuggaauacuacagucgugggaggcuaccugccagcgagguacaguggaauauuccuguaggcugaggcaggaggauggugaguuuggggucaagcugggcuauacaacaaggaccuugucucgaccacaaugcuugcuuagcauacacaaggguuuagguucucccuuggaggaaaacaaugucugacauccaagcucacuccagacagauagaaacuguaucaggggguggacaggagcuucagaagugcaccgaggucaaggcaggcucaacccacauaggcuacaucuaggaaccuuuauggaagugcaugucugaccaggacccuuccuuacagaccuucucagggggcuaugugcaugugcugaagggugu

SEQ ID NO: 10377 - RNA, 2501 nt, Mus musculus
ggggguuaagccuggucuacauagcaagauccaggguagccagggcuacauagacccuggcuuaaugauacauuauaaagauuuuacuuuugggagaucguuucuucaguggcuacugaugaauaacaggucuagauuuaaugcggaguacuagaggaaggcuggcaaggucuguaugagcgagcccugcugcgggccugggagauggaacacagagcuccauccuccugggcucugccuuuuuuguguuucacaggcuccaaaacaaaguuaccauuacagucacccuuagggagccccaccaagcacagcccacuagcucaggaugcagacaagaaaacacgcuaaaggcaccaagagagaauucccucuuagcuuuugccucccgacaugcaggcacgguaccagcucaugauagguacuugggauuuguucacugaaucgggcgucugagccccccacccccagccaguaaugcauacaucagagacagcauacuccaucucugcuuaagcuugugggcuuguucuuucuuuccucagagaaagaaagaaagaaagaaagaaagaaagaaagaaagaaagaaagaaagaaagacagaccucugcccuauacaagggggcugccuguauugacagccaugcuaacggaggcucaggggcacaggcaaguuuccaacaucgcacagcucaaaaaauaacucugagcucuacaagccaaguccuugcucuccaaaccaucuaccuucugguacccacggagcuggugcugggaagacccagggucuggggacugucaauagcaagaacgcuggucucccauaaaaacaaaacaaagcacaaccaaucccacuggcuggaaagugucuggcgcuuaggcagauaaggguuuucaagcaggacacugcuccccgccuguagacauaggagccgcuuggggacagcucccacgggcaacccuuuggacuucagaagaagccaucguguggcuggguugcaggcggaauggcaagcuggccaaauccucagacacuugguguuuccuugggaugggaucuucaggaaauccuagagguguuggguauggcuaagcaagugauggauuguucagauuacauccaaguucccacagcgauggaucccugaaaagcuuucuggaaagcugagacgcagggugggugauuuuuaagaguuuucucucuauuaucagccacccgccugugggcacgcuccaaggagggcagacccugcgguaagauguuaaccucaagggucuucagcugcugggagaggccgaggaaggagcacaccauucacaccuucccuuccaaauauauggcagcugggcagcucggaggccgcugcccugcagcaccaagagcucgggugcaugcgccaugaccucacaaaaaccccagcucagucgggagccccagacccccuuccgccucuugucauuccuccugguaucgcggcuggggcgaacaaagccuacgcgugaacaagcggguagcaucgccccuacgaauccccucuccagaucccuaacuccggccccuacacgccccucccccgcucccaggcucggcuggcagggggcucaggacgcaaccccuggucaccuccuuggagggcaguccgcaagccuuccggagcccggagcucgcauaucagggaaagagacgcagucuguguuugccgagccggauacccgcacguuuccaaggaucuggcccggcccccuccuccgccccuagcucugagucggacgggcgggcucagaaggcaucagcgggucuccaggccccgggaguagcuggcuagugggcagagggaggggcugcgguuuguuguuggguucugggggccggggucggacucaccucccggaccagcgcccucgggagacuccaugcggccaaugggguccgcggggggugugggcagcggcggcgacagcccgggugccccaacugcucuggugacuacugaguccgggcuucgggcacagcgcaucggggcagcagcuaaggggccgcgguggcggggaggagcccgcggggcggggcgcgcagcugcuucuggcgccgcuccccuccccaucuccagcagccagcagcacaggugcagccccgcccugcuccucgcgcgcccccugccgacccggccaacaacaacccccccccaucccacucccacccccccacccccacccccacccacccuucugcagggacguagcccuuugcggaccuccgacuucagcuagcuucccuggcuccugcgcacugagcugcgcgcuggcugcgguccaucuauccaucacaaccucgggcuuuuguggggcgccagcgacaugaggagccuggcaaaagaguuaggagaggaggugccacaagaagggccaaagcagccccagaacccucaacugauaagccuggaauuguggaccugauuaaugcuauugaauccauauugagaguacaaguccgggaggagugg

SEQ ID NO: 10378 - RNA, 2501 nt, Mus musculus
ccacuccucccggacuuguacucucaauauggauucaauagcauuaaucagguccacaauuccaggcuuaucaguugaggguucuggggcugcuuuggcccuucuuguggcaccuccucuccuaacucuuuugccaggcuccucaugucgcuggcgccccacaaaagcccgagguugugauggauagauggaccgcagccagcgcgcagcucagugcgcaggagccagggaagcuagcugaagucggagguccgcaaagggcuacgucccugcagaagggugggugggggugggggugggggggugggagugggauggggggggguuguuguuggccgggucggcagggggcgcgcgaggagcagggcggggcugcaccugugcugcuggcugcuggagauggggaggggagcggcgccagaagcagcugcgcgccccgccccgcgggcuccuccccgccaccgcggccccuuagcugcugccccgaugcgcugugcccgaagcccggacucaguagucaccagagcaguuggggcacccgggcugucgccgccgcugcccacaccccccgcggaccccauuggccgcauggagucucccgagggcgcugguccgggaggugaguccgaccccggcccccagaacccaacaacaaaccgcagccccucccucugcccacuagccagcuacucccggggccuggagacccgcugaugccuucugagcccgcccguccgacucagagcuaggggcggaggagggggccgggccagauccuuggaaacgugcggguauccggcucggcaaacacagacugcgucucuuucccugauaugcgagcuccgggcuccggaaggcuugcggacugcccuccaaggaggugaccagggguugcguccugagcccccugccagccgagccugggagcgggggaggggcguguaggggccggaguuagggaucuggagaggggauucguaggggcgaugcuacccgcuuguucacgcguaggcuuuguucgccccagccgcgauaccaggaggaaugacaagaggcggaagggggucuggggcucccgacugagcugggguuuuugugaggucauggcgcaugcacccgagcucuuggugcugcagggcagcggccuccgagcugcccagcugccauauauuuggaagggaaggugugaauggugugcuccuuccucggccucucccagcagcugaagacccuugagguuaacaucuuaccgcagggucugcccuccuuggagcgugcccacaggcggguggcugauaauagagagaaaacucuuaaaaaucacccacccugcgucucagcuuuccagaaagcuuuucagggauccaucgcugugggaacuuggauguaaucugaacaauccaucacuugcuuagccauacccaacaccucuaggauuuccugaagaucccaucccaaggaaacaccaagugucugaggauuuggccagcuugccauuccgccugcaacccagccacacgauggcuucuucugaaguccaaaggguugcccgugggagcuguccccaagcggcuccuaugucuacaggcggggagcaguguccugcuugaaaacccuuaucugccuaagcgccagacacuuuccagccagugggauugguugugcuuuguuuuguuuuuaugggagaccagcguucuugcuauugacaguccccagacccugggucuucccagcaccagcuccguggguaccagaagguagaugguuuggagagcaaggacuuggcuuguagagcucagaguuauuuuuugagcugugcgauguuggaaacuugccugugccccugagccuccguuagcauggcugucaauacaggcagcccccuuguauagggcagaggucugucuuucuuucuuucuuucuuucuuucuuucuuucuuucuuucuuucuuucuuucucugaggaaagaaagaacaagcccacaagcuuaagcagagauggaguaugcugucucugauguaugcauuacuggcuggggguggggggcucagacgcccgauucagugaacaaaucccaaguaccuaucaugagcugguaccgugccugcaugucgggaggcaaaagcuaagagggaauucucucuuggugccuuuagcguguuuucuugucugcauccugagcuagugggcugugcuugguggggcucccuaagggugacuguaaugguaacuuuguuuuggagccugugaaacacaaaaaaggcagagcccaggaggauggagcucuguguuccaucucccaggcccgcagcagggcucgcucauacagaccuugccagccuuccucuaguacuccgcauuaaaucuagaccuguuauucaucaguagccacugaagaaacgaucucccaaaaguaaaaucuuuauaauguaucauuaagccagggucuauguagcccuggcuacccuggaucuugcuauguagaccaggcuuaaccccc

SEQ ID NO: 10379 - RNA, 2501 nt, Mus musculus
ugcuuugcugaagcagccaaagggaagggaugggggaggugagccagcugccaggagcuuggcacaagccaaggcuugugccgugcuccuggccagccccgugcugccagagauucgauucucaagucauuuuuaacagcugcucccaccccccccgaccugucaucugucacuuuccuucggcuucaccgcgacuugguaggaagaagucccucucuugaccaccccgccuuuuacucccagggucugggaagcgcccagucuuucggucccuggccacacugccccaucacacuuccccuccuugguuuccuccaagugaaaagcaaaacuuucugcgcugcggucugggagccgcgaggggcggcgcgcgcgcgcuagcgaggggccgaggcuggagaggaagcggcgguccugggcaggaggaagaagccagcccucggcucggcccccugcccguuucccgccgccuccgcggccgccgcuaccaccaucaccaccacagucaccgccguccggggcgcagccggccgcacgaugcagggcggggguccccggggcgcuccgauccacaguccgagccacggcgcagguagggcccgggguucuggaggagggcgaacgaggccugccgagauccgggcgcacccugaugcaggggagggaaaucgaggcagugagcggggagugcagggugcgggcggucguguccccagcucccacugcagcucccguccaagcgcguccccgucccgagaguccggccgcccugaggcgcagucggcgaagggcgcgcccgcacuccuuccuugcgaggucccgguggccgcgaagguuuccgcagcgcccaagugcagcucgaucccaggacucccucggguggccggcgcagacgcugcggggacgcggggcgagguugagagaggugugggaacugcagcccgcaccucccguggggcugcucgccgcccacuuccgaguguggacugugacgcgcagggcagcgcaggcugaggggacccgcuccauuuccucugucagcuugggccacguaccaaccccggugaugacaucgaguuaaguggguggccgcuuuucaaccucagcaacucacugucagaaaccccaagaaaagaacgugauggcacacgccucuuuuccuagcacucgagagacaggaagacuguggagacuuucuaauacaaucugggcuacaauagugagacucuaucucaaaaaccaaaaucaaaucagaacaaugaaaaauaaaacaagcacggagaucugcuccagacugggcuuugcaguuugggcgugugcugugccaaggagagaaggcaaaggacuuaggagcuucuuuuggcucuuggagccucaguuuacccaucugugaaaggagcacuaaucacuagcuucccuaccuccuuaacuggcuucuaugaagacauuuuugcaauugggaguuggaaaauacaggguugguagguggguguaggguaagagucuucugcacccgcauccuggacucgggaaugccuuaguuuuucaauuuguaaaauggagcugauuuuccugccuacgugguagauuuuaaaagggguuuaaugugguaggaggacaugaaaccccuggccaaaucucugcgauacaaagcaaauucucaaaaaucucuuaguugcccaggcuagccuuaaaucugcugccuagcccaggcuggccuccaauuugcuagccuuugccucccaagugcugggauuacaggugugcuccacuacgcacggguccuuaaguauuauuuugaccaugcaagaccuaaauaaucgugggcaauacaggaaugccagugugacauguuagugucugaguuacaggguauuugaaaagacauuuggcaccugacauggagaccguugagguuuagccaggauucugcccacagcaaauagagcccuggaugagaaaccugcuuucugagcugucucuccaagucucgggcuuucucuucuguuuauaagaaagagaaagcaccugggcuguaauuauuaccuuagcccugagagugcugcccugggauggagagcagaacaucuggaacuggggcaggugacagccuacaggcgacaggugccacuuugcagagagugcaugggccaggcacuugguccugcccuuugaugaggucccccucacaccggugaggggcuggugcuaccauccucaucuucccuuggauguggcaaggguuggagucaccugccuguggcccuggugguuaaacagggacuggggcucaaagucagaugcaggugucuccaauuacaggcugaagggaaggugucagguggagcccaggcugagcguggaccuuugccuggucaaagguaauaccuggucuucuguuucugccguuuauaccuaucuucaucuaucuaucuaucuaucuaucuaucuaucuaucuaucuaucuaucuaucuaucuaucuaucaucuaucuaucuauc

SEQ ID NO: 10380 - RNA, 2501 nt, Mus musculus
gauagauagauagaugauagauagauagauagauagauagauagauagauagauagauagauagauagauagauagaugaagauagguauaaacggcagaaacagaagaccagguauuaccuuugaccaggcaaagguccacgcucagccugggcuccaccugacaccuucccuucagccuguaauuggagacaccugcaucugacuuugagccccagucccuguuuaaccaccagggccacaggcaggugacuccaacccuugccacauccaagggaagaugaggaugguagcaccagccccucaccggugugagggggaccucaucaaagggcaggaccaagugccuggcccaugcacucucugcaaaguggcaccugucgccuguaggcugucaccugccccaguuccagauguucugcucuccaucccagggcagcacucucagggcuaagguaauaauuacagcccaggugcuuucucuuucuuauaaacagaagagaaagcccgagacuuggagagacagcucagaaagcagguuucucauccagggcucuauuugcugugggcagaauccuggcuaaaccucaacggucuccaugucaggugccaaaugucuuuucaaauacccuguaacucagacacuaacaugucacacuggcauuccuguauugcccacgauuauuuaggucuugcauggucaaaauaauacuuaaggacccgugcguaguggagcacaccuguaaucccagcacuugggaggcaaaggcuagcaaauuggaggccagccugggcuaggcagcagauuuaaggcuagccugggcaacuaagagauuuuugagaauuugcuuuguaucgcagagauuuggccagggguuucauguccuccuaccacauuaaaccccuuuuaaaaucuaccacguaggcaggaaaaucagcuccauuuuacaaauugaaaaacuaaggcauucccgaguccaggaugcgggugcagaagacucuuacccuacacccaccuaccaacccuguauuuuccaacucccaauugcaaaaaugucuucauagaagccaguuaaggagguagggaagcuagugauuagugcuccuuucacagauggguaaacugaggcuccaagagccaaaagaagcuccuaaguccuuugccuucucuccuuggcacagcacacgcccaaacugcaaagcccagucuggagcagaucuccgugcuuguuuuauuuuucauuguucugauuugauuuugguuuuugagauagagucucacuauuguagcccagauuguauuagaaagucuccacagucuuccugucucucgagugcuaggaaaagaggcgugugccaucacguucuuuucuugggguuucugacagugaguugcugagguugaaaagcggccacccacuuaacucgaugucaucaccgggguugguacguggcccaagcugacagaggaaauggagcggguccccucagccugcgcugcccugcgcgucacaguccacacucggaagugggcggcgagcagccccacgggaggugcgggcugcaguucccacaccucucucaaccucgccccgcguccccgcagcgucugcgccggccacccgagggaguccugggaucgagcugcacuugggcgcugcggaaaccuucgcggccaccgggaccucgcaaggaaggagugcgggcgcgcccuucgccgacugcgccucagggcggccggacucucgggacggggacgcgcuuggacgggagcugcagugggagcuggggacacgaccgcccgcacccugcacuccccgcucacugccucgauuucccuccccugcaucagggugcgcccggaucucggcaggccucguucgcccuccuccagaaccccgggcccuaccugcgccguggcucggacuguggaucggagcgccccggggacccccgcccugcaucgugcggccggcugcgccccggacggcggugacugugguggugauggugguagcggcggccgcggaggcggcgggaaacgggcagggggccgagccgagggcuggcuucuuccuccugcccaggaccgccgcuuccucuccagccucggccccucgcuagcgcgcgcgcgccgccccucgcggcucccagaccgcagcgcagaaaguuuugcuuuucacuuggaggaaaccaaggaggggaagugugauggggcaguguggccagggaccgaaagacugggcgcuucccagacccugggaguaaaaggcgggguggucaagagagggacuucuuccuaccaagucgcggugaagccgaaggaaagugacagaugacaggucggggggggugggagcagcuguuaaaaaugacuugagaaucgaaucucuggcagcacggggcuggccaggagcacggcacaagccuuggcuugugccaagcuccuggcagcuggcucaccucccccaucccuucccuuuggcugcuucagcaaagca

SEQ ID NO: 10381 - RNA, 2501 nt, Mus musculus
cacacagagcacuugcugcuccugcagagaaccccaguuaggaccucagcaccuauaucagagcaccugcaacuucaccucugagggcucucacccucucugcugacgucugagcaacuauauaaccauguaacauacacucccagagacauauacacguaauaaaaugaaaauacuugagaucauuuuauaccuuuuauacaaaaaauaaaaugucacgauaugucacugucuguguugaauauuuacaaauauuuucaaauccugaaaucuuuacaacaacuuugcuuuuuauaggguggggcuggcaugcuucuuaauucaguacaaauucugauauguuuagauuucuucucaaagcaucugauauuccagguggaaucagacuagugaguagcuggaauuccaacgccagagauuuagaucuagccagugauuggcuagggaggggcuuugggcgggccuuccuagagcgccaacgcuugcuagaaagcuauggagccagucuagacugucacuaucagucuuuguaguauuuacgggugcgaggauucugacauucugcuaacuucucuuagcuuuacuagagcaaccugcaaccagaacucgcugggauuguagagaaccuagggagccauagagacugucgcugcaggagaacgaguaagaaugggcuacgucuuagccccagguuuuuggugaggacuguaaagcaaacuuccuaggaugucuagguuucaacaaacauaagaaguccggagauagcgggaguccuuuuuuucagcaccggccacaccaguuccgggucucccauucaagaagaaacacgaaaaaaagucucucgaauaacucccaguucucagaccagaccagcuugcuccagcuacuucuuccuguccucaccccaccgcgaccgggacagcgcgacuaccacccuuccucugcgucuggguggaggguaaggacaggagcugaccaagaccgccccucccaaccaggagguggagaucccacggguccugcgacucuacacccacuuccuccucccucugccccuauaucaccggcacccccuccuccuucccuuuucccuccucccaggagacaggggaggagaaaaggggagcuugggucgucaugacugagcugcaggcaaaggauccgcagguucuccacacgucuggcgcuucgcccucccccccacacaucgggucccccuugcuugcacgcuuggacucaggucccuuccaagggagccagcacucggacgugucgucuguagucucgccuauaccgaucucccuggacgggcugcuuuuuccucgguccugccggggucccgagcucccagacggaaagacaggggaccagcagucgcuguccgacguggagggagcuuucucugggguagaagccacucauagggaaggaggcagaaauuccagagccccggagaaggacagcagacucuuagacagugucuuagacucguuguugacucccuccgggaccgaacagagucacgccagcccuccagccugcgaggccaucacuuccuggugucucuuugggccagagcuuccagaagacccccgcagugucccugcuaccaaaggguuguuguccccgcucaugagucggccagagaucaaggcuggcgacagcuccgggacaggagcaggacagaaggugcugcccaaaggacugucaccacccaggcagcuguugcucccuaccucggggagugcucacuggcccggggcaggggugaagccguccccgcagccagcugcaggggagguggaagaggacaguggccuggagaccgagggcucugcagcuccgcuucuaaagagcaaaccucgagcacuggaaggcaccggcagcggaggaggagucgcagccaacgcggccucagcggccccaggcggugucacucuggucccaaaggaagauucacgguuuucugcuccuagggucuccuuggagcaagacucucccauugcccccgggcgcuccccacuggccaccacagugguggauuucauccaugugcccauccugccucugaaccacgcacuccuggccgcccgcacccggcagcugcuggagggggacagcuacgacggcggggccacagcccagggcccuuuugccccgccuaggggcucgcccuccgcgccauccccgccggugcccugcggugacuucccagacugcaccuacccucuggaaggcgaccccaaagaggacguguucccucuuuacggcgacuuccagacgccuggcuugaagaucaaggaggaggaggagggcgcggaugcugcugugcgcucgccgcgccccuaccugucggcuggagccagcuccuccaccuucccagacuucccgcuggcacccgcgccgcagcgagcgccauccuccaggcccggagaagcggcgguggccggcggacccagcagcgccgcggugucgccagcguccuccuccggcuccgcgcu

SEQ ID NO: 10382 - RNA, 2501 nt, Mus musculus
agcgcggagccggaggaggacgcuggcgacaccgcggcgcugcuggguccgccggccaccgccgcuucuccgggccuggaggauggcgcucgcugcggcgcgggugccagcgggaagucugggaagguggaggagcuggcuccagccgacagguaggggcgcggcgagcgcacagcagcauccgcgcccuccuccuccuccuugaucuucaagccaggcgucuggaagucgccguaaagagggaacacguccucuuuggggucgccuuccagaggguaggugcagucugggaagucaccgcagggcaccggcggggauggcgcggagggcgagccccuaggcggggcaaaagggcccugggcuguggccccgccgucguagcugucccccuccagcagcugccgggugcgggcggccaggagugcgugguucagaggcaggaugggcacauggaugaaauccaccacugugguggccaguggggagcgcccgggggcaaugggagagucuugcuccaaggagacccuaggagcagaaaaccgugaaucuuccuuugggaccagagugacaccgccuggggccgcugaggccgcguuggcugcgacuccuccuccgcugccggugccuuccagugcucgagguuugcucuuuagaagcggagcugcagagcccucggucuccaggccacuguccucuuccaccuccccugcagcuggcugcggggacggcuucaccccugccccgggccagugagcacuccccgagguagggagcaacagcugccuggguggugacaguccuuugggcagcaccuucuguccugcuccugucccggagcugucgccagccuugaucucuggccgacucaugagcggggacaacaacccuuugguagcagggacacugcgggggucuucuggaagcucuggcccaaagagacaccaggaagugauggccucgcaggcuggagggcuggcgugacucuguucggucccggagggagucaacaacgagucuaagacacugucuaagagucugcuguccuucuccggggcucuggaauuucugccuccuucccuaugaguggcuucuaccccagagaaagcucccuccacgucggacagcgacugcugguccccugucuuuccgucugggagcucgggaccccggcaggaccgaggaaaaagcagcccguccagggagaucgguauaggcgagacuacagacgacacguccgagugcuggcucccuuggaagggaccugaguccaagcgugcaagcaagggggacccgaugugugggggggagggcgaagcgccagacguguggagaaccugcggauccuuugccugcagcucagucaugacgacccaagcuccccuuuucuccuccccugucuccugggaggagggaaaagggaaggaggagggggugccggugauauaggggcagagggaggaggaaguggguguagagucgcaggacccgugggaucuccaccuccugguugggaggggcggucuuggucagcuccuguccuuacccuccacccagacgcagaggaagggugguagucgcgcugucccggucgcgguggggugaggacaggaagaaguagcuggagcaagcuggucuggucugagaacugggaguuauucgagagacuuuuuuucguguuucuucuugaaugggagacccggaacugguguggccggugcugaaaaaaaggacucccgcuaucuccggacuucuuauguuuguugaaaccuagacauccuaggaaguuugcuuuacaguccucaccaaaaaccuggggcuaagacguagcccauucuuacucguucuccugcagcgacagucucuauggcucccuagguucucuacaaucccagcgaguucugguugcagguugcucuaguaaagcuaagagaaguuagcagaaugucagaauccucgcacccguaaauacuacaaagacugauagugacagucuagacuggcuccauagcuuucuagcaagcguuggcgcucuaggaaggcccgcccaaagccccucccuagccaaucacuggcuagaucuaaaucucuggcguuggaauuccagcuacucacuagucugauuccaccuggaauaucagaugcuuugagaagaaaucuaaacauaucagaauuuguacugaauuaagaagcaugccagccccacccuauaaaaagcaaaguuguuguaaagauuucaggauuugaaaauauuuguaaauauucaacacagacagugacauaucgugacauuuuauuuuuuguauaaaagguauaaaaugaucucaaguauuuucauuuuauuacguguauaugucucugggaguguauguuacaugguuauauaguugcucagacgucagcagagagggugagagcccucagaggugaaguugcaggugcucugauauaggugcugagguccuaacugggguucucugcaggagcagcaagugcucugugug

SEQ ID NO: 10383 - RNA, 2501 nt, Mus musculus
ccacauuuccugcauacuauugacuccccaagcuaauacaagcaaccucuccauccacccuugcucaaacaggcgcuggugggagggaccgaggaugggcguggcuuggagacccagcgcguugucucagacucuauaccuauggugguggguguuugggcagggccucucagcaucccuucccuccuucgccagggaugacgcgggagagcguggucgcccccagaaggcuuuagaucauuaggccgaccuccauguagaucuuucccccacgggggaccgcucuugccuggcuagcucgccugcauuaaggccuggagaagcccagugcgcgcucgccuccugucagcucgccccccaucaccgccucugucaccgcccccuccuuagaaaccaaguuaccaacguuuaaaccaaucccugggcgcaauucugccacccccacacuccacccgcugcgcugcgcgguccucccagccccgcucuccaucacucgcgcuccccucgccuucugugcucuccccuccccggcagcggcggcaaugccggggccuucgccagggcugcgccgagcgcuccucggccucugggcugcccugggccuggggauccuaggcaucucagguaagaagagcccgccggcggagccagguggauaaggcgggggcggaauugaaggaccagagagggcggcccggguguccccuccaggcuccgcccucuucuagcuucccacgcuucugccaccaccuggagcuccgggcuucucccuguccuuccuccaccccaacacaccucgaucuuucagaucggaacccagcaccuuuucugaauucgggguuuugcacccaaccuggcucaggagacacuguggcucuccuguucucuccugcucugucguguccuaugguucacagacuagcaucaucccuauuuaugauccucaaagacccuaucuccucaacugucauaacucagaggcccuguuuccccuccaccuggagcccuggcaaccggcuuucuagggcuuuccucacgguuccuucccggaaucuaaccuuguggcuuucuguccaaguuacucaaguuuggggacaaucuccuuuaagccuuugacucagucucucauuucuacuuugcuuucgcccccagccucggugucucucccccccauuuccugacgaccugucagggucuuaagagugacuugguuccccauccccccaaauuggaaucuccuccuccucacuauugauguguucaucugagaccccaucccugcaccgagcuuccccaucucugccauaggcagcaaggcuuccagagacgccccucuaagagugcgucagucccgaaucuugagugggaugcgggacucccgugcuauuucuuggcgguggucuuuccucguccuuacagacaccccugguuugggagaugggggccacuaagauuucagagauggggucccuaggcugagcccgcguuuuccugggcagcggucgcgcuagaaccuuucugggcggaccuucagccccgcguggcgcucguggagcgcgggggcucgcuguggcucaacugcagcacuaacuguccgcggccggagcgcgguggccuggagaccucgcuacgccgaaacgggacccagaggggucugcgcuggcuggcucggcagcugguggacauccgagagccugagacccagccggucugcuucuuccgcugcgcgcgccgcacacuccaagcgcguggacucauccgaacuuuccgugaguacaguguggacacgccccuugggucccuggaccucccccuaaagcuccgcccacccguucucugguccuccuuccuaggcuuguccugagagcacuacagcucgcuaaagcccagguuuuggucccuugcagagcgaccggaucggguagagcuggugccgcucccuucuuggcagccagugggcgagaacuucaccuugagcugcagggucccgggagcaggaccccgagcgagccucacauugacccugcugcggggcggccaggagcugauucgccgcaguuucguaggcgagccaccccgagcgcggggugcgaugcucaccgccaggguccuggcacgcagggaggaccacagggucaauuucucaugccucgccgagcuugaccugcggccacacggcuugggacuguuugcaaauagcucggcccccagacagcuccguaccuuuggugaguauggacccuaacugacagguuuuaaguuuagggcagcggggcguaguguagugguguaggcccuaagucucagcccaagcagaacuaaggcggaacucuuguucauuuaaaguccagucuggucuacauagccagggcugcauaguuagauccccaaaggcuuagcagcuucaacacaaguacuaacuuaagugcuuucuuuuuuuuuuuuuuuuuuuuuaaagauuuauuuauuuauuuauuuauuauauguaaguacacuguagc

SEQ ID NO: 10384 - RNA, 2501 nt, Mus musculus
gcuacaguguacuuacauauaauaaauaaauaaauaaauaaaucuuuaaaaaaaaaaaaaaaaaaaaagaaagcacuuaaguuaguacuuguguugaagcugcuaagccuuuggggaucuaacuaugcagcccuggcuauguagaccagacuggacuuuaaaugaacaagaguuccgccuuaguucugcuugggcugagacuuagggccuacaccacuacacuacgccccgcugcccuaaacuuaaaaccugucaguuaggguccauacucaccaaagguacggagcugucugggggccgagcuauuugcaaacagucccaagccguguggccgcaggucaagcucggcgaggcaugagaaauugacccugugguccucccugcgugccaggacccuggcggugagcaucgcaccccgcgcucgggguggcucgccuacgaaacugcggcgaaucagcuccuggccgccccgcagcagggucaaugugaggcucgcucgggguccugcucccgggacccugcagcucaaggugaaguucucgcccacuggcugccaagaagggagcggcaccagcucuacccgauccggucgcucugcaagggaccaaaaccugggcuuuagcgagcuguagugcucucaggacaagccuaggaaggaggaccagagaacgggugggcggagcuuuagggggagguccagggacccaaggggcguguccacacuguacucacggaaaguucggaugaguccacgcgcuuggagugugcggcgcgcgcagcggaagaagcagaccggcugggucucaggcucucggauguccaccagcugccgagccagccagcgcagaccccucugggucccguuucggcguagcgaggucuccaggccaccgcgcuccggccgcggacaguuagugcugcaguugagccacagcgagcccccgcgcuccacgagcgccacgcggggcugaagguccgcccagaaagguucuagcgcgaccgcugcccaggaaaacgcgggcucagccuagggaccccaucucugaaaucuuaguggcccccaucucccaaaccaggggugucuguaaggacgaggaaagaccaccgccaagaaauagcacgggagucccgcaucccacucaagauucgggacugacgcacucuuagaggggcgucucuggaagccuugcugccuauggcagagauggggaagcucggugcagggauggggucucagaugaacacaucaauagugaggaggaggagauuccaauuuggggggauggggaaccaagucacucuuaagacccugacaggucgucaggaaaugggggggagagacaccgaggcugggggcgaaagcaaaguagaaaugagagacugagucaaaggcuuaaaggagauuguccccaaacuugaguaacuuggacagaaagccacaagguuagauuccgggaaggaaccgugaggaaagcccuagaaagccgguugccagggcuccagguggaggggaaacagggccucugaguuaugacaguugaggagauagggucuuugaggaucauaaauagggaugaugcuagucugugaaccauaggacacgacagagcaggagagaacaggagagccacagugucuccugagccagguugggugcaaaaccccgaauucagaaaaggugcuggguuccgaucugaaagaucgagguguguugggguggaggaaggacagggagaagcccggagcuccaggugguggcagaagcgugggaagcuagaagagggcggagccuggaggggacacccgggccgcccucucugguccuucaauuccgcccccgccuuauccaccuggcuccgccggcgggcucuucuuaccugagaugccuaggauccccaggcccagggcagcccagaggccgaggagcgcucggcgcagcccuggcgaaggccccggcauugccgccgcugccggggaggggagagcacagaaggcgaggggagcgcgagugauggagagcggggcugggaggaccgcgcagcgcagcggguggaguguggggguggcagaauugcgcccagggauugguuuaaacguugguaacuugguuucuaaggagggggcggugacagaggcggugauggggggcgagcugacaggaggcgagcgcgcacugggcuucuccaggccuuaaugcaggcgagcuagccaggcaagagcggucccccgugggggaaagaucuacauggaggucggccuaaugaucuaaagccuucugggggcgaccacgcucucccgcgucaucccuggcgaaggagggaagggaugcugagaggcccugcccaaacacccaccaccauagguauagagucugagacaacgcgcugggucuccaagccacgcccauccucggucccucccaccagcgccuguuugagcaaggguggauggagagguugcuuguauuagcuuggggagucaauaguaugcaggaaaugugg

SEQ ID NO: 10385 - RNA, 2501 nt, Mus musculus
gccagcagccccgcgggggcguccaggagcacugcagaaagugaaauggauccuguaggcggggacccaguucgguccccaccccaucgaugucgcucccauccccucucaccuaccuacuucauugauauggaugaugcggugauagcgaggagaaccggacgccuccgucaccugcagcuccagcggcacaaaacucgauguguccgcuguuggcagugaacaccagaaacgcacggagccgcggacggugggagccuggugcaggcuacaugacuuucgugacucaccccugugcgaucgggggaaccaagaagaaaagguugaacaaguagggagggcaggaggugauuggagaguuucggauuucuuugguccacaucguggggaccagagcauuuuugacuaccacgaugguagugcccuaauuccaacguaauaccugaguccauugauggaaaagaauuauuccagcuccggccacccaggggcgaccuccacaccauccgcaccacccccauccccuccuccguucccggaguuucccacccuuaaccuagucuccaggcccauccaggaagcucugcucuacccaccccuccuaaggccacccaguccugaggacucacucgagcugguaugagaagcuguaguugaaguccaucccggagcucgccgcuuccucccagaaacacaccaagucuuccaagcguugggugaagcacagaaguucuucggagccccgggaugccagcagggccgcuagaaaaggggauagccauggcggggggagggggagaucagggaagcccaggucugccuuccacggugcccuuacccucccucuugucgccugugcagauccgauaauuuuagugccccgcccucuucuccaaaagggccuucgaggggucuugcaaaaguggcgccucagaacucccaagaguagcgaccccgccugccuuguucuacuccuccgugcgcacgcccacucacccugcaaguugagcgcuguucgccccgcccuagcgggugugugugagcgcagagaacucggccuccuaucgguucccgcaggcacccggcugucccccgauagcgccaaccgugucccccgcccccuuccuccuccuagcaagccguccaaaggaccuagcaccauccgcccgccaaacugaguuuacagucugcagcgggucuguuucacagucucugggagcucgauccccucccccaggagagcggaccuagcacuaccuuacccuugccauuucuaccauaucccagacucccucaaaacacgaaacagagccgaauguguuggcucuugcaggucaucccagcaacuggagguggaggcaggagaaucaggaauucaagcucaaccucaauuacauaaugagucugagggcagcuuuggcuacacagacgccgccucaaaaccagaaacaguacaggcgagugacacaugccuuucauccuagcaauuccaggacauccuggaaugucuagcgagauccugcuucaaacaaacaaacaaacaaacaaacaaacaaacaaaccaaccaaucuuaagccucugcccugagcaucacuccagggcgaggagacucugagaugccucaucgaguucagacaccaguuuggccccuaggaccccaucuggagguucaggggacauuuagccccugggacucgggcugggaauucagaccacagcauugcccauguacaguucuuaccuuugcucucaaacuugggguccgggaggcugggugaaggugcccaggcugccccagcaaguaggagacagagggggccuacccgaggccagaggggcacccugaguuuguccaugaugcagcccuagcuucaggaagcucagggcuccagcgccccuguuucgucccccccaccucuccuucccuuuccucuuuccccuuuccccuaguccacagcugggucagcagcagcugccggacacagcugaccaggagcuucuaaguggcagcuccuuccagggggcggggccagcuugcaggcuggggacagauaagcuacagccaccaagggaacaggggccuucuugggcacagccacugccuaaaccaguguaggggguggggcagacagcagaguuuuguuucggguggcuuugcuaauguggucacggacaagugacuuauguuguuucaccgucuaggucuaguccgggcaucugugaauccagccugcugugcagccggcaggccacagauggaagagaggcucucgcuccagccaguaucucuuccccagcucaguucaaaauaagaauccuaaagacaacuagcaacugggugugugaguggaaucaggcuguguagcgugacagacacgugcuaugguguuuucuguuuaugaauuacacggauuugggaauaugaaauauuuacuauuuuuaaaauuacauuugugugugugugcaugugugugcaugcacaaaugcagcaggaugcuug

SEQ ID NO: 10386 - RNA, 2501 nt, Mus musculus
caagcauccugcugcauuugugcaugcacacacaugcacacacacacaaauguaauuuuaaaaauaguaaauauuucauauucccaaauccguguaauucauaaacagaaaacaccauagcacgugucugucacgcuacacagccugauuccacucacacacccaguugcuaguugucuuuaggauucuuauuuugaacugagcuggggaagagauacuggcuggagcgagagccucucuuccaucuguggccugccggcugcacagcaggcuggauucacagaugcccggacuagaccuagacggugaaacaacauaagucacuuguccgugaccacauuagcaaagccacccgaaacaaaacucugcugucugccccacccccuacacugguuuaggcaguggcugugcccaagaaggccccuguucccuugguggcuguagcuuaucuguccccagccugcaagcuggccccgcccccuggaaggagcugccacuuagaagcuccuggucagcuguguccggcagcugcugcugacccagcuguggacuaggggaaaggggaaagaggaaagggaaggagaggugggggggacgaaacaggggcgcuggagcccugagcuuccugaagcuagggcugcaucauggacaaacucagggugccccucuggccucggguaggcccccucugucuccuacuugcuggggcagccugggcaccuucacccagccucccggaccccaaguuugagagcaaagguaagaacuguacaugggcaaugcuguggucugaauucccagcccgagucccaggggcuaaauguccccugaaccuccagaugggguccuaggggccaaacuggugucugaacucgaugaggcaucucagagucuccucgcccuggagugaugcucagggcagaggcuuaagauugguugguuuguuuguuuguuuguuuguuuguuuguuuguuugaagcaggaucucgcuagacauuccaggauguccuggaauugcuaggaugaaaggcaugugucacucgccuguacuguuucugguuuugaggcggcgucuguguagccaaagcugcccucagacucauuauguaauugagguugagcuugaauuccugauucuccugccuccaccuccaguugcugggaugaccugcaagagccaacacauucggcucuguuucguguuuugagggagucugggauaugguagaaauggcaaggguaagguagugcuagguccgcucuccugggggaggggaucgagcucccagagacugugaaacagacccgcugcagacuguaaacucaguuuggcgggcggauggugcuagguccuuuggacggcuugcuaggaggaggaagggggcgggggacacgguuggcgcuaucgggggacagccgggugccugcgggaaccgauaggaggccgaguucucugcgcucacacacacccgcuagggcggggcgaacagcgcucaacuugcagggugagugggcgugcgcacggaggaguagaacaaggcaggcggggucgcuacucuugggaguucugaggcgccacuuuugcaagaccccucgaaggcccuuuuggagaagagggcggggcacuaaaauuaucggaucugcacaggcgacaagagggaggguaagggcaccguggaaggcagaccugggcuucccugaucucccccuccccccgccauggcuauccccuuuucuagcggcccugcuggcaucccggggcuccgaagaacuucugugcuucacccaacgcuuggaagacuugguguguuucugggaggaagcggcgagcuccgggauggacuucaacuacagcuucucauaccagcucgagugaguccucaggacuggguggccuuaggagggguggguagagcagagcuuccuggaugggccuggagacuagguuaagggugggaaacuccgggaacggaggaggggauggggguggugcggaugguguggaggucgccccuggguggccggagcuggaauaauucuuuuccaucaauggacucagguauuacguuggaauuagggcacuaccaucgugguagucaaaaaugcucugguccccacgauguggaccaaagaaauccgaaacucuccaaucaccuccugcccucccuacuuguucaaccuuuucuucuugguucccccgaucgcacaggggugagucacgaaagucauguagccugcaccaggcucccaccguccgcggcuccgugcguuucugguguucacugccaacagcggacacaucgaguuuugugccgcuggagcugcaggugacggaggcguccgguucuccucgcuaucaccgcaucauccauaucaaugaaguagguaggugagaggggaugggagcgacaucgaugggguggggaccgaacuggguccccgccuacaggauccauuucacuuucugcagugcuccuggacgcccccgcggggcugcuggc

SEQ ID NO: 10387 - RNA, 2501 nt, Mus musculus
gcaggugguauucucucagaaugucaccugaauugacugucccuuaccugaccaagccagucgcuuuuccuccucugucugcucucccuuagccuccuucaagaaaucuucuagaaguuucucugcuucccuggcuucugccccuccuggggcugcccagcccaaaaagauucggacauugccuagguucugaugaucagggggaucccggaaguccugaggaugauuucgcagccaagaacccagcaccgaaacuacagcccugaacagagggguguguggcucaaaauugaguccaaggaucuaaacguucccaaccuugcagucgucagacccgaccuugagaucccucccccacgcucccuugggucgaggguguggacgggaauggaaaccgaccucagguucuugcugaaguucagaucuugucccucuguccucuugcugucuacccugggaagaaagccucuaucagaugggaacagagcuauagggcguuaggaccucgguucuaaauuugagguguaugugugugugcgcagguagaugggguucuggggauggggacaugcgggucuccugaaaaugacugacccagcaggaggugguggcggcggcgguggcggggguagcagaaaacccaaaacgcgggcuguggguacaaaggcccgguggguggccaggaaggcaggcacgaagccaggauccugcucgcggucuccggacaccaacucaugcaccagccgcuccagucgggcggcccucagcgcccgcaccuugcugguucgguaaugaaggaaggugucgguagccgggaugggggucugcgggggaguggggcagugaaugaaauaaggugaggagcguuccaagcaccuuguuuccaauuauacccaucucuggcacuuuuuuugggggggugugacuguguccuuuucugaaacuccgagacucccuaaauauacaccaaucaugcaaugcucacaucaaccccgcaggacaccccacuacucuagcacuucccucugugcccuccucaccccgccaccccaggcuucaggcaguuuugcagccaagcuucacuggccaagccugagucccacccaucaccaccuggccgcuccuccguucugcuuuccugcacccugccggucaguuucgccuuuggggggagcgcuaucaccuggccccaccccguuuccuggauucaaaccaagucaccuggccgcccccaggcccuuuccacacaccuggucgccucuuagcuccgcccuuccuccuggccccguaguucuagggaggcucacccucagcucuccagcuucccccucuccucccaacucccaggccccugagcugaguccgcccucacuugcucgccucagucccuuccucaccuggccuucuccagaccucucuggggucgagcgcuggcugcgcugccgccgcagggagacgcuguacacggcgccauccucggucuccucgccccaguccugcagcggcgccuggauguggaggcgggcucagggaagucccuccggcuucagcccccugccuuuauguuuggcccacuuucccgaacagaguauucaagacucggggugggaucccaggucuucgccacggauacccuucucccaggucuugaguggauggaguaucauuuggggauaucccagaguccaaugucacaaagaaucugucaccuccuccugagauuccucagacccccguccccaucccccaaacuagccgcuucacggggucaggaacucugaauccccaaauggggacuccaaggcacauccauuuugcagaaagauuagaaaacgaggggcggucgccuggaguuucugaaucuggggguacacuagggacgugggguccgaggauccccagcuuccucuuaccagggccagcucuuugcccgcuguccucuccauggccccggugcccguccugcucccuggcgccgcugagugaagcggaagggccagcgggcaguggggcggggcagccgagcguccagucguggggcggggcugggcaaggcggucccacaauuccagagguccccagccggaccccauccccgcacccaggcuagccuagaagucccguuccuucccagaagugcgggucaaucugucacucagacauaugggugcaggggacacgacaacaggucugugucccugggagggaagugcuuuauacuagguugggguugaucaaucccaggugucgagggugucuccuaugucuggaggagaaggagggcacacugaaucuguaccauaggugauggaagccaugccaucucaggcuagaagccgcgaagugucuguggcccugcauuuugugggggcagccuuuugggggcggugcagggucaaaaagaggugaauacccaggggguuguucagugaccuuuauugcgcgauuccgaggcgggcaccaacccgccucgagagauuuacugugggaacuucuggcuc

SEQ ID NO: 10388 - RNA, 2501 nt, Mus musculus
gagccagaaguucccacaguaaaucucucgaggcggguuggugcccgccucggaaucgcgcaauaaaggucacugaacaacccccuggguauucaccucuuuuugacccugcaccgcccccaaaaggcugcccccacaaaaugcagggccacagacacuucgcggcuucuagccugagauggcauggcuuccaucaccuaugguacagauucagugugcccuccuucuccuccagacauaggagacacccucgacaccugggauugaucaaccccaaccuaguauaaagcacuucccucccagggacacagaccuguugucguguccccugcacccauaugucugagugacagauugacccgcacuucugggaaggaacgggacuucuaggcuagccugggugcggggaugggguccggcuggggaccucuggaauugugggaccgccuugcccagccccgccccacgacuggacgcucggcugccccgccccacugcccgcuggcccuuccgcuucacucagcggcgccagggagcaggacgggcaccggggccauggagaggacagcgggcaaagagcuggcccugguaagaggaagcuggggauccucggaccccacgucccuaguguacccccagauucagaaacuccaggcgaccgccccucguuuucuaaucuuucugcaaaauggaugugccuuggaguccccauuuggggauucagaguuccugaccccgugaagcggcuaguuugggggauggggacgggggucugaggaaucucaggaggaggugacagauucuuugugacauuggacucugggauauccccaaaugauacuccauccacucaagaccugggagaaggguauccguggcgaagaccugggaucccaccccgagucuugaauacucuguucgggaaagugggccaaacauaaaggcagggggcugaagccggagggacuucccugagcccgccuccacauccaggcgccgcugcaggacuggggcgaggagaccgaggauggcgccguguacagcgucucccugcggcggcagcgcagccagcgcucgaccccagagaggucuggagaaggccaggugaggaagggacugaggcgagcaagugagggcggacucagcucaggggccugggaguugggaggagagggggaagcuggagagcugagggugagccucccuagaacuacggggccaggaggaagggcggagcuaagaggcgaccagguguguggaaagggccugggggcggccaggugacuugguuugaauccaggaaacgggguggggccaggugauagcgcuccccccaaaggcgaaacugaccggcagggugcaggaaagcagaacggaggagcggccagguggugaugggugggacucaggcuuggccagugaagcuuggcugcaaaacugccugaagccugggguggcggggugaggagggcacagagggaagugcuagaguagugggguguccugcgggguugaugugagcauugcaugauugguguauauuuagggagucucggaguuucagaaaaggacacagucacacccccccaaaaaaagugccagagauggguauaauuggaaacaaggugcuuggaacgcuccucaccuuauuucauucacugccccacucccccgcagacccccaucccggcuaccgacaccuuccuucauuaccgaaccagcaaggugcgggcgcugagggccgcccgacuggagcggcuggugcaugaguugguguccggagaccgcgagcaggauccuggcuucgugccugccuuccuggccacccaccgggccuuuguacccacagcccgcguuuuggguuuucugcuacccccgccaccgccgccgccaccaccuccugcugggucagucauuuucaggagacccgcauguccccauccccagaaccccaucuaccugcgcacacacacauacaccucaaauuuagaaccgagguccuaacgcccuauagcucuguucccaucugauagaggcuuucuucccaggguagacagcaagaggacagagggacaagaucugaacuucagcaagaaccugaggucgguuuccauucccguccacacccucgacccaagggagcgugggggagggaucucaaggucgggucugacgacugcaagguugggaacguuuagauccuuggacucaauuuugagccacacaccccucuguucagggcuguaguuucggugcuggguucuuggcugcgaaaucauccucaggacuuccgggaucccccugaucaucagaaccuaggcaauguccgaaucuuuuugggcugggcagccccaggaggggcagaagccagggaagcagagaaacuucuagaagauuucuugaaggaggcuaagggagagcagacagaggaggaaaagcgacuggcuuggucagguaagggacagucaauucaggugacauucugagagaauaccaccugc

SEQ ID NO: 10389 - RNA, 2501 nt, Mus musculus
aucucccgauuccuuuccccauccuucuuggcuucucagccuuuucuuucuugccuagcaguuacccuccuccccuguugacucauaucucauaaucugccaucuaucuauuuauuuuuuauuuuuuuacuuaauggaacauugcuggggaugaggggcucuuccucaauugagacugaagacccacaccuuuccuuucccagccaaaaagugauucuugggcucaguguguagcucagaagcagaguacauauuuagcaggcauaaaguccagaagucaauccccagcaccaaaaauaaguaaguaaauaagcaaauaagcaaacaaacuguucccuggagaauagcaaaccgcuuccuuggaagaagcccuggauaguguucuucaaagggcggaacuguaugugauuggcaugcuuguauauguauauguauauguauauguauauguauauguauauguauauguauauguauauguauauauuuuuucugaucuauacauuuacugcuaugagcauuuacaguaaugaaaaucaguaugcuucaaagagggauuggagggcaaucuuuugagaggacagggcuccacacuugucaaaggugccuacuuggggaaaaaaaaucacauuucuaagccccauuuguacaacuguaaaagaccuaccuaccuggggugaucaggcacucuggcagcuguuauuuauuuaacaagaguuaaaaugucagcaauggcuugccccuaaguucucacugcgucuuggacacugggcauugggaagugucaccucucaaagauaugggcuauuccucccuuccaaacuuauuuauuuugcacauugugggagaaaggugggguuccugcugucguuaaguaaccucuggagucuuuagccagagugacagaaagaaaacacuaggaauuuggagucgucucuuuccuuagaucggaggcuaagaauaagcaaacacguuuuauauagguaugggucacucaacuccuuuagccagcuaggagccaggaccagugcuggaugccuucauacaagagcccuuaacaagaucugcuuuggcguuaggcacuugcagcauccaguuuccguguaggcgcugauagacacuuccuccccuugcccacagggcccucucacggucacucacccagcaccuuccaaaggagaagguuuugggggcugaaccagcuccaccccagaaccacacugacuagguucuuuccugcccaucaccaccaagaccaggguggauucuccccgacuucgccacauaagggcuuagacgaucaucugagggucgugaagaucuugccacaguccgcgacagcagcagugggauaggaaaucguuugggggccaaaaaauaccaagggaaaggacuagcacaccagcaacuuuccugugucuccgugggggaaguuccaccucucgucuaagcagcagcuuuccugcaugaaagcucugcucagauccagauacaaccuagauugucuggcccaugggcgcucagacgcccccgcgagcuggggagcauuuuccccagggcuuggcucagaucaggcaggcgccuuccaucauccaauacaauauuucagcaccauucuuucccacauuguuccuaggucuuccgcacccacuuccaucccucacucaccccccagggguucucgugugccccuugccccagaacacgcugaguucaaguauggacuuaccgugcagcaguccauugccgguguugaggguccuuggcugggguggagccuggcgcagagcggggguggguuuguacgaugcuggguggcagcucaggggcugucgggcacuccccgaccagcgcagaauccuugcagaaccagccucucuccucuuggguccggucucccgcgcuccgcaacucuugcgaauguaaccugagcccugcggccucgaagccaaucagaagacacuuucugcagggugggcggggagaacuggagcgaggaccacuccuucucucgacucucuccgccucgcucgcuuuggugcuccaaccucuccaccuacacacuuccauccauuccuccuacacaccccaucucccaaauucacccccccccccgcuuucuaagucgcagacugccaggcagauguacgucggaguaagcacaaggccuccaacauccagggcacaaauacacaucugggugcagcacgcccuaccgcccauagauagaaaaccacgaaccucacccaccucccuguucuagagucccaaacauuacucccucuauuuccccucucugcagagaugcccuccucacucuaguuacagagaaaccugaugguagacagccuacaugaugggcacauagugacauagacgcuccaagccucaugcauccauacauacucccaggcgggguggugugguguaucuucccacauacagacacugcagacacaauaggcaaaaacaacuccacagggccguguccacacacccug

SEQ ID NO: 10390 - RNA, 2501 nt, Mus musculus
caggguguguggacacggcccuguggaguuguuuuugccuauugugucugcagugucuguaugugggaagauacaccacaccaccccgccugggaguauguauggaugcaugaggcuuggagcgucuaugucacuaugugcccaucauguaggcugucuaccaucagguuucucuguaacuagagugaggagggcaucucugcagagaggggaaauagagggaguaauguuugggacucuagaacagggaggugggugagguucgugguuuucuaucuaugggcgguagggcgugcugcacccagauguguauuugugcccuggauguuggaggccuugugcuuacuccgacguacaucugccuggcagucugcgacuuagaaagcgggggggggggugaauuugggagaugggguguguaggaggaauggauggaaguguguagguggagagguuggagcaccaaagcgagcgaggcggagagagucgagagaaggagugguccucgcuccaguucuccccgcccacccugcagaaagugucuucugauuggcuucgaggccgcagggcucagguuacauucgcaagaguugcggagcgcgggagaccggacccaagaggagagaggcugguucugcaaggauucugcgcuggucggggagugcccgacagccccugagcugccacccagcaucguacaaacccacccccgcucugcgccaggcuccaccccagccaaggacccucaacaccggcaauggacugcugcacgguaaguccauacuugaacucagcguguucuggggcaaggggcacacgagaaccccuggggggugagugagggauggaagugggugcggaagaccuaggaacaaugugggaaagaauggugcugaaauauuguauuggaugauggaaggcgccugccugaucugagccaagcccuggggaaaaugcuccccagcucgcgggggcgucugagcgcccaugggccagacaaucuagguuguaucuggaucugagcagagcuuucaugcaggaaagcugcugcuuagacgagagguggaacuucccccacggagacacaggaaaguugcuggugugcuaguccuuucccuugguauuuuuuggcccccaaacgauuuccuaucccacugcugcugucgcggacuguggcaagaucuucacgacccucagaugaucgucuaagcccuuauguggcgaagucggggagaauccacccuggucuugguggugaugggcaggaaagaaccuagucagugugguucugggguggagcugguucagcccccaaaaccuucuccuuuggaaggugcugggugagugaccgugagagggcccugugggcaaggggaggaagugucuaucagcgccuacacggaaacuggaugcugcaagugccuaacgccaaagcagaucuuguuaagggcucuuguaugaaggcauccagcacugguccuggcuccuagcuggcuaaaggaguugagugacccauaccuauauaaaacguguuugcuuauucuuagccuccgaucuaaggaaagagacgacuccaaauuccuaguguuuucuuucugucacucuggcuaaagacuccagagguuacuuaacgacagcaggaaccccaccuuucucccacaaugugcaaaauaaauaaguuuggaagggaggaauagcccauaucuuugagaggugacacuucccaaugcccaguguccaagacgcagugagaacuuaggggcaagccauugcugacauuuuaacucuuguuaaauaaauaacagcugccagagugccugaucaccccagguagguaggucuuuuacaguuguacaaauggggcuuagaaaugugauuuuuuuuccccaaguaggcaccuuugacaaguguggagcccuguccucucaaaagauugcccuccaaucccucuuugaagcauacugauuuucauuacuguaaaugcucauagcaguaaauguauagaucagaaaaaauauauacauauacauauacauauacauauacauauacauauacauauacauauacauauacauauacaagcaugccaaucacauacaguuccgcccuuugaagaacacuauccagggcuucuuccaaggaagcgguuugcuauucuccagggaacaguuuguuugcuuauuugcuuauuuacuuacuuauuuuuggugcuggggauugacuucuggacuuuaugccugcuaaauauguacucugcuucugagcuacacacugagcccaagaaucacuuuuuggcugggaaaggaaaggugugggucuucagucucaauugaggaagagccccucauccccagcaauguuccauuaaguaaaaaaauaaaaaauaaauagauagauggcagauuaugagauaugagucaacaggggaggaggguaacugcuaggcaagaaagaaaaggcugagaagccaagaaggauggggaaaggaaucgggagau

SEQ ID NO: 10391 - RNA, 2501 nt, Mus musculus
cugauugacucuguccagaacaccauacauaaaaugucccuaaaguuuggcuggaugugcugagugaccaguuuccccuucuccacacacuggcucauuggcccuauuugcauguaagaacccaguuugggccuguguggcaagcacgggcuaccauucugcuaaguccuuggucaggaugacucccugggccugggcuagaacaucaguccaggcucaccucuacucuacccaacacuggaucucccugguaccucugaugcucaugacagucucacaggaucccuagcuggcugcccaaauucugcccccucucccuccaaggucuccaaauaacucucaguuuuggaauggaggggaggggagaggagaggagggaagaggagggauggcuauuuaguccuggauauucgucacuucuguuccucucccaaagacagaggggugcaaugccuccuuuuagggggaagagcugagaguggaugauuagaagacucuccuccccccaaccaugagauaaggucucacucuguagcucuguauagccuugaacuuguguuccuccugucuuaggcuccugggaugacugggguggcauuucacugucuuuucuuucagagauuucuguuguugggucaccgucacucagcacccuggaguuccauuucuggauaacucuaacaucucuucuucucuccauaccaccacacccacacagagacagagacagagacagagacagagagagagagagagagagagagagagagagagacgggacgggaggggggcagcuaaacuguggacuucaccagccccugucaggcaugggcggagacaccgaccacccuuuccaacugaggggaaccuccccuuuucucuccucccuucccccaacucugccuagguccucuggcucccaaguaguucagcccuucagguuacagaggagagcugcuaccagacuugggagggaccaagggcagacagcucugcagggaaagcgaucccggaauggugcuccaggcuggaggucuugaaaccgcuuccuugccaaagaacagcggaguaagggaaacuaacuucacaccaacacaacagggagagcccaagguccucuugccaccuguggauuuccccuuuagucacagaggcaguggcaagaaaggaggccuuguuaacaagaacuuuugucggagugucagcuuggagugcugaggagggagcgggcuuugaagccggucagugcgugagaagggccuugguuacucagagccaagcaacaaaaaagcuagagggguucacgaaagagaauaaagaccgggaucugggugccagagagugggcagcgaguuagagaggugaccuugggcaugucacguuccccuuucggcacugcguuucucuucugcgggcuugaggguuccugggacgcccgacagcuugcccgcccuccguggugggugggacaggacucuugaugguaccucaccuucuugaaauccgcgaugaaggagaugagagugccgucggguuugcgcagaucaaggcugaugcuguccgcgucgcuguccgccuguagacucuccucgaucaccuggcugucgggcagucucacucggacccgcagcucggccggagcgccgcugcccgcgcccacgccgugcagcgccccaagcagcagcggcgacagcagcagcagcagcagcggcagcgcggggcgcgccgaggggacgucgcggcagccagggggccgcauccccggggcccccggcgcgccgcgugggggaggggagacgcgccuacaaaguuugcucgaaguuggggguccgguucggggauucccggcaguccccuacuucuagaggggagacucaacccggagguuccccacgacgugcagcgaauucacgugggccgcguacagccacgcaccccgagucccggacggcgccccccgugcguguccccuagccgccccgauuccugagcuccggacuccguucagcacuuuucauucaaucccaccccccgucacuuccuucagaaaacagaaaccaccaggaccugccuuaaagagaccgcgcaccucuuggcccuuaaagggaccgcaguggcccagagaggggcggggauuggggaccacggggcucagccgcuuuguggucuaggcuggcuuucucuggaucccucccucccgccgcgccccgucaccggccgggccuuguccagaguuugcgcuccgggcaaaucccuuccucccauuaagggcgggacgggugacucccccgcccccuacaccccucuggcuuguucuggugccacguggaugaaauaaucgggcuuggguuuucagagguuuugcuuagucuuuuaguuucucugacacagcgaauuucucaaaagcggcugggggaaaaaaucaggccucaccuagcauucuggucuuuuccuaggucggggagugcaauuagggguugagggccaucugugcauccauc

SEQ ID NO: 10392 - RNA, 2501 nt, Mus musculus
gauggaugcacagauggcccucaaccccuaauugcacuccccgaccuaggaaaagaccagaaugcuaggugaggccugauuuuuucccccagccgcuuuugagaaauucgcugugucagagaaacuaaaagacuaagcaaaaccucugaaaacccaagcccgauuauuucauccacguggcaccagaacaagccagagggguguagggggcgggggagucacccgucccgcccuuaaugggaggaagggauuugcccggagcgcaaacucuggacaaggcccggccggugacggggcgcggcgggagggagggauccagagaaagccagccuagaccacaaagcggcugagccccgugguccccaauccccgccccucucugggccacugcggucccuuuaagggccaagaggugcgcggucucuuuaaggcagguccuggugguuucuguuuucugaaggaagugacggggggugggauugaaugaaaagugcugaacggaguccggagcucaggaaucggggcggcuaggggacacgcacggggggcgccguccgggacucggggugcguggcuguacgcggcccacgugaauucgcugcacgucguggggaaccuccggguugagucuccccucuagaaguaggggacugccgggaauccccgaaccggacccccaacuucgagcaaacuuuguaggcgcgucuccccucccccacgcggcgcgccgggggccccggggaugcggcccccuggcugccgcgacguccccucggcgcgccccgcgcugccgcugcugcugcugcugcugucgccgcugcugcuuggggcgcugcacggcgugggcgcgggcagcggcgcuccggccgagcugcggguccgagugagacugcccgacagccaggugaucgaggagagucuacaggcggacagcgacgcggacagcaucagccuugaucugcgcaaacccgacggcacucucaucuccuucaucgcggauuucaagaaggugagguaccaucaagaguccugucccacccaccacggagggcgggcaagcugucgggcgucccaggaacccucaagcccgcagaagagaaacgcagugccgaaaggggaacgugacaugcccaaggucaccucucuaacucgcugcccacucucuggcacccagaucccggucuuuauucucuuucgugaaccccucuagcuuuuuuguugcuuggcucugaguaaccaaggcccuucucacgcacugaccggcuucaaagcccgcucccuccucagcacuccaagcugacacuccgacaaaaguucuuguuaacaaggccuccuuucuugccacugccucugugacuaaaggggaaauccacagguggcaagaggaccuugggcucucccuguuguguuggugugaaguuaguuucccuuacuccgcuguucuuuggcaaggaagcgguuucaagaccuccagccuggagcaccauuccgggaucgcuuucccugcagagcugucugcccuuggucccucccaagucugguagcagcucuccucuguaaccugaagggcugaacuacuugggagccagaggaccuaggcagaguugggggaagggaggagagaaaaggggagguuccccucaguuggaaaggguggucggugucuccgcccaugccugacaggggcuggugaaguccacaguuuagcugccccccucccgucccgucucucucucucucucucucucucucucucucucugucucugucucugucucugucucuguguggguguggugguauggagagaagaagagauguuagaguuauccagaaauggaacuccagggugcugagugacggugacccaacaacagaaaucucugaaagaaaagacagugaaaugccaccccagucaucccaggagccuaagacaggaggaacacaaguucaaggcuauacagagcuacagagugagaccuuaucucaugguuggggggaggagagucuucuaaucauccacucucagcucuucccccuaaaaggaggcauugcaccccucugucuuugggagaggaacagaagugacgaauauccaggacuaaauagccaucccuccucuucccuccucuccucuccccuccccuccauuccaaaacugagaguuauuuggagaccuuggagggagagggggcagaauuugggcagccagcuagggauccugugagacugucaugagcaucagagguaccagggagauccaguguuggguagaguagaggugagccuggacugauguucuagcccaggcccagggagucauccugaccaaggacuuagcagaaugguagcccgugcuugccacacaggcccaaacuggguucuuacaugcaaauagggccaaugagccaguguguggagaaggggaaacuggucacucagcacauccagccaaacuuuagggacauuuuauguaugguguucuggacagagucaaucag

SEQ ID NO: 10393 - RNA, 2501 nt, Mus musculus
ggacccguggcgcacccggcucgcuccccucgguccuccgagaccgugcagccccgagccccgcgggcagcuggccgcccuagccgcacaccaccgccugggccccgagcccuccgcaccgcccggccacccucggagaacagccggccauggacgccugcaaguuggagccgagcgggagggugugagcgcgcccagggccgggagccugcgccgcgcuagcccgguagccgggcgcgccgggggugggucccucuccccagccgggcuuugcguggaagaagagggcggggaccggggcgaggagaagagcggaggaggcgaagggggcaugacucgugcaacuuacugcgggcaucugccgaggcucugagccggcggcagccggggaccggauugcggccgcgcggaucccacccagcccaccccgccccgaccgacggcugcggcugaccuggauccuccgagcgcccgccaaccgccagcgauccgcccucgucuuccagacugguuucuggagcgcgaggagcgcccuccuggcagccccuuucgccggacccccaccccccgauggcucggauggggcuugcgggcgccgcuggacgcugguggggacucgcucucggcuugaccgccuucuuccucccagguaaggcgauugccucugccucccuccauagccccccacccaaccagaaccuccccgggacuuggagcuggaugaugggcaaggcuacggguuguagggagcgaacggagccagaaaaguugggucacgcuuggauaagggggggcaggagguggcaccguggagaaagggguugagaagcccaacagccugcccugcaggguagcaaucggaugcacgucucuauguagcaagaaagcacuuucuccgcucaguucuucacaaaaauaauaauauguaauaggguucuauuuauuuaauaaccaguucucagcucgagaagcaguuuggaaacacugcguguuacauaaaugcaaaauaaucaccguaaucacgggcuugggguaugagacaacagccccagggggagggcgucagucuccuagcuggugggcugugggcuaggagaguggcggggguugggggcgacuucauuucuuuuggcggccucuugucagaugguuucgggcucaugggggcccccuccugccccacaucgccccacagcgggcgaucggaaccugcuccugcggcacaggcagcuucuuacucaccugcgguuccuuuucuggagggugaggucgggccgccuagggaucgcaaacuccgggccuugcgcggggcugggcuccgucucggaacuccacuucuaaagcggagggcucucccaggaggaagcuccacgggcuucaugccagccagguggccgcaugacccacuuucccgggaggccccgagggugucccgcgugucuuuccucgaggugugagcugccggcagaagagggguuaacuccgcgcccgacccugggguggcccauauuggccuauucugacggauggggugggggcgggcggaggcuaggacggcccaggcauauugugcuggggaaugaacuggaaaaugcguuuaggaggcaaauccuaccgaguccccucgccuggguuuaaccccuugggucccuggggaagcaacuaggcugccagcaggacacuaauucgggucaaaguggggagaguaucucgcuagccaacucccccgucccccguaaagaaaccugagacaagcucuugagauaagauggggucuuggaaggcuuguuucguggucgucaacucgggguggcaaaauagggggcuggaaugcagacagagacuucuggauuauuaagaauauuggauucccggccacugugauucugcaggcuugccaggcaguuugguaaggagagguaggccugccuguccagguguagcuuggacucucuccuggauggcaagagccuggccuccucugcuucccuuacugccuccuccuccuccugcugccggccuucuccgugcuggggcgcugcaccucuccagcagugguggaugucaggaaagcaguuugggaaagccaguaccuaggccaguguggagugcuccccucuugggugucccaggaagggacauuccacaucccuuuccacuucacaggggcaugcugaacccgugggggcaugcugaacccgccgccacuguggucugggugagagugacagccagucggcuacuuucuugcugauaguguuaagugcggugcacacagaaacucagccucugaauuuacauggucagcauaggcugaacuucagaacgccuuuuaauucccuaacucuuccuggaacccagaguaagccacuugccaagagccccuaaggauuccuagcacacuagggguuaaccuaauccggggauggacaaagggccagaggguuugcggagggauaagcucagcacauuguaucuggugcuugguuccccaguuuugg

SEQ ID NO: 10394 - RNA, 2501 nt, Mus musculus
ccaaaacuggggaaccaagcaccagauacaaugugcugagcuuaucccuccgcaaacccucuggcccuuuguccauccccggauuagguuaaccccuagugugcuaggaauccuuaggggcucuuggcaaguggcuuacucuggguuccaggaagaguuagggaauuaaaaggcguucugaaguucagccuaugcugaccauguaaauucagaggcugaguuucugugugcaccgcacuuaacacuaucagcaagaaaguagccgacuggcugucacucucacccagaccacaguggcggcggguucagcaugcccccacggguucagcaugccccugugaaguggaaagggauguggaaugucccuuccugggacacccaagaggggagcacuccacacuggccuagguacuggcuuucccaaacugcuuuccugacauccaccacugcuggagaggugcagcgccccagcacggagaaggccggcagcaggaggaggaggaggcaguaagggaagcagaggaggccaggcucuugccauccaggagagaguccaagcuacaccuggacaggcaggccuaccucuccuuaccaaacugccuggcaagccugcagaaucacaguggccgggaauccaauauucuuaauaauccagaagucucugucugcauuccagcccccuauuuugccaccccgaguugacgaccacgaaacaagccuuccaagaccccaucuuaucucaagagcuugucucagguuucuuuacgggggacgggggaguuggcuagcgagauacucuccccacuuugacccgaauuaguguccugcuggcagccuaguugcuuccccagggacccaagggguuaaacccaggcgaggggacucgguaggauuugccuccuaaacgcauuuuccaguucauuccccagcacaauaugccugggccguccuagccuccgcccgcccccaccccauccgucagaauaggccaauaugggccaccccagggucgggcgcggaguuaaccccucuucugccggcagcucacaccucgaggaaagacacgcgggacacccucggggccucccgggaaagugggucaugcggccaccuggcuggcaugaagcccguggagcuuccuccugggagagcccuccgcuuuagaaguggaguuccgagacggagcccagccccgcgcaaggcccggaguuugcgaucccuaggcggcccgaccucacccuccagaaaaggaaccgcaggugaguaagaagcugccugugccgcaggagcagguuccgaucgcccgcuguggggcgauguggggcaggagggggcccccaugagcccgaaaccaucugacaagaggccgccaaaagaaaugaagucgcccccaacccccgccacucuccuagcccacagcccaccagcuaggagacugacgcccucccccuggggcuguugucucauaccccaagcccgugauuacggugauuauuuugcauuuauguaacacgcaguguuuccaaacugcuucucgagcugagaacugguuauuaaauaaauagaacccuauuacauauuauuauuuuugugaagaacugagcggagaaagugcuuucuugcuacauagagacgugcauccgauugcuacccugcagggcaggcuguugggcuucucaaccccuuucuccacggugccaccuccugcccccccuuauccaagcgugacccaacuuuucuggcuccguucgcucccuacaacccguagccuugcccaucauccagcuccaagucccggggagguucugguuggguggggggcuauggagggaggcagaggcaaucgccuuaccugggaggaagaaggcggucaagccgagagcgaguccccaccagcguccagcggcgcccgcaagccccauccgagccaucgggggguggggguccggcgaaaggggcugccaggagggcgcuccucgcgcuccagaaaccagucuggaagacgagggcggaucgcuggcgguuggcgggcgcucggaggauccaggucagccgcagccgucggucggggcggggugggcugggugggauccgcgcggccgcaauccgguccccggcugccgccggcucagagccucggcagaugcccgcaguaaguugcacgagucaugcccccuucgccuccuccgcucuucuccucgccccgguccccgcccucuucuuccacgcaaagcccggcuggggagagggacccacccccggcgcgcccggcuaccgggcuagcgcggcgcaggcucccggcccugggcgcgcucacacccucccgcucggcuccaacuugcaggcguccauggccggcuguucuccgaggguggccgggcggugcggagggcucggggcccaggcgguggugugcggcuagggcggccagcugcccgcggggcucggggcugcacggucucggaggaccgaggggagcgagccgggugcgccacgggucc

SEQ ID NO: 10395 - RNA, 2501 nt, Mus musculus
cugccaggccagcgaagacucuggaacagugccaagccggcagccgccgcagugaagcggucauuccagaaggcgaccagggccagcuccaugccuccacagcaggguagaggaaccugacugagaguccucuaucagggauaccucucuguugcuccucugcuagaggguccccgcuaguaguggacaaaccugagcgagcgcugcuacugcguccaagagucuacagcgaccgggccagcuucugccgccucggccagucauucgagccccaggacaccugucauugcuccuucaaccuuuccaagccagaaaacgggaguuagccucuaggccuggaucggggagcagcagcucgcagccagcgcgccgggggcccgcccccuagggcgcggggagggggcggggggcuacgcggggcggggccgggcggcgcccgggguccccucccccgccccccugacgucagcccccgacagcggcgaguuccucacuuggcucgcgcccuccgucggggaagcauggggcugcccaaacuggugugcgucuucuuguucgcugccugcugcugcugucgccgugccgcgggugaguucuuuauguugagggggcuguggggggcccgacccgcgucccucagagcccaggcguugggaguuuggggaugucuucgacggagccggacugugccgccugaguguaccggagaucagagcugguagcaacguagagucggggcucugcaccccagugggcgcuccuucuugccagaguccccgauuuccaggcgccccgcgugcgugcaacuucuuugcgggugugcagccuagguuuuagaguauucugggaacggacuagucggguugcugcagcagcgagcgggaagggguggggccgagcuucugcaggacgcugggcccggccucccgcagguguucgcucugggugcuggaugcugggugcuggagucccggcagagaggcgcagccggggcgcauccccaacccgugcaucccgcgcccgccuguugcuggaaaaggcaguuucccuagcuggagggggccgccgaccccucccccuccgccugggccucacgccaguuuggaggugagcgagggaggaggccgcuccugcuggggcugggcguuggcaagggcagcggguggugugggucuccuugcgccuccggguuugacgggauuacaggggaaagacaacagauggagaaguucuacaacaguaacagcuucugugguccacuagagucagguggagagagccuggcaccucggagcuuuccuuuaagccaucgaguagacaugcuuuccuggguccgggcuucccuuguagggcacacgcagcggugucguguguuauucuuggcucuuucucgcgucucagccacuggucaggcuggggaaggggaggacugggcauuacccacuucucuggccucuugcccagugccagccacgucccugggguacuccagucuagugccucccagacugaccuuauuucuggggaaagggcuaaacccagcuaggcaaucgcagcacagaaaacucaguuucgcucugcccugcucuucuggcccuuagaaagcagggauucaaaguuccugcuguugguagaaggcuauucccaccuucccuccagucuggaagccacacaguccagacaucccaggguccaggcagauugugcuuagugacaucaccucuucuaagagcuggcagcaugcuggcaccacugacgucacuccugcccacucucugguuuuugaccuaacccuuggcggagacugaccccucuagacuuggauggggucuucagauuguauugcagcguuucuugacaugcuacugugggaacauaaaucauagccucuggcuagaguuggcucacugugucuuccagaggauuugggggacagaggguagaauagugacgucuucguggagggggggcacacaaaggggccugugugccccagccuggcacaugccuuacauuccccuagucugagcucaccaggacuaggaaggggcccaggagcaaaggggccuucaucuuggcccagagcccauguugcucuuaucugucucuccaccagcuucuucuaagauauacccagucacucugucuguguuucacuccguauuacacugggagaggucugacccagguugggggugugggcuuggugaaguugaggguaaggagaggguaaggcccuccccagacccuucaagugggacagcugcagugaaccaggagaggggaggggaccggacagaacaccuggagcugacaaagcugccugggcaugccccucucuuuccccaggugugccaggagaggaaaagcagccaguacccacgcccgaccugguggaggcagaagugggcagcacagcccuucucaaguguggccccucacgggccucaggcaacuucagccaaguggacugguuuuuggugagcgccuggacuuuggag

SEQ ID NO: 10396 - RNA, 2501 nt, Mus musculus
cuccaaaguccaggcgcucaccaaaaaccaguccacuuggcugaaguugccugaggcccgugaggggccacacuugagaagggcugugcugcccacuucugccuccaccaggucgggcguggguacuggcugcuuuuccucuccuggcacaccuggggaaagagaggggcaugcccaggcagcuuugucagcuccagguguucuguccgguccccuccccucuccugguucacugcagcugucccacuugaagggucuggggagggccuuacccucuccuuacccucaacuucaccaagcccacacccccaaccugggucagaccucucccaguguaauacggagugaaacacagacagagugacuggguauaucuuagaagaagcugguggagagacagauaagagcaacaugggcucugggccaagaugaaggccccuuugcuccugggccccuuccuaguccuggugagcucagacuaggggaauguaaggcaugugccaggcuggggcacacaggccccuuugugugcccccccuccacgaagacgucacuauucuacccucugucccccaaauccucuggaagacacagugagccaacucuagccagaggcuaugauuuauguucccacaguagcaugucaagaaacgcugcaauacaaucugaagaccccauccaagucuagaggggucagucuccgccaaggguuaggucaaaaaccagagagugggcaggagugacgucaguggugccagcaugcugccagcucuuagaagaggugaugucacuaagcacaaucugccuggacccugggaugucuggacuguguggcuuccagacuggagggaaggugggaauagccuucuaccaacagcaggaacuuugaaucccugcuuucuaagggccagaagagcagggcagagcgaaacugaguuuucugugcugcgauugccuagcuggguuuagcccuuuccccagaaauaaggucagucugggaggcacuagacuggaguaccccagggacguggcuggcacugggcaagaggccagagaaguggguaaugcccaguccuccccuuccccagccugaccaguggcugagacgcgagaaagagccaagaauaacacacgacaccgcugcgugugcccuacaagggaagcccggacccaggaaagcaugucuacucgauggcuuaaaggaaagcuccgaggugccaggcucucuccaccugacucuaguggaccacagaagcuguuacuguuguagaacuucuccaucuguugucuuuccccuguaaucccgucaaacccggaggcgcaaggagacccacaccacccgcugcccuugccaacgcccagccccagcaggagcggccuccucccucgcucaccuccaaacuggcgugaggcccaggcggagggggaggggucggcggcccccuccagcuagggaaacugccuuuuccagcaacaggcgggcgcgggaugcacggguuggggaugcgccccggcugcgccucucugccgggacuccagcacccagcauccagcacccagagcgaacaccugcgggaggccgggcccagcguccugcagaagcucggccccaccccuucccgcucgcugcugcagcaacccgacuaguccguucccagaauacucuaaaaccuaggcugcacacccgcaaagaaguugcacgcacgcggggcgccuggaaaucggggacucuggcaagaaggagcgcccacuggggugcagagccccgacucuacguugcuaccagcucugaucuccgguacacucaggcggcacaguccggcuccgucgaagacauccccaaacucccaacgccugggcucugagggacgcgggucgggccccccacagcccccucaacauaaagaacucacccgcggcacggcgacagcagcagcaggcagcgaacaagaagacgcacaccaguuugggcagccccaugcuuccccgacggagggcgcgagccaagugaggaacucgccgcugucgggggcugacgucaggggggcgggggaggggaccccgggcgccgcccggccccgccccgcguagccccccgcccccuccccgcgcccuagggggcgggcccccggcgcgcuggcugcgagcugcugcuccccgauccaggccuagaggcuaacucccguuuucuggcuuggaaagguugaaggagcaaugacagguguccuggggcucgaaugacuggccgaggcggcagaagcuggcccggucgcuguagacucuuggacgcaguagcagcgcucgcucagguuuguccacuacuagcggggacccucuagcagaggagcaacagagagguaucccugauagaggacucucagucagguuccucuacccugcuguggaggcauggagcuggcccuggucgccuucuggaaugaccgcuucacugcggcggcugccggcuuggcacuguuccagagucuucgcuggccuggcag

SEQ ID NO: 10397 - RNA, 2501 nt, Mus musculus
ggguggacagcaggaguauuagggagcggaaagccgauuagcuuagcucucgaaagagccacucccuaauucuucuacagcaguggaaagcaggguagaagaacuaccugaggaagggggcacagccugggcuggguauguccugcaggcuugagauagagaaaacaaaaugcacagagcucauucacuuucccuagcaaacuucccugcgguggcagcuuucuucuucaaaagucaugccaguuggggagaugagugcuuaguuccccucucuccucccccugcaggagaggccaauguccagcugagucagcugucccagggacaagguacaggaagagccagguuggagggguagggucaauguauaaacugacagaugucaucuggcuuucagcuggccagcugacaagaggaaacaggagaacuucuugggggccacuucagucucuaggcaucuggauuaauagggcaaagccuccaagcucuuauggcuggaaacagagaaagaccuguuuccacaaggagcugauagucugauggccaggaagggaaaugguccagaaaugggagaccucugccuuccacccaaccucagucucaugacucugauuccugcccacuuccugggaggccagaugcccagggugcaacggguggagguggcuggcugcucugguuuaugagcgacccugaaggggcagcccaaguucaugcauuagaaaggacgcagguuaucaauaugcccuuuaacuaaacuacuuuccuuuaacacuacacugcaggccagccuggaggacuguaguagugaaauuacuaaaauauggagagaugauucaguuaccgugggggcucuaccugaccaccaggguuugggagccugaaaucuuaacugggugugguggcaugaggaccaggcaaauuccuucugcaggugcaccugucucccuuggcccaaccaggccagucuaggcggaagugcccuaaggcacacggauuagcguugcuaugagaacaguaacuugugcuggguuuagaaccagaguaccuugcucacaaaaauagaaaauuugguauauaacuggacuucuuuacaagccccagucuaaccugcacgcucuucucugaucugaaagagaaagcuggaggguucuccaguugauccccagcucuaauccagcccuccuaacaugagcaagcucuucccuagaaggcaaagcugaagggacgacacaggggcucagugcaacucaccccgucccugcaggccugcucauucaaggcucgcacccaagcccguugccaguucucccggaaagacuugaaggcaaagagcgaagccaggaggccccguacgccggcuuccucgggggugcugguccgggucgcccgcaaacgcagcagcgaacgccacacacccagcucgcgcagugaacccccgggcucagcagcugaggcaggucgggagucucggcccccaucggcucgcgacagccacaaaccccgggcauacugcagcauccagcccaauaccgugaucagcgaggcggcgaagagaaccagcagggccgcccagcccacaucccgcugcccccaguccggauccaugcucccgcgggcucgggucccggcucggguucagccgcugccccgggggagcauggcccggauggaccguggggcgugggcgagcucccccggggcugagcgcgcgggcuccggggcucuccggcgccgccgagauuccaggaccagugggugccacggauggagaagagguccuccggggucgcgacgcucgagcucugucuccguagccagagaucuggaucccuaacaccggcggugugaccccagcuagguuccagcuaucacccgauuccucccacggcguggggccccgccggacccgggcagggaccagccugcagagauaccggggcucgcgggccggcaccggcuccgggagggcugcgugcgcagaacugacacugacaacaccgccggcgccccgcccccacccgcccuuaaaggagccgcgcccucaccgggcggggcugagcuaacccgccgcucagagcuagaggaggguggagugggggaggguugaguugcacacguagaggauuccgggaugagaauaggcggagucuuuagcuguuccgccccguccugaaaucccugugcaccccuucaguaccaggcaagggaacuucacuuaucugagaugacgccugguucucccuacguuucuuagauuucuauggguuggacgccuguagguuaaaaauuagucccuguggaaaucaccacucacuuuuaacaccuccuggcucagcagcuucuggucuuacuccuugacugaagcuagcuaggcacugggugaagagggaguaaggugucccucccagauagaagugccugacaaaacccagcuaaugucaacggcggcgagaaaaaugaagcuuaacgugauaaagguugggaauagaacacuacca

SEQ ID NO: 10398 - RNA, 2501 nt, Mus musculus
ugguaguguucuauucccaaccuuuaucacguuaagcuucauuuuucucgccgccguugacauuagcuggguuuugucaggcacuucuaucugggagggacaccuuacucccucuucacccagugccuagcuagcuucagucaaggaguaagaccagaagcugcugagccaggagguguuaaaagugaguggugauuuccacagggacuaauuuuuaaccuacaggcguccaacccauagaaaucuaagaaacguagggagaaccaggcgucaucucagauaagugaaguucccuugccugguacugaaggggugcacagggauuucaggacggggcggaacagcuaaagacuccgccuauucucaucccggaauccucuacgugugcaacucaacccucccccacuccacccuccucuagcucugagcggcggguuagcucagccccgcccggugagggcgcggcuccuuuaagggcgggugggggcggggcgccggcgguguugucagugucaguucugcgcacgcagcccucccggagccggugccggcccgcgagccccgguaucucugcaggcuggucccugcccggguccggcggggccccacgccgugggaggaaucgggugauagcuggaaccuagcuggggucacaccgccgguguuagggauccagaucucuggcuacggagacagagcucgagcgucgcgaccccggaggaccucuucuccauccguggcacccacugguccuggaaucucggcggcgccggagagccccggagcccgcgcgcucagccccgggggagcucgcccacgccccacgguccauccgggccaugcucccccggggcagcggcugaacccgagccgggacccgagcccgcgggagcauggauccggacugggggcagcgggaugugggcugggcggcccugcugguucucuucgccgccucgcugaucacgguauugggcuggaugcugcaguaugcccgggguuuguggcugucgcgagccgaugggggccgagacucccgaccugccucagcugcugagcccggggguucacugcgcgagcuggguguguggcguucgcugcugcguuugcgggcgacccggaccagcacccccgaggaagccggcguacggggccuccuggcuucgcucuuugccuucaagucuuuccgggagaacuggcaacgggcuugggugcgagccuugaaugagcaggccugcagggacggggugaguugcacugagccccugugucgucccuucagcuuugccuucuagggaagagcuugcucauguuaggagggcuggauuagagcuggggaucaacuggagaacccuccagcuuucucuuucagaucagagaagagcgugcagguuagacuggggcuuguaaagaaguccaguuauauaccaaauuuucuauuuuugugagcaagguacucugguucuaaacccagcacaaguuacuguucucauagcaacgcuaauccgugugccuuagggcacuuccgccuagacuggccugguugggccaagggagacaggugcaccugcagaaggaauuugccugguccucaugccaccacacccaguuaagauuucaggcucccaaacccugguggucagguagagcccccacgguaacugaaucaucucuccauauuuuaguaauuucacuacuacaguccuccaggcuggccugcaguguaguguuaaaggaaaguaguuuaguuaaagggcauauugauaaccugcguccuuucuaaugcaugaacuugggcugccccuucagggucgcucauaaaccagagcagccagccaccuccacccguugcacccugggcaucuggccucccaggaagugggcaggaaucagagucaugagacugagguuggguggaaggcagaggucucccauuucuggaccauuucccuuccuggccaucagacuaucagcuccuuguggaaacaggucuuucucuguuuccagccauaagagcuuggaggcuuugcccuauuaauccagaugccuagagacugaaguggcccccaagaaguucuccuguuuccucuugucagcuggccagcugaaagccagaugacaucugucaguuuauacauugacccuaccccuccaaccuggcucuuccuguaccuugucccugggacagcugacucagcuggacauuggccucuccugcagggggaggagagaggggaacuaagcacucaucuccccaacuggcaugacuuuugaagaagaaagcugccaccgcagggaaguuugcuagggaaagugaaugagcucugugcauuuuguuuucucuaucucaagccugcaggacauacccagcccaggcugugcccccuuccucagguaguucuucuacccugcuuuccacugcuguagaagaauuagggaguggcucuuucgagagcuaagcuaaucggcuuuccgcucccuaauacuccugcuguccaccc

SEQ ID NO: 10399 - RNA, 2501 nt, Mus musculus
uucuccauuuuacguccucgaaaacggccgugcagcuaggggcaguaacagggcggggucucucccaacgggaggcgagcgagaccguuaagcuagaacacccggggaccauccuggcagcuugggcgccacccgcgccgcaauaaaagccucucgcggcuucccgcccagccagccucgcucugauuggucgccgaucagaguuggcuggaggcgguggcccagcucugcucucuugcugcccucggaggggggcgcacugggugcucccggggccgcucugugggcuccacacccaaggcuuagagaucuggaccaguacagccacaccaggcagaagccacagccaugcgcggucuccuccgccuagccugcuuucagcuggugcuuggcagcacacgccccccccccgccccagcugucggcccaucccacccagcucucggcggccccagugcccuuugcuucccccucucccaguccauugggacgccaaagcacaaauccuugggugggguaggggcagcagcuggaagggagggugggcacacugaggaauuuuccagggaaagccgagauggaaauagccaaaaugcaaugcgcccccuucccgaaugcuaaggaucucugggcgguggcacagcccucgccacccgcgacagcgucgcuacggucuuucucccgagcuccccauuguucacacuuugccaggaucaggaauaucgcccagagaaaggaagaggugucuugggcagcuggcuaccugccauucuucgcuggcaccgugcaacccuaggcucucggugcguguaaaggcacacgcgcgcacacgcgcgcgcacacacacacaaccaggcagccccgaucacgcccuccucacccuccgccccucugcacuuccuccugucaaaacgcggcgcuggacccucccaucccuccgugcucccggccgagggcagguuuugcaacuacccagcaauuuggcaaaugaaaaacuaacgucauuugcacgggggugcaggaacgaccacagggcccugcggugcugccggugguugccccauuuugcaaaccguuauucggggcggggaagacgggggaguaagcgaaggcugcaagccucacuuuaccccagcccgggacauaacgguggggguaaaacugccccagccuuauuguucacucuucucgaagcuugacaaacaccucuaggugaaagaugagccuggggggcgacaccacccgagccacgcauccgccacccgccuucggggaaggggaaagcagcgcugcccaucacggcagcaucccgguccccauaccccugucccaccuccgcgggcacacaagugggaagggcgugcgcggccgccacugagcggggaggcagccgcguccagcgccgucccggagggcacggguuuggcuggccaagcaaggacgauacgaugcgcucccuucucagcucagugaaaaugcugucuuugcuuuacacacaaaaccagccaaaagaaccgggcuucucggggauagggagagaagacaggggcaagcggacaauuaacagacccgauguagauuuuuuuuaauuaaauuaaauuaaaauguaccugcaguucccaggaaaaacaaaguccagaugagauccuuaguucgcagcauuguaaacugccggcugggagggauguucuggccgcgguaaauucagugccuuccccuugcaagcgacuguggacggcggcggagcaauggaccgaggagcagacaauugccaggcuggguaugauuauuuuugcagaauuguuucuugccagccacugccgagcugcguucacgcgcugagcggagaaugagugacagucccagccucagcacacucgcaacucggagaucccugcgcuggcccggguuggcuuugauggaacuggggaugcgagcgacgggcggggggcggaggugagagccucacuguguccuuccaccacgccgaccacaaauaguuccuaacauccaggagguaagagacaggggaggcagaugcggcugccuguaaaacgcggccuggaguuaccaagggagccgggcucuuucacagggaaccuuccaggcagagcugggauuucuuuucacccuuuuccuucauucacgucuuuggagaucauucugcccuccggcguuccuuaaucaggaauuugaacguuuuuaauaauuagggggaaaaagaauuuuagauucgguucgauuuucaaaguuguggacaccccccccuccaguuuaguuacuaaaguccuugcaauaaaaagcauauggcugcuucugcuucuucuucuucuccuucuucuccuucuucuccuucuucuccuucuucuccuucuuuuccuucuuuuccuucuuuuccuucuccuccuccuccuccuccuccuccuccuccuccuccuccuccuccuucuccuucuuuuccucuuccuccuaagagaaggaaauuggaaauuuggagagag

SEQ ID NO: 10400 - RNA, 2501 nt, Mus musculus
cucucuccaaauuuccaauuuccuucucuuaggaggaagaggaaaagaaggagaaggaggaggaggaggaggaggaggaggaggaggaggaggaggaggagaaggaaaagaaggaaaagaaggaaaagaaggagaagaaggagaagaaggagaagaaggagaagaaggagaagaagaagaagcagaagcagccauaugcuuuuuauugcaaggacuuuaguaacuaaacuggagggggggguguccacaacuuugaaaaucgaaccgaaucuaaaauucuuuuucccccuaauuauuaaaaacguucaaauuccugauuaaggaacgccggagggcagaaugaucuccaaagacgugaaugaaggaaaagggugaaaagaaaucccagcucugccuggaagguucccugugaaagagcccggcucccuugguaacuccaggccgcguuuuacaggcagccgcaucugccuccccugucucuuaccuccuggauguuaggaacuauuuguggucggcgugguggaaggacacagugaggcucucaccuccgccccccgcccgucgcucgcauccccaguuccaucaaagccaacccgggccagcgcagggaucuccgaguugcgagugugcugaggcugggacugucacucauucuccgcucagcgcgugaacgcagcucggcaguggcuggcaagaaacaauucugcaaaaauaaucauacccagccuggcaauugucugcuccucgguccauugcuccgccgccguccacagucgcuugcaaggggaaggcacugaauuuaccgcggccagaacaucccucccagccggcaguuuacaaugcugcgaacuaaggaucucaucuggacuuuguuuuuccugggaacugcagguacauuuuaauuuaauuuaauuaaaaaaaaucuacaucgggucuguuaauuguccgcuugccccugucuucucucccuauccccgagaagcccgguucuuuuggcugguuuuguguguaaagcaaagacagcauuuucacugagcugagaagggagcgcaucguaucguccuugcuuggccagccaaacccgugcccuccgggacggcgcuggacgcggcugccuccccgcucaguggcggccgcgcacgcccuucccacuugugugcccgcggaggugggacagggguauggggaccgggaugcugccgugaugggcagcgcugcuuuccccuuccccgaaggcggguggcggaugcguggcucggguggugucgccccccaggcucaucuuucaccuagagguguuugucaagcuucgagaagagugaacaauaaggcuggggcaguuuuacccccaccguuaugucccgggcugggguaaagugaggcuugcagccuucgcuuacucccccgucuuccccgccccgaauaacgguuugcaaaauggggcaaccaccggcagcaccgcagggcccuguggucguuccugcacccccgugcaaaugacguuaguuuuucauuugccaaauugcuggguaguugcaaaaccugcccucggccgggagcacggagggaugggaggguccagcgccgcguuuugacaggaggaagugcagaggggcggagggugaggagggcgugaucggggcugccugguugugugugugugcgcgcgcgugugcgcgcgugugccuuuacacgcaccgagagccuaggguugcacggugccagcgaagaauggcagguagccagcugcccaagacaccucuuccuuucucugggcgauauuccugauccuggcaaagugugaacaauggggagcucgggagaaagaccguagcgacgcugucgcggguggcgagggcugugccaccgcccagagauccuuagcauucgggaagggggcgcauugcauuuuggcuauuuccaucucggcuuucccuggaaaauuccucagugugcccacccucccuuccagcugcugccccuaccccacccaaggauuugugcuuuggcgucccaauggacugggagagggggaagcaaagggcacuggggccgccgagagcugggugggaugggccgacagcuggggcggggggggggcgugugcugccaagcaccagcugaaagcaggcuaggcggaggagaccgcgcauggcuguggcuucugccugguguggcuguacugguccagaucucuaagccuuggguguggagcccacagagcggccccgggagcacccagugcgccccccuccgagggcagcaagagagcagagcugggccaccgccuccagccaacucugaucggcgaccaaucagagcgaggcuggcugggcgggaagccgcgagaggcuuuuauugcggcgcggguggcgcccaagcugccaggaugguccccggguguucuagcuuaacggucucgcucgccucccguugggagagaccccgcccuguuacugccccuagcugcacggccguuuucgaggacguaaaauggagaa

SEQ ID NO: 10401 - RNA, 2501 nt, Mus musculus
agcuugugaaagcuagcugcccugcucuuccaggcgcaucugaccccagugacaaggugugcugugagcugugcggcucacacagacugucaaucacuuggacaggcagugacauucagagcugaagcaggcuggaggagugggcacacuaggauguauauguauguauuccuuuucuccucgucccucucaauacuaagaacccuggaguuuuuccugcucccaucucccuuuaaggaaucucauuaccuuccucucuuauuccucaauuuccuagcuuccaccuacagaauaagucgguaggcugugacacuguaacugagauuucuaaagugucagugacaauguuucugaugccccucuuccccaaccuuuggugauauacuuggaaacacacuccuaccuacuagagacaccuauugaaucacaugauuaaagaagauccaaaagccaccuaugaagugaaaucuuggugccuuacagucacagaaacacauaggcaugcaaaggguucgugcuuaggaauagcauccacacccauacacuacaccaagcaggagucccuugcacagcuuuuggaauccucacaugcagauaccucccuugccgccuaccuuagcccagggagccuaccuacucuaagugaagaccaaagccaccuggagcugggagagguuugacccagggcccaaagcagagaaucuggaccucugcaaaauggagauuaaaaaaaaaaaagguauaaacaaaacccaaaaacauuuggcuagaugcuaucuuacccugauucuugaacacacguucccuauaccagcacccggucuaguagaccuucccgaacuggucuccacucuuggcacucagguguacccuugggaagugugaggaccugacuguguacagguuugugcuaggagacucccaacagacagucauggccuggucuguauggcaagcaaacuuucaaggcgugcugggugcacagaaggaugacuguagguagaaagugagugguccuggacccugcacuccagggaggggccugaagggcgaagccugcagguggagguugggugaguauggaggaaaauagaccuuggguugugggcagcuuccuccuguugcucaguacugaggagauacagaaaaggacauucauuucucuaaauaagcauccuccuauccuauugcuugcauuccuauugauuauggauggaaagccgguggcaccuuuuaaaggggaaggccggcagcucugcgggucacuuuggggccgcuccuggggguccaccucccgcuagccacgccacaggaauggauuagcacuucugcacccgcuugcccagcagucucggaaccucagacauuagcccaggcaggagcccugaucuacccaggagucuuuucuuuccaccgacucugaagcguggucucaccgccccaggauggcagacuaagcagcacaugggaaguuacuucaguucgguuuccacugcaaauuacaaggcacagauaucucaagcccuccuuuccccccacccccaccuugcagugcgccccaaggcuuccgcuggagacccugccacuuuucgaucgauccacgggcaaaaugucccuccugucucuccgacacaccuaagugcaguggugugggaggacgccucaaaccaguccccagucucagcauggaaggguucgggcugcuggggaccggccuucugccccaccgcuccaagaaauacucucgauuuccugcacuggccuccccuccucuuuaaccccagcccucccggcaggguugcccccucgcuaccugcagcagucccgggcucgcccucgcucugcucuccagaaucugaauccauacugugggcugccgcccgcgcauccaccaccgcccgccugcggggcgcuccuggcucggguggacgcggcacacacgguaugggcugcaaagagucuggagcccgggcggugcagagugggcaguguguggccagacacuagggccagggggcggcuccgaagaggccaagccugcuccaguggcccgcccgccgcccgccagugccugcacgcgaggguagaguccgggugcggggagggggggggggagugagggggugcugguggcgaguaggguguagggaaggagaggaggaguguccagugcuccuggcugggauuaaauagcccagguuccucuacacccagagcccuggucugggagccuggugagcuggugggggggagccaggacgcuccuucuuuggguguggcaaaguuugcaagauuguuuaaguacaaaugcaccucucugcccacugaaaaagguguauuguuagguuuaagguugugaggcugcacgaguuuuaguuccacuucaccacuuggauccuuuuugaggaaaaucugugugucuguuaccucguguugggaggggagcgaacagucuugcaggaauuuugugggaaguauaaugccggcuccccugugaagga

SEQ ID NO: 10402 - RNA, 2501 nt, Mus musculus
uccuucacaggggagccggcauuauacuucccacaaaauuccugcaagacuguucgcuccccucccaacacgagguaacagacacacagauuuuccucaaaaaggauccaaguggugaaguggaacuaaaacucgugcagccucacaaccuuaaaccuaacaauacaccuuuuucagugggcagagaggugcauuuguacuuaaacaaucuugcaaacuuugccacacccaaagaaggagcguccuggcucccccccaccagcucaccaggcucccagaccagggcucuggguguagaggaaccugggcuauuuaaucccagccaggagcacuggacacuccuccucuccuucccuacacccuacucgccaccagcacccccucacucccccccccccuccccgcacccggacucuacccucgcgugcaggcacuggcgggcggcgggcgggccacuggagcaggcuuggccucuucggagccgcccccuggcccuagugucuggccacacacugcccacucugcaccgcccgggcuccagacucuuugcagcccauaccgugugugccgcguccacccgagccaggagcgccccgcaggcgggcggugguggaugcgcgggcggcagcccacaguauggauucagauucuggagagcagagcgagggcgagcccgggacugcugcagguagcgagggggcaacccugccgggagggcugggguuaaagaggaggggaggccagugcaggaaaucgagaguauuucuuggagcgguggggcagaaggccgguccccagcagcccgaacccuuccaugcugagacuggggacugguuugaggcguccucccacaccacugcacuuaggugugucggagagacaggagggacauuuugcccguggaucgaucgaaaaguggcagggucuccagcggaagccuuggggcgcacugcaagguggggguggggggaaaggagggcuugagauaucugugccuuguaauuugcaguggaaaccgaacugaaguaacuucccaugugcugcuuagucugccauccuggggcggugagaccacgcuucagagucgguggaaagaaaagacuccuggguagaucagggcuccugccugggcuaaugucugagguuccgagacugcugggcaagcgggugcagaagugcuaauccauuccuguggcguggcuagcgggagguggacccccaggagcggccccaaagugacccgcagagcugccggccuuccccuuuaaaaggugccaccggcuuuccauccauaaucaauaggaaugcaagcaauaggauaggaggaugcuuauuuagagaaaugaauguccuuuucuguaucuccucaguacugagcaacaggaggaagcugcccacaacccaaggucuauuuuccuccauacucacccaaccuccaccugcaggcuucgcccuucaggccccucccuggagugcaggguccaggaccacucacuuucuaccuacagucauccuucugugcacccagcacgccuugaaaguuugcuugccauacagaccaggccaugacugucuguugggagucuccuagcacaaaccuguacacagucagguccucacacuucccaaggguacaccugagugccaagaguggagaccaguucgggaaggucuacuagaccgggugcugguauagggaacguguguucaagaaucaggguaagauagcaucuagccaaauguuuuuggguuuuguuuauaccuuuuuuuuuuuuaaucuccauuuugcagagguccagauucucugcuuugggcccugggucaaaccucucccagcuccagguggcuuuggucuucacuuagaguagguaggcucccugggcuaagguaggcggcaagggagguaucugcaugugaggauuccaaaagcugugcaagggacuccugcuugguguaguguauggguguggaugcuauuccuaagcacgaacccuuugcaugccuauguguuucugugacuguaaggcaccaagauuucacuucauagguggcuuuuggaucuucuuuaaucaugugauucaauaggugucucuaguagguaggaguguguuuccaaguauaucaccaaagguuggggaagaggggcaucagaaacauugucacugacacuuuagaaaucucaguuacagugucacagccuaccgacuuauucuguagguggaagcuaggaaauugaggaauaagagaggaagguaaugagauuccuuaaagggagaugggagcaggaaaaacuccaggguucuuaguauugagagggacgaggagaaaaggaauacauacauauacauccuagugugcccacuccuccagccugcuucagcucugaaugucacugccuguccaagugauugacagucugugugagccgcacagcucacagcacaccuugucacuggggucagaugcgccuggaagagcagggcagcuagcuuucacaagcu

SEQ ID NO: 10403 - RNA, 2501 nt, Mus musculus
ccucaaggucugucguccccaggaggaauuuuuaauuuaaaaauuauaaaagaaaaacacuuuuaagggggagacgacucucaucuauucccagaagacuauugccuugcuaggcaaacgcccuacaaguccgaagaaagcgcggcgcugcggcagagcccgcgggguggagaugcggcuuccaagggauugcgggacccggggcugcagagaggaucuaggaagguuucgggggagggggcugcgcuccauuguucacuccgaaccaaucagagcuuucccacuuccucccagccaaucucccugcgccuccgugucuaccccagcccacccuccggguccccaucaucucccgagcaagccccagggcggugggagagcugggugacgcuacaggucccgccuccagcucgggccccgggcgagugcgugcugacgucaugcugcgugcgggccggugcggaaucgcuccuucaacuccgcggggcaggaguuaguuagcaaagagcagaggcugggcgcucgacccugguccuucuguccccggccgcaagcuuugcucacaucucucucugcaugguggauauuauuuuucauuauccuuuucugggugcuaugggggaucauuccaagaguaagucuuucucuguguguggguguguaugugugcuugauaugcaacauuuccaaugcagaagaauguuuagcggauucuacaaguggcuuuuauuugacaaaauacuugggagaauaaaaaaaaacaaacaaacaagcagugcauuucgcccauaacacuguuuauucguuggaauccuacuauuuuauuuugcaauuagacauuauuucccaaguuggcuggaaugaccucaggcugugaaauucuuuuucuuuucugcuaggacaauuagguuugauuuagagaaauggguuucuucucugccuuaggaagguagagagguuucaguagcuugaucugagguguuuaaacuaagaacugucgaagaagcuaagaggggacagggcugaaugcugcggugucugcguugaaauagggagucgcugugagcgggagcgggcggaaauccgggcuuggcugacaguguggacacggaggcguccguagcuccccagugucaccgugcugucgucugccucccguuagcucugucucuagcugaaccgauacuacguccgcguucaaagacggugauaauggaaauaucaggagauuguguuguuuucguuuccuacuuucuggaucauucgaaaguggucucacuuuuagagcgggagaucaagcaagggagggcggguuggguuggggcugcugcagcggccaaggccggccggguccuguaccgggccugacgcgggcccugcgcccuucccugcuagagaagcccgggacggccaugugcgugggcugcgggagucagauccacgaccaguuuauccuucgcgugucgcccgaccucgaguggcacgccgccugccucaagugcgcggagugcagccaguaccuggacgagacgugcacgugcuucgugagagacgggaaaaccuacugcaagcgggacuacgucaggugagccggcgggacccgggguucggcccccuugggcugggggggacacggcugcgcguccugggcucgggucccugcgcugacgcccgccgcacccgggcccgcaggcuguucggcaucaagugugcccagugccaggugggcuucagcagcagugaccuggugaugcgggcgcgggacagcguguaccacaucgagugcuuccgcugcuccgugugcagccgccagcugcucccuggagacgaguucucgcugcgggagcaugagcugcucugccgagcugaccacggccuccugcuggagcgcgcugcggcuggcagcccgcgcagccccggcccgcuccccggcgcccgcggccugcaucugccagguaagccucucucccggcccgcagcgcugcgccgcgucaguaggauguacgacuguguagccgacagcugagcuuccgacgggaagccggugugaaaggcugcgugcgcugggaacccugcuaugugucugcgagugcgggggucggggggaauuguauguaugugagcgugagagccucgggaguuguguucuccguggcccggaccauguaggaucgggagaguggaggacccggaauccuaggugcugccugucuggguuguguuuagaauuccuuugaugaacagggagaaaagguauccaucccacccggagccaagggaagaaggccagcggcgcagaagaggggccuguguucuuguuuugauguccggcuagcauaaagaaagguucagggaguuuauugguuaaaacccuccuaggaugauaggugcucuggccaggaguugcucagacugggaaauaaguguugacaagaagcagguggagagggugcgacaggagaccccaguuccaggaagccaggggaucugcuacucagauc

SEQ ID NO: 10404 - RNA, 2501 nt, Mus musculus
gaucugaguagcagauccccuggcuuccuggaacuggggucuccugucgcacccucuccaccugcuucuugucaacacuuauuucccagucugagcaacuccuggccagagcaccuaucauccuaggaggguuuuaaccaauaaacucccugaaccuuucuuuaugcuagccggacaucaaaacaagaacacaggccccucuucugcgccgcuggccuucuucccuuggcuccgggugggauggauaccuuuucucccuguucaucaaaggaauucuaaacacaacccagacaggcagcaccuaggauuccggguccuccacucucccgauccuacaugguccgggccacggagaacacaacucccgaggcucucacgcucacauacauacaauuccccccgacccccgcacucgcagacacauagcaggguucccagcgcacgcagccuuucacaccggcuucccgucggaagcucagcugucggcuacacagucguacauccuacugacgcggcgcagcgcugcgggccgggagagaggcuuaccuggcagaugcaggccgcgggcgccggggagcgggccggggcugcgcgggcugccagccgcagcgcgcuccagcaggaggccguggucagcucggcagagcagcucaugcucccgcagcgagaacucgucuccagggagcagcuggcggcugcacacggagcagcggaagcacucgaugugguacacgcugucccgcgcccgcaucaccaggucacugcugcugaagcccaccuggcacugggcacacuugaugccgaacagccugcgggcccgggugcggcgggcgucagcgcagggacccgagcccaggacgcgcagccgugucccccccagcccaagggggccgaaccccgggucccgccggcucaccugacguagucccgcuugcaguagguuuucccgucucucacgaagcacgugcacgucucguccagguacuggcugcacuccgcgcacuugaggcaggcggcgugccacucgaggucgggcgacacgcgaaggauaaacuggucguggaucugacucccgcagcccacgcacauggccgucccgggcuucucuagcagggaagggcgcagggcccgcgucaggcccgguacaggacccggccggccuuggccgcugcagcagccccaacccaacccgcccucccuugcuugaucucccgcucuaaaagugagaccacuuucgaaugauccagaaaguaggaaacgaaaacaacacaaucuccugauauuuccauuaucaccgucuuugaacgcggacguaguaucgguucagcuagagacagagcuaacgggaggcagacgacagcacggugacacuggggagcuacggacgccuccguguccacacugucagccaagcccggauuuccgcccgcucccgcucacagcgacucccuauuucaacgcagacaccgcagcauucagcccuguccccucuuagcuucuucgacaguucuuaguuuaaacaccucagaucaagcuacugaaaccucucuaccuuccuaaggcagagaagaaacccauuucucuaaaucaaaccuaauuguccuagcagaaaagaaaaagaauuucacagccugaggucauuccagccaacuugggaaauaaugucuaauugcaaaauaaaauaguaggauuccaacgaauaaacaguguuaugggcgaaaugcacugcuuguuuguuuguuuuuuuuuauucucccaaguauuuugucaaauaaaagccacuuguagaauccgcuaaacauucuucugcauuggaaauguugcauaucaagcacacauacacacccacacacagagaaagacuuacucuuggaaugaucccccauagcacccagaaaaggauaaugaaaaauaauauccaccaugcagagagagaugugagcaaagcuugcggccggggacagaaggaccagggucgagcgcccagccucugcucuuugcuaacuaacuccugccccgcggaguugaaggagcgauuccgcaccggcccgcacgcagcaugacgucagcacgcacucgcccggggcccgagcuggaggcgggaccuguagcgucacccagcucucccaccgcccuggggcuugcucgggagaugauggggacccggagggugggcugggguagacacggaggcgcagggagauuggcugggaggaagugggaaagcucugauugguucggagugaacaauggagcgcagcccccucccccgaaaccuuccuagauccucucugcagccccgggucccgcaaucccuuggaagccgcaucuccaccccgcgggcucugccgcagcgccgcgcuuucuucggacuuguagggcguuugccuagcaaggcaauagucuucugggaauagaugagagucgucucccccuuaaaaguguuuuucuuuuauaauuuuuaaauuaaaaauuccuccuggggacgacagaccuugagg

SEQ ID NO: 10405 - RNA, 2501 nt, Mus musculus
cugccagcgccgaggcgagcggagccgcgcgagcccggcggccuuugagggagccugcgcccggccgggcggccaguccggcggggcgcggcggcgcucgggguaagcgggccaggcccgcggagccgggugggcagggcagggcagggcagggcgagggcgaagcagccggggagaaaggcccgagcagccccggugccucguuugccccaucggcagcuacccggcgccccgggccgcgaggcgcggagccgugagcgagcgcgcuggaggcgguggagccgagcggaggcugcgcgcccggugugccuggccgggcccggcgcgccuccuccaucgccucccuggcgucucgcucgcccccuucugcuuuccuuugcuuccucggcugagccccgccgugcugaggcccccccgaccucgugcacucaucuccgcugugcucgacaccgggucccccuggccacggcugcuuccccucccccgagacgcgaaggaauccggacuuuccccaccguugauggagccgacugccgggcuggacugagcgguuucugcggccgcuccagacgucgcccgggccggagcacggacauucugggucccggcugaguacaccccggacaccuagcagugccagcucgggaagggcagagcaaggcaaaggcaggacagaccccggaggggcucagaccugcccaucuagaauggacagagagaaucgcgaacccuguggagcccggggaaugccgggcgugggcugaggggaucccggcgcccuccccagcccuccgacuuuggcuuagucgccuggaccggaccggugucaccucggcucgggucaccuguggccucggggccuccgagcucgccggacccucgcgaccgggagccuggcgagcguggugaggagauuuuuggggauuuuuuuuuuuugcccccuuccccggagcgcggaggccccgcccccucccaccgcccagaugucuccggucaccgcucggaagaccuuccugaggccaggagccgaaggguccagagagagaagcccgcccuagggagccuugggggccccccaaccucgucuuguggcucggccccgacacugcuuagaggaaaggccacugcccccacccuuggugaguaggggaguccagcuucggaggguucggagggaaggcgggguugggggagaaaggguccucugggaaggagggcacccugugggcauugaaagaagguuggagagcuggagaggcccugugcuaaaccagucuggccaagcuugguugguggcugggggcggggggugcaccacggcuagagugcuccagaggaggcuaagggcucauuccucuaaaacaggggcuccuccacucuucuguugaagaaggguguugaaaacuaucugccuccaccaccccuccccacuaaauaaauaaauaaauaaauaaauaaauaaaucuccagcuaggaaggagggugcaggcagagagaagagggaggcagcagcagcaggcuggugcagcagccugggagggcugacgccaggcucgcucuuucugcagggggcugcccuccuccaauccaguucccucuccagugcuguucacaucuggagcccccuccacaucuggaagauccugaucaccgucccugugcugguucagcugcaucuagagaccucugccuuuguaacugccuaggaguugcgaggggauugcugccuucccccaucccaagggcaucucuuacccuuaguccuugcagaaucaucccccugccuccgcauccagauucgggcaaagaucagcucuguacaccauaggcacuucaaguccuggaagcuguucuugggcccuaaggccccuccccuugcccuccuguguccucaccuugaccccccucccacccugucagacucugucucccucugggugcuccaucccccacccagaggcgaguagguggaguggcaggcugcaggggcugggugagggccgcccaaggccaggguaggcuggggggccguuaaaauguggagcucugcccggccgaggggggcuccguggaggcagacgaagcgugugccccgcuggggcgaguaugggcaggcuugcggccacguggugaaggaugaacauucggggugccccggaccucgggcagcccagugacgaccccaacagugguggagagagagagcggauucgacagcgcaugaagauggucaucgggcaacuugaaggcauccugagagaacucaaagaaguggcuaaggagcugagggaggugaguuaagaggccagcaggggccacacagaccccccucacccugacuggcugggcucagcaguaaagcauuugccugugucuugagugugcaaugcuaugugcacauggccuguuuccacugagcacccauccccuuuccauucuccuuacuucaaaucugguuugcuuaaaaaucccuauccccagagcuggugauggggccuugg

SEQ ID NO: 10406 - RNA, 2501 nt, Mus musculus
ccaaggccccaucaccagcucuggggauagggauuuuuaagcaaaccagauuugaaguaaggagaauggaaaggggaugggugcucaguggaaacaggccaugugcacauagcauugcacacucaagacacaggcaaaugcuuuacugcugagcccagccagucagggugaggggggucuguguggccccugcuggccucuuaacucaccucccucagcuccuuagccacuucuuugaguucucucaggaugccuucaaguugcccgaugaccaucuucaugcgcugucgaauccgcucucucucuccaccacuguuggggucgucacugggcugcccgagguccggggcaccccgaauguucauccuucaccacguggccgcaagccugcccauacucgccccagcggggcacacgcuucgucugccuccacggagccccccucggccgggcagagcuccacauuuuaacggccccccagccuacccuggccuugggcggcccucacccagccccugcagccugccacuccaccuacucgccucugggugggggauggagcacccagagggagacagagucugacagggugggaggggggucaaggugaggacacaggagggcaaggggaggggccuuagggcccaagaacagcuuccaggacuugaagugccuaugguguacagagcugaucuuugcccgaaucuggaugcggaggcagggggaugauucugcaaggacuaaggguaagagaugcccuugggaugggggaaggcagcaauccccucgcaacuccuaggcaguuacaaaggcagaggucucuagaugcagcugaaccagcacagggacggugaucaggaucuuccagauguggagggggcuccagaugugaacagcacuggagagggaacuggauuggaggagggcagcccccugcagaaagagcgagccuggcgucagcccucccaggcugcugcaccagccugcugcugcugccucccucuucucucugccugcacccuccuuccuagcuggagauuuauuuauuuauuuauuuauuuauuuauuuaguggggaggggugguggaggcagauaguuuucaacacccuucuucaacagaagaguggaggagccccuguuuuagaggaaugagcccuuagccuccucuggagcacucuagccguggugcaccccccgcccccagccaccaaccaagcuuggccagacugguuuagcacagggccucuccagcucuccaaccuucuuucaaugcccacagggugcccuccuucccagaggacccuuucucccccaaccccgccuucccuccgaacccuccgaagcuggacuccccuacucaccaagggugggggcaguggccuuuccucuaagcagugucggggccgagccacaagacgagguuggggggcccccaaggcucccuagggcgggcuucucucucuggacccuucggcuccuggccucaggaaggucuuccgagcggugaccggagacaucugggcggugggagggggcggggccuccgcgcuccggggaagggggcaaaaaaaaaaaauccccaaaaaucuccucaccacgcucgccaggcucccggucgcgaggguccggcgagcucggaggccccgaggccacaggugacccgagccgaggugacaccgguccgguccaggcgacuaagccaaagucggagggcuggggagggcgccgggauccccucagcccacgcccggcauuccccgggcuccacaggguucgcgauucucucuguccauucuagaugggcaggucugagccccuccggggucuguccugccuuugccuugcucugcccuucccgagcuggcacugcuagguguccgggguguacucagccgggacccagaauguccgugcuccggcccgggcgacgucuggagcggccgcagaaaccgcucaguccagcccggcagucggcuccaucaacgguggggaaaguccggauuccuucgcgucucgggggaggggaagcagccguggccagggggacccggugucgagcacagcggagaugagugcacgaggucgggggggccucagcacggcggggcucagccgaggaagcaaaggaaagcagaagggggcgagcgagacgccagggaggcgauggaggaggcgcgccgggcccggccaggcacaccgggcgcgcagccuccgcucggcuccaccgccuccagcgcgcucgcucacggcuccgcgccucgcggcccggggcgccggguagcugccgauggggcaaacgaggcaccggggcugcucgggccuuucuccccggcugcuucgcccucgcccugcccugcccugcccugcccacccggcuccgcgggccuggcccgcuuaccccgagcgccgccgcgccccgccggacuggccgcccggccgggcgcaggcucccucaaaggccgccgggcucgcgcggcuccgcucgccucggcgcuggcag

SEQ ID NO: 10407 - RNA, 2501 nt, Mus musculus
uggcagcgccucguccgcaccguccucguccaggggcccgcgggauagagcgcucgggcagcgcuccuccguaccgaggcugcccucuuuagcuggcucggcaccguccaaagacucaggaccgcccccgccagccgccgccgccgcugcagcagcagccgcagccaccgcggccgcuacggccuuagcuuggcucugagcggccggguaaggaggcaccgggaggcucccggcugcuggccagaacaugggaaacgucggguauacaguggcggcggcagcugcggcagcuaccgccgcugcguccuuggcugcgccggaagguugauguccccagaacauugugccgccaccagggccgggcccugcuccugggggcaaguggccagcucccgggccacccgcacccgcggcggugccagcgcccccacugcucccggugccagggccucccuuggguucuccggcgaccaacacugggucguccuuuuugggacauaggccgaaugcuguggggaaaccguaaggaugcgggaaaagaggcgggggcagcuuuugcaagaggccaaaaccuuugcugggcacuggaaucaccggguagcugcgaaccccugcgcugcccccagguccuccagguccugcagggccacuagcugccgccgccaggccaagugcgcgcugcggaugcgguggagguggcccgggaggcccagccgccucgucuucaccgcagcgcagacuuuuguggggcggugggccuggggccaucucugagccgcacccuggaccgccaccgccaccagcgccgcccuucccugcaccaccagacccgcuauuagcgccgccuccgccgcccccuugcagggagaagguccgcuugcgcguaccgccauuaaacauagccuugacguccucccaagcguggcucaguucgucgguggccgacuugucacugaguuugaggugccgacgccacgaguuaaaguuggcggcgucgggcugaguguacuuggcgucgggugugcggugcgaauggaagaugaacuuguugggagagaaauacauacugcaguagccgcacuugaugcacuuagcacgagagcuguuguaacgggcagggaugaagcugccccgagagccccaugcgcacucgugcaccacgucaaaggcgaaguucucaggcaguuuggggggcuugugcucgcccaggaacgacuugcacaggcguucggccucucguuuugugaucauaccacagcggcgagaggagaugggcauggccccggcccgacgcaguaucuccagcugcaccggcgugcauugcacgcaugugaugcccagggccacgcggcgguuguggaucucauuguagcuguaguuuuugagcaggguguuggagaucugggcuaggcacaggcgcuccugcccaucaaugaccagcgacacgauggguaccccguacagcgacgucucgcccaccugguuggguuuaagggcgcuggaucccgaguagggcugcagcucuugcuuggaguugggagaggagcugcccucgcgucccggccccagcugaguggugagagccuccaugccgccgcuccugcgaaacagagagagcagagagcagaugagccauuuuuuuagcgccgcuaccuagguucaggcccgcccagcggggcgcaacguguggggugcgaggggguuacuuggcaguggggagcucaagcucauucgucccacggacuggccccuuuuguuauucagaccagcuucugagcugaaacaaaagcacccggggggcuaagggaggaaaagggaaaaucgaaaccucaggaaagccccggcugccaggaaaccaauccuguuuucagauuggaaaggaagugggacccagagacggagagugacuugcccaaggccacacagcaaugccauagccaaauccaggcuuuccagccggcacucagguuugcgugccuucagcuaccucacagcucgcccugcccgccaggguccugaagcccggacuucagggaccagcggccccucugcucagucgcgcaugcacgcgugcgggcgggggcagugaagggagagguggggaggcgaaggaggggcacucacugcccaucacaaacugcaggauguaggggugggggcagggagaagggggagggauggagguugaaggaggaggauagaaggaagaggaggaggccacugcuguucgcggugcugaacccuacccuuuccaaagcuugucgcgugcaccacgaccucggguggcccccaaugcaccuaucuucguggugaccggcuuccagggacaacaguaccgguuugcacaaaccuguacuucucuucugacuccuugagcccgguguuccuugagcagaaagaguccagcuggguuuacaaaacgcuuucuugccagccaucaguuaggccgggaucacgcagucucuaaccacauuuucugcauuuuuuagcugcauuccaga

SEQ ID NO: 10408 - RNA, 2501 nt, Mus musculus
ucuggaaugcagcuaaaaaaugcagaaaaugugguuagagacugcgugaucccggccuaacugauggcuggcaagaaagcguuuuguaaacccagcuggacucuuucugcucaaggaacaccgggcucaaggagucagaagagaaguacagguuugugcaaaccgguacuguugucccuggaagccggucaccacgaagauaggugcauugggggccacccgaggucguggugcacgcgacaagcuuuggaaaggguaggguucagcaccgcgaacagcaguggccuccuccucuuccuucuauccuccuccuucaaccuccaucccucccccuucucccugcccccaccccuacauccugcaguuugugaugggcagugagugccccuccuucgccuccccaccucucccuucacugcccccgcccgcacgcgugcaugcgcgacugagcagaggggccgcuggucccugaaguccgggcuucaggacccuggcgggcagggcgagcugugagguagcugaaggcacgcaaaccugagugccggcuggaaagccuggauuuggcuauggcauugcuguguggccuugggcaagucacucuccgucucugggucccacuuccuuuccaaucugaaaacaggauugguuuccuggcagccggggcuuuccugagguuucgauuuucccuuuuccucccuuagccccccgggugcuuuuguuucagcucagaagcuggucugaauaacaaaaggggccaguccgugggacgaaugagcuugagcuccccacugccaaguaacccccucgcaccccacacguugcgccccgcugggcgggccugaaccuagguagcggcgcuaaaaaaauggcucaucugcucucugcucucucuguuucgcaggagcggcggcauggaggcucucaccacucagcuggggccgggacgcgagggcagcuccucucccaacuccaagcaagagcugcagcccuacucgggauccagcgcccuuaaacccaaccaggugggcgagacgucgcuguacgggguacccaucgugucgcuggucauugaugggcaggagcgccugugccuagcccagaucuccaacacccugcucaaaaacuacagcuacaaugagauccacaaccgccgcguggcccugggcaucacaugcgugcaaugcacgccggugcagcuggagauacugcgucgggccggggccaugcccaucuccucucgccgcugugguaugaucacaaaacgagaggccgaacgccugugcaagucguuccugggcgagcacaagccccccaaacugccugagaacuucgccuuugacguggugcacgagugcgcauggggcucucggggcagcuucaucccugcccguuacaacagcucucgugcuaagugcaucaagugcggcuacugcaguauguauuucucucccaacaaguucaucuuccauucgcaccgcacacccgacgccaaguacacucagcccgacgccgccaacuuuaacucguggcgucggcaccucaaacucagugacaagucggccaccgacgaacugagccacgcuugggaggacgucaaggcuauguuuaauggcgguacgcgcaagcggaccuucucccugcaagggggcggcggaggcggcgcuaauagcgggucugguggugcagggaagggcggcgcugguggcgguggcgguccagggugcggcucagagauggccccaggcccaccgccccacaaaagucugcgcugcggugaagacgaggcggcugggccucccgggccaccuccaccgcauccgcagcgcgcacuuggccuggcggcggcagcuaguggcccugcaggaccuggaggaccugggggcagcgcagggguucgcagcuacccggugauuccagugcccagcaaagguuuuggccucuugcaaaagcugcccccgccucuuuucccgcauccuuacgguuuccccacagcauucggccuaugucccaaaaaggacgacccaguguuggucgccggagaacccaagggaggcccuggcaccgggagcagugggggcgcuggcaccgccgcgggugcggguggcccgggagcuggccacuugcccccaggagcagggcccggcccugguggcggcacaauguucuggggacaucaaccuuccggcgcagccaaggacgcagcggcgguagcugccgcagcugccgccgccacuguauacccgacguuucccauguucuggccagcagccgggagccucccggugccuccuuacccggccgcucagagccaagcuaaggccguagcggccgcgguggcugcggcugcugcugcagcggcggcggcggcuggcgggggcgguccugagucuuuggacggugccgagccagcuaaagagggcagccucgguacggaggagcgcugcccgagcgcucuaucccgcgggccccuggacgaggacggugcggacgaggcgcugcca

SEQ ID NO: 10409 - RNA, 2501 nt, Mus musculus
cacacaaccaccaggggucagcaggccuuuagggcaggacuuugacuugccuggugucacuaggcaggaauucccccagggugcugaaaagaagagaaacacuaaguugcuugaggauacccagggggauggugaggaggggguggagacacuauagcccaggagacucuugcuucuauuuuguaacaagcccaguuccggagguggaggcaaggcaguuagaguaaccaaagcuguccaccaaaaagcagccccuguuccaagucaggaaaggugaugagggaagcgguguaucagaaccaggccagggcccaguccguucaaaaaggaaaaaagcuuauccuaaagguucccuuugcggccgagggccuugccacgugagcaggguuauccuuaccuccagcugcuggucuuggagucuguagggaaaugucuaagucucaagaauuccaguaacuccuugggcacauccugauucagguacaggaugcccuagagaagaaggcagagaaagucugcaaucagauaagauccagcuacuaauugcacaacccauuacaacaauuuugaggacauuuguuccaaaauaaugaagacuuucaaggcaguagaaauaaguauuagcccaaacucagggucauccuaaggaaugaaccgcaaagacuagcaccacaaagugggcaggcuagucaaauaacuaucacuguuagaggaaggaguccacacacaccucaugaagaaaauacaggaaaacacccuaagggugaagaaucuacucauuggauuauucaaaacuuucaauaacccagauagaaaaguucguacucauuuggauaaagagccugagauacugaauaacaaccccaaguugugggacccaacacacucccacaucucuaacugggucuccccuggucccucagacuuaggggcaaccaaguguaccccgugcacaccuggauguaggucucuaaucccugccggcgcuguuccaguccucugguccuccaguugggcaggcguuuugagggaaagucaggcacuuuguaccguuucuugaucuguacaucaguuacagaggugaguucccagcaaagcacucaagcccacugcaucuagcugaggacuuucuccaguccucucuauaugucugucuuuaagcuucaaccugggacagcuggcaagaggugguugggacagaagugacaagccagagaguggaaaggacgcacacggacaaggucagucugagcugagcucuagccauugcguccuccccgcgaggggcccugcagcccagggggagucgccuaugaucugcacccuccugggggcugggacaguaaugggggugaccaaccagaagcugggaucagagcucuuucucaugccaccgagggaccuggccuggagccaaaucgguggguaguccgcgacaucucacccgcuuguguagagcguggaacucgcuguagcgccgcggcacggugugucugcguccgcuguacagcaccuccacuuggaacaccuggcgggcggaggagugcagacggcggguccaaaggaugcaguaggacccgcgccgcgagacgcgcccaauuucugguguuagaaaggcacaaagccgacuuggcgugccaccaucagggaaaccccuuccgaaccccagacacaccugaaagaaaaggguaaccggcccuccccucugcuccaagcgaccccucaagagcccaaaccauuguccaaggggcuggcaaagccaaguaaccccgaaccuuugcgacgaauguccuagcccugaauucugggucccuuuugcgcugaucgcgaagauaaucgguagauccccgcacacacucuucguccauuugcucaccauguggccuuucucuggacucugccugggcccuucggccucgggccccaccgagggaaugugaacuuccagcauccgcgccccgacccggcugcagccucucccggaucgagcgcuugggcacccgaacucccuggagcagccaagcagcccuaagaggcugacccgcccucgggcuccaggcccugcccccgggccguaggcuccgccccacucucuggauuuuucagccccaggcuccacccucugauacgggagcccgcccucgccacgcccaggguguucccuggcucacuaaaguccugaggccagaagauaacaccaugggucgccaugcaagggaaggaaccuucagcagggucacccauuugucaaacauuucccuaguaucccagguagucagccgagguacauuuuaccuggucucucuaaaauuucaccuggucuuuguugaauguccuggaugcuaaggugucagaggaaggcacaguggguuucaggucugggcuuccgguuaggaccauccuuguucuuagagaaccuagccaccacaaccuucccucuuucauguggucccugguagcaccaccugaagacuccaacugagguagugccggggugaggc

SEQ ID NO: 10410 - RNA, 2501 nt, Mus musculus
gccucaccccggcacuaccucaguuggagucuucagguggugcuaccagggaccacaugaaagagggaagguugugguggcuagguucucuaagaacaaggaugguccuaaccggaagcccagaccugaaacccacugugccuuccucugacaccuuagcauccaggacauucaacaaagaccaggugaaauuuuagagagaccagguaaaauguaccucggcugacuaccugggauacuagggaaauguuugacaaaugggugacccugcugaagguuccuucccuugcauggcgacccaugguguuaucuucuggccucaggacuuuagugagccagggaacacccugggcguggcgagggcgggcucccguaucagaggguggagccuggggcugaaaaauccagagaguggggcggagccuacggcccgggggcagggccuggagcccgagggcgggucagccucuuagggcugcuuggcugcuccagggaguucgggugcccaagcgcucgauccgggagaggcugcagccgggucggggcgcggaugcuggaaguucacauucccucgguggggcccgaggccgaagggcccaggcagaguccagagaaaggccacauggugagcaaauggacgaagagugugugcggggaucuaccgauuaucuucgcgaucagcgcaaaagggacccagaauucagggcuaggacauucgucgcaaagguucgggguuacuuggcuuugccagccccuuggacaaugguuugggcucuugaggggucgcuuggagcagaggggagggccgguuacccuuuucuuucaggugugucugggguucggaagggguuucccugaugguggcacgccaagucggcuuugugccuuucuaacaccagaaauugggcgcgucucgcggcgcggguccuacugcauccuuuggacccgccgucugcacuccuccgcccgccagguguuccaaguggaggugcuguacagcggacgcagacacaccgugccgcggcgcuacagcgaguuccacgcucuacacaagcgggugagaugucgcggacuacccaccgauuuggcuccaggccaggucccucgguggcaugagaaagagcucugaucccagcuucugguuggucacccccauuacugucccagcccccaggagggugcagaucauaggcgacucccccugggcugcagggccccucgcggggaggacgcaauggcuagagcucagcucagacugaccuuguccgugugcguccuuuccacucucuggcuugucacuucugucccaaccaccucuugccagcugucccagguugaagcuuaaagacagacauauagagaggacuggagaaaguccucagcuagaugcagugggcuugagugcuuugcugggaacucaccucuguaacugauguacagaucaagaaacgguacaaagugccugacuuucccucaaaacgccugcccaacuggaggaccagaggacuggaacagcgccggcagggauuagagaccuacauccaggugugcacgggguacacuugguugccccuaagucugagggaccaggggagacccaguuagagaugugggaguguguugggucccacaacuugggguuguuauucaguaucucaggcucuuuauccaaaugaguacgaacuuuucuaucuggguuauugaaaguuuugaauaauccaaugaguagauucuucacccuuaggguguuuuccuguauuuucuucaugagguguguguggacuccuuccucuaacagugauaguuauuugacuagccugcccacuuuguggugcuagucuuugcgguucauuccuuaggaugacccugaguuugggcuaauacuuauuucuacugccuugaaagucuucauuauuuuggaacaaauguccucaaaauuguuguaauggguugugcaauuaguagcuggaucuuaucugauugcagacuuucucugccuucuucucuagggcauccuguaccugaaucaggaugugcccaaggaguuacuggaauucuugagacuuagacauuucccuacagacuccaagaccagcagcuggagguaaggauaacccugcucacguggcaaggcccucggccgcaaagggaaccuuuaggauaagcuuuuuuccuuuuugaacggacugggcccuggccugguucugauacaccgcuucccucaucaccuuuccugacuuggaacaggggcugcuuuuugguggacagcuuugguuacucuaacugccuugccuccaccuccggaacugggcuuguuacaaaauagaagcaagagucuccugggcuauagugucuccacccccuccucaccaucccccuggguauccucaagcaacuuaguguuucucuucuuuucagcacccugggggaauuccugccuagugacaccaggcaagucaaaguccugcccuaaaggccugcugaccccuggugguugugug

SEQ ID NO: 10411 - RNA, 2501 nt, Mus musculus
cuugaaauugcgcagaguccagagcuaugccucuccaagcucagaagacgaguaguuuuguuguuuuguuuuguuuuguuuuguuuuguuuuguuuuguuuuguuuuguuuuguuucuguuuucuccgagcaggagggagucaggguguucugccuguuggaugggagugcauuucagggucccaggagggaccgcuuggcuuggauuagccccuguuuucucuggugcccuagagggaccgaagacaacuuucacacgccuuccggcaaguuugugguuugucuucugguuccaaaaccaaaaguucuucuaagagcgaggacugaagaagguagaaugggcaagucgggguggcgguuuuaggucgcggagggcuggacccggagcagggaaguguugagaggggugguguggaccaagacggagccccagcuuccuugggucagugcacggccaccgagugcaaggcggaggccgggcuggugagugucucgcuagggguggcggggcugcuuuggcugguggcugucugcgaggagguggggcugagcgaaggcggcgaguucgagagcaggguggggaugggugcgggcagagcuggcagcgcgggcacugcggccggcgugggcuugaugggcacugggauggcgggcaacgucuggcccgcggcguggcacagcggcuucagcggcacuccauaggcgcuguagucgccacuagucauggagauggggguggcugagucgaucauacccgcggaaccguacacauguggccauccagugcccagagagcugcccaugguaguuaacugguuagggagaggauaggcagccggaaccggcugcauggcagagaaggccagccccccaggcaucuuguacucccuagcgaugauguucucgauagcaaagggaugcuugaagccggaaggcugcgccacaccgcccagguuguacgcagcggccggcaucugcggcagaugcgugcccgaggcggccagcgcgcugagccgcagcuuagccugcugcuggagguacugcgcggcguccgccggcuugcugggcgccagguggucugacuugagcaccuugaagcgcuugcgacgccgcaggaagcucccguucucgaacauguccccgcagcugggaugcagcgcccagaagcugcccuugcccggcuggucuggccgccucgggaucuugaugaagcaaucguugaaggagagauuguggcgcaggcuguucugccagcgcugcguguucucccgguaguaggggaagcgguccaugaugaacuuguagaucucgcugagcggcagcaucuucuccggagagcucuggauggccauggcggucagcgagauguaugaguagggcggcuucuggucgcuguacguguugcggcccggccgaggcaucuucuugcuuggccacuugcucaggguccgcgcggcccggaggacuggucgaaucugagaaggggggaggugauggagaagggcagcauaggugcagagacacuggcgaggucacucaggccgagucacagauauaggggguggggaagaggggauucgggugccagcaacuuugcgcaccaaacuggguaagacucagcuaggggaaguggagaggggaagaccgagagcagcagagagguuugcaggaaaguagguaggaccuggauucaggggaggggacagagagauagaugcucaccuuaaaguuguuccaaguugccgguccgcauccgggauggcguggcugguggccgagucccucccugcgcgcgaccggagcgcagcgucggggagcagugagacucgcugccagcuaggcuuggacucagcccgguagagcuccucuccgcgggcugcgcagcgcgcucgugggucgugcgcccugcugggagaccgaacucggcugcggagugcccgugaggacaguggcagacgccgccucagggauccagaggacgcugcugugguguucgugguuccgcugagcuagguggcugccuccauguccacccucgaaccaucugauaguuuuaagcggugacaggagcagaaaagaccccuguagcggcgcuucauuaaugugccacuucuuagcuaucguaugacaaucgccuugggaggaggaggaaaaggagggggagcgggggcugcagagggaggggacugagggagaggagagagagccuggccagcgcugguuucuuucacaccuauuuacauggacaccuuggccaauaggaaucacuuccagccgaagacugggagaccgggaagagccucugccgcccgcggggagcgggcagcgccuaccggugugcgcaaugggaagguaugagcggagcagcgcgcggagccggcuggcaggugaccacucacucugagcuaucugccgcgccggugguguuugacauggaaauugcucggcugggguauucuguuuccuuugcuuugugucggguuuguauuguuagcuaacuu

SEQ ID NO: 10412 - RNA, 2501 nt, Mus musculus
aaguuagcuaacaauacaaacccgacacaaagcaaaggaaacagaauaccccagccgagcaauuuccaugucaaacaccaccggcgcggcagauagcucagagugaguggucaccugccagccggcuccgcgcgcugcuccgcucauaccuucccauugcgcacaccgguaggcgcugcccgcuccccgcgggcggcagaggcucuucccggucucccagucuucggcuggaagugauuccuauuggccaagguguccauguaaauaggugugaaagaaaccagcgcuggccaggcucucucuccucucccucaguccccucccucugcagcccccgcucccccuccuuuuccuccuccucccaaggcgauugucauacgauagcuaagaaguggcacauuaaugaagcgccgcuacaggggucuuuucugcuccugucaccgcuuaaaacuaucagaugguucgaggguggacauggaggcagccaccuagcucagcggaaccacgaacaccacagcagcguccucuggaucccugaggcggcgucugccacuguccucacgggcacuccgcagccgaguucggucucccagcagggcgcacgacccacgagcgcgcugcgcagcccgcggagaggagcucuaccgggcugaguccaagccuagcuggcagcgagucucacugcuccccgacgcugcgcuccggucgcgcgcagggagggacucggccaccagccacgccaucccggaugcggaccggcaacuuggaacaacuuuaaggugagcaucuaucucucuguccccuccccugaauccagguccuaccuacuuuccugcaaaccucucugcugcucucggucuuccccucuccacuuccccuagcugagucuuacccaguuuggugcgcaaaguugcuggcacccgaauccccucuuccccacccccuauaucugugacucggccugagugaccucgccagugucucugcaccuaugcugcccuucuccaucaccuccccccuucucagauucgaccaguccuccgggccgcgcggacccugagcaaguggccaagcaagaagaugccucggccgggccgcaacacguacagcgaccagaagccgcccuacucauacaucucgcugaccgccauggccauccagagcucuccggagaagaugcugccgcucagcgagaucuacaaguucaucauggaccgcuuccccuacuaccgggagaacacgcagcgcuggcagaacagccugcgccacaaucucuccuucaacgauugcuucaucaagaucccgaggcggccagaccagccgggcaagggcagcuucugggcgcugcaucccagcugcggggacauguucgagaacgggagcuuccugcggcgucgcaagcgcuucaaggugcucaagucagaccaccuggcgcccagcaagccggcggacgccgcgcaguaccuccagcagcaggcuaagcugcggcucagcgcgcuggccgccucgggcacgcaucugccgcagaugccggccgcugcguacaaccugggcgguguggcgcagccuuccggcuucaagcaucccuuugcuaucgagaacaucaucgcuagggaguacaagaugccuggggggcuggccuucucugccaugcagccgguuccggcugccuauccucucccuaaccaguuaacuaccaugggcagcucucugggcacuggauggccacauguguacgguuccgcggguaugaucgacucagccacccccaucuccaugacuaguggcgacuacagcgccuauggagugccgcugaagccgcugugccacgccgcgggccagacguugcccgccaucccagugcccaucaagcccacgccggccgcagugcccgcgcugccagcucugcccgcacccauccccacccugcucucgaacucgccgccuucgcucagccccaccuccucgcagacagccaccagccaaagcagccccgccaccccuagcgagacacucaccagcccggccuccgccuugcacucgguggccgugcacugacccaaggaagcuggggcuccgucuugguccacaccaccccucucaacacuucccugcuccggguccagcccuccgcgaccuaaaaccgccaccccgacuugcccauucuaccuucuucaguccucgcucuuagaagaacuuuugguuuuggaaccagaagacaaaccacaaacuugccggaaggcgugugaaaguugucuucggucccucuagggcaccagagaaaacaggggcuaauccaagccaagcggucccuccugggacccugaaaugcacucccauccaacaggcagaacacccugacucccuccugcucggagaaaacagaaacaaaacaaaacaaaacaaaacaaaacaaaacaaaacaaaacaaaacaaaacaacaaaacuacucgucuucugagcuuggagaggcauagcucuggacucugcgcaauuucaag

SEQ ID NO: 10413 - RNA, 2501 nt, Mus musculus
gaggguggcggggagcgcggagcaggacauugcgcccuugcgcccugcacagguugcgcagagccagcuagucuugggccucggagggcagcgggaagcgcggggcccgagcugcggggcgcgggcgggagacgcagggccggggguacugggccuuggagggcgcgaggugagugcagggccuggcgcacacggccccggagcgcagcggagccuuccagcgaggccgcggccccgaaacccugugcgggugcgggugagggugcggggcuccgcgcgcccuggguccccgcccccgaagcccggccccgugcugggcuguggagcacaggcagggcggggaggccucggggccgcgccacgucccccgagcggccgcugcaggccgggggcuuuuguguccgcggaggccgcgucucccccgcgcgcgggcggagcgcagcgcagcgcggcccagggcgcgcgucuccucccggccgggcgcgggcgccgcccccaggccgcggcccugagcccggcggagcccggcggagcccggcuaagccccgcgagcgcacggagccccgaggccucggcugccucccaaacuuuucaaagucggcccgcggcucggccggccugggcuccgagcucggccgggaggacuccagggaccgagaggaggacccggaggaucaggaggaggacccagaggaggaggggccgccgcaucaaagacaccggcuucccgcggcccgggggcgagccaugcgcggcggucgguaaugucagcggaacaggacaaggagcccaucgcgcugaagagaguuagagguaacggagcuggguugggaggacugagggagcucgggcccgugaggaagccaccggggcgacccgggccuaagugcgcggcuccaggcgcccgggguccccacuuugugugcagacgugcagcgcucagcaucccuuccuacccggcuccucuccugcuccccaccacacagcacaauagacaccucggggugaaaaagagacacccgcgaacaauacccacccccccagaaaacuaaguugcacugccagagaguugaggcgcuuggcggaaucaccucccuccaaaaggcaaacacauauucaguauauuuucuuuuaguugagagagaggaacuagauacauucagaaggcguuuucuuuauuaaccaauaagauuaagaaucaaaucauacaaaaacagcuuccugcaucauugguuuucuuccuugccuuacugucucagagaaaacagagagaagggcguacuaaacaaaagguacugcauguaaguuuaaaacacacacacauacucacuaccacauaccaucuggagauuuggagauaccugccagcccuuauuuccagcuccggguggguuucucagucugggagucucaaaguuuguucauugugcaaauauuuguugaacauguacuagguacuaaguacugugcuuggcauggguuaaaacagugaauaaagaauuuagauguucuuuacacaggagugcaccucucaguaaacaauauagaugguaaaguacugugcaaaauaccaaagcagggaauggggguagaaaagacuuccagggagcgaaggccaggaguguguagaaggugaccuggaaggugggcugaaaggaagaugacacaaucccugucuuaccuggggagaaggcacuccaggcaaagggaaccagagaugcaaaggcuuuggguuugguuugccuguguauccaagccgugccaaggcagcuaugguaacuuguggcaaggugagccaggaugagccgggacagccaggugugaugggcugagggugggugugucuugagagucauuaaggcuuugucuuuugcuaggcacggugggcaggccuuuagcuccaacacugcugaggcagaggcagguggaugucugugaauuugagguuagcaugaucuauacuaguaaguugcaauccagcuauugagacccugucaaagaagaaaaaaaaaaaaaaagaaggcgccgggugugguggugcacgccuuuaaucccagcccuugggaggcagaggcaggugaauuucugaguuccagcuagggguacagagagaaacccugucucaaaaaaaacaaacaaaagaaggaggaggaggaggaggaagaggaggaaggcagacaggcagacagauuuuggcuuuuacucugagaugggaacugcacaguuuuucagaaaagcaguauuggguuccuaagggguuugucuggguguugugcagaaaaucagacugaggggaaugacugaagcagagaggcuacugcguaaccuuuccauccaccgccccccaaaaggauaaagugcacauaagucggcaacauuuccuuuugccuuaugugaccacggacauccauugaugucuugguucagugugacuuccgcaugcacaugaccccagugcaguggcacccauguucuucucucaaauguuuagggagaauucu

SEQ ID NO: 10414 - RNA, 2501 nt, Mus musculus
agaauucucccuaaacauuugagagaagaacaugggugccacugcacuggggucaugugcaugcggaagucacacugaaccaagacaucaauggauguccguggucacauaaggcaaaaggaaauguugccgacuuaugugcacuuuauccuuuuggggggcgguggauggaaagguuacgcaguagccucucugcuucagucauuccccucagucugauuuucugcacaacacccagacaaaccccuuaggaacccaauacugcuuuucugaaaaacugugcaguucccaucucagaguaaaagccaaaaucugucugccugucugccuuccuccucuuccuccuccuccuccuccuucuuuuguuuguuuuuuuugagacaggguuucucucuguaccccuagcuggaacucagaaauucaccugccucugccucccaagggcugggauuaaaggcgugcaccaccacacccggcgccuucuuuuuuuuuuuuuuucuucuuugacagggucucaauagcuggauugcaacuuacuaguauagaucaugcuaaccucaaauucacagacauccaccugccucugccucagcaguguuggagcuaaaggccugcccaccgugccuagcaaaagacaaagccuuaaugacucucaagacacacccacccucagcccaucacaccuggcugucccggcucauccuggcucaccuugccacaaguuaccauagcugccuuggcacggcuuggauacacaggcaaaccaaacccaaagccuuugcaucucugguucccuuugccuggagugccuucuccccagguaagacagggauugugucaucuuccuuucagcccaccuuccaggucaccuucuacacacuccuggccuucgcucccuggaagucuuuucuacccccauucccugcuuugguauuuugcacaguacuuuaccaucuauauuguuuacugagaggugcacuccuguguaaagaacaucuaaauucuuuauucacuguuuuaacccaugccaagcacaguacuuaguaccuaguacauguucaacaaauauuugcacaaugaacaaacuuugagacucccagacugagaaacccacccggagcuggaaauaagggcuggcagguaucuccaaaucuccagaugguaugugguagugaguauguguguguguuuuaaacuuacaugcaguaccuuuuguuuaguacgcccuucucucuguuuucucugagacaguaaggcaaggaagaaaaccaaugaugcaggaagcuguuuuuguaugauuugauucuuaaucuuauugguuaauaaagaaaacgccuucugaauguaucuaguuccucucucucaacuaaaagaaaauauacugaauauguguuugccuuuuggagggaggugauuccgccaagcgccucaacucucuggcagugcaacuuaguuuucuggggggguggguauuguucgcgggugucucuuuuucaccccgaggugucuauugugcugugugguggggagcaggagaggagccggguaggaagggaugcugagcgcugcacgucugcacacaaaguggggaccccgggcgccuggagccgcgcacuuaggcccgggucgccccgguggcuuccucacgggcccgagcucccucaguccucccaacccagcuccguuaccucuaacucucuucagcgcgaugggcuccuuguccuguuccgcugacauuaccgaccgccgcgcauggcucgcccccgggccgcgggaagccggugucuuugaugcggcggccccuccuccucuggguccuccuccugauccuccggguccuccucucggucccuggaguccucccggccgagcucggagcccaggccggccgagccgcgggccgacuuugaaaaguuugggaggcagccgaggccucggggcuccgugcgcucgcggggcuuagccgggcuccgccgggcuccgccgggcucagggccgcggccugggggcggcgcccgcgcccggccgggaggagacgcgcgcccugggccgcgcugcgcugcgcuccgcccgcgcgcgggggagacgcggccuccgcggacacaaaagcccccggccugcagcggccgcucgggggacguggcgcggccccgaggccuccccgcccugccugugcuccacagcccagcacggggccgggcuucgggggcggggacccagggcgcgcggagccccgcacccucacccgcacccgcacaggguuucggggccgcggccucgcuggaaggcuccgcugcgcuccggggccgugugcgccaggcccugcacucaccucgcgcccuccaaggcccaguacccccggcccugcgucucccgcccgcgccccgcagcucgggccccgcgcuucccgcugcccuccgaggcccaagacuagcuggcucugcgcaaccugugcagggcgcaagggcgcaauguccugcuccgcgcuccccgccacccuc

SEQ ID NO: 10415 - RNA, 2501 nt, Mus musculus
uuaaaaaaaaaaguccccccccccgcuuuuucauacauauacagaaacuaccaauauauaccuaccgaugugugaaugugcauguguguguguguguguguguguguguguaggcacgcgaacgcuugccauuuuccuaaacuucugacucaucgucuggaggacaaugauugacuuuuccucaguucacauagcugcccuggaugccgcucacaaggaugggccugcuuauucacuccgggcaucccugguagagcgcuagaguaaacaaaccccagguucccgguggcgggggaaaugggcucccuauguucucccuggggagcaggaaaguuggggccagguuguggccaccgcgugcagagaccgcuuuucucagcaacgggacagcgcgacguuagccugggagaagccagaagcgccauugugaugcagcgggauggguggagccaucaagucucaauuuagaucccucugcuuuuaggcgcgcccauuucagauugcuaaacccuggugugaagcgggacaggccagggcaggagguggccaaccacaccccgcagggcgcgcacuuggcgggcugcagaccccacgggcagacgccgagaugcgcagucggaggcuccugagcgcggcccaccuucucugcuugugcgcggucgcgcuggccgccccaggguaggagcgcgggcuggagggcgcccgcgcaggggaugcgcgcggcaugugggacccgccaggggggcuuucuuuaggguccuugugcugcgacaacuugucaaagaacgucguucuagcuguaguucacgcugcucugccuuuugccucgcaacuuguugcuccucaauaauguaccucuuuuucagagacuuuuuuuuuucuaaacuggauguuucuaccgugacacugucagugugacugaggugaccggaguaggaugagaaugcuauaucaaagacuguaggaagauuaacaaaaauuagacuguauaaauugcuccauuucuuaagugguuuuuuuuuucccccagcaaagaaaucguuauuuuuacguguguguguucauuuguagcucaggcugggcagucuucaguuuugaguggcaggagucuaggcgugcaauuaccacacccggccuccuugggggacuuucauguuuccuaacucggagauuucauugcuggguauuuauuuucagguggucagguggugauuucaauuaaugggacuaguuagaugacccccccccccguuauauagauuugagcaggcugaaucauaaaucuaggggugugugugugcacacaugcgcucgugcgcgugcuuccuaagaaaauaauguggagaugaagucaccuuaacgaggcuuggagacuugcauuuugcaguggcuuauuuuucccuucuggcuccugugccuuugaacuguuugaggaauuaugguuuccguagcauuucauggccuuacgaaacagcagaggcaccacguucacuguaaauaguguaguggagcagugcagagaucccccacccccuuucagaaaucgaagugggguguguguaaauaagauacuuugcuuuucuuuuguuggcaacucuuuaggucccgcuuucuggugacagccccagggaucaucagacccggagcaaaugugacuauugggguggaucuccuggaaaauagccccccacagguccuuguaaaggcucagguguucaagauagcuuccaacaaaucgagauccauccuggaagcagaaggagucuuucacagagguaagagaaacugcacugucuaacagucacacuuggaauaugguaauagagcccugggcuaggcaacacaacagaggagcacaaacaaguuugcagugauuuccacagugccccuuugcaaauuagccgugacuuccacaggugccuguuugauucuaacaccugugaagucugaaauuguccccgaguguuccaacaaguggacaaagagccagauuccuuccguguguggcugcaucgaaucagacugcaggggaagaacauccggaguuuccuacgugggagguguuugugggccuggccuggaaacucugcuugccaccauugcucauauacagauggccaggagggugggaaaugcaggccagugucuacccagagaaugggcagagauagaugccugucucacagaacaccaugguuauugggugcaguggauuuuauuaaguaagccagugggaaggaaagaagagcgacauaauucaguuuuauagaacagcagcagcagcaacaaaaccuaaauaaacaaacaaacgaacaaagaaaaacaaacuccaguagcuuagaggugaugugagugugggagggggaagagagccuugugaaaaguguuggccaauuauagagaaccaacaucuuuuguuucaagcuugaguucuaauuauggucaggaguaucuuuuuuuuucuuucuacuauuaagggaaaauuaaaccuagggacuauu

SEQ ID NO: 10416 - RNA, 2501 nt, Mus musculus
aauagucccuagguuuaauuuucccuuaauaguagaaagaaaaaaaaagauacuccugaccauaauuagaacucaagcuugaaacaaaagauguugguucucuauaauuggccaacacuuuucacaaggcucucuucccccucccacacucacaucaccucuaagcuacuggaguuuguuuuucuuuguucguuuguuuguuuauuuagguuuuguugcugcugcugcuguucuauaaaacugaauuaugucgcucuucuuuccuucccacuggcuuacuuaauaaaauccacugcacccaauaaccaugguguucugugagacaggcaucuaucucugcccauucucuggguagacacuggccugcauuucccacccuccuggccaucuguauaugagcaaugguggcaagcagaguuuccaggccaggcccacaaacaccucccacguaggaaacuccggauguucuuccccugcagucugauucgaugcagccacacacggaaggaaucuggcucuuuguccacuuguuggaacacucggggacaauuucagacuucacagguguuagaaucaaacaggcaccuguggaagucacggcuaauuugcaaaggggcacuguggaaaucacugcaaacuuguuugugcuccucuguuguguugccuagcccagggcucuauuaccauauuccaagugugacuguuagacagugcaguuucucuuaccucugugaaagacuccuucugcuuccaggauggaucucgauuuguuggaagcuaucuugaacaccugagccuuuacaaggaccuguggggggcuauuuuccaggagauccaccccaauagucacauuugcuccgggucugaugaucccuggggcugucaccagaaagcgggaccuaaagaguugccaacaaaagaaaagcaaaguaucuuauuuacacacaccccacuucgauuucugaaagggggugggggaucucugcacugcuccacuacacuauuuacagugaacguggugccucugcuguuucguaaggccaugaaaugcuacggaaaccauaauuccucaaacaguucaaaggcacaggagccagaagggaaaaauaagccacugcaaaaugcaagucuccaagccucguuaaggugacuucaucuccacauuauuuucuuaggaagcacgcgcacgagcgcaugugugcacacacacaccccuagauuuaugauucagccugcucaaaucuauauaacgggggggggggucaucuaacuagucccauuaauugaaaucaccaccugaccaccugaaaauaaauacccagcaaugaaaucuccgaguuaggaaacaugaaagucccccaaggaggccgggugugguaauugcacgccuagacuccugccacucaaaacugaagacugcccagccugagcuacaaaugaacacacacacguaaaaauaacgauuucuuugcugggggaaaaaaaaaaccacuuaagaaauggagcaauuuauacagucuaauuuuuguuaaucuuccuacagucuuugauauagcauucucauccuacuccggucaccucagucacacugacagugucacgguagaaacauccaguuuagaaaaaaaaaagucucugaaaaagagguacauuauugaggagcaacaaguugcgaggcaaaaggcagagcagcgugaacuacagcuagaacgacguucuuugacaaguugucgcagcacaaggacccuaaagaaagccccccuggcgggucccacaugccgcgcgcauccccugcgcgggcgcccuccagcccgcgcuccuacccuggggcggccagcgcgaccgcgcacaagcagagaaggugggccgcgcucaggagccuccgacugcgcaucucggcgucugcccguggggucugcagcccgccaagugcgcgcccugcggggugugguuggccaccuccugcccuggccugucccgcuucacaccaggguuuagcaaucugaaaugggcgcgccuaaaagcagagggaucuaaauugagacuugauggcuccacccaucccgcugcaucacaauggcgcuucuggcuucucccaggcuaacgucgcgcugucccguugcugagaaaagcggucucugcacgcgguggccacaaccuggccccaacuuuccugcuccccagggagaacauagggagcccauuucccccgccaccgggaaccugggguuuguuuacucuagcgcucuaccagggaugcccggagugaauaagcaggcccauccuugugagcggcauccagggcagcuaugugaacugaggaaaagucaaucauuguccuccagacgaugagucagaaguuuaggaaaauggcaagcguucgcgugccuacacacacacacacacacacacacacacaugcacauucacacaucgguagguauauauugguaguuucuguauauguaugaaaaagcggggggggggacuuuuuuuuuuaa

SEQ ID NO: 10417 - RNA, 2501 nt, Mus musculus
aggguuagggcagcuuuccucauccgaguguaaauugcauuuuacaugucugaugagcaggcaagccaaauugcccagagcuccuuuuuaugaagccaauauuaaaauuuuggcgcagcucugggaucuaagggguuuuaguaaugucuucucccccuaauuaacaacaaacccuuuccuacauuagucaaaauuuguaaagauuaaaaaagcauaaaugcuucauuguugucgucacccggccauaacgcugauaugauaauuuagaaugcaguccgcaguugugcucacgaaaaguuaaagagugguaaccuacccacaaaaaucggugugcaguauuugggggggggggggguguuaaaagggugaacaaaaaacuugaguuagucuagucuuagucuagugcgccaccuaucggcuuccugucucagcaucaagaaugaaucacuucucuuugggguaucugaugaauaacucagccaucucagccagccaagaauuccguucguauacguuuuaaagaaaaacuucucucuccuucuuagccaaaacauuuaucggagugcuuagcaacacuucauugagcauucucagacauagaugucugaaagcgguagcccuuacguggcaguaggauuucccucacuuccccucaugaaugaaaaugaaucaacugcccggagugggggcacuaugggaacuggucucuuucggacaacuugccccucccccaccccuugcuggaaggagccaacuucuuaacucucucaauuuaacuuuuuuuuucaaacgcacacacaggcacacaaauguuucgugggcccaucuagaguccaggcgucaccuacgucuucuauaaaggcuaccuagccaaggacgagcuuagacuuguuucuucgccccccucccccaauccuaccccaguauucuuuagaagacccuaaccuuggagcugagaggagguguaugccaaagaucugaauuggucaggggaugguggcugaggaagccagaugcaggucccauuugucaacugcucucaaaugcacugacuccacgcacucugaucugugcacucaaagacuggaggagaacccuccucaaaggucccauugacugacccuggguaaaacuuaaucccagugcauucaggaggaacccaaaaaggaagucucagaagcugcgagagcuggccuaacccagcagcacuuugaaagcaguggaggauggagccagggcagcucccccgagcaucuggagaugccacuagcgccuagucuccccaagcuggagcgcuuuccacuggcccuccauggaauucuucgcggagcguacaguacuucacuucguuuucuggcaaugccuugagucccugcugcaagccuggagucccuggcaaagccaccagauuauaaagagcgaccuaugcagcccgugcacuucacugaaagcgacagagacuauagaggacauugcccuacagauggauacacugagucccacuuggcacacaagcaagccaccuuuccuucucccuccaaaacuccaaagaaaccgccaaacuccugugccacagaucuaucucgggcacacuaaucaaucgcuuccaaagccaagcagccccugcugggcauucugccagccccggguuaaggugcaagcaagaagccacuuuccccaguuaucuuugggaaagggcgcgagggguggggguugggguggggaacagaagccagacugaccugagccggaggugacagagggagcgggcguccagcagccugcgcgugggaccccccgggccugggagggcgcugcgcuccgggagcaccuggcggccgccgguguggaaaaggcgaugggagcacccagcagcagcgccuagugcgcagagugagcggaggcagggggacugaaugcagcugcgggcggacgcgucugcagcggccgccuuugccgacugggaagagacuccgcgccgcgggcuacuuaauagagggcuguucccggcucucaguuuacucgguuacgaaacgccugagaagguggaaggcugccacgggugauguaugcuccucggcggugaaggaggucuacuuuugggaacgugugcauacuucgagcauuccuucggcgugagguggcgaucgccguaguagcaaugccccuccgggggcggggaggagggagggagagagggggacagccgcagccggguucccugccaagggaggccgcggacuccuccgcuuggggcgggcuagggggcucggguuucccuaacccaacgaguuucuuuaauacguuuauuuuucuaaaauaagaacaauggagaaguggggaacggaucuucguuucagagcagcgggaugggcauccccuuugucccucaccauugcaucuccggccgccaccguccccacguccaccuuccucccccucuguccugggugcacuuaaaaccgauuuacaggcuuuccauuaacuaacugucugugcac

SEQ ID NO: 10418 - RNA, 2501 nt, Mus musculus
gugcacagacaguuaguuaauggaaagccuguaaaucgguuuuaagugcacccaggacagagggggaggaagguggacguggggacgguggcggccggagaugcaauggugagggacaaaggggaugcccaucccgcugcucugaaacgaagauccguuccccacuucuccauuguucuuauuuuagaaaaauaaacguauuaaagaaacucguuggguuagggaaacccgagcccccuagcccgccccaagcggaggaguccgcggccucccuuggcagggaacccggcugcggcugucccccucucucccucccuccuccccgcccccggaggggcauugcuacuacggcgaucgccaccucacgccgaaggaaugcucgaaguaugcacacguucccaaaaguagaccuccuucaccgccgaggagcauacaucacccguggcagccuuccaccuucucaggcguuucguaaccgaguaaacugagagccgggaacagcccucuauuaaguagcccgcggcgcggagucucuucccagucggcaaaggcggccgcugcagacgcguccgcccgcagcugcauucagucccccugccuccgcucacucugcgcacuaggcgcugcugcugggugcucccaucgccuuuuccacaccggcggccgccaggugcucccggagcgcagcgcccucccaggcccggggggucccacgcgcaggcugcuggacgcccgcucccucugucaccuccggcucaggucagucuggcuucuguuccccaccccaacccccaccccucgcgcccuuucccaaagauaacuggggaaaguggcuucuugcuugcaccuuaacccggggcuggcagaaugcccagcaggggcugcuuggcuuuggaagcgauugauuagugugcccgagauagaucuguggcacaggaguuuggcgguuucuuuggaguuuuggagggagaaggaaagguggcuugcuugugugccaagugggacucaguguauccaucuguagggcaauguccucuauagucucugucgcuuucagugaagugcacgggcugcauaggucgcucuuuauaaucugguggcuuugccagggacuccaggcuugcagcagggacucaaggcauugccagaaaacgaagugaaguacuguacgcuccgcgaagaauuccauggagggccaguggaaagcgcuccagcuuggggagacuaggcgcuaguggcaucuccagaugcucgggggagcugcccuggcuccauccuccacugcuuucaaagugcugcuggguuaggccagcucucgcagcuucugagacuuccuuuuuggguuccuccugaaugcacugggauuaaguuuuacccagggucagucaaugggaccuuugaggaggguucuccuccagucuuugagugcacagaucagagugcguggagucagugcauuugagagcaguugacaaaugggaccugcaucuggcuuccucagccaccauccccugaccaauucagaucuuuggcauacaccuccucucagcuccaagguuagggucuucuaaagaauacugggguaggauugggggaggggggcgaagaaacaagucuaagcucguccuuggcuagguagccuuuauagaagacguaggugacgccuggacucuagaugggcccacgaaacauuugugugccugugugugcguuugaaaaaaaaaguuaaauugagagaguuaagaaguuggcuccuuccagcaaggggugggggaggggcaaguuguccgaaagagaccaguucccauagugcccccacuccgggcaguugauucauuuucauucaugaggggaagugagggaaauccuacugccacguaagggcuaccgcuuucagacaucuaugucugagaaugcucaaugaaguguugcuaagcacuccgauaaauguuuuggcuaagaaggagagagaaguuuuucuuuaaaacguauacgaacggaauucuuggcuggcugagauggcugaguuauucaucagauaccccaaagagaagugauucauucuugaugcugagacaggaagccgauagguggcgcacuagacuaagacuagacuaacucaaguuuuuuguucacccuuuuaacaccccccccccccccaaauacugcacaccgauuuuuguggguagguuaccacucuuuaacuuuucgugagcacaacugcggacugcauucuaaauuaucauaucagcguuauggccgggugacgacaacaaugaagcauuuaugcuuuuuuaaucuuuacaaauuuugacuaauguaggaaaggguuuguuguuaauuagggggagaagacauuacuaaaaccccuuagaucccagagcugcgccaaaauuuuaauauuggcuucauaaaaaggagcucugggcaauuuggcuugccugcucaucagacauguaaaaugcaauuuacacucggaugaggaaagcugcccuaacccu

SEQ ID NO: 10419 - RNA, 2501 nt, Mus musculus
aaacaaagcagccugcagacuuuggcacuagcacacaucauguuuugaguuguuaagagcuguggauugacgaucacuaaacaggaauuaaaaaaauuagaaaucugcagaaaacaaacaaucuuagguguugauucugaguaucacuccccuucucccaugcccacccaccacccccauauaauuuuugauuguaauaaaaauagagaucuuagcaucagaauuuugcuguuaacucuucaagguugcucugugccguccaagccacauucaguguuugaagcaccaaauccacaaguuucuccgaccaaauuuaaauaaauaaaugaagacugaaggaugccaaaguguuuaaaacuuaagcuguaacacagaguucuccccagagcauagaguauuaauugucaaguucaaguacugccaggcuguauguagaggugucucaggccucagacaacaucuacaagugcuacuggcuuagagggcaacaacauccaugauacaaaacggggcagggauacccauccaucaccaauguuaaaaaguugcaaccuuuugugugaauggcugcuggaggaucugugcugagcccggacuuugaguggaggaagcuaaguuccucggguauggaagcuuuacaguaguuugcguuguucacauuccagagugcucucucagagaagcuaggcuucugccggggccucugaggauccauugcccuugcccagaagagagagccuugcuuccacccaguaacagggaaagaagauuugaccuaccugugaaaagacccaacuugguccccaaaggucgcuuaggcgaccccacugccauugacaagucaaccugcgcacuuaaagcguaucaguuuguggaacgcuuguuugaaguccucauuggacaugguguagaugaugggguugaugagggaguuaagauagccuaaccaauugaagaagucaaaaauggccaugugaaaccagcaggcauccuuacagauaggcaucaccagggagaugaugaagaagggcagccaacacacaauaaaugcuccuaaaaugaucccuagggucuugguggcuuugcgcucccuagcggccaugaguuucuucuuuuccagcagggcgucugagacucgcacuuugacuugguucacguacacaggagacccggacucacugggcacguccggagcccgggaguuaauggaggugaccgaggauguggaucccggggagucuguuaucaacugggcucgggucaagcgcuugccggucuuguugggugucuguuucaaaauccgagagcgggcuuccacauagaugcggccauagagggcgaugaggagcaggguggguaaauagaaagcgcccaccguggaguagaccguguagaggacguggucgguguucacaaagcaguccagcaucuccuccucugcuuuggcuugacgccagaagaaggguggcaacgaaauagagauggagaagacccacaccagcacgaucaugauggccgcccuuuugggaguccuuuuagcagaauacuccaccgcaucggugauggcccaguagcgguccagggcgaugacacagagaugcaugauggaagcagugcaacaggugauauccgacgacagccagaagucgcagaccaccuggccuaguguccagcguccagugaccguguacauggugcugaugggcaucaccaggauggacacgagcaggucagugacugccagagaggcgaucagguaguuagccgggguguguagcuuccggguccgauacaccguagcgauuacaaaggcguuggagagcgugguggccaaggugaugagcgccaacaaagcaaccagcaggacuuuccagggcagggcgauggaguccugguaaauguagccgucggcgcugcaguugugggagagguuggugagagguaccccugucugggaggcggcgggaggcggcggggcgcacugaauacccugcuccuccauagcucuccucguccuggcugcggagcgcagcucuugaacauggagcggaccagggaaagaacagaggacgggaggaucauggagacuauaggcuugucuccuuuggcuagccaguuccgugggcuccucaguaacuccuccgccuguguucucagcccaaaggagaggucacaggcgcggccaccaagccugcgggcgcguccccugcacuuccagugcgccaggcgcugcugccgcgucugcuagcuccucuccacuccccgucuucgcccgggugaauaaagcacuggcccacccaguccagcuucucucagguucccuggaggcaaacaguggagaaggacuaaguaucgcuuguagaggggucucggggucuagugggaccucuuaccccaauugcucaggucucagcuucuccuaacccgggcgcuccggaaucugcagacuccgcccgaaggaguuugcuggcugugcagaccgaagcuugcaggccagugca

SEQ ID NO: 10420 - RNA, 2501 nt, Mus musculus
ugcacuggccugcaagcuucggucugcacagccagcaaacuccuucgggcggagucugcagauuccggagcgcccggguuaggagaagcugagaccugagcaauugggguaagaggucccacuagaccccgagaccccucuacaagcgauacuuaguccuucuccacuguuugccuccagggaaccugagagaagcuggacugggugggccagugcuuuauucacccgggcgaagacggggaguggagaggagcuagcagacgcggcagcagcgccuggcgcacuggaagugcaggggacgcgcccgcaggcuugguggccgcgccugugaccucuccuuugggcugagaacacaggcggaggaguuacugaggagcccacggaacuggcuagccaaaggagacaagccuauagucuccaugauccucccguccucuguucuuucccugguccgcuccauguucaagagcugcgcuccgcagccaggacgaggagagcuauggaggagcaggguauucagugcgccccgccgccucccgccgccucccagacagggguaccucucaccaaccucucccacaacugcagcgccgacggcuacauuuaccaggacuccaucgcccugcccuggaaaguccugcugguugcuuuguuggcgcucaucaccuuggccaccacgcucuccaacgccuuuguaaucgcuacgguguaucggacccggaagcuacacaccccggcuaacuaccugaucgccucucuggcagucacugaccugcucguguccauccuggugaugcccaucagcaccauguacacggucacuggacgcuggacacuaggccagguggucugcgacuucuggcugucgucggauaucaccuguugcacugcuuccaucaugcaucucugugucaucgcccuggaccgcuacugggccaucaccgaugcgguggaguauucugcuaaaaggacucccaaaagggcggccaucaugaucgugcuggugugggucuucuccaucucuauuucguugccacccuucuucuggcgucaagccaaagcagaggaggagaugcuggacugcuuugugaacaccgaccacguccucuacacggucuacuccacggugggcgcuuucuauuuacccacccugcuccucaucgcccucuauggccgcaucuauguggaagcccgcucucggauuuugaaacagacacccaacaagaccggcaagcgcuugacccgagcccaguugauaacagacuccccgggauccacauccucggucaccuccauuaacucccgggcuccggacgugcccagugaguccgggucuccuguguacgugaaccaagucaaagugcgagucucagacgcccugcuggaaaagaagaaacucauggccgcuagggagcgcaaagccaccaagacccuagggaucauuuuaggagcauuuauuguguguuggcugcccuucuucaucaucucccuggugaugccuaucuguaaggaugccugcugguuucacauggccauuuuugacuucuucaauugguuaggcuaucuuaacucccucaucaaccccaucaucuacaccauguccaaugaggacuucaaacaagcguuccacaaacugauacgcuuuaagugcgcagguugacuugucaauggcaguggggucgccuaagcgaccuuuggggaccaaguugggucuuuucacagguaggucaaaucuucuuucccuguuacuggguggaagcaaggcucucucuucugggcaagggcaauggauccucagaggccccggcagaagccuagcuucucugagagagcacucuggaaugugaacaacgcaaacuacuguaaagcuuccauacccgaggaacuuagcuuccuccacucaaaguccgggcucagcacagauccuccagcagccauucacacaaaagguugcaacuuuuuaacauuggugauggauggguaucccugccccguuuuguaucauggauguuguugcccucuaagccaguagcacuuguagauguugucugaggccugagacaccucuacauacagccuggcaguacuugaacuugacaauuaauacucuaugcucuggggagaacucuguguuacagcuuaaguuuuaaacacuuuggcauccuucagucuucauuuauuuauuuaaauuuggucggagaaacuuguggauuuggugcuucaaacacugaauguggcuuggacggcacagagcaaccuugaagaguuaacagcaaaauucugaugcuaagaucucuauuuuuauuacaaucaaaaauuauauggggguggugggugggcaugggagaaggggagugauacucagaaucaacaccuaagauuguuuguuuucugcagauuucuaauuuuuuuaauuccuguuuagugaucgucaauccacagcucuuaacaacucaaaacaugaugugugcuagugccaaagucugcaggcugcuuuguuu

SEQ ID NO: 10421 - RNA, 2501 nt, Mus musculus
agagcaaugagagggcguucgggacuccaacucucuccagacuuaaugacauugguccuauaagcauuccagucguuucccuaauccaucauccggcgccugccagcgcccccugggagacagacuuugggacaaacuucuuucccaggucagcccgcccaccucccgccgcgagcgcucccugcguaagugacuugugcugacacaacgcaccgcaucugguguagggagcuuuccgggugacucacgucuuugcaauuugcuuuuguuucugggguguuuuagcugcaauuuucuucccucugguuuuaauuuugagaggaggggggaaaaaaccacccauaaugaaucaagaaugaguguccuuuccaguaacccucccccacuuuaaaguugacugucuuuacaaguuugauaacuacccuagacgugcgggggcggcacagguaggaaggcauuaacuaacuaccucauaaacugaaguugccagccaaaccgagccacgagagaggagacuuucugaaucucccucacaacccaggcguuugccgcggcggauguaaccugugcagcuccuucuucuacugcugcuuugcucacgcuuaaaucccucuccucacugccagcggugccagaagcagcgugaauuccaagagguccaccagcgguuuuguuucuguccgagguaaauacgcuaugcaaaauacggaaccaccaaaggaugccggggagggggaacagaaggggaaucccucaccuucucgggaugcguugcucauuuaucuccgccuaggggagucgcccagccuagguugccccucguaucccucccugaagccccuaccuggggcagcagagguggccagcgcggcggcgaucucuccugcagcccuggcccucccccgccccccggcuugguuuuucccagccguggagguugggccaggggcugggguugagaggagagucggcgcccgcagcaggagcugggaaggcgcguggacucggguggcccucggaguuggcuuugcaggcgcggggugcggaggugagcaguggggaccgagcggccagguuuggagccuggaggcgggaccaggguuccuuucuauacuagggcgugaagagagccggggggggggggguccuggcugccacaccgcccacggucccacggccgcuuuguuggcggguucccuccguuuuucuggagaugucuggauccucucgggaucggggagcuggguggccaggaacuggggagucgagaguaggcgacagcuguacggcucugcuccccuuuucacacuaauccaaggagguaccaaaaaaaaaaaaaagcucuuaagagucccguaacccgaaacuucgcucucaucccaaggugggagggggaggagcggcgggggcggggaccccggaaggcagguggucggccggggcgguaggagcugggauccggaaaaaggagaaguuugcucgcuggacaccgcggggucugcgugaaguucuaggcgggaggagggcaauccgggcaggagccaggcgggagguggcccggguccugauggugugggcccggaagagguaggcuuagcgccugggaguggggaccgcgucccacuagggaggaaggacgcacacagaagcuugggccggguugcuaguguggggacuacuugguucguacucggggagcugcggccgucacuccuccucacgcuucucucccgcuugucccaggucgcucauccgauccugcccugagagaggcgccaacaaaggaguugaggaggugccacccaccccagcugcggcgggaggaggagcgccaaggcccgugucccgacccgccgugcguacucacuggagggaagggcggggugccgcuccgggagggggacgcccgguggcucgggguuagccaaguuccagcuuuuggcguccccuccucugcucccacgcgaggaaaguuugccgucgacgcuugcggccggcucgcgcccgccgggcccaggcggucgagucuucggagcgggcgcugucccagcuccggggaaccgcgagccgcgaugccuggggcgggcucccggggccccuccgccggggacggacggcugagguuggcaaggcuggcgcuagugcugcuggguugggucuccgcgucggcccccagcucuucgguacccucgucuuccaccuccccggcagccuuccuggccucggggucugcgcagccuccgccagccgagagaugccccgcggcgugcgagugcuccgaggcggcgcgcacgguuaagugcgugaaccgcaaccugcuggaggugccggcggaucuaccgccuuacgugcgcaaccuuuuccuuaccggcaaccagaugaccgugcucccggcgggcgccuucgcccgccagccgccgcucgccgaccuggaggcgcucaaccucagcggcaaccaccugaaggaagugugugcaggugccuucgagcaucugccgggu

SEQ ID NO: 10422 - RNA, 2501 nt, Mus musculus
acccggcagaugcucgaaggcaccugcacacacuuccuucaggugguugccgcugagguugagcgccuccaggucggcgagcggcggcuggcgggcgaaggcgcccgccgggagcacggucaucugguugccgguaaggaaaagguugcgcacguaaggcgguagauccgccggcaccuccagcagguugcgguucacgcacuuaaccgugcgcgccgccucggagcacucgcacgccgcggggcaucucucggcuggcggaggcugcgcagaccccgaggccaggaaggcugccggggagguggaagacgaggguaccgaagagcugggggccgacgcggagacccaacccagcagcacuagcgccagccuugccaaccucagccguccguccccggcggaggggccccgggagcccgccccaggcaucgcggcucgcgguuccccggagcugggacagcgcccgcuccgaagacucgaccgccugggcccggcgggcgcgagccggccgcaagcgucgacggcaaacuuuccucgcgugggagcagaggaggggacgccaaaagcuggaacuuggcuaaccccgagccaccgggcgucccccucccggagcggcaccccgcccuucccuccagugaguacgcacggcgggucgggacacgggccuuggcgcuccuccucccgccgcagcugggguggguggcaccuccucaacuccuuuguuggcgccucucucagggcaggaucggaugagcgaccugggacaagcgggagagaagcgugaggaggagugacggccgcagcuccccgaguacgaaccaaguaguccccacacuagcaacccggcccaagcuucugugugcguccuuccucccuagugggacgcgguccccacucccaggcgcuaagccuaccucuuccgggcccacaccaucaggacccgggccaccucccgccuggcuccugcccggauugcccuccucccgccuagaacuucacgcagaccccgcgguguccagcgagcaaacuucuccuuuuuccggaucccagcuccuaccgccccggccgaccaccugccuuccgggguccccgcccccgccgcuccucccccucccaccuugggaugagagcgaaguuucggguuacgggacucuuaagagcuuuuuuuuuuuuuugguaccuccuuggauuagugugaaaaggggagcagagccguacagcugucgccuacucucgacuccccaguuccuggccacccagcuccccgaucccgagaggauccagacaucuccagaaaaacggagggaacccgccaacaaagcggccgugggaccgugggcgguguggcagccaggacccccccccccccggcucucuucacgcccuaguauagaaaggaacccuggucccgccuccaggcuccaaaccuggccgcucgguccccacugcucaccuccgcaccccgcgccugcaaagccaacuccgagggccacccgaguccacgcgccuucccagcuccugcugcgggcgccgacucuccucucaaccccagccccuggcccaaccuccacggcugggaaaaaccaagccggggggcgggggagggccagggcugcaggagagaucgccgccgcgcuggccaccucugcugccccagguaggggcuucagggagggauacgaggggcaaccuaggcugggcgacuccccuaggcggagauaaaugagcaacgcaucccgagaaggugagggauuccccuucuguucccccuccccggcauccuuuggugguuccguauuuugcauagcguauuuaccucggacagaaacaaaaccgcugguggaccucuuggaauucacgcugcuucuggcaccgcuggcagugaggagagggauuuaagcgugagcaaagcagcaguagaagaaggagcugcacagguuacauccgccgcggcaaacgccuggguugugagggagauucagaaagucuccucucucguggcucgguuuggcuggcaacuucaguuuaugagguaguuaguuaaugccuuccuaccugugccgcccccgcacgucuaggguaguuaucaaacuuguaaagacagucaacuuuaaagugggggaggguuacuggaaaggacacucauucuugauucauuaugggugguuuuuuccccccuccucucaaaauuaaaaccagagggaagaaaauugcagcuaaaacaccccagaaacaaaagcaaauugcaaagacgugagucacccggaaagcucccuacaccagaugcggugcguugugucagcacaagucacuuacgcagggagcgcucgcggcgggaggugggcgggcugaccugggaaagaaguuugucccaaagucugucucccagggggcgcuggcaggcgccggaugauggauuagggaaacgacuggaaugcuuauaggaccaaugucauuaagucuggagagaguuggagucccgaacgcccucucauugcucu

SEQ ID NO: 10423 - RNA, 2501 nt, Mus musculus
aaggucuugcugaggucuuugaccuccucaggacuguuaacccgcucauagcccagcacggccaugggcugguagcaaaacuccuccaccuguuugaucugcuggaaggugagcgcgguccgccaggcauuggcggccugaguggcauugcgagcugacaccacgaaaggcuuggaggaggagcccgaaccacuggucauguucagggcaaacugcuccauuucgggacucaccagcagccccacaaagucauauacccuccguagggucuuaacggggucucccaccagauccucguaccucaccaccaaguagugucccugcagccagucaggaggcugcagggcuguuugcagcgucuuggccauacuguugcagaugaccuccauugcacccagagcgugguagucugcugggccacccauacccuccuucuuggcaccaagcuuguggccagcagccuccaggaagggcaugcggugggcucuuggaucccggcuucgcaccaccuguaggcuuucccggaugaggccgugacgcgagcggaugcgggagcuggcaacagcacgaggaucacguacuagguggaugaccuugagguccaaggcuggaucuuuaagcagcggcgccaacacagccacaucgaagacccgcacgcccuugauaaccagcgugcgguacuugcgacacuccuccucgaagcgugccaggcguugaggugggcacuuuuugcacacgcggucguccaccaguccgacgaccuccuugcgguaggcaggacagaguggcgaggagcauaccaccuuguuaguggcugccccaaagaugcccagaguggugagguugcgccccccacugccugcggggcuauacagcuggaaaaccgaaagaucgcagcgguagagagcgcucagcaugucccgcgcugcccccugcagggaaacggcguccccgggguacaguuuuugccacacgugccacacaggcucauagaggaagaacaccucaggguucugguugaagagcucaccgaagaaggacgagcccgagcgccacguggugaacacauacaccaacugccgcuuguccccuccaccccuggugccucgaguagcauugcccagagaggccgcagcuccugcacucccagccgcggcugcgggaacugcccccacgcccgcggcaggagggcgguacggggugcggggguccaugcgagagugagcgcgggguggcgcugcaggaggcgaccccggccguccccagccggccccggccgccccuaccgcggcacccagaggcccgucgggguugcacugcugcagcggcucuuuaugccacuuguaguccaagagguugagcaucgugagcaccaguagcagugcauagcccgcgcacagcaccagcgccuuccugcgaaauaccuucaucccgagcggggacgcaggccagcggcguccugcgcgccggggccacggcgggagcagggcccgcugcacggcggcaggcgcggccggcagcggccggggaagcgcaccggggggcagagcucgcggcgagcugcggcucaucacaggcacagccggggccggcggcgcggcggaggcggcccugcagcccaggagggggacgcugcaggccggcugcgggcgccgggacuggggccgccgauccgaggcgggcgcggcggcagaggcugcugguccccggcgcccagggcuggcucucccauggcagcggcuccgagaaggaccugcgaggggaagcggagugaaugggugagcccagucuccgguccagaugccuccuccgccugaguaacgcccacccucuagucugcgggcuccuccacucaccuggagcggagggugcgccucggagcguccccagauccccgaccggcggacuguccggcuagcacucuccucgguuucucuccgguucucuucugcuagggguccccaagccuucgagggagccgcgagacuccgcugcccuagcccuaggcagaguuuuccagcagcgggcgcccugcaccccgggaggggaaacuuucaccgggcccggagcccagcucugcgcuccaccgagcgcggcgcgucccggcuccagcgacgucuccuuaggucucucgggaccgcugcuucccuccaggcucuggggcacgaagcaggcaggaggcgacagugggggguggcuuacauacgccccagcuccaggcuguucugcucuccaucgcucucucuuggccuccacguagcgaaccuucccaucccuccggcggccgcggauagggugcagcgcggccccgcagcggcggcugcuucuuccaucacccggaggauguccuggcgggcggcucaggcgagccccggcgcuccguggccgcggacuggcccaggacucuguacaccuagcugaaggcaaaagagcgggaccccccacccccgcgucaccagcggcuucugcccuacgaggucccgaggcagaggaagcccccg

SEQ ID NO: 10424 - RNA, 2501 nt, Mus musculus
cgggggcuuccucugccucgggaccucguagggcagaagccgcuggugacgcggggguggggggucccgcucuuuugccuucagcuagguguacagaguccugggccaguccgcggccacggagcgccggggcucgccugagccgcccgccaggacauccuccgggugauggaagaagcagccgccgcugcggggccgcgcugcacccuauccgcggccgccggagggaugggaagguucgcuacguggaggccaagagagagcgauggagagcagaacagccuggagcuggggcguauguaagccaccccccacugucgccuccugccugcuucgugccccagagccuggagggaagcagcggucccgagagaccuaaggagacgucgcuggagccgggacgcgccgcgcucgguggagcgcagagcugggcuccgggcccggugaaaguuuccccucccggggugcagggcgcccgcugcuggaaaacucugccuagggcuagggcagcggagucucgcggcucccucgaaggcuuggggaccccuagcagaagagaaccggagagaaaccgaggagagugcuagccggacaguccgccggucggggaucuggggacgcuccgaggcgcacccuccgcuccaggugaguggaggagcccgcagacuagagggugggcguuacucaggcggaggaggcaucuggaccggagacugggcucacccauucacuccgcuuccccucgcagguccuucucggagccgcugccaugggagagccagcccugggcgccggggaccagcagccucugccgccgcgcccgccucggaucggcggccccagucccggcgcccgcagccggccugcagcgucccccuccugggcugcagggccgccuccgccgcgccgccggccccggcugugccugugaugagccgcagcucgccgcgagcucugccccccggugcgcuuccccggccgcugccggccgcgccugccgccgugcagcgggcccugcucccgccguggccccggcgcgcaggacgccgcuggccugcguccccgcucgggaugaagguauuucgcaggaaggcgcuggugcugugcgcgggcuaugcacugcuacuggugcucacgaugcucaaccucuuggacuacaaguggcauaaagagccgcugcagcagugcaaccccgacgggccucugggugccgcgguaggggcggccggggccggcuggggacggccggggucgccuccugcagcgccaccccgcgcucacucucgcauggacccccgcaccccguaccgcccuccugccgcgggcgugggggcaguucccgcagccgcggcugggagugcaggagcugcggccucucugggcaaugcuacucgaggcaccagggguggaggggacaagcggcaguugguguauguguucaccacguggcgcucgggcucguccuucuucggugagcucuucaaccagaacccugagguguucuuccucuaugagccuguguggcacguguggcaaaaacuguaccccggggacgccguuucccugcagggggcagcgcgggacaugcugagcgcucucuaccgcugcgaucuuucgguuuuccagcuguauagccccgcaggcaguggggggcgcaaccucaccacucugggcaucuuuggggcagccacuaacaaggugguaugcuccucgccacucuguccugccuaccgcaaggaggucgucggacugguggacgaccgcgugugcaaaaagugcccaccucaacgccuggcacgcuucgaggaggagugucgcaaguaccgcacgcugguuaucaagggcgugcgggucuucgauguggcuguguuggcgccgcugcuuaaagauccagccuuggaccucaaggucauccaccuaguacgugauccucgugcuguugccagcucccgcauccgcucgcgucacggccucauccgggaaagccuacagguggugcgaagccgggauccaagagcccaccgcaugcccuuccuggaggcugcuggccacaagcuuggugccaagaaggaggguauggguggcccagcagacuaccacgcucugggugcaauggaggucaucugcaacaguauggccaagacgcugcaaacagcccugcagccuccugacuggcugcagggacacuacuugguggugagguacgaggaucuggugggagaccccguuaagacccuacggaggguauaugacuuuguggggcugcuggugagucccgaaauggagcaguuugcccugaacaugaccagugguucgggcuccuccuccaagccuuucguggugucagcucgcaaugccacucaggccgccaaugccuggcggaccgcgcucaccuuccagcagaucaaacagguggaggaguuuugcuaccagcccauggccgugcugggcuaugagcggguuaacaguccugaggaggucaaagaccucagcaagaccuu

SEQ ID NO: 10425 - RNA, 2501 nt, Mus musculus
cucggguccccaguguccucuagaacgccggcguggcugucgcacuucgaacccccucgcccacccuugcccacccucucgcccugggcgccggcggccgcgucucuggccagccuccggccccgcaucaaucauuaacgcggcggcccgagcggucgcagcccgagaagggggggaugguaggagacgcaagacaggggacaccuccauccccccgccgcggcgcagacacccuaaccccgggggcccccgcccugcgcggcgccgcccucccccgccagcgccucgcgcacaucccgccucccgccgcccgccccgcgcgcacgaugcccagucaccgccgcgccgccgccgccgccaccaccgccaccaccgccgcagucagccgcgccaccgccgccaccgcagcgcggccggccgcgggcugagagacccgagcguggcgaggacgccgccggcaagccgcgcgcgcagcagcagccucccgcccggugcgccgagcccccggagcagcccgcuuccaagccgaggccgcguagccaaccugcggccgcggucccgcgcgcgcgcgcgcgcacaaaggcuccgacggcgcccggcgcccgcgguggccucgcgcgcgcccuagcuaagcccggggcaccaugccgcggcgccugcagcagcggggcgccggcgugaagggaccgccggccucgaccucccggcgcucgcaucccgccuccgccuccgccccccggagcccgccggcggccacgaccaagccgcugcugcgcugggacgaggugcccgaugacuucguggagugcuucauccuguccggcuaccggcggcugccgugcaccgcgcaagagugccuggccucggugcugaagcccaccaaugagacgcucaacuucuggacgcacuucaucccgcugcugcuguuccucaguaaguucugccgccucuucuuccugggcggcagcgaugugcccuuccaccaccccuggcugcugccgcuguggugcuaugcgucgggggugcugcugaccuucgccaugagcugcacggcgcacguguucagcugccugucgcugcgccugcgcgccgccuucuucuaccuggacuacgcuuccaucagcuacuauggcuucggcagcaccguggccuacuacuacuaccugcugcccagccugagccugcuggacgccagggucaugacgccguaugugcagcagcgccugggcuggcacguggacugcacccgccucaucgcggucuaccgcgcgcucgugcugcccguggccuucgugcuggcuguggccugcaccguggcuugcuguaagagccgcaccgacuggugcuccuacccguucgcccugcgcaccuucgucuucgucaugccgcucagcauggccugccccauuaugcuagagagcuggcucuucgaccugcgaggcgagaaccccacacucuucgugcacuucuaccgccgcuacuucuggcuggugguggccgccuucuucaacgugagcaagaucccugagcgcauccagccgggucucuucgacaucauuggccacagccaucagcucuuccacaucuucacuuuccucagcaucuaugaccagguguacuacguggaagagggccugcgccaguuccuccaggcacccccugccgcgcccaccuucucgggcacagugggcuacaugcugcugcuggugguuugccugggacuagucaucaggaaguuccugaacagcaccgaauucugcaguaaaaagugagccuccacccccggaggaggcuaugguuugcccaccgguuugcguggaguuucuguuguuguuguuguuauuguugguuuguuuucaaguuuuguuguuuccuucuuugcuggaagagggugcugcaggccacuagggaaagguucccugacaguuggggaaucccaaguccacuggccuuuagaagagggagaugggaggugaaacagaaggaagagggccuccgggaagaaaauuagggacugucuaugauauccagggauuuuugcaaagacagugaggauugugauuacagauagagccccaagcaguuggcuuuucuaacagucuucugugucccuuagugaaggcagguaugcagugaagaggauaaacacaaaccccuggcugcuucugaggucuagcaaugcuuggauuugucgaaagaauggagcuuucucuguugggaaaugggcacaaagacacaaacccggggcuuaacccgcuagacaaugcauggaaugugaacacaaguuaauuauuucaaaauguguaucagauguuauuuaaaugauaauauauucaaugauuuuuuucauaauuuaucgaagccugugagaugcacuggauuuccuuugucacauaguuuugauuuuugcagccuucugcauugcacacgugaacuggaccuuagggcaagcugcuugagagaguucucgacuacauuuuuaaacaguguucugugaaggc

SEQ ID NO: 10426 - RNA, 2501 nt, Mus musculus
gccuucacagaacacuguuuaaaaauguagucgagaacucucucaagcagcuugcccuaagguccaguucacgugugcaaugcagaaggcugcaaaaaucaaaacuaugugacaaaggaaauccagugcaucucacaggcuucgauaaauuaugaaaaaaaucauugaauauauuaucauuuaaauaacaucugauacacauuuugaaauaauuaacuuguguucacauuccaugcauugucuagcggguuaagccccggguuugugucuuugugcccauuucccaacagagaaagcuccauucuuucgacaaauccaagcauugcuagaccucagaagcagccagggguuuguguuuauccucuucacugcauaccugccuucacuaagggacacagaagacuguuagaaaagccaacugcuuggggcucuaucuguaaucacaauccucacugucuuugcaaaaaucccuggauaucauagacagucccuaauuuucuucccggaggcccucuuccuucuguuucaccucccaucucccucuucuaaaggccaguggacuugggauuccccaacugucagggaaccuuucccuaguggccugcagcacccucuuccagcaaagaaggaaacaacaaaacuugaaaacaaaccaacaauaacaacaacaacaacagaaacuccacgcaaaccggugggcaaaccauagccuccuccggggguggaggcucacuuuuuacugcagaauucggugcuguucaggaacuuccugaugacuagucccaggcaaaccaccagcagcagcauguagcccacugugcccgagaaggugggcgcggcagggggugccuggaggaacuggcgcaggcccucuuccacguaguacaccuggucauagaugcugaggaaagugaagauguggaagagcugauggcuguggccaaugaugucgaagagacccggcuggaugcgcucagggaucuugcucacguugaagaaggcggccaccaccagccagaaguagcggcgguagaagugcacgaagagugugggguucucgccucgcaggucgaagagccagcucucuagcauaauggggcaggccaugcugagcggcaugacgaagacgaaggugcgcagggcgaacggguaggagcaccagucggugcggcucuuacagcaagccacggugcaggccacagccagcacgaaggccacgggcagcacgagcgcgcgguagaccgcgaugaggcgggugcaguccacgugccagcccaggcgcugcugcacauacggcgucaugacccuggcguccagcaggcucaggcugggcagcagguaguaguaguaggccacggugcugccgaagccauaguagcugauggaagcguaguccagguagaagaaggcggcgcgcaggcgcagcgacaggcagcugaacacgugcgccgugcagcucauggcgaaggucagcagcacccccgacgcauagcaccacagcggcagcagccaggggugguggaagggcacaucgcugccgcccaggaagaagaggcggcagaacuuacugaggaacagcagcagcgggaugaagugcguccagaaguugagcgucucauuggugggcuucagcaccgaggccaggcacucuugcgcggugcacggcagccgccgguagccggacaggaugaagcacuccacgaagucaucgggcaccucgucccagcgcagcagcggcuuggucguggccgccggcgggcuccggggggcggaggcggaggcgggaugcgagcgccgggaggucgaggccggcggucccuucacgccggcgccccgcugcugcaggcgccgcggcauggugccccgggcuuagcuagggcgcgcgcgaggccaccgcgggcgccgggcgccgucggagccuuugugcgcgcgcgcgcgcgcgggaccgcggccgcagguuggcuacgcggccucggcuuggaagcgggcugcuccgggggcucggcgcaccgggcgggaggcugcugcugcgcgcgcggcuugccggcggcguccucgccacgcucgggucucucagcccgcggccggccgcgcugcgguggcggcgguggcgcggcugacugcggcggugguggcggugguggcggcggcggcggcgcggcggugacugggcaucgugcgcgcggggcgggcggcgggaggcgggaugugcgcgaggcgcuggcgggggagggcggcgccgcgcagggcgggggcccccgggguuagggugucugcgccgcggcggggggauggagguguccccugucuugcgucuccuaccaucccccccuucucgggcugcgaccgcucgggccgccgcguuaaugauugaugcggggccggaggcuggccagagacgcggccgccggcgcccagggcgagagggugggcaagggugggcgaggggguucgaagugcgacagccacgccggcguucuagaggacacuggggacccgag

SEQ ID NO: 10427 - RNA, 2501 nt, Mus musculus
ugcauuuaugguuaacccacauccugggaacgcuccucacuucggcucccaucuccagggcucccaucuccagggcucccaacuaaucugugauuuuggauuuucagaaaucacuccaacuugcuuuuuuugucucuaucucuugcacugcucuaaggugaacucccugaccaccauagaccaugcacaccaaauccccggaaaugucccuccuccugcaaacagcagcugagaugaguuugaacuuaguacugggugggaucuuuuaagucauacacucuccagaguuuacacaccuaacaacucuacagucaaaaaauagggauguguucuaaacaauaauucaggaagcuguauccaaaggggaguacggcagcacggacagaagucauaaagcacugugggguugggguuaggaagagagcuacacauggcugcugcuaucaaagggaacuuccaagaagaggcuacaccugagcaaugagcucacacccgggagggaaacaagcaagcauucagugugagaaagggcacaggguucgguucccagaccagcauccccaucagggaggcuugagagguguguggcuuugugaauagagggaugagcaagguaggaacuaacucccugccuccaucagacugagcgggagaggcuggaagagaaagaaaggucaaucaucuacaacaagaagaauaucagagaggcacaguaaagagaucccugaaaucagaaaaccagcuucccaggcccugcuuggcccugaggggcgagcgcgggcagagcaagucaucuaaccucccuggucucagcuuucucauuuguaaacugaagcagcugaacuggcugaccucagaggucccucggaacaaaaccagaccaacuguauauuauuucgaccauuaaaacccucacggcaggaaaauaaagggaaggggggggggucuucugugaucucuuuucuaguuuguuuuuuccuccucaacuucaauuuuccguuuccuacacuuacuacggucacgugccucucgcaucacaaauuuaacacuuuccuauagaauuucacuaaugaauuaaguuuaaagaggaguugguuacaagagguggggcguggaauuaaaugcccuugcuucaccuuuguggggccaaaacauuggucucuguauucauccugaaauucuaguuaugauuccacauuccuccaacaaagaaauguucauuccguguuggccccauacagucuacaacagcuuugagguaggauacaugucuguauaagucacacaauguaaauaacuaggaaaguuuuucuuuucaauacuacucauugaagccugggauggggguaauaauguuaaaaauggguuucuguauuuuguuuugguauuuuuuucuuuuuaauuuuuaaagcuuauacucgaaaaugcagccugcugaaucgcacaaaauucuuggcacuuuccccuaagacugacauuucuugcacugcauccagaggccccagggcuccuggaaaggcacuuaaguccagcaaacacggaugcaauuucauucugucccuacauucgccugugcaccagaggcgaacacaguaacacaacuuaagagacacaccaacggaucagaaaaaccucuucaacagccacgcaaaguuuaaaccagaaaacuuaguacccucccuuccuagaugcaggguaucacgaugugcuuccugggcuggggcuuaagcagcgacacacaggacuucacaccugagcgcaagacuccgccgcagggcaggagcgcgcccgcaggugucggaggaacccggagcccucgccgagcgccgcuaagccaagcuugccuuuccugcccggccucccccuccugacccacgcccgcuugugcguucaggcacccagcccccgguaccugcggcggccguucggcagcuccugcccgggauccccgcgcccgcuggucugguccgcuccgcugcggcugccacucacccgccuccuugcuccugcgcucgcgccacugcgcaugcucgucccgcacccccacccgcacgcuugaaauccacucgccagguuuuaguugcugcacccaggggagaggccaccagaucuuugcagucaggugaaaggaggcuugcaggagcuaacuaaagagguuuguguugagguugggggauggaagauggggaaguggacccgcgcugcaggggcgucaucccugcugcccacgcuucacucagccuaauuacaacugucugcaccccugaaaugaguuuuagcacggugguucucaaacaagggggccucagguuuuuguucaaacagcucucaaacccagaguauccgcaucuuuuaucugaaugcuggauguuucuaauguguucucagaacacuaguaugcauagcacuuuugaaaacuacagcucacaagguaagauaauuauuaaaguaaaacaauuucucucauccuucucccuucuggggaauucagaugauccuuc

SEQ ID NO: 10428 - RNA, 2501 nt, Mus musculus
gaaggaucaucugaauuccccagaagggagaaggaugagagaaauuguuuuacuuuaauaauuaucuuaccuugugagcuguaguuuucaaaagugcuaugcauacuaguguucugagaacacauuagaaacauccagcauucagauaaaagaugcggauacucuggguuugagagcuguuugaacaaaaaccugaggcccccuuguuugagaaccaccgugcuaaaacucauuucaggggugcagacaguuguaauuaggcugagugaagcgugggcagcagggaugacgccccugcagcgcggguccacuuccccaucuuccaucccccaaccucaacacaaaccucuuuaguuagcuccugcaagccuccuuucaccugacugcaaagaucugguggccucuccccugggugcagcaacuaaaaccuggcgaguggauuucaagcgugcgggugggggugcgggacgagcaugcgcaguggcgcgagcgcaggagcaaggaggcgggugaguggcagccgcagcggagcggaccagaccagcgggcgcggggaucccgggcaggagcugccgaacggccgccgcagguaccgggggcugggugccugaacgcacaagcgggcgugggucaggagggggaggccgggcaggaaaggcaagcuuggcuuagcggcgcucggcgagggcuccggguuccuccgacaccugcgggcgcgcuccugcccugcggcggagucuugcgcucaggugugaaguccugugugucgcugcuuaagccccagcccaggaagcacaucgugauacccugcaucuaggaagggaggguacuaaguuuucugguuuaaacuuugcguggcuguugaagagguuuuucugauccguuggugugucucuuaaguuguguuacuguguucgccucuggugcacaggcgaauguagggacagaaugaaauugcauccguguuugcuggacuuaagugccuuuccaggagcccuggggccucuggaugcagugcaagaaaugucagucuuaggggaaagugccaagaauuuugugcgauucagcaggcugcauuuucgaguauaagcuuuaaaaauuaaaaagaaaaaaauaccaaaacaaaauacagaaacccauuuuuaacauuauuacccccaucccaggcuucaaugaguaguauugaaaagaaaaacuuuccuaguuauuuacauugugugacuuauacagacauguauccuaccucaaagcuguuguagacuguauggggccaacacggaaugaacauuucuuuguuggaggaauguggaaucauaacuagaauuucaggaugaauacagagaccaauguuuuggccccacaaaggugaagcaagggcauuuaauuccacgccccaccucuuguaaccaacuccucuuuaaacuuaauucauuagugaaauucuauaggaaaguguuaaauuugugaugcgagaggcacgugaccguaguaaguguaggaaacggaaaauugaaguugaggaggaaaaaacaaacuagaaaagagaucacagaagaccccccccccuucccuuuauuuuccugccgugaggguuuuaauggucgaaauaauauacaguuggucugguuuuguuccgagggaccucugaggucagccaguucagcugcuucaguuuacaaaugagaaagcugagaccagggagguuagaugacuugcucugcccgcgcucgccccucagggccaagcagggccugggaagcugguuuucugauuucagggaucucuuuacugugccucucugauauucuucuuguuguagaugauugaccuuucuuucucuuccagccucucccgcucagucugauggaggcagggaguuaguuccuaccuugcucaucccucuauucacaaagccacacaccucucaagccucccugauggggaugcuggucugggaaccgaacccugugcccuuucucacacugaaugcuugcuuguuucccucccgggugugagcucauugcucagguguagccucuucuuggaaguucccuuugauagcagcagccauguguagcucucuuccuaaccccaaccccacagugcuuuaugacuucuguccgugcugccguacuccccuuuggauacagcuuccugaauuauuguuuagaacacaucccuauuuuuugacuguagaguuguuagguguguaaacucuggagaguguaugacuuaaaagaucccacccaguacuaaguucaaacucaucucagcugcuguuugcaggaggagggacauuuccggggauuuggugugcauggucuaugguggucagggaguucaccuuagagcagugcaagagauagagacaaaaaaagcaaguuggagugauuucugaaaauccaaaaucacagauuaguugggagcccuggagaugggagcccuggagaugggagccgaagugaggagcguucccaggauguggguuaaccauaaaugca

SEQ ID NO: 10429 - RNA, 2501 nt, Mus musculus
guguuuuacuauugaguuuuaucccugcucagccugagccuguauguuuaccucugacaucuucauaccucuaucaacauggaugcaguaguuuuucuccaguuccagguccuguuggcuguuauguuaauacacuucccugcaugguuccccccuuccucagccaccccccccccuuuaagacaggguuucucuguguggcccuagcuguucuagaacucacucuaucaaccagaguaggccuagaacucagacaucaaccagccccagccuccggagugcuaggauuaaaggugugcaccccguccccagggcuucucugcauccuauccaguaaauucuuuaugcucugcuugccuuuguucaccagguuggcuggccugguccaacccaacagagguucuggggacuuggaaucuagacccugagguauauucuaagacgaccuuucucucucuccaaggaaagucaugacgaacuguccccucaguuacacacaccuguaaccccaacaagaaggaggaucagaaguccaaggccagccuuguccacauagugaguuugaggccagccuaaacuacaugaaaccuuggguuagaaaacaaaaacaaacaaaccaaaaccacaaauaaacgaaugggccugucgucugugcaguccuugggcucuugguauaguggacacaagacccauuccgacugauuuuucaggacugaauuacauauugguccuaaagggcagaugaggaauuugaagggcccuccgggagguauuucccugaggagacuggagacagaggugcaugccaaacacccacauuccaucagucuccagcugaaaaaauuaauugccugcccuuuaugccauuugucuucggcaugugaacugcagucucagagugggaggggaggagagaacggcaggcagcuuagagcggggguucaaccacgcugaucucuuggcugcuccuuuaacuccuguggugacggaucggaucggagcauuagucucuggcaucaaaacagucucucgguccaugugaccagcacugccguugccgcacuguaaagcccacaagaaucggcagcccacagacccaucaguggaagcuuuguguuugcuucguguggguuugcugguggccuuuggcauagccacacguucaacaccugcuggagcaaaacaaaccaugcccagcauugcugucgcaucuuggccugucccuguccugagacuauggauuaggacacugacaaggucugcccacucccucaccgcucacacccgggaguacaaagucucugcguucaucaugcucaggggauugcuuagacccaccugucacuuacuggugaccuugaaggcggacagaccgggauucggaccccgauccuccaggaaccugacaucuauugccauugccuugacccaugggauaaagguggcaccagucccaguguggcccugcacagcagcgggcugugaccuuggcugagauaauagcggggacagggcaucuccauggaacaaggguuccuaucuuaacaguuuuuaaggccuacgcugcagguccuucaaugccaaggucacgagucaacggguagaaaucucgacaucucaucccuugaucuagagcaaugcccucguggggcuccuggcuggggacaggcaaggcggacagcguugccaucaagcggcaggucgagccagaagcuacccucagcucuucacaaagcagauccagucugcggccgcaauccaaacaccgaagggaaucagaacguacgucuuuuguuugccguggcaggagaacuguugagcagaggaaaaaacaagcugagcuuagcgcuaucagcugcuuccuggggcucgcuccuuccuuccuccgaggggggucuggccgcuuuguucucguucccagcugcacuucugcgccuuuaagcaguggccuccgcagaccucagaggaauguagcccugggaccccaggggacuuggcucagggcuccgcccgauacggccccaagcucucaacccgggugcuccugcccuugcuacguaucgcucuuucugccagccacuuccuggcuuggggaacaggggggugagccuccccagaggggcuuccuguuuucuuugacaauccugagaggacgugguuucauagaaucccacgaagaguccacaaaaggguguccguaauacuacuucgauugucuggggggagaaugugucucuccuggcauccguuuguccugguucaguuccuagcucuagagguuucuagccagucacacccccagccagcugcucaaccccucugaggcugaagcuaccuagggaagauuaaagcgccaacagugucuuggaugccuucccaaaucuuggcccacggggggcccucaacagguguuagccaauugucacuaugccuggguuuugauuacuucagugacacaagaaaaccaaacagaacccuuuaagacugauuauguugaagaa

SEQ ID NO: 10430 - RNA, 2501 nt, Mus musculus
uucuucaacauaaucagucuuaaaggguucuguuugguuuucuugugucacugaaguaaucaaaacccaggcauagugacaauuggcuaacaccuguugagggccccccgugggccaagauuugggaaggcauccaagacacuguuggcgcuuuaaucuucccuagguagcuucagccucagagggguugagcagcuggcugggggugugacuggcuagaaaccucuagagcuaggaacugaaccaggacaaacggaugccaggagagacacauucuccccccagacaaucgaaguaguauuacggacacccuuuuguggacucuucgugggauucuaugaaaccacguccucucaggauugucaaagaaaacaggaagccccucuggggaggcucaccccccuguuccccaagccaggaaguggcuggcagaaagagcgauacguagcaagggcaggagcacccggguugagagcuuggggccguaucgggcggagcccugagccaaguccccuggggucccagggcuacauuccucugaggucugcggaggccacugcuuaaaggcgcagaagugcagcugggaacgagaacaaagcggccagaccccccucggaggaaggaaggagcgagccccaggaagcagcugauagcgcuaagcucagcuuguuuuuuccucugcucaacaguucuccugccacggcaaacaaaagacguacguucugauucccuucgguguuuggauugcggccgcagacuggaucugcuuugugaagagcugaggguagcuucuggcucgaccugccgcuugauggcaacgcuguccgccuugccuguccccagccaggagccccacgagggcauugcucuagaucaagggaugagaugucgagauuucuacccguugacucgugaccuuggcauugaaggaccugcagcguaggccuuaaaaacuguuaagauaggaacccuuguuccauggagaugcccuguccccgcuauuaucucagccaaggucacagcccgcugcugugcagggccacacugggacuggugccaccuuuaucccaugggucaaggcaauggcaauagaugucagguuccuggaggaucgggguccgaaucccggucuguccgccuucaaggucaccaguaagugacaggugggucuaagcaauccccugagcaugaugaacgcagagacuuuguacucccgggugugagcggugagggagugggcagaccuugucaguguccuaauccauagucucaggacagggacaggccaagaugcgacagcaaugcugggcaugguuuguuuugcuccagcagguguugaacguguggcuaugccaaaggccaccagcaaacccacacgaagcaaacacaaagcuuccacugaugggucugugggcugccgauucuugugggcuuuacagugcggcaacggcagugcuggucacauggaccgagagacuguuuugaugccagagacuaaugcuccgauccgauccgucaccacaggaguuaaaggagcagccaagagaucagcgugguugaacccccgcucuaagcugccugccguucucuccuccccucccacucugagacugcaguucacaugccgaagacaaauggcauaaagggcaggcaauuaauuuuuucagcuggagacugauggaauguggguguuuggcaugcaccucugucuccagucuccucagggaaauaccucccggagggcccuucaaauuccucaucugcccuuuaggaccaauauguaauucaguccugaaaaaucagucggaaugggucuuguguccacuauaccaagagcccaaggacugcacagacgacaggcccauucguuuauuugugguuuugguuuguuuguuuuuguuuucuaacccaagguuucauguaguuuaggcuggccucaaacucacuauguggacaaggcuggccuuggacuucugauccuccuucuuguugggguuacagguguguguaacugaggggacaguucgucaugacuuuccuuggagagagagaaaggucgucuuagaauauaccucagggucuagauuccaaguccccagaaccucuguuggguuggaccaggccagccaaccuggugaacaaaggcaagcagagcauaaagaauuuacuggauaggaugcagagaagcccuggggacggggugcacaccuuuaauccuagcacuccggaggcuggggcugguugaugucugaguucuaggccuacucugguugauagagugaguucuagaacagcuagggccacacagagaaacccugucuuaaagggggggggguggcugaggaaggggggaaccaugcagggaaguguauuaacauaacagccaacaggaccuggaacuggagaaaaacuacugcauccauguugauagagguaugaagaugucagagguaaacauacaggcucaggcugagcagggauaaaacucaauaguaaaacac

SEQ ID NO: 10431 - RNA, 2501 nt, Mus musculus
uguguuauuucuguuucacucucucuggguaaauugucuguagucuuuguccuuuggggcucuuccuugucuugauucuuuauacauuuuaagcugaggcuagagcuuagggguggagugcuuaucuuguaugcacagagcccuagguuccacucccagcacacagacaccccaaaucgguucccaauuggaagcuacgaagccacugcaguaaguagcauuucuuucccagcucugccgugacuuuugacuucuucugguuuuuccuugcagauuuuauuucuaugucacugaauauccuuaaagucgaagagaaaugaaaacugaagagauauuugcauggcauagcuggugaaucuaauuuuguucgcagcuugccagaaguggcuuaaauucuuuuuaccguccuugcuguggaaaucugaaacauggauucagggugugugucucaaaaacuguggccgucuguaaaggaugucuauaccacacuuuugacauuuuguuguucugcauagaggguuuaucgggcagcccaaaaccaauugggagagcgaguggagcagcgagguugaaagauccuccaucacccugagcaauagaaacugcaggcuuuaguugaaagacagaggugccaaagugaggaaacagacaggaagccucagggguuagucgcuuuccacagggcacagugggaagugaacuuuccccuuaucucuucuaaaucuagauaggcucaacaacuguuaggggcagaugaauggaaggauaagagauguucacaccaauuccuggaguagggagggagaggaaccaggagaaggggaagaaagggggaggggaggagggcgaggggaagcacagagcagcggaccuuagaagaaucgcucaaggucacaccgcgggauggagcugaaagccgaauucaaauccaagcccgggacugcaggacugaaaguucuagauagagccacacaaacgugcucucuucucucuucuugacucagcagcucucgcuuggccacggggcggugggaaucacacuuccugggccuuucuagccgggaguuuggggucccuuguuuuuccuggacuuauuugccgcacuccgggcuuuggcuuccuccucccugcuucccagagcagaauccggagccaccuauucucuccaaguuugucucgcagccaggcugggaaccgugcgcgagcgacucccggacccggcaaucagucuucccugccccagcgucggagacgaacaaucaccaccagcggcugcugagugcuagacgcuuuacucccacagcuccaaaagccacagacgagcagacccccagaaauuaguccucgccacucagaugaggcagcucugcgaaauuggaugaugugcuuggacucacaaggcuaauaacgcuaguuaguaucuaagugcuuucugaaugccagacgcgggucuccgcaccaccccagcaguuccuccaacacucuaguaaaaaagggcacacuaucacccccaucuuauggaugaggaaaccgugguuguggcaccuggcccaaggucaccccagagagugacggauauacgaccggaacauagucgguugagucuggguucaauuuguguguguugucuccacuacagggagagcagcgguuucaaaccuacaguaccagaggcugaccucaacgcaacgcccgaggcugggcgcaaaccaaccaguucggaaugccauaauucacagagacauucccacggaccggaaccagagagucccccaagagcaccgagugugaccgguacuggcggacgaucaccccuuagcaggagcuggagaacacuuaccauaaaagagagggcgagcgccugccugggaggaauccccagcgcuggcagguccgggacucccgggagagaggucugcugccacugccgcccacgcaggggcgcccgagcgaccccgcggaugcuggcugcugcuucucaaccagcggcgcguccucucgacuuguauccggcggcagcgcccucucgcuccgcagggugcccuggaguuagggacguucuuggagaaguugacgcucgggagaggccgccgagguccggucccgaguagugaagugccccacugcgcugaucucagcgagaugcggaagcccuugcccugauggcccuaaagcuuggcgccugaccuggagagcgacgagucccgcgcucagggcacacgggccgcaccucggccgcccguccccggagcaccggguuucuucccuagagcacugagcacacgccgcgagggcugcagugguggccagggcccgggcagcugugcgcucauugccuuccccaggggcugagcgccuuugugcgccgggcgcgccgaccgccagggccagcucuggaugcugcagccgccgccucccccuccuccuccacggccgcucgcuccccgccuucccggccggcccggaggcugcagcugaaagccgauccggcugagcucauc

SEQ ID NO: 10432 - RNA, 2501 nt, Mus musculus
gaugagcucagccggaucggcuuucagcugcagccuccgggccggccgggaaggcggggagcgagcggccguggaggaggagggggaggcggcggcugcagcauccagagcuggcccuggcggucggcgcgcccggcgcacaaaggcgcucagccccuggggaaggcaaugagcgcacagcugcccgggcccuggccaccacugcagcccucgcggcgugugcucagugcucuagggaagaaacccggugcuccggggacgggcggccgaggugcggcccgugugcccugagcgcgggacucgucgcucuccaggucaggcgccaagcuuuagggccaucagggcaagggcuuccgcaucucgcugagaucagcgcaguggggcacuucacuacucgggaccggaccucggcggccucucccgagcgucaacuucuccaagaacgucccuaacuccagggcacccugcggagcgagagggcgcugccgccggauacaagucgagaggacgcgccgcugguugagaagcagcagccagcauccgcggggucgcucgggcgccccugcgugggcggcaguggcagcagaccucucucccgggagucccggaccugccagcgcuggggauuccucccaggcaggcgcucgcccucucuuuuaugguaaguguucuccagcuccugcuaaggggugaucguccgccaguaccggucacacucggugcucuugggggacucucugguuccgguccgugggaaugucucugugaauuauggcauuccgaacugguugguuugcgcccagccucgggcguugcguugaggucagccucugguacuguagguuugaaaccgcugcucucccuguaguggagacaacacacacaaauugaacccagacucaaccgacuauguuccggucguauauccgucacucucuggggugaccuugggccaggugccacaaccacgguuuccucauccauaagaugggggugauagugugcccuuuuuuacuagaguguuggaggaacugcugggguggugcggagacccgcgucuggcauucagaaagcacuuagauacuaacuagcguuauuagccuugugaguccaagcacaucauccaauuucgcagagcugccucaucugaguggcgaggacuaauuucugggggucugcucgucuguggcuuuuggagcugugggaguaaagcgucuagcacucagcagccgcugguggugauuguucgucuccgacgcuggggcagggaagacugauugccggguccgggagucgcucgcgcacgguucccagccuggcugcgagacaaacuuggagagaauagguggcuccggauucugcucugggaagcagggaggaggaagccaaagcccggagugcggcaaauaaguccaggaaaaacaagggaccccaaacucccggcuagaaaggcccaggaagugugauucccaccgccccguggccaagcgagagcugcugagucaagaagagagaagagagcacguuuguguggcucuaucuagaacuuucaguccugcagucccgggcuuggauuugaauucggcuuucagcuccaucccgcggugugaccuugagcgauucuucuaagguccgcugcucugugcuuccccucgcccuccuccccucccccuuucuuccccuucuccugguuccucucccucccuacuccaggaauuggugugaacaucucuuauccuuccauucaucugccccuaacaguuguugagccuaucuagauuuagaagagauaaggggaaaguucacuucccacugugcccuguggaaagcgacuaaccccugaggcuuccugucuguuuccucacuuuggcaccucugucuuucaacuaaagccugcaguuucuauugcucagggugauggaggaucuuucaaccucgcugcuccacucgcucucccaauugguuuugggcugcccgauaaacccucuaugcagaacaacaaaaugucaaaagugugguauagacauccuuuacagacggccacaguuuuugagacacacacccugaauccauguuucagauuuccacagcaaggacgguaaaaagaauuuaagccacuucuggcaagcugcgaacaaaauuagauucaccagcuaugccaugcaaauaucucuucaguuuucauuucucuucgacuuuaaggauauucagugacauagaaauaaaaucugcaaggaaaaaccagaagaagucaaaagucacggcagagcugggaaagaaaugcuacuuacugcaguggcuucguagcuuccaauugggaaccgauuuggggugucugugugcugggaguggaaccuagggcucugugcauacaagauaagcacuccaccccuaagcucuagccucagcuuaaaauguauaaagaaucaagacaaggaagagccccaaaggacaaagacuacagacaauuuacccagagagagugaaacagaaauaacaca

SEQ ID NO: 10433 - RNA, 2501 nt, Mus musculus
aggagacuuagagaugaacucgcccgugcgcugcuggcugccccgcuauaggggcgaaggccccugacgcaagcggaacucugcggagcccauacgaaucagaacggagcgaggcuccuggcgcacuagggacuccaggaggcggcugcgccagagacgcgggucgcgccucggggaaaccgggcgguggggggaggggagagcucagccaagaaaacccaccgaggcggggacuggccugggcggggaggggcggcggggccggagccccucgcuguugggcagacucccgauggccagaggcugacuuccacucccgcagaccgcuccccggggggaaaagagaagagagugagagccgcgcgaggccuccgguccccgcagccugcagaaguuagaggcucugcgccgagcgcacacuccugcgcccgccugcaaggcgagccugcaccaggagagcacagccuccgggcugcccggccgcggagagccggcuuuugucaugauggccagcuaccccgagcccgaagacacggcggggacccugcuggcuccggagagcggacgcgcagucaaagaggccgaggcgucgccgccgagucccggcaagggaggcgggacaacaccggagaaaccagaccccgcgcagaagcccccguacucguacguggcgcucaucgccauggcgauccgcgagagcgccgagaagaggcucacucuguccggcaucuaccaguacaucauagccaaguucccguucuacgagaagaacaagaagggcuggcagaauagcauccgccacaaccucagccucaacgagugcuucaucaaggugccgcgcgagggcggcggcgagcgcaagggcaacuacuggacgcucgacccggccugcgaggacauguucgagaagggcaacuaccggcgccgccgccgcaugaagcggcccuuccggccgccgcccgcucacuuccagcccggcaaggggcucuucgggagcggaggagcggcggguggcugcggcgugcccggagcuggggccgauggcuauggcuaccuggcgccacccaaguaccugcaaucgggguuccucaacaacuccuggccccugccgcagccucccucgcccaugcccuacgccuccugccagauggcggcggcugcggcggccgcugcugcagccgcugcagccgccggcccgggcagccccggugcagccgcgguggucaaggggcuggcgggccccgccgccuccuacgggccguacucgcgcgugcagagcauggcgcugccuccgggcgucgugaacuccuacaacggccuggggggcccuccugccgcaccaccgccgccgccaccgccgccgcacccucacccgcacccucacgcacaucaucugcacgcggccgcugcgcccccgccagccccgccacaccacggggcugccgcgccucccccgggucagcucagucccgccagcccggccaccgccgcgcccccggcacccgcgcccacgagcgcgcccggccugcaguucgccugcgcccggcaacccgagcucgccaugaugcauugcucauacugggaccacgacagcaagacgggcgcgcugcacucgcgucuggaucucugagugccaacgcgcgcgggagcggucccccaccccuaucccgggaguggaggagccgagcucgggucgcagccgcagcagccagccugacagcgcgcacuccgggacagcuucuggaugcagagcccucgagcggucugcccuuccucgguccgccccgcuccugcgacuccgcuuugucgccuccgcugcuccuccggugcucuuccccgccgcggccucugcuuucccgugcugcuggccggaggccgcccacuccgugcuuuccgcgggccuccucuccucaccgcagggagugaguccccggccgaggugcggucgaagugucugagacgcagcuuaccucuuggcccucucuuccaggucgguggacucaagcucgauuuuauuuuuaauuccccaccccgacugucugcgacuagaagcgcuaggcugcugggggaagagggacccacacuaccggagaauggaaagaacgugucuggucgcucugcgaucccuccuggaacugaucagaagccgcuugcagaggggcccacugggcggggcggggguugagccccaggcuggagcagggacagccucguuccgcggccugcaaccgaguucucaucccccgcuccuugugaggccguggugccuccgcuccgcagagcaccgcauagggcaccuccaggccaggucuuuaugaaaaagauuggugaggcuuuugaaaauauuaaaaaauacuuuuuaaagaaaaaaagaaagagggagagaauaaaacauucauggggggguggggaggagaaauguaauggccuuggaguuugcuaaaaccaaacaacaaaaucaaaaguuuugguuuucuucaucgacccugcugggaaauuug

SEQ ID NO: 10434 - RNA, 2501 nt, Mus musculus
caaauuucccagcagggucgaugaagaaaaccaaaacuuuugauuuuguuguuugguuuuagcaaacuccaaggccauuacauuucuccuccccacccccccaugaauguuuuauucucucccucuuucuuuuuuucuuuaaaaaguauuuuuuaauauuuucaaaagccucaccaaucuuuuucauaaagaccuggccuggaggugcccuaugcggugcucugcggagcggaggcaccacggccucacaaggagcgggggaugagaacucgguugcaggccgcggaacgaggcugucccugcuccagccuggggcucaacccccgccccgcccagugggccccucugcaagcggcuucugaucaguuccaggagggaucgcagagcgaccagacacguucuuuccauucuccgguagugugggucccucuucccccagcagccuagcgcuucuagucgcagacagucgggguggggaauuaaaaauaaaaucgagcuugaguccaccgaccuggaagagagggccaagagguaagcugcgucucagacacuucgaccgcaccucggccggggacucacucccugcggugaggagaggaggcccgcggaaagcacggagugggcggccuccggccagcagcacgggaaagcagaggccgcggcggggaagagcaccggaggagcagcggaggcgacaaagcggagucgcaggagcggggcggaccgaggaagggcagaccgcucgagggcucugcauccagaagcugucccggagugcgcgcugucaggcuggcugcugcggcugcgacccgagcucggcuccuccacucccgggauaggggugggggaccgcucccgcgcgcguuggcacucagagauccagacgcgagugcagcgcgcccgucuugcugucguggucccaguaugagcaaugcaucauggcgagcucggguugccgggcgcaggcgaacugcaggccgggcgcgcucgugggcgcgggugccgggggcgcggcgguggccgggcuggcgggacugagcugacccgggggaggcgcggcagccccgugguguggcggggcuggcgggggcgcagcggccgcgugcagaugaugugcgugagggugcgggugagggugcggcggcgguggcggcggcgguggugcggcaggagggccccccaggccguuguaggaguucacgacgcccggaggcagcgccaugcucugcacgcgcgaguacggcccguaggaggcggcggggcccgccagccccuugaccaccgcggcugcaccggggcugcccgggccggcggcugcagcggcugcagcagcggccgccgcagccgccgccaucuggcaggaggcguagggcaugggcgagggaggcugcggcaggggccaggaguuguugaggaaccccgauugcagguacuuggguggcgccagguagccauagccaucggccccagcuccgggcacgccgcagccacccgccgcuccuccgcucccgaagagccccuugccgggcuggaagugagcgggcggcggccggaagggccgcuucaugcggcggcggcgccgguaguugcccuucucgaacauguccucgcaggccgggucgagcguccaguaguugcccuugcgcucgccgccgcccucgcgcggcaccuugaugaagcacucguugaggcugagguuguggcggaugcuauucugccagcccuucuuguucuucucguagaacgggaacuuggcuaugauguacugguagaugccggacagagugagccucuucucggcgcucucgcggaucgccauggcgaugagcgccacguacgaguacgggggcuucugcgcggggucugguuucuccgguguugucccgccucccuugccgggacucggcggcgacgccucggccucuuugacugcgcguccgcucuccggagccagcaggguccccgccgugucuucgggcucgggguagcuggccaucaugacaaaagccggcucuccgcggccgggcagcccggaggcugugcucuccuggugcaggcucgccuugcaggcgggcgcaggagugugcgcucggcgcagagccucuaacuucugcaggcugcggggaccggaggccucgcgcggcucucacucucuucucuuuuccccccggggagcggucugcgggaguggaagucagccucuggccaucgggagucugcccaacagcgaggggcuccggccccgccgccccuccccgcccaggccaguccccgccucgguggguuuucuuggcugagcucuccccuccccccaccgcccgguuuccccgaggcgcgacccgcgucucuggcgcagccgccuccuggagucccuagugcgccaggagccucgcuccguucugauucguaugggcuccgcagaguuccgcuugcgucaggggccuucgccccuauagcggggcagccagcagcgcacgggcgaguucaucucuaagucuccu

SEQ ID NO: 10435 - RNA, 2501 nt, Mus musculus
aaguauuaccacccagggcgggucagacuccauuaaucuuuaugggucuuggcacacaggacagggcacaacauaccuuucucugacacuucucugaauaggcacauggaaagaugaucucugaccacacaaggucuguuccauguaucccuuucugcagcgcccccacccccgcauuacucuguccagugcauuccuggucuccgucuccguuccccacauggugaacuagugccugacaguguuccuaugaaagagggccaugaggagagaggagccagauuguccugcagcguucuaaccucaaccagauggguuguggggauauaggaugguucaggaauacuccuucccaggucacaacaacagccuucucacagcuggaaagagucagacagagcuggaaagaaagcagggccuucgacagggcuccgcccguagccccgcccccagcccugccgcacccacuggggcccaccucccuucgacuuugauccaaguagcuguagcagcggcagcuagaagcagcagcuggggccccuggugaggugaucgugccauugccguguccguggguccacagccaggugcucagaccacaagccagagagaaagguuggguuugccagggaccagggcaggggggcagcugcccaggagcuuucaguaccgcugcguaaagcuggucucagcucggacccugagucugguucgaucaaguccuggaccuucugggauucccaaggggccccagcucaauggggcugccucugccgcugcuucaauccucucuucugcuaaugcuucuuuugcggcugucggcggcguccaccaaccugaacuggcagugcccacgaauacccuacgcagccucccgagacuucagugucaaguacgugguccccagcuucuccgcggggggccggguacaggccaccgcagccuacgaggacaguacaaauagugcgguguuuguggccacacgcaaucaccugcacgugcuugggccugaccugcaguucauagagaaccugaccacuggcccuaucgggaacccuggcugccagacuugugcgagcugugguccaggcccucauggaccaccaaaggacacagacacacuggugcuagugauggagccagguuugccagcccuggucagcuguggcucaacccuacagggccgcugcuuccugcaugagcuggagccucgggggaaagcccugcacuuagcagcuccagccugccuauucucagcaaacaauaacaagccugaggccugcacggacuguguggcuagcccccugggcacucgugugacugugguggagcaggggcaugcuuccuacuucuauguggcaucuucgcuagacccagaguuggccgcuagcuuuagcccccgcucgguguccauccgucgucuaaagucugauacuucuggauuccaaccagguuuuccgucgcugucggugcugcccaaauauuuggccuccuaccucaucaaauauguguacagcuuccacucgggggauuuugucuacuuucugacuguccagcccaucagugucacaagcccucccagugccuugcauacacgucugguccggcucaaugcuguagagccagagauuggugacuaccgggagcuggucuuggacugucauuuugcaccuaaacgccggcgccguggagccccggagggcacacagcccuacccagugcuucaggcagcccacucugcuccaguggaugccaaacuggcuguggaacugagcauuucagagggccaggaagugcuuuuuggggucuuugugaccgucaaggaugguggcucuggcaugggucccaacucuguuguaugugccuuccccauuuaccaccugaacauccugauugaagagggugucgaauauugcugucacucuucaaauucuucuucccuguugucgagaggccuugacuucuuccagacgcccaguuuuuguccuaauccggugagcagaaagagcgggccccugaccugugaguacccuguggagcugaauacgggcuauuuccuugcuaucucugaaagggccugggugggaaaaggcagugggcuaagacacacaaaucaucagccaugucccggaaggucacccagcacgaggcugucauccuuccugccaucugauucuuuaagauagcuuccaggguugugugaggaggggcuuacgucauaguuaacccugccagcacaacuuccaaauuccccuccaaccuguccaguuccuagacccucagggacaccgagaaaaauacagacagaggcaaacacucagagggcagagccucacaacgguccgcagcggcuugccgaccaguucuacuuuccuuugaaggcacuguuuugcucugcuuuucaaagaggggugguuggcagggcugccagagaacuccuccccgccccaccccccacuccgugagguuccagggaacccuggaagucugggaguuuuuuu

SEQ ID NO: 10436 - RNA, 2501 nt, Mus musculus
aaaaaaacucccagacuuccaggguucccuggaaccucacggagugggggguggggcggggaggaguucucuggcagcccugccaaccaccccucuuugaaaagcagagcaaaacagugccuucaaaggaaaguagaacuggucggcaagccgcugcggaccguugugaggcucugcccucugaguguuugccucugucuguauuuuucucggugucccugagggucuaggaacuggacagguuggaggggaauuuggaaguugugcuggcaggguuaacuaugacguaagccccuccucacacaacccuggaagcuaucuuaaagaaucagauggcaggaaggaugacagccucgugcugggugaccuuccgggacauggcugaugauuugugugucuuagcccacugccuuuucccacccaggcccuuucagagauagcaaggaaauagcccguauucagcuccacaggguacucacaggucaggggcccgcucuuucugcucaccggauuaggacaaaaacugggcgucuggaagaagucaaggccucucgacaacagggaagaagaauuugaagagugacagcaauauucgacacccucuucaaucaggauguucaggugguaaauggggaaggcacauacaacagaguugggacccaugccagagccaccauccuugacggucacaaagaccccaaaaagcacuuccuggcccucugaaaugcucaguuccacagccaguuuggcauccacuggagcagagugggcugccugaagcacuggguagggcugugugcccuccggggcuccacggcgccggcguuuaggugcaaaaugacaguccaagaccagcucccgguagucaccaaucucuggcucuacagcauugagccggaccagacguguaugcaaggcacugggagggcuugugacacugaugggcuggacagucagaaaguagacaaaaucccccgaguggaagcuguacacauauuugaugagguaggaggccaaauauuugggcagcaccgacagcgacggaaaaccugguuggaauccagaaguaucagacuuuagacgacggauggacaccgagcgggggcuaaagcuagcggccaacucugggucuagcgaagaugccacauagaaguaggaagcaugccccugcuccaccacagucacacgagugcccagggggcuagccacacaguccgugcaggccucaggcuuguuauuguuugcugagaauaggcaggcuggagcugcuaagugcagggcuuucccccgaggcuccagcucaugcaggaagcagcggcccuguaggguugagccacagcugaccagggcuggcaaaccuggcuccaucacuagcaccagugugucuguguccuuuggugguccaugagggccuggaccacagcucgcacaagucuggcagccaggguucccgauagggccaguggucagguucucuaugaacugcaggucaggcccaagcacgugcaggugauugcguguggccacaaacaccgcacuauuuguacuguccucguaggcugcgguggccuguacccggccccccgcggagaagcuggggaccacguacuugacacugaagucucgggaggcugcguaggguauucgugggcacugccaguucagguugguggacgccgccgacagccgcaaaagaagcauuagcagaagagaggauugaagcagcggcagaggcagccccauugagcuggggccccuugggaaucccagaagguccaggacuugaucgaaccagacucaggguccgagcugagaccagcuuuacgcagcgguacugaaagcuccugggcagcugccccccugcccuggucccuggcaaacccaaccuuucucucuggcuuguggucugagcaccuggcuguggacccacggacacggcaauggcacgaucaccucaccaggggccccagcugcugcuucuagcugccgcugcuacagcuacuuggaucaaagucgaagggaggugggccccagugggugcggcagggcugggggcggggcuacgggcggagcccugucgaaggcccugcuuucuuuccagcucugucugacucuuuccagcugugagaaggcuguuguugugaccugggaaggaguauuccugaaccauccuauauccccacaacccaucugguugagguuagaacgcugcaggacaaucuggcuccucucuccucauggcccucuuucauaggaacacugucaggcacuaguucaccauguggggaacggagacggagaccaggaaugcacuggacagaguaaugcgggggugggggcgcugcagaaagggauacauggaacagaccuuguguggucagagaucaucuuuccaugugccuauucagagaagugucagagaaagguauguugugcccuguccugugugccaagacccauaaagauuaauggagucugacccgcccugggugguaauacuu

SEQ ID NO: 10437 - RNA, 2501 nt, Mus musculus
uagguaccaaaacuuuugaccugggaagaagaugggacaaggauaaaaguuucuguagacuguauccguguuagcagggacccucugagucaauaggguuccacuguuaccaugcccuugguuucugcaugccggcgagcagucugaagcccuguuuguaagggcugaguagcaugagcuguaucuccaggcucccagccuccccuuagaggaacaagcugcuuuaucggagacuccagcgacgcagcuccagcuuccucaggaagcagccccagucucccccucuccagcuggccugugcgauggacgucuguuuccccauacagggccccauagcuccauuuccugugcuggccccagccugggcggggagggggcugagacucugggcccagaucccaccuuccgcccccccaccccuuggccgcagcuuccugccucuagagcggcuccuccucuaggaaaagcugcugguuaacugggccagggguugcagguuugugugagaaaucucuagaucccucuccucuccauccuguaguuccgugaccugaaauggaccuguugggaccgccugaaggugcccgcugugcagccugaaaggacacugaagucacugcuggcccaucuccagguaugcccugucuccacucagccccuggcccagcccagccuggcccaaugggcaucugauguauaccuucuaggaagaacauggacugaagguggagaugcuucuccaccaccaggcucugcucuauucuucaggauggucaucugaaaagcaggcucaacaccugugccucaggugagccggucguagccaggcucuaccaugucccuggagguugagcaugggugacaaggucuuuuucuccaccccauuuuaggccccucacaccuucuugaagcauucuuccaccaaauggagccaacaaaugggccugggaggggguggagcuaagggccagaggaaggggacuucaguagcugucugcuuggccagcccccuuggcuucccauacccugcccagcccccaucucccuucacagccugcucucgagggacaaacagcuuccugccucuugccugccccaccagcugcuccuaaaauaguuucagauguuuccugccuugggccgcuccugcuccugguuggggcucuugagggcucaccagcacccucuuguccacacuagguugcccucugucugccuugacccaccuacagagucuccccuaaacccccucccauaccagggugacagaacugguucagcacgugaccggcuggaagcccaagccugggcugaagguucugguguuugagcugagcugugagggcgaggaggaagaaauggccuucccaccucugcauuaugagcugugacgagguagccacaccacgccaccacuuggccauaacaaacucugcauaaaauuccuacaucuucagcucacagcagauacuucaacaauaaaaacuuguugacggaaggcacaagugaaguggaugguagaaaaugaaugguaagguacacacaggugauacggguaagacaggaacccuggaaaaggagagggaacauucuagacuggccugucuuagcugugcuccacagggccagagauacuuccugaagccucaggaguaugggaccagcaguuuaggaaaaaaagccuuuauugucccuagcuggaggggcagggucagagguagcugacaucauuguagauaauagguuggcgacuucgacaguucaugagggcugcaaaucgugagaugucugcaggcaggucagguucugagcgaggugggcaggacaaccucuugcuugccauagcuguccgucgagcccuggccagccuacgccguagcugcucagagagaccaagcaggaacugagggggucgagcccgugcucgggguacaucuccaucacuccccucacugguugcuucaggcaacuccauccaauugugaacuaaaucagcaaaacaguuauccccuagcaccaggggcugccgacugcggccccuguucagcagggcugccguccaguccucugcuuccaaucccugccaauguuccaggcaagcaucugggguggacuugggccucggacggugggcaggagguauguugguuacagcugcccuacugcgcauaggaaugucacugacugagaaacgcuggcuaugagguggacguucucgaggugcuuggcgcugggguacagacggcucuuccucucgccauguacugccugacaccucggagaagccagagucccagucuagagcaugcucccuaggacaucccaaggguaaacccuugucuucugcuaccaagccuuccuccucuuccucuucuacacagcagacagaguccucuuccaaaacauccgaggcccugaacuggcgcuuuggcuguacauuuugaucaguucuggguuuugguugcagugggccagacauuggaggugagccugugucccga

SEQ ID NO: 10438 - RNA, 2501 nt, Mus musculus
ucgggacacaggcucaccuccaaugucuggcccacugcaaccaaaacccagaacugaucaaaauguacagccaaagcgccaguucagggccucggauguuuuggaagaggacucugucugcuguguagaagaggaagaggaggaaggcuugguagcagaagacaaggguuuacccuugggauguccuagggagcaugcucuagacugggacucuggcuucuccgaggugucaggcaguacauggcgagaggaagagccgucuguaccccagcgccaagcaccucgagaacguccaccucauagccagcguuucucagucagugacauuccuaugcgcaguagggcagcuguaaccaacauaccuccugcccaccguccgaggcccaaguccaccccagaugcuugccuggaacauuggcagggauuggaagcagaggacuggacggcagcccugcugaacaggggccgcagucggcagccccuggugcuaggggauaacuguuuugcugauuuaguucacaauuggauggaguugccugaagcaaccagugaggggagugauggagauguaccccgagcacgggcucgacccccucaguuccugcuuggucucucugagcagcuacggcguaggcuggccagggcucgacggacagcuauggcaagcaagagguuguccugcccaccucgcucagaaccugaccugccugcagacaucucacgauuugcagcccucaugaacugucgaagucgccaaccuauuaucuacaaugaugucagcuaccucugacccugccccuccagcuagggacaauaaaggcuuuuuuuccuaaacugcuggucccauacuccugaggcuucaggaaguaucucuggcccuguggagcacagcuaagacaggccagucuagaauguucccucuccuuuuccaggguuccugucuuacccguaucaccuguguguaccuuaccauucauuuucuaccauccacuucacuugugccuuccgucaacaaguuuuuauuguugaaguaucugcugugagcugaagauguaggaauuuuaugcagaguuuguuauggccaagugguggcgugguguggcuaccucgucacagcucauaaugcagaggugggaaggccauuucuuccuccucgcccucacagcucagcucaaacaccagaaccuucagcccaggcuugggcuuccagccggucacgugcugaaccaguucugucacccugguaugggaggggguuuaggggagacucuguaggugggucaaggcagacagagggcaaccuaguguggacaagagggugcuggugagcccucaagagccccaaccaggagcaggagcggcccaaggcaggaaacaucugaaacuauuuuaggagcagcugguggggcaggcaagaggcaggaagcuguuugucccucgagagcaggcugugaagggagaugggggcugggcaggguaugggaagccaagggggcuggccaagcagacagcuacugaaguccccuuccucuggcccuuagcuccacccccucccaggcccauuuguuggcuccauuugguggaagaaugcuucaagaaggugugaggggccuaaaaugggguggagaaaaagaccuugucacccaugcucaaccuccagggacaugguagagccuggcuacgaccggcucaccugaggcacagguguugagccugcuuuucagaugaccauccugaagaauagagcagagccuggugguggagaagcaucuccaccuucaguccauguucuuccuagaagguauacaucagaugcccauugggccaggcugggcugggccaggggcugaguggagacagggcauaccuggagaugggccagcagugacuucaguguccuuucaggcugcacagcgggcaccuucaggcggucccaacagguccauuucaggucacggaacuacaggauggagaggagagggaucuagagauuucucacacaaaccugcaaccccuggcccaguuaaccagcagcuuuuccuagaggaggagccgcucuagaggcaggaagcugcggccaaggggugggggggcggaaggugggaucugggcccagagucucagcccccuccccgcccaggcuggggccagcacaggaaauggagcuauggggcccuguauggggaaacagacguccaucgcacaggccagcuggagagggggagacuggggcugcuuccugaggaagcuggagcugcgucgcuggagucuccgauaaagcagcuuguuccucuaaggggaggcugggagccuggagauacagcucaugcuacucagcccuuacaaacagggcuucagacugcucgccggcaugcagaaaccaagggcaugguaacaguggaacccuauugacucagagggucccugcuaacacggauacagucuacagaaacuuuuauccuugucccaucuucuucccaggucaaaaguuuugguaccua

SEQ ID NO: 10439 - RNA, 2501 nt, Mus musculus
guguuugagcugagcugugagggcgaggaggaagaaauggccuucccaccucugcauuaugagcugugacgagguagccacaccacgccaccacuuggccauaacaaacucugcauaaaauuccuacaucuucagcucacagcagauacuucaacaauaaaaacuuguugacggaaggcacaagugaaguggaugguagaaaaugaaugguaagguacacacaggugauacggguaagacaggaacccuggaaaaggagagggaacauucuagacuggccugucuuagcugugcuccacagggccagagauacuuccugaagccucaggaguaugggaccagcaguuuaggaaaaaaagccuuuauugucccuagcuggaggggcagggucagagguagcugacaucauuguagauaauagguuggcgacuucgacaguucaugagggcugcaaaucgugagaugucugcaggcaggucagguucugagcgaggugggcaggacaaccucuugcuugccauagcuguccgucgagcccuggccagccuacgccguagcugcucagagagaccaagcaggaacugagggggucgagcccgugcucgggguacaucuccaucacuccccucacugguugcuucaggcaacuccauccaauugugaacuaaaucagcaaaacaguuauccccuagcaccaggggcugccgacugcggccccuguucagcagggcugccguccaguccucugcuuccaaucccugccaauguuccaggcaagcaucugggguggacuugggccucggacggugggcaggagguauguugguuacagcugcccuacugcgcauaggaaugucacugacugagaaacgcuggcuaugagguggacguucucgaggugcuuggcgcugggguacagacggcucuuccucucgccauguacugccugacaccucggagaagccagagucccagucuagagcaugcucccuaggacaucccaaggguaaacccuugucuucugcuaccaagccuuccuccucuuccucuucuacacagcagacagaguccucuuccaaaacauccgaggcccugaacuggcgcuuuggcuguacauuuugaucaguucuggguuuugguugcagugggccagacauuggaggugagccugugucccgagcacacaacuggagagaaagauagggcaaauguuggucaggaaucucuuagccccugacuccuuagugucuaaccaagccagcccugagaacggagguuucagaaggacuugaaaaaccucugggcagcaaggcggaacuguaagcauagggcccacaugggggcacuggcacucgaggcucauguggcucccauccgcagagcugguggcaguccggcaggcugcagcacgcagggccgggcaagucagcacgcgccaccagggcgggcaggcagaguagaggaaggagguacaggccagcccgugguaggggauguccacagcagcacagcacuucuuuaggcccugggugcucccugucgguccccaaaagaaacuucucuuccccaacucuccuuccccgccaaccccugccgcuagcacggccagcugggcgccuguuaccugaugcccagaacaauucccaaccgucagaaacccgaagcgggccaucugggccaucuguagcgcgcuacccugcccccauccugacucagauggguacccggaguccacccgguugccguuuguuguuccauccaggcggcagccacgcaccccacacacaucuucacaaccacacccacuccaaagacucaccaguucccagcggagcuggcucaggaagcugucaagccgagcgcugugcaugcuggugcuggugcuguacacucuccaggucggccggcucacccgccgaucacccgcgggagcggcgcagagugggccgggucggcccgcgggugguggcguccucacccuugccuuacucuaaggcuccuugcucucgguagcucccgccgcugccgccccaacaucuggcagccgcgccccgccccuccccggcgcccuagccaauggaggcggggcaggaugaaguuguccugccccuuucagccccgcccuccagcccccacucugcugguggagcccggcuguaguagcacgggagaccagagugcagcucaggaccccuuuaugucucaaaaaguuuaguuaacccggcuguaacgcagucccgacacgacccccucccgcccccgcacguucgucccgugcaauuuguccccuggugaaauagcgguuucuuguacuggggcccgaugccacacccacgugugggcacuuucuucuucuuuuuuguuuguuuguuuguuuuuuguuuucgagacaggguuucucuguguagcccuggcuggccuggaacuuacucuguagaccaggcuggccucgaacucagaaauccgccugccucugccucccaagugcugggauuaaaggc

SEQ ID NO: 10440 - RNA, 2501 nt, Mus musculus
gccuuuaaucccagcacuugggaggcagaggcaggcggauuucugaguucgaggccagccuggucuacagaguaaguuccaggccagccagggcuacacagagaaacccugucucgaaaacaaaaaacaaacaaacaaacaaaaaagaagaagaaagugcccacacguggguguggcaucgggccccaguacaagaaaccgcuauuucaccaggggacaaauugcacgggacgaacgugcgggggcgggagggggucgugucgggacugcguuacagccggguuaacuaaacuuuuugagacauaaagggguccugagcugcacucuggucucccgugcuacuacagccgggcuccaccagcagagugggggcuggagggcggggcugaaaggggcaggacaacuucauccugccccgccuccauuggcuagggcgccggggaggggcggggcgcggcugccagauguuggggcggcagcggcgggagcuaccgagagcaaggagccuuagaguaaggcaagggugaggacgccaccacccgcgggccgacccggcccacucugcgccgcucccgcgggugaucggcgggugagccggccgaccuggagaguguacagcaccagcaccagcaugcacagcgcucggcuugacagcuuccugagccagcuccgcugggaacuggugagucuuuggagugggugugguugugaagauguguguggggugcguggcugccgccuggauggaacaacaaacggcaaccggguggacuccggguacccaucugagucaggaugggggcaggguagcgcgcuacagauggcccagauggcccgcuucggguuucugacgguugggaauuguucugggcaucagguaacaggcgcccagcuggccgugcuagcggcagggguuggcggggaaggagaguuggggaagagaaguuucuuuuggggaccgacagggagcacccagggccuaaagaagugcugugcugcuguggacauccccuaccacgggcuggccuguaccuccuuccucuacucugccugcccgcccugguggcgcgugcugacuugcccggcccugcgugcugcagccugccggacugccaccagcucugcggaugggagccacaugagccucgagugccagugcccccaugugggcccuaugcuuacaguuccgccuugcugcccagagguuuuucaaguccuucugaaaccuccguucucagggcuggcuugguuagacacuaaggagucaggggcuaagagauuccugaccaacauuugcccuaucuuucucuccaguugugugcucgggacacaggcucaccuccaaugucuggcccacugcaaccaaaacccagaacugaucaaaauguacagccaaagcgccaguucagggccucggauguuuuggaagaggacucugucugcuguguagaagaggaagaggaggaaggcuugguagcagaagacaaggguuuacccuugggauguccuagggagcaugcucuagacugggacucuggcuucuccgaggugucaggcaguacauggcgagaggaagagccgucuguaccccagcgccaagcaccucgagaacguccaccucauagccagcguuucucagucagugacauuccuaugcgcaguagggcagcuguaaccaacauaccuccugcccaccguccgaggcccaaguccaccccagaugcuugccuggaacauuggcagggauuggaagcagaggacuggacggcagcccugcugaacaggggccgcagucggcagccccuggugcuaggggauaacuguuuugcugauuuaguucacaauuggauggaguugccugaagcaaccagugaggggagugauggagauguaccccgagcacgggcucgacccccucaguuccugcuuggucucucugagcagcuacggcguaggcuggccagggcucgacggacagcuauggcaagcaagagguuguccugcccaccucgcucagaaccugaccugccugcagacaucucacgauuugcagcccucaugaacugucgaagucgccaaccuauuaucuacaaugaugucagcuaccucugacccugccccuccagcuagggacaauaaaggcuuuuuuuccuaaacugcuggucccauacuccugaggcuucaggaaguaucucuggcccuguggagcacagcuaagacaggccagucuagaauguucccucuccuuuuccaggguuccugucuuacccguaucaccuguguguaccuuaccauucauuuucuaccauccacuucacuugugccuuccgucaacaaguuuuuauuguugaaguaucugcugugagcugaagauguaggaauuuuaugcagaguuuguuauggccaagugguggcgugguguggcuaccucgucacagcucauaaugcagaggugggaaggccauuucuuccuccucgcccucacagcucagcucaaacac

SEQ ID NO: 10441 - RNA, 2501 nt, Mus musculus
cagugugugagcccuacccacagcuggcaaaauguguugugacugcaaaauccagcaauagcccaugguuucugcaugauggcaguggcuagguuuucccugaagcaggacuuauagguagagcacaaauggaacacugagccguaugagcaguauacagcagcagccucuguccugucccucuaauccgccaggucuuuccaaaauuccauaugcuugccucugcaaugucggauaaacaacuaguagagcagccagucugguuauccggaagggagaugguaaauucuccauauaacaacaaggugguuuuccauucagcuguagcuuuuccuugaagggagagagcugaagcuuggcgagccuguuucucaggcuaaaacccaaaacaagcaucucaucacacagcgagaugggcaguguguccagggcuaagagcugcgugguacucaacugcauuacugucaaagcaaauguaaaacgggccaguuccuccucuaaaagcuacauucaugggcuggccuguuugagauggcuucaggcuacugacaucucugcaucacugugaguuaucuaagaaaagacuccugaagaaaucaacacaggaggcacaguugggugucugaaaaagcaaacauuauucuuccuuggaguuucuguguaccagaaaaggcaaagcaacauagauauuggcagcuuugaauggagauagaaacaccuccccccaagggggacgauacuccccaggcccaacugguguaaaaauaacgccuuccguuuuacccugucaucucuugguagucuugagucggcugacacaggccaacauucacauccuccgccuuccaugccacuuguuuuugcagaaucuggguuuggcaaacccugaaacaagcugggcucaaaaauauuuggccagaucuauuugguuuaaaccagucuauguggauuuuggcuuucccacuggccggagguguugagcuaaaucauuaagccaugaguucauaucuggugggagguaauucaauagcguuuucugccucaccugaaaguguucacaaacccuugacgaaagcacaugaccgcgaguauuauagggccugauaguauccggugggcaauuuuccuuuccucagagacagugacaggcacgaaaugcuugaggaaagcaaaggaccaaguucauggcucaacuauucccaucuuucccuauuccuagcagugacacuuaucuucccugacagccacucccauugugcucuuucucgacccaacacaauggacauaugcagacgcuggcagacagggaggaugucuuccaucccauugcuccccugugcagagggaccagacuaagguuacauaagccccuccugagcuguugggccccugcgcuauggggaagagaauugggggauugugacgaagucacggucugcaggcccugacuaacccuguacucaccauccuguccugucaaggcggggcggcuggagaaccuaggguugcccaccuugaccacccagcucacgccaaucuggcaggauucgcagugcaggcagacccgaaccugcuguccacuagaucgugggauuccaggccccggccccagauucggaccacagcucccugccccccaggagcccagacgcgcgcucuuaccugcccgggccggggccggggccagggccggggaccggaccgagaccaggggucgggggucccgccgcucgcgcagcgccagccacggggagcuguccgccgccagcuagugcugaaggcggcuucccugcuccggggcccggacccagaccagagccuccgggcggcagcggcccuucgcccgcgccgcccuccaggcuggccucguugcccauggugggcaggcgggcgggcggggucggggucgcacugcgcccgggccggcggcucccgggcggcgcucacacucuccgcuccaccgcagcugccgccaucucccagcucggcucgcacagccgccugcugcugcgcaugcgcgucgcgcgcgcuccugcccugcacacgccccccccccuccccgcgcgcgcucacgccagcccgcgaagacucguguccacgcaccagccucggggucgccgggaaaaggccuccggaacccgcgcaugcgcccuccgcagccaacgcggccggcggguguugaaugaaggccggcggccucggguggcuggcugcaaucugcuggaccacuuuggagguucacuagaccuuagaagcgacuaagagccuugagugguggccuacgucuguaaugccagucaauaggagauugaggcaggaaaaucaaggucauccuuaguuacguagugaguucgaggccagccuacaccaaaccauuuuaaaagaaaaaaaaccgggccagcaaaagggaccaauagguaaagaugcuugcuccaaguuugaugcugugaguuaggagcccacauggugaaaggaaagaaccgacuuccacguugucuucu

SEQ ID NO: 10442 - RNA, 2501 nt, Mus musculus
agaagacaacguggaagucgguucuuuccuuucaccaugugggcuccuaacucacagcaucaaacuuggagcaagcaucuuuaccuauuggucccuuuugcuggcccgguuuuuuuucuuuuaaaaugguuugguguaggcuggccucgaacucacuacguaacuaaggaugaccuugauuuuccugccucaaucuccuauugacuggcauuacagacguaggccaccacucaaggcucuuagucgcuucuaaggucuagugaaccuccaaagugguccagcagauugcagccagccacccgaggccgccggccuucauucaacacccgccggccgcguuggcugcggagggcgcaugcgcggguuccggaggccuuuucccggcgaccccgaggcuggugcguggacacgagucuucgcgggcuggcgugagcgcgcgcggggaggggggggggcgugugcagggcaggagcgcgcgcgacgcgcaugcgcagcagcaggcggcugugcgagccgagcugggagauggcggcagcugcgguggagcggagagugugagcgccgcccgggagccgccggcccgggcgcagugcgaccccgaccccgcccgcccgccugcccaccaugggcaacgaggccagccuggagggcggcgcgggcgaagggccgcugccgcccggaggcucuggucuggguccgggccccggagcagggaagccgccuucagcacuagcuggcggcggacagcuccccguggcuggcgcugcgcgagcggcgggacccccgaccccuggucucgguccgguccccggcccuggccccggccccggcccgggcagguaagagcgcgcgucugggcuccuggggggcagggagcugugguccgaaucuggggccggggccuggaaucccacgaucuaguggacagcagguucgggucugccugcacugcgaauccugccagauuggcgugagcuggguggucaaggugggcaacccuagguucuccagccgccccgccuugacaggacaggauggugaguacaggguuagucagggccugcagaccgugacuucgucacaaucccccaauucucuuccccauagcgcaggggcccaacagcucaggaggggcuuauguaaccuuagucuggucccucugcacaggggagcaaugggauggaagacauccucccugucugccagcgucugcauauguccauuguguugggucgagaaagagcacaaugggaguggcugucagggaagauaagugucacugcuaggaauagggaaagaugggaauaguugagccaugaacuugguccuuugcuuuccucaagcauuucgugccugucacugucucugaggaaaggaaaauugcccaccggauacuaucaggcccuauaauacucgcggucaugugcuuucgucaaggguuugugaacacuuucaggugaggcagaaaacgcuauugaauuaccucccaccagauaugaacucauggcuuaaugauuuagcucaacaccuccggccagugggaaagccaaaauccacauagacugguuuaaaccaaauagaucuggccaaauauuuuugagcccagcuuguuucaggguuugccaaacccagauucugcaaaaacaaguggcauggaaggcggaggaugugaauguuggccugugucagccgacucaagacuaccaagagaugacaggguaaaacggaaggcguuauuuuuacaccaguugggccuggggaguaucgucccccuuggggggagguguuucuaucuccauucaaagcugccaauaucuauguugcuuugccuuuucugguacacagaaacuccaaggaagaauaauguuugcuuuuucagacacccaacugugccuccuguguugauuucuucaggagucuuuucuuagauaacucacagugaugcagagaugucaguagccugaagccaucucaaacaggccagcccaugaauguagcuuuuagaggaggaacuggcccguuuuacauuugcuuugacaguaaugcaguugaguaccacgcagcucuuagcccuggacacacugcccaucucgcugugugaugagaugcuuguuuuggguuuuagccugagaaacaggcucgccaagcuucagcucucucccuucaaggaaaagcuacagcugaauggaaaaccaccuuguuguuauauggagaauuuaccaucucccuuccggauaaccagacuggcugcucuacuaguuguuuauccgacauugcagaggcaagcauauggaauuuuggaaagaccuggcggauuagagggacaggacagaggcugcugcuguauacugcucauacggcucaguguuccauuugugcucuaccuauaaguccugcuucagggaaaaccuagccacugccaucaugcagaaaccaugggcuauugcuggauuuugcagucacaacacauuuugccagcuguggguagggcucacacacug

SEQ ID NO: 10443 - RNA, 2501 nt, Mus musculus
gaccugccaaacuagacccgaacucaggaaugauuccuaugccguggguagaccauguucgcagacuucaaacccguuucuccggcgccauagagccaccggguacaccaggauugauucucagugggauauaguucucccaaagacgcuuaaagaaacaccaaaccagcaauaacagccaaauaagcuaagagaaaaugaaacucgcaggcgacccgauccaauuaauaaauacuuaauugaauuagugucaccucuaacagccaauagcaaaguccccuagccauggggcugcgaagccccucccuggccgcacauauauaagcagccaaccaccgcucacaaguuuccaagcggucaaguaugccuagaguuuagcagagccagccgagaggaaauggcugguugcuaaaugggaacucagagcuaaguccucuucuuccuuagugugaguguagggguccugagagguuagacaaggagggaaggaagaaaagaaggaaggaaggaaggaaggaaggaaggaaggaaggaaggaaggaaggaaggaaggagagagacaccuacaacccgggguuuguuuucuugcggaaggaaaggggcaccuacaaucccgaguuuguucccuugagggaaggacgcuaaauugggcgcgcgcugaagccgccccgcagguccgcagguggguagccuaggcgagggaggaaggggacauuaccuuccccucggaagagggcgcuggcucccccaacuggccuuuauaaccaggccgcgggaggcgaggaggcagccgguugccgucugcgauucgcuaaagcaugcaguugggagagcagcuccuggugagcucggugaaccugcccggcgcgcacuucuacucgcuggagagugcucgcggaggaggaggaggaggaggcggaggaggagggggaggcggagggagcgucagccuccuccccggugcugcccccucgccccagaggcuggacuuagacaaagcguccaagaaguuuccgggcagucucccgugccaggcggggagcgcagaacccgcaggcgccggcgcgggggcccccgcggccaugcucagugacgcggacgcuggggacaccuucgggagcaccucggcgguggccaagcccgggcccccggacggccgcaagggcuccccgugcgcggaggaggagcugcccuccgccgccaccgccgcggccaccgcgcgcuacuccauggacagccugagcuccgagcgcuacuaccucccgucgccgggaccgcagggcuccgagcucgccgcgcccugcucgcucuuccaguacccggcggcggccggagcagcccacggacccguguaccccgcguccaauggcgcgcgcuaccccuacggcuccaugcugccccccgguggauuccccgccgccgugugcccgcccgcgagggcgcaguucggccccgcugcggguucggggagcggcgcugguagcagcggcgguggugccggcgguccuggcgccuaucccuacggccaggguucuccgcucuacgggccauacgccggaaccucagcggccgggucuuguggaggauuggggggccuaggggugccuggcuccggcuuccgcgcccacgucuaccugugcaaccggccccuauggcucaaauuccaccggcaccaaacugagaugaucaucaccaaacagggcaggugagugcaggguggagggaccccaggcgccugguuguccgcacacugcgggcucugcuuaggguguuuaagugguacaucauaucuccaaagucgugucccuuacuuccuaaggcacaccuguagcuugggcuccgagcccacguuacucuccucucuagucaccuucaccgggauugacugggaggaggaggaggcggagauggaaauuugggaaugaacccuugagggcagaucuacgugacccgcuggcuccuggguuugcagcaggcgauuugugggcugcauagcgaaagagggcuagcuggagcuggcugcggccugcgcacaaguguuugaaaagaagcuuuuuaaagcuccuugguuugguggggcucuucuguaagaagagcagaaagaagucgguuugagcuggugacuagguagacaguuuuuggagccagauguuugggggagggggcucugcuugcggggaagggaccagaaaguucaggcacaccuucaaauugucaucagcuacuucuugaggaagugaggaguggauauugggagacagggacccaaagagggcucguugagagagagagagagagagagagagagagagagugcaagaaggcgcgcuccggccuaauguucucagucaccuaugucuuuaaaaauaauuuuagacauuucagaaagaaaccuaguagauaccugaaaauagauggaugucucagaaaagaagcacgcgaauuagggaaaauacugauuuggaggcuguuccaaauaaauaugucaauuuaaaaccauu

SEQ ID NO: 10444 - RNA, 2501 nt, Mus musculus
aaugguuuuaaauugacauauuuauuuggaacagccuccaaaucaguauuuucccuaauucgcgugcuucuuuucugagacauccaucuauuuucagguaucuacuagguuucuuucugaaaugucuaaaauuauuuuuaaagacauaggugacugagaacauuaggccggagcgcgccuucuugcacucucucucucucucucucucucucucucucucaacgagcccucuuugggucccugucucccaauauccacuccucacuuccucaagaaguagcugaugacaauuugaaggugugccugaacuuucuggucccuuccccgcaagcagagcccccucccccaaacaucuggcuccaaaaacugucuaccuagucaccagcucaaaccgacuucuuucugcucuucuuacagaagagccccaccaaaccaaggagcuuuaaaaagcuucuuuucaaacacuugugcgcaggccgcagccagcuccagcuagcccucuuucgcuaugcagcccacaaaucgccugcugcaaacccaggagccagcgggucacguagaucugcccucaaggguucauucccaaauuuccaucuccgccuccuccuccucccagucaaucccggugaaggugacuagagaggagaguaacgugggcucggagcccaagcuacaggugugccuuaggaaguaagggacacgacuuuggagauaugauguaccacuuaaacacccuaagcagagcccgcagugugcggacaaccaggcgccuggggucccuccacccugcacucaccugcccuguuuggugaugaucaucucaguuuggugccgguggaauuugagccauaggggccgguugcacagguagacgugggcgcggaagccggagccaggcaccccuaggccccccaauccuccacaagacccggccgcugagguuccggcguauggcccguagagcggagaacccuggccguagggauaggcgccaggaccgccggcaccaccgccgcugcuaccagcgccgcuccccgaacccgcagcggggccgaacugcgcccucgcgggcgggcacacggcggcggggaauccaccggggggcagcauggagccguagggguagcgcgcgccauuggacgcgggguacacggguccgugggcugcuccggccgccgccggguacuggaagagcgagcagggcgcggcgagcucggagcccugcggucccggcgacgggagguaguagcgcucggagcucaggcuguccauggaguagcgcgcgguggccgcggcgguggcggcggagggcagcuccuccuccgcgcacggggagcccuugcggccguccgggggcccgggcuuggccaccgccgaggugcucccgaagguguccccagcguccgcgucacugagcauggccgcgggggcccccgcgccggcgccugcggguucugcgcuccccgccuggcacgggagacugcccggaaacuucuuggacgcuuugucuaaguccagccucuggggcgagggggcagcaccggggaggaggcugacgcucccuccgccucccccuccuccuccgccuccuccuccuccuccuccgcgagcacucuccagcgaguagaagugcgcgccgggcagguucaccgagcucaccaggagcugcucucccaacugcaugcuuuagcgaaucgcagacggcaaccggcugccuccucgccucccgcggccugguuauaaaggccaguugggggagccagcgcccucuuccgaggggaagguaauguccccuuccucccucgccuaggcuacccaccugcggaccugcggggcggcuucagcgcgcgcccaauuuagcguccuucccucaagggaacaaacucgggauuguaggugccccuuuccuuccgcaagaaaacaaaccccggguuguaggugucucucuccuuccuuccuuccuuccuuccuuccuuccuuccuuccuuccuuccuuccuuccuucuuuucuuccuucccuccuugucuaaccucucaggaccccuacacucacacuaaggaagaagaggacuuagcucugaguucccauuuagcaaccagccauuuccucucggcuggcucugcuaaacucuaggcauacuugaccgcuuggaaacuugugagcggugguuggcugcuuauauaugugcggccagggaggggcuucgcagccccauggcuaggggacuuugcuauuggcuguuagaggugacacuaauucaauuaaguauuuauuaauuggaucgggucgccugcgaguuucauuuucucuuagcuuauuuggcuguuauugcugguuugguguuucuuuaagcgucuuugggagaacuauaucccacugagaaucaauccugguguacccgguggcucuauggcgccggagaaacggguuugaagucugcgaacauggucuacccacggcauaggaaucauuccugaguucgggucuaguuuggcagguc

SEQ ID NO: 10445 - RNA, 2501 nt, Mus musculus
ucuccagcuaauggaggggacugagggcaccucuccagcagacccccaacugcccaagucagaaagugaccagugcugugggaccugcacuguggagaggagugcagacuccccaucagcuaacaaguacaagccacagugaccacgcccucccacagagacccuccuugaccccucuccccuccccaucggguuggcaguguaggcaggagcugcuucuggaggucacgguggaugccacgcuugaagcgcugggcccacagguccgucagcuuggccacaguguacauuccaguccugcaggaaaggcuggacugagucacaacuccaggaggcugggcucaaacaggaugggccaggcuggccaagccugugcuguauuagacugaggcucugugucuuccuggguacgggagauaccagggcugacccaagaaagaaaugggaccaggguacagacacugaggccugcuccaugacccagguuccaugacacuauggcggucagaggcagccagagggaggcggccaggggagagcccgccccucuccacugugacccucagagcggccacccucuguucccaccagucaggagcuguaggggcaucucugaccucuggagagaaugagggaacagugggaggggcaggaacacagcccaacaagguggcuuuuagaaacccaagcuuacugggcccccacaacaauaaaguccaggucaacugaugcaaaacagguugggggcugccugcagggcacacauccaagggggaguggagcggaggacaggugaacacaaaaaucuacagcccaggaggcaaggcgucuuaguggguaaaggcaauugcugccaagcccagugaccugaguuugauccuagaacgcacaagauagaaggagauaacugauuccugcaaguuguccucugaucuccauacacccauacccccuccagcacaaguacacguuguuuaauuaaaaaacaaaaaccaagaaccuacaaucucagggauacucgaguuaagugaaaaauacugugaaaccguggaucgaugugagaggagcagguauugcugagcuaauagaugaccuggggagacacgaaggaaagacuccccacagccccucccacagagugugcguaaauaccacuuaguuccuugcucuucccuggacgcuucuaagacaggcagccaggagccugcgcuuucccucucugcuagagggacaggcauggggagaagagcuagcccagaugggaagaaacaaagccggcuggacaaaggaccaagcugccaggcgguucuaacugagaucuggcccaguccgaccaggagggucagcaaaaagacagcgcugcuccucccagcccuggcaucgcuuuucucuguucuggggagcgaaggcugccagaacgacuucagccaaacuugcacaccuccuccucgccccacccauuuacacccucauccgccacacccgcgcggccugacucgcuucaggcgcacccguguuuuggggagccucugaaucgagaguuuggcuaaggaugcugucccuuuccuucccugaccccuuuggugccaucuggacccaggagcccagccuuuuaugaacaggcuaaggggaaauccccgagagaugucagcauugcuccccgaucucuugggccagauuugggggaaagucuggaaacgcccaagguuguguccagcgcgggccgagguuuuucugggaucccacaaggggacaaggaguuggcucucuggugguuuaaaugcggccgaaggagcuguuaucccugccgcccggguguauuucggcuuucccgagggucuccccuacguucgggacacucaccgugcaaggucaggaagucccgaccggaguccaugccggucggggcgcgcggaggaggggacgcggcgugauucacuugagcaaaaucaccaagcggccugggguccuugcgcaguccggugcagggacccaacugaacugagaugggaggcggccggggguggguccagaacaccguaccgccccccggacccgccaaccggcgcuucuccccgcccccuccaggggaccuggaaaggacgcggugcugggggccgggaagacuagccaacccuggccggggcucgggccagcugggugcgccagggccagaaauagucagaucccuccugcuuccuccaccgccaccacccacaggcccugucauuacggcgagcugccggccccacgcccugccugugggcgccuggccucgccgggguugugggugaugugggaaagaaucagaaucgggucuuagcggggacaggaaucacugcuaaagcggcugauuagccaggcagucuggucugucuucuaagaaaugcgugcaugcacgggcccacauugccacguuuggggagaguaauaucuagauuuuuuuuucaagagaggggccccucucuuuagcucugagagacgucucauuuccgggggug

SEQ ID NO: 10446 - RNA, 2501 nt, Mus musculus
cacccccggaaaugagacgucucucagagcuaaagagaggggccccucucuugaaaaaaaaaucuagauauuacucuccccaaacguggcaaugugggcccgugcaugcacgcauuucuuagaagacagaccagacugccuggcuaaucagccgcuuuagcagugauuccuguccccgcuaagacccgauucugauucuuucccacaucacccacaaccccggcgaggccaggcgcccacaggcagggcguggggccggcagcucgccguaaugacagggccugugggugguggcgguggaggaagcaggagggaucugacuauuucuggcccuggcgcacccagcuggcccgagccccggccaggguuggcuagucuucccggcccccagcaccgcguccuuuccagguccccuggagggggcggggagaagcgccgguuggcggguccggggggcgguacgguguucuggacccacccccggccgccucccaucucaguucaguugggucccugcaccggacugcgcaaggaccccaggccgcuuggugauuuugcucaagugaaucacgccgcguccccuccuccgcgcgccccgaccggcauggacuccggucgggacuuccugaccuugcacggugagugucccgaacguaggggagacccucgggaaagccgaaauacacccgggcggcagggauaacagcuccuucggccgcauuuaaaccaccagagagccaacuccuuguccccuugugggaucccagaaaaaccucggcccgcgcuggacacaaccuugggcguuuccagacuuucccccaaaucuggcccaagagaucggggagcaaugcugacaucucucggggauuuccccuuagccuguucauaaaaggcugggcuccuggguccagauggcaccaaaggggucagggaaggaaagggacagcauccuuagccaaacucucgauucagaggcuccccaaaacacgggugcgccugaagcgagucaggccgcgcggguguggcggaugaggguguaaauggguggggcgaggaggaggugugcaaguuuggcugaagucguucuggcagccuucgcuccccagaacagagaaaagcgaugccagggcugggaggagcagcgcugucuuuuugcugacccuccuggucggacugggccagaucucaguuagaaccgccuggcagcuugguccuuuguccagccggcuuuguuucuucccaucugggcuagcucuucuccccaugccugucccucuagcagagagggaaagcgcaggcuccuggcugccugucuuagaagcguccagggaagagcaaggaacuaagugguauuuacgcacacucugugggaggggcuguggggagucuuuccuucgugucuccccaggucaucuauuagcucagcaauaccugcuccucucacaucgauccacgguuucacaguauuuuucacuuaacucgaguaucccugagauuguagguucuugguuuuuguuuuuuaauuaaacaacguguacuugugcuggaggggguauggguguauggagaucagaggacaacuugcaggaaucaguuaucuccuucuaucuugugcguucuaggaucaaacucaggucacugggcuuggcagcaauugccuuuacccacuaagacgccuugccuccugggcuguagauuuuuguguucaccuguccuccgcuccacucccccuuggaugugugcccugcaggcagcccccaaccuguuuugcaucaguugaccuggacuuuauuguugugggggcccaguaagcuuggguuucuaaaagccaccuuguugggcuguguuccugccccucccacuguucccucauucucuccagaggucagagaugccccuacagcuccugacuggugggaacagaggguggccgcucugagggucacaguggagaggggcgggcucuccccuggccgccucccucuggcugccucugaccgccauagugucauggaaccugggucauggagcaggccucagugucuguacccuggucccauuucuuucuugggucagcccugguaucucccguacccaggaagacacagagccucagucuaauacagcacaggcuuggccagccuggcccauccuguuugagcccagccuccuggaguugugacucaguccagccuuuccugcaggacuggaauguacacuguggccaagcugacggaccugugggcccagcgcuucaagcguggcauccaccgugaccuccagaagcagcuccugccuacacugccaacccgauggggaggggagaggggucaaggagggucucugugggagggcguggucacuguggcuuguacuuguuagcugauggggagucugcacuccucuccacagugcaggucccacagcacuggucacuuucugacuugggcaguugggggucugcuggagaggugcccucaguccccuccauuagcuggaga

SEQ ID NO: 10447 - RNA, 2501 nt, Mus musculus
ugagagguuugggcacagaaagaaacauucaaagggcaaggcgcagaaucgcccaugggauucaugggaaaggccuuccaaagcggagaagcucagcguuccaacagcuacagaaagguaagauagaacucucccugugaggucagcccccugcuugcagucaaggggacgcucuuggcccuuugacccuuuccuccugcucuguacugggggagaggugcacaaggccuccggcucuuuucagaucucaggcugucucagcgccgacccacuuccugccugagggguucccaaggucagagccugguggcccccagcagaagcgauagggcggaucuaaggaaucuuaccagcacuugauuauuauuauuuuuuaauguuguccuaaaacgguuuuauauuucauccgaagacagugucaaaaucaguucagaaaagggucuguuagccggcuucccuuaccaacgagguaagcccuccgcccaccuccccugugaacaccgccugucuacugcucagcgcugugcagcguaccucagggaagaaaagugaaaauuuugcuccuugugcguccucuguuuccuccucccugccagugcugaaaggaucaagauuggagccgcagcagaagccugacggggagcggacacccuuaccuuugcggaccugcuggauguaucgcgcuagcagugcgcccaggcgcgcucggggcucgccguccguccggagcacagcccgcagcugccuucggggcgccucuugcgcccgcugcuccacgggguccguagcuucugcagggacuaccggcugcgccagggcgccagcagcuaggacugccaucaccacgcacagacauacgccgcucuucauggcuaugggaagcaaaggcgaggagagugaaccaaagacuggccucagcgugcuccagcccaaagucccgcacacagaagucggcugaggcugaacaugggggcugcagccgggucagacuggcucaaccguagccaagcgaaguuccuagaugcgcccuggccaccgcgauaauuucugccuggcuuuuguguuauccacaccugggaccugggaaucccgcagagucccgauuuuucugcccugaucagaagcagcguuuccucuugcuuuccugaaguuccaggacgccuuuguagcucaucucucuucuaaccagaaaagcagaaugaagcgugugugugugugugugugugugugugugugugugugugugugugagagagagagagagagagagagagagagagagagagagagucagagagacagagagagacacagaaagacaaacggacagacaaacacggggaggauacuucuggagagaaaugugagagauuaaauuuauucacuacauuaaaaaugucaggacacugggaaacgccguuuuaagugugggcccauaaaaagaagcuguauuuauauagauucuucugcguuuuacgggaagucacuauacaaagcaaaagccagaaaucugugcccaguccucagauguggccaaagcccugcuacacuugagaacugagcagaugggugcuguaucauaaugauguguuuuuauuccccaaagccuuaaaauuuuuuuaaugcagcauuuagaaaaugggcauaaaucuuuaaaccucuagguaguuucuuuuaaaugauugcaaagugcuccgaacagcagagaaacccuaagaguggcuauucccagccuugcuguaaacagaacauacaacaagucucuccgcagcaguacccacccagaugcauuuuaaggcuauuucugacuucaggaaaucuuucuagcugucaagggagggaaggcacagaaaaaggaaagacuaaacagcaagaggugcaaagcugcaggccaauauucuucacacucaagauuguuggaucagccagcuacuuaccuuuggauggggaaaucagcuggcuuggcgaguuccagcggagaaggcugcaguccagcuaaguugagggcaggcgggagggugacugcucuuaaauagcuccucccgguucgcagccagucaucuguuuacccagugcugacgcaguccagcaggacacgugcucagaggcagccacuggagggaccaccgauugauguggcccuccggagagaagggaagcgucccagugaaugaggauagccccucccaggggggcacuuugcaugggucuuacucuuuaucuaaagagcuuccuucccaccuguucggcgccugugcagaguccaccucagggagggugccaccuccacucucggugaaaaacaggaguuuaucugcaauggagaagcugaccaaguucagugagcuuuggggaucaaauccuucaaggaaacugggggacccucacaggcugggugucagcagauguaauccugguguguucucugggaccaccucagaccugagugggcucucacaaguaagagagggaaaucgggcucccaauuuuucagaacucaa

SEQ ID NO: 10448 - RNA, 2501 nt, Mus musculus
uugaguucugaaaaauugggagcccgauuucccucucuuacuugugagagcccacucaggucugagguggucccagagaacacaccaggauuacaucugcugacacccagccugugagggucccccaguuuccuugaaggauuugauccccaaagcucacugaacuuggucagcuucuccauugcagauaaacuccuguuuuucaccgagaguggagguggcacccucccugagguggacucugcacaggcgccgaacaggugggaaggaagcucuuuagauaaagaguaagacccaugcaaagugccccccugggaggggcuauccucauucacugggacgcuucccuucucuccggagggccacaucaaucgguggucccuccaguggcugccucugagcacguguccugcuggacugcgucagcacuggguaaacagaugacuggcugcgaaccgggaggagcuauuuaagagcagucacccucccgccugcccucaacuuagcuggacugcagccuucuccgcuggaacucgccaagccagcugauuuccccauccaaagguaaguagcuggcugauccaacaaucuugagugugaagaauauuggccugcagcuuugcaccucuugcuguuuagucuuuccuuuuucugugccuucccucccuugacagcuagaaagauuuccugaagucagaaauagccuuaaaaugcaucuggguggguacugcugcggagagacuuguuguauguucuguuuacagcaaggcugggaauagccacucuuaggguuucucugcuguucggagcacuuugcaaucauuuaaaagaaacuaccuagagguuuaaagauuuaugcccauuuucuaaaugcugcauuaaaaaaauuuuaaggcuuuggggaauaaaaacacaucauuaugauacagcacccaucugcucaguucucaaguguagcagggcuuuggccacaucugaggacugggcacagauuucuggcuuuugcuuuguauagugacuucccguaaaacgcagaagaaucuauauaaauacagcuucuuuuuaugggcccacacuuaaaacggcguuucccaguguccugacauuuuuaauguagugaauaaauuuaaucucucacauuucucuccagaaguauccuccccguguuugucuguccguuugucuuucugugucucucucugucucucugacucucucucucucucucucucucucucucucucucucucucacacacacacacacacacacacacacacacacacacacacacacgcuucauucugcuuuucugguuagaagagagaugagcuacaaaggcguccuggaacuucaggaaagcaagaggaaacgcugcuucugaucagggcagaaaaaucgggacucugcgggauucccaggucccagguguggauaacacaaaagccaggcagaaauuaucgcgguggccagggcgcaucuaggaacuucgcuuggcuacgguugagccagucugacccggcugcagcccccauguucagccucagccgacuucugugugcgggacuuugggcuggagcacgcugaggccagucuuugguucacucuccucgccuuugcuucccauagccaugaagagcggcguaugucugugcguggugauggcaguccuagcugcuggcgcccuggcgcagccgguagucccugcagaagcuacggaccccguggagcagcgggcgcaagaggcgccccgaaggcagcugcgggcugugcuccggacggacggcgagccccgagcgcgccugggcgcacugcuagcgcgauacauccagcagguccgcaaagguaaggguguccgcuccccgucaggcuucugcugcggcuccaaucuugauccuuucagcacuggcagggaggaggaaacagaggacgcacaaggagcaaaauuuucacuuuucuucccugagguacgcugcacagcgcugagcaguagacaggcgguguucacaggggaggugggcggagggcuuaccucguugguaagggaagccggcuaacagacccuuuucugaacugauuuugacacugucuucggaugaaauauaaaaccguuuuaggacaacauuaaaaaauaauaauaaucaagugcugguaagauuccuuagauccgcccuaucgcuucugcugggggccaccaggcucugaccuugggaaccccucaggcaggaagugggucggcgcugagacagccugagaucugaaaagagccggaggccuugugcaccucucccccaguacagagcaggaggaaagggucaaagggccaagagcguccccuugacugcaagcagggggcugaccucacagggagaguucuaucuuaccuuucuguagcuguuggaacgcugagcuucuccgcuuuggaaggccuuucccaugaaucccaugggcgauucugcgccuugcccuuugaauguuucuuucugugcccaaaccucuca

SEQ ID NO: 10449 - RNA, 2501 nt, Mus musculus
aggaaggucucugaguuugggcagaggaaacuccuucccauuuuaggagugauugccaaggaaaaagacauguucaccaagcaggacacccaaacaugcuauaaccaggaguggccacaugagauacggucugugaggaaggcugugagcacucaggccuggaagacaguggaaaggagagggaguugagcccucuucauaggcagcagcauuucuagacuaaggaauccagaggcaacuggguucugggucgagagaccuuccaguucuggaaaggcccagacacaccccacccucgccccaugagcccccauagcugacucaaggcugcucagagagaaagccucugcccagcuguccucugugcgucaugugcaggaggccagcagcuccucuuacagguucugggcauccucuauauauagcccagggcagacagcugcgcagucagugcacagccccacaagacagcagaggugugcagggcugcccucgauacacagacuugcugaguuccagggagccgcaccaugacgcugggcuuggagcaggcggaggaacagcgucuguaccagcagacgcuccugcaagacggccucaaggacaugcuggaccacggcaaguuccuagacuguguagugcgcgugggugagcgcgaguucccgugccaccgccuggugcuagccgccuguagccccuacuuccgcgcgcgcuuccuggcugagccagauagcgcgggagagguacgccuggaggaggugucgccagacguagugucccaggugcugcacuaccuguacacaucagagaucgcgcuggaugaggcaagcgugcaagaccuguuugccgcggcgcaucgauuccagaucccguccaucuucaccaucugcgugucguuucugcagaagcgccugugcuuggccaauugccuggcugucuuccgccucggccuccugcuggacugcgcgcgucuggcuguggccgcgcgcgacuucaucugcgcgcgcuucccgcugguggcgcgggacaacgacuuccugggacucucggcugacgagcugaucgccaucaucuccagcgacggccucaacguagagaaggaggaggcaguguuugaggcugugaugcgcugggccagcagcggagaugcugaggcgcaggcggagcgccagcgcgcgcugcccacggucuucgagagcguucgcugccgccugcugccucgugcuuuccuggagacucgcguggagcgccacccacuugugcgcucccagcccgagcuguugcgcaaggugcagauggugaaggaugcacaugagggccgccucacuacacugcgcaagaagaagaaggaaaagggugagcagacagcucgggccaaggaggccaaccagggcacagaagacaccaaggcugaggacgaugaggaacgaguacugcccgggauccucaaugacacucugcgcuucggcauguuccuucaggaucucaucuucaugaucagcgaggaaggcgccguggcuuacgacccagccgccaacgagugcuacugugcaucccuguccacccagauccccaagaaccaugucagucuggugaccaaggagaaccaagucuucguggccgguggccucuucuacaaugaggacaacaaggaggacccuaugagugcuuacuuccugcaggugccuggccagucuugagaggaagggacuggugcuggguucuggguacuaggaggcaacuuagggccugggaagggccugugucuaccugggacugucauuggaucuaggaccuuugauuggcagccacuugcuugaagugggaagaguuacagccaguuuccaaagagucugguaucuguguuaggcucaguguacaacaagcuggggagcuggaggcccccuggcccagcacagggguugggggcagagacauggagaagaaucauaagcagagcuuugacagaagugccaggucaggggugggagacagauuauuacacagaaagcaccuugccuucucguuuccagggaaggaaacugagucucagcagggucugggagacaggcaagcaggcccagguugaggaugugacugugggaccucagagggagggagaaucuacagccuggucccaugguuuugagccuugucggcugggugaaaucuggagauaugaagggggggggggggagggaguuaguaacccaggcuggcgauccugugacagagcagagccaggugagcaguuauaggcaggcaggagcaaaugggcagcuggaggccaaggucaaguccacaggccucacagcuggaggaggagaggggcagcucucccaagcuggcugggggaaguuucagagguugcauaguaucaaguguccauccacacaaugcagcuguuggacaacucuccaaggugggcucuuugugccuauaaccacucgguuaggcagauaaaaaggguggcauggaaggcuauagauuuuaagggacuu

SEQ ID NO: 10450 - RNA, 2501 nt, Mus musculus
aagucccuuaaaaucuauagccuuccaugccacccuuuuuaucugccuaaccgagugguuauaggcacaaagagcccaccuuggagaguuguccaacagcugcauuguguggauggacacuugauacuaugcaaccucugaaacuucccccagccagcuugggagagcugccccucuccuccuccagcugugaggccuguggacuugaccuuggccuccagcugcccauuugcuccugccugccuauaacugcucaccuggcucugcucugucacaggaucgccagccuggguuacuaacucccucccccccccccccuucauaucuccagauuucacccagccgacaaggcucaaaaccaugggaccaggcuguagauucucccucccucugaggucccacagucacauccucaaccugggccugcuugccugucucccagacccugcugagacucaguuuccuucccuggaaacgagaaggcaaggugcuuucuguguaauaaucugucucccaccccugaccuggcacuucugucaaagcucugcuuaugauucuucuccaugucucugcccccaaccccugugcugggccagggggccuccagcuccccagcuuguuguacacugagccuaacacagauaccagacucuuuggaaacuggcuguaacucuucccacuucaagcaaguggcugccaaucaaagguccuagauccaaugacagucccagguagacacaggcccuucccaggcccuaaguugccuccuaguacccagaacccagcaccagucccuuccucucaagacuggccaggcaccugcaggaaguaagcacucauaggguccuccuuguuguccucauuguagaagaggccaccggccacgaagacuugguucuccuuggucaccagacugacaugguucuuggggaucuggguggacagggaugcacaguagcacucguuggcggcugggucguaagccacggcgccuuccucgcugaucaugaagaugagauccugaaggaacaugccgaagcgcagagugucauugaggaucccgggcaguacucguuccucaucguccucagccuuggugucuucugugcccugguuggccuccuuggcccgagcugucugcucacccuuuuccuucuucuucuugcgcaguguagugaggcggcccucaugugcauccuucaccaucugcaccuugcgcaacagcucgggcugggagcgcacaaguggguggcgcuccacgcgagucuccaggaaagcacgaggcagcaggcggcagcgaacgcucucgaagaccgugggcagcgcgcgcuggcgcuccgccugcgccucagcaucuccgcugcuggcccagcgcaucacagccucaaacacugccuccuccuucucuacguugaggccgucgcuggagaugauggcgaucagcucgucagccgagagucccaggaagucguugucccgcgccaccagcgggaagcgcgcgcagaugaagucgcgcgcggccacagccagacgcgcgcaguccagcaggaggccgaggcggaagacagccaggcaauuggccaagcacaggcgcuucugcagaaacgacacgcagauggugaagauggacgggaucuggaaucgaugcgccgcggcaaacaggucuugcacgcuugccucauccagcgcgaucucugauguguacagguagugcagcaccugggacacuacgucuggcgacaccuccuccaggcguaccucucccgcgcuaucuggcucagccaggaagcgcgcgcggaaguaggggcuacaggcggcuagcaccaggcgguggcacgggaacucgcgcucacccacgcgcacuacacagucuaggaacuugccgugguccagcauguccuugaggccgucuugcaggagcgucugcugguacagacgcuguuccuccgccugcuccaagcccagcgucauggugcggcucccuggaacucagcaagucuguguaucgagggcagcccugcacaccucugcugucuuguggggcugugcacugacugcgcagcugucugcccugggcuauauauagaggaugcccagaaccuguaagaggagcugcuggccuccugcacaugacgcacagaggacagcugggcagaggcuuucucucugagcagccuugagucagcuaugggggcucauggggcgaggguggggugugucugggccuuuccagaacuggaaggucucucgacccagaacccaguugccucuggauuccuuagucuagaaaugcugcugccuaugaagagggcucaacucccucuccuuuccacugucuuccaggccugagugcucacagccuuccucacagaccguaucucauguggccacuccugguuauagcauguuuggguguccugcuuggugaacaugucuuuuuccuuggcaaucacuccuaaaaugggaaggaguuuccucugcccaaacucagagaccuuccu

SEQ ID NO: 10451 - RNA, 2501 nt, Mus musculus
uggcucacagaacuauuuauugauuuuccuggggcaccaugugaaaacaaacuaugccaagcgcugugaaccugugcucuguagaaaggacguacgugucuggggcccagugaacugauuagcaauccccaucggaaccauucugaaagcgauuucaccugucucagccaggaagacagauggcgccccucuuuucaggaauuucuucaugauucauuugcgucuuggaucccucucccaaaagcaaauaaaggaaacauacacauuucuggaggaaaaugucuguauuaaaagccagaaaaccacauuaauacaagaagaaacgcccaccaggccaugucacugaauagaucgacuuggaaaagauucauaaaguucuuuuguaagcaauuacaauaaauccgugucaaaucuucccucgucccccccuuuaaaaaaacaaacaagaagcuucaaauacaacuacauucagauacaaagagcuccuguuaccacagcuuuagcaguugaaucuuuuuguuuuguauuuuuuuuuacuaaaacuuucauuuaaaacaguuauuaaauauauaaaacaaauacacaggaucuggucacuuucugccauaaauaaagggcaugugggcgcagggagggggugccgcaggggaaagagccgguuucccuuguguccucgagccacgcguggaucccacccuucagcccgagagcuugccccugcucuuccgaaccagaaccucagcacaaaccccacuuucccaccucauuugugccucucugcgguccccucccgggaaaaggaugaacaauaaggacagcacgaagcgcaccugccccgucuccggugaggaaggcgcgugcgagcgcuuacacagcgcggacgcggggcggagggggucacuuaggagccacccccgaggugacagccgcggcagcagcagcagcagcugcagcagcggcggcggcagcggcgguaguccccgcggguacggcugcaggagcggccgcgggggcgccggcggugguccggcgcugcuccaugccguugggcaggaagccggcaaugaugggcaccggccagaugagggcggccacgcuccacaccacgaugaccagggucaugaagcaggccaccagcguagacucgaugggcuugcgguucagccgccagcccggcucgcccugcagcuccuccaggcugaaguccaggcagcagaagugacgaggcucgcccugcagccacagcggccccggcucggccgccggguaggcaggcagcgcggugggagccccggcgggagcccgcaggcggccgcgcacccagccgcagcccacgcacaggcgcaggucuugcugcgcgccgcccgccgccagccccagaugcucgaugagcagugguggcccgacgcgguggaaggcggcggcgaagaaggcgcggccgugcgcguugguagagaagagcagcaggucgcacugcaagccccgcgggcggccccagcgcacgagcagcgagcucagcaucugucguugcacgcugauguugcagggcgccgccggagccuccucugggcccgcgcgcucugggggcgccgaugccgccgaugccagcagacgcgggguggaguguucguuggugaaggacgcauuggccgaggcguuugggggcgucccugcaaggccgggcgcauccguggccccgccgugcgccggcggcagcuggcaggcggcggccaguagcgcggcgagaaggggcagcauggccuguggcgagcgccuacgcgcgcggggcaggcggcggcugcauggcgcgcaggcgaccguccggugagggaaccgcggggccuggaaggccgaggcggaacucugccaguguauugggacgacaccggcucacgggccgcgauggccucuucagacuccgcucgucgagguuccgcugcccccagagcuggggcccuuggacggccaggaggcucugcuggcucgcggcgaaacgagagaggauuccccugcucggcuccgccuuccgcgcgccccgcccccggcucaccgggugcggggaauugggagggcggggcuccacucgcaggggcgggaacugaagaccugagcgacagggcggugcguggaggcggagcgaggggacccccgagggcgggaagcccagagcgagucccggagcccagacagucccucugucacgcccccaggagagcuaaucaguaccuccuuucugcuuaggagaaacuaagaagggagaaagucuccgggcuaccucaggagccagagacaggacucuuguaccuuucugcugaguucagaaauucagaucuggagucuggcugguuuuaaugugucuucaccacaauagauacauauggguuuuuuuguuguuguuguuguuuuguuuuuuguuuuguuuuuguuucguuguuuuguuuuacaggaagagaacucauaaaaaaauccucaaaauucugaaguuuugguguugguugggg

SEQ ID NO: 10452 - RNA, 2501 nt, Mus musculus
ccccaaccaacaccaaaacuucagaauuuugaggauuuuuuuaugaguucucuuccuguaaaacaaaacaacgaaacaaaaacaaaacaaaaaacaaaacaacaacaacaacaaaaaaacccauauguaucuauuguggugaagacacauuaaaaccagccagacuccagaucugaauuucugaacucagcagaaagguacaagaguccugucucuggcuccugagguagcccggagacuuucucccuucuuaguuucuccuaagcagaaaggagguacugauuagcucuccugggggcgugacagagggacugucugggcuccgggacucgcucugggcuucccgcccucggggguccccucgcuccgccuccacgcaccgcccugucgcucaggucuucaguucccgccccugcgaguggagccccgcccucccaauuccccgcacccggugagccgggggcggggcgcgcggaaggcggagccgagcaggggaauccucucucguuucgccgcgagccagcagagccuccuggccguccaagggccccagcucugggggcagcggaaccucgacgagcggagucugaagaggccaucgcggcccgugagccggugucgucccaauacacuggcagaguuccgccucggccuuccaggccccgcgguucccucaccggacggucgccugcgcgccaugcagccgccgccugccccgcgcgcguaggcgcucgccacaggccaugcugccccuucucgccgcgcuacuggccgccgccugccagcugccgccggcgcacggcggggccacggaugcgcccggccuugcagggacgcccccaaacgccucggccaaugcguccuucaccaacgaacacuccaccccgcgucugcuggcaucggcggcaucggcgcccccagagcgcgcgggcccagaggaggcuccggcggcgcccugcaacaucagcgugcaacgacagaugcugagcucgcugcucgugcgcuggggccgcccgcggggcuugcagugcgaccugcugcucuucucuaccaacgcgcacggccgcgccuucuucgccgccgccuuccaccgcgucgggccaccacugcucaucgagcaucuggggcuggcggcgggcggcgcgcagcaagaccugcgccugugcgugggcugcggcugggugcgcggccgccugcgggcucccgccggggcucccaccgcgcugccugccuacccggcggccgagccggggccgcuguggcugcagggcgagccucgucacuucugcugccuggacuucagccuggaggagcugcagggcgagccgggcuggcggcugaaccgcaagcccaucgagucuacgcugguggccugcuucaugacccuggucaucgugguguggagcguggccgcccucaucuggccggugcccaucauugccggcuuccugcccaacggcauggagcagcgccggaccaccgccggcgcccccgcggccgcuccugcagccguacccgcggggacuaccgccgcugccgccgccgcugcugcagcugcugcugcugcugccgcggcugucaccucggggguggcuccuaagugacccccuccgccccgcguccgcgcuguguaagcgcucgcacgcgccuuccucaccggagacggggcaggugcgcuucgugcuguccuuauuguucauccuuuucccgggaggggaccgcagagaggcacaaaugaggugggaaagugggguuugugcugagguucugguucggaagagcaggggcaagcucucgggcugaagggugggauccacgcguggcucgaggacacaagggaaaccggcucuuuccccugcggcacccccucccugcgcccacaugcccuuuauuuauggcagaaagugaccagauccuguguauuuguuuuauauauuuaauaacuguuuuaaaugaaaguuuuaguaaaaaaaaauacaaaacaaaaagauucaacugcuaaagcugugguaacaggagcucuuuguaucugaauguaguuguauuugaagcuucuuguuuguuuuuuuaaagggggggacgagggaagauuugacacggauuuauuguaauugcuuacaaaagaacuuuaugaaucuuuuccaagucgaucuauucagugacauggccuggugggcguuucuucuuguauuaaugugguuuucuggcuuuuaauacagacauuuuccuccagaaauguguauguuuccuuuauuugcuuuugggagagggauccaagacgcaaaugaaucaugaagaaauuccugaaaagaggggcgccaucugucuuccuggcugagacaggugaaaucgcuuucagaaugguuccgauggggauugcuaaucaguucacugggccccagacacguacguccuuucuacagagcacagguucacagcgcuuggcauaguuuguuuucacauggugccccaggaaaaucaauaaauaguucugugagcca

SEQ ID NO: 10453 - RNA, 2501 nt, Mus musculus
gagccagaucagaaaauaauauuauuacaagcuuauugcuuauacaaucaagcuucauuauaucauaaucguucaucgauagucagcauggagaauacuguugccuuguguaauaugaaugcuaaagaaaauauauauucacgaugggccauaaaauaugugaagauaaaauagccuacauggacugguaaagccagugaguucaucuuucuccuccccucccaauaauuacaagaacacaaaucuaguuuuaacuuggaaaccacauucuuaauuauuaaucuccuccacacuuacauccuccuaaauuguucuccacuaaccgaaauagaacacuucauugagaacccuuguuucuuaagacucucgggaaaccauuuggcuuugguuauuuuucucccuccaucauguguauguguguagacccgccugugcauaacuucagucccugaauuguggggaaccgugugcuguuggugcggggguggggggagcuugggcacccagagcaggcaaaucugaggaguacugcuugugccaccagccuaggcacucuuggggacuuucccugggcgccccuucggugggaguaacagagcuugagaaggaaacgaagcuacaagaaagcccuacaugagccucuugaggaagaauccugaggacucgcguccaagguggcugaaaaagagggagcauuggucccacgcuuaugauggacaauuuaaggagcuaagggagaguuugagauccccagaacgucucuacuccaggagcaucuaccuagcucucuauuuuccccagccuauauuagggcgcaggcaaagggagccacccagguguaguuagagcuggguguaguuagagcugugcagacaagcuccaagaacacggaggaaagcaucgaccuucucgggacccaacccucuucccaugccaucaagggagccuauagcuccccuggcucuaggcagcugaacccaggcagcggguaucccaaacgcugcgcccuggcgccagagggcaccccgggagagagaucacgcaacgacacacucccggggcucgguucccaggggcagugcaccccugggagccagagccacggaaaauucccgggugggcacagaggggcagaagagauccggacaccgcucuuuccgcccccagccaguguccagguaccucgcagccguacagcugacccagcugcuccacgauccauucuuccagcaccaaccgcuuacgaagcuccuuacggucguauuucacugucacuuuucccugcugguggcgucguuguugcuguugcacuugcccggcggcggccaccguagucaccggcgccgaguccucccuugaggagccggagcugcugcuggauccugggcugccgccgguuccaccgcggggacucuggaagaagacacgcgcaccgccgccgccgccgccaccggccgccucaccgccgccagucaccaccgacauguccccgcgcgccagagccugagaguggcccggagaaggggugggcgagcgccccgcgccgcuaccacagcagccccaacagccgcauacgguggcccgcaccugcuccgcgcgccuagacgcuggauccuugcggagggaggcgggaagagggcgggcgaugagggcggggaccaaagccuuaaagacgccuccaaggacccuggugcuccugccccagagaccgcccccggcuaggaagucguccgagguggagaaucugugcccagcgacagggccucgaggggcuguguaguccaaggaggagacuggcguggaucgucugggaggcaggagacagucgguccucuaauugggcguccucguuuuuugcccugcagacgcgaacugcgcuucucgagcaaucuuggggcgcacgaaauaugucgacucccucugucuggauaagcucugucccaccggguaaaggucgugggaaaagaccgugcugugggguccucucgccucagcucuccuaggacagcugggagugucuccuccccucuccuucggccccaccccgcggcucuaaacacacauuccuauucacgccaugaccaccacagaugccacuuccucuguaggauugggaagaaaauugaugagacaauguuuguguaaucaggcagucaccgugccucaggaauuauucccagacugguuuuccuuuuuucuuaccaagugcauguuucacccuaagcuggauauugaaagcuugagcagcccagagggcgaggggcuaaagucaucaagaccuggagcauuuuggcguuugcugggcuuaaaaugccuuguuguguuuucagcucagccagcuuuccucccagggcccuuucuaagcaaccucucccuccuugcccccacccccaggaaggcagcugcuuugacuagcuuacuugaaaaacaucaugcaaccaagaagaauuacgaaugaaugagcuuauuauaacguuuagggcuaagaggugggauggaga

SEQ ID NO: 10454 - RNA, 2501 nt, Mus musculus
ucuccaucccaccucuuagcccuaaacguuauaauaagcucauucauucguaauucuucuugguugcaugauguuuuucaaguaagcuagucaaagcagcugccuuccugggggugggggcaaggagggagagguugcuuagaaagggcccugggaggaaagcuggcugagcugaaaacacaacaaggcauuuuaagcccagcaaacgccaaaaugcuccaggucuugaugacuuuagccccucgcccucugggcugcucaagcuuucaauauccagcuuagggugaaacaugcacuugguaagaaaaaaggaaaaccagucugggaauaauuccugaggcacggugacugccugauuacacaaacauugucucaucaauuuucuucccaauccuacagaggaaguggcaucugugguggucauggcgugaauaggaauguguguuuagagccgcgggguggggccgaaggagaggggaggagacacucccagcuguccuaggagagcugaggcgagaggaccccacagcacggucuuuucccacgaccuuuacccggugggacagagcuuauccagacagagggagucgacauauuucgugcgccccaagauugcucgagaagcgcaguucgcgucugcagggcaaaaaacgaggacgcccaauuagaggaccgacugucuccugccucccagacgauccacgccagucuccuccuuggacuacacagccccucgaggcccugucgcugggcacagauucuccaccucggacgacuuccuagccgggggcggucucuggggcaggagcaccaggguccuuggaggcgucuuuaaggcuuugguccccgcccucaucgcccgcccucuucccgccucccuccgcaaggauccagcgucuaggcgcgcggagcaggugcgggccaccguaugcggcuguuggggcugcugugguagcggcgcggggcgcucgcccaccccuucuccgggccacucucaggcucuggcgcgcggggacaugucgguggugacuggcggcggugaggcggccgguggcggcggcggcggcggugcgcgugucuucuuccagaguccccgcgguggaaccggcggcagcccaggauccagcagcagcuccggcuccucaagggaggacucggcgccggugacuacgguggccgccgccgggcaagugcaacagcaacaacgacgccaccagcagggaaaagugacagugaaauacgaccguaaggagcuucguaagcgguuggugcuggaagaauggaucguggagcagcugggucagcuguacggcugcgagguaccuggacacuggcugggggcggaaagagcgguguccggaucucuucugccccucugugcccacccgggaauuuuccguggcucuggcucccaggggugcacugccccugggaaccgagccccgggagugugucguugcgugaucucucucccggggugcccucuggcgccagggcgcagcguuugggauacccgcugccuggguucagcugccuagagccaggggagcuauaggcucccuugauggcaugggaagaggguugggucccgagaaggucgaugcuuuccuccguguucuuggagcuugucugcacagcucuaacuacacccagcucuaacuacaccuggguggcucccuuugccugcgcccuaauauaggcuggggaaaauagagagcuagguagaugcuccuggaguagagacguucuggggaucucaaacucucccuuagcuccuuaaauuguccaucauaagcgugggaccaaugcucccucuuuuucagccaccuuggacgcgaguccucaggauucuuccucaagaggcucauguagggcuuucuuguagcuucguuuccuucucaagcucuguuacucccaccgaaggggcgcccagggaaaguccccaagagugccuaggcugguggcacaagcaguacuccucagauuugccugcucugggugcccaagcuccccccacccccgcaccaacagcacacgguuccccacaauucagggacugaaguuaugcacaggcgggucuacacacauacacaugauggagggagaaaaauaaccaaagccaaaugguuucccgagagucuuaagaaacaaggguucucaaugaaguguucuauuucgguuaguggagaacaauuuaggaggauguaaguguggaggagauuaauaauuaagaaugugguuuccaaguuaaaacuagauuuguguucuuguaauuauugggaggggaggagaaagaugaacucacuggcuuuaccaguccauguaggcuauuuuaucuucacauauuuuauggcccaucgugaauauauauuuucuuuagcauucauauuacacaaggcaacaguauucuccaugcugacuaucgaugaacgauuaugauauaaugaagcuugauuguauaagcaauaagcuuguaauaauauuauuuucugaucuggcuc

SEQ ID NO: 10455 - RNA, 2501 nt, Mus musculus
uucauuuuaaguguaagauuugguuaaaagaaauagaaugaggggaguggcacagaagaaaguuuuuaaagaacaaaacaacaacaaaaacaagaaguccagugcauccgcggugagugugucaaucaaaggguuuugugccugggggcuccuugugguuccaagcagaggugucccagggcggccccacaaugaauaugaauaggaauccuugcuaacugggacagcaaagcgcaccgcccugaaugaugauggcacgucaucuuaaccagcccaggauagauaggagggcuccuuuugucucuuuucuccacugcagcgcuauaaaagccccucuuuuacugcaagagguuaguucaggcacacaccaaugugcagugcaggaaacagcuaaaccagagauagcgaagcaagccaggagagagagagaggcggggcaaggcagggccuugacuuuucuucucugguuuuacaacuggggaaguggguuccuggaccuugcuuuuuuuuuuuuuuuuuuuuuaauucaagauucucuuuaauuuccugccuaaaggcuccucaaccauaaggccgcaucucuuguaauaaaaugaauucugauucgagcucugucuccagcagagcgucaucuccggacauggaugagauguaccuaagagaccaccaccaccgccaccaccaccaccaucaggagagucgucugaacucggucuccuccacacagggcgauaugguccagaagaugccaggggaaagccucucgagggcaggcgccaaggcugcaggagaaagcagcaaguacaaaaucaagaagcagcugucggagcaggaucuucagcaguugcggcugaagaucaacggacgcgaacgcaagaggaugcacgaccugaaccucgccauggauggucugcgcgaggucaugcccuacgcucacgggcccucggugcgcaagcucuccaagaucgccacucugcuucuggccagaaacuacauccucaugcucaccagcucccuggaggagaugaagagguugguuggagagaucuacgggggacaccacucggccuuccacugugggacuguggggcauucggccggccacccggcacacgcagccaacgcugugcacccggugcacccuauccugggcggcgcgcucuccucuggcaaugccucguccccucuguccgcgaccucccugccgaccauuggcaccauccguccuccccacucacugcucaaggcgcccuccacgccgcccgcgcuacaauugggcagcggcuuccagcacugggcggggcugcccugucccugcaccaucugccagaugccaccaccgccgcaccuguccgcucucuccaccgccaacauggcccggcuuucggcugaauccaaggacuugcucaagugagccacgggcuggcccggccgggaggaggaagggagagcugaggcaggggucgcagugccgggccaggagggaaagggagacugcucggccugcgggagggugggcgcgcggccccaggccucgccagcgcccuacagauccagauuccaguugacccaccccagcggggcgugccaaaaccaaacuggaauaccuagguguuagcgaaggggacuggaacccgaaguccuguuuugcaugcaugcuucuuucccucaugccacgccaguauuucucacugugguaugcucuugucaaaacugcauuuguuguuuaacgaugggaucaguggaguuuaaaacuugcaaaggaacuuuggaguuggcucuuucuggcuguguucuuaucuuggaggaaagauggcuaucccuuuugugcaaagcaaauguaaauauuucaucgagcuagauacacuuaugauugucucugcccuuauagauuuuucagagacaauggagagagagagagagagagagagagagagagagagagagagcuuguuucagaauccaaguuuugauucucagcccagggcaugaaccucuuauguggguuuuccuuuccacgcaaacauaggucaagaaaaugcaugcacgcuucuaaaugaaucuugucuaaacauguugugcgggcuauagcgccauuuuccuuguaacaaggauuuauuagugagcucuccaaaguacuccauauaucugucugugguuguauaaaaugaaaagggggccagagcacagagauucacacucaaugaacaugugauucuucccccaagcccaugucugucucugucccucaaaucucauuccaacguuagggcuguuccaaggggcccacuacaaaaccgggccuccucuagaaguucauccuacccccuugccaaauuauacugcaugcgggguugggucgguuaccccucagcuuugaaaacacacuggguuuuuggggagggggcugccacuuuuauuuuccugaacauuugcuugaauauuuuguuagggccucaaagacaauaccugucuuuauuuuuuauauauucuugauaagu

SEQ ID NO: 10456 - RNA, 2501 nt, Mus musculus
acuuaucaagaauauauaaaaaauaaagacagguauugucuuugaggcccuaacaaaauauucaagcaaauguucaggaaaauaaaaguggcagcccccuccccaaaaacccaguguguuuucaaagcugagggguaaccgacccaaccccgcaugcaguauaauuuggcaaggggguaggaugaacuucuagaggaggcccgguuuuguagugggccccuuggaacagcccuaacguuggaaugagauuugagggacagagacagacaugggcuugggggaagaaucacauguucauugagugugaaucucugugcucuggcccccuuuucauuuuauacaaccacagacagauauauggaguacuuuggagagcucacuaauaaauccuuguuacaaggaaaauggcgcuauagcccgcacaacauguuuagacaagauucauuuagaagcgugcaugcauuuucuugaccuauguuugcguggaaaggaaaacccacauaagagguucaugcccugggcugagaaucaaaacuuggauucugaaacaagcucucucucucucucucucucucucucucucucucucucuccauugucucugaaaaaucuauaagggcagagacaaucauaaguguaucuagcucgaugaaauauuuacauuugcuuugcacaaaagggauagccaucuuuccuccaagauaagaacacagccagaaagagccaacuccaaaguuccuuugcaaguuuuaaacuccacugaucccaucguuaaacaacaaaugcaguuuugacaagagcauaccacagugagaaauacuggcguggcaugagggaaagaagcaugcaugcaaaacaggacuucggguuccaguccccuucgcuaacaccuagguauuccaguuugguuuuggcacgccccgcuggggugggucaacuggaaucuggaucuguagggcgcuggcgaggccuggggccgcgcgcccacccucccgcaggccgagcagucucccuuucccuccuggcccggcacugcgaccccugccucagcucucccuuccuccucccggccgggccagcccguggcucacuugagcaaguccuuggauucagccgaaagccgggccauguuggcgguggagagagcggacaggugcggcggugguggcaucuggcagauggugcagggacagggcagccccgcccagugcuggaagccgcugcccaauuguagcgcgggcggcguggagggcgccuugagcagugaguggggaggacggauggugccaauggucggcagggaggucgcggacagaggggacgaggcauugccagaggagagcgcgccgcccaggauagggugcaccgggugcacagcguuggcugcgugugccggguggccggccgaaugccccacagucccacaguggaaggccgaguggugucccccguagaucucuccaaccaaccucuucaucuccuccagggagcuggugagcaugaggauguaguuucuggccagaagcagaguggcgaucuuggagagcuugcgcaccgagggcccgugagcguagggcaugaccucgcgcagaccauccauggcgagguucaggucgugcauccucuugcguucgcguccguugaucuucagccgcaacugcugaagauccugcuccgacagcugcuucuugauuuuguacuugcugcuuucuccugcagccuuggcgccugcccucgagaggcuuuccccuggcaucuucuggaccauaucgcccuguguggaggagaccgaguucagacgacucuccugauggugguggugguggcgguggugguggucucuuagguacaucucauccauguccggagaugacgcucugcuggagacagagcucgaaucagaauucauuuuauuacaagagaugcggccuuaugguugaggagccuuuaggcaggaaauuaaagagaaucuugaauuaaaaaaaaaaaaaaaaaaaaagcaagguccaggaacccacuuccccaguuguaaaaccagagaagaaaagucaaggcccugccuugccccgccucucucucucuccuggcuugcuucgcuaucucugguuuagcuguuuccugcacugcacauuggugugugccugaacuaaccucuugcaguaaaagaggggcuuuuauagcgcugcaguggagaaaagagacaaaaggagcccuccuaucuauccugggcugguuaagaugacgugccaucaucauucagggcggugcgcuuugcugucccaguuagcaaggauuccuauucauauucauuguggggccgcccugggacaccucugcuuggaaccacaaggagcccccaggcacaaaacccuuugauugacacacucaccgcggaugcacuggacuucuuguuuuuguuguuguuuuguucuuuaaaaacuuucuucugugccacuccccucauucuauuucuuuuaaccaaaucuuacacuuaaaaugaa

SEQ ID NO: 10457 - RNA, 2501 nt, Mus musculus
gagccacaggcuaucccuagaaaaggagaggagaacgcauccagaaauggacaccaugccucuggcuccugaggucaucuaccucagguucccucccgccccuggaauccuuuuuccacccacuuuccuguacacuagugggggccacauacaaaucuauauaaauauagaucagacauccggcgccuuggcugcguaaauaagggauguggggaagcaaucaggaacgcugaauauucauuucgaguccuuggagagacuccaaacugcgagggggagggggagggggaggcggcgucuaggaaaggccugaccucggggucugaaagccaacuugaagugggagggccuggaaggggaagguggaaagggaguggugagaaugagugugggaaggaagccagagccgcgccgaccucagucccagccgccagggagaggagguggccaggagcgcucgccucgcucaugccagucugcuccccugccuuuugauguucacagggcgcuagcuccauccaucuguaagucccagaacccaagucucaggagcggcgggagaccggagacaaagugagagagguggauggaagcgaaagacaagcaggagagagagaagagaccacgcugacucucacucccucuucuuuaauacaacaaaguugcaacuugggcuccuggaucuaaauaccgcagguccagagaagacaaaacaccaggcaucacugcaucucuuaggggguacccaccaagaccuccagguccuucacuccaggaagggcccuguugaauaucugcagagagauggguuggagcacagcuuggugcucaguccuggcccuguggcuccucuggugugcugucugcuccaacgcagcgucaggggacggcaaugcguuuccuuuugacaucgaggggagcgcaguggucggcaggcaagacccaucggagacuagcgacucaggcgugacacugggacgccugccgccugcugcugagguacaguacccccugccuuugccaacccgcuccacaccugugucuaccgugucuaugggcugggccacaauccucuuucucucuccccaucuguuugauaaccuaggcuuucaucugggcuaggucuccucaguugaaauaaagggcucuguuuugaaaguuugacuuggacgucaguugaaaguugaggcuuccagugagaguacccuucaugucugcgugggucuguuagacuacaugagaaauguaugcaguaugcagugguggucuuuugguguguuccaauagccauuuugucaaaccuuggcacuuacuguaagugcccccucucugucucccugcuccucuuugcuguuugaacaaugagagcaauaucacuaaaaagaccuauccugucucaaacuaaacaaaaggucuucugcaaggcuggggugcuggggguggggguugucugugaaggaagcuguuagaaaauuucagggcagauaccuuaaacaaaagcagaccauucuaauccagaagcaagauuaagucaagcuccacucccaaaguaaagcugaucaggauauacuacuggucuaagguuuauucagugagcuacuguuuuuauauaucaagagacuuuucaguugagaaauggcugaacuguagacauuggaggagaaggauggguccacaguaagugauuuaagagccucugcgccuggauuacaguagcauguccaggcugugggggaugcgaaggaggaggaaaaugaagucaccuaaguucaugggaaaggaaagaucaacugaccuaacaccacacauguacaacacacacaccacauaccauacaacacacauacacacagcaaacauauaacacacacaaauauacauaccacacacacacacaccacacucacacaacauacacacauacacaccacuccacauaccacacagcacacacaugcacaccacauaccauacaacacacauacacacagcaaacauauaacacacaaauauacauacacaccacacacgcauaccacacucacaccacacacauauacaccacuccauauacuacacagcacacacauacacacaccacacacucauaacauauacacacagcauauacacacacagcacacacacaugcccacacuaauauauccaugucuauagcaaucauacagcuaaaguagugaugcaaguugcuaaaagucacugaagucucaacuguugcuccuaauucuaccuucugguaauauaacuacagcuguuauuguugauuaaaaauaaaaugcaagaugauccuuaaguaaaaguccuaguggugcuuccucaaaagggaggcagguggguagaaccagaguguaccagucucucguuucagugcauagggucuaccuaaggcucuuuuuugaaaggggcuucugaucacacccagucacuggggacaggucagagcagccaaacuccauccaucaauggagaggaauugccuc

SEQ ID NO: 10458 - RNA, 2501 nt, Mus musculus
gaggcaauuccucuccauugauggauggaguuuggcugcucugaccuguccccagugacugggugugaucagaagccccuuucaaaaaagagccuuagguagacccuaugcacugaaacgagagacugguacacucugguucuacccaccugccucccuuuugaggaagcaccacuaggacuuuuacuuaaggaucaucuugcauuuuauuuuuaaucaacaauaacagcuguaguuauauuaccagaagguagaauuaggagcaacaguugagacuucagugacuuuuagcaacuugcaucacuacuuuagcuguaugauugcuauagacauggauauauuagugugggcaugugugugugcuguguguguauaugcuguguguauauguuaugagugugugguguguguaugugugugcuguguaguauauggagugguguauauguguguggugugagugugguaugcgugugugguguguauguauauuuguguguuauauguuugcuguguguauguguguuguaugguauguggugugcaugugugugcugugugguauguggagugguguguauguguguauguugugugaguguggugugugugugugugguauguauauuuguguguguuauauguuugcuguguguauguguguuguaugguaugugguguguguguuguacaugugugguguuaggucaguugaucuuuccuuucccaugaacuuaggugacuucauuuuccuccuccuucgcaucccccacagccuggacaugcuacuguaauccaggcgcagaggcucuuaaaucacuuacuguggacccauccuucuccuccaaugucuacaguucagccauuucucaacugaaaagucucuugauauauaaaaacaguagcucacugaauaaaccuuagaccaguaguauauccugaucagcuuuacuuugggaguggagcuugacuuaaucuugcuucuggauuagaauggucugcuuuuguuuaagguaucugcccugaaauuuucuaacagcuuccuucacagacaacccccacccccagcaccccagccuugcagaagaccuuuuguuuaguuugagacaggauaggucuuuuuagugauauugcucucauuguucaaacagcaaagaggagcagggagacagagagggggcacuuacaguaagugccaagguuugacaaaauggcuauuggaacacaccaaaagaccaccacugcauacugcauacauuucucauguagucuaacagacccacgcagacaugaaggguacucucacuggaagccucaacuuucaacugacguccaagucaaacuuucaaaacagagcccuuuauuucaacugaggagaccuagcccagaugaaagccuagguuaucaaacagauggggagagagaaagaggauuguggcccagcccauagacacgguagacacagguguggagcggguuggcaaaggcaggggguacuguaccucagcagcaggcggcaggcgucccagugucacgccugagucgcuagucuccgaugggucuugccugccgaccacugcgcuccccucgaugucaaaaggaaacgcauugccguccccugacgcugcguuggagcagacagcacaccagaggagccacagggccaggacugagcaccaagcugugcuccaacccaucucucugcagauauucaacagggcccuuccuggagugaaggaccuggaggucuugguggguacccccuaagagaugcagugaugccugguguuuugucuucucuggaccugcgguauuuagauccaggagcccaaguugcaacuuuguuguauuaaagaagagggagugagagucagcguggucucuucucucucuccugcuugucuuucgcuuccauccaccucucucacuuugucuccggucucccgccgcuccugagacuuggguucugggacuuacagauggauggagcuagcgcccugugaacaucaaaaggcaggggagcagacuggcaugagcgaggcgagcgcuccuggccaccuccucucccuggcggcugggacugaggucggcgcggcucuggcuuccuucccacacucauucucaccacucccuuuccaccuuccccuuccaggcccucccacuucaaguuggcuuucagaccccgaggucaggccuuuccuagacgccgccucccccucccccucccccucgcaguuuggagucucuccaaggacucgaaaugaauauucagcguuccugauugcuuccccacaucccuuauuuacgcagccaaggcgccggaugucugaucuauauuuauauagauuuguauguggcccccacuaguguacaggaaaguggguggaaaaaggauuccaggggcgggagggaaccugagguagaugaccucaggagccagaggcaugguguccauuucuggaugcguucuccucuccuuuucuagggauagccuguggcuc

SEQ ID NO: 10459 - RNA, 2501 nt, Mus musculus
uagugguuucuguuacagggaaugguauuaauuuccaaggcaaagcuuccuaacuuucccagacggauaacuccugcuuccagacacuaaauucuucaccaccaccaccuccucccaaaauaaaagcccuacuuccaaagcguggaauacaaguaaaacucccgggagagaggcaaagcuaggaacauacaccuaguuucacaaacaccuaagaugugugucuguuugccccuucuaaacgugggcuuucucgcagcacccucaccaaauacgcuugcuauaaccaagaagaugcccaagccgcaauaacagugaauuagucccauaccauuuuaaccaguuugccuuucaaauacaaacuuaaccaaagcugaccaagucaccugacuguauugaagauuccaugcagacagaaguggagaacgccaagaaacgcgaaaaacaagccuuacauauuuuaauaucauagaaacaaaucuauguacguaaagugauuucuuuuucaaaucaagaaacucauaaugcacacacaagauaaaauccucgccaggcaaaacacacaacuuugaggaaaauaaagaagugggggugacagaagaguccaggcugagccguguucuuggguuucuacgcgaacagcuggagcgccaggaggcugcgcucgccaccucuggagcaccgcuggccuggcagggcgcccggccucgcagagaggacucggggcuggccuucgcgaacaaugggcaggcggcagcggaggccgccccucagacagcuggcuuucagccgggcuugccgggucugcuaacuggaaagugaggcgugcagaggcgagcgggagacccggggcagaagcagagaggagcggccggggacggcgaggcgagcccgcuggcugcagcgucccugacccgcgccgcuccggcccaagccuccgccacugacagcuacaccgccgcagccggcgaguuggagcaaagcgggaucaccgagccuggggauggaccgggaagagggguggaauccagguaucccgggugccccgguccggcagcucuuaacuuuggagggguccggagauucauuuccgaaaaagggagaaauacuacaccgaccaucaggaaagccacugcaccaugcucacucgccacugggguucagugcccucgcccggcaacaucuguaccagucuaggguuugugagguuaaauaguauccccccccccucgcccccaucaaaucugagguuggcagacuucggagaugcagcccaugaguuggccucgguuuugcaccuggagggggagcugaggcgucccagggacccagcagaaacugacaagcgcgccccugucccccccccccccccccgcagccuacacaacagcccgaagggagcggacggaauaaagagcucggucuccccggccuccgaguccgaaaauaccuucaucuccucguugaucucccucuucacagggugagcggguuuccggcuucuuuuauuuuccggaggucucccuucuuucuccauuucugccauguuuuugugucugguuucuguggagaugaaauggcugcugccgccgccggcggugguggugguggcgguggcgguggcggagguggagguggugcugaugguggcaacgcuggcggagguagcggugcuagcggguccggggcuggggguggggguggaacaggcgagggaggagcggggucucuucuagcggcggagaccgucaguggccgucacggggaaggguagcccggggagucucggggaugccgccgccgccgcuccuaccgucgccgccgccgcuccugcugccgccgcugccggugccgccgccgccgcucccgcucccgccgccgccgggcugcauccucggggcccgaaggagucgucagccaucuuccugagcucugucuguccgcaugggcgagaggagcgccggccacggcggagacagcugcucugggcgugcgugcguggaucugugugugcgcccgggagagcgcgccagccccggcgcccagcgccucccgcgagccgagccgcgggcggagggagggacugagcggggagggguccgagggaggggaggcugggggugggggggacaaggccagccccccgcucgcgagcgggcguggcuucccggucguuguagacgcggaugcugcgcggcuccgggggcugcuggcggccgccugcuccugggcggcgggcaccggcccuacucggagccgccaccuccccgcgacgaccccuccugcucccgagcuccgugacgugggcuccggugggcucagaguuggcuucugaggaugaccuagaggccgcugaggcaaaacauagcggggugaaggguggagguggagcgcugaaagggcgcagggaccugaaggcagagcgagaacucggcuccgggguugcagcgcccgggagcggagggaaacacagaccggacccaccgcucaggcaccaguguccu

SEQ ID NO: 10460 - RNA, 2501 nt, Mus musculus
aggacacuggugccugagcgguggguccggucuguguuucccuccgcucccgggcgcugcaaccccggagccgaguucucgcucugccuucaggucccugcgcccuuucagcgcuccaccuccacccuucaccccgcuauguuuugccucagcggccucuaggucauccucagaagccaacucugagcccaccggagcccacgucacggagcucgggagcaggaggggucgucgcggggagguggcggcuccgaguagggccggugcccgccgcccaggagcaggcggccgccagcagcccccggagccgcgcagcauccgcgucuacaacgaccgggaagccacgcccgcucgcgagcggggggcuggccuugucccccccacccccagccuccccucccucggaccccuccccgcucagucccucccuccgcccgcggcucggcucgcgggaggcgcugggcgccggggcuggcgcgcucucccgggcgcacacacagauccacgcacgcacgcccagagcagcugucuccgccguggccggcgcuccucucgcccaugcggacagacagagcucaggaagauggcugacgacuccuucgggccccgaggaugcagcccggcggcggcgggagcgggagcggcggcggcggcaccggcagcggcggcagcaggagcggcggcggcgacgguaggagcggcggcggcggcauccccgagacuccccgggcuacccuuccccgugacggccacugacggucuccgccgcuagaagagaccccgcuccucccucgccuguuccacccccacccccagccccggacccgcuagcaccgcuaccuccgccagcguugccaccaucagcaccaccuccaccuccgccaccgccaccgccaccaccaccaccgccggcggcggcagcagccauuucaucuccacagaaaccagacacaaaaacauggcagaaauggagaaagaagggagaccuccggaaaauaaaagaagccggaaacccgcucacccugugaagagggagaucaacgaggagaugaagguauuuucggacucggaggccggggagaccgagcucuuuauuccguccgcucccuucgggcuguuguguaggcugcgggggggggggggggggacaggggcgcgcuugucaguuucugcugggucccugggacgccucagcucccccuccaggugcaaaaccgaggccaacucaugggcugcaucuccgaagucugccaaccucagauuugaugggggcgaggggggggggauacuauuuaaccucacaaacccuagacugguacagauguugccgggcgagggcacugaaccccaguggcgagugagcauggugcaguggcuuuccugauggucgguguaguauuucucccuuuuucggaaaugaaucuccggaccccuccaaaguuaagagcugccggaccggggcacccgggauaccuggauuccaccccucuucccgguccauccccaggcucggugaucccgcuuugcuccaacucgccggcugcggcgguguagcugucaguggcggaggcuugggccggagcggcgcgggucagggacgcugcagccagcgggcucgccucgccguccccggccgcuccucucugcuucugccccgggucucccgcucgccucugcacgccucacuuuccaguuagcagacccggcaagcccggcugaaagccagcugucugaggggcggccuccgcugccgccugcccauuguucgcgaaggccagccccgaguccucucugcgaggccgggcgcccugccaggccagcggugcuccagagguggcgagcgcagccuccuggcgcuccagcuguucgcguagaaacccaagaacacggcucagccuggacucuucugucacccccacuucuuuauuuuccucaaaguuguguguuuugccuggcgaggauuuuaucuugugugugcauuaugaguuucuugauuugaaaaagaaaucacuuuacguacauagauuuguuucuaugauauuaaaauauguaaggcuuguuuuucgcguuucuuggcguucuccacuucugucugcauggaaucuucaauacagucaggugacuuggucagcuuugguuaaguuuguauuugaaaggcaaacugguuaaaaugguaugggacuaauucacuguuauugcggcuugggcaucuucuugguuauagcaagcguauuuggugagggugcugcgagaaagcccacguuuagaaggggcaaacagacacacaucuuagguguuugugaaacuagguguauguuccuagcuuugccucucucccgggaguuuuacuuguauuccacgcuuuggaaguagggcuuuuauuuugggaggagguggugguggugaagaauuuagugucuggaagcaggaguuauccgucugggaaaguuaggaagcuuugccuuggaaauuaauaccauucccuguaacagaaaccacua

SEQ ID NO: 10461 - RNA, 2501 nt, Mus musculus
acuugacuccuugaucgcugguucauuuagacaagccguuucccucucugagccaaaagaccccauguguaauacucaaagaagaggccuuccuuauauauauauaggcacccccaaaccuccuucaugcuaccaagaaagggucuggacacaugccaaaaagaaagaggaaaaggcaaagcucuccccagcggccggacgggacucuucuggcugggcgaggcucuuugaggaaccgagaguugcugggacugagcccgcgacgggggaggcguggagugggggaacaaacagagugcugcuccccucccccgaccccugcccuuuguccggaauccagcugugcucugcggguggggguuguggggggaggagcgggcucgcguggcgcagccccugggcccccuccgcugauuggcccguggugcaggcagcagcccggcaggcacgcuccuggccgggggcagagcagauaaagcgugccaggggacacacgacuugcaugcagcucagaaaucccucugggucucaucacugcagcaguggucgaguaccuccucggagcuuuucuacgacuuccagacgcaauuuacuccaggcgagggcgccugcaguuuagcagaacuucagagggagcagagaggcucagcuauccacugcugcuugacacugacccuauccacugcugcuugucacugacugaccugcugcucucuauucuuuugagucgggagaacuagguaacaauucggaaacuccaaaggguggaugaggggcgcgcggggugugugugggggauacucuggucccccgugcagugaccucuaagucagaggcuggcacacacacaccuuccauuuuuucccaaccgcaggauggcgccucaucccuuggaugcgcucaccauccaaguguccccagagacacaacaaccuuuucccggagccucggaccacgaagugcucaguuccaauuccaccccaccuagccccacucucauaccuagggacugcuccgaagcagaagugggugacugccgagggaccucgaggaagcuccgcgcccgacgcggagggcgcaacaggcccaagagcgaguuggcacucagcaaacagcgaagaagccggcgcaagaaggccaaugaucgggagcgcaaucgcaugcacaaccucaacucggcgcuggaugcgcugcgcgguguccugcccaccuucccggaugacgccaaacuuacaaagaucgagacccugcgcuucgcccacaacuacaucugggcacugacucagacgcugcgcauagcggaccacagcuucuauggcccggagcccccugugcccuguggagagcuggggagccccggagguggcuccaacggggacuggggcucuaucuacuccccagucucccaagcggguaaccugagccccacggccucauuggaggaauucccuggccugcaggugcccagcuccccauccuaucugcucccgggagcacugguguucucagacuucuugugaagagaccugucuggcucuggguggugggugcuaguggaaagggaggggaccagagccgucuggagugggagguaguggaggcucucaagcaucucgccucuucuggcuuucacuacuuggaucccuagcccucucacagggcuuaacuaggcuucucaucgguacccuugcugcugcgcacagcagacauugggggcugcucuucucuuaacucuccucggugcagccacaucaaacucucgcuccaagcauuugagaaugguagcacuaccuaguuggagacucccauacuuccuggugagucugcccucauucaaaucugccggccuccgaccauccaucacuuuuuccagggugaccuaauccaguguugcgucuuaccucacuggcuccuccauccagcucuuggcccauagaugauguucgucgucuuuacugcccgcuacaugcaggguuucugagcuucuccauucugccuuaguccacgaaggugaucugccuucuucugcacuuuucaagucguuacccuucccccaagggagaccaggcugugaaccggaaagcccuagccuauggcuagagcaucucuccaacuugucucccgugucuaaagugugaguugcagggacgguuccugaagcacuguuugucucccuaaaaaggaaaaaaaaagaaaaagaaaucaguuuguaaaugauauaaugccuuuugaaaugaauuuuguuaugguaaauuauaugccuccugccccauuuuuacacauuuguauuuauugaugcuauuucgugguaggagaguuuauauuuuguacauaagaguaucaaggacuggugauugagauuuugagcuaacaaauaaaagaugaacgucgagaaucuucacaaggugacuccauugugcgcagagaaggggaggagggugacagcccaggcugggggugucuagaguaauucuacucugcagagcgagaggagaggagca

SEQ ID NO: 10462 - RNA, 2501 nt, Mus musculus
ugcuccucuccucucgcucugcagaguagaauuacucuagacacccccagccugggcugucacccuccuccccuucucugcgcacaauggagucaccuugugaagauucucgacguucaucuuuuauuuguuagcucaaaaucucaaucaccaguccuugauacucuuauguacaaaauauaaacucuccuaccacgaaauagcaucaauaaauacaaauguguaaaaauggggcaggaggcauauaauuuaccauaacaaaauucauuucaaaaggcauuauaucauuuacaaacugauuucuuuuucuuuuuuuuuccuuuuuagggagacaaacagugcuucaggaaccgucccugcaacucacacuuuagacacgggagacaaguuggagagaugcucuagccauaggcuagggcuuuccgguucacagccuggucucccuugggggaaggguaacgacuugaaaagugcagaagaaggcagaucaccuucguggacuaaggcagaauggagaagcucagaaacccugcauguagcgggcaguaaagacgacgaacaucaucuaugggccaagagcuggauggaggagccagugagguaagacgcaacacuggauuaggucacccuggaaaaagugauggauggucggaggccggcagauuugaaugagggcagacucaccaggaaguaugggagucuccaacuagguagugcuaccauucucaaaugcuuggagcgagaguuugauguggcugcaccgaggagaguuaagagaagagcagcccccaaugucugcugugcgcagcagcaaggguaccgaugagaagccuaguuaagcccugugagagggcuagggauccaaguagugaaagccagaagaggcgagaugcuugagagccuccacuaccucccacuccagacggcucugguccccucccuuuccacuagcacccaccacccagagccagacaggucucuucacaagaagucugagaacaccagugcucccgggagcagauaggauggggagcugggcaccugcaggccagggaauuccuccaaugaggccguggggcucagguuacccgcuugggagacuggggaguagauagagccccaguccccguuggagccaccuccggggcuccccagcucuccacagggcacagggggcuccgggccauagaagcugugguccgcuaugcgcagcgucugagucagugcccagauguaguugugggcgaagcgcagggucucgaucuuuguaaguuuggcgucauccgggaaggugggcaggacaccgcgcagcgcauccagcgccgaguugagguugugcaugcgauugcgcucccgaucauuggccuucuugcgccggcuucuucgcuguuugcugagugccaacucgcucuugggccuguugcgcccuccgcgucgggcgcggagcuuccucgaggucccucggcagucacccacuucugcuucggagcagucccuagguaugagaguggggcuaggugggguggaauuggaacugagcacuucgugguccgaggcuccgggaaaagguuguugugucucuggggacacuuggauggugagcgcauccaagggaugaggcgccauccugcgguugggaaaaaauggaaggugugugugugccagccucugacuuagaggucacugcacgggggaccagaguaucccccacacacaccccgcgcgccccucauccacccuuuggaguuuccgaauuguuaccuaguucucccgacucaaaagaauagagagcagcaggucagucagugacaagcagcaguggauagggucagugucaagcagcaguggauagcugagccucucugcucccucugaaguucugcuaaacugcaggcgcccucgccuggaguaaauugcgucuggaagucguagaaaagcuccgaggagguacucgaccacugcugcagugaugagacccagagggauuucugagcugcaugcaagucguguguccccuggcacgcuuuaucugcucugcccccggccaggagcgugccugccgggcugcugccugcaccacgggccaaucagcggagggggcccaggggcugcgccacgcgagcccgcuccuccccccacaacccccacccgcagagcacagcuggauuccggacaaagggcaggggucgggggaggggagcagcacucuguuuguucccccacuccacgccucccccgucgcgggcucagucccagcaacucucgguuccucaaagagccucgcccagccagaagagucccguccggccgcuggggagagcuuugccuuuuccucuuucuuuuuggcauguguccagacccuuucuugguagcaugaaggagguuugggggugccuauauauauauaaggaaggccucuucuuugaguauuacacauggggucuuuuggcucagagagggaaacggcuugucuaaaugaaccagcgaucaaggagucaagu

SEQ ID NO: 10463 - RNA, 2501 nt, Mus musculus
aaggagggguuugacuguagugucucggcagcgcucgguuuucuuuccgaaguuuaauuuuccggaauggcucccaaacaagggccggggaggcggagccgccacuaccggaucuucuccuuuuuuggaaagucucggagaaccggaauuccuccccgccccaagagacagagcuaccagcgcggccgccgugggugaacucacggcggccgcgcuagggucggugcucgcgccuucuucccgcugaacucugcaguccggaguccccgcugcaggcaggggccgagagccccagacccgggugguuguccaccggcugcaaaucguuccuggcgagcucagcggagcccgcgcagccaagcccguaugcaaauuggccaugugacggcaaaagcugccaggcccagcccuguuccucaguccauauaugggcagcgacgucacggguauugaagaccugcccauaaauacuccgagccuaacacuuuccgucugagagagcagcgauugauuaauagcugggcgaggggacacacugacuguuauaauaacacuacaccagcaacuccuggcuccccaacagccggaucacaggcaggagagagucagugacggauagacuuuuuuuuuucuuuaagaagccaacaacuugguugcuaguuuuauuucuguuaauuuuuuucuuuuuuuugguguguguggauguguugugguggucuuuucuaaguguggagggcaaaaggagauaccauccuaggcucaguucaaccccucuccaaaaaaaacggcuucucuggcgcuccagguagcgagggaguugggucuccagguugugcgaggagcaaaugaugaccgccaaggccguagacaaaaucccaguaacucucagugguuuuaugcaccagcugccugacagccucuacccgguggaagaccucgccgccucgucggugaccaucuuccccaauggugaacugggaggccccuuugaccagaugaacggaguggcgggagguaagccgcgugucuucuucggagcuuguggguggggagcggugggugugggggggcuuggaggggagaauggggacuugagguggacggcgcugaccacacuggcucugaagacuggaaguaggcgcagggggagcggaaaaagauagacuagggcugccuggccgugcgcgccagcagaugcaccuggucaccaaaagccacccgcaugccuguagcuccgggcgcgcccagcuuuggcuaggcgcaggguugaagcaucaucuccugguccuugaagcagguccaucagccggacucugcgcuacugggcuagggucaaagagaugggaaaguucaucagucggguuagagcugcgcgucuggagagcucagugucaggggagcgcuuagggagcgcgcgggcagcgcucucugggcagagcccacucccggaggaucucccgagcgcguuguccuucugggguggcugggaggcaccacccaacuugcgcaucgccccaaagugaacaggguuaacaagccgaggcggcggagcagggcaaguaacagcgagaagcggcaaggagaaugccuagggaggcccgcgcuggcaccggugugcgccgguuccuuggcgaugcuguguaaagucgucuuccucagcccccgcgccuuccuagaagcgcagccucuuagucuuaggcuaagacagggaugcgcggguguccggcuuggccgaggauguugggagggaagggaacccuagacuccuuccuccgcugcccggguucacacuggcagucuucagcugaagcgcagcgggagagggagggggagguggcaccaggaauuagcuucaagaacaucacccacccacuuauccauucugggguuccccucucucgcggcuggcaccuucucuguaccgccugggauugauuggucggcucuuuuuauuggugucuguaugguugccucggcgguaagaccacaaggcaaaggagugggagagaagucagaggcagaugggaaauuguuugauauuguugcugcuauuggguguuuuuauugggaacuagagucacagauggccgggagauggaagcaggaaggggcaugcccugcuucuuggagauacaguuuuugaguuccagacucugccuaacuucuuacugucucuccaggccucaguuuccccaccuguugcucuguaguguuggaaucaugaaauggggauugccguguguguguguguguguguguguguguguguguguguguguguguguccgcgcgucagcaugcguguaugugaauuaguucuugccuguauucucauugucccaccucuucccugacuuuucccuccccagauggcaugaucaacauugacaugacuggagagaagagaccccuggaucucccguauccgaguagcuucgcucccaucucugcaccuagaaaccagaccuucacuuacaugggcaaauucuccauugacccac

SEQ ID NO: 10464 - RNA, 2501 nt, Mus musculus
gugggucaauggagaauuugcccauguaagugaaggucugguuucuaggugcagagaugggagcgaagcuacucggauacgggagauccaggggucucuucucuccagucaugucaauguugaucaugccaucuggggagggaaaagucagggaagaggugggacaaugagaauacaggcaagaacuaauucacauacacgcaugcugacgcgcggacacacacacacacacacacacacacacacacacacacacacacacacggcaauccccauuucaugauuccaacacuacagagcaacagguggggaaacugaggccuggagagacaguaagaaguuaggcagagucuggaacucaaaaacuguaucuccaagaagcagggcaugccccuuccugcuuccaucucccggccaucugugacucuaguucccaauaaaaacacccaauagcagcaacaauaucaaacaauuucccaucugccucugacuucucucccacuccuuugccuuguggucuuaccgccgaggcaaccauacagacaccaauaaaaagagccgaccaaucaaucccaggcgguacagagaaggugccagccgcgagagaggggaaccccagaauggauaagugggugggugauguucuugaagcuaauuccuggugccaccucccccucccucucccgcugcgcuucagcugaagacugccagugugaacccgggcagcggaggaaggagucuaggguucccuucccucccaacauccucggccaagccggacacccgcgcaucccugucuuagccuaagacuaagaggcugcgcuucuaggaaggcgcgggggcugaggaagacgacuuuacacagcaucgccaaggaaccggcgcacaccggugccagcgcgggccucccuaggcauucuccuugccgcuucucgcuguuacuugcccugcuccgccgccucggcuuguuaacccuguucacuuuggggcgaugcgcaaguuggguggugccucccagccaccccagaaggacaacgcgcucgggagauccuccgggagugggcucugcccagagagcgcugcccgcgcgcucccuaagcgcuccccugacacugagcucuccagacgcgcagcucuaacccgacugaugaacuuucccaucucuuugacccuagcccaguagcgcagaguccggcugauggaccugcuucaaggaccaggagaugaugcuucaacccugcgccuagccaaagcugggcgcgcccggagcuacaggcaugcggguggcuuuuggugaccaggugcaucugcuggcgcgcacggccaggcagcccuagucuaucuuuuuccgcucccccugcgccuacuuccagucuucagagccaguguggucagcgccguccaccucaaguccccauucuccccuccaagcccccccacacccaccgcuccccacccacaagcuccgaagaagacacgcggcuuaccucccgccacuccguucaucuggucaaaggggccucccaguucaccauuggggaagauggucaccgacgaggcggcgaggucuuccaccggguagaggcugucaggcagcuggugcauaaaaccacugagaguuacugggauuuugucuacggccuuggcggucaucauuugcuccucgcacaaccuggagacccaacucccucgcuaccuggagcgccagagaagccguuuuuuuuggagagggguugaacugagccuaggaugguaucuccuuuugcccuccacacuuagaaaagaccaccacaacacauccacacacaccaaaaaaaagaaaaaaauuaacagaaauaaaacuagcaaccaaguuguuggcuucuuaaagaaaaaaaaaagucuauccgucacugacucucuccugccugugauccggcuguuggggagccaggaguugcugguguaguguuauuauaacagucaguguguccccucgcccagcuauuaaucaaucgcugcucucucagacggaaaguguuaggcucggaguauuuaugggcaggucuucaauacccgugacgucgcugcccauauauggacugaggaacagggcugggccuggcagcuuuugccgucacauggccaauuugcauacgggcuuggcugcgcgggcuccgcugagcucgccaggaacgauuugcagccgguggacaaccacccgggucuggggcucucggccccugccugcagcggggacuccggacugcagaguucagcgggaagaaggcgcgagcaccgacccuagcgcggccgccgugaguucacccacggcggccgcgcugguagcucugucucuuggggcggggaggaauuccgguucuccgagacuuuccaaaaaaggagaagauccgguaguggcggcuccgccuccccggcccuuguuugggagccauuccggaaaauuaaacuucggaaagaaaaccgagcgcugccgagacacuacagucaaaccccuccuu

SEQ ID NO: 10465 - RNA, 2501 nt, Mus musculus
agcuggccucaaacucacagcaauccuccugcuucagccuccaaaggcuagaaugguagguaugagucuuuaaauaguuuggaacagcauggggacacccuuugcaaccguggguacugucauggugaagguuaggcaagaggcuaaagagaccagaugguaaccucaauacccgcuuagcccagguggggcuucucaccugcaccccagagauccccaaaggaacacuggacaccuggagguguccaccucccaggacaugcccuccgggccacacuuugugaccugaccccauuguggacuguucuuccuagacaacugucugguucccagaugggacacggccugcccccgguggccacccccgcgcaggcccgggcccugcgccucggggacacguccgucccgcugcgccccgccccgcccgccgccggccccgcccgcccugggcuuuuauaggccgaggcgucugcacucgcugaguccccgcugcugcccaacacucgccaugcguucuggggcacuguggccgcugcuuuggggagcccuggucuggacagugggauccgugggcgccgugaugggcuccgaggauucugugcccggugaguggggcugggcggaaggggcgggcgagcgggccacccacguggccugaggaaugcggcagggggaugucuggggugugcucuggcugggugggcgaaugcgggacuccacgccuccagccucaaaagaggacugacauuuauuuauugagcucuuacuguuuacaugcuuucccaugaguccacagaacagccgaaacuuguggguacuuuuuccuccccguuuucaggauagguaaacugaggcccagggucaugaaccuuuuaagugacgugguagguggcucuguaggcccuagagagacaucucuggguggcuggcccugcuaaugccacuuaggcagaggguuucaggagucucuggaugagaugccucagguagaaugguauaccugcaucuggccaggagagcuccagccucagucucccuuuuuguaaagccuuugcagaggugcuggggcccaguucauggaaggcguucggcagugucucuugagcaagaaugaguucugaugggggcggggggggggggggaggugugcggcugucuucacuuaagggugaagaaagccaaagguucuguguucuagccccuaccagcccugcaaggcugcugcccuccaagggagccaagcccccuccccuagggccgcgucccccgucccugucccaggggagugagcucacgcagagggaauguuccccaguuggagugaguaagaggcgggucaggcgagggggggcugcaagccgggggcucggcuguccugggcacugucuagacagagggcagaggcgggaagccagugcaggcccacagacccucacaugccgagcgccuggcauuugaaggggcugggcagggugccaguucucaggccuggaggccaggcgggaguuggugguggagcacucgggugcggcucagaggagaaggguucccuccacagaagagcucgagccacagcuguggcuuucugcccuuucuuccuguacagggcauuuaggauagcuauggacaucucugaauuggcugggggaauuagaucugagguguuggggguuaguugggaguuuguuccacaaagaucauguauagggauaauucuuagguagagauggggucuggagcuuccccauuccuccuccuccuuccaaauagguggcgugugcuggcuccagcagggcagagaggccaccugcagucuggugcugaagacucgugucagccgggaggagugcugugcuuccggcaacaucaacaccgccugguccaacuucacccacccaggcaauaaaaucagccugcuaggguuccugggccucguccacugccuccccugcaaaggugaagccguggggggcuccugauggcagacaagacccagagugaauggggaacuggggaggggacccuggggcccacgacuugcggaggcuuugagaagcccccugguuucaucauguaaagccccuaaccugcauccuaccucaccugguggggaggaacuuagccuuaaauccugaccaggcauucaggcuauguccguccguacugcuacccucaugggacccugagcaccacacauuuuacauagcuaauaugccuggaguaucugccugugcuuuauucugagcacgcccgccacccgcgucccugcugaggugaaugaauaacaguccaggugacagagggcaccccuggccucucugugcuuggggcugaaccaguagaaagugaugggaaggauuuggaggaagcaggcauaagaucuagggucggggugaugauuaggaguuuguugagugaagcccauauggaagagugcacugggucuaggguuagucucuagagguaggagcaacaucaggcagcucauccaggaggaagcu

SEQ ID NO: 10466 - RNA, 2501 nt, Mus musculus
agcuuccuccuggaugagcugccugauguugcuccuaccucuagagacuaacccuagacccagugcacucuuccauaugggcuucacucaacaaacuccuaaucaucaccccgacccuagaucuuaugccugcuuccuccaaauccuucccaucacuuucuacugguucagccccaagcacagagaggccaggggugcccucugucaccuggacuguuauucauucaccucagcagggacgcggguggcgggcgugcucagaauaaagcacaggcagauacuccaggcauauuagcuauguaaaauguguggugcucagggucccaugaggguagcaguacggacggacauagccugaaugccuggucaggauuuaaggcuaaguuccuccccaccaggugagguaggaugcagguuaggggcuuuacaugaugaaaccagggggcuucucaaagccuccgcaagucgugggccccaggguccccuccccaguuccccauucacucugggucuugucugccaucaggagccccccacggcuucaccuuugcaggggaggcaguggacgaggcccaggaacccuagcaggcugauuuuauugccugggugggugaaguuggaccaggcgguguugauguugccggaagcacagcacuccucccggcugacacgagucuucagcaccagacugcagguggccucucugcccugcuggagccagcacacgccaccuauuuggaaggaggaggaggaauggggaagcuccagaccccaucucuaccuaagaauuaucccuauacaugaucuuuguggaacaaacucccaacuaacccccaacaccucagaucuaauucccccagccaauucagagauguccauagcuauccuaaaugcccuguacaggaagaaagggcagaaagccacagcuguggcucgagcucuucuguggagggaacccuucuccucugagccgcacccgagugcuccaccaccaacucccgccuggccuccaggccugagaacuggcacccugcccagccccuucaaaugccaggcgcucggcaugugagggucugugggccugcacuggcuucccgccucugcccucugucuagacagugcccaggacagccgagcccccggcuugcagcccccccucgccugacccgccucuuacucacuccaacuggggaacauucccucugcgugagcucacuccccugggacagggacgggggacgcggcccuaggggagggggcuuggcucccuuggagggcagcagccuugcagggcugguaggggcuagaacacagaaccuuuggcuuucuucacccuuaagugaagacagccgcacaccuccccccccccccccgcccccaucagaacucauucuugcucaagagacacugccgaacgccuuccaugaacugggccccagcaccucugcaaaggcuuuacaaaaagggagacugaggcuggagcucuccuggccagaugcagguauaccauucuaccugaggcaucucauccagagacuccugaaacccucugccuaaguggcauuagcagggccagccacccagagaugucucucuagggccuacagagccaccuaccacgucacuuaaaagguucaugacccugggccucaguuuaccuauccugaaaacggggaggaaaaaguacccacaaguuucggcuguucuguggacucaugggaaagcauguaaacaguaagagcucaauaaauaaaugucaguccucuuuugaggcuggaggcguggagucccgcauucgcccacccagccagagcacaccccagacaucccccugccgcauuccucaggccacguggguggcccgcucgcccgccccuuccgcccagccccacucaccgggcacagaauccucggagcccaucacggcgcccacggaucccacuguccagaccagggcuccccaaagcagcggccacagugccccagaacgcauggcgaguguugggcagcagcggggacucagcgagugcagacgccucggccuauaaaagcccagggcgggcggggccggcggcgggcggggcggggcgcagcgggacggacguguccccgaggcgcagggcccgggccugcgcggggguggccaccgggggcaggccgugucccaucugggaaccagacaguugucuaggaagaacaguccacaauggggucaggucacaaaguguggcccggagggcauguccugggagguggacaccuccagguguccaguguuccuuuggggaucucuggggugcaggugagaagccccaccugggcuaagcggguauugagguuaccaucuggucucuuuagccucuugccuaaccuucaccaugacaguacccacgguugcaaaggguguccccaugcuguuccaaacuauuuaaagacucauaccuaccauucuagccuuuggaggcugaagcaggaggauugcugugaguuugaggccagcu

SEQ ID NO: 10467 - RNA, 2501 nt, Mus musculus
acuuuaguucuuuucugcugcgguuucauguagcccagguuggccuagaacccucuauguagccgaggaugaccuugaaugucugauccuucugccucagccucccgaaugcugggagggcaggugugcaccaccacaacuggccuacgacuucuuuguuuuaucagaucugaucugacacuguagccuaggauggccuggaacucgcgucaauccuccugccucagccuccuaaguacugagaugccaggcgcggcgcaaacaagcacuucgcuacaaccuacccaggguggggccacaaagcccccccacccccgcacaagcucagcgcucugggguccccuucccgaugcgggaggcuagggcgggacccuggggauccgcggcagagucugcgcgagucuggccggggcggggcccgggcagaggcuuggaggguccggggcgcggcgggagggggcgcccgcgacccuccaagacgcuccagcggggacaaaggcgaggggagcccccgcgcccggggaacccgggagagcgccuugcgcagugcaccgcucgggccucugccccgcgccgccgucgccgccgccgccgccgccgccgccgccgccugguuucucggcgcccgcggucuacggcgggggccgcgcgcagaggcggggcggcagaucuccaagcgcgcgcggcgcuccgcccgcucggcggcggaggcggaggcggagacggcggggccaggcggcggcuggagagcgagggagcgagcgcggcggcagcaccggggccauggcgcccgcgcagcgcccgcugcugccgcugcugcugcugcugcugccgcugcgugcgcgcaacgaggacccggcccgggccaacgcugaccgauacgcagucuacuggaaccguagcaaccccaggugagcuugauugggggaacccccggggaccccaagaggccccagcccuggggauugcagcgcacggaccuccuccugaacuucgggggugccuaguauucccccaagagcuccuggacuuugggggaagcccucugcacccucagacucaggaguuccuucucuguacuugcuugggggacacccuugaaccccuggccucuuggaggagggagcacccuggagggcugaggguuuggcaaauaucccuggggacuucccuuccacccaaggaauccccggacuuggcucuuuugagaagguucugagaguccugucuuugguucuccagaugaacuuggggaaguuacaaaauccccuuucuaccccuauguucacucguucacuccaaggggugcuccaaucccccagacacuuuagaggaacagaggggaccaggcaccaaagcgacggaggucaguuugaggggugcagccuaggcuuaucguuuuccaccuuuguagcugcggggggaaacugaggugcaggagccaggaggggcugccucaaggucaugcccagagaacuggugcuagggcuggagacccuggugguacccagccugccacacccagcaaggcaccggguccugccugucuguuugguggcaccccaugggucagacccugccaggcacuggguacagucaggggacacagcagaagccacuguuacaggcugaguaaaaaguuuacagccacugaccacauucuggaaagcauagaaccuuccgggucagaagggucucagaagugggggcaugcuggagggugucuugggagauaggcuuugggguuccaaggcuugggugcaguauagaucgagaguccccauguguccgaggcuggccagugaggaacuuaguugauggaucagccaagcugcccucuugauccaucaacagaaaguugcaaaaaaaagguggucuuugaggcaagcuguggcacaagggccaacagugucucucggugggagugggagcucucuguccccuaccaucaaggcagagcugugaggucagcuccuuugggcugagggcagggaccccagguccucucagcaaccuggcaggaccaucgcucagugggcccccuacccccacggcccgccagcuacacuggucacauguggguuugauuaacacucaguggccgugcagggagcagggugagacuuccuuggccuaaguuuucuaguuuuagcuuguggagucucuguccccaguauggccuguccuuugucuggaaaaagcacagaggauggagggaggggguauggagaagaaggaaaagggucauggcugccccuaauggccuuacuugccguggagacacggucauggggcugcaggcuggaacccugacucuggaaggauggagguguccccugccaccaccaggguccagcucaggcuugccaccuccuguugcuguguaucagggcaggcugccugagaggacagacagcuaggcagguagcagagccaaccccuaagguuguauguguguguguguguguguguguguguguguguguguguguguguguaug

SEQ ID NO: 10468 - RNA, 2501 nt, Mus musculus
cauacacacacacacacacacacacacacacacacacacacacacacacauacaaccuuagggguuggcucugcuaccugccuagcugucuguccucucaggcagccugcccugauacacagcaacaggagguggcaagccugagcuggacccuggugguggcaggggacaccuccauccuuccagagucaggguuccagccugcagccccaugaccgugucuccacggcaaguaaggccauuaggggcagccaugacccuuuuccuucuucuccauacccccucccuccauccucugugcuuuuuccagacaaaggacaggccauacuggggacagagacuccacaagcuaaaacuagaaaacuuaggccaaggaagucucacccugcucccugcacggccacugaguguuaaucaaacccacaugugaccaguguagcuggcgggccguggggguagggggcccacugagcgaugguccugccagguugcugagaggaccuggggucccugcccucagcccaaaggagcugaccucacagcucugccuugaugguaggggacagagagcucccacucccaccgagagacacuguuggcccuugugccacagcuugccucaaagaccaccuuuuuuuugcaacuuucuguugauggaucaagagggcagcuuggcugauccaucaacuaaguuccucacuggccagccucggacacauggggacucucgaucuauacugcacccaagccuuggaaccccaaagccuaucucccaagacacccuccagcaugcccccacuucugagacccuucugacccggaagguucuaugcuuuccagaauguggucaguggcuguaaacuuuuuacucagccuguaacaguggcuucugcuguguccccugacuguacccagugccuggcagggucugacccauggggugccaccaaacagacaggcaggacccggugccuugcuggguguggcaggcuggguaccaccagggucuccagcccuagcaccaguucucugggcaugaccuugaggcagccccuccuggcuccugcaccucaguuuccccccgcagcuacaaagguggaaaacgauaagccuaggcugcaccccucaaacugaccuccgucgcuuuggugccugguccccucuguuccucuaaagugucugggggauuggagcaccccuuggagugaacgagugaacauagggguagaaaggggauuuuguaacuuccccaaguucaucuggagaaccaaagacaggacucucagaaccuucucaaaagagccaaguccggggauuccuuggguggaagggaaguccccagggauauuugccaaacccucagcccuccagggugcucccuccuccaagaggccagggguucaagggugucccccaagcaaguacagagaaggaacuccugagucugagggugcagagggcuucccccaaaguccaggagcucuugggggaauacuaggcacccccgaaguucaggaggagguccgugcgcugcaauccccagggcuggggccucuugggguccccggggguucccccaaucaagcucaccugggguugcuacgguuccaguagacugcguaucggucagcguuggcccgggccggguccucguugcgcgcacgcagcggcagcagcagcagcagcagcggcagcagcgggcgcugcgcgggcgccauggccccggugcugccgccgcgcucgcucccucgcucuccagccgccgccuggccccgccgucuccgccuccgccuccgccgccgagcgggcggagcgccgcgcgcgcuuggagaucugccgccccgccucugcgcgcggcccccgccguagaccgcgggcgccgagaaaccaggcggcggcggcggcggcggcggcggcggcgacggcggcgcggggcagaggcccgagcggugcacugcgcaaggcgcucucccggguuccccgggcgcgggggcuccccucgccuuuguccccgcuggagcgucuuggagggucgcgggcgcccccucccgccgcgccccggacccuccaagccucugcccgggccccgccccggccagacucgcgcagacucugccgcggauccccagggucccgcccuagccucccgcaucgggaaggggaccccagagcgcugagcuugugcgggggugggggggcuuuguggccccacccuggguagguuguagcgaagugcuuguuugcgccgcgccuggcaucucaguacuuaggaggcugaggcaggaggauugacgcgaguuccaggccauccuaggcuacagugucagaucagaucugauaaaacaaagaagucguaggccaguugugguggugcacaccugcccucccagcauucgggaggcugaggcagaaggaucagacauucaaggucauccucggcuacauagaggguucuaggccaaccugggcuacaugaaaccgcagcagaaaagaacuaaagu

SEQ ID NO: 10469 - RNA, 2501 nt, Mus musculus
ucguagugccggcagcccacaauagaguggucauugauggccucaaugcuaucccccacgcacacagccucaauccgguugauaaugcugccuuccuugauucucuaugggaaaugacaaucacucgugacuagucugcccggggccacccucccugggguccccagagucuucuuaggacucgacaaggccauugaucacccaguucacacacacccacaggcaccuugaugaaggcguauccggcuccguugucugugauggucaguccuagagcauccuccguuuuggugaccuccacuucuuuggucucuccacgcacaugugcaaagaugaagucuuccagcccaaucuguccccccagcaacuuuugcauguccacuuugugacuguugagggugcagaauaggaucuguucggauaagagagggacccagauugagccauggacaaaagucgauucugugcacauccuucugcgggcgcccccuggaggccagaugcacccguggcccgcaggaaacagcagcugcccccagccucuaacugcucaccggugaccaagugggcuggcaagacugugggugugcuuuaggucugucuguuccuaagcaggaacuuaggaagcugaggcagaaggaugacugagagucucaggcuucccaaaaauaaaaaauaaaaaagccaagcauccugaaucgggaguguaagcccagaagucgggaagccaaggcaagggaaaugcuggaaguuagaagccagcuuggguuacagaaugaauuucaggccagccugagcuacaaagcgaaauauuaucuuaauuagacgaacaagcaauggaaugaaaacggacaagagggcuagagcucagcgguuaagagcaccaucugcuuuucugaagguccugaguucaaaucccagcaaccacaugguggcucacaaccaucuguaacaagaucugaugcccucuucuaaagugucugagacagcuacacaguguccuuacguauaauaaauaacuaaaucuuuaaaaaaagaaaagaaaagaaaauggacaagaaggcuggagucaggagggagggagggagugggaggggcuuguggccagucugccaaguccugaaccuguuugauucucaagggcugcauguggaaggagaguacuaaccccuugcaaacuguugcccaaccuccaccguggugcccacucuggugccccuacauauaauaaaucaaacccacacuaaguggguggcccacaccuuuaaucccagcucucuagaggcugcagcagguagauuucugugaauuugaaaucagacuggucuacagagcuaguuccagaccggccagggcuacaugaugagacugccugucuuagaaaaacaaaauuaaaagaaagaaaacaaacaacugaaagggaauaguagaaauaauugaguugaaaaaaauuaaaagugauuuuauuuuauauaaggccucauguagcucaggcugacccucuaguuuccuauguaucugaggaugaccagcuuaacucucaauccuccugccuccaccuucccagaaucggaauaacagacuuuacaucacuacaccugcuuuauccugugucggggauggaaacuggcuuuccaaacccuaggugacugcucuacccacugagcugauugccacccauuagccauucaugggcuccugacaccugggucggguccucggcggcuaugggaaccccacucccagggucugauccugucuuucgcguggagugcagacaggauccugggugguguccgcgguccacccucaccucgguaggagcgaugccgaaggccucggcgaucuuggcguaaagcucgcggacauuggugaagcccucgauccugccggucggacugccgugcgccagcugcgugcggaacacuaggcgcgggcgcgcgcgggcggggggcucgguggccccgggcucgcggggcgcagcacuguccauggugcgugggguccgccgcguccugagccucccgccggaggucccgcgacagcggagccgggcguaagcggauccgggaacccgagccgcccgggggaaggugaaaccgcccgccggggccagccgcgcccucccccgggacucgcgaacaacagggggaggccccgggcugugggugcugcguccagucuuggccucccggggagccccgcccguccuccccuucucccuccuccgcuccgcacacagcccaccguccaugucagcggucuucccgcagcccccgacccugucugugaacuccgugccuugucccucugucuaucuggccucgcgugccuccuuccuugcccuaccucaggguccacccugccucagggcucuugcacaagcugggcucuccucuggggcucaguccccagagcucccagugaguuccugcucaccuguuuauuuuaaagaccaccugcggccccuaccuccaaaucucucccuuaauaauuuuugu

SEQ ID NO: 10470 - RNA, 2501 nt, Mus musculus
acaaaaauuauuaagggagagauuuggagguaggggccgcagguggucuuuaaaauaaacaggugagcaggaacucacugggagcucuggggacugagccccagaggagagcccagcuugugcaagagcccugaggcaggguggacccugagguagggcaaggaaggaggcacgcgaggccagauagacagagggacaaggcacggaguucacagacagggucgggggcugcgggaagaccgcugacauggacggugggcugugugcggagcggaggagggagaaggggaggacgggcggggcuccccgggaggccaagacuggacgcagcacccacagcccggggccucccccuguuguucgcgagucccgggggagggcgcggcuggccccggcgggcgguuucaccuucccccgggcggcucggguucccggauccgcuuacgcccggcuccgcugucgcgggaccuccggcgggaggcucaggacgcggcggaccccacgcaccauggacagugcugcgccccgcgagcccggggccaccgagccccccgcccgcgcgcgcccgcgccuaguguuccgcacgcagcuggcgcacggcaguccgaccggcaggaucgagggcuucaccaauguccgcgagcuuuacgccaagaucgccgaggccuucggcaucgcuccuaccgaggugaggguggaccgcggacaccacccaggauccugucugcacuccacgcgaaagacaggaucagacccugggagugggguucccauagccgccgaggacccgacccaggugucaggagcccaugaauggcuaauggguggcaaucagcucaguggguagagcagucaccuaggguuuggaaagccaguuuccauccccgacacaggauaaagcagguguagugauguaaagucuguuauuccgauucugggaagguggaggcaggaggauugagaguuaagcuggucauccucagauacauaggaaacuagagggucagccugagcuacaugaggccuuauauaaaauaaaaucacuuuuaauuuuuuucaacucaauuauuucuacuauucccuuucaguuguuuguuuucuuucuuuuaauuuuguuuuucuaagacaggcagucucaucauguagcccuggccggucuggaacuagcucuguagaccagucugauuucaaauucacagaaaucuaccugcugcagccucuagagagcugggauuaaaggugugggccacccacuuaguguggguuugauuuauuauauguaggggcaccagagugggcaccacgguggagguugggcaacaguuugcaagggguuaguacucuccuuccacaugcagcccuugagaaucaaacagguucaggacuuggcagacuggccacaagccccucccacucccucccucccuccugacuccagccuucuuguccauuuucuuuucuuuucuuuuuuuaaagauuuaguuauuuauuauacguaaggacacuguguagcugucucagacacuuuagaagagggcaucagaucuuguuacagaugguugugagccaccaugugguugcugggauuugaacucaggaccuucagaaaagcagauggugcucuuaaccgcugagcucuagcccucuuguccguuuucauuccauugcuuguucgucuaauuaagauaauauuucgcuuuguagcucaggcuggccugaaauucauucuguaacccaagcuggcuucuaacuuccagcauuucccuugccuuggcuucccgacuucugggcuuacacucccgauucaggaugcuuggcuuuuuuauuuuuuauuuuugggaagccugagacucucagucauccuucugccucagcuuccuaaguuccugcuuaggaacagacagaccuaaagcacacccacagucuugccagcccacuuggucaccggugagcaguuagaggcugggggcagcugcuguuuccugcgggccacgggugcaucuggccuccagggggcgcccgcagaaggaugugcacagaaucgacuuuuguccauggcucaaucugggucccucucuuauccgaacagauccuauucugcacccucaacagucacaaaguggacaugcaaaaguugcuggggggacagauugggcuggaagacuucaucuuugcacaugugcguggagagaccaaagaaguggaggucaccaaaacggaggaugcucuaggacugaccaucacagacaacggagccggauacgccuucaucaaggugccugugggugugugugaacugggugaucaauggccuugucgaguccuaagaagacucuggggaccccagggaggguggccccgggcagacuagucacgagugauugucauuucccauagagaaucaaggaaggcagcauuaucaaccggauugaggcugugugcgugggggauagcauugaggccaucaaugaccacucuauugugggcugccggcacuacga

SEQ ID NO: 10471 - RNA, 2501 nt, Mus musculus
gcagcccccacggcuccagaggcgcgcgcacagagauuuuuuuuuuuuuuuugccuaauuucucuccccccgguuuuuuuuuuuuuuuugaguggggguggggcgggaacacuaggaucgaacccaagccucaguuuccccagcgggucuuggaaccgaagaagcagagcaggcgggggcggcggugccaccuuaaggcgggucccgcccgcggcucccagccgagccccgcggagggaggcggcuccgcagccacugaggccaccagcgccgaccccgggcggcggccacagaccugcggcgcugacugcagcugccccuggguuguacaaccccggacgcgcuggcuggagggggggcgcagcgcgggguccugguccccugccccgacaggcucucccuggcugcucuuucuuugcguaaaaaucccucccccagcuccggcuucucuccuagcuuuuccaggcucagucuccuugcaccccagcucuagcuuagcaccccaaauucuacugccugcuccuccccgcacccaauucucuccccagcgccaccucugcaccucagcgucccuuugccacauccucaagccuccaagaagcuggggggguccauucucucacccauccaucagcaggauguacccucagggaaggcacccggugaguacggagacucccaucucuggcugcaggagguggggaccagggaggggacuccugccugcuguugcccuggaacucacccuaguguccuuucccacucucccccucagaccccgcugcagucuggccagccuuucaaguucucaguacuggaaaucugugaccggaucaaagaggaauuccaguuucuucaagcucaguaccacaggugagggagcccuaguucugggcccugggaagccccaugggggugagcggggacucuuggaggggcgugguuucuagggcaaggggcggggcucauugggccuacuggagggcuuucugguggagguggugcccagaagagugugagaugaauggauucagggaaagccuucccugagaauguuuuggucccaggaguagaucugggcucgagaggacugggaacaguuucuaaaggaauggggagccagcagcuucugccugucacuguggaaacugacccaugugggguguggcaagucaacccccauuuuugucuauucuuccugcccagccucaagcuagaaugugagaagcuggccagcgagaagacagaaaugcaaaggcauuaugugaugguaaggaguaccugcccauucugcccacuuccguguucucccuaaaaagggcaggcugggauaccaggcacuguucugugggucucccccccccuccaauuugggggacuaccugauuguccuaucucucugagcccauccgugauccaucuuguggguucccugucugggucuccauggggcucaggguguuugugucuugcccugauacucguaccacccccucgaggcugcaccccaucaguguccccaggguggcaccagcuauccacacuggccaagacugucuccuuugcaguacuacgagauguccuacggacucaacauugagaugcauaaacaggugaccaugugggguacgggugucugcggggagggucuaacuaaguucauccacauuucagguggucaucccaaagguucugaguggaucugagauuugagauagcccugaagguucugaggguucaaggaucugagauagcccugaaaguucugagauaacugacaguuccaaggacuggagguucugagauagcccugaagguucugagggcuugagcuucugagauagcauuuggaguugcaugguugaucccaugggcuucugagacuccagccuaugguguuaggguucugagauacacucuauguggagauugacuuugaggucuguaauuaacccugaguccccaaaguggccaguggcucuaggggguccugaggguucagagaucuguugaugaguggauuuauagguuuugcccccgaacacucaugauuccaugcuggagcccuacccuaggcuccuuucugugcagguagaugcugagugagccucaccugccauuugcuuccccugguuucugugggacuuggugcugaugugggcagcagagagcugguccuuacugguccuugccugguggaggacacaggccuuguaggcgaccagaggcaaccacagaacagccccccaaagaccugcagagagcugggucaugccagacaaacacacacucuuucacacagguuucuagggccucggggaaugaccacagugcugccuugggcaucaucgguccaucuauguuugcaucucugagggcuucauagggcgguggggaggugucacagacuugcaggacucccuagccaggcagcuccacgaaugcucaguccagcugggggcuggaugguggaagugacugucccuuccagugcuggcggc

SEQ ID NO: 10472 - RNA, 2501 nt, Mus musculus
gccgccagcacuggaagggacagucacuuccaccauccagcccccagcuggacugagcauucguggagcugccuggcuagggaguccugcaagucugugacaccuccccaccgcccuaugaagcccucagagaugcaaacauagauggaccgaugaugcccaaggcagcacuguggucauuccccgaggcccuagaaaccugugugaaagaguguguguuugucuggcaugacccagcucucugcaggucuuuggggggcuguucugugguugccucuggucgccuacaaggccuguguccuccaccaggcaaggaccaguaaggaccagcucucugcugcccacaucagcaccaagucccacagaaaccaggggaagcaaauggcaggugaggcucacucagcaucuaccugcacagaaaggagccuaggguagggcuccagcauggaaucaugaguguucgggggcaaaaccuauaaauccacucaucaacagaucucugaacccucaggacccccuagagccacuggccacuuuggggacucaggguuaauuacagaccucaaagucaaucuccacauagaguguaucucagaacccuaacaccauaggcuggagucucagaagcccaugggaucaaccaugcaacuccaaaugcuaucucagaagcucaagcccucagaaccuucagggcuaucucagaaccuccaguccuuggaacugucaguuaucucagaacuuucagggcuaucucagauccuugaacccucagaaccuucagggcuaucucaaaucucagauccacucagaaccuuugggaugaccaccugaaauguggaugaacuuaguuagacccuccccgcagacacccguaccccacauggucaccuguuuaugcaucucaauguugaguccguaggacaucucguaguacugcaaaggagacagucuuggccaguguggauagcuggugccacccuggggacacugauggggugcagccucgagggggugguacgaguaucagggcaagacacaaacacccugagccccauggagacccagacagggaacccacaagauggaucacggaugggcucagagagauaggacaaucagguagucccccaaauuggagggggggggagacccacagaacagugccugguaucccagccugcccuuuuuagggagaacacggaagugggcagaaugggcagguacuccuuaccaucacauaaugccuuugcauuucugucuucucgcuggccagcuucucacauucuagcuugaggcugggcaggaagaauagacaaaaauggggguugacuugccacaccccacaugggucaguuuccacagugacaggcagaagcugcuggcuccccauuccuuuagaaacuguucccaguccucucgagcccagaucuacuccugggaccaaaacauucucagggaaggcuuucccugaauccauucaucucacacucuucugggcaccaccuccaccagaaagcccuccaguaggcccaaugagccccgccccuugcccuagaaaccacgccccuccaagaguccccgcucacccccauggggcuucccagggcccagaacuagggcucccucaccugugguacugagcuugaagaaacuggaauuccucuuugauccggucacagauuuccaguacugagaacuugaaaggcuggccagacugcagcggggucugagggggagagugggaaaggacacuagggugaguuccagggcaacagcaggcaggaguccccucccugguccccaccuccugcagccagagaugggagucuccguacucaccgggugccuucccugaggguacauccugcugauggaugggugagagaauggacccccccagcuucuuggaggcuugaggauguggcaaagggacgcugaggugcagagguggcgcuggggagagaauugggugcggggaggagcaggcaguagaauuuggggugcuaagcuagagcuggggugcaaggagacugagccuggaaaagcuaggagagaagccggagcugggggagggauuuuuacgcaaagaaagagcagccagggagagccugucggggcaggggaccaggaccccgcgcugcgcccccccuccagccagcgcguccgggguuguacaacccaggggcagcugcagucagcgccgcaggucuguggccgccgcccggggucggcgcugguggccucaguggcugcggagccgccucccuccgcggggcucggcugggagccgcgggcgggacccgccuuaagguggcaccgccgcccccgccugcucugcuucuucgguuccaagacccgcuggggaaacugaggcuuggguucgauccuaguguucccgccccacccccacucaaaaaaaaaaaaaaaaccggggggagagaaauuaggcaaaaaaaaaaaaaaaaucucugugcgcgcgccucuggagccgugggggcugc

SEQ ID NO: 10473 - RNA, 2501 nt, Mus musculus
uccgcucuuaggggagcguggggcaacuuccccugcuaaaccgcccagggauuguaaauggucgcgugucagcagggcuccuguuugccucugucaccuaaccugcuucucgccacaccggagaacggguggcagcacuacagcaucuuauucaugguuuucccccaucccgguugugucauggaaacguucacgcaaccucgagacagcggcccagcuccgcccagggacugagggcuuuugggacccugcgggagcgugcugcgcacuccggacuccccgggaaacagcuggacgcgaccacgucucggguaggggcggggggaggcgacgcuccgccccggcgcggccccgcccuccccgcucgccggcgcccuccccucgccgggggcugcgaguugcguuugguaaaacccagcccuggaauauauagaucacuggagcgcaaugaaguagcuuuuggcgagggagggagggaggggggccuggacagucacagaggccagugcacggcggcggcggcaccuuccuucucgcaucccggucgcccggcccgugaggaggcagcggcggccgcaggcgccagcagaggaggcggcggagcaucgagcagaggcgaggcggaccggcaggagcgcgcggccggagccacgcauccucacacuugcacaccaacuccugcgccuuucacccucuagaccagagucggggccucggagagccucggugaagcuagcgggagccagcuccggagcccagccagcucuguucugagccuccccggugcugguacccccgcggcgggguccccgcuucugcgcucgggacgcgccucccggacagccggguccccgcggccaggacaaagccaugaagccggcgcugcuggaagugaugaggaugaacagaauuugccggauggugcuggccacuugcuucggauccuuuaucuuggucaucuucuauuuccaaaguauguugcacccagguagggggcgcguuagcgugguuuuguuggauauuuucuccucucucgcucugcuuucugcuucuuccaaccucaccucuucccuucggccucuucggggcucuuuacugccgggauccgcgggucacggaguugggaugggaagagaaggugcgcuuccucuuccucccaucuccaggcuagagguugagacugcaaggagagacagcggcgcguguuguugccuccuuuuucuuuucuuuucuuuucuuuuuuucuuugugucuugucuauuggcuagguggcauagaaagguagggcuuguuggaagcugcccggguugaugggaagacuacaaaacucuguccggguugcugcugagggcugaggugaagcaggcgcuggcagccggcuguucugcgccaggcagcgcugccucuuccugguuggggacccccgggcgaguggugcacgccccggcuggguagugagucccugcagccgccugggaagccccaagcccagcuaccacguguuccaagcucagcagcagagcagguguggggacagaguggguagguucccugcucuucucuccaucgggggagauauuuugcgaaaacaccccaggguccagcacgguggugacuuugcagcuguugcuccugggccuggucuaccaucuccuggccccagaccccccagcuaggaacuccagagccuuugggcugcacuuugaccaucaaagcucuuggagauacuuugugcaguuucaucccuucuucuuggguucugagcauuuagagacuucugcagcacaggaacgaauccuuccucacgucuucucuggcuuaggcuaaauaccaagucuccuaucaggauaggcagggccuaggcaccccucaucccggggguccagaaggaaaguuuggugcuagagaagagaggggcgcccuggagugcucuggccgggcugugcugcaugguuuagaagcccaacagguaggacuuucuaagacgguucuguauguggccacccagccuuagacuugggaaccccuuuccccauuucuucuggaucaauagaccuguacugggucaccuugacauauuuugacuccucagagucgcuacaauaaucauuuccuuuccuaauagcagggaggaagggggugggguggaaacacguaucuuuccagggaaauaaggcuguuuuuuuuuuuuuuuuuuuuuuuuuuuuuuuuuuuugccucccgccuucuuuacguguauagcuaacacuuucaguagacucagccgcgaauucaucaagccagacagagccguaaagcuguuccuugcaucaaacaggcagggauuccuugacagcgcagggacagacuggccucucuuccuuuuggggcucacaacaguuguuaaggaggucuggcugccaagaauauggucuugugcuacccggacaccccagccaguccugguaaaagauggcuuuuguuugcagcucauauuuuuagucuaaugucagcaaacuccu

SEQ ID NO: 10474 - RNA, 2501 nt, Mus musculus
aggaguuugcugacauuagacuaaaaauaugagcugcaaacaaaagccaucuuuuaccaggacuggcugggguguccggguagcacaagaccauauucuuggcagccagaccuccuuaacaacuguugugagccccaaaaggaagagaggccagucugucccugcgcugucaaggaaucccugccuguuugaugcaaggaacagcuuuacggcucugucuggcuugaugaauucgcggcugagucuacugaaaguguuagcuauacacguaaagaaggcgggaggcaaaaaaaaaaaaaaaaaaaaaaaaaaaaaaaaaaaacagccuuauuucccuggaaagauacguguuuccaccccacccccuuccucccugcuauuaggaaaggaaaugauuauuguagcgacucugaggagucaaaauaugucaaggugacccaguacaggucuauugauccagaagaaauggggaaagggguucccaagucuaaggcuggguggccacauacagaaccgucuuagaaaguccuaccuguugggcuucuaaaccaugcagcacagcccggccagagcacuccagggcgccccucucuucucuagcaccaaacuuuccuucuggacccccgggaugaggggugccuaggcccugccuauccugauaggagacuugguauuuagccuaagccagagaagacgugaggaaggauucguuccugugcugcagaagucucuaaaugcucagaacccaagaagaagggaugaaacugcacaaaguaucuccaagagcuuugauggucaaagugcagcccaaaggcucuggaguuccuagcuggggggucuggggccaggagaugguagaccaggcccaggagcaacagcugcaaagucaccaccgugcuggacccugggguguuuucgcaaaauaucucccccgauggagagaagagcagggaaccuacccacucuguccccacaccugcucugcugcugagcuuggaacacgugguagcugggcuuggggcuucccaggcggcugcagggacucacuacccagccggggcgugcaccacucgcccggggguccccaaccaggaagaggcagcgcugccuggcgcagaacagccggcugccagcgccugcuucaccucagcccucagcagcaacccggacagaguuuuguagucuucccaucaacccgggcagcuuccaacaagcccuaccuuucuaugccaccuagccaauagacaagacacaaagaaaaaaagaaaagaaaagaaaagaaaaaggaggcaacaacacgcgccgcugucucuccuugcagucucaaccucuagccuggagaugggaggaagaggaagcgcaccuucucuucccaucccaacuccgugacccgcggaucccggcaguaaagagccccgaagaggccgaagggaagaggugagguuggaagaagcagaaagcagagcgagagaggagaaaauauccaacaaaaccacgcuaacgcgcccccuaccugggugcaacauacuuuggaaauagaagaugaccaagauaaaggauccgaagcaaguggccagcaccauccggcaaauucuguucauccucaucacuuccagcagcgccggcuucauggcuuuguccuggccgcggggacccggcuguccgggaggcgcgucccgagcgcagaagcggggaccccgccgcggggguaccagcaccggggaggcucagaacagagcuggcugggcuccggagcuggcucccgcuagcuucaccgaggcucuccgaggccccgacucuggucuagagggugaaaggcgcaggaguuggugugcaagugugaggaugcguggcuccggccgcgcgcuccugccgguccgccucgccucugcucgaugcuccgccgccuccucugcuggcgccugcggccgccgcugccuccucacgggccgggcgaccgggaugcgagaaggaaggugccgccgccgccgugcacuggccucugugacuguccaggccccccucccucccucccucgccaaaagcuacuucauugcgcuccagugaucuauauauuccagggcuggguuuuaccaaacgcaacucgcagcccccggcgaggggagggcgccggcgagcggggagggcggggccgcgccggggcggagcgucgccuccccccgccccuacccgagacguggucgcguccagcuguuucccggggaguccggagugcgcagcacgcucccgcagggucccaaaagcccucagucccugggcggagcugggccgcugucucgagguugcgugaacguuuccaugacacaaccgggaugggggaaaaccaugaauaagaugcuguagugcugccacccguucuccgguguggcgagaagcagguuaggugacagaggcaaacaggagcccugcugacacgcgaccauuuacaaucccugggcgguuuagcaggggaaguugccccacgcuccccuaagagcgga

SEQ ID NO: 10475 - RNA, 2501 nt, Mus musculus
aacagggucuguugaauaauuccacagauccauuuacccccaauggcaauuaccacagccaucccacaaaggcagagguguguguguguguguguguguguguguguguguguguguguguguugggggugggaggugagggaagcugauguccagcgguuuccucuuacucccugcucucucuaggaaagauaagaaggugaaaauuucuuugaggcuuccuucuugacuuuuuccaggaggcgugaucaaggacuucagggugcgggccaccuggggcccuuggaagagauuaugcaggaaggcuggguggcugggacugaauccuuguuuagguccaaggcucauagagaggcggugggcguagggcgaaggggccgugggacgccgcuguagcgcacaccggcccaggacgcgcccagcccacccacucgcgugcccacaacugcauuauucccuauaaggaucugaacgguccgggccggcuccgcccugucgccccgcgccccccggccccgcccccuuuuuggagggccgaugagguaaugcggcgcugccauuggucggagggggcggaccccgagcucccgaggggcuggguccccucgcgccccuauaucacucugcagcccuggacucucgcucacagugggcagcgggcagccgccagcgccaagaaucuucuucucccgcuucuccgcuucccgauccuucuccgggaggccacucguuggcuccgcggacucguguuccagcgacccuuggccacuuaguccugucccgccgggcuacuuggaaggcacuuccccggagcucaucguugcccaccgugcacagugcccgguuaaacccagcgagugagcucggacuguagcaucagcgcuagcgcucggcaacuuugaagaaaagagcggcaguccccgcagcggaccacaacagcuaccaugacucccuggcuugggcuugucgugcuccugagcugcuggagccuugggcacuggggcgcggaagcgugcacaugcucucccagccauccccaggaugccuucugcaacuccgacaucgguaagugcuccggaagacucaguuucccugggcggggacucuguguggggagaugcccugcagagggaacccaaccaguggccuaguggucucuggcgggcgagcgugaacgagguccugcuugauaucuagaaaaauuuccccauugccuugaagggaaaagagcuggagaaggagggugagagauucugaaaaguuggaacgcuaacugaaguucugggaccucgacgacacuuuacaaguuguagucugugcggguggaguugcgagagagaaaacuccuagcuucaaagauugcuuaucucccgcgcccuugaacuucauucuuuuccuugagaaacucagccuagcugcaggcucucccggcaagugcuaauggagcuucuugccugccaaguuuggguggcuggaaaaggggggagggggagaugaaaaaaaaacggggagggggggggcggaaacugugggauugcccuccucccugggagaacugcaucagaguguugauagcuggccugaggugacugugggggaaucacuuaucauagagcugugaaaauucacaggaagauauauuuuuucuucccccggaauguuugugaggagggagagagugaguaucaucggagaaagcagauuugucaccaaaagagcaaagcugccaaaggucucaucgcuuguggugauggucucaaagagacugugcugauuagagggacuugauaagaaguagaacccacuauccagaggaguguuggggacauuaguguuuggagggcuccaggggaaguggaagcuggcuacucucuucuccagcuccuuaaagcucucagguccaauguguguuugcugggcaggggugggacaagaggcugcccuuagccaguguggagucaguaaagaauggaguguguguguuuuaaguauggucauaaaggagauggaaaauuuccacugggucuugagugagggauucuacucugcaaguguguuguguugagaggggggcggggggagggguggugaccuggcaggaaagaaaaccaagguuggagaggcacugcuggugggucggccuagggggaaaucugggaggugguuuugguggucaggucaguccacuuggcagcccaggguguuugugugacccugcagucacccuucuugaagguuuccugggacccagagacacccacccuucucugucccugggggagaaccccuggcuuuauggagugcuugcaagcauccuuuuuuggauugcuggagggcugggaaaguuuucucccuucucucauuagggcccccacccagauuccucuuagucuuuccucccaguagccgaugacuuucucuacuaguuccugcugucugcuuuugcucagccuagagccuggugcuggccugugagcuagcagguggaggaaucugggugu

SEQ ID NO: 10476 - RNA, 2501 nt, Mus musculus
acacccagauuccuccaccugcuagcucacaggccagcaccaggcucuaggcugagcaaaagcagacagcaggaacuaguagagaaagucaucggcuacugggaggaaagacuaagaggaaucugggugggggcccuaaugagagaagggagaaaacuuucccagcccuccagcaauccaaaaaaggaugcuugcaagcacuccauaaagccagggguucucccccagggacagagaagggugggugucucugggucccaggaaaccuucaagaagggugacugcagggucacacaaacacccugggcugccaaguggacugaccugaccaccaaaaccaccucccagauuucccccuaggccgacccaccagcagugccucuccaaccuugguuuucuuuccugccaggucaccaccccuccccccgccccccucucaacacaacacacuugcagaguagaaucccucacucaagacccaguggaaauuuuccaucuccuuuaugaccauacuuaaaacacacacacuccauucuuuacugacuccacacuggcuaagggcagccucuugucccaccccugcccagcaaacacacauuggaccugagagcuuuaaggagcuggagaagagaguagccagcuuccacuuccccuggagcccuccaaacacuaauguccccaacacuccucuggauaguggguucuacuucuuaucaagucccucuaaucagcacagucucuuugagaccaucaccacaagcgaugagaccuuuggcagcuuugcucuuuuggugacaaaucugcuuucuccgaugauacucacucucucccuccucacaaacauuccgggggaagaaaaaauauaucuuccugugaauuuucacagcucuaugauaagugauucccccacagucaccucaggccagcuaucaacacucugaugcaguucucccagggaggagggcaaucccacaguuuccgcccccccccuccccguuuuuuuuucaucucccccuccccccuuuuccagccacccaaacuuggcaggcaagaagcuccauuagcacuugccgggagagccugcagcuaggcugaguuucucaaggaaaagaaugaaguucaagggcgcgggagauaagcaaucuuugaagcuaggaguuuucucucucgcaacuccacccgcacagacuacaacuuguaaagugucgucgaggucccagaacuucaguuagcguuccaacuuuucagaaucucucacccuccuucuccagcucuuuucccuucaaggcaauggggaaauuuuucuagauaucaagcaggaccucguucacgcucgcccgccagagaccacuaggccacugguuggguucccucugcagggcaucuccccacacagaguccccgcccagggaaacugagucuuccggagcacuuaccgaugucggaguugcagaaggcauccuggggauggcugggagagcaugugcacgcuuccgcgccccagugcccaaggcuccagcagcucaggagcacgacaagcccaagccagggagucaugguagcuguugugguccgcugcggggacugccgcucuuuucuucaaaguugccgagcgcuagcgcugaugcuacaguccgagcucacucgcuggguuuaaccgggcacugugcacggugggcaacgaugagcuccggggaagugccuuccaaguagcccggcgggacaggacuaaguggccaagggucgcuggaacacgaguccgcggagccaacgaguggccucccggagaaggaucgggaagcggagaagcgggagaagaagauucuuggcgcuggcggcugcccgcugcccacugugagcgagaguccagggcugcagagugauauaggggcgcgaggggacccagccccucgggagcucgggguccgcccccuccgaccaauggcagcgccgcauuaccucaucggcccuccaaaaagggggcggggccggggggcgcggggcgacagggcggagccggcccggaccguucagauccuuauagggaauaaugcaguugugggcacgcgagugggugggcugggcgcguccugggccggugugcgcuacagcggcgucccacggccccuucgcccuacgcccaccgccucucuaugagccuuggaccuaaacaaggauucagucccagccacccagccuuccugcauaaucucuuccaagggccccagguggcccgcacccugaaguccuugaucacgccuccuggaaaaagucaagaaggaagccucaaagaaauuuucaccuucuuaucuuuccuagagagagcagggaguaagaggaaaccgcuggacaucagcuucccucaccucccacccccaacacacacacacacacacacacacacacacacacacacacacacaccucugccuuugugggauggcugugguaauugccauuggggguaaauggaucuguggaauuauucaacagacccuguu

SEQ ID NO: 10477 - RNA, 2501 nt, Mus musculus
gccuguuagugguugggaguuaauauagugucugucugugugugugugugugugugugacgcucuugcuccaggaaaggaacccaucugugauucgggcuuagguucagacaccagucacucuucucgugucuggaaaugauguuggaaugcagagacacuguuggagcccaccccuguuugcugagaacauugcaucuuagugaaggugccccuguagguuggcugucugguuuguuuguuucauuucuucuucuuuuuuccccuuguuuuucugccuccccauuugacgucguuggcgagaaacacuaaagaugcaggaucugcugccauccuguaacagaaacaagagagguuagugugaacuugaaggggugugguagaagcuauucaggcuuggagaaucugucagguaaaacaucucuuuggacaaagucccaggacucaauacgcagggucucuaugccucaccucgaccuucugcucuuggaaacuugggcaaagccacucucaggggccaagacugaaguuaacacacuagcacuugagauggacaaacuaacaacauaguaaccuccucucaccccuggguuccuggagacagccccuaccuuccgugaacuccccccuccacaccgaaaaagaaaaagggaccuagucaagaaaggcucugcccauccccacaugaagcguaccugcuuccaaaguccauucccaggagagccuggcagguccucagaaccaguugguaaaguccagcagcucuuguuccucugggcuaagagggucguaggaucccucgucggaggaguaggacgagaccggagaacccgccauagaguucaagucguuggaguaguugggggagauggugggcgacaggacgcccgccugaaaggcagcgcucaccgcgucgugcucguccagcagcugcugcagcgcgcggauguacucgaccgccgagcgcagcgucuccaccuugcucaucuucuuguuggccgcgccguuggggacaugcucccggaggguggcaaaacccagguugaccaacuugacccgguugcgcucgcgcucguugcggcgcgccacggcggccggcugcugcuguggcaggcuguagccgaagccgcugaaguugagccggcguuugcagcgcaucaguuccggagaggacgagcgcuggcgcuugaccugcuuggccgcugacuugugaccgcccccugagggcuggcugucggccaccgggcucagcugcggcgccugcugcggcggcgccugcggcuguugcugcugcgcgcucugagcugccgcggccgccgccgcugccgccgccgccgcggucgcaaagaagcaggcugcgggaggcaggaagggcugcgggggcugcggcugcuggccggcuccacucuccaucuugccagagcucuccaugccgggccaaacugucgcgggggagaacgaguuggggacgcagggugcgcagagcccuugaaggaagcggggcugcgaagcacgaucaaagggggacgaagaaaaaggagaggggagaaacgagccccggaggaaaguuaaaggggaagaaacgcgcagaaggaggcagaguugucaggcugcagcggaggaaggugccugggcgaucgucuucccucugcgccgccuccucccuccccuccucccgccgcgguuggcuucgggagccucgcguggcgcucgcgugugcggccgccgccggcgccuucucgguuuuaaaagaggaaagggaaaaggaaagcagccgcaaaagucagugccgagcgcacucugccagguggagcugcuccggggcugcgcuuucuugcgcccgcucucccuugcuccagccugggcuugagccugcuucugggauuauuugguugaacccccuuucuuucuaauugcucucucguuccccccaauucgcccucccuaaccggcucccagccgguacgccuuccacguucccuggccagaagugagagacugcugggcggcugcggugcggccgccuuuucaaugggacacccagccccacgcgcagcccuggccccgccucgccccccacuccccgcugcugcagcgagcggcugcagcccccacuaccccuccucuucccccaccuccucagcucccucccucucgcccccccccccuccaguugcccgcgcccgcuccuugcaaacucuccauucagccugguuuguuguugcagugcgugcgcccggcgcgugccggacucccggcugaauaaacaggccgcgcgcucggggcgguggcuccgggagccaggggguggcucuagaaaugggggccuuuuuaaaaaagggggggggcaaauaacuccuggacuuggggugccuagguggaaagucuggagggaaaagugucuuuggagucuccugagaacuuggaagaaaauucagggaaggguuuaggcagaaaaaguggcaaagggaacucuuggaaguggagggcugggcuucugcu

SEQ ID NO: 10478 - RNA, 2501 nt, Mus musculus
agcagaagcccagcccuccacuuccaagaguucccuuugccacuuuuucugccuaaacccuucccugaauuuucuuccaaguucucaggagacuccaaagacacuuuucccuccagacuuuccaccuaggcaccccaaguccaggaguuauuugcccccccccuuuuuuaaaaaggcccccauuucuagagccacccccuggcucccggagccaccgccccgagcgcgcggccuguuuauucagccgggaguccggcacgcgccgggcgcacgcacugcaacaacaaaccaggcugaauggagaguuugcaaggagcgggcgcgggcaacuggagggggggggggcgagagggagggagcugaggaggugggggaagaggagggguagugggggcugcagccgcucgcugcagcagcggggaguggggggcgaggcggggccagggcugcgcguggggcugggugucccauugaaaaggcggccgcaccgcagccgcccagcagucucucacuucuggccagggaacguggaaggcguaccggcugggagccgguuagggagggcgaauuggggggaacgagagagcaauuagaaagaaaggggguucaaccaaauaaucccagaagcaggcucaagcccaggcuggagcaagggagagcgggcgcaagaaagcgcagccccggagcagcuccaccuggcagagugcgcucggcacugacuuuugcggcugcuuuccuuuucccuuuccucuuuuaaaaccgagaaggcgccggcggcggccgcacacgcgagcgccacgcgaggcucccgaagccaaccgcggcgggaggaggggagggaggaggcggcgcagagggaagacgaucgcccaggcaccuuccuccgcugcagccugacaacucugccuccuucugcgcguuucuuccccuuuaacuuuccuccggggcucguuucuccccucuccuuuuucuucgucccccuuugaucgugcuucgcagccccgcuuccuucaagggcucugcgcacccugcguccccaacucguucucccccgcgacaguuuggcccggcauggagagcucuggcaagauggagaguggagccggccagcagccgcagcccccgcagcccuuccugccucccgcagccugcuucuuugcgaccgcggcggcggcggcagcggcggcggccgcggcagcucagagcgcgcagcagcaacagccgcaggcgccgccgcagcaggcgccgcagcugagcccgguggccgacagccagcccucagggggcggucacaagucagcggccaagcaggucaagcgccagcgcucguccucuccggaacugaugcgcugcaaacgccggcucaacuucagcggcuucggcuacagccugccacagcagcagccggccgccguggcgcgccgcaacgagcgcgagcgcaaccgggucaaguuggucaaccuggguuuugccacccuccgggagcauguccccaacggcgcggccaacaagaagaugagcaagguggagacgcugcgcucggcggucgaguacauccgcgcgcugcagcagcugcuggacgagcacgacgcggugagcgcugccuuucaggcgggcguccugucgcccaccaucucccccaacuacuccaacgacuugaacucuauggcggguucuccggucucguccuacuccuccgacgagggauccuacgacccucuuagcccagaggaacaagagcugcuggacuuuaccaacugguucugaggaccugccaggcucuccugggaauggacuuuggaagcagguacgcuucauguggggaugggcagagccuuucuugacuaggucccuuuuucuuuuucgguguggaggggggaguucacggaagguaggggcugucuccaggaacccaggggugagaggagguuacuauguuguuaguuuguccaucucaagugcuaguguguuaacuucagucuuggccccugagaguggcuuugcccaaguuuccaagagcagaaggucgaggugaggcauagagacccugcguauugaguccugggacuuuguccaaagagauguuuuaccugacagauucuccaagccugaauagcuucuaccacaccccuucaaguucacacuaaccucucuuguuucuguuacaggauggcagcagauccugcaucuuuaguguuucucgccaacgacgucaaauggggaggcagaaaaacaaggggaaaaaagaagaagaaaugaaacaaacaaaccagacagccaaccuacaggggcaccuucacuaagaugcaauguucucagcaaacaggggugggcuccaacagugucucugcauuccaacaucauuuccagacacgagaagagugacuggugucugaaccuaagcccgaaucacagauggguuccuuuccuggagcaagagcgucacacacacacacacacacacagacagacacuauauuaacucccaaccacuaacaggc

SEQ ID NO: 10479 - RNA, 2501 nt, Mus musculus
agaaaagaagcaccuccuuuaagugaaaggauacacccuagaauagaaguaggcugggcacccagagaagaccuguccugcuucuagcauccccaggggacucacuuccuuuuaaccaucaaacucccaacauuuaccauaaacuucacaggggcuccgggugggguauuggguggagaaugucccuuccauauagguacuucccacacuucaccccaaaguuccuguuuggagggacacgucuucacccucucuggguggcccgggaugccaaggggagaaguuaugcuacguuaaguuucugaaagucagauccagucccggauuaccaucucuccgccccggggcuccugcugcacgcgaaaguggcggcggcggcggcggcugccgcugcuugggcggcaaagggaccgcggcugcuuuaagaaccgccucccccucucuucccuuugacaauggucugaaccgagcccugcuucccaaagcaaaauuuguaauaugccauuuuuccgauggaccuuucuccuuuuggcugcugacggagccacgggaagaugccgaacugcugccacguuaggaagccagggcacguuccaagagaacgcuggggcucgcgagugucuaagcugucuuucuccucccguugcuaaggaaaugguccaggacugcugggugugagccucaccucuccuccagccgagacugcgguugucauugacaauugaagaaacaggaccugaaauaagagacauuagguacagaaacuguauucgaguugcaugguuucucuuccgcuucggguuuuuuccccccuugaccaccuccccagccccaccccgcccccagggaagaggagaggcaaaguccuccuuguggguauuaguuaccuuugcuuuccacccaucuucuccauccccgauuuuucuagcuccugccuagcucguucucuccuggggcugaugaacaauuuuaguguggaaauuaugaagucaacuucuuucggggugguggggguguggcugagcaguaacuguccagcagugugggguacgcuugcuguuugaccauccgagcaggcacagagguaaagaaagugaaaaugcuuccauuagacaugguaggaauauuucccgaggacaggggauuucaaagaguuaaagaggaggagaaauauucguguaauguaaucagacaauggcuaggcuuucucuuacugaauuacuccuuuaacggagacagagcugggaggguuccgaagacuaaguaagccuuugccgaagaagaaacuuguuacagagaacgacugcuucuuugccugugguaguguauaauuucuagaaauauaauuaaaugaaguuaucgacuuacagaaauaaaagucuuuuggaauguucuugucugaauagguauagcuccuaagaacacauauuaccaaggaucacacuggaucucaaaauucuugcugaaugacuccacugggcauucaaaacuuuuauuuuggauucugagagguuuagaagacagucaagguuauauccugacagcgugggaguugguuuucuugauauaaaauuauucgugcuaaauuuaagcacugagauaauuaaaccaaucaggguuauuauuuuucucucucuuaaaaaugaaauuuacacugucugaaacuggguccugaaaccuucaauaguuuacgugucaagucaucucuaucuagaugagguuaaugcaauuauauuucacauugacauaaaagagggauaaugaaaaggcaaauuaccucagcaaacugugagcucacucgucucucagugaugguguaauguuugcaauuuuaguuccaaaaauggcuauaaaagcaaaaugugauauaucugggugcaauacacaagauacuggauaaccauaccugcacugugccaggguucuauaaaauacucuucauaggauuuuaauuacuccuaauacacucaagcugugcauuugggaauuguuagacuauguuuuaugguacauacaaguacuuuauaagauuacaucagaaucugaggucucacauauuaaccaaccuagcccauaaaaguugauuugguuuuuguagacuguuuauuguuuguuuguuuguuuguuuacuuuucguuuuagaggagaagauucugaauuuagccauuuguguuggcuuggaagaaaguagcaugcauucauuuucuguccuauguaauuuugcaugguuugaauuuuaugaauugaauuuggagaguucagaaguaucugcuaggauuacggcuauagaccuacaagcaagaguuuugauguagaauauuauuucuguaaggauaaauggugaccaguuuguaacagagagcaugcuuggguuuuuauaguauuuuuuauauaugacacuguguguucuuuguuggauaacccacuggaaugcuaaaagugggaauuuuauaaacaaauuauaauucuuuaaggaaggaaacguguuuuucaaaggcaaa

SEQ ID NO: 10480 - RNA, 2501 nt, Mus musculus
uuugccuuugaaaaacacguuuccuuccuuaaagaauuauaauuuguuuauaaaauucccacuuuuagcauuccaguggguuauccaacaaagaacacacagugucauauauaaaaaauacuauaaaaacccaagcaugcucucuguuacaaacuggucaccauuuauccuuacagaaauaauauucuacaucaaaacucuugcuuguaggucuauagccguaauccuagcagauacuucugaacucuccaaauucaauucauaaaauucaaaccaugcaaaauuacauaggacagaaaaugaaugcaugcuacuuucuuccaagccaacacaaauggcuaaauucagaaucuucuccucuaaaacgaaaaguaaacaaacaaacaaacaaacaauaaacagucuacaaaaaccaaaucaacuuuuaugggcuagguugguuaauaugugagaccucagauucugauguaaucuuauaaaguacuuguauguaccauaaaacauagucuaacaauucccaaaugcacagcuugaguguauuaggaguaauuaaaauccuaugaagaguauuuuauagaacccuggcacagugcagguaugguuauccaguaucuuguguauugcacccagauauaucacauuuugcuuuuauagccauuuuuggaacuaaaauugcaaacauuacaccaucacugagagacgagugagcucacaguuugcugagguaauuugccuuuucauuaucccucuuuuaugucaaugugaaauauaauugcauuaaccucaucuagauagagaugacuugacacguaaacuauugaagguuucaggacccaguuucagacaguguaaauuucauuuuuaagagagagaaaaauaauaacccugauugguuuaauuaucucagugcuuaaauuuagcacgaauaauuuuauaucaagaaaaccaacucccacgcugucaggauauaaccuugacugucuucuaaaccucucagaauccaaaauaaaaguuuugaaugcccaguggagucauucagcaagaauuuugagauccagugugauccuugguaauauguguucuuaggagcuauaccuauucagacaagaacauuccaaaagacuuuuauuucuguaagucgauaacuucauuuaauuauauuucuagaaauuauacacuaccacaggcaaagaagcagucguucucuguaacaaguuucuucuucggcaaaggcuuacuuagucuucggaacccucccagcucugucuccguuaaaggaguaauucaguaagagaaagccuagccauugucugauuacauuacacgaauauuucuccuccucuuuaacucuuugaaauccccuguccucgggaaauauuccuaccaugucuaauggaagcauuuucacuuucuuuaccucugugccugcucggauggucaaacagcaagcguaccccacacugcuggacaguuacugcucagccacacccccaccaccccgaaagaaguugacuucauaauuuccacacuaaaauuguucaucagccccaggagagaacgagcuaggcaggagcuagaaaaaucggggauggagaagauggguggaaagcaaagguaacuaauacccacaaggaggacuuugccucuccucuucccugggggcgggguggggcuggggagguggucaaggggggaaaaaacccgaagcggaagagaaaccaugcaacucgaauacaguuucuguaccuaaugucucuuauuucagguccuguuucuucaauugucaaugacaaccgcagucucggcuggaggagaggugaggcucacacccagcaguccuggaccauuuccuuagcaacgggaggagaaagacagcuuagacacucgcgagccccagcguucucuuggaacgugcccuggcuuccuaacguggcagcaguucggcaucuucccguggcuccgucagcagccaaaaggagaaagguccaucggaaaaauggcauauuacaaauuuugcuuugggaagcagggcucgguucagaccauugucaaagggaagagagggggaggcgguucuuaaagcagccgcggucccuuugccgcccaagcagcggcagccgccgccgccgccgccacuuucgcgugcagcaggagccccggggcggagagaugguaauccgggacuggaucugacuuucagaaacuuaacguagcauaacuucuccccuuggcaucccgggccacccagagagggugaagacgugucccuccaaacaggaacuuuggggugaagugugggaaguaccuauauggaagggacauucuccacccaauaccccacccggagccccugugaaguuuaugguaaauguugggaguuugaugguuaaaaggaagugaguccccuggggaugcuagaagcaggacaggucuucucugggugcccagccuacuucuauucuaggguguauccuuucacuuaaaggaggugcuucuuuucu

SEQ ID NO: 10481 - RNA, 2501 nt, Mus musculus
ccaaggacuuuccucauuugaagaaagcagucuaugacugaacaauuacccuaagcccauucuccaaaccauuuuuacauaacuguuacaguuucagaaauuauaagcauauuguuugccaaccacaaaggaaaaaaaccacuauuuuagauaaagcugcuuuaaaauacucauguguauuuucaaguaacauuaacuacaacagcaugaguuaucaucuaacuccaaagagaacacuuguauuuaacaaagcauagacuuugccugagcuuuuuguuuguuuguuuguuuguuuguuuuucgagacaggguuucucuguguaaccauggcuguccuggaacucacucuguagaccaggcugaccuugaacucagaaauccgccugccucugccucccaagugcugggauuaaaggcgugcgccaccaugcccggcugagcuuuuuuguuacuauaucaccacuuuacaauauguaguugcucaguuuaccaaaucugcauaaaauggauauuugaagauaacuuuugagauuaauaugaagaggcuuucuuuacaauuuuauugcaguagauuuggcaaauaagcaaaaaacauuuaauuaagaaaaguggaaaucggggcuggagagauggcucagugguuaaagagcacugacugcucuucggaagguccugacuucaauucccagcaaccacaugguggcucacaaccauccguaacgagaucuggugcccucuucuggagugucugaaggcagcuacaguguacuuacauauaauaaauaaaucuuaaaaagaaagaaagaaagagagagagagagagagagagagagagagagagagagagagagagagaaaggaagaaagaaagaaagaaaaguggaaaucacauccaccgcaaacagcauuucccuuauagauuauuggagacuuauuggaaacagcgaaguggguuaugcaugccaucugaguucugucccaggaucccgugguggaaggagagaacugguuccuggaauuugucuucuagaugcgggaggagugugggauacacacacaaaaaacaccaaagaauagauaucuuaaaguucuaaaagaaaggaaggaaggaaggaaggaaggaaggaaggaaggaagaaggaaaggagaaaagaaagaaagaaagaaagaaagaaagaaagaaagaaagaaagaaagaaagaaagaaagaaagaaaggaaggaaggaaggaaggaaggaaggaaggaagaaagaaagaaagaaagaaagaaagaaagaaaggaaagaaaagaaaguaaguuugcuuuuuguuuuugagauggcgucucauguuucccaagccagcuaggaacucucuacaaggagaggaugcucuugagcaucuguccugccuacuucuaccucucaaugacuggcacuaccacugucuguuuuauuccaagcuagggaaucgaacaugcagcuucauacaucuauagguaagcacucuagcaacugagcggcaucucaaaaaagaaguuauaauauuaaaaaaaucugauguagggguuguagagccaguagccaugcccugcauacgguaauauuugcauacugcugcgcacacugcaaaccgagugaagcgagaaucucuucccagcacgggaugcuuucuugacaucugacauacccaauccccuaacuugauacagcaguaccccacugucagagagggaaggagagugaguggcagguccccggguuugcugagucccucgcgggggaggaccggcaggucugagucgcacucacccaggccccgccagccgagcgggccaucgcagcuguccaggaucccgcaaagcucucccagcagugcgggcggcaggucgaagagcagcaacuguggcgacagcgcgccacgggccccgcaccggccggccaucgcggagucccgggaccccacgcagagaagcagggaggucgccgcugucaccgccuuucacaaccgcggaaauucagcuccacgacggcugcccggagcuugcaacacgccgucgcagggcgggccccacgugacguagggagccgcuccccagggaugcgcccugcgagaccugggcugcccuugcuccuagccgcugucccgcgacccugcgcgccgcaccccaggucaucuuuguuaugaaccguucuguccguccccgucuugggacaugacccaggagaccagccaagaaaaugagggcggggaacagcggcuggaauccgggaaagccgccaccccucugcugcucugggacgggcggccuccuggccacgauggaucuaagagguuuguguuacaucuuuuaaaguuucucuuugucccgucaggaaagaaaugcgugcucaccgagaaacacguuuuugccaaauaacuuuaaacggaaggaaacguguacacgccgggcgaaauggacauaaaaagaaaaccacaacaaacaggccaaaccugggcaaacaaacugcucauccuugcu

SEQ ID NO: 10482 - RNA, 2501 nt, Mus musculus
agcaaggaugagcaguuuguuugcccagguuuggccuguuuguugugguuuucuuuuuauguccauuucgcccggcguguacacguuuccuuccguuuaaaguuauuuggcaaaaacguguuucucggugagcacgcauuucuuuccugacgggacaaagagaaacuuuaaaagauguaacacaaaccucuuagauccaucguggccaggaggccgcccgucccagagcagcagagggguggcggcuuucccggauuccagccgcuguuccccgcccucauuuucuuggcuggucuccugggucaugucccaagacggggacggacagaacgguucauaacaaagaugaccuggggugcggcgcgcagggucgcgggacagcggcuaggagcaagggcagcccaggucucgcagggcgcaucccuggggagcggcucccuacgucacguggggcccgcccugcgacggcguguugcaagcuccgggcagccgucguggagcugaauuuccgcgguugugaaaggcggugacagcggcgaccucccugcuucucugcguggggucccgggacuccgcgauggccggccggugcggggcccguggcgcgcugucgccacaguugcugcucuucgaccugccgcccgcacugcugggagagcuuugcgggauccuggacagcugcgauggcccgcucggcuggcggggccugggugagugcgacucagaccugccgguccucccccgcgagggacucagcaaacccggggaccugccacucacucuccuucccucucugacagugggguacugcuguaucaaguuaggggauuggguaugucagaugucaagaaagcaucccgugcugggaagagauucucgcuucacucgguuugcagugugcgcagcaguaugcaaauauuaccguaugcagggcauggcuacuggcucuacaaccccuacaucagauuuuuuuaauauuauaacuucuuuuuugagaugccgcucaguugcuagagugcuuaccuauagauguaugaagcugcauguucgauucccuagcuuggaauaaaacagacagugguagugccagucauugagagguagaaguaggcaggacagaugcucaagagcauccucuccuuguagagaguuccuagcuggcuugggaaacaugagacgccaucucaaaaacaaaaagcaaacuuacuuucuuuucuuuccuuucuuucuuucuuucuuucuuucuuucuuucuuccuuccuuccuuccuuccuuccuuccuuccuuucuuucuuucuuucuuucuuucuuucuuucuuucuuucuuucuuucuuucuuucuuucuuucuuuucuccuuuccuucuuccuuccuuccuuccuuccuuccuuccuuccuuccuuucuuuuagaacuuuaagauaucuauucuuugguguuuuuuguguguguaucccacacuccucccgcaucuagaagacaaauuccaggaaccaguucucuccuuccaccacgggauccugggacagaacucagauggcaugcauaacccacuucgcuguuuccaauaagucuccaauaaucuauaagggaaaugcuguuugcgguggaugugauuuccacuuuucuuucuuucuuucuuccuuucucucucucucucucucucucucucucucucucucucucucucucucuuucuuucuuucuuuuuaagauuuauuuauuauauguaaguacacuguagcugccuucagacacuccagaagagggcaccagaucucguuacggaugguugugagccaccaugugguugcugggaauugaagucaggaccuuccgaagagcagucagugcucuuuaaccacugagccaucucuccagccccgauuuccacuuuucuuaauuaaauguuuuuugcuuauuugccaaaucuacugcaauaaaauuguaaagaaagccucuucauauuaaucucaaaaguuaucuucaaauauccauuuuaugcagauuugguaaacugagcaacuacauauuguaaaguggugauauaguaacaaaaaagcucagccgggcaugguggcgcacgccuuuaaucccagcacuugggaggcagaggcaggcggauuucugaguucaaggucagccuggucuacagagugaguuccaggacagccaugguuacacagagaaacccugucucgaaaaacaaacaaacaaacaaacaaacaaaaagcucaggcaaagucuaugcuuuguuaaauacaaguguucucuuuggaguuagaugauaacucaugcuguuguaguuaauguuacuugaaaauacacaugaguauuuuaaagcagcuuuaucuaaaauagugguuuuuuuccuuugugguuggcaaacaauaugcuuauaauuucugaaacuguaacaguuauguaaaaaugguuuggagaaugggcuuaggguaauuguucagucauagacugcuuucuucaaaugaggaaaguccuugg

SEQ ID NO: 10483 - RNA, 2501 nt, Mus musculus
uguccugauacuuucaacauuucagcugaacuauugaaacaaguaacuuuacaaguugaaacauugcuuugauucgaagccuaaaugaugcucuguccugcaaccuuggcagacaggcaguucaggcacugugacaacaaucuaaauggcaaagagcuacuggguuuaauguuaaaaaaaaaaaaaaaaacccagacagccacauagggaacuauuaaaagcaucagaaauucgacuaucagguaggaacaaauuuuagaacuauguuuaaauaguccaaauauaaacuugguguuagaacugacuggcaagaggccauggcacaguugacuuuggucuucaaaggcuguuugaccacagacaucaaguaaguccacuuaucacgcacacacacgcacacacacacacacacacgcacacacacgcgcacacacacgcacacgcacgcacacgcacacacaugcacacgcacgcgcacgcacacacgcacgcgcacacacacacgcaaauaaucauucauacacucccuuucagcacaaucuguuccuuaucagccagcccagcagguuuuagaaauccauugauaaaaugucuagucagaauccguugauucccaagaaugagcguuagaaagcagccccaggaauaugagucgauuuaaagguggguccuuuccgaaguacaauguuccagaacaaacauaaaacuuccgucauuguuaacggaagcacuuacaaacugcaguggguauacuuaacuauguaccacugguccugagaaaccacuucgucaagucuauaacccugagaaucuucccuggauaacauuuuauacaucaaaguaccuuuaaaaccuauuuugucuuuuaugcugcacaggguguagucgacugucaacucaagugugcguuguguccuggcuagccgaaccucauuuugacaguucaggcuauccuagccauaggcaacacagcgaccaccuaacaccucccacauaauccagguuucuggugauuauaacguuuugccuugccagacaaaaugaaucaagcuuugauuuguuuacucuguccaaauucaagagccccugcaacuuaauauuuuccuuuaaaaccuccccuuuggacuucaaauaauuaguuuuuugacacgcaauggaaauaggaagaaagaaagaaagaaagaaagaaagaaagaaagaaagaaagaaagaaagaaagaaagaaagaaagaaagaaagagagagagaaagaagaaagaaagcucucuaauacuuuacauaugauucaaagaaaauucuuuuaaauccuuauugcccccacuuaucgcauaaccuacaaaggcaggaacaguacuuuuuauucagauagucugacuugaaauagcccaguggaaaaguuuaagaaauaaaaagggaggcggggggggggggcucugaugcuuguuuucacuugaaaagaagacagaacugguaccugcccccuggaguuuugcugguaccuguuugggccuaugagccgccagcccgguccggggugcgccccuguccccaggggccuggcgacgccuuccugguucccacgcccuggcccguuaucccccggccgcagcugcggagaggcccgaaagagagagagacgcgcccucggagcugcagcccgcgcccccgaccaccucacugagccuccccgaggacccgcgcgaggacggcggcucagguucccguuggggacggguaaggugucagcgcggcggccggcggggcgcgggcucucccgccugaccucguucugcgcuguccccucguuggcgaggagcgucuccgggguccacgccgagacucuacggcagggggaugacucucaagacugagggggcggcgcgggcgcucccgggacggggguggggguggggggaaacacuccgggucccaggcugacucggagggaucggagggccggauggggcgaggcggggacucaccgcgcgucgugguggccgcggccgcggcuaggcagagacccaggcagagcgcgauugggcacgggaggguccgccgcgcacucuuggggaagacgagccuccgcuguccgaucccuccucccucccggcuccgggcgacagacggggcggcgggaggcaugacgggaaauuccugggcacgggcggccgaguccaaauaugagcauagcagacaagcgagggaggacggcggagcgcgcuggccgcggacggggcccgcugcccgggacgcggccgccgccaacucccgccuccggcgccgccuccaccgccccgggccagcccugcgggaacagggcuuccgcgcgugggcaacccguagcagagcccccuggcagcauccaccugagaccuuuacuguagggucagggcgccugagagcuaaggaccaaaaguccuggccuguaccaaagaggcugugaagugccaguuaaggugugacauggucgcucuugugccuacugaauacccauaauacag

SEQ ID NO: 10484 - RNA, 2501 nt, Mus musculus
cuguauuauggguauucaguaggcacaagagcgaccaugucacaccuuaacuggcacuucacagccucuuugguacaggccaggacuuuugguccuuagcucucaggcgcccugacccuacaguaaaggucucagguggaugcugccagggggcucugcuacggguugcccacgcgcggaagcccuguucccgcagggcuggcccggggcgguggaggcggcgccggaggcgggaguuggcggcggccgcgucccgggcagcgggccccguccgcggccagcgcgcuccgccguccucccucgcuugucugcuaugcucauauuuggacucggccgcccgugcccaggaauuucccgucaugccucccgccgccccgucugucgcccggagccgggagggaggagggaucggacagcggaggcucgucuuccccaagagugcgcggcggacccucccgugcccaaucgcgcucugccugggucucugccuagccgcggccgcggccaccacgacgcgcggugaguccccgccucgccccauccggcccuccgaucccuccgagucagccugggacccggaguguuuccccccacccccacccccgucccgggagcgcccgcgccgcccccucagucuugagagucaucccccugccguagagucucggcguggaccccggagacgcuccucgccaacgaggggacagcgcagaacgaggucaggcgggagagcccgcgccccgccggccgccgcgcugacaccuuacccguccccaacgggaaccugagccgccguccucgcgcggguccucggggaggcucagugagguggucgggggcgcgggcugcagcuccgagggcgcgucucucucucuuucgggccucuccgcagcugcggccgggggauaacgggccagggcgugggaaccaggaaggcgucgccaggccccuggggacaggggcgcaccccggaccgggcuggcggcucauaggcccaaacagguaccagcaaaacuccagggggcagguaccaguucugucuucuuuucaagugaaaacaagcaucagagccccccccccccgccucccuuuuuauuucuuaaacuuuuccacugggcuauuucaagucagacuaucugaauaaaaaguacuguuccugccuuuguagguuaugcgauaagugggggcaauaaggauuuaaaagaauuuucuuugaaucauauguaaaguauuagagagcuuucuuucuucuuucucucucucuuucuuucuuucuuucuuucuuucuuucuuucuuucuuucuuucuuucuuucuuucuuucuuucuuucuuucuuccuauuuccauugcgugucaaaaaacuaauuauuugaaguccaaaggggagguuuuaaaggaaaauauuaaguugcaggggcucuugaauuuggacagaguaaacaaaucaaagcuugauucauuuugucuggcaaggcaaaacguuauaaucaccagaaaccuggauuaugugggagguguuagguggucgcuguguugccuauggcuaggauagccugaacugucaaaaugagguucggcuagccaggacacaacgcacacuugaguugacagucgacuacacccugugcagcauaaaagacaaaauagguuuuaaagguacuuugauguauaaaauguuauccagggaagauucucaggguuauagacuugacgaagugguuucucaggaccagugguacauaguuaaguauacccacugcaguuuguaagugcuuccguuaacaaugacggaaguuuuauguuuguucuggaacauuguacuucggaaaggacccaccuuuaaaucgacucauauuccuggggcugcuuucuaacgcucauucuugggaaucaacggauucugacuagacauuuuaucaauggauuucuaaaaccugcugggcuggcugauaaggaacagauugugcugaaagggaguguaugaaugauuauuugcgugugugugugcgcgugcgugugugcgugcgcgugcgugugcaugugugugcgugugcgugcgugugcgugugugugcgcgugugugugcgugugugugugugugugugcgugugugugcgugauaaguggacuuacuugaugucuguggucaaacagccuuugaagaccaaagucaacugugccauggccucuugccagucaguucuaacaccaaguuuauauuuggacuauuuaaacauaguucuaaaauuuguuccuaccugauagucgaauuucugaugcuuuuaauaguucccuauguggcugucuggguuuuuuuuuuuuuuuuuaacauuaaacccaguagcucuuugccauuuagauuguugucacagugccugaacugccugucugccaagguugcaggacagagcaucauuuaggcuucgaaucaaagcaauguuucaacuuguaaaguuacuuguuucaauaguucagcugaaauguugaaaguaucaggaca

SEQ ID NO: 10485 - RNA, 2501 nt, Mus musculus
gguaaagguggccaugugccaucuuuccaugguguuacaugcacaggaggugagaggcguggccagcgcaggugaaucuccacagcaaaaaagacaacccaagaauaugggaacaacugaggcugcaccuuccaccuaguuuccauucagggagugacaauuuccagggacgggccugagggacucggcuccccaggaaaaugggaaauccaucaggcucuggcuccugaacuccagaggcacagccuuucccaggaagaccuuuaggcugcugcuggaccagggcauuaauacaagaggagcacaagacaucugguguggagcuguugucacaggagacccaaaagccagagucagcccuagcccugccuacuguugugggugcugagcuacacagaccacuugcaaagggauuggcugaagagcuuggagaggggcgucuucaccuccaggaccaaggguauauauggguccaggcaagugcagaagaugcucuggaaaagugcucucgagcagacuccccaaacacagacaugacccaggcagucaagcucgccuccagaguuuuucaccgaauccaccugccucugcagcuggaugccucgcugggcuccagaggcagugagucgguucuccggagcuugucugacaucccugggcccucuacacucagcuuccuggcugaacucuucugcaaaggggggcuguccaggcugcaugaacugcagguaagggggcaguccuugcccuugguaggacugagcagggagagccggcuuuaauggcagaaaggaccacggugaagaacacaggaaggagggucagugaggguggggaccuguggauuaugaagaacucacgcugggaccauagaagguuccacugccccggagucaauaccuaacucccggcaaagggauguacugucgcuucauacacaguaaacccugcagauccaggacaagcgugcugaaggagggagagcgcugugcuauccugcagaugaagcuuaaagcuacgcgcuccucuucuuucacuagaggcuccucuugagguacaguuaggagaagagcccugaaggaacugcucccccuaggcuagagccagauaacuaaaaagaagugcuaaaugucuacuguuuugccauucucucucaaacuuucaugggaugggagaaaaaguuugccauuugggggcccuacgcuagcccggcacugaaaaagcucccuuuucccaagccuagccaacacccuuggcccuggcacaagccaaacgaaauucacccgcccagguauucaaaugcgccgauucucucaggugcauggcgcugcgcgguacgggccaauauggucuggcagcuuugggacacuucgcacaguuuacguugccgacccuacacuuguggagcagcuccugcgacaagaaagucacuguccagagcgcuguaguuucucaucaugggcagagcaccgucgccgccaccagcgugcuugcggauugcuaacggcgugagucgaccccugagcaccuuauuccugccccgacucccacagccaaguugggcuuggagggaggucggaaguuuccaccaaucuucuggcauuuccccgguucuccagucuguacuccaguccgaacgcagguagagccgauuccucaccccucccugcauguuuggggccaaaauccuacgauuccacgagauaggcgagggcaccagcauuuggcuggaacgugagcaucugugauucaguuuaccauggaacccacucccaucccugagcaggaagugaguaaagaggaacggagaugagagauuggugaggucagggugauuucuacacccggagagagcagacauaauacuccuggucacccuagccuucuccacacacgcucacgucccuaaagucccucucugcacccgggcagggauggugaagaauggcagaggcuccgaagucuucuggccccgcuccuccuccggccacaagcagccgcgggcuaugcuggaacucuggacaacgugguccgugaccuugugcgacgacuaaggcgccagcggggacguggcucugggcuacccggccuaguucuggacguggcaggagaguuuuacaaauuuggccuagaaagugaguccuaaagcagaguuaaggaccuguguagauaguucaggguccuagauggcugaugugugacugugcccccuccuggccagguauaggcgcggugcugcugggaucgcgccugggcugccuagaggcugaagucccuccugacacagaaaccuucauacaugcagugggcucaguguuugugucuacacucuugaccauggcgaugcccaacugguugcaccaccuuauaccuggacccugggcccgccucugccgagacugggaucagauguuugccuuugguaaggcccgggggaggggacuggguaucaauacugcacuggagcagugaggcagcgugccuuccuucucagcccagag

SEQ ID NO: 10486 - RNA, 2501 nt, Mus musculus
cucugggcugagaaggaaggcacgcugccucacugcuccagugcaguauugauacccaguccccucccccgggccuuaccaaaggcaaacaucugaucccagucucggcagaggcgggcccaggguccagguauaagguggugcaaccaguugggcaucgccauggucaagaguguagacacaaacacugagcccacugcauguaugaagguuucugugucaggagggacuucagccucuaggcagcccaggcgcgaucccagcagcaccgcgccuauaccuggccaggagggggcacagucacacaucagccaucuaggacccugaacuaucuacacagguccuuaacucugcuuuaggacucacuuucuaggccaaauuuguaaaacucuccugccacguccagaacuaggccggguagcccagagccacguccccgcuggcgccuuagucgucgcacaaggucacggaccacguuguccagaguuccagcauagcccgcggcugcuuguggccggaggaggagcggggccagaagacuucggagccucugccauucuucaccaucccugcccgggugcagagagggacuuuagggacgugagcguguguggagaaggcuagggugaccaggaguauuaugucugcucucuccggguguagaaaucacccugaccucaccaaucucucaucuccguuccucuuuacucacuuccugcucagggaugggaguggguuccaugguaaacugaaucacagaugcucacguuccagccaaaugcuggugcccucgccuaucucguggaaucguaggauuuuggccccaaacaugcagggaggggugaggaaucggcucuaccugcguucggacuggaguacagacuggagaaccggggaaaugccagaagauugguggaaacuuccgaccucccuccaagcccaacuuggcugugggagucggggcaggaauaaggugcucaggggucgacucacgccguuagcaauccgcaagcacgcugguggcggcgacggugcucugcccaugaugagaaacuacagcgcucuggacagugacuuucuugucgcaggagcugcuccacaaguguagggucggcaacguaaacugugcgaagugucccaaagcugccagaccauauuggcccguaccgcgcagcgccaugcaccugagagaaucggcgcauuugaauaccugggcgggugaauuucguuuggcuugugccagggccaaggguguuggcuaggcuugggaaaagggagcuuuuucagugccgggcuagcguagggcccccaaauggcaaacuuuuucucccaucccaugaaaguuugagagagaauggcaaaacaguagacauuuagcacuucuuuuuaguuaucuggcucuagccuagggggagcaguuccuucagggcucuucuccuaacuguaccucaagaggagccucuagugaaagaagaggagcgcguagcuuuaagcuucaucugcaggauagcacagcgcucucccuccuucagcacgcuuguccuggaucugcaggguuuacuguguaugaagcgacaguacaucccuuugccgggaguuagguauugacuccggggcaguggaaccuucuauggucccagcgugaguucuucauaauccacagguccccacccucacugacccuccuuccuguguucuucaccgugguccuuucugccauuaaagccggcucucccugcucaguccuaccaagggcaaggacugcccccuuaccugcaguucaugcagccuggacagccccccuuugcagaagaguucagccaggaagcugaguguagagggcccagggaugucagacaagcuccggagaaccgacucacugccucuggagcccagcgaggcauccagcugcagaggcagguggauucggugaaaaacucuggaggcgagcuugacugccugggucaugucuguguuuggggagucugcucgagagcacuuuuccagagcaucuucugcacuugccuggacccauauauacccuugguccuggaggugaagacgccccucuccaagcucuucagccaaucccuuugcaaguggucuguguagcucagcacccacaacaguaggcagggcuagggcugacucuggcuuuugggucuccugugacaacagcuccacaccagaugucuugugcuccucuuguauuaaugcccugguccagcagcagccuaaaggucuuccugggaaaggcugugccucuggaguucaggagccagagccugauggauuucccauuuuccuggggagccgagucccucaggcccgucccuggaaauugucacucccugaauggaaacuagguggaaggugcagccucaguuguucccauauucuuggguugucuuuuuugcuguggagauucaccugcgcuggccacgccucucaccuccugugcauguaacaccauggaaagauggcacauggccaccuuuacc

SEQ ID NO: 10487 - RNA, 2501 nt, Mus musculus
cgguuccucuucaagucuguaccaagaagcaguuaggggaaguaggccggccauugaguaacggcuugccucgguugauggcuggaauucggagccaagaggucagagagaggccgcugucuuuguugcucgugaggcaguguucaccuccagggcuggcugguuuuauuuauuucaucuuccccauccaaguguuccuugaaaugagguuagaccgcauacugaacccaaucgcccuuccuggggcuacacugugaacgaguggggaaauggcggggaccgggaacuggcaucuuagacaccgcgguuuggggacgaagggaugugaaaaggggggaccuucccgggagggcucaucgccuaagcaaucuucuccgcguccgccagacggcgccgcggagcucgccauccccgcucagagcccgagccugugccgcagccagcccgggagcggcgcugcgcugcggugugagagccgggcggaggccugagcccucggcugccugggagcgcgacgcggugccagggcuuccccgcuuugucgcuggggcuggggcgcggcggauuuacgauccaguucaccccggcaggaaacguucagaaccacccccgcgcugcggucuacaaagccccggaguccgcaggcgggaggagucggauccccgacacugucgggcucccucccgcccagcucccgcaucaggccgucgccggccucaugaggaccccccggccggggcggagaaccgggcacugcccggaccgcgauccugccgcggccuuagaacguuagacaggucagugcgcuggcacgcccggcggccgaggugugggcaggagcggcguccuccuggccucgcgcaucgugcccguggcucaacgaggccacccgagggucaccgaggccgggcacccgcgagcgcgggcgcgacaccgugccuucccugacccgccaggugcaguacagccgccccuccgcagcacccuggcccggcugcugcccguggggugggggugggguccccgagggcugcgcacccaagauacugcaugucaccacggcaagccuuggguguaugcggaagcccagaggcgagagagaggcggaagaaaggaggccgggagaccuuuggcgugagcaugagggaaggggugcgcgccgugcggagcggagauggcuggccuuggguaccugcgcgagccucggaggcggcgggguccagagucccggcccucacguucucugagagccuggucaccucucacccucccccauaucaggaugcggcuagaccgccgggcccucuaugcgcuagucuugcugcucgccugcgccucgcugggucuccuguacuccagcacccgaaacgcgccaagucucccgaacccucuggcauuguggucgcccccacaaggucccccgagacucgaucugcuagaccuugccccugagccucgcuacgcacacaucccggucaggaucaaggagcaagugguggggugagugcggaccgcggcguggcggcggcgacagcgcagaacaugcuggaggggguggccggggagcuuuuguuuccuccagugcuagacucggacgcugcuuacugcugacugguugggugcaguuaucagggagguggagagggcuaccgaagcuugaacugggggggagacaggggcgcggcaaaucuauccuccucaaccuugucgccgccacuggagugugggaggauguacaggcaaaagagcacccggagacugccugcugucuugauuuagacuugagauuccagaaggguuccuggauggcggcuacguagacauccuaguaauuggcccuaguucgcaccucuguaacgcacagauuuaagggauaagcugucucucaccugugggcagaguugagggaucaaagugugcagcgcugugcguuuugugagauaaauggagcuuagguaccuaccuggacucugaagccgcuucuccucccuuuaggcugcuggcucagaacaacugcaguugugaauccaagggaggaagccuucccuugcccuuucugagacagguucgggcgguugaccucacuaaagccuuugacgcugaggagcugagggcuguuucugucgccagggagcaggaauaccaggccuuccuugcaagguaccagugagagaggaggauccagcucuucccagggaggccaguggugucguagugaccccguuggaagaaagagcuccucuccuacugacuccuuuaucaccucuacacuacaggagccggucccuggcugaccagcugcugauagcucccgccaacucccccuuacaguacccccugcaggguguggagguucagccccucaggagcauccuggugccagguaaagaaggaaggucucagggguuaagucaggucgugaggguggcggagcuacaggcuagcagguggagaucucugacaaagagauauggaggcagagggacucuaaggucgucagg

SEQ ID NO: 10488 - RNA, 2501 nt, Mus musculus
ccugacgaccuuagagucccucugccuccauaucucuuugucagagaucuccaccugcuagccuguagcuccgccacccucacgaccugacuuaaccccugagaccuuccuucuuuaccuggcaccaggaugcuccugaggggcugaaccuccacacccugcaggggguacuguaagggggaguuggcgggagcuaucagcagcuggucagccagggaccggcuccuguaguguagaggugauaaaggagucaguaggagaggagcucuuucuuccaacggggucacuacgacaccacuggccucccugggaagagcuggauccuccucucucacugguaccuugcaaggaaggccugguauuccugcucccuggcgacagaaacagcccucagcuccucagcgucaaaggcuuuagugaggucaaccgcccgaaccugucucagaaagggcaagggaaggcuuccucccuuggauucacaacugcaguuguucugagccagcagccuaaagggaggagaagcggcuucagaguccagguagguaccuaagcuccauuuaucucacaaaacgcacagcgcugcacacuuugaucccucaacucugcccacaggugagagacagcuuaucccuuaaaucugugcguuacagaggugcgaacuagggccaauuacuaggaugucuacguagccgccauccaggaacccuucuggaaucucaagucuaaaucaagacagcaggcagucuccgggugcucuuuugccuguacauccucccacacuccaguggcggcgacaagguugaggaggauagauuugccgcgccccugucucccccccaguucaagcuucgguagcccucuccaccucccugauaacugcacccaaccagucagcaguaagcagcguccgagucuagcacuggaggaaacaaaagcuccccggccacccccuccagcauguucugcgcugucgccgccgccacgccgcgguccgcacucaccccaccacuugcuccuugauccugaccgggaugugugcguagcgaggcucaggggcaaggucuagcagaucgagucucgggggaccuugugggggcgaccacaaugccagaggguucgggagacuuggcgcguuucgggugcuggaguacaggagacccagcgaggcgcaggcgagcagcaagacuagcgcauagagggcccggcggucuagccgcauccugauaugggggagggugagaggugaccaggcucucagagaacgugagggccgggacucuggaccccgccgccuccgaggcucgcgcagguacccaaggccagccaucuccgcuccgcacggcgcgcaccccuucccucaugcucacgccaaaggucucccggccuccuuucuuccgccucucucucgccucugggcuuccgcauacacccaaggcuugccguggugacaugcaguaucuugggugcgcagcccucggggaccccacccccaccccacgggcagcagccgggccagggugcugcggaggggcggcuguacugcaccuggcgggucagggaaggcacggugucgcgcccgcgcucgcgggugcccggccucggugacccucggguggccucguugagccacgggcacgaugcgcgaggccaggaggacgccgcuccugcccacaccucggccgccgggcgugccagcgcacugaccugucuaacguucuaaggccgcggcaggaucgcgguccgggcagugcccgguucuccgccccggccgggggguccucaugaggccggcgacggccugaugcgggagcugggcgggagggagcccgacagugucggggauccgacuccucccgccugcggacuccggggcuuuguagaccgcagcgcgggggugguucugaacguuuccugccggggugaacuggaucguaaauccgccgcgccccagccccagcgacaaagcggggaagcccuggcaccgcgucgcgcucccaggcagccgagggcucaggccuccgcccggcucucacaccgcagcgcagcgccgcucccgggcuggcugcggcacaggcucgggcucugagcggggauggcgagcuccgcggcgccgucuggcggacgcggagaagauugcuuaggcgaugagcccucccgggaagguccccccuuuucacaucccuucguccccaaaccgcggugucuaagaugccaguucccgguccccgccauuuccccacucguucacaguguagccccaggaagggcgauuggguucaguaugcggucuaaccucauuucaaggaacacuuggauggggaagaugaaauaaauaaaaccagccagcccuggaggugaacacugccucacgagcaacaaagacagcggccucucucugaccucuuggcuccgaauuccagccaucaaccgaggcaagccguuacucaauggccggccuacuuccccuaacugcuucuugguacagacuugaagaggaaccg

SEQ ID NO: 10489 - RNA, 2501 nt, Mus musculus
cgccccacuguuuuucuccuaaguccauuggagaacagauuuccuuacaugacccuaugcaaaguaacagguauucagaaaccaaacauaaacauagacccucacauguccacaggcuggaccaaaugccagauaggcacuucccugcugauuccgacauagccaccccacagcugcagccuucucacaggaagacagauucccaucucuccuaucauccucaugcuuacucucccucaaggcucuaccagauguuuccuuccucuucagggggcaaaggaaauuaaaccagaucuguccacaggggaguuaauuugaugcgaagagaguggagaaggcugguggggguggagggaaggaucagggcaauguauccuuccuuccucugugaccccaggccuucacauacugugguuuguuuggggcuggaccuucuccugcagucucccuggguacaaaccaggccucagguucaaagaaagcucuugccaaaggcagcauuuuucacacuagggggcuauuuucuuuucuuucuuuuuuuccauccauccauccauccauccauccauucguucauucuuucuuauuuauuuauuuauuuauuuauugcccaguuuccguucucucaaggucacuaggcagauaggcuugggagaauccaagggcucuacuaacuggcucacuggggcagugucuacccuauuguaguuaugaggacaccacaccaggccugggguccaagcguuuuggaggagaauuacugguuucucuuaaagacuggggauugagguccaagagugagggcuuguggagccaacugguugcccuuaaacuggguaggucauaguugagaaaggaaguugggggcagagucuaaacuacccuugugggucacacuucagggcacaaauagauggcagugcuuugaagcaggcacaaucaaccaugcaaagacaaugucuccaccauggcaugccaacauagacauucaccuugggucccagugccuggauucccuggacacaugcauacaagggcugguuuuaacccauacacuccauguccgcacugugagcccauaugggcugaagaucucaaggcaagagucgggcaggaugagcucugggcccuuuuagccuuugggucuucacccagaaaccccaggaaaagagacagugagaagggugggggcaggaaggagauguaaggagagacuccccucccagacaacaaccaccaggcgugagaggggggugugucugugagguuaugcaggggagauggugucuccgcgggaaaugggauggaagauuguagccaaguucagcccugcugguguggguccguguaagcgcgugugccuggauaauguaugcucggaucgcagagcuuaccuggcauugugacaaggagaagaggaaugggaagguggagggugagagguggaaggacagacagacagacagagggaggcaagcgagguaggugcggaaagaaggcuaggcuaacacccgcuggcuugucugucugucucgcacuccuucucugucuggcgcacucgcgggucgcgcuucguccccuccccccgucgcgccugaauccgacuggagccgggccuccacccugcaccuucuucuaacccucagccaacuugcugggugcaugccaguccuaaagcgggcagucugucuguccacgucccccacgacgcacaaaguugggacgcuuaguccugggggcggggcggacgcgcggagcccccuggcaugcaguguucuucgugucccggaccccgcaccuuggcucugccacccuuaccuuccuaaggagccaaggaccaaagagcaagaggagccauuccgggagcagccgcaucuucccgagcggucgagcgggucgggcagggcgggucccgaguccggcaggacugggcucagggugagggacgccgggcagagggcggcggcgcgagcagcgggagcgggcggcucggcccgcggacugagcgcggagcggagcaaggcgcugggggcggggcgcgggcgggggagaaaguugggucugagucgggcgggcggggugggggggcggggcuccgcggugcuccaaucccggccgcgccccgcgcgcccccucccgcccagcugggggcaaggaaggugacuuucaccgugacacacccuggacacaccccuggcucaggugugaagcuggagaggggcaagggguuuggggagcagcaccccaaagacgccaggucuuggggcagaugagggcuacaauagggcgugggacucuaggcccugaacugugagcgggaaggggucgucgcggagcaugaguucccauacacaggcuagggaacgcagcaggacccuguccugugaugcccgagguggaugggugggggguguuucuauaauccuggcagagguaggucuagggcagugauccggacagggaccgaggugagggcgggcggggccucgggcgacuagcac

SEQ ID NO: 10490 - RNA, 2501 nt, Mus musculus
gugcuagucgcccgaggccccgcccgcccucaccucggucccuguccggaucacugcccuagaccuaccucugccaggauuauagaaacaccccccacccauccaccucgggcaucacaggacaggguccugcugcguucccuagccuguguaugggaacucaugcuccgcgacgaccccuucccgcucacaguucagggccuagagucccacgcccuauuguagcccucaucugccccaagaccuggcgucuuuggggugcugcuccccaaaccccuugccccucuccagcuucacaccugagccagggguguguccagggugugucacggugaaagucaccuuccuugcccccagcugggcgggagggggcgcgcggggcgcggccgggauuggagcaccgcggagccccgcccccccaccccgcccgcccgacucagacccaacuuucucccccgcccgcgccccgcccccagcgccuugcuccgcuccgcgcucaguccgcgggccgagccgcccgcucccgcugcucgcgccgccgcccucugcccggcgucccucacccugagcccaguccugccggacucgggacccgcccugcccgacccgcucgaccgcucgggaagaugcggcugcucccggaauggcuccucuugcucuuugguccuuggcuccuuaggaagguaaggguggcagagccaaggugcgggguccgggacacgaagaacacugcaugccagggggcuccgcgcguccgccccgcccccaggacuaagcgucccaacuuugugcgucgugggggacguggacagacagacugcccgcuuuaggacuggcaugcacccagcaaguuggcugaggguuagaagaaggugcaggguggaggcccggcuccagucggauucaggcgcgacggggggaggggacgaagcgcgacccgcgagugcgccagacagagaaggagugcgagacagacagacaagccagcggguguuagccuagccuucuuuccgcaccuaccucgcuugccucccucugucugucugucuguccuuccaccucucacccuccaccuucccauuccucuucuccuugucacaaugccagguaagcucugcgauccgagcauacauuauccaggcacacgcgcuuacacggacccacaccagcagggcugaacuuggcuacaaucuuccaucccauuucccgcggagacaccaucuccccugcauaaccucacagacacaccccccucucacgccuggugguuguugucugggaggggagucucuccuuacaucuccuuccugcccccacccuucucacugucucuuuuccugggguuucugggugaagacccaaaggcuaaaagggcccagagcucauccugcccgacucuugccuugagaucuucagcccauaugggcucacagugcggacauggaguguauggguuaaaaccagcccuuguaugcauguguccagggaauccaggcacugggacccaaggugaaugucuauguuggcaugccaugguggagacauugucuuugcaugguugauugugccugcuucaaagcacugccaucuauuugugcccugaagugugacccacaaggguaguuuagacucugcccccaacuuccuuucucaacuaugaccuacccaguuuaagggcaaccaguuggcuccacaagcccucacucuuggaccucaauccccagucuuuaagagaaaccaguaauucuccuccaaaacgcuuggaccccaggccuggugugguguccucauaacuacaauaggguagacacugccccagugagccaguuaguagagcccuuggauucucccaagccuaucugccuagugaccuugagagaacggaaacugggcaauaaauaaauaaauaaauaaauaagaaagaaugaacgaauggauggauggauggauggauggauggaaaaaaagaaagaaaagaaaauagcccccuagugugaaaaaugcugccuuuggcaagagcuuucuuugaaccugaggccugguuuguacccagggagacugcaggagaagguccagccccaaacaaaccacaguaugugaaggccuggggucacagaggaaggaaggauacauugcccugauccuucccuccacccccaccagccuucuccacucucuucgcaucaaauuaacuccccuguggacagaucugguuuaauuuccuuugcccccugaagaggaaggaaacaucugguagagccuugagggagaguaagcaugaggaugauaggagagaugggaaucugucuuccugugagaaggcugcagcugugggguggcuaugucggaaucagcagggaagugccuaucuggcauuugguccagccuguggacaugugagggucuauguuuauguuugguuucugaauaccuguuacuuugcauagggucauguaaggaaaucuguucuccaauggacuuaggagaaaaacaguggggcg

SEQ ID NO: 10491 - RNA, 2501 nt, Mus musculus
ggauccccugccccagguccuccagggaguggcgacaacuucucuccaaguucgaggggacucuuggggcuaaagcuucgagcacugcccgccuuuucuccugggcugccgugcccauugcucaugcucccuuuccggguaccagcugucucagagaucuugaaaagugggaugcuggagacgggcacagcaggcacugguuggcugaagagcccuggauugguggcccauucucucagagccuucuguagacgucggacauggagugguuugguggccaugcccacgagugccaugauuuccaggaacuccuccucgccagccucacacagcugcuguacaucaucuccucccugcuggaugaaggucucguaguaagagaggagguuggcgcguugcaggacccgauacagcuguagcucacccaguguccgaggcagugccauggcuggggcacuugcccugaggagaaagggcaggagagaggcagugaguaugagugcccugcugggguaccaacccacacuaacaacugcccucuuuccuggacagugcccuccgauccccaggagcacagaaggccgguugcccgaccuaagcuaucaggaaaaacgcuuaccucgucuuuuacuuugaucuuucuggucugggcagcaccaucuugagcccugagacuuuucauaacuucccugaaauggcuggacccacuucccucccaacuaaguccuuaccucuucccccuaaauacucagcagccucaacauuacuuaauguaacaucccauauuaaaguuaacuuagaauacuaagagcuauugcuggcagcuguacuccuuggccagguagcugagagggagggguguggccucuuccuuggcauuuagggaaccugguagacccuugcuccuguucuucgcuuccaaggauuaaagcacccuuccuagacucugucccaacuuuccaaaggcugcccaguucccuucaguuacccccucuccuuugauugauccuuccuacuauucagcaggccccucucuucugggaaagggggagggaagccuugauuguucugcucuggggcccuucuucccacacacucccacaguagcagcgucugugggcgaaaaccgccugggggcucccgccuacucuccucucgcuuguuuuccacccuuaucuucgacaagggagugcgggagagguugaaggucucuugaggaaggggcugcaccccuccucacccugugaauggucauuucacggacaagggaggccugaagcacacccccuucaggcccgcagaugcuuaacucaaaggaaccaccuucucccggaugccugcuaaugacacacugagacagcuaagagccgccaccccucacacuguugacagaucaagcucuggagcuuccccuggcuggggggacauucuuugcagggggcucaugugccagguuaugcccacugaguaaaccuggaguggaaaacgaggcaguacucuaucguauccagguucaucgggucuuuguuugcuuccaggauccccuauuucgaauacucacccccuuuuccaucagucuccaccucccaccuccgucccgcuuccccacguccucuuuucgaccuccacccuuuagaccccauuccggaguccaacuccacccaucuccacucccugccaccuccuuuugcccacuaacuugaaucuggguugcgggguccggcguguguuauccccucugccagguggcuguuccgcugugggagagggagcucugugcauggacggccagagaucaccagugccuccccucucggugcccggcgccugcugcgcgcugcucuuugccuggcgcgcgcggcccggguccaccgcuguccaggcuccgucccucccuccacgucuucucucucggagccuccgcgccucugucugugccucugcccccaccuccccggcugcgcuugccgccucuccgcgccuccucccccgcaggacgcacagggagcgaggcccggcgcugcgcuggcugccgggcuggcgggaggagggcgugggcagaaccgggggcugggaccggaggcggugggugggagcccaggccugagccuuggagaggcugcuguggagacugagaggaggagacuugggggaagggggggggggggagguguggaggcggagcggggacucaggaaucgggcgcugaguuggggaccgaggugaccgaggccgagcuguggaagggggagcuuggggacccaacgggcggggcaggucgcuccuugccgcccacgccggaugcacagccggcccucucugcgcccacguacccacgugagcgccccgccggcuacauuccuacucccugcaccacuccuacuccugugagccgagagcgcaguuucacaaccacgcacaaguauacaaagacacgcgcacguacgugcacacgcguccaaacaacgacgcggacgcccguuggccgcacucuggccgcg

SEQ ID NO: 10492 - RNA, 2501 nt, Mus musculus
cgcggccagagugcggccaacgggcguccgcgucguuguuuggacgcgugugcacguacgugcgcgugucuuuguauacuugugcgugguugugaaacugcgcucucggcucacaggaguaggaguggugcagggaguaggaauguagccggcggggcgcucacguggguacgugggcgcagagagggccggcugugcauccggcgugggcggcaaggagcgaccugccccgcccguuggguccccaagcucccccuuccacagcucggccucggucaccucgguccccaacucagcgcccgauuccugaguccccgcuccgccuccacaccucccccccccccccuucccccaagucuccuccucucagucuccacagcagccucuccaaggcucaggccugggcucccacccaccgccuccggucccagcccccgguucugcccacgcccuccucccgccagcccggcagccagcgcagcgccgggccucgcucccugugcguccugcgggggaggaggcgcggagaggcggcaagcgcagccggggaggugggggcagaggcacagacagaggcgcggaggcuccgagagagaagacguggagggagggacggagccuggacagcgguggacccgggccgcgcgcgccaggcaaagagcagcgcgcagcaggcgccgggcaccgagaggggaggcacuggugaucucuggccguccaugcacagagcucccucucccacagcggaacagccaccuggcagaggggauaacacacgccggaccccgcaacccagauucaaguuagugggcaaaaggagguggcagggaguggagauggguggaguuggacuccggaauggggucuaaaggguggaggucgaaaagaggacguggggaagcgggacggaggugggagguggagacugauggaaaagggggugaguauucgaaauaggggauccuggaagcaaacaaagacccgaugaaccuggauacgauagaguacugccucguuuuccacuccagguuuacucagugggcauaaccuggcacaugagcccccugcaaagaauguccccccagccaggggaagcuccagagcuugaucugucaacagugugagggguggcggcucuuagcugucucagugugucauuagcaggcauccgggagaaggugguuccuuugaguuaagcaucugcgggccugaagggggugugcuucaggccucccuuguccgugaaaugaccauucacagggugaggaggggugcagccccuuccucaagagaccuucaaccucucccgcacucccuugucgaagauaaggguggaaaacaagcgagaggagaguaggcgggagcccccaggcgguuuucgcccacagacgcugcuacugugggagugugugggaagaagggccccagagcagaacaaucaaggcuucccucccccuuucccagaagagaggggccugcugaauaguaggaaggaucaaucaaaggagaggggguaacugaagggaacugggcagccuuuggaaaguugggacagagucuaggaagggugcuuuaauccuuggaagcgaagaacaggagcaagggucuaccagguucccuaaaugccaaggaagaggccacaccccucccucucagcuaccuggccaaggaguacagcugccagcaauagcucuuaguauucuaaguuaacuuuaauaugggauguuacauuaaguaauguugaggcugcugaguauuuagggggaagagguaaggacuuaguugggagggaaguggguccagccauuucagggaaguuaugaaaagucucagggcucaagauggugcugcccagaccagaaagaucaaaguaaaagacgagguaagcguuuuuccugauagcuuaggucgggcaaccggccuucugugcuccuggggaucggagggcacuguccaggaaagagggcaguuguuaguguggguugguaccccagcagggcacucauacucacugccucucuccugcccuuucuccucagggcaagugccccagccauggcacugccucggacacugggugagcuacagcuguaucggguccugcaacgcgccaaccuccucucuuacuacgagaccuucauccagcagggaggagaugauguacagcagcugugugaggcuggcgaggaggaguuccuggaaaucauggcacucgugggcauggccaccaaaccacuccauguccgacgucuacagaaggcucugagagaaugggccaccaauccagggcucuucagccaaccagugccugcugugcccgucuccagcaucccacuuuucaagaucucugagacagcugguacccggaaagggagcaugagcaaugggcacggcagcccaggagaaaaggcgggcagugcucgaagcuuuagccccaagaguccccucgaacuuggagagaaguugucgccacucccuggaggaccuggggcaggggaucc

SEQ ID NO: 10493 - RNA, 2501 nt, Mus musculus
caguuaagaccacugauuguuccuucagagauucugaguucaguucccagcaaccacaugguggcucacaaccaucuauaaugggauucaaugcccucuucuggugugucuggacagcaacagcguacucacauauauaaaauaaaucauuuuaaaaauuuuaagaauuauguauucuguguauguauagaagugcuuugccuacauguguguacgaguaccacaugaguacauaguuuccuuggaggucaaaagaagguaucagauuccauggaauuggugauaugagcuugauuuuuuaauucauuuuggccauauguuuagaagccuuuauacucuugucaaaguuuucaagacucaucccauauggaguccugaccuacaguuugaaaagcugagaucagggcuggagaaauaccccagcaguuaacaacaguacaugauauucuagcagagaaaugaaguuugguuccuaccacccacaaccugugguuuccaaccuccuuuaacuacaguuccaaggaauccauuaagagaucgacccaacacucguggcuccaagagagccuguacaaauacacauguacccccacaaacacauaacuaaaaacaauaaaaguaaaucuguguugggggggagaggggcugaagugauggcucagcuguguugggggggagaggggcugaagugauggcucagcuguugaggacgaaucagauucagcugaccgcuuuuccaaaguacccagauuaaguucccaggacccagggguggcucacaaucaccuggaacuccaguucugggguuccaaugcccucgucugaccucuccauuugggcuucugagggcaacaggcaagcacaagguacccagacacccaugcacgcaaaacagccacacacauaaaucuuuuuuuuuuuaauguuuuuaaauaaucaugaauuggagguuagccuggguucugaggccagugugagcuagcuuguguuauagagacgccagaaauggagcccaaagccuucaggacaccagacaaucagucuaccuaugagcuggcauuucagguguguugugagccaccaguggugaacgcugggauuccaacugguauugucucaaaaaggaguaaggguuucuuaagcgcugagccaucucucuggcuccuuuaauaaaucaucuuucuuuuuaaaaauauuuaauauuaaauuuuaaaccaugauaacuucaaauuacuugauaauuaccaggcaaucuaaagcucagggacuacaauuaagacagcauuuacagcacggguugcacauguuuuuccgaagcacuuuucaugaacgacccacucuaagaacaggcaccucagcuggugcuuauugucauuuuccaggcugaugcucaagaccaucagcuaacagguggcaaaggugccacucucauucaaaccucgauacaccuucaggaacuaaaccagaagagguuccaugguacaaacgcaacgugagcucagcuccuugcuuggucacuugagcucaguguaccaacgagcccuacgccccgccacaccccugaaucgaacguggaucugcgcagacuaguaagcgaagcacgagcuggagaaucacucagcggagcucuccaccagggggagaaggaugcauagacccugcagaaacagcgcgagugcagccgugacugcgagcgaccuuacgcacgcccugcucgcacuuccacgcauggaccagagccuuguggguaggcagcaucuccugcacuucuacagaagaaagcagaagccccgaccaagccguuccaggacaaaguuccuaggaacgcgcgcuccgccaacuucaaaacgcaagggcgagccagucaaaagcuggaggcgcuaggccgggccucguaccugagggaggugacuccucagcagacgcuagacagaggugguagcaaagggccccagcccagaguuuccggcccugcgccgacggcggcuccucccccgucuccacggcaacgcgacccgcgccggaagcugcucuguccagcuuagugcgcucugucuuccaggaaacagagacuucucucuaagcucggcuuccuacgguuuucuugcccugaaguuucugcgcuucugagaagcgggucacuaguuacaacuccugcaugggaccggugugagacggaaaagugucucuuuucauugcgugguggcucacgucgguaaucuccgcaucaaacagccgaaucuuuaaagagaacuuucagaacaaaguaugaaguuucauacuaagaacagugaaaacuagugggugggugucugaagacgaaaaccaaggggcaggagauaugacucaccaguuaaaugcacuuuucauucauccagacucccaauacccacacgguggcucuuaaaacagccgugacucccaagucgcgcucccguuugaccuauaugcaagcaaaacauucauacucaaaauuuuuaaaaagauuaaacccaagaaau

SEQ ID NO: 10494 - RNA, 2501 nt, Mus musculus
auuucuuggguuuaaucuuuuuaaaaauuuugaguaugaauguuuugcuugcauauaggucaaacgggagcgcgacuugggagucacggcuguuuuaagagccaccguguggguauugggagucuggaugaaugaaaagugcauuuaacuggugagucauaucuccugccccuugguuuucgucuucagacacccacccacuaguuuucacuguucuuaguaugaaacuucauacuuuguucugaaaguucucuuuaaagauucggcuguuugaugcggagauuaccgacgugagccaccacgcaaugaaaagagacacuuuuccgucucacaccggucccaugcaggaguuguaacuagugacccgcuucucagaagcgcagaaacuucagggcaagaaaaccguaggaagccgagcuuagagagaagucucuguuuccuggaagacagagcgcacuaagcuggacagagcagcuuccggcgcgggucgcguugccguggagacgggggaggagccgccgucggcgcagggccggaaacucugggcuggggcccuuugcuaccaccucugucuagcgucugcugaggagucaccucccucagguacgaggcccggccuagcgccuccagcuuuugacuggcucgcccuugcguuuugaaguuggcggagcgcgcguuccuaggaacuuuguccuggaacggcuuggucggggcuucugcuuucuucuguagaagugcaggagaugcugccuacccacaaggcucugguccaugcguggaagugcgagcagggcgugcguaaggucgcucgcagucacggcugcacucgcgcuguuucugcagggucuaugcauccuucucccccugguggagagcuccgcugagugauucuccagcucgugcuucgcuuacuagucugcgcagauccacguucgauucagggguguggcggggcguagggcucguugguacacugagcucaagugaccaagcaaggagcugagcucacguugcguuuguaccauggaaccucuucugguuuaguuccugaagguguaucgagguuugaaugagaguggcaccuuugccaccuguuagcugauggucuugagcaucagccuggaaaaugacaauaagcaccagcugaggugccuguucuuagagugggucguucaugaaaagugcuucggaaaaacaugugcaacccgugcuguaaaugcugucuuaauuguagucccugagcuuuagauugccugguaauuaucaaguaauuugaaguuaucaugguuuaaaauuuaauauuaaauauuuuuaaaaagaaagaugauuuauuaaaggagccagagagauggcucagcgcuuaagaaacccuuacuccuuuuugagacaauaccaguuggaaucccagcguucaccacugguggcucacaacacaccugaaaugccagcucauagguagacugauugucugguguccugaaggcuuugggcuccauuucuggcgucucuauaacacaagcuagcucacacuggccucagaacccaggcuaaccuccaauucaugauuauuuaaaaacauuaaaaaaaaaaagauuuauguguguggcuguuuugcgugcaugggugucuggguaccuugugcuugccuguugcccucagaagcccaaauggagaggucagacgagggcauuggaaccccagaacuggaguuccaggugauugugagccaccccuggguccugggaacuuaaucuggguacuuuggaaaagcggucagcugaaucugauucguccucaacagcugagccaucacuucagccccucucccccccaacacagcugagccaucacuucagccccucucccccccaacacagauuuacuuuuauuguuuuuaguuauguguuuguggggguacauguguauuuguacaggcucucuuggagccacgaguguugggucgaucucuuaauggauuccuuggaacuguaguuaaaggagguuggaaaccacagguugugggugguaggaaccaaacuucauuucucugcuagaauaucauguacuguuguuaacugcugggguauuucuccagcccugaucucagcuuuucaaacuguaggucaggacuccauaugggaugagucuugaaaacuuugacaagaguauaaaggcuucuaaacauauggccaaaaugaauuaaaaaaucaagcucauaucaccaauuccauggaaucugauaccuucuuuugaccuccaaggaaacuauguacucaugugguacucguacacacauguaggcaaagcacuucuauacauacacagaauacauaauucuuaaaauuuuuaaaaugauuuauuuuauauaugugaguacgcuguugcuguccagacacaccagaagagggcauugaaucccauuauagaugguugugagccaccaugugguugcugggaacugaacucagaaucucugaaggaacaaucaguggucuuaacug

SEQ ID NO: 10495 - RNA, 2501 nt, Mus musculus
gcaucugcuggcucugugcccuccaccugccagucacagggauggcccuguccuucaggugcccccugcaccagggccccuccucuaguccaaaggggaccagagagaagcagggaguguauuugaugugauggugacuaacagcacugggcuucugccagcaugaccacgggauggcucggagggagcgugggccuccuugcccuugcauugcccacccuggcgcuucucaccccugcacgacugucucucucagcuucucgauagccugacuggggauccagugagaccuggagucauggggccagguuauguggggggugcugggagcaggggaaaggaggcuggaucucucuggggagacaugccgccucugucccaagaguggagagaaagggguggauggacgcuucugcguggcucagaauuaaaggcaguaaaggaaagggaaacuggccugcgcccugcaccccucccgggccccaucucuuccccucaaccuggaggaggcucugcuuugguccagacaggacaggaccugggguuuccgggguauagacuaagcacacauccuuccaucugugccuccacuguuggggcugagagccccucugcgacuuuuccugcuucugaguucauggggggugugggaagugggugucugguggacuguggugcagugagcauggcaguugcacccuuucucucucucuccacugucuacucgcccaaaauuugccccagaccaggccugggcugaggacagacuucccgaauggcuuccccugggcucccacuaguauccuuuccuauguuggucacuccaacucacuccuaugagcccaagugggaccccaaagcugagaccccuugacuacagagaccggagacaggcccaucaucuggguaaucucaaccccucccccagcagccgacaaacacccuaagggaccaagacucccaucagcucagagucuccgacuccacuccauauggggccucaagaggccuggggggaggggaaucuugagcacacccccgcccccaaucucagcagagaaaaagcuaggaaggccccaggggucucacugcgccccaggacacucaauccaggaaccccagccucggccugcugcucugaucuucaauagccaacugccugcgugcggucccuauucccgaaaggcacggggacuagggucggggggagguuuagguuccggccucugccuuuccuuccaggcuuuugcuaucgcgaccgagccucccaauccggccacuuguugucgccaacgccucccagcugccucggcagcgcacggguggggggucccucgcagggccgcagaaggggauggggguagcccugcacccagcaagagcggggcagucgcccucucuccccuucucccacugccggagcagauuggauucucaacgcgacacgagcggaaugucaauaggagcgcagagccacgggcgggcgccgcggaagggaucaggaugcggacgcuccgguggcgggcgcggggggcaacagcucggacucuccacuucagcccccgccgccuugccgcaccgucaccgccggccacgcggcccagugaccccgcugcggggccccgcaaguuuccgcagcgcugggggccacgcgggcaggggccgggcugcuccugcgccgcggcgacccccaccgcggcgcccggggccacccggccgucccgccucccgcguagccgcucauccgagucgcgcagcagggucccgggcuccccgggccagcgcggcaccagggcgcacagguaggagggcucguggcaggggucccggcagggcacucacccucuagcucguccucagggauauccaccgggcgcugcuccgacagcagguugggcacgguguagaugccccgguacaucaacgccgccgucaccggguggaacggcaucuuggaggcuccgcgcccgcccgcccgccgcaaacuuugaggccggggcucaugggccgccggcggccccgggggcggcuggagcgggcggugcgcgcggugcggcgcgcaguggcggcggcgaggcaaugggcacccguccgggaccuagcgccccugcgccccgggcugucgggccaugccgccggcuccuucguugggaucccggccgggggcucgcagggauggcgggggcggcgccgcuccggccucuuggcucggaccgcugcgcgcugcgcucccuccgcgcgcuccgcguugcucgccgcccgcucguccgcucgcuggugcggcugcccgacccgccgcuccggcucccgccgcugccgccaccgccgccgccgccaccgccgccgccgccaccgccgccgccgccgccgccugcacuccucacucgcucgcucgcuugcucugugcggcgcucgccgcgcucccgccucccccgcccgccccucccgcccccgccccuucccgcugccggccccugagcggccaccccaagcccucccgg

SEQ ID NO: 10496 - RNA, 2501 nt, Mus musculus
ccgggagggcuugggguggccgcucaggggccggcagcgggaaggggcgggggcgggaggggcgggcgggggaggcgggagcgcggcgagcgccgcacagagcaagcgagcgagcgagugaggagugcaggcggcggcggcggcggcgguggcggcggcggcgguggcggcggcggcgguggcggcagcggcgggagccggagcggcgggucgggcagccgcaccagcgagcggacgagcgggcggcgagcaacgcggagcgcgcggagggagcgcagcgcgcagcgguccgagccaagaggccggagcggcgccgcccccgccaucccugcgagcccccggccgggaucccaacgaaggagccggcggcauggcccgacagcccggggcgcaggggcgcuaggucccggacgggugcccauugccucgccgccgccacugcgcgccgcaccgcgcgcaccgcccgcuccagccgcccccggggccgccggcggcccaugagccccggccucaaaguuugcggcgggcgggcgggcgcggagccuccaagaugccguuccacccggugacggcggcguugauguaccggggcaucuacaccgugcccaaccugcugucggagcagcgcccgguggauaucccugaggacgagcuagagggugagugcccugccgggaccccugccacgagcccuccuaccugugcgcccuggugccgcgcuggcccggggagcccgggacccugcugcgcgacucggaugagcggcuacgcgggaggcgggacggccggguggccccgggcgccgcggugggggucgccgcggcgcaggagcagcccggccccugcccgcguggcccccagcgcugcggaaacuugcggggccccgcagcggggucacugggccgcguggccggcggugacggugcggcaaggcggcgggggcugaaguggagaguccgagcuguugccccccgcgcccgccaccggagcguccgcauccugaucccuuccgcggcgcccgcccguggcucugcgcuccuauugacauuccgcucgugucgcguugagaauccaaucugcuccggcagugggagaaggggagagagggcgacugccccgcucuugcugggugcagggcuacccccauccccuucugcggcccugcgagggaccccccacccgugcgcugccgaggcagcugggaggcguuggcgacaacaaguggccggauugggaggcucggucgcgauagcaaaagccuggaaggaaaggcagaggccggaaccuaaaccuccccccgacccuaguccccgugccuuucgggaauagggaccgcacgcaggcaguuggcuauugaagaucagagcagcaggccgaggcugggguuccuggauugaguguccuggggcgcagugagaccccuggggccuuccuagcuuuuucucugcugagauugggggcgggggugugcucaagauuccccuccccccaggccucuugaggccccauauggaguggagucggagacucugagcugaugggagucuuggucccuuaggguguuugucggcugcugggggagggguugagauuacccagaugaugggccugucuccggucucuguagucaaggggucucagcuuuggggucccacuugggcucauaggagugaguuggagugaccaacauaggaaaggauacuagugggagcccaggggaagccauucgggaagucuguccucagcccaggccuggucuggggcaaauuuugggcgaguagacaguggagagagagagaaagggugcaacugccaugcucacugcaccacaguccaccagacacccacuucccacaccccccaugaacucagaagcaggaaaagucgcagaggggcucucagccccaacaguggaggcacagauggaaggaugugugcuuagucuauaccccggaaaccccagguccuguccugucuggaccaaagcagagccuccuccagguugaggggaagagauggggcccgggaggggugcagggcgcaggccaguuucccuuuccuuuacugccuuuaauucugagccacgcagaagcguccauccaccccuuucucuccacucuugggacagaggcggcaugucuccccagagagauccagccuccuuuccccugcucccagcaccccccacauaaccuggccccaugacuccaggucucacuggauccccagucaggcuaucgagaagcugagagagacagucgugcaggggugagaagcgccagggugggcaaugcaagggcaaggaggcccacgcucccuccgagccaucccguggucaugcuggcagaagcccagugcuguuagucaccaucacaucaaauacacucccugcuucucucugguccccuuuggacuagaggaggggcccuggugcagggggcaccugaaggacagggccaucccugugacuggcagguggagggcacagagccagcagaugc

SEQ ID NO: 10497 - RNA, 2501 nt, Mus musculus
gaagagaagagguccccucugggaggagccuugcugcagagaugggggaagggcacugccaccgcaaaggcguagaacaugaaaagggaaauuccaaccauccaaaucccagcauuccuggcuuuccaugcuguuagcaaaggcuuaaaagccacucaaguuaggauucuuggcuauuauggaucacagacacuuuugaaaagcgcagaugcucuguacuugccuccagauuuauagaugacuacaggaacgacuacagcagaugacugcagcugacacaaagaagcccaguuacucuuugccccaaucccaaaagaaaugagaaugagagaaagccaauguuggucaaggucacccugcagcuaaaggguaagguuucagggcaacugcagucuagcugacucagaaccccuguaaauuuugggaaagaggaaggggauauuaaauaacagccauuuacagcaaugagguccacaugaugguuccguacuggcuagaaacggcaugaaaaugaauggcuuucauuuuuacacagcaauuacuaaaauucgcgauguuauguacugagcaaguagugggacgaagccugguagaacgaauacuccuguuccacccacugcgcagggugcgcaagaaagggugggcagaguuggcauggcaagcggcugcuggauaccugauacgcuggguccagacggggcuugcuccauuucagaugggagaucagucugaaucuggggucuaacaguguguggggcacagggguuggccccgguguuuaauuacagacauaaaaaauguggagggugguuuccuuuuucuaaaggaaaauccagaguuggggcgccccaagggagggucuggguaaaaccgcuacuuugucagguggcaugcaccucgcagcgggucuagcuacuucugagaggaguccucucgggcugcucacugcuccgccaggagggggcgaccccuucccaccccgcgcucccgcgcaccucggaaccacuccucggacugcagcgugcucugcaccgcguggccuucgagcugcgcgcggaucucccgcagcgccgacgucacgucgcacuugagggcgucgcgagccucggccugagccugcgccugcgcggccccgcagcccuggaucugaccgagcagcucgcccaccuccuccuggugguggcgccgcagguagccgcacuccuccugcagcgccugcgccuucuucugcagcuccacgcgcgccgcuuccgccuccugcgcgaagcgcgccagggcgcgcgccgccgccuccgccuccucacgcugccgggccuccucguccagccgcuggcggacgugagcgauguccuccagcaggugcuccugcuccaggcgcagcugcccgcgcgccgccccgaggcgcagcacggcgccgcgcaucucgcgcaccucgcgcucguacagcucgcccauggcggcgcggccggcuugcugcugccgcagcgccgccgccucgcccuccaggcugcgguugugcgccucgagcugccucaccuugucgauguagcccgcgaagcggucguucagagccugcagcugcuccuucucgcugcgcgccgccaccgccgccaccacgcagcccucugggccguugcuuagggugucuagcgagucggugcucgaggcggcgccgcggaagcggcugggugaggcggacacggagcucacggacguccgcgcccacgaguggaagccgcuggaggagccggccgcggagcgcgugccgcccgggccugccuugcggcucagcgaguagugcaggcugccgccuccgugcagcggcgcgaacggggcgcccagcagcgcaucggcgcugccgaagcucaucauggccggagcaggugcggccgccagcggagcgggagugcggggcugggacggggcaggcagcacugcggcagcucugggacuccggcucuuuuauauccgcgguggcccgguccggccccucggcaguggggggcuggggaggagggccccacccucuccaccuccucccccgcggccccgggccgaccggcuucuccgcagugagaggggcggggcugggggggacgacccaggagugaaggggaaucgacgcaucgucaguagagccucccgaggucagaccaaggaguaaaggacuuccggagcggacaagugcagaccuccaggugcaugucggaagacccuauuagucagaauaagacccucagaauaagagagggcacuggaaauagggagaggauugcagaacugaugggucagggcgccuucggguugaagcagugggagacugcagugauuacuaugagaggacacccccacuugagaagcagcacaggguugguucccugauaguuagagaggaccuugagaugaggagugcagacugcagucacccacgaagggauucuguaugggguugcaugauggaugcuacugaugauaaauggggaccuucuagcuggcggugc

SEQ ID NO: 10498 - RNA, 2501 nt, Mus musculus
gcaccgccagcuagaagguccccauuuaucaucaguagcauccaucaugcaaccccauacagaaucccuucgugggugacugcagucugcacuccucaucucaagguccucucuaacuaucagggaaccaacccugugcugcuucucaaguggggguguccucucauaguaaucacugcagucucccacugcuucaacccgaaggcgcccugacccaucaguucugcaauccucucccuauuuccagugcccucucuuauucugagggucuuauucugacuaauagggucuuccgacaugcaccuggaggucugcacuuguccgcuccggaaguccuuuacuccuuggucugaccucgggaggcucuacugacgaugcgucgauuccccuucacuccugggucgucccccccagccccgccccucucacugcggagaagccggucggcccggggccgcgggggaggagguggagaggguggggcccuccuccccagccccccacugccgaggggccggaccgggccaccgcggauauaaaagagccggagucccagagcugccgcagugcugccugccccgucccagccccgcacucccgcuccgcuggcggccgcaccugcuccggccaugaugagcuucggcagcgccgaugcgcugcugggcgccccguucgcgccgcugcacggaggcggcagccugcacuacucgcugagccgcaaggcaggcccgggcggcacgcgcuccgcggccggcuccuccagcggcuuccacucgugggcgcggacguccgugagcuccguguccgccucacccagccgcuuccgcggcgccgccucgagcaccgacucgcuagacacccuaagcaacggcccagagggcugcgugguggcggcgguggcggcgcgcagcgagaaggagcagcugcaggcucugaacgaccgcuucgcgggcuacaucgacaaggugaggcagcucgaggcgcacaaccgcagccuggagggcgaggcggcggcgcugcggcagcagcaagccggccgcgccgccaugggcgagcuguacgagcgcgaggugcgcgagaugcgcggcgccgugcugcgccucggggcggcgcgcgggcagcugcgccuggagcaggagcaccugcuggaggacaucgcucacguccgccagcggcuggacgaggaggcccggcagcgugaggaggcggaggcggcggcgcgcgcccuggcgcgcuucgcgcaggaggcggaagcggcgcgcguggagcugcagaagaaggcgcaggcgcugcaggaggagugcggcuaccugcggcgccaccaccaggaggaggugggcgagcugcucggucagauccagggcugcggggccgcgcaggcgcaggcucaggccgaggcucgcgacgcccucaagugcgacgugacgucggcgcugcgggagauccgcgcgcagcucgaaggccacgcggugcagagcacgcugcaguccgaggagugguuccgaggugcgcgggagcgcggggugggaaggggucgcccccuccuggcggagcagugagcagcccgagaggacuccucucagaaguagcuagacccgcugcgaggugcaugccaccugacaaaguagcgguuuuacccagacccucccuuggggcgccccaacucuggauuuuccuuuagaaaaaggaaaccacccuccacauuuuuuaugucuguaauuaaacaccggggccaaccccugugccccacacacuguuagaccccagauucagacugaucucccaucugaaauggagcaagccccgucuggacccagcguaucagguauccagcagccgcuugccaugccaacucugcccacccuuucuugcgcacccugcgcaguggguggaacaggaguauucguucuaccaggcuucgucccacuacuugcucaguacauaacaucgcgaauuuuaguaauugcuguguaaaaaugaaagccauucauuuucaugccguuucuagccaguacggaaccaucauguggaccucauugcuguaaauggcuguuauuuaauauccccuuccucuuucccaaaauuuacagggguucugagucagcuagacugcaguugcccugaaaccuuacccuuuagcugcagggugaccuugaccaacauuggcuuucucucauucucauuucuuuugggauuggggcaaagaguaacugggcuucuuugugucagcugcagucaucugcuguagucguuccuguagucaucuauaaaucuggaggcaaguacagagcaucugcgcuuuucaaaagugucugugauccauaauagccaagaauccuaacuugaguggcuuuuaagccuuugcuaacagcauggaaagccaggaaugcugggauuuggaugguuggaauuucccuuuucauguucuacgccuuugcgguggcagugcccuucccccaucucugcagcaaggcuccucccagaggggaccucuucucuuc

SEQ ID NO: 10499 - RNA, 2501 nt, Mus musculus
uuuucacagccuuccucgcaaaaauuggcuccaaagaccugggauguuggugauaacuggacaaaggugacaccugugcaagcacacagcaggugacacuuugaagagcuaaccuccagaaaguggaaaggaggugaucgccaguacccucgagggcccuacucccucccuccccuagcaaucucccugggcucagagcaaagggcacagcggguuagagcacaggucuccuuagacuccgcacacucccuuccccauaacuguugcauucuuuucucccaggccuuccuccccgcuaggcgcccugcacccagacccucuaaacugggcgcugacgcugcuauuagucugggcuccgugcugcuccgccucccucccccgcagcccccgguccaaggccggcuccuccuccucccccuccggaaacccgaagcccccgccccggccaggccgucgcaagcgcucuggagggcgguccgcgugagagccagccacgcggggcaggagcgcccaguugcugccggagcugggcccgccagaaccucuccuggagccccuugcucuccuugaaucucccuuucccaccgcuuucuggauacccuugacgcccacguuccucgcgcccuuucccgccccuacgcggggcgcugccccugccacccaagucccugcucaagcccgcccggcucccgcgcgugcccagagccauggcuccagugcgcaccgcaucccugcucugcggccuccuggcacugcugacgcugugcccugaggggaacccacagacggugcugacggacgacgagaucgaggaguuccucgaaggcuuccuuucggaguuggagacccaguccccgccccgggaagacgacguggaaguccagccgcuucccgaacccacccagcguccccgcaaauccaaggcagggggcaagcagcgggcagauguagaaggugagaaccuggugacauggguggccauggcaucaagugagcauacaggggcucuggagggucuagccacuucccaugcugccccgugaggaaugucucuccaaggcaacgcaaggcaacacacugccaggcagcaguucuguccuggaguuuggaaaccuggagguguguguucagcauaggguggcgcugggcuuuugaggucgcccaaguuguucaucccaggucucaagagaguguagguuuggacgagugggaaauugugauucgccucuccgaacuggcccuagucucuuaguggcaagcuucaagccuaggcaucugcuugccuccucuucucccacaggaacacagacaggggagcggggugaggaagacuuccaggugaaagugggcagucugagauggucagaacuaagcgaggugauagcaucccggaggcaugcaaccccgagccucuuaugcaaucguugucaguaaaucuuagcuguuuuucauggcccucuggagaguggcaacggaucuugugaucucucucccaggagacuguaaggcaccauucaucauuccugaggucagccacucccccuccggcccccacugcuguagaucuguccugcucucccuacccucaccucccugcacacuuugccuccagcaaccaagacguucuggacauugccaagugacccugcuccugcugcauguuuugcuguauucccuguguuucagccagcugccuguguguuucccauucgccauuaaauucuccgcacccagcaauugcagcuccuagggugcuagaaggguggccccugcuacuugacuucucugagaugagccagcacggagagaacuaccuaccugccucucucucccucuguccuugauaagggccuccuguugguuuugaguuucaacgggaaccuuuugggacuucaagaccuacggagugacugccggccugccugccugccuuccucccugggaaggaaccaaauccagggccuuacauaccaggggacugacugcucuagggcagaucuacauccccagccugacugucucuuugaagcuuuucuucucccuugaaaggaggcucuuggaaggccaagccacagucuuuaauuugccuggcuguuugcuuggguagcccugcucuuucagguucuucccuguaccuuccaugccuggcacugagcugugaggcauguggguuaggcagacaugugaauuagggacuaugaggaccccauggagguuuggacagacagagaugucucucuauauaucaugcccugaacucacuacuucagagcagccaagaguugcugcuguucacucuggauguacagauaggaugccuggacaagguuucucauucuaucacuugggcaaauggcuaaccucaguuuccugaucuguaccagaccagggacugacaggugcccucacacccaggcucugggcauccagggggaccaugugggcacacagauuaggcucugauugucugcuccugcaucuucauccuugacagucccucc

SEQ ID NO: 10500 - RNA, 2501 nt, Mus musculus
ggagggacugucaaggaugaagaugcaggagcagacaaucagagccuaaucugugugcccacauggucccccuggaugcccagagccugggugugagggcaccugucagucccuggucugguacagaucaggaaacugagguuagccauuugcccaagugauagaaugagaaaccuuguccaggcauccuaucuguacauccagagugaacagcagcaacucuuggcugcucugaaguagugaguucagggcaugauauauagagagacaucucugucuguccaaaccuccaugggguccucauagucccuaauucacaugucugccuaacccacaugccucacagcucagugccaggcauggaagguacagggaagaaccugaaagagcagggcuacccaagcaaacagccaggcaaauuaaagacuguggcuuggccuuccaagagccuccuuucaagggagaagaaaagcuucaaagagacagucaggcuggggauguagaucugcccuagagcagucaguccccugguauguaaggcccuggauuugguuccuucccagggaggaaggcaggcaggcaggccggcagucacuccguaggucuugaagucccaaaagguucccguugaaacucaaaaccaacaggaggcccuuaucaaggacagagggagagagaggcagguagguaguucucuccgugcuggcucaucucagagaagucaaguagcaggggccacccuucuagcacccuaggagcugcaauugcugggugcggagaauuuaauggcgaaugggaaacacacaggcagcuggcugaaacacagggaauacagcaaaacaugcagcaggagcagggucacuuggcaauguccagaacgucuugguugcuggaggcaaagugugcagggaggugaggguagggagagcaggacagaucuacagcagugggggccggagggggaguggcugaccucaggaaugaugaauggugccuuacagucuccugggagagagaucacaagauccguugccacucuccagagggccaugaaaaacagcuaagauuuacugacaacgauugcauaagaggcucgggguugcaugccuccgggaugcuaucaccucgcuuaguucugaccaucucagacugcccacuuucaccuggaagucuuccucaccccgcuccccugucuguguuccugugggagaagaggaggcaagcagaugccuaggcuugaagcuugccacuaagagacuagggccaguucggagaggcgaaucacaauuucccacucguccaaaccuacacucucuugagaccugggaugaacaacuugggcgaccucaaaagcccagcgccacccuaugcugaacacacaccuccagguuuccaaacuccaggacagaacugcugccuggcaguguguugccuugcguugccuuggagagacauuccucacggggcagcaugggaaguggcuagacccuccagagccccuguaugcucacuugaugccauggccacccaugucaccagguucucaccuucuacaucugcccgcugcuugcccccugccuuggauuugcggggacgcuggguggguucgggaagcggcuggacuuccacgucgucuucccggggcggggacugggucuccaacuccgaaaggaagccuucgaggaacuccucgaucucgucguccgucagcaccgucuguggguuccccucagggcacagcgucagcagugccaggaggccgcagagcagggaugcggugcgcacuggagccauggcucugggcacgcgcgggagccgggcgggcuugagcagggacuuggguggcaggggcagcgccccgcguaggggcgggaaagggcgcgaggaacgugggcgucaaggguauccagaaagcggugggaaagggagauucaaggagagcaaggggcuccaggagagguucuggcgggcccagcuccggcagcaacugggcgcuccugccccgcguggcuggcucucacgcggaccgcccuccagagcgcuugcgacggccuggccggggcgggggcuucggguuuccggagggggaggaggaggagccggccuuggaccgggggcugcgggggagggaggcggagcagcacggagcccagacuaauagcagcgucagcgcccaguuuagagggucugggugcagggcgccuagcggggaggaaggccugggagaaaagaaugcaacaguuauggggaagggagugugcggagucuaaggagaccugugcucuaacccgcugugcccuuugcucugagcccagggagauugcuaggggagggagggaguagggcccucgaggguacuggcgaucaccuccuuuccacuuucuggagguuagcucuucaaagugucaccugcugugugcuugcacaggugucaccuuuguccaguuaucaccaacaucccaggucuuuggagccaauuuuugcgaggaaggcugugaaaa

SEQ ID NO: 10501 - RNA, 2501 nt, Mus musculus
gccuuccuagugucuguccccagagcucaguucacguccugcguaagagggggaggagcagugccuaggggccugcggcuccagcaggcacacagccaacacugccggcuuuaccaugcucacuggugacagggcaacaucgccuguaccguggcggcuuugucuuucucagcuacugagcaauucucagcugggaugagagggaagcuggaggggagacagccaccuccuugauaucugaucucaggaaugucugagcgcuggguucuuugacaucagcuggacucacugaccagaagcugggcuauuagagcaaucagguccugacagaaagggagagggguucuuucagguucuuugagggagaugguaccgacguggguguggcuaguagccaucacugggcguucccaaguuaggcucuugccuucuccacuuccuaguguggccccagggcaguagggcagaauugggccaagguuaaaauggaagggaaauaaaaagccaagguguguguauguuuguguguguguguguaugugucauucaaggucaccaagcaaacuagcuuaugacugggccuggggagucccagccuggauugccugucccccagcaagaguaagaugggaacuguuagcucccacccaggacccuggcacagcacuggcaccauccccauucuugcccauccugucccuagauaacuucuugcacccagcaaggugcccuuggcuuugcccaaguuacacacagcccaucuccagcaggaaccauuuaaacuuaagaguauccuccagccugcaaguggacugaccucuaccaacauuuaaugcccccucuuauccaaggucugcauaggaagaccacugcuggccaggagagcugcuguucagagccccaccucucagacgugguucugccgguguccucuggcuagccucccagguuccaucggcccuacaacucccuuauaagucuagccgcuugcugcccuaggcacccaacguaccucuaagaacccucugguggucacaggaugagccugcaaggacccuuugggccucccugcuuccaaaccugccaccccaccgucgguccuggggcccagcucucuguggacaauggaaugcaauguggcacagagacacaacuaaaugggacuugguccaaagacuacgguccccacagcccagagugaaaggccaagacgcugcccuucauagcuacaaggcuaggaggaugcugucugcggcgcccaggccuucacgaaauccuggggcuugggggugggggaaagaugcagguggagggaauaaccggucuggaaagacaggggaggggacugugaggaggcagagggauggaggagagagaaagccagaaaagguauugagccagaaaggggagccggcgcggucucaccugugcgggauccaggcccuccugccucaggcagcggcagcucagcgcccgcagccuccccuggcauggccuggacgugugccugccgauaccccugucucucugucccucuguccgucaaugcgcucggaguagccagcacggccaccgccccucugcuggggggggggggggcguaaaugacgucagcgcugccccgcccgccuaucaagccgagugagcgugcgccagcgcgccgagcacugcggagcgccagagggagggcgcucauucccuucguucaccccaucgccucucucccacugcugagucuaaggccagaaggcugcgcccugccccgccuuucccgcagcauccaaggggggccgcuuggaggccagacuccucccaaggugacaucgccucuuaacuggaaagagacaaaaggugucuccagaaccaggggugcggguuaauauggggagauagcuauauauucugcagagggggcagggccacuuuaauaagugauggcccaaccuaucgcucaaugacuggacagaggacacagggagcccagugaaggagccuaagcuccuaagccccaagaugagcgaaaacagcagcucaggauuggcugguccuggcagacagucuccauagcaacuaccuccugucucuguggcaacgggagauggaacugagugcgccagagagugguuccagacaaucucuugggcugagcuggaucuuugacuucuagcuuggcggucugcuuuguuuccuucaccguucagcucuuuaggacagggaagaaauguaccucacucacuauucccgccagcccugggccacacccccagagaugaugcuuacuauuucccuuccugaaaugcacuauguuuccauccuggcguuugcagugcccagcccguccccccuucccagugccaggcaccagaugaaugaaugacacauugucaucugugagcugaagucggggaaauuaguggcuauugaggcaaacaaggagggaguguccaauguauaggaucuucugagucuacaggaagucaggugcuguucccuacuucccu

SEQ ID NO: 10502 - RNA, 2501 nt, Mus musculus
agggaaguagggaacagcaccugacuuccuguagacucagaagauccuauacauuggacacucccuccuuguuugccucaauagccacuaauuuccccgacuucagcucacagaugacaaugugucauucauucaucuggugccuggcacugggaaggggggacgggcugggcacugcaaacgccaggauggaaacauagugcauuucaggaagggaaauaguaagcaucaucucuggggguguggcccagggcuggcgggaauagugagugagguacauuucuucccuguccuaaagagcugaacggugaaggaaacaaagcagaccgccaagcuagaagucaaagauccagcucagcccaagagauugucuggaaccacucucuggcgcacucaguuccaucucccguugccacagagacaggagguaguugcuauggagacugucugccaggaccagccaauccugagcugcuguuuucgcucaucuuggggcuuaggagcuuaggcuccuucacugggcucccuguguccucuguccagucauugagcgauagguugggccaucacuuauuaaaguggcccugcccccucugcagaauauauagcuaucuccccauauuaacccgcaccccugguucuggagacaccuuuugucucuuuccaguuaagaggcgaugucaccuugggaggagucuggccuccaagcggccccccuuggaugcugcgggaaaggcggggcagggcgcagccuucuggccuuagacucagcagugggagagaggcgauggggugaacgaagggaaugagcgcccucccucuggcgcuccgcagugcucggcgcgcuggcgcacgcucacucggcuugauaggcgggcggggcagcgcugacgucauuuacgccccccccccccccagcagaggggcgguggccgugcuggcuacuccgagcgcauugacggacagagggacagagagacagggguaucggcaggcacacguccaggccaugccaggggaggcugcgggcgcugagcugccgcugccugaggcaggagggccuggaucccgcacaggugagaccgcgccggcuccccuuucuggcucaauaccuuuucuggcuuucucucuccuccaucccucugccuccucacaguccccuccccugucuuuccagaccgguuauucccuccaccugcaucuuucccccacccccaagccccaggauuucgugaaggccugggcgccgcagacagcauccuccuagccuuguagcuaugaagggcagcgucuuggccuuucacucugggcuguggggaccguagucuuuggaccaagucccauuuaguugugucucugugccacauugcauuccauuguccacagagagcugggccccaggaccgacggugggguggcagguuuggaagcagggaggcccaaaggguccuugcaggcucauccugugaccaccagaggguucuuagagguacguugggugccuagggcagcaagcggcuagacuuauaagggaguuguagggccgauggaaccugggaggcuagccagaggacaccggcagaaccacgucugagagguggggcucugaacagcagcucuccuggccagcaguggucuuccuaugcagaccuuggauaagagggggcauuaaauguugguagaggucaguccacuugcaggcuggaggauacucuuaaguuuaaaugguuccugcuggagaugggcuguguguaacuugggcaaagccaagggcaccuugcugggugcaagaaguuaucuagggacaggaugggcaagaauggggauggugccagugcugugccaggguccugggugggagcuaacaguucccaucuuacucuugcugggggacaggcaauccaggcugggacuccccaggcccagucauaagcuaguuugcuuggugaccuugaaugacacauacacacacacacacaaacauacacacaccuuggcuuuuuauuucccuuccauuuuaaccuuggcccaauucugcccuacugcccuggggccacacuaggaaguggagaaggcaagagccuaacuugggaacgcccagugauggcuacuagccacacccacgucgguaccaucucccucaaagaaccugaaagaaccccucucccuuucugucaggaccugauugcucuaauagcccagcuucuggucagugaguccagcugaugucaaagaacccagcgcucagacauuccugagaucagauaucaaggagguggcugucuccccuccagcuucccucucaucccagcugagaauugcucaguagcugagaaagacaaagccgccacgguacaggcgauguugcccugucaccagugagcaugguaaagccggcaguguuggcugugugccugcuggagccgcaggccccuaggcacugcuccucccccucuuacgcaggacgugaacugagcucuggggacagacacuaggaaggc

SEQ ID NO: 10503 - RNA, 2501 nt, Mus musculus
auuaaagcucacaucaauuuuuacuacaguguucaauggugauuauuaauagaggucauuaaggcuuaacucaaaauagcaaugcuaguauuucuuaagauugcuuuugguauaccacagaacgcacuagaaguuaaagacacacaggcaaauggcaugauuuugccuuugucugagucagcgaaacaacuggaaucuugcuuugccaggaauccaaugcuucucggggaugaacauaccaggacuugccuguacccgggaguguaggucagcagccacagaaaucauaaagagacucucuacccagcuagcccugguccugggggcucgaucugcaccaucugccagccuggugugggaaaccggagaauucuagccuucagauguucagggcaagaacuugacucacauaacuaagcgagacuggcuaggaaugcuggccauuuagagcaacagcuaagaaugcuggccauuuagagcaacagcugccaaauccauuuaaauguuucuguuuuguuuuguuuuuuccuuaaaggaacgaaggaugcccuuagagugacugccugcuugguagggcuugcagcaggagagguaacuguuaaacguuugcauuuuucucauuggcgcugucgcuguccccacugcugcugcugcugcaccuaggucgaauuagaaagaguaacauuccugggucguacuucgcauuucuagucucugcuuuggcagggaaccggccugagucugcauccucugcaccaaaugcagucucugaaucuggaaggcgcugcugcagagcauaggauggcgccuauggggcccgaaccgggcucaaaccuuuuugcagcuccuggugacacugagcaguuuugaacuuuagguuucacaguuucaaagacaccagugcucuuaauuucaucucguuaguuuuuggauaaauugggacacaauccugcguugccaauuagcccgugcaaaugauaggauguuucaagacagguacuguuuccaacagcguggcugccugcaaauaccuucaugguccggauccaacccgggauuccuacacucaagcuucccugggauagacgcgcuccuucccaauuuaugaggaaugaaaacccaggucaacagcuggguuacacagaccuaaaccuggguauccccgcucagcgaggagacucuccagugacugggaucuguccacuggcagucucccuugcuacccgcucguccuggcacugaauucuaccuauuuucacagagcgcauuuugcaacuuauaagaaaagcuguacuuugagaaccaagcaagaggaaaaauggguucagugccucacuccgccucccaggguccauuuuccaaccuucaauaugagccaagacaaacaucugaagauacacucccugccacccucgucgggucccagggaguugcgcguggcgcacguggcagggacagcuuaccuggagcagguugggaggggagguaggugcuuaggcugccugcagcgcuggcguuggcgcagaacccgcggccauucagcagcgcccucagcggguacugcuccgcgggccgcggcuggcagcggaggccggugccacagcgcuccguguagacgccgcacgcgucgccuucgcgcagcgcgcaagucaggcagcagccgcagccgggcucucgcaccagcuccgugcacgcgggcgcggugggcggaggcgcgcacugggacagcgcacgcgcgucgcacgguucgcagcgcaccacggggcccgcgcccaccgcgcccgcgccagcucgcgccaccggcgguccgcggagcagagugagggcagugagcgcagccgcccagagcgcggggcgcgcgggaugcauggcgccggguggacggcucgguggaggggagcggaguggagcacgcgggaugaggcggcgggaugaggcggcgggaugggagcagcgagcaagcagguccucagcgcccagucgccgcucuaagcucgcaucugggcagcccgggcgcgcaggccgauauauagaagccgggguggcggaggacacgccccggaacggcgaggguggggggugggccggcgcaggcuccgcuccggggcccgcgccucccgacgaagcgggaacgaggacgggggcgcgcugcgcgcgucuucaccgggcaccugcucucugugcgcacgcccuguaucagggccaccucuucacggguaaccacaggcgcuccaggccaccuugcgucucuagagucccagccacuccagggacucuggucuucucuuccuucaaugacucccagccaauuuggcgucccggacccuauagccccucccccuggauggcuggcuaagcuggccuuuccagggaugguuuauguuugggaagcuggcccggacccauucagcgccuguguacuuuguaaaguucccgcaauggaauuccucguguaggguaugcuguauuaggcauuucccagcgagaacgcgcagaucacu

SEQ ID NO: 10504 - RNA, 2501 nt, Mus musculus
agugaucugcgcguucucgcugggaaaugccuaauacagcauacccuacacgaggaauuccauugcgggaacuuuacaaaguacacaggcgcugaauggguccgggccagcuucccaaacauaaaccaucccuggaaaggccagcuuagccagccauccagggggaggggcuauaggguccgggacgccaaauuggcugggagucauugaaggaagagaagaccagagucccuggaguggcugggacucuagagacgcaagguggccuggagcgccugugguuacccgugaagagguggcccugauacagggcgugcgcacagagagcaggugcccggugaagacgcgcgcagcgcgcccccguccucguucccgcuucgucgggaggcgcgggccccggagcggagccugcgccggcccaccccccacccucgccguuccggggcguguccuccgccaccccggcuucuauauaucggccugcgcgcccgggcugcccagaugcgagcuuagagcggcgacugggcgcugaggaccugcuugcucgcugcucccaucccgccgccucaucccgccgccucaucccgcgugcuccacuccgcuccccuccaccgagccguccacccggcgccaugcaucccgcgcgccccgcgcucugggcggcugcgcucacugcccucacucugcuccgcggaccgccgguggcgcgagcuggcgcgggcgcggugggcgcgggccccguggugcgcugcgaaccgugcgacgcgcgugcgcugucccagugcgcgccuccgcccaccgcgcccgcgugcacggagcuggugcgagagcccggcugcggcugcugccugacuugcgcgcugcgcgaaggcgacgcgugcggcgucuacacggagcgcuguggcaccggccuccgcugccagccgcggcccgcggagcaguacccgcugagggcgcugcugaauggccgcggguucugcgccaacgccagcgcugcaggcagccuaagcaccuaccuccccucccaaccugcuccagguaagcugucccugccacgugcgccacgcgcaacucccugggacccgacgaggguggcagggaguguaucuucagauguuugucuuggcucauauugaagguuggaaaauggacccugggaggcggagugaggcacugaacccauuuuuccucuugcuugguucucaaaguacagcuuuucuuauaaguugcaaaaugcgcucugugaaaauagguagaauucagugccaggacgagcggguagcaagggagacugccaguggacagaucccagucacuggagagucuccucgcugagcggggauacccagguuuaggucuguguaacccagcuguugaccuggguuuucauuccucauaaauugggaaggagcgcgucuaucccagggaagcuugaguguaggaaucccggguuggauccggaccaugaagguauuugcaggcagccacgcuguuggaaacaguaccugucuugaaacauccuaucauuugcacgggcuaauuggcaacgcaggauugugucccaauuuauccaaaaacuaacgagaugaaauuaagagcacuggugucuuugaaacugugaaaccuaaaguucaaaacugcucagugucaccaggagcugcaaaaagguuugagcccgguucgggccccauaggcgccauccuaugcucugcagcagcgccuuccagauucagagacugcauuuggugcagaggaugcagacucaggccgguucccugccaaagcagagacuagaaaugcgaaguacgacccaggaauguuacucuuucuaauucgaccuaggugcagcagcagcagcaguggggacagcgacagcgccaaugagaaaaaugcaaacguuuaacaguuaccucuccugcugcaagcccuaccaagcaggcagucacucuaagggcauccuucguuccuuuaaggaaaaaacaaaacaaaacagaaacauuuaaauggauuuggcagcuguugcucuaaauggccagcauucuuagcuguugcucuaaauggccagcauuccuagccagucucgcuuaguuaugugagucaaguucuugcccugaacaucugaaggcuagaauucuccgguuucccacaccaggcuggcagauggugcagaucgagcccccaggaccagggcuagcuggguagagagucucuuuaugauuucuguggcugcugaccuacacucccggguacaggcaaguccugguauguucauccccgagaagcauuggauuccuggcaaagcaagauuccaguuguuucgcugacucagacaaaggcaaaaucaugccauuugccugugugucuuuaacuucuagugcguucugugguauaccaaaagcaaucuuaagaaauacuagcauugcuauuuugaguuaagccuuaaugaccucuauuaauaaucaccauugaacacuguaguaaaaauugaugugagcuuuaau

SEQ ID NO: 10505 - RNA, 2501 nt, Mus musculus
uccuugaauggggagggggcgcgugcuaggaacugcacagcaggcaauccgagaaacgucuucuccuuuagcucggcagcuacacagcuucucaggaaaguaaacuuuucccacaucguuccuuccucuuuuagggcuugacaagggccaaagacacuccucgagugucaacaggaaggaaaaguuaaagcgugaucaggcugaggaggugagagccgggaccgcggagggugcaaaaucccaagugaagucaauuuuuuuuuuaguguggcggaagcaauuugcucaagcaaauguucauuuggcgccgggagggcaggccgcacagagauaccggguuauuucguuuaguuugaaauauuuuugaaagagggacaaaauggcaaguaauacagaggcccaaggugaauacaccuugggucgccaaggcucacuggccacaucauuucuucaaagaucuccagcgcugccuccuaccccagagccugcaaucaccuuucuaguugaccucucugggccccuagcacuaagagauagcugaacaggaaucccaccgcaccuccaggguagaugcggcccaggccaggcuaaggcggcaagaagacgccaaaggcaccacaguagaaguggcaguuucaggaugccgcccaaggucagggguaccuccgaggcggucaccccucuuccuuugcucgcacaggcgggccuucuuucuaccaagucugcuaagcacaccgagucccaccagaauuugauggccaacccagcgccccaaacauucuagggauuuuggaaggccuagcgugccaggucgcgucgcaucggccguccuauaugaacccgauggagagcaaggaacuaggccucagguuguaaagcucacgcacagccgaccgggagggcgaggcucggcgcagacacucugagcccacgcagcucugcuccagcaaaagaagggguucugggaguaugacugggaccggcggggggcuugaagcuacaucccaggacccaaggguaggagauuccggggagaaagggagguaaaacuaaagcagcucccccaucccaacuccuuuccccgccucagcccugggggacccucagccuagacuaaggggguggggggaggucagcgagcacauaaggcggaaaggaaggauucaaagagcuugggccgaagggccacaggccugcagccuccgcggcuaagcccggcugcggugugaguuuucgaguacuuucgucuaacuuagcagcccaguuccgcagcuucggaggaggcgggggagggggcggccggcucccgagcggccugggguccccagggcagccaaggggcgcccggccucucacuccaaccccgcccaccugccccggacagagguagcgggggucgauuagaggacggggagacgagaggggccaccaucgucccgggguggcgcgcggcccggcgacucccuccuuaccugcccuccgcagucgcggcuuuucaccaucuaccucucgccuucaccgagacucgccggcagccaaccugcaaaacggaggcgcacagguauuaccccggagacggcgggacccuaggcuuuccucuucccucaacuucccucuucccgucuccugcauuuuuucuaggagcucugugcguguaccuccagguuucacuuuauugcucaaacacuuuguugcaaagucccacaugcuuuuccucucaagaccuggccucgcccgggacccgggggguggggugggugaguaggggguguucgagggacagaguuaggagguggcuugcgcuggcagcugcacucucucggagcaagccggaggcgguagggacuggagaaauccugcauagucacuuggcaaacuaaauaaaucaagcaauuuaccuugucggaguggcuugucuugcucgguuguuuaggugauuggaaauguagccugaugaagauugaucaccuuucuacugcccuccccggguaugugaacgcgaggcgagugcguaacggggcucggccuccaauagggggccuagagcggacugagugacagggagcugggcaauggcgagcccggguuaccuccgcgcgcccccgcccucccucgcccccaccuccucccuccccgcgcgccggccccgccccggucgcgcgcuaacucugggucuagguuggcaaauuccgcucagaacgaguugaggagggcgaaggcugcgccggaguugcuggcacagagggggccccgggucccaaggcucgcccgagggcccccgcccuccccuugcccgggccgcgcuccggaggaguggcgucaagcugcuggauaaccgguuccugcucgcgcgcgcgcgccgccaggcucugccgcacugugggagccaggcuucccaggccgaggacucggggcgugcuggccccuggcacuccuugaugcucccuggggccccagcaacuccuccuccgcucccccacaaccagcggucgccgccggcg

SEQ ID NO: 10506 - RNA, 2501 nt, Mus musculus
cgccggcggcgaccgcugguugugggggagcggaggaggaguugcuggggccccagggagcaucaaggagugccaggggccagcacgccccgaguccucggccugggaagccuggcucccacagugcggcagagccuggcggcgcgcgcgcgcgagcaggaaccgguuauccagcagcuugacgccacuccuccggagcgcggcccgggcaaggggagggcgggggcccucgggcgagccuugggacccggggcccccucugugccagcaacuccggcgcagccuucgcccuccucaacucguucugagcggaauuugccaaccuagacccagaguuagcgcgcgaccggggcggggccggcgcgcggggagggaggaggugggggcgagggagggcgggggcgcgcggagguaacccgggcucgccauugcccagcucccugucacucaguccgcucuaggcccccuauuggaggccgagccccguuacgcacucgccucgcguucacauacccggggagggcaguagaaaggugaucaaucuucaucaggcuacauuuccaaucaccuaaacaaccgagcaagacaagccacuccgacaagguaaauugcuugauuuauuuaguuugccaagugacuaugcaggauuucuccagucccuaccgccuccggcuugcuccgagagagugcagcugccagcgcaagccaccuccuaacucugucccucgaacacccccuacucacccaccccaccccccgggucccgggcgaggccaggucuugagaggaaaagcaugugggacuuugcaacaaaguguuugagcaauaaagugaaaccuggagguacacgcacagagcuccuagaaaaaaugcaggagacgggaagagggaaguugagggaagaggaaagccuagggucccgccgucuccgggguaauaccugugcgccuccguuuugcagguuggcugccggcgagucucggugaaggcgagagguagauggugaaaagccgcgacugcggagggcagguaaggagggagucgccgggccgcgcgccaccccgggacgaugguggccccucucgucuccccguccucuaaucgacccccgcuaccucuguccggggcaggugggcgggguuggagugagaggccgggcgccccuuggcugcccuggggaccccaggccgcucgggagccggccgcccccucccccgccuccuccgaagcugcggaacugggcugcuaaguuagacgaaaguacucgaaaacucacaccgcagccgggcuuagccgcggaggcugcaggccuguggcccuucggcccaagcucuuugaauccuuccuuuccgccuuaugugcucgcugaccuccccccacccccuuagucuaggcugagggucccccagggcugaggcggggaaaggaguugggaugggggagcugcuuuaguuuuaccucccuuucuccccggaaucuccuacccuuggguccugggauguagcuucaagccccccgccggucccagucauacucccagaaccccuucuuuugcuggagcagagcugcgugggcucagagugucugcgccgagccucgcccucccggucggcugugcgugagcuuuacaaccugaggccuaguuccuugcucuccaucggguucauauaggacggccgaugcgacgcgaccuggcacgcuaggccuuccaaaaucccuagaauguuuggggcgcuggguuggccaucaaauucuggugggacucggugugcuuagcagacuugguagaaagaaggcccgccugugcgagcaaaggaagaggggugaccgccucggagguaccccugaccuugggcggcauccugaaacugccacuucuacuguggugccuuuggcgucuucuugccgccuuagccuggccugggccgcaucuacccuggaggugcggugggauuccuguucagcuaucucuuagugcuaggggcccagagaggucaacuagaaaggugauugcaggcucugggguaggaggcagcgcuggagaucuuugaagaaaugauguggccagugagccuuggcgacccaagguguauucaccuugggccucuguauuacuugccauuuugucccucuuucaaaaauauuucaaacuaaacgaaauaacccgguaucucugugcggccugcccucccggcgccaaaugaacauuugcuugagcaaauugcuuccgccacacuaaaaaaaaaauugacuucacuugggauuuugcacccuccgcggucccggcucucaccuccucagccugaucacgcuuuaacuuuuccuuccuguugacacucgaggagugucuuuggcccuugucaagcccuaaaagaggaaggaacgaugugggaaaaguuuacuuuccugagaagcuguguagcugccgagcuaaaggagaagacguuucucggauugccugcugugcaguuccuagcacgcgcccccuccccauucaagga

SEQ ID NO: 10507 - RNA, 2501 nt, Mus musculus
gcuccgccucccgcuccuccgccgucugccgccugcacccggggagggagagggacagcaccgucacgcacugggguuugcuaggccaccagcgggccccagcccucccgggaacagagccucccggccccucgaggcgaagccgccugcggcccgcacacacuugccccgagguccgcggggcaggaggacggguggaaccauuggguuuuguuugugcaccccgggggcgcugggaaggcacucugcccgcccguccaccugcacacccggauuuuguggccuugucaacaauaaaucuuguuuuguguguguguguguguguguguguguguguguuuuguuacccccugcgggauaagagcggcagggcaguguauaacugacuugguccugcggccaauggggucacuugugcccacggguggacuggcgggcugugcaccaccagcugggcgacacuugacggggugucuaccaggcacuaucuugaagcccucucuagaacauagagcuucuucgucguuuacggguuggauggaagcaaagauaguauuaaaaagaaaaaaaggaaaagaaaaaagcagaguuggagagaggacccuaaaacagcccuggccaucaauccgaaauccgagugggugggcuagaaugagagagggaggagagugugggaggcccggggugugugugguggggggcaggugggaggaacccaaacgagcaaaggaggcgaaacaaaacacuggcgagaugggccugaaaauggagacgccgaggcgugggagagauggcgagagggauacaggucggugggaagaaaggacaacaaaucuguaaaagaagggcgaugcaugguccagggggcgcggguaggagcuagcacaggagagggcgugaugcuggacugccgcgcagggcggggcaggugcagggcaggugcguggugggccgggccgggccucucucaccgccacuugguccuccgauuuuggaaccaggucuugaccugcgcguccgucauuuugagggacuuugcgagcgccgcccucucggccgaggccagguacuuuuggcgauggaagcgcuuuuccagcucacagaucugcacccgggaaaaggacgugcgcggcuucuuacgcuuggguggcguccgguucugguagggguggccaaugcgccgggucacggugaagggcgugagcgcggccgccgcugcagagacacaugaggccccuugaagcccagcccuaccaccguucgggccacacguggagccccgugggacacagugcuccgcuauuucgcucgucccgcgaguccccuccgcagcuucaagccaggcagggacgccccccccccuuucccugggacguugguuucuuuccccccucccccgacccauaacucuccgauuuaccuucaaccuccccccacccauagccgccccgagcucugggugccgaggccuccgccacgccugggccucuggaaucgauccugggaguggggugcacagggcgcggcgccccuggccccgggagagccgaggccuggcuccuggugguucgcucugcucaccugugaagcgguccuuuacaaagcggcgacugcucuccauccaggggaaauugaggccgccuaggcuggagaccgugggcaccgagggcauagcgggcagcgcgcuaggcagaggcggcggcacggccccagggagcggccugugcgcuggcacccggaucacgccggcgggggccaagcuuagguugacacuguaagaucccgcguccucgaagggcgcgccgaggcccgcaaaggaggcgggcagagacggguacgcggcgcccggacggcccccggggggcccucccagguagcuggcgccgucggggccccgcggggcgggcgcgcuguccugguccgggcuguugaggauuuggucgaugccgaagcugaugggcucgugcggguguggggucugcgcgcuggcgggcgccuccauccugggcgggcggaagggcugggcugggcugggcggggaggcugcuggguccccguuacggcgcggccauggagcgcccggcgccuccagucgcacugaaacuuugccaagagugcgcgggcccgacaggcucugugucaucuuucuugaaccgaaccuggaguuuccgcugcuaauuccucucccgccgcagccauuggcugcgaucaacaagccucucuucucucauuggcucccggcuuucaauaaaggccuaauucauggaaauaggagcuuagggacuguuccaaggugacaucauuuuaacaaacgaacaauaggucaaauuuauuagccgggauaaugggcggcggauauuagcgcccgaaccgcagcuucucaaacccgaaaucuaacgaagcugcaauuagcagacgcuccccgcuccgggcucggccguuucccgccgccgcacccgcccguaggcgcugcuggggaaauggccuuuugccgcgggggu

SEQ ID NO: 10508 - RNA, 2501 nt, Mus musculus
acccccgcggcaaaaggccauuuccccagcagcgccuacgggcgggugcggcggcgggaaacggccgagcccggagcggggagcgucugcuaauugcagcuucguuagauuucggguuugagaagcugcgguucgggcgcuaauauccgccgcccauuaucccggcuaauaaauuugaccuauuguucguuuguuaaaaugaugucaccuuggaacagucccuaagcuccuauuuccaugaauuaggccuuuauugaaagccgggagccaaugagagaagagaggcuuguugaucgcagccaauggcugcggcgggagaggaauuagcagcggaaacuccagguucgguucaagaaagaugacacagagccugucgggcccgcgcacucuuggcaaaguuucagugcgacuggaggcgccgggcgcuccauggccgcgccguaacggggacccagcagccuccccgcccagcccagcccagcccuuccgcccgcccaggauggaggcgcccgccagcgcgcagaccccacacccgcacgagcccaucagcuucggcaucgaccaaauccucaacagcccggaccaggacagcgcgcccgccccgcggggccccgacggcgccagcuaccugggagggccccccgggggccguccgggcgccgcguacccgucucugcccgccuccuuugcgggccucggcgcgcccuucgaggacgcgggaucuuacagugucaaccuaagcuuggcccccgccggcgugauccgggugccagcgcacaggccgcucccuggggccgugccgccgccucugccuagcgcgcugcccgcuaugcccucggugcccacggucuccagccuaggcggccucaauuuccccuggauggagagcagucgccgcuuuguaaaggaccgcuucacaggugagcagagcgaaccaccaggagccaggccucggcucucccggggccaggggcgccgcgcccugugcaccccacucccaggaucgauuccagaggcccaggcguggcggaggccucggcacccagagcucggggcggcuauggguggggggagguugaagguaaaucggagaguuaugggucgggggaggggggaaagaaaccaacgucccagggaaaggggggggggcgucccugccuggcuugaagcugcggaggggacucgcgggacgagcgaaauagcggagcacugugucccacggggcuccacguguggcccgaacggugguagggcugggcuucaaggggccucaugugucucugcagcggcggccgcgcucacgcccuucaccgugacccggcgcauuggccaccccuaccagaaccggacgccacccaagcguaagaagccgcgcacguccuuuucccgggugcagaucugugagcuggaaaagcgcuuccaucgccaaaaguaccuggccucggccgagagggcggcgcucgcaaagucccucaaaaugacggacgcgcaggucaagaccugguuccaaaaucggaggaccaaguggcggugagagaggcccggcccggcccaccacgcaccugcccugcaccugccccgcccugcgcggcaguccagcaucacgcccucuccugugcuagcuccuacccgcgcccccuggaccaugcaucgcccuucuuuuacagauuuguuguccuuucuucccaccgaccuguaucccucucgccaucucucccacgccucggcgucuccauuuucaggcccaucucgccaguguuuuguuucgccuccuuugcucguuuggguuccucccaccugccccccaccacacacaccccgggccucccacacucuccucccucucucauucuagcccacccacucggauuucggauugauggccagggcuguuuuaggguccucucuccaacucugcuuuuuucuuuuccuuuuuuucuuuuuaauacuaucuuugcuuccauccaacccguaaacgacgaagaagcucuauguucuagagagggcuucaagauagugccugguagacaccccgucaagugucgcccagcugguggugcacagcccgccaguccacccgugggcacaagugaccccauuggccgcaggaccaagucaguuauacacugcccugccgcucuuaucccgcaggggguaacaaaacacacacacacacacacacacacacacacacaaaacaagauuuauuguugacaaggccacaaaauccgggugugcagguggacgggcgggcagagugccuucccagcgcccccggggugcacaaacaaaacccaaugguuccacccguccuccugccccgcggaccucggggcaagugugugcgggccgcaggcggcuucgccucgaggggccgggaggcucuguucccgggagggcuggggcccgcugguggccuagcaaaccccagugcgugacggugcugucccucucccuccccgggugcaggcggcagacggcggaggagcgggaggcggagc

SEQ ID NO: 10509 - RNA, 2501 nt, Mus musculus
gccaagccggcuucgagagucguaucuauuguuucuuaaauugucaucagggugguuuuuuuucuuccugcuucuucaagugaagguaccgcuacaaaaggaaacuccagccccuccuguucuccaacggccugugauuacuacaaaaagaaaaaaaaaaaggcaaaaaaaaaaaaaaaagcaaaaaaaaaaaaaaaaaaaaaaaaaaaaaaggaaaaaaaaagcacccaaacucaaaaccaaccaaccaaacaacccccaacagccaggcauauaucucuguuuuuucuuaauuuuggucuuuucguuggauuuucccuuucuuuuuuuuuccccucgccccccuccuuguuaucgcucaguuuugagcgaagguuuacauuuuuaaaaauuuugcuuuucagcccgccuugauguagcgcgagucucaucgacucaaaaaaaaaaaaaaaaaucugugguuggcguuuuuuuuuuuuuuuccuuuuuuuuuuuuucaaauauuuucaaaggggaggagauuuuuccacaagaaaagguuguuuucauguuugggauccaggaaagcauccaacggaguggaagcaguaugaaggaagagccgcugggcagcggcaugaacgcggugcggacguggaugcagggcgccggggugcuggacgccaacacagcggcgcagagguggguaccgcugggggaccguggaggagaggccaccggcuagcgggagagcccggagacggcggcgcggcuacccggggccuggccacgcgagugcgucugccgcugcgcugcgcucgccgcccgagcuccgcgcuccucggcugcgcagcacucgucgccggguggccagagaucagcgagcugcuggagggagccgagcccaagcuuugccggcacuuuccgcagccccaucugcgaguguuuucguuuuguuuuaacccagaagaggcgucucugcagcucgguguuggauagcugcgcuuuucugaccgcuuguuuucuuuucugugugguuauauuuuucccuuuuccucuccuucucuucgcuuccuuuccccuuuauuucgcuucaguucuuuccuuuuucuucuucccucuuuucuuuuuuccuacuuaauuuucuucucucccccuuucuuccuuucuauuuucuaccuucuuuaauucuuuccuuucccccuaucuuuccuuucccuuuucuaccuucuuuaauuuuuucuuguccuucuccacucuuuuccccccuucuuucucaguuucacucuucguuuuucucuucucuuuccucaccuggcucucucccccguuucucucucucucucucucucucucucuccauuuuucuucuuggagucuccucuuauuucuccuaucugguucuuuacucucuccucucuccacuucuuagccuucaguuuuucucagucugccuguagaauagugauuuccaacuuuaauuuucacaucuccuaaaagccacccucauccacugucaccuuggccuuccccagucccucucccacucuccagauccuacacugagugauuuggaggccaugcucuuggagaccaacuugaggaacuucccuggacacacccagugcccuguccaggggcuccuagucccaagugagaaaugguaccuugcccuuuucauugcuggccaccaccugggcuucggggaaaacuuugugggcccaggcuccauuagacauaaagggugcagaaggggaauggggaguaguuccaucuuuccauuuuuggggggaagggcuagggacaacuguccuauacuguuuccauccccaugagcacaggguugggagugguugguagugagagugaauuggguaacuaggcuagaagcgaaaguguguguguguguguguguguguguguguguguguguguguguguguguuguccgauaguguccggcaguuugggcugucauuguggugcccccgggcauccuauucuccagucccccgcggaucuucucagccaagaagccuuggcccuuuggguuucuggaaugugugaggaggauuucucagaauggcaaaacuuuggcaagacaggucuuuuauuuaaaaaaaaaauuaaccaaacaacaacagucacuuacaacaguaaaacaagacgccccaguucucuuucccauggcgaucgaucauuucuaauagccgcgagucccaaucagggacccuucuccgcuugcuugccguuuguguagaaaauuagcgugcugaggucggguaccaucagcuggccgaggcuagggaguuuccuggaggguggcugaggcagcgaacaaccuagcaugccuucaugcauuuccaccugcccacuuacuugcgagauuuggaggcguagucggagccuauucccacgcccuggccuucgaaguaguaaauugcgcacuuucucuuuaaccccgucucauuucacccacggucacguuuccucuccacgcagcgcguuucaaguggaguaaa

SEQ ID NO: 10510 - RNA, 2501 nt, Mus musculus
uuuacuccacuugaaacgcgcugcguggagaggaaacgugaccgugggugaaaugagacgggguuaaagagaaagugcgcaauuuacuacuucgaaggccagggcgugggaauaggcuccgacuacgccuccaaaucucgcaaguaagugggcagguggaaaugcaugaaggcaugcuagguuguucgcugccucagccacccuccaggaaacucccuagccucggccagcugaugguacccgaccucagcacgcuaauuuucuacacaaacggcaagcaagcggagaagggucccugauugggacucgcggcuauuagaaaugaucgaucgccaugggaaagagaacuggggcgucuuguuuuacuguuguaagugacuguuguuguuugguuaauuuuuuuuuuaaauaaaagaccugucuugccaaaguuuugccauucugagaaauccuccucacacauuccagaaacccaaagggccaaggcuucuuggcugagaagauccgcgggggacuggagaauaggaugcccgggggcaccacaaugacagcccaaacugccggacacuaucggacaacacacacacacacacacacacacacacacacacacacacacacacacacuuucgcuucuagccuaguuacccaauucacucucacuaccaaccacucccaacccugugcucauggggauggaaacaguauaggacaguugucccuagcccuuccccccaaaaauggaaagauggaacuacuccccauuccccuucugcacccuuuaugucuaauggagccugggcccacaaaguuuuccccgaagcccaggugguggccagcaaugaaaagggcaagguaccauuucucacuugggacuaggagccccuggacagggcacuggguguguccagggaaguuccucaaguuggucuccaagagcauggccuccaaaucacucaguguaggaucuggagagugggagagggacuggggaaggccaaggugacaguggaugaggguggcuuuuaggagaugugaaaauuaaaguuggaaaucacuauucuacaggcagacugagaaaaacugaaggcuaagaaguggagagaggagagaguaaagaaccagauaggagaaauaagaggagacuccaagaagaaaaauggagagagagagagagagagagagagagaaacgggggagagagccaggugaggaaagagaagagaaaaacgaagagugaaacugagaaagaaggggggaaaagaguggagaaggacaagaaaaaauuaaagaagguagaaaagggaaaggaaagauagggggaaaggaaagaauuaaagaagguagaaaauagaaaggaagaaagggggagagaagaaaauuaaguaggaaaaaagaaaagagggaagaagaaaaaggaaagaacugaagcgaaauaaaggggaaaggaagcgaagagaaggagaggaaaagggaaaaauauaaccacacagaaaagaaaacaagcggucagaaaagcgcagcuauccaacaccgagcugcagagacgccucuucuggguuaaaacaaaacgaaaacacucgcagauggggcugcggaaagugccggcaaagcuugggcucggcucccuccagcagcucgcugaucucuggccacccggcgacgagugcugcgcagccgaggagcgcggagcucgggcggcgagcgcagcgcagcggcagacgcacucgcguggccaggccccggguagccgcgccgccgucuccgggcucucccgcuagccgguggccucuccuccacggucccccagcgguacccaccucugcgccgcuguguuggcguccagcaccccggcgcccugcauccacguccgcaccgcguucaugccgcugcccagcggcucuuccuucauacugcuuccacuccguuggaugcuuuccuggaucccaaacaugaaaacaaccuuuucuuguggaaaaaucuccuccccuuugaaaauauuugaaaaaaaaaaaaaggaaaaaaaaaaaaaaacgccaaccacagauuuuuuuuuuuuuuuuugagucgaugagacucgcgcuacaucaaggcgggcugaaaagcaaaauuuuuaaaaauguaaaccuucgcucaaaacugagcgauaacaaggaggggggcgaggggaaaaaaaaagaaagggaaaauccaacgaaaagaccaaaauuaagaaaaaacagagauauaugccuggcuguuggggguuguuugguugguugguuuugaguuugggugcuuuuuuuuuccuuuuuuuuuuuuuuuuuuuuuuuuuuuuuugcuuuuuuuuuuuuuuuugccuuuuuuuuuuucuuuuuguaguaaucacaggccguuggagaacaggaggggcuggaguuuccuuuuguagcgguaccuucacuugaagaagcaggaagaaaaaaaaccacccugaugacaauuuaagaaacaauagauacgacucucgaagccggcuuggc

SEQ ID NO: 10511 - RNA, 2501 nt, Mus musculus
gucccugcugcacaauagcugacccucauucaucaccacuguagccgcgacuuuccuggggcgcgcuauuccacgcgcgugccaccuucccaaggcgggcccgccgggaucccgggagcuggccuccuaccccgcccccucgcggugcucccagcggcggcgagugaugcggccccuuuaaaucccggccgccccgcccuucgcccgucgacucggcggcggucccggauccagcccggccgcggcucuugccgccuugccccaacccugcucggccccggcccagccucagaucgaggccgccagcaccgcgcaccgcggaggagcagcucgcacgcgcccuccacccccguccccauucccgcccugccuguagccuccucucccgggcccgcagcuccuccgcgcuccggggccggggcccccgccgccuccgggcccccgugccccggccccggucccccgggccaugcggccucggccccgccggcgcccgccgcgcaucgggggagaugaggcuccgcaauggcaccuuccugacgcugcugcucuucugcuugugcgccuuccucucgcucuccugguacgcagcgcucagcggccagaaaggugagcccccacccugccgccgccugcucaggcccgcaccgggagcaccugagccucucccaugcucgccccacuuguuugcuuuuggcaucacgaaauucccuggucaggccuggccgaggggagcgagugguuaccagauccccgccuccguguggcgcucgggacuggccucugccugcgguuaucccaugccaggggcgggcgcuuccacuggcaaguuaaggaccuauggaguucccacagaggggcagagacacaaggucacagagguaguguacccagagaaccuggugcaggcucuuggacaagagcuggcacaguauuguugagacaggugaggagauagagccaagguauccaucucccugccccauccacuguugugcucugcagcagcccugcucccgugggcgcugcucccugggggccuacagccuccuccauggcaccgagccccaggguuccucuguagggccucuugaauagcuagcccagaaacccugauaugugaucacuuugugggguuuccuuggccuuuccuggugcagcuucgaagcuugggcuugcuggccaguccacacuauggccucccagcuuggccagccgucuugggaguagaaggacacagguccuagcacugcuaggaagcccccugagcuagguugaaugguuuaaacugagugggagcugaggaguucagagaccaugauccacccagccuggacacaggagacucugagcugcuuccuuccugccugccuucuguucuuccugucauaucaggcugaggugggcuagcucucucccucccucaagcaggcucucuguucccaaagguuaugcuaaacggggaaggggagguccaggaagaggccuguggcaaguccaacuccuggcaucaggcuccugccugcucagcccagccucaccuccuguagcacuuucccuauuuuagugguaguggaggucugggcuggucuugagagaaucacaagucaggaacucuaaggagagauucgauagggccuggcacagagagagugugggauggaaugagcuaucaagggaggguauggccaggggacgguucucugaagguaggguguggcauccagaaggguacauuuugagcccuugggagaguagccauggaaagcuaugagggcuguaguggagccgugucggaagaacugggaucagguuguuccauugugguuagggccauuagacugugucucauccucauuugguaguggucccgugugcuuccuaugacagucacaugucuccaucugauguuaggauaccucccgagggagcaagccaggagacuagcauucugagggccuggggagcaagaucagagaagaguagggcucagauacagaguucuuccuccugaggacaagcccuguaugcauggagagagagaagugacugaguguagccucagggcuguacuguuuccauggguauccagcaaagccagcugacuagaagucaggaaucuugacugugggccuuucucauucuuccacacagacaagucaguagcaaacucagcuagucagccacuagauugaagcugguuuccacuuuguagcggauauggggcucaggagaggaggguccaguacuuaggggaagagcaaaagaaccggaagggaggauguaggcggggagccagagaggaaagaggcagcagaagcaggggucacccuagagccuggguuaagagugggaaagacucagacuuggccaggugcaccuaggguuuaggacucagguucaaauccaaccuuggcuuuuaucuguugaagcagccagacauucaggaaucaaacuauagccucagccaaacagcugcagagcuuggaccucagggagac

SEQ ID NO: 10512 - RNA, 2501 nt, Mus musculus
gucucccugagguccaagcucugcagcuguuuggcugaggcuauaguuugauuccugaaugucuggcugcuucaacagauaaaagccaagguuggauuugaaccugaguccuaaacccuaggugcaccuggccaagucugagucuuucccacucuuaacccaggcucuagggugaccccugcuucugcugccucuuuccucucuggcuccccgccuacauccucccuuccgguucuuuugcucuuccccuaaguacuggacccuccucuccugagccccauauccgcuacaaaguggaaaccagcuucaaucuaguggcugacuagcugaguuugcuacugacuugucuguguggaagaaugagaaaggcccacagucaagauuccugacuucuagucagcuggcuuugcuggauacccauggaaacaguacagcccugaggcuacacucagucacuucucucucuccaugcauacagggcuuguccucaggaggaagaacucuguaucugagcccuacucuucucugaucuugcuccccaggcccucagaaugcuagucuccuggcuugcucccucgggagguauccuaacaucagauggagacaugugacugucauaggaagcacacgggaccacuaccaaaugaggaugagacacagucuaauggcccuaaccacaauggaacaaccugaucccaguucuuccgacacggcuccacuacagcccucauagcuuuccauggcuacucucccaagggcucaaaauguacccuucuggaugccacacccuaccuucagagaaccguccccuggccauacccucccuugauagcucauuccaucccacacucucucugugccaggcccuaucgaaucucuccuuagaguuccugacuugugauucucucaagaccagcccagaccuccacuaccacuaaaauagggaaagugcuacaggaggugaggcugggcugagcaggcaggagccugaugccaggaguuggacuugccacaggccucuuccuggaccuccccuuccccguuuagcauaaccuuugggaacagagagccugcuugagggagggagagagcuagcccaccucagccugauaugacaggaagaacagaaggcaggcaggaaggaagcagcucagagucuccuguguccaggcuggguggaucauggucucugaacuccucagcucccacucaguuuaaaccauucaaccuagcucagggggcuuccuagcagugcuaggaccuguguccuucuacucccaagacggcuggccaagcugggaggccauaguguggacuggccagcaagcccaagcuucgaagcugcaccaggaaaggccaaggaaaccccacaaagugaucacauaucaggguuucugggcuagcuauucaagaggcccuacagaggaacccuggggcucggugccauggaggaggcuguaggcccccagggagcagcgcccacgggagcagggcugcugcagagcacaacaguggauggggcagggagauggauaccuuggcucuaucuccucaccugucucaacaauacugugccagcucuuguccaagagccugcaccagguucucuggguacacuaccucugugaccuugugucucugccccucugugggaacuccauagguccuuaacuugccaguggaagcgcccgccccuggcaugggauaaccgcaggcagaggccagucccgagcgccacacggaggcggggaucugguaaccacucgcuccccucggccaggccugaccagggaauuucgugaugccaaaagcaaacaaguggggcgagcaugggagaggcucaggugcucccggugcgggccugagcaggcggcggcagggugggggcucaccuuucuggccgcugagcgcugcguaccaggagagcgagaggaaggcgcacaagcagaagagcagcagcgucaggaaggugccauugcggagccucaucucccccgaugcgcggcgggcgccggcggggccgaggccgcauggcccgggggaccggggccggggcacgggggcccggaggcggcgggggccccggccccggagcgcggaggagcugcgggcccgggagaggaggcuacaggcagggcgggaauggggacggggguggagggcgcgugcgagcugcuccuccgcggugcgcggugcuggcggccucgaucugaggcugggccggggccgagcaggguuggggcaaggcggcaagagccgcggccgggcuggauccgggaccgccgccgagucgacgggcgaagggcggggcggccgggauuuaaaggggccgcaucacucgccgccgcugggagcaccgcgagggggcgggguaggaggccagcucccgggaucccggcgggcccgccuugggaagguggcacgcgcguggaauagcgcgccccaggaaagucgcggcuacaguggugaugaaugagggucagcuauugugcagcagggac

SEQ ID NO: 10513 - RNA, 2501 nt, Mus musculus
ggggccugucuuggacaggcuuagacagcgugccacaggcccugguaggugguagcuccaaugccauucagguuggagggggcagacugggcacuaaaccagcuaaagguccuggaguggaucgaugagagauuucggugaaggacggcaggccaccgcgaaucuuggucuuuuuucggggagccaugggcgaggcacccaagaacuugcugaaggaacuugacuucuucaagccacgagccagguccuggagcaucaagucaucggccaggacgcccagaaacgcacuagugguggagcugaggaugguggcggcuaccugcacggggugccgagacacaaggcucccacugccaccacuggccgcaucaggcuccaucauagaucgcaggccagggucacccaguaaacgccucagcgcguaggaggagccaggccguagguacugguaggcacgccggccgcuguagucgcggacgugcacuugggcacccaagcgcaccacuagcagcacagcagcauccucguggccgugcagagccgccaggugcagcggcguguagccaccgugagagcgcgcguucacguccacgggcgcgccuccacgccgcgccaccuccaccagcuguaaagccaucucccggucgccguucuuggccgcccaguguagcgcggugaagccggacaugaagucgcgcuuggcagccaggccgcggucccgcaagagcaacccgugcagcuggugacuccaacgaccgcuggccgugcgcaccagccacucgugcuccgugggcuccaggggcaccgcgggugacgguagcggcgcgacgggcaucuccuccguguccggacucagcaggcgcggaccggcgcgggacaggcgccugagaugcggggaacggccgggucccagguggagucccagacccgacuccucuaccgaaagccuccgcaggagcaucggggagccccgugggcucggcuccuccgagcgcugccggcgcaggcccugcuccuccgcgcggauccgcagcgccgcggggccaggaacgacgcagcgcaccggcagcaugcaaggcuucugcgguggcacuugcgccgugggaggugcaggcuccgggccuggcgacucugugcucgucagggccagccccgacggcacgcuggcgggucgggcuagcuccgaggaccgagguagcgccggauccuccggccccccgggcuguggcgcugagccugauggcgccucaaccugggugaccucugaggguagggucucaggggugugcuguagcucggauggugcggacgaguccuccggcgguucuccugaucgcuguggggaguggggagccccgggggcacaguuguccuccgcugggacagcagcgcacugggccagcgcggcuggcacuccagggcuggaggggaguggggccucggguccuuccggcggccggggcuucuuucucagcaccacgaacuugaccccauccagcuccuucaccacggccacguuguugacgaacugcuugaagcggucccuacgggccgcgcggccccguggguccccagcguccagcagcggcuugaagcggcucagcagcucggaguugcgcaccugcccgccgugcucccgcaggaagcccaacaccgccgccuggcucaccccugcggcagcagcggcggcagcggcggcggcugccagcgccauucucggugucugcgacuccggggucgccccagccgcccagccgggcucaccugggacucugauuuccgaaacuggacugcagucacgcccucgccgccgugcugagaagucuccgggcgaagggcaccugggacuccuauccuccgccugcgccaggccuggcccccagacugggggguagguugcugcugagagguccuguccaaugggcgccaggcuccaugccccugugcggcgcucggcuuacaggugacagcugccacuggaggugcggagggaaugggaaagcggaaccucucugcacugcccccaccaauuaaaggcggaauuaaaggcgcagcguugcucuucagcuccacucccgguugcuagguggguguguucccuggggauguugcagcguaugggcgaggcguggguauuuauuaccuucagcacuauuuaccacaaaauaaaagcaauauuuuacauauauauguccuugcacugcauauauugcaucaauaccucuccaaugucugaugcuuuuuauauagggggaaaaaaaccaaccagauuuacaaaauucauagcaagaacaguucccugugugguauugagugcaggguacuggaggcucacaagagguuuaggaagcaguuuucucaugauagauaauacuuuuugaaauguggagcuuugcgaucuacauauuuuauuauucguugacuuucugucucucugucucucucugucuaucuguuucucucucucucucucucucucucucucucucucucucucucuc

SEQ ID NO: 10514 - RNA, 2501 nt, Mus musculus
gagagagagagagagagagagagagagagagagagagagagagaaacagauagacagagagagacagagagacagaaagucaacgaauaauaaaauauguagaucgcaaagcuccacauuucaaaaaguauuaucuaucaugagaaaacugcuuccuaaaccucuugugagccuccaguacccugcacucaauaccacacagggaacuguucuugcuaugaauuuuguaaaucugguugguuuuuuucccccuauauaaaaagcaucagacauuggagagguauugaugcaauauaugcagugcaaggacauauauauguaaaauauugcuuuuauuuugugguaaauagugcugaagguaauaaauacccacgccucgcccauacgcugcaacauccccagggaacacacccaccuagcaaccgggaguggagcugaagagcaacgcugcgccuuuaauuccgccuuuaauuggugggggcagugcagagagguuccgcuuucccauucccuccgcaccuccaguggcagcugucaccuguaagccgagcgccgcacaggggcauggagccuggcgcccauuggacaggaccucucagcagcaaccuaccccccagucugggggccaggccuggcgcaggcggaggauaggagucccaggugcccuucgcccggagacuucucagcacggcggcgagggcgugacugcaguccaguuucggaaaucagagucccaggugagcccggcugggcggcuggggcgaccccggagucgcagacaccgagaauggcgcuggcagccgccgccgcugccgccgcugcugccgcaggggugagccaggcggcgguguugggcuuccugcgggagcacggcgggcaggugcgcaacuccgagcugcugagccgcuucaagccgcugcuggacgcuggggacccacggggccgcgcggcccguagggaccgcuucaagcaguucgucaacaacguggccguggugaaggagcuggauggggucaaguucguggugcugagaaagaagccccggccgccggaaggacccgaggccccacuccccuccagcccuggagugccagccgcgcuggcccagugcgcugcugucccagcggaggacaacugugcccccggggcuccccacuccccacagcgaucaggagaaccgccggaggacucguccgcaccauccgagcuacagcacaccccugagacccuacccucagaggucacccagguugaggcgccaucaggcucagcgccacagcccggggggccggaggauccggcgcuaccucgguccucggagcuagcccgacccgccagcgugccgucggggcuggcccugacgagcacagagucgccaggcccggagccugcaccucccacggcgcaagugccaccgcagaagccuugcaugcugccggugcgcugcgucguuccuggccccgcggcgcugcggauccgcgcggaggagcagggccugcgccggcagcgcucggaggagccgagcccacggggcuccccgaugcuccugcggaggcuuucgguagaggagucgggucugggacuccaccugggacccggccguuccccgcaucucaggcgccugucccgcgccgguccgcgccugcugaguccggacacggaggagaugcccgucgcgccgcuaccgucacccgcggugccccuggagcccacggagcacgaguggcuggugcgcacggccagcggucguuggagucaccagcugcacggguugcucuugcgggaccgcggccuggcugccaagcgcgacuucauguccggcuucaccgcgcuacacugggcggccaagaacggcgaccgggagauggcuuuacagcugguggagguggcgcggcguggaggcgcgcccguggacgugaacgcgcgcucucacgguggcuacacgccgcugcaccuggcggcucugcacggccacgaggaugcugcugugcugcuaguggugcgcuugggugcccaagugcacguccgcgacuacagcggccggcgugccuaccaguaccuacggccuggcuccuccuacgcgcugaggcguuuacugggugacccuggccugcgaucuaugauggagccugaugcggccagugguggcagugggagccuugugucucggcaccccgugcagguagccgccaccauccucagcuccaccacuagugcguuucugggcguccuggccgaugacuugaugcuccaggaccuggcucguggcuugaagaagucaaguuccuucagcaaguucuugggugccucgcccauggcuccccgaaaaaagaccaagauucgcgguggccugccguccuucaccgaaaucucucaucgauccacuccaggaccuuuagcugguuuagugcccagucugcccccuccaaccugaauggcauuggagcuaccaccuaccagggccuguggcacgcugucuaagccuguccaagacaggcccc

SEQ ID NO: 10515 - RNA, 2501 nt, Mus musculus
gaaacgccggcuucugcgcguguucaggugagcgcggguccgcagggucgucgccgggcugggcucgggucccgguggccgggcggugcguucugcucugcgcggagccgggagcuggauccggggucccucagccccgugccccgcguccggcgcccugauucugcacccgccuggguuccugucccgcccgcgucccuucccaggguuagggcggugaggucagcggugcccuuccugccgguacuguuaggccgggccggacaggacacuuggcgggcucccgggaaggggcgaccugaccccggggucgccccccgaucuaaggcggaggcgcccgccuggccccgaaggcggcgcugcuuaggaugaggaagaccccuggcucccaacccuggcaaggaccagcuuggucgcugccaguuuuaugggcucuuaaaucagaaacucuccuccuaucugucagaagacauccuugucgaaccucugauguuuucccugagcaguuucagagaccgguggcgauuggcugacugauucaacaaauagagcauucucugugccuggagacuuucaaggacugaggcaggcagaagggaagacucagaaaguucagguccagagcaucagcaagguaaguacugaguuaguguggaguuugggcuguguggacuugguagaugucuggaugcuuccgggcaggagacaugggcuggggugggaggcuccgguaaacuggauuggucacuuaggaaccuggacugaggaaucacccugaguggccgcaagcuugggccaguaucacgucugugguacaguaguggaaucaagguaacggaaaagggccgcuuuagggaauagcuguccaagggccccacccacaagcagugagagaucugcaugaggaaaguccacugagcccuugcaaggugagcaugggucuggguacuucugucgcaggauuuuacugggaaguacaggugggucuuccugucaucuguauucuaaugugucauuuacuaugcugaaggagaucauugaauugcccccuacagcaacucugcugugcucucaacgcgcuaaggagucucaguacaagagaaucauuggggaaaggccuccagccaacucacuccauccuugcgacguggcuucccugacugggccacacaguggauccuuacccugaagaaugacacuuuaaggauuuugcuucuuaaugcaggccaucucguuacugacaccuuaucccuccugauggaagagcuuccuggaacuaagagcagggucccagugcaccacuuuguagcuucugacauccucaaacguucucagcuuugcagaggucuauugucuagcucaaaauuuauagggugauuuugcaaguuguugcuuguucugaauuuauaucacauccaagucagcccaugguugagugcccuguuaaauugaccaggcuuuccucuggcguguaucuccacugccucugaaguguccaggguguagucucucgauaugguucugugugugccucaaggccagccucucggcuccucuccauguacagaauguuugaccuugggauucuuuucuucuugggccuucuuguccucacacgagcuuguccacuguguggcccagccagugaagccacauugcuugauggagugaguuggcuggaggcccuagccugaagauucugucauauugauccuccuuauuaccgucagagcucagcaggcagauauggugacaacucaacugaagcauugugugugaccuuugggagucccuccacauugucacaggcucugcagagagacuuacuuaucuauagauuggacugcguacaauggacuguggguuguuccuugaauugcaugugcuucauaucugacuagacugggccuggggcuugaaugagggagaagacaggcggugggggaggagcucuuuuugcccacaggcagcucauaaucucucugagaucgcuguuuagcccuggcagcugccuagagccuagggaggagcccuagugugggugcucaucagagggagacugaggcccugcagcucuggggacugcguggagugagggaauugagggcuuccuugucugcugagaaagcuuccauuuuugacugcauucucccacauccuugggaggguuugaggcuggaccgaaggccuuggcugacuuagggccacguuggccgauagugugcagaggccuggggggugugucccuggcuucugggaucugucaagagcuuaauuuuaugcagauggagguugacagcaaaugcugcaaugcaggcacgggaaagaccagcagaguccuggaaagaggcuucaacuuugaaaaccaucauucaaaucuagucauuuagaccuuugaaguaccugagggugggacaccagcguaucccagagcaaagggaauuacugaguccuguggucugugggguuugugcuggggauguggagugaaggauagacag

SEQ ID NO: 10516 - RNA, 2501 nt, Mus musculus
cugucuauccuucacuccacauccccagcacaaaccccacagaccacaggacucaguaauucccuuugcucugggauacgcuggugucccacccucagguacuucaaaggucuaaaugacuagauuugaaugaugguuuucaaaguugaagccucuuuccaggacucugcuggucuuucccgugccugcauugcagcauuugcugucaaccuccaucugcauaaaauuaagcucuugacagaucccagaagccagggacacaccccccaggccucugcacacuaucggccaacguggcccuaagucagccaaggccuucgguccagccucaaacccucccaaggaugugggagaaugcagucaaaaauggaagcuuucucagcagacaaggaagcccucaauucccucacuccacgcaguccccagagcugcagggccucagucucccucugaugagcacccacacuagggcuccucccuaggcucuaggcagcugccagggcuaaacagcgaucucagagagauuaugagcugccugugggcaaaaagagcuccucccccaccgccugucuucucccucauucaagccccaggcccagucuagucagauaugaagcacaugcaauucaaggaacaacccacaguccauuguacgcaguccaaucuauagauaaguaagucucucugcagagccugugacaauguggagggacucccaaaggucacacacaaugcuucaguugaguugucaccauaucugccugcugagcucugacgguaauaaggaggaucaauaugacagaaucuucaggcuagggccuccagccaacucacuccaucaagcaauguggcuucacuggcugggccacacaguggacaagcucgugugaggacaagaaggcccaagaagaaaagaaucccaaggucaaacauucuguacauggagaggagccgagaggcuggccuugaggcacacacagaaccauaucgagagacuacacccuggacacuucagaggcaguggagauacacgccagaggaaagccuggucaauuuaacagggcacucaaccaugggcugacuuggaugugauauaaauucagaacaagcaacaacuugcaaaaucacccuauaaauuuugagcuagacaauagaccucugcaaagcugagaacguuugaggaugucagaagcuacaaaguggugcacugggacccugcucuuaguuccaggaagcucuuccaucaggagggauaaggugucaguaacgagauggccugcauuaagaagcaaaauccuuaaagugucauucuucaggguaaggauccacuguguggcccagucagggaagccacgucgcaaggauggagugaguuggcuggaggccuuuccccaaugauucucuuguacugagacuccuuagcgcguugagagcacagcagaguugcuguagggggcaauucaaugaucuccuucagcauaguaaaugacacauuagaauacagaugacaggaagacccaccuguacuucccaguaaaauccugcgacagaaguacccagacccaugcucaccuugcaagggcucaguggacuuuccucaugcagaucucucacugcuuguggguggggcccuuggacagcuauucccuaaagcggcccuuuuccguuaccuugauuccacuacuguaccacagacgugauacuggcccaagcuugcggccacucagggugauuccucaguccagguuccuaagugaccaauccaguuuaccggagccucccaccccagcccaugucuccugcccggaagcauccagacaucuaccaaguccacacagcccaaacuccacacuaacucaguacuuaccuugcugaugcucuggaccugaacuuucugagucuucccuucugccugccucaguccuugaaagucuccaggcacagagaaugcucuauuuguugaaucagucagccaaucgccaccggucucugaaacugcucagggaaaacaucagagguucgacaaggaugucuucugacagauaggaggagaguuucugauuuaagagcccauaaaacuggcagcgaccaagcugguccuugccaggguugggagccaggggucuuccucauccuaagcagcgccgccuucggggccaggcgggcgccuccgccuuagaucggggggcgaccccggggucaggucgccccuucccgggagcccgccaaguguccuguccggcccggccuaacaguaccggcaggaagggcaccgcugaccucaccgcccuaacccugggaagggacgcgggcgggacaggaacccaggcgggugcagaaucagggcgccggacgcggggcacggggcugagggaccccggauccagcucccggcuccgcgcagagcagaacgcaccgcccggccaccgggacccgagcccagcccggcgacgacccugcggacccgcgcucaccugaacacgcgcagaagccggcguuuc

SEQ ID NO: 10517 - RNA, 2501 nt, Mus musculus
agucggagugugacagcuuccugucaccugccaugauuagcagguggccuguggaggagaguaugaauauucuccaaaacaaggcccccugguauaggccaagugaggcagaggguaaacagagccaggaggucuagagcaggucccacuuggaagugggaggccauuuuccgaaagccaggucccucuccaguucuuggccacuggcacugagcacugaggcaggaaaccuaaaagcaaagcaccauuuuccguuucuaaauuauuuuauuuuaaauaaaaaauaauaauaaagaccucacacaauagaaauguagagauuuuguucaugucacauugacacuggaacuauuaaagugcaaguuuuguguuuuguuuuucuuuuggguaauugcacacacacauguaaacaagucacuuggcuaugauugaacaccccccccccccaccuccagccaaaguuuccaguuugcugaggacagagguggcugacagcggccauggcaacaccaaucacagacaagauaaugcccuauuauuaguccugcccugaagcgagcaggacaguuacuuuaagucucacaggcugaugaacuucacacgcuuuuucucaaaccucuugagaaaaaugccaagcgccccucugcuggguccuggcaucccagaaucggaggugacagcuccugucuuagcuaguucucuuuccuuucacagcaggugacugucccuuacuggcuuggucuccccgggcugggucucagggagggaaggagaaggccaauuggcgcuccuguggcacggaccgcuaguccaggaauccgauuugacuuuugaacaaaaaagguccucagguuguguggcugacccugggggcuccuaacugaugacacagcgcuccuuguccuuagccuggcugccgacacugguuuuuucacgaauguacaugaggucgcugugcacgcugggucugcgagcaaagggcgccaagaugccaaaggcaucgccguggucgcccccgccuccgcugcccgcacgcagaagcuucuuguuccucagagccuucuugugcaguacgucgcaguacugcacagauaccuugcggugcaagucggggcucaucucgcuaggcagcuuggccauggcaaagagcgcacggaacaucugguccaagcugcuguucuucuuggcugagaucucgaaguaggcacaacgcugagggucgucacccaccagcugcucaaucucccgcugcucuacuucccgguagaagucccgguccccuuuguuaccgcaaaugaccagcggcacguccacauucucuuugguuuuguucuugagacaggacuuggugucuaggaucugcuguuugagccuuugcaccucuucgaaugagucgcgguugucuaagcugaacaccagaaugaaaacgucuccuauaagggaacgagugggaaaggugaggacagcugccaggcacagagcugcagacaccccaggugaaggggcaagccccaagcacaacacaccagccccauccacuccccucaagacuccggucccccuauccccgucgacuccccacucaccugugaggauagagaggcgccgcauggcgggaaacggaugauugccggauguguccaguauguccaacugguagacuucgccgcggaucgaguaaaacuuucgguggaaguccucgaugguagggguguaagcauccucgaaacggcccgugaggaagcgcgacacaauggccgucuugcccacuuuggaugagccgaggaugaccauccuguagcaguucuuggccgggauacucaguucagagucgcuugggcacaucuucuugaucaucgcggccaguuucauuggguagaggggccccaggggcggaugcguggccgagagaagguagagagagggcugcagagaacuccggagugacggaagagcuuggcuucgggacugcgcgagcuggucugggcucuuggguacagacagcaggcucaggcuuuccgcgccccacaccgcccuuauauucaguuggccgaagcccggccaggcaccucccagcuaaggugcgucacgucccgcccccggacgcgcccagcuccuccuagacgcagcgaccuccgccuuggagccugaggcuccucuucagaccuacgugcgcugaaaggaaaacuaaauccaaacuacggccagugggauccggcgcuucccacuuuuggccgcagagguccuggcugugccuuugauucacuuaccucugggaucuccauucucuuaacacuagugcacagacacccacuuuucuugggccuuaguuuccccaaaaaauauuaucugaugauagcaacagauuugcuggacauuugccccagggccaaccccuuagguccccggacucuuggugcucuccugggcuuaguguccgguguuuguggguuuucuauguuaucguccgcgcuuugcgcuucagccaccagagggaagca

SEQ ID NO: 10518 - RNA, 2501 nt, Mus musculus
ugcuucccucugguggcugaagcgcaaagcgcggacgauaacauagaaaacccacaaacaccggacacuaagcccaggagagcaccaagaguccggggaccuaagggguuggcccuggggcaaauguccagcaaaucuguugcuaucaucagauaauauuuuuuggggaaacuaaggcccaagaaaagugggugucugugcacuaguguuaagagaauggagaucccagagguaagugaaucaaaggcacagccaggaccucugcggccaaaagugggaagcgccggaucccacuggccguaguuuggauuuaguuuuccuuucagcgcacguaggucugaagaggagccucaggcuccaaggcggaggucgcugcgucuaggaggagcugggcgcguccgggggcgggacgugacgcaccuuagcugggaggugccuggccgggcuucggccaacugaauauaagggcgguguggggcgcggaaagccugagccugcugucuguacccaagagcccagaccagcucgcgcagucccgaagccaagcucuuccgucacuccggaguucucugcagcccucucucuaccuucucucggccacgcauccgccccuggggccccucuacccaaugaaacuggccgcgaugaucaagaagaugugcccaagcgacucugaacugaguaucccggccaagaacugcuacaggauggucauccucggcucauccaaagugggcaagacggccauugugucgcgcuuccucacgggccguuucgaggaugcuuacaccccuaccaucgaggacuuccaccgaaaguuuuacucgauccgcggcgaagucuaccaguuggacauacuggacacauccggcaaucauccguuucccgccaugcggcgccucucuauccucacaggugaguggggagucgacggggauagggggaccggagucuugaggggaguggauggggcugguguguugugcuuggggcuugccccuucaccuggggugucugcagcucugugccuggcagcuguccucaccuuucccacucguucccuuauaggagacguuuucauucugguguucagcuuagacaaccgcgacucauucgaagaggugcaaaggcucaaacagcagauccuagacaccaaguccugucucaagaacaaaaccaaagagaauguggacgugccgcuggucauuugcgguaacaaaggggaccgggacuucuaccgggaaguagagcagcgggagauugagcagcuggugggugacgacccucagcguugugccuacuucgagaucucagccaagaagaacagcagcuuggaccagauguuccgugcgcucuuugccauggccaagcugccuagcgagaugagccccgacuugcaccgcaagguaucugugcaguacugcgacguacugcacaagaaggcucugaggaacaagaagcuucugcgugcgggcagcggaggcgggggcgaccacggcgaugccuuuggcaucuuggcgcccuuugcucgcagacccagcgugcacagcgaccucauguacauucgugaaaaaaccagugucggcagccaggcuaaggacaaggagcgcugugucaucaguuaggagcccccagggucagccacacaaccugaggaccuuuuuuguucaaaagucaaaucggauuccuggacuagcgguccgugccacaggagcgccaauuggccuucuccuucccucccugagacccagcccggggagaccaagccaguaagggacagucaccugcugugaaaggaaagagaacuagcuaagacaggagcugucaccuccgauucugggaugccaggacccagcagaggggcgcuuggcauuuuucucaagagguuugagaaaaagcgugugaaguucaucagccugugagacuuaaaguaacuguccugcucgcuucagggcaggacuaauaauagggcauuaucuugucugugauugguguugccauggccgcugucagccaccucuguccucagcaaacuggaaacuuuggcuggaggugggggggggggguguucaaucauagccaagugacuuguuuacaugugugugugcaauuacccaaaagaaaaacaaaacacaaaacuugcacuuuaauaguuccagugucaaugugacaugaacaaaaucucuacauuucuauugugugaggucuuuauuauuauuuuuuauuuaaaauaaaauaauuuagaaacggaaaauggugcuuugcuuuuagguuuccugccucagugcucagugccaguggccaagaacuggagagggaccuggcuuucggaaaauggccucccacuuccaagugggaccugcucuagaccuccuggcucuguuuacccucugccucacuuggccuauaccagggggccuuguuuuggagaauauucauacucuccuccacaggccaccugcuaaucauggcaggugacaggaagcugucacacuccgacu

SEQ ID NO: 10519 - RNA, 2501 nt, Mus musculus
gggugggcuggagaaggguaggaauacagaagcugggaccagagggaaucaggaaguggggaucuggggguguuaaggcugcuaaggacuaagcugagcuggagaggucugagaacccccaauccggcaagggguggacuggcugggcguuagacucaggcaaucauacaggcgcugucaaucugacagcgcccagagaccuagggguggaggaggaggaaggaggaaaggagagagggagugcgaggaaggggcgucuccucugucguccgcgcccucuccaguguauugggcggugccucgucaccuuuuuuuuuuuuuuuugucccggucccaccccuucugccucucuagcccggccccugcgccucugcucugcacccuagagcggauccccgcguuggucuggccugggccguugacgucaccaccaaguuugcuguccuucgcgucccacguguggcgguagcggcugaggaggcugcggggagagcccaagagcacaguggcagcgguggcugacaggucccgcacagcggggccccuccaagcuguucccagcuggggccccagaggaguggguagacuuccggagcgcucaagaggccagaaggcuugagucccauucggauagagggacuagggggacuuugcuugcucgguugcugagacgagcugagccaggacucagggcacgcuccugggcgggccaggagagcagaagcuggaaaaagggucacucguucuaaccggagcguacacaauucuucggcccgagaguccugcgcccgcuccacgggggacugagccaaggauguguuaucgcugagccaaguuccgcaccgcucaggacccugcugagccgagcaccuucgccacugccgccgcagagacucccuugccgggcgacucucggagacccagggcgcggagcucugcgcagcuaggcucaggacucgggcgcguuucagacccaagaccaugguuucuuaagcacggccccgcaccccuuuccuccucgucgcccgaagcccaggaccccaagaagggcucgcagugcuuggucccuaguuccagccccugcugccgcccagcggggcagcucucaggcacgcagggcggcucaggcgaugcggccgcggggcagcacgcuggcuggcagcggggauggcggagcucccagcacagucguggccuagcauggcccgcucgccguccgaggucgccucuggcuaggauggcccccucgggucccaccggcgcccagcccagcccggcggagccacugucgcgcagcaucuucaggaaguucuugcugaugcucugcucgcuacucacuucccucuacgucuucuacugccuggcggagcgcugcccacccggcucgggccccgucgcgggggucccggggcgcggcgucccugcaggacccagggaacuggcgauguggcccgcgggagcgccaaggaagcgccuccugcagcugaggcaacggaggaggcgcgggcggucggggccaggagacagcagcgaccaggaggagcagagcccugggcuggccgccgcaccaggaggcuccggggcgggaagcagcguggccgaggcccagccggggacccuggccuuacuucuggacgagggcagcaagcagcugccgcaggccaucaucaucggcgugaagaagggcggcacgcgggcgcugcuggaguuccugcgcgugcaccccgacgugcgugccgugggugcugagccccacuuuuuugaccgcagcuaccacaagggccucgccugguaccggugagcgcggggacccccauggguacuucugagcgcuggcugugcagagggggagacuaggaagggauggcaaagggggagcaguagcuguucccaucuugggcucccguucuucucccuuggggaggggcagauggagagaggaauggagaucuugauuuuaauugucagggcuccccaguuccccaaacaucuuauuccuugaaaucgcccuaguaauuagauaaaggaaaagaaaaggaaagaggagaguuuccuuuuaaguuagaaaacuguuccucauuacugggcuuaccaagggaagccuaugucuauuccuuuaucuuugggguaauucccugugguuaacaugggucuuugcuccgguauuuauuugccuugacccuuugccagauaguuguccaaggugguaagucauauagaaacuuaguaaaagugucaagagucccuguaguuuggauaaucuaugccucaucacgugccagcaacgacuaacuggguuuuaaagaacacuuuguugguaauacuaucagccugacagaaauuuuucuaaagaucuccuaacuauuaucuuuacaaauaagauaguuaauuuuaaaggggggggggaaaucaugggaaaaugcgcuggauacaauuuaggaaguaaauguuauuuacaggauaagcugauuugccagugucaaauucagaucaccuauaau

SEQ ID NO: 10520 - RNA, 2501 nt, Mus musculus
auuauaggugaucugaauuugacacuggcaaaucagcuuauccuguaaauaacauuuacuuccuaaauuguauccagcgcauuuucccaugauuuccccccccccuuuaaaauuaacuaucuuauuuguaaagauaauaguuaggagaucuuuagaaaaauuucugucaggcugauaguauuaccaacaaaguguucuuuaaaacccaguuagucguugcuggcacgugaugaggcauagauuauccaaacuacagggacucuugacacuuuuacuaaguuucuauaugacuuaccaccuuggacaacuaucuggcaaagggucaaggcaaauaaauaccggagcaaagacccauguuaaccacagggaauuaccccaaagauaaaggaauagacauaggcuucccuugguaagcccaguaaugaggaacaguuuucuaacuuaaaaggaaacucuccucuuuccuuuucuuuuccuuuaucuaauuacuagggcgauuucaaggaauaagauguuuggggaacuggggagcccugacaauuaaaaucaagaucuccauuccucucuccaucugccccuccccaagggagaagaacgggagcccaagaugggaacagcuacugcucccccuuugccaucccuuccuagucucccccucugcacagccagcgcucagaaguacccauggggguccccgcgcucaccgguaccaggcgaggcccuugugguagcugcggucaaaaaaguggggcucagcacccacggcacgcacgucggggugcacgcgcaggaacuccagcagcgcccgcgugccgcccuucuucacgccgaugaugauggccugcggcagcugcuugcugcccucguccagaaguaaggccaggguccccggcugggccucggccacgcugcuucccgccccggagccuccuggugcggcggccagcccagggcucugcuccuccuggucgcugcugucuccuggccccgaccgcccgcgccuccuccguugccucagcugcaggaggcgcuuccuuggcgcucccgcgggccacaucgccaguucccuggguccugcagggacgccgcgccccgggacccccgcgacggggcccgagccgggugggcagcgcuccgccaggcaguagaagacguagagggaagugaguagcgagcagagcaucagcaagaacuuccugaagaugcugcgcgacaguggcuccgccgggcugggcugggcgccggugggacccgagggggccauccuagccagaggcgaccucggacggcgagcgggccaugcuaggccacgacugugcugggagcuccgccauccccgcugccagccagcgugcugccccgcggccgcaucgccugagccgcccugcgugccugagagcugccccgcugggcggcagcaggggcuggaacuagggaccaagcacugcgagcccuucuugggguccugggcuucgggcgacgaggaggaaaggggugcggggccgugcuuaagaaaccauggucuugggucugaaacgcgcccgaguccugagccuagcugcgcagagcuccgcgcccugggucuccgagagucgcccggcaagggagucucugcggcggcaguggcgaaggugcucggcucagcaggguccugagcggugcggaacuuggcucagcgauaacacauccuuggcucagucccccguggagcgggcgcaggacucucgggccgaagaauuguguacgcuccgguuagaacgagugacccuuuuuccagcuucugcucuccuggcccgcccaggagcgugcccugaguccuggcucagcucgucucagcaaccgagcaagcaaagucccccuagucccucuauccgaaugggacucaagccuucuggccucuugagcgcuccggaagucuacccacuccucuggggccccagcugggaacagcuuggaggggccccgcugugcgggaccugucagccaccgcugccacugugcucuugggcucuccccgcagccuccucagccgcuaccgccacacgugggacgcgaaggacagcaaacuugguggugacgucaacggcccaggccagaccaacgcggggauccgcucuagggugcagagcagaggcgcaggggccgggcuagagaggcagaaggggugggaccgggacaaaaaaaaaaaaaaaaggugacgaggcaccgcccaauacacuggagagggcgcggacgacagaggagacgccccuuccucgcacucccucucuccuuuccuccuuccuccuccuccaccccuaggucucugggcgcugucagauugacagcgccuguaugauugccugagucuaacgcccagccaguccaccccuugccggauuggggguucucagaccucuccagcucagcuuaguccuuagcagccuuaacacccccagauccccacuuccugauucccucuggucccagcuucuguauuccuacccuucuccagcccaccc

SEQ ID NO: 10521 - RNA, 2501 nt, Mus musculus
agauacaacggcgccgucuuuucccacagccagccaguagaauccgguagaucugcucugcaccuuuagggguugggagaagauuauaauauucagccuggaggcagaagcaugccaacauuuauuucaggguugguggggcuauagugaaccuccaagaaaucuacuagucuaggagacccccaaauuucaugccuaagugauuucuucccaguucacuuagacucucuuccccuaauaaucuccucccuccaguugggucccgccuuauuauacagcuuuaugguccuuaaaccagccuguggccccuuccuccccucacuucccacauuuggggcuaguuccuccccuuccccucccccuucacucccugccuuuccgggagccucgugccgggguccuugagcugggcaucuaggggcugaagggggcggggccgggcccuagcccuccuacccugcagcggcgggauauaaggaucuaggcagcacgcgcugaguccaccgaaggguccggaggagcaauggucacccgggagcgagcugagaauagggacggccccaaggugagaggugggaagggagggaaauagggucccuguucaggccagaggacuuaaagguucuaacucugugggcuaggaaugaggauggagacacaagagugaaaagaccgaaagaaccuguaaaguauaaagagggcagggucagagcccaacuugcgcgggcugcggaagcggaggucuagggguuugcauuauugugggcuaaggcuuguggcuaggaaagugccagaauuugggcaucguggccuauucuagggcucgggaagcuggggcagguggauuaucgcaaguucgaggccacagagugcaccccuaccgaaaaaacaaacaaacaaacaaacaaaaaccaaaccaaaauaaaacaaacaaacaaaaccccacgaagcuauacuauaacaugagauaagcuagaggccauagcugguggaggaggguggaaacaaaaauagaggaaaggcuauggacgcugucuguaagcgccugggaacccacaucugacucaaagagaagaccuuugagucguugguuccggaggugcgaggccaggugagagauauuaggagaacgagugaaggguuugagugagaagaggagguguggucgcacugugugucugccuuucaccuuaggucucuaucgcgcggcucacuagccugggggcaaagaguggcccuaaaguucuucagugauacacugagagggagacgacacaagauagagauauaaagagaaaagaagagugccauagaggggagaagagaggagaaagcugaacacagaaagggcagggagaagugggcgagccacggaaagcgacccaagggacugggaaguagcagggagugagagggaaacgaauggaccagacccaagcagccugggauuaggggaaaggggcgcaugggggguuuucccagcggcaggaucggacgcuugcgcggcggcgcugagucucgguccggucggcccgcucuuccuuucccgcuggucacagaugcugaagccguugguggagaagcggcgccgggaccgcaucaaccgcagccuagaagagcugaggcugcugcuccuggagaggaccagggaccaggucaguuccaccgcuggccccaggccccuaagcauucuguaccugugucccagagcuuucuacugggguggggacauaagcuggaguggugacucuggacccaagccugcuccuugaaaucccaucccagacccccucucgcucucagaacuugcucuucuccaccuugcuggucuguaaguuuccagucuggcucgguaaacugagcuuccagccugcgucaguuucccacuugggguuuucuaaaauuccuuaucuaccucccacgccugaucaaugggcuucaguucugcggugguuuucaccauccggguugcuguuucguacaccucucauauugggaacugguuccacucccucagguuggacaggcucaucucggggugggacgggaacuuuucuuggccaucuccacauucggucgcgagucaugggggcacccgcagcucccguauccgccccucccuucuuccccuagccacuuucccccucucuccccaccccuuucugucucugcgccccuccccccgucuguagaaccuccggaacccgaagcuggagaaagcggagauacuggaguucgccgugggcuacuugagggagcgaagccggguggagcccccggguacagcgcgggggguggggcagcggagggaggcugggagggugggagcccggaaggcuccggccgggggaggggcgggcucugagguggccugggacuugggggagcggccagcugugcaccauggcgagguuaauaacacccgcgcgugucugucucugugucucccucauugcccuccucugcacguccauccggccuccugucucugucugugcgcc

SEQ ID NO: 10522 - RNA, 2501 nt, Mus musculus
ggcgcacagacagagacaggaggccggauggacgugcagaggagggcaaugagggagacacagagacagacacgcgcggguguuauuaaccucgccauggugcacagcuggccgcucccccaagucccaggccaccucagagcccgccccucccccggccggagccuuccgggcucccacccucccagccucccuccgcugccccaccccccgcgcuguacccgggggcuccacccggcuucgcucccucaaguagcccacggcgaacuccaguaucuccgcuuucuccagcuucggguuccggagguucuacagacggggggaggggcgcagagacagaaagggguggggagagagggggaaaguggcuaggggaagaagggaggggcggauacgggagcugcgggugcccccaugacucgcgaccgaauguggagauggccaagaaaaguucccgucccaccccgagaugagccuguccaaccugagggaguggaaccaguucccaauaugagagguguacgaaacagcaacccggauggugaaaaccaccgcagaacugaagcccauugaucaggcgugggagguagauaaggaauuuuagaaaaccccaagugggaaacugacgcaggcuggaagcucaguuuaccgagccagacuggaaacuuacagaccagcaagguggagaagagcaaguucugagagcgagagggggucugggaugggauuucaaggagcaggcuuggguccagagucaccacuccagcuuauguccccaccccaguagaaagcucugggacacagguacagaaugcuuaggggccuggggccagcgguggaacugaccuggucccugguccucuccaggagcagcagccucagcucuucuaggcugcgguugaugcggucccggcgccgcuucuccaccaacggcuucagcaucugugaccagcgggaaaggaagagcgggccgaccggaccgagacucagcgccgccgcgcaagcguccgauccugccgcugggaaaaccccccaugcgccccuuuccccuaaucccaggcugcuugggucugguccauucguuucccucucacucccugcuacuucccagucccuugggucgcuuuccguggcucgcccacuucucccugcccuuucuguguucagcuuucuccucucuucuccccucuauggcacucuucuuuucucuuuauaucucuaucuugugucgucucccucucaguguaucacugaagaacuuuagggccacucuuugcccccaggcuagugagccgcgcgauagagaccuaaggugaaaggcagacacacagugcgaccacaccuccucuucucacucaaacccuucacucguucuccuaauaucucucaccuggccucgcaccuccggaaccaacgacucaaaggucuucucuuugagucagauguggguucccaggcgcuuacagacagcguccauagccuuuccucuauuuuuguuuccacccuccuccaccagcuauggccucuagcuuaucucauguuauaguauagcuucgugggguuuuguuuguuuguuuuauuuugguuugguuuuuguuuguuuguuuguuuguuuuuucgguaggggugcacucuguggccucgaacuugcgauaauccaccugccccagcuucccgagcccuagaauaggccacgaugcccaaauucuggcacuuuccuagccacaagccuuagcccacaauaaugcaaaccccuagaccuccgcuuccgcagcccgcgcaaguugggcucugacccugcccucuuuauacuuuacagguucuuucggucuuuucacucuugugucuccauccucauuccuagcccacagaguuagaaccuuuaaguccucuggccugaacagggacccuauuucccucccuucccaccucucaccuuggggccgucccuauucucagcucgcucccgggugaccauugcuccuccggacccuucgguggacucagcgcgugcugccuagauccuuauaucccgccgcugcaggguaggagggcuagggcccggccccgcccccuucagccccuagaugcccagcucaaggaccccggcacgaggcucccggaaaggcagggagugaagggggaggggaaggggaggaacuagccccaaaugugggaagugaggggaggaaggggccacaggcugguuuaaggaccauaaagcuguauaauaaggcgggacccaacuggagggaggagauuauuaggggaagagagucuaagugaacugggaagaaaucacuuaggcaugaaauuugggggucuccuagacuaguagauuucuuggagguucacuauagccccaccaacccugaaauaaauguuggcaugcuucugccuccaggcugaauauuauaaucuucucccaaccccuaaaggugcagagcagaucuaccggauucuacuggcuggcugugggaaaagacggcgccguuguaucu

SEQ ID NO: 10523 - RNA, 2501 nt, Mus musculus
gcugcauccccacucgcaaguccagccucgcgccucugccgccccaacgcgugccucggaagggagcggcccaucugcgcgugacgccucgagggcggggccucacuauuaaaaggggacagaggcggcggcgcgggccccaggccccugcccuggcccaaggagggcucauucguucuguauccuagccgccuagagaucgaagcccucgggccacggugaccacgaugcagcucuugaugagagugcccucucuucccgagcugggugagcuggacugcaacaucuguuuccgacccuacaaccucggggcccgugcgccccgccgccugccuggcacggcgcgcgcccgcugcggccacacgcugugcacagcuugccugcgcgagcuggcagcgcggggcgacggcagccgcacggccgcgcgcguggugcgccugcgccgcgcugucacgugcccguucugccgcgcgccuuccccgcucccgcgcggcggcgucacggagaucgcgcuagacccugucuuguggucacggcuggaggaaaaagcccgggcugagcgugaaggagacccgauggggagcccggccaaagacagcggagaggauggagaggacgacgacggggaagcggagagcgagaagggggcgggaccuccaagugcggguuggcgcgcgcuucgccgaauuuuggacaggguccuggcgccggcacgccgcuugcggcguccguugccuagcaauggugaggggcggccuagggaggauacuggguacauugcaccgaagaaugcugggucaaguugcauccuccuguugccacuaacccuucuucuuuccuccagugcucuacuguccagaggucaaggacauugcccacaugacccguuguacgcuguaaccaaggaaccccagagcuauggcagaaagcaggugggagcagcauccucaggcgugcucugacacaaaagguugaugucaagacuaccuggaaaucaaggcugaugcuggaauugguacaugcgugauggagauggagcucaacagaaaggacccuagaugguguggauucugagcggcgaaggcuccuagacugugccagcauuauauuuucaggauggaguggccaagggauaauagaaacaaagccuaccauaauguaggaagaaaaaaaaaauaacaaagcuuuggcguuuguucagagucugugguguaagcaaaggauccaauuuuagcaguggucugugguugacaauguguacuguggaaaaaaggacaggacaggggauaagcuaauuuauaugucaugucaaucucacuuaucugguuguguuugcuggcaugccaucuucccacucuuguuaccgugcuccagcaauuacugaguugacucccugcuuaugauugggaaucuugcauauacaaccucccuucagcuggauagggcagguaugaaaacauccaaggggcauuuauuuacaugaggccuuauuaaaggcuuaucaaagaugggugagccauuugauaaaggaagcaaaauuuaggccuuuguuaucuuuacugacucuguagcaauacuggggaaaagaaaaaaaaagaugcucacauaauuuuaauuugugucccauaaugggacauuguuuacuguauguaguuaguucuauucuaaaguccuguaaauaucuuacuguagacuuaaaaucaagaccagcaguguugguuggucucacagcuugcuagaaaugcagaauuucaggaccccaguccacauuccccgguaguuuuagaaucccagguauguguauguaaguuaagaaucacugguuuagcucuuagucacucugagauggcaucaucagcuguagguggaacauuuaaaacacuagugacgcauuaaagugccaaagugacauucuuuugagaaaaauuuuucugagcuacaaaugugaauuuacaaggccucaguuuucagaggucuucaagauuuuguuuuuaaugacaaauaauguauguaguucuaggguauaaaccuccauuuguaaaauguuuugucuuuuuccuguccuucgguuccagcugaaaucuccccuuuuggaggccagcaugcaucugugggaauguguauguuuucucuauacguguugccaaagggaaugcuauguuuauuuucugcuauuuuauguuuugaguauuucuagaguauaaauuucaagugacuaucuccagagccgauagcaguguuaauguuauauguauucaaaaaaaaauguuugcugaauuuauuuugaauguaauagucucuagaauaaaguaucugggcucauucaaucugugaaagacuguuauugaauaacguuauugacuaagacggaguucuguccaacaguucagggacaccacagucaucccaguucuuuaaaacaaaauaaaacaaggugucugcuccacaguggagcuguggugcuguggugaccucugcugacucuggggagguggcuuuca

SEQ ID NO: 10524 - RNA, 2501 nt, Mus musculus
ugaaagccaccuccccagagucagcagaggucaccacagcaccacagcuccacuguggagcagacaccuuguuuuauuuuguuuuaaagaacugggaugacuguggugucccugaacuguuggacagaacuccgucuuagucaauaacguuauucaauaacagucuuucacagauugaaugagcccagauacuuuauucuagagacuauuacauucaaaauaaauucagcaaacauuuuuuuuugaauacauauaacauuaacacugcuaucggcucuggagauagucacuugaaauuuauacucuagaaauacucaaaacauaaaauagcagaaaauaaacauagcauucccuuuggcaacacguauagagaaaacauacacauucccacagaugcaugcuggccuccaaaaggggagauuucagcuggaaccgaaggacaggaaaaagacaaaacauuuuacaaauggagguuuauacccuagaacuacauacauuauuugucauuaaaaacaaaaucuugaagaccucugaaaacugaggccuuguaaauucacauuuguagcucagaaaaauuuuucucaaaagaaugucacuuuggcacuuuaaugcgucacuaguguuuuaaauguuccaccuacagcugaugaugccaucucagagugacuaagagcuaaaccagugauucuuaacuuacauacacauaccugggauucuaaaacuaccggggaauguggacugggguccugaaauucugcauuucuagcaagcugugagaccaaccaacacugcuggucuugauuuuaagucuacaguaagauauuuacaggacuuuagaauagaacuaacuacauacaguaaacaaugucccauuaugggacacaaauuaaaauuaugugagcaucuuuuuuuuucuuuuccccaguauugcuacagagucaguaaagauaacaaaggccuaaauuuugcuuccuuuaucaaauggcucacccaucuuugauaagccuuuaauaaggccucauguaaauaaaugccccuuggauguuuucauaccugcccuauccagcugaagggagguuguauaugcaagauucccaaucauaagcagggagucaacucaguaauugcuggagcacgguaacaagagugggaagauggcaugccagcaaacacaaccagauaagugagauugacaugacauauaaauuagcuuauccccuguccuguccuuuuuuccacaguacacauugucaaccacagaccacugcuaaaauuggauccuuugcuuacaccacagacucugaacaaacgccaaagcuuuguuauuuuuuuuuucuuccuacauuaugguaggcuuuguuucuauuaucccuuggccacuccauccugaaaauauaaugcuggcacagucuaggagccuucgccgcucagaauccacaccaucuaggguccuuucuguugagcuccaucuccaucacgcauguaccaauuccagcaucagccuugauuuccagguagucuugacaucaaccuuuugugucagagcacgccugaggaugcugcucccaccugcuuucugccauagcucugggguuccuugguuacagcguacaacgggucaugugggcaauguccuugaccucuggacaguagagcacuggaggaaagaagaaggguuaguggcaacaggaggaugcaacuugacccagcauucuucggugcaauguacccaguauccucccuaggccgccccucaccauugcuaggcaacggacgccgcaagcggcgugccggcgccaggacccuguccaaaauucggcgaagcgcgcgccaacccgcacuuggaggucccgcccccuucucgcucuccgcuuccccgucgucguccucuccauccucuccgcugucuuuggccgggcuccccaucgggucuccuucacgcucagcccgggcuuuuuccuccagccgugaccacaagacagggucuagcgcgaucuccgugacgccgccgcgcgggagcggggaaggcgcgcggcagaacgggcacgugacagcgcggcgcaggcgcaccacgcgcgcggccgugcggcugccgucgccccgcgcugccagcucgcgcaggcaagcugugcacagcguguggccgcagcgggcgcgcgccgugccaggcaggcggcggggcgcacgggccccgagguuguagggucggaaacagauguugcaguccagcucacccagcucgggaagagagggcacucucaucaagagcugcaucguggucaccguggcccgagggcuucgaucucuaggcggcuaggauacagaacgaaugagcccuccuugggccagggcaggggccuggggcccgcgccgccgccucuguccccuuuuaauagugaggccccgcccucgaggcgucacgcgcagaugggccgcucccuuccgaggcacgcguuggggcggcagaggcgcgaggcuggacuugcgaguggggaugcagc

SEQ ID NO: 10525 - RNA, 2501 nt, Mus musculus
aggacgccacacaaagacccaucucgaccuuaggcucguucauucuccucucuuacaggcauccagugccggggaucaaaaccagauccggaguucagaacaguuaggcgagaguuaccgacgcccuaacucaccugacaagccccucuccccucuuuuucacaccuugccgcaggcagcccugcgggcagcccucucucuccucaggaucuuuaauucuucccccacuccaagggaauccugagggcucgcuggaauaacuuuuuucuaaacuuuuccucuuuuacagguaaaccugacgagguuaggggugaggcuuuacccaauacgcauuaaacacauuauuuuuaacaccccccacccccggaaaagcugucucaacacgugcgacaaaaagucacaguggucaguaagacaguuuuacaaauaacguuuuaaaguuuggugugugugugcugcucugccgccagagacuuggggguguggauguccccaaucagagguuggcgacaccuauccuaaagaagcuagaaaucacucuccacuuggaggguggucugagaguugcgccacugauccagagaagggucugucccaagcacagcuggacguccuacgccaguggcaggugacuugucaucucggagaagggugcugagugaugauggucaggacagagcagcugggugggcaguucacgccccccaacguggucagggugugugggugguuucaucaagagagugacagugaauggcagccacgugagagucacagcugggcaguucggccaccccagacugacggggucacgagggggggaugggggcugcacuugacacaaaagagcccggggcagagaugacgaggguggggccgggggcaucuggcuccccagacauucuccugucucucuucaaaucugaggugacccgagaccucggcggccagcuaggggggaguggacgguauguccaagucuuacuccaggaaguggucugcguggaguguggccaccaccugccucuggucaucagccgcuacaaacauucgcacgcccccucccacgcgugccaccgcacaccccuaaguuggcgggcaccgaagucccugcagguggaggggcugguccgcgggccacugucccaccucugcuugcccaaguccccagcggagggcgucggguggcagucagcuccacaccccgaacccacucggcuucaguccgaccccaccggggcccggcccaaggggcgcucacgcggccgccccucccccacgcgccccuccccccacgccgccguccggucgccggggucuccgcggucccucgcucggccugggaggggggcccuggcuucgcuacggccguuuccugccuacccccuccccgccgagggugaaaaaaauaaaucuccucccccgaaagccgcgaccaaguggcccgguccgcgcgcgcagcucgcucccugcgcucuccagcccgggcgcggcggcggcggcggcggcggcgguggcggcggccgcgguagcggcggaggaggggugcggcgggggaggggaggaggccuggccccaaggccgccgccgcccggacugccgggcccgucuagacccgccaggcgcccgggacucuccucggcucggccgaaccguaggugccgggccccgcggcuccgcucgggccccggggagucggacggacgcuuaccugguggcgggggcggcggcagcggcggcggcggcggcgggaagagguggcagcugggggggcuguggcggucgcggcuccggucguggcccggcccgcgcccgaguacucccucuucguccuccuccucaucguccucgucggccgccuccaccuccuccuccuccucgucgcccucuucuuccuccucuucuuccuccuccgacaccaccaucuccuccuccuccuccuccucgucccucagaggggaagccauccuguggcucuggcccccccaccacccccccacccaccgcccgcccgccucccccaccgcuaccaccaccaccuccuccuccuccuccuccuccuccuccuccuccucggcggcggcguccuccuccuccuccuccucaccgccucccccagccccccaaacccccgggccaccccccuccagaacacccacccccggggccggcgucugaggaggggggccgcaccacccccaaaaauguucuuggaaaaauuuaaggacuuuuucccccuucugucuuuccucccaagagaacaagaaagggagaucguuuaaaaaaaaaaaauuauauauauguauauaaaaguuuucgacuucucucuaccccccucgguugcuuuaaauauauuuaaauucugaggggggcgcucagaaauauuucucagagcugaggcacuaagauggccgccuugaaauuauuuuuaaaacaacccccccuccagcacugccaccccccucuauaaagaaagagagagggggguaaaauccccuuuu

SEQ ID NO: 10526 - RNA, 2501 nt, Mus musculus
aaaaggggauuuuaccccccucucucuuucuuuauagagggggguggcagugcuggaggggggguuguuuuaaaaauaauuucaaggcggccaucuuagugccucagcucugagaaauauuucugagcgccccccucagaauuuaaauauauuuaaagcaaccgagggggguagagagaagucgaaaacuuuuauauacauauauauaauuuuuuuuuuuuaaacgaucucccuuucuuguucucuugggaggaaagacagaagggggaaaaaguccuuaaauuuuuccaagaacauuuuuggggguggugcggccccccuccucagacgccggccccggggguggguguucuggagggggguggcccggggguuuggggggcugggggaggcggugaggaggaggaggaggaggacgccgccgccgaggaggaggaggaggaggaggaggaggaggaggaggugguggugguagcggugggggaggcgggcgggcgguggguggggggguggugggggggccagagccacaggauggcuuccccucugagggacgaggaggaggaggaggaggagaugguggugucggaggaggaagaagaggaggaagaagagggcgacgaggaggaggaggagguggaggcggccgacgaggacgaugaggaggaggacgaagagggaguacucgggcgcgggccgggccacgaccggagccgcgaccgccacagcccccccagcugccaccucuucccgccgccgccgccgccgcugccgccgcccccgccaccagguaagcguccguccgacuccccggggcccgagcggagccgcggggcccggcaccuacgguucggccgagccgaggagagucccgggcgccuggcgggucuagacgggcccggcaguccgggcggcggcggccuuggggccaggccuccuccccucccccgccgcaccccuccuccgccgcuaccgcggccgccgccaccgccgccgccgccgccgccgccgcgcccgggcuggagagcgcagggagcgagcugcgcgcgcggaccgggccacuuggucgcggcuuucgggggaggagauuuauuuuuuucacccucggcggggaggggguaggcaggaaacggccguagcgaagccagggccccccucccaggccgagcgagggaccgcggagaccccggcgaccggacggcggcguggggggaggggcgcgugggggaggggcggccgcgugagcgccccuugggccgggccccgguggggucggacugaagccgaguggguucgggguguggagcugacugccacccgacgcccuccgcuggggacuugggcaagcagaggugggacaguggcccgcggaccagccccuccaccugcagggacuucggugcccgccaacuuaggggugugcgguggcacgcgugggagggggcgugcgaauguuuguagcggcugaugaccagaggcaggugguggccacacuccacgcagaccacuuccuggaguaagacuuggacauaccguccacuccccccuagcuggccgccgaggucucgggucaccucagauuugaagagagacaggagaaugucuggggagccagaugcccccggccccacccucgucaucucugccccgggcucuuuugugucaagugcagcccccaucccccccucgugaccccgucagucugggguggccgaacugcccagcugugacucucacguggcugccauucacugucacucucuugaugaaaccacccacacacccugaccacguuggggggcgugaacugcccacccagcugcucuguccugaccaucaucacucagcacccuucuccgagaugacaagucaccugccacuggcguaggacguccagcugugcuugggacagacccuucucuggaucaguggcgcaacucucagaccacccuccaaguggagagugauuucuagcuucuuuaggauaggugucgccaaccucugauuggggacauccacacccccaagucucuggcggcagagcagcacacacacaccaaacuuuaaaacguuauuuguaaaacugucuuacugaccacugugacuuuuugucgcacguguugagacagcuuuuccgggggugggggguguuaaaaauaauguguuuaaugcguauuggguaaagccucaccccuaaccucgucagguuuaccuguaaaagaggaaaaguuuagaaaaaaguuauuccagcgagcccucaggauucccuuggagugggggaagaauuaaagauccugaggagagagagggcugcccgcagggcugccugcggcaaggugugaaaaagaggggagaggggcuugucaggugaguuagggcgucgguaacucucgccuaacuguucugaacuccggaucugguuuugauccccggcacuggaugccuguaagagaggagaaugaacgagccuaaggucgagaugggucuuuguguggcguccu

SEQ ID NO: 10527 - RNA, 2501 nt, Mus musculus
aacugcgcagcacucucagccaaauucuuaucaccucagaggacucagguagcaagaucugucugucugucugucugucucucgcccugaggaagcagccccugaaaugaggggcuaauggcccagcagucacccccaccuuuaacucacacaggaucuuggccagagucaaggagaagacagaaucuccuagaagccuucccuggacaucaucucucaggacuccuauccuaagccuccagugaggaggacaugcuguuccaaucucccugaacucucagucuuucuaccuaagaagacaguuccucuguggaggcuucugaguagcccaagcauccaucguugauccuucacaucccacagggucuuggguuccuugaggacaagggcugcauugaucuccuuucaugguccccuaagccucagguggguggucugaugaagacuguguccaaucgauguggauaugucguaaauuaugucacacagaaucccuugugcuucaauucuccagcuuggcacugucuugcaagacugucagucacccuuaccucaccggguacccaucagcagccccugacuaccuaaguccuugcacacccaugagguaaggguagagaguucuuccaaggcaucugagucccauguaaacacccugccugaggauguacccauaucagcacagugaccauuacucccuccaccucugacaucugaaaaccucaagccuggaaaaauaccaucccuccuggcagccccccacccacaaagcagccacagaggacuccaaacgcccaaugguggaauacagacaaacaacuuccgcuguuaagaacccccccucccaagaccccccugccagauccgccuccucaugaauguucccaggguccaagggggugggugagagcuaaaaauaaacgagguuggcuagcuagugagagccagagggagaguuagggcacucuucggggagagggaugaugaccgugugcagccgcagggccugagccggagcgggagcgccguggcacggacacgcgcgcagagcccgcgaccccccgcccgagggggcuccgcggggggcgggcaggcggcagugaccuacuuucuccgccuccgcagcggccagucagagagauuagaccgcugauucggggccccucccgauccaaagcccgacagugggggcuggacgccagggacccggcaggggagcuggggcgacgcccgcgggacccugcgccccaaaggcaucgccgagcggucagcuaccaccuuucccgcgccagccccgcguaccccagcuggucccggugcgccccaugaacuggugcguccgcggguuccacacgaacuccuuccacuccucaaccaccugcccgcagcucuucuucucuuucuggaugaccaucuuggaggcacggggcgagucccggcgcgcugcugggggcugcggagaagccggggcgucgcgcgcugaagcccuccacgcaccaaaugcgcgcgggagcgaggcagggagacuccagucagauauacagcugcugcaaauuccggggugcacagccacgcacuguggucugcuggcagugcggcgaaggugcaccgaggcuaggccccccgacugcgauagaaaggggggcugucaaaacagggaaagauaaccagggaaagggaugccgaggcaccuucaccccacacaccgccuagaagcaaaacaaaaaggggugcaaaaccagacggcuccaaaauucgagcgaaacgcagaaaaagcggggugcaaagaagcagggaaagaugggggagggagccgccccgaaauccgagaugcaaagaggcuguagaacgcggcagguggccgauuaaggcuccuccgacaaacggcgacagccacaccacaguuggcccagccagugggagcuggggcggggacaagcaguugugggggaaagacaaggauaggggccccccaaucggaggcuccgcuccucagcagugcggggagcgcgaacccugcgcacagucuuuauagucugugacucugaggguguccgcccccuucccacccaccccucaggaaccccgccucuucguugcucgcucaggagaccucauacauaugcaaaugaagauggauuggacccgcccccuggcgccuuuuuuuuuuuuuuuuuuuuuuuuuuuuuugguccuagcggguucuuccuaccccagaccccagguacaguacugaaacaagauuggaaaagaagacaagagggugagagucuggguagaccuaaagaagagaacaccuccugagaggcucaaacugaaagacgagcugauacguacucaaaaguggggggcccggggcagggaauuuaaaaagagacuaagauagaguuacuucgaaagccuccggaacagagggcugaaugugagaggaauaaagaaaagcaagcgccagacaccaagaaagagccuagaaacuagaacauagagagggauagaagcca

SEQ ID NO: 10528 - RNA, 2501 nt, Mus musculus
uggcuucuaucccucucuauguucuaguuucuaggcucuuucuuggugucuggcgcuugcuuuucuuuauuccucucacauucagcccucuguuccggaggcuuucgaaguaacucuaucuuagucucuuuuuaaauucccugccccgggccccccacuuuugaguacguaucagcucgucuuucaguuugagccucucaggagguguucucuucuuuaggucuacccagacucucacccucuugucuucuuuuccaaucuuguuucaguacuguaccuggggucugggguaggaagaacccgcuaggaccaaaaaaaaaaaaaaaaaaaaaaaaaaaaaaggcgccagggggcggguccaauccaucuucauuugcauauguaugaggucuccugagcgagcaacgaagaggcgggguuccugaggggugggugggaagggggcggacacccucagagucacagacuauaaagacugugcgcaggguucgcgcuccccgcacugcugaggagcggagccuccgauuggggggccccuauccuugucuuucccccacaacugcuuguccccgccccagcucccacuggcugggccaacugugguguggcugucgccguuugucggaggagccuuaaucggccaccugccgcguucuacagccucuuugcaucucggauuucggggcggcucccucccccaucuuucccugcuucuuugcaccccgcuuuuucugcguuucgcucgaauuuuggagccgucugguuuugcaccccuuuuuguuuugcuucuaggcgguguguggggugaaggugccucggcaucccuuucccugguuaucuuucccuguuuugacagccccccuuucuaucgcagucggggggccuagccucggugcaccuucgccgcacugccagcagaccacagugcguggcugugcaccccggaauuugcagcagcuguauaucugacuggagucucccugccucgcucccgcgcgcauuuggugcguggagggcuucagcgcgcgacgccccggcuucuccgcagcccccagcagcgcgccgggacucgccccgugccuccaagauggucauccagaaagagaagaagagcugcgggcaggugguugaggaguggaaggaguucguguggaacccgcggacgcaccaguucauggggcgcaccgggaccagcugggguacgcggggcuggcgcgggaaaggugguagcugaccgcucggcgaugccuuuggggcgcagggucccgcgggcgucgccccagcuccccugccgggucccuggcguccagcccccacugucgggcuuuggaucgggaggggccccgaaucagcggucuaaucucucugacuggccgcugcggaggcggagaaaguaggucacugccgccugcccgccccccgcggagcccccucgggcggggggucgcgggcucugcgcgcguguccgugccacggcgcucccgcuccggcucaggcccugcggcugcacacggucaucaucccucuccccgaagagugcccuaacucucccucuggcucucacuagcuagccaaccucguuuauuuuuagcucucacccacccccuuggacccugggaacauucaugaggaggcggaucuggcaggggggucuugggaggggggguucuuaacagcggaaguuguuugucuguauuccaccauugggcguuuggaguccucuguggcugcuuuguggguggggggcugccaggagggaugguauuuuuccaggcuugagguuuucagaugucagagguggagggaguaauggucacugugcugauauggguacauccucaggcaggguguuuacaugggacucagaugccuuggaagaacucucuacccuuaccucaugggugugcaaggacuuagguagucaggggcugcugauggguacccggugagguaagggugacugacagucuugcaagacagugccaagcuggagaauugaagcacaagggauucugugugacauaauuuacgacauauccacaucgauuggacacagucuucaucagaccacccaccugaggcuuaggggaccaugaaaggagaucaaugcagcccuuguccucaaggaacccaagacccugugggaugugaaggaucaacgauggaugcuugggcuacucagaagccuccacagaggaacugucuucuuagguagaaagacugagaguucagggagauuggaacagcauguccuccucacuggaggcuuaggauaggaguccugagagaugauguccagggaaggcuucuaggagauucugucuucuccuugacucuggccaagauccugugugaguuaaaggugggggugacugcugggccauuagccccucauuucaggggcugcuuccucagggcgagagacagacagacagacagacagaucuugcuaccugaguccucugaggugauaagaauuuggcugagagugcugcgcaguu

SEQ ID NO: 10529 - RNA, 2501 nt, Mus musculus
caucuccccacugcccacccugcagcuggugucccuucucacugaaggagcugguguccucuggggugcccuggauacucccaucgggauucgccuggagguagaaacccuggcggcagaacaguuuggugacgaugccuuugagcugaggcucuggagagagagacauuuaucuuugaaaaugacaucucuguucccagaaacauuccuacacuuggcgggaucacaggaaagaagaaaggggaaaugaagagaagaggguuccagggccccagcuccuuuacccuucaagcaagcuucccuccaccucgcuuugauuccugaggaagcuggggugugggucccuuccgcuuucucuaaucaugagcgucagcuuaauuuauugaaauuuauuuaaaugguuuaauuccuuuucccuaccagaguugggggcggggaggagguagaagagagagagagagagagagagagagagagagagagagagagagagagagagagagagaaacggacagugccagaaacgcagggcaauguguuugcaaaugucggggugagcagcaaggugaccacagggaaggggcucccccucagaaguaggggugggacugggcuugacugacgcugacucagcaccugcugcugcagcugccgcucgcuuggcgcgggccuugcucuggcacagcgccggccugucugacacugacccaucugucugucugucugucagucagucggcuggcucacgaggguccaguuuucccugagacugagcuucuacccuucagccagguaacuggccugggaugggggacauuuaaaccacaucaaggaaaaggaagaggggacagagauggagaggcaggcugcaucacgugggggcugggucccacucagagggugggcugcggacuguaccacuaccuaccguugguggugggggaggagggcacaaggggcuaccccuaagggaaccggcagcggccuggagcgaggccagagggacucccuaacugucguaccuggacgggaaucacauaccagcccuuacaucucuccucuccugguggggcuugcucucugccgauuucccuguucccccuuguaagugguacgaccccccgcuuaagucccugugcaggucuucagcuugaacuaugugugaguuccuacuggcugaggguccccggagccugugggacuggauuuccgagucacacaggaguaaugggagggggugcccagcacccuucucgaagcgcaggucacagaaggagggcguacggagggggcugacugacgagguagccugcaaggacacccgggggagagcuggagagauuggcuccuggccaggcgagcucgaccaggaagaacagagccaaagcguggaggggcgggagagccggagcgggggcggggcagccagggcugcagaaacccucggggugacccaagcguccagaaccccucaagccccgccacuucggauggaaagaaucgcgagaacccgcacguaggcgaagaaccgugggggguggggaguccugugcugaaggggggcugacaggagcagagaagcuuggggcgccagacuucgccccucaaaccuucccccugcccucgaaagcaaggagacucggcauuacaggcaaagaggaagaaccugaaggauagucccguaaauucugucguucuggcccaccucuuccacuucugggacaccccccuccucaucgggcuucaaucgucagggucccuggccucaggcaggacuucugugggagaccccgcccuagccacacucaccugggccgcgguccugucgcgugggacgccccccgcacagucgcaccuuggacagcaggaugaggagcuguuucuggcaaagugacuugguaccgcggggacacacgcgccgcugcgccgacacgggccggcugcccccgggcucgcggaccucccgcuucugucggaucaggcuacuggccaacgccgccaucgcgccccgggaggagacacccccaaaccagcaggcucccggagcgcccugggcuccccaagaggagcccucucaccagggcaugcucaggacccaacccaccgccccacccacaggaucugaagagaaaccccagaccccaguacguuccccaacaccaccggcucccacccuugggcccugacuagcuccagcggcuccagcagccuaugcacuccucagcugaccucacccaugaauucuguccccuaaugaaagcuuuccccuucccuccucucuggccucuguaccagauagaagauaccuccucuaucccacagucaagacccuccuauauuucuaagauguguucucaauaccccgaggcuucuuucuacccuauuuuggggccgcuccugcccagccuacucuuacacaggguguggguccuaagcuuuguggacauuagcucacccuaggcugcugucaaugucaagaggagcccagcucuguuuucuuu

SEQ ID NO: 10530 - RNA, 2501 nt, Mus musculus
aaagaaaacagagcugggcuccucuugacauugacagcagccuagggugagcuaauguccacaaagcuuaggacccacacccuguguaagaguaggcugggcaggagcggccccaaaauaggguagaaagaagccucgggguauugagaacacaucuuagaaauauaggagggucuugacugugggauagaggagguaucuucuaucugguacagaggccagagaggagggaaggggaaagcuuucauuaggggacagaauucaugggugaggucagcugaggagugcauaggcugcuggagccgcuggagcuagucagggcccaagggugggagccggugguguuggggaacguacuggggucugggguuucucuucagauccuguggguggggcgguggguuggguccugagcaugcccuggugagagggcuccucuuggggagcccagggcgcuccgggagccugcugguuugggggugucuccucccggggcgcgauggcggcguuggccaguagccugauccgacagaagcgggagguccgcgagcccgggggcagccggcccgugucggcgcagcggcgcguguguccccgcgguaccaagucacuuugccagaaacagcuccucauccugcuguccaaggugcgacugugcggggggcgucccacgcgacaggaccgcggcccaggugaguguggcuagggcggggucucccacagaaguccugccugaggccagggacccugacgauugaagcccgaugaggaggggggugucccagaaguggaagaggugggccagaacgacagaauuuacgggacuauccuucagguucuuccucuuugccuguaaugccgagucuccuugcuuucgagggcagggggaagguuugaggggcgaagucuggcgccccaagcuucucugcuccugucagccccccuucagcacaggacuccccaccccccacgguucuucgccuacgugcggguucucgcgauucuuuccauccgaaguggcggggcuugagggguucuggacgcuugggucaccccgaggguuucugcagcccuggcugccccgcccccgcuccggcucucccgccccuccacgcuuuggcucuguucuuccuggucgagcucgccuggccaggagccaaucucuccagcucucccccggguguccuugcaggcuaccucgucagucagcccccuccguacgcccuccuucugugaccugcgcuucgagaagggugcugggcacccccucccauuacuccugugugacucggaaauccagucccacaggcuccggggacccucagccaguaggaacucacacauaguucaagcugaagaccugcacagggacuuaagcggggggucguaccacuuacaagggggaacagggaaaucggcagagagcaagccccaccaggagaggagagauguaagggcugguaugugauucccguccagguacgacaguuagggagucccucuggccucgcuccaggccgcugccgguucccuuagggguagccccuugugcccuccucccccaccaccaacgguagguagugguacaguccgcagcccacccucugagugggacccagcccccacgugaugcagccugccucuccaucucuguccccucuuccuuuuccuugaugugguuuaaaugucccccaucccaggccaguuaccuggcugaaggguagaagcucagucucagggaaaacuggacccucgugagccagccgacugacugacagacagacagacagaugggucagugucagacaggccggcgcugugccagagcaaggcccgcgccaagcgagcggcagcugcagcagcaggugcugagucagcgucagucaagcccagucccaccccuacuucugagggggagccccuucccuguggucaccuugcugcucaccccgacauuugcaaacacauugcccugcguuucuggcacuguccguuucucucucucucucucucucucucucucucucucucucucucucucucucucucucucuucuaccuccuccccgcccccaacucugguagggaaaaggaauuaaaccauuuaaauaaauuucaauaaauuaagcugacgcucaugauuagagaaagcggaagggacccacaccccagcuuccucaggaaucaaagcgagguggagggaagcuugcuugaaggguaaaggagcuggggcccuggaacccucuucucuucauuuccccuuucuucuuuccugugaucccgccaaguguaggaauguuucugggaacagagaugucauuuucaaagauaaaugucucucucuccagagccucagcucaaaggcaucgucaccaaacuguucugccgccaggguuucuaccuccaggcgaaucccgaugggaguauccagggcaccccagaggacaccagcuccuucagugagaagggacaccagcugcagggugggcaguggggagaug

SEQ ID NO: 10531 - RNA, 2501 nt, Mus musculus
ucccgcccccuacgcccgcuaaaccgcccccuuugcgggcaaccuuggcuuccucuacagccucacgcaaggccugugcaggguccccgcggagcugggccaaugccccgcgcagagcagcggagccgucucccacacggagcuuucggccgcucaaaaaauaaugaggcagcgccccggccucuagcacucggcucagcucauccaguagcccaaggcaacaagcgccggcauuuuccggccgcgccaaguagagcgccgggagccgcucgcacgcccaguagagcaagguccgcaggagguagggcgcagcggcucggguccccgccaccagcgggcgcagcagcgccugggccgccgcgugugccugaagcagcggcguggggaugcgcucuuugagcgccagcuccuggcgagcgaagcacagcugccauccagaggugcucggcugcucugggaggcugcccggcacuagguagaaagaggccgauucagagaccaguggacccgcccacgaguggcuccgagccgugucaggccagccugucacggucaccaccgggaucaagucgaagagcaggagguggcgugggggcucuggaguugccaggaggaccguggugacaccugcgugacgagcugcaugaacuagccguggggcgccugggaccgggaucagggacucagcaaccucagccaacuuaacgaagaaccaggaaguuacuugggucgggcauaaugugggccaugccuuuggagccuccgacggcuuugggacuuggcuuucgucggcguccaaggcgucgcugcucaguguuuccaauggcucaggaguuucaggauugguaauguccuuauaagacgauugggacucugaaaggucacuagaugauuuuugcaaagacauguguggcucagguucagggacauaaucaugugacggaucuacagaguuuucccggucggugggacucucuuugcuauggguuuggugagucauaucacuuucuucugggacaggagguccuaagcaauccugccaggccucccggaccaaaauuccacgcaucaguucuggaaggcggagccaugcagaacaggauuccagauccaguagcagcucgggcccagugccauccagagaaaacacaggcacaaggaguguaaagccggcaucauaaugagguccccgggaguagggaccuaagggggcgugcccuaaaucuagggaaccuucgcgaaucccaccacgaagcagcaagaguucugccugggguggaaaacgagggucuuggcggugaaccagaccuaaagaagagaaagggucgugaagguauccugguucaaagucggggcaggaaauggcgaggcugggguuugcaaauucccacacuuaccgaguagagcgaagacaaaauccuuggcucggagaagaucagcuccaggcuugggcccuucacuccaacucuccugaacacggagcuccugaauuaacugagugagcuccugcagcugggcgcccgagcagaaaucuaugucugugagaggccgggcuggggcugggggcggugguccccaccagggggcacccccccagacgguggaagccaugcuucgcuagcguuuggugcaguuagcuuuggcaggccuuucuuuugcggccccaaacuuguccaguuuuccccucccucugaggcagaucaaggguuacagacaggccacaagugggucuuggagaugaugugaucuguauuuagucuuccugaugaacaaaugacuauugccuucgguuuuuucuaagcagguugccccacgguaaaucgguucaccugacucagcagguuaaaaaaaaaaaaaaaggcuauuuggucccuccugggaauacaauagccaaucuuuaccacgagccuuugcccaccucccuuuaccucuuuuugagaagggcuuauugguccgcggcuuuccgaugaagggguagcuucaaaggugguggacagaaagcaacauaaaagauucuacagguaacuuccugguggucacauguccacgcccuuucuggaagcugucuggguggcuccggacugguuccgccuccugugagaguucguucagucacgccucucacccugcugagauguuguuacccugggaguuguaguuuguguuccacgauacaggugcagcggugccuacacacccuuuccguuguuucaaaguagugccuacuggaagcuguaguuuguuuguuuguuuuccuuuuuaucccuucaauuuauuuagcuauuugagacugggucucacugugcaccucuggauggcuuggaacuugcuauguagaccugacugacugcaucucaaacaguucauccugccucugccuccugaguucugagauuaaagacauaugguaccuuuuauacaaagucuuauguagcccaagauggccuggagucaccauguagcccaggcugacccugaacucacagcaggcuuccuauuuc

SEQ ID NO: 10532 - RNA, 2501 nt, Mus musculus
gaaauaggaagccugcugugaguucagggucagccugggcuacauggugacuccaggccaucuugggcuacauaagacuuuguauaaaagguaccauaugucuuuaaucucagaacucaggaggcagaggcaggaugaacuguuugagaugcagucagucaggucuacauagcaaguuccaagccauccagaggugcacagugagacccagucucaaauagcuaaauaaauugaagggauaaaaaggaaaacaaacaaacaaacuacagcuuccaguaggcacuacuuugaaacaacggaaaggguguguaggcaccgcugcaccuguaucguggaacacaaacuacaacucccaggguaacaacaucucagcagggugagaggcgugacugaacgaacucucacaggaggcggaaccaguccggagccacccagacagcuuccagaaagggcguggacaugugaccaccaggaaguuaccuguagaaucuuuuauguugcuuucuguccaccaccuuugaagcuaccccuucaucggaaagccgcggaccaauaagcccuucucaaaaagagguaaagggaggugggcaaaggcucgugguaaagauuggcuauuguauucccaggagggaccaaauagccuuuuuuuuuuuuuuuaaccugcugagucaggugaaccgauuuaccguggggcaaccugcuuagaaaaaaccgaaggcaauagucauuuguucaucaggaagacuaaauacagaucacaucaucuccaagacccacuuguggccugucuguaacccuugaucugccucagagggaggggaaaacuggacaaguuuggggccgcaaaagaaaggccugccaaagcuaacugcaccaaacgcuagcgaagcauggcuuccaccgucugggggggugcccccugguggggaccaccgcccccagccccagcccggccucucacagacauagauuucugcucgggcgcccagcugcaggagcucacucaguuaauucaggagcuccguguucaggagaguuggagugaagggcccaagccuggagcugaucuucuccgagccaaggauuuugucuucgcucuacucgguaagugugggaauuugcaaaccccagccucgccauuuccugccccgacuuugaaccaggauaccuucacgacccuuucucuucuuuaggucugguucaccgccaagacccucguuuuccaccccaggcagaacucuugcugcuucguggugggauucgcgaagguucccuagauuuagggcacgcccccuuaggucccuacucccggggaccucauuaugaugccggcuuuacacuccuugugccuguguuuucucuggauggcacugggcccgagcugcuacuggaucuggaauccuguucugcauggcuccgccuuccagaacugaugcguggaauuuugguccgggaggccuggcaggauugcuuaggaccuccugucccagaagaaagugauaugacucaccaaacccauagcaaagagagucccaccgaccgggaaaacucuguagauccgucacaugauuaugucccugaaccugagccacacaugucuuugcaaaaaucaucuagugaccuuucagagucccaaucgucuuauaaggacauuaccaauccugaaacuccugagccauuggaaacacugagcagcgacgccuuggacgccgacgaaagccaagucccaaagccgucggaggcuccaaaggcauggcccacauuaugcccgacccaaguaacuuccugguucuucguuaaguuggcugagguugcugagucccugaucccggucccaggcgccccacggcuaguucaugcagcucgucacgcaggugucaccacgguccuccuggcaacuccagagcccccacgccaccuccugcucuucgacuugaucccgguggugaccgugacaggcuggccugacacggcucggagccacucgugggcggguccacuggucucugaaucggccucuuucuaccuagugccgggcagccucccagagcagccgagcaccucuggauggcagcugugcuucgcucgccaggagcuggcgcucaaagagcgcauccccacgccgcugcuucaggcacacgcggcggcccaggcgcugcugcgcccgcugguggcggggacccgagccgcugcgcccuaccuccugcggaccuugcucuacugggcgugcgagcggcucccggcgcucuacuuggcgcggccggaaaaugccggcgcuuguugccuugggcuacuggaugagcugagccgagugcuagaggccggggcgcugccucauuauuuuuugagcggccgaaagcuccgugugggagacggcuccgcugcucugcgcggggcauuggcccagcuccgcggggacccugcacaggccuugcgugaggcuguagaggaagccaagguugcccgcaaagggggcgguuuagcgggcguagggggcggga

SEQ ID NO: 10533 - RNA, 2501 nt, Mus musculus
ugaaucgugcagugguaguagcuagagauagucuaggcagaaguuaagagccauagaaaagguuagggauuggggguggggcacuggcuccccccgcccugccccuuuucuggaauauacagacuucaaggccugucuucuggaagugagccaauauugaucauuaagucccaccuuuggccuuuggccaacucccuaagcuggguuaguaucccugaaaccugguucagagggugccacaauggccuacucaauggcucugccuccuagaguggaccagacucuaaaacucuugggaguuauagauucuauaccugcuuuggagaccaggcgugguuccuucuucacugcugcugcugcugcuacaggcuucaucuccacuagggagccuggccuggggacaagguugaccugaacucuccccaaccaggcuuccugcuugugaggucugagaauuuagcacaauaaauuuguauuuuuuccaguugcaggccuuggggucugggcuggcuggacuuggggaaccuugacugcagcuucgagacucaguaggugggucuggguguccuucugagcgccugggacugccugguggagcgacuguugggggucuuggggguucuaccuccacaggucgcaaggagaugccuagagguucauagcuagaaaaaguaggaugaucauuaacaccgucuccuagucguugccuuugcccuuauucccggcacuaguucugcuagggagaauacaaauccaugguuccuuuaccuggcuuggaugaaacggugacacgccuggacuacguguuccaucugcaaauagguggcagcugcgaggacagcuggggcaguggcuggagagaggcgaagccuugaaguauacaugaaguccagaagaggagcaaagccucuggcuucuggcccccccggcagagagaguacauccaccccgagucccgcucggccccggaaaauugaauagaagaagccacuggagagagggcagauggguuggucauguuaggagccgggagaccaaaggagagucuugccuccccacuagcacugcugccucaauuuuuggaugcucucccaagcuucccccucccuucuuccuuccuccccccuucuuacucuccaguucugggauugccgguguggaccauuauucccagcuucccucaugcuuuggauuaccucucaacagccauguuacucuguuuuuuccccaguuaguccccaggugcccuacccccucgaaccugcaagcgauaagaacugccuugugcgcucuuagggguugcccgccaaccagcagcgugacgucagugaggaucccgcgcaggcgcagcucauucagauugcuaagcacgucggaggaguggcgggugaacucucggacguagcccagagcucccucuggggccgcuguggaacccauagcgaccuaagccugcgacagccaccgaaaaaguuagaggaucuaggcauuacuaaaacagauuccuuucuucucugauguuuucuaccugggauaccccuagagccaaccaacgccaucagauagcggacucagcaucaccacuuaauuccucucguucauucugcccuaaacgguugcuuccuuccuucccuuugcuggaucgcggagaucuuggagcaaguuagaaacucucguuccaccgcuuggagggcgagcgugaggaaucccgcacucccgcgcgccgugcguugguucgacucuaguuaccucauccacuaccuuccuuuccucugcuccccgggcgccugggucacagguaccagacuuuaccugggggaccaaauaugaucugcagcccacacccaucuacgcgacuccuaucgcuagacccaauacuuuccaucucuucuuagcacaguuccugggguucaggucuuauuacuaucaacuaaccccaagcccucuuuggagacucagaaaucugauacccucaggguuugguucuuaccccugucccgcaggggcugcggcuucucuucucgaggggggcggggucucucuccucuuucggucucugcuccuuuauucagccgggauggcgggggcggggguggagguggggugaacccgugagucuguauccuuccuuccucugaggcucuccagauggugagcccggggcggggucuccguuucaaacuguaucucagaaucucgggguggucguaucguggauggcuuugguucauuaaauaagcacccgaggaugaggauauuagaauuggggagguuaguggugcggagggugguaauaugggaggcuuaugucgucgaaggagcugggacagcgaguauuggaguguuggguuuuggaggcgugugccaacagccaguugagggagaaaggaaauauccuaaaacuccucuuucuaauguauuggacucaggaagaaaauagacaguccaagugguaucggguuuggggaggcauuaguggacuccaguggaucucagauagu

SEQ ID NO: 10534 - RNA, 2501 nt, Mus musculus
acuaucugagauccacuggaguccacuaaugccuccccaaacccgauaccacuuggacugucuauuuucuuccugaguccaauacauuagaaagaggaguuuuaggauauuuccuuucucccucaacuggcuguuggcacacgccuccaaaacccaacacuccaauacucgcugucccagcuccuucgacgacauaagccucccauauuaccacccuccgcaccacuaaccuccccaauucuaauauccucauccucgggugcuuauuuaaugaaccaaagccauccacgauacgaccaccccgagauucugagauacaguuugaaacggagaccccgccccgggcucaccaucuggagagccucagaggaaggaaggauacagacucacggguucaccccaccuccacccccgcccccgccaucccggcugaauaaaggagcagagaccgaaagaggagagagaccccgccccccucgagaagagaagccgcagccccugcgggacagggguaagaaccaaacccugaggguaucagauuucugagucuccaaagagggcuugggguuaguugauaguaauaagaccugaaccccaggaacugugcuaagaagagauggaaaguauugggucuagcgauaggagucgcguagaugggugugggcugcagaucauauuuggucccccagguaaagucugguaccugugacccaggcgcccggggagcagaggaaaggaagguaguggaugagguaacuagagucgaaccaacgcacggcgcgcgggagugcgggauuccucacgcucgcccuccaagcgguggaacgagaguuucuaacuugcuccaagaucuccgcgauccagcaaagggaaggaaggaagcaaccguuuagggcagaaugaacgagaggaauuaaguggugaugcugaguccgcuaucugauggcguugguuggcucuagggguaucccagguagaaaacaucagagaagaaaggaaucuguuuuaguaaugccuagauccucuaacuuuuucgguggcugucgcaggcuuaggucgcuauggguuccacagcggccccagagggagcucugggcuacguccgagaguucacccgccacuccuccgacgugcuuagcaaucugaaugagcugcgccugcgcgggauccucacugacgucacgcugcugguuggcgggcaaccccuaagagcgcacaaggcaguucuuaucgcuugcagguucgaggggguagggcaccuggggacuaacuggggaaaaaacagaguaacauggcuguugagagguaauccaaagcaugagggaagcugggaauaaugguccacaccggcaaucccagaacuggagaguaagaaggggggaggaaggaagaagggagggggaagcuugggagagcauccaaaaauugaggcagcagugcuaguggggaggcaagacucuccuuuggucucccggcuccuaacaugaccaacccaucugcccucucuccaguggcuucuucuauucaauuuuccggggccgagcgggacucgggguggauguacucucucugccgggggggccagaagccagaggcuuugcuccucuucuggacuucauguauacuucaaggcuucgccucucuccagccacugccccagcuguccucgcagcugccaccuauuugcagauggaacacguaguccaggcgugucaccguuucauccaagccagguaaaggaaccauggauuuguauucucccuagcagaacuagugccgggaauaagggcaaaggcaacgacuaggagacgguguuaaugaucauccuacuuuuucuagcuaugaaccucuaggcaucuccuugcgaccuguggagguagaacccccaagacccccaacagucgcuccaccaggcagucccaggcgcucagaaggacacccagacccaccuacugagucucgaagcugcagucaagguuccccaaguccagccagcccagaccccaaggccugcaacuggaaaaaauacaaauuuauugugcuaaauucucagaccucacaagcaggaagccugguuggggagaguucaggucaaccuuguccccaggccaggcucccuaguggagaugaagccuguagcagcagcagcagcagugaagaaggaaccacgccuggucuccaaagcagguauagaaucuauaacucccaagaguuuuagagucugguccacucuaggaggcagagccauugaguaggccauuguggcacccucugaaccagguuucagggauacuaacccagcuuagggaguuggccaaaggccaaaggugggacuuaaugaucaauauuggcucacuuccagaagacaggccuugaagucuguauauuccagaaaaggggcagggcggggggagccagugccccacccccaaucccuaaccuuuucuauggcucuuaacuucugccuagacuaucucuagcuacuaccacugcacgauuca

SEQ ID NO: 10535 - RNA, 2501 nt, Mus musculus
ugccccuggggacagucugacucucucucucucucucucucucucucucucucucucucuguccuggaguguucuguaucucuggguuuucuugcccaaugaagggcauggugaaugggaacaggguggucuuugguggugagcaaaaagagggacagagggcaaaaauagggagccaaagacccaggcucccaggcaccaagccacuuggagagaagguacaggaagacugccuuuuggaagaaccuccaaaauggccucccagucccuaaauuuucagucccagggcauauagauguauuaauacacccgguugggaaccuaacucacugauauuuauauucccccucugccugccuaccugucugucugucucugucucugucucucucugaguguauguguguguguugggggggggggggugugcacacgugcgcauacacaugcaugagccagggauaaagugggauccugguuacacuguccucuaccagaaaggucaagcaagcaacuauaauuauuccaaggaacaucacuccccgccagcagagcuaaaaucacagcuuccuaaccuggaugccucccacagacgggaauggccccgaaucucuggaugcucgcuaacagaguggcagcggaugaguccgcacaguugcucugcucuccuuggcccauguggagccucugcucaguauguuuccucugcccccccccccgcgccccaauccuaggagccggaaugauccccuuuuacucccagaauccagucaccccauuguacccaucaaagcacccggggcccggagagcaaagggucuugcugaaaggcacaaugugaaaugacuagaagcccaccaggggacaccccucuccucucaaaaccuucccugaagagagccacuguuucucaaaccugccuguggaggggaagcaggauccgagcaagguuuccugucugggcugagagugaaaggguagccacauaaggcuucaaagagcccuggccucgccaaacuggcugcacacagccugacagagccggggccagcgcucccgcccuccucugcucugcagccaaggccauucauucucucccuuccucccaggagcaccaggaggccagggaaugggacucagcuuccccagcaaccgagagccaugccacccaaggcgugagcucugggaauacguccugccuccucacacugacugccucagcaggcggugggcagugcccgaccugccuuucaggcugcagcaggauuugaacucgagaguggcuuccuuggcuuccgagcuagaaagaaauauagaucauagauggggaaccugagcuucaaauaucaaggccagauuauggcaaaggcaugauccacucuguuccuguaguucccugccugaaggcaucuacagcuaggaaaucucucuuuccuagagaagaggcacagagggaaagaaagcccagccuucagagucucuacuagcucgagcauuaucuuugagcuggacuagcguugguugugcacucugggaggagauuuugagucagaggcuaagccugucgaggggucugugugguucagaucuguucuaacguccagguuuccguguuugcccggacggcucuugcgcccugaaaucggugcacucuaggacguguucaccuuagggucugugcgucccucggauucuuugcagagcaccuccuaucuggugccuggagcgucugagcacgcgucccaggggagcucguccccacggaggaaucuaugcguuccagcucagcguucccggguuccgugcccguuauugcacugggcacccggauuccgccaggcugcccagacacgcaacugaccuugucagguaucagaaugacgaguggaagcaucaggaucggggugaagagcaaaaucgcaaaggacuugaacuuggucacacaagucuucgccgaauccaucgcgugaaagggagacugacuggagggagaaaagauugcgaggcagcuagaagcuucacgagcuuaaaagggggacgcgcggucccaccggauugggggcggcuacaacuccgccccccauugccaggccucccugcgguccuggggcggagccaccccucggggucuguggggagugucugucccaggacucugccaccccgcggcagagugaggcguuugcagauuucagugcuuggcaccagcccucuauggagaggacuggacccuggcaccucaccacuugccagcccguuggcgcugcucugguccucaguaccaugcagggugugccggucauucugccagcuuaagcgugaggacccuuuguguacucucaccugcucucuccuggacuccggaaugucccagaugaaaaacaccagccuguaggauucucaggcuucucucuccaaagcguucuccuucucaucccuaucccggaggggcgucuccuagaggcgauggccgagcccugcgccaccgcggucuucucacc

SEQ ID NO: 10536 - RNA, 2501 nt, Mus musculus
ggugagaagaccgcgguggcgcagggcucggccaucgccucuaggagacgccccuccgggauagggaugagaaggagaacgcuuuggagagagaagccugagaauccuacaggcugguguuuuucaucugggacauuccggaguccaggagagagcaggugagaguacacaaaggguccucacgcuuaagcuggcagaaugaccggcacacccugcaugguacugaggaccagagcagcgccaacgggcuggcaaguggugaggugccaggguccaguccucuccauagagggcuggugccaagcacugaaaucugcaaacgccucacucugccgcgggguggcagaguccugggacagacacuccccacagaccccgagggguggcuccgccccaggaccgcagggaggccuggcaauggggggcggaguuguagccgcccccaauccggugggaccgcgcgucccccuuuuaagcucgugaagcuucuagcugccucgcaaucuuuucucccuccagucagucucccuuucacgcgauggauucggcgaagacuugugugaccaaguucaaguccuuugcgauuuugcucuucaccccgauccugaugcuuccacucgucauucugauaccugacaaggucaguugcgugucugggcagccuggcggaauccgggugcccagugcaauaacgggcacggaacccgggaacgcugagcuggaacgcauagauuccuccguggggacgagcuccccugggacgcgugcucagacgcuccaggcaccagauaggaggugcucugcaaagaauccgagggacgcacagacccuaaggugaacacguccuagagugcaccgauuucagggcgcaagagccguccgggcaaacacggaaaccuggacguuagaacagaucugaaccacacagaccccucgacaggcuuagccucugacucaaaaucuccucccagagugcacaaccaacgcuaguccagcucaaagauaaugcucgagcuaguagagacucugaaggcugggcuuucuuucccucugugccucuucucuaggaaagagagauuuccuagcuguagaugccuucaggcagggaacuacaggaacagaguggaucaugccuuugccauaaucuggccuugauauuugaagcucagguuccccaucuaugaucuauauuucuuucuagcucggaagccaaggaagccacucucgaguucaaauccugcugcagccugaaaggcaggucgggcacugcccaccgccugcugaggcagucagugugaggaggcaggacguauucccagagcucacgccuuggguggcauggcucucgguugcuggggaagcugagucccauucccuggccuccuggugcuccugggaggaagggagagaaugaauggccuuggcugcagagcagaggagggcgggagcgcuggccccggcucugucaggcugugugcagccaguuuggcgaggccagggcucuuugaagccuuauguggcuacccuuucacucucagcccagacaggaaaccuugcucggauccugcuuccccuccacaggcagguuugagaaacaguggcucucuucagggaagguuuugagaggagagggguguccccuggugggcuucuagucauuucacauugugccuuucagcaagacccuuugcucuccgggccccgggugcuuugauggguacaauggggugacuggauucugggaguaaaaggggaucauuccggcuccuaggauuggggcgcgggggggggggcagaggaaacauacugagcagaggcuccacaugggccaaggagagcagagcaacugugcggacucauccgcugccacucuguuagcgagcauccagagauucggggccauucccgucugugggaggcauccagguuaggaagcugugauuuuagcucugcuggcggggagugauguuccuuggaauaauuauaguugcuugcuugaccuuucugguagaggacaguguaaccaggaucccacuuuaucccuggcucaugcauguguaugcgcacgugugcacacccccccccccccaacacacacacauacacucagagagagacagagacagagacagacagacagguaggcaggcagagggggaauauaaauaucagugaguuagguucccaaccggguguauuaauacaucuauaugcccugggacugaaaauuuagggacugggaggccauuuuggagguucuuccaaaaggcagucuuccuguaccuucucuccaaguggcuuggugccugggagccugggucuuuggcucccuauuuuugcccucugucccucuuuuugcucaccaccaaagaccacccuguucccauucaccaugcccuucauugggcaagaaaacccagagauacagaacacuccaggacagagagagagagagagagagagagagagagagagagagagucagacuguccccaggggca

SEQ ID NO: 10537 - RNA, 2501 nt, Mus musculus
caccagcaagauggcugacuugaggucugucagcagaggucuugaugauaaagccacuccucucuaguuuuaggaaaaggaccacccacacccuuuguaagggaguagagcugagacagucugaggauucaguuucuagccuccuaacaaucucuagaucuuuagggacuuccucaggcaaggaaaaugaagagcagccagagaaaacaggauuggaucuuuacguccugucuuccucacacuguaaucccagaaccaaaucuccuccagggcaggccuugguaccuuguauuugcuuuucccagcucucugaccuccugucuuuacaaagccuuuaugacagauaaacuaacuuggggugaccugguggaagcaaaggcagaaaggaagugaaccccuaggcuggcccggaggcuugcaggcccagguuauguuauuauuaaacgggaugaaaugcagagucaagugcuguaccggucuggaggcugggagugaaugucagacgguccaacccucucugcuucacagucugauguccagccuuggccccuucccuugggaauuacacaggucuucacacugagcuaccaugauuguaguggaccuaaaaucccuaagcuucagacccuaaucaagccugcaaauuugaaucuuuaagcaacccaggguagccuggguccagcucugcccacugcuucgccugaggggguggaggguaauguuggcaccgucacugcuuugccaguugucagcugggguggcaaggcacaauugaggacuauuagugacuuugcacccaccuuuguccugaagaaugaccgagaaaucaucccccaggcuuccuggguuuucaaauacagggucucacuauguagcccuggcugcucugcaacaugaaguccacccucugaccuuacacuuguggcaauccuccugccucugccuccccggugcugagacuacaggcaugcacugccacuucuagcuccccggcuucuuugaagucgcugcccaacccaaagcugucugacccacagguuucucugauuggcagaaagcagggaaccccuguucugugcaggaccucaaguccuuccuauggcccccuggcuuccuccacggugagaagguaggcccuagcaccaagaggcaggagagcgccuuucagcaccuggacaaggcccuccggagcaucccaauagggucuuucucacuccuggcuccgaagccagggcuggcaucugaagcacccauaggcucuguccacucuaaacaaacagagaccugguucaccaggaagugagagggcacuggguggggcuggaaugcccgagggugcaacacagcuuguuccccgaucuuaugugggcccccuccccacgcaggccuuucccgucccugcacauucacgcgggaugucaugucgcgucuagaucgagugggguggacucucccaccacauggagcccagacagaaccgacaaccccucccuagaaucccuucaagccccaacggagaagaacacaggguccuuccacaccagucucggagagcccggaacacgugugggccaccgguccuggaaccagagaagcaggcgggggcugcugccaucacccacuucaggucaacgagcacaaaagccgcagcugcaaacaaagaagcgcugcaaacuagccggggaggcgggacaggcggcgccgcgcccccuccccacgccgcgcgggcgugcggggccaugguccccgacggcgcuccuaccuggccggcgcggaccuccuucuccagcucccgguggcgguugugccacacgagguagugcagcggguacuugcccucgggccccuuccuggcggaggcguuggcggggaucaucgcccgcuccucaugccggggccgcggcgcccggcccgcggggagggacggcgcgggagcccgggcccggggccgcggggcggacggccggagcugucugcucgcggggcugcggcucgggcaugugcgagcggcggcggcggcggcgggcgggggcggcgcgcccggcguggugcgggcggcgggcguccucgggaggcggcggcgggaggcgcggagcagcccccacccgcccugggagggagcgggcacucggcggcacgcggccucgcgccuccccucccacacccccgcacacaaagacgccucucggcggagggagcagggacccgcagcuggagcgggggcgcucggggcgccggccccggggucgccgccgccgccgccgccgcagggacgcgcgcccgcacccuccggcuccccuaagccgcauagcccggcccucagcccgagcggacggugagggacaagcgaaugcggggaagagaggaggggacccgggugcgccgugcuggguuaguuacagcuuggccccgcagcaucauggggcuuguaguccgccugguagaaccgugcguuucggaugaccagagauggucuggaacugauuuccuggaagggugga

SEQ ID NO: 10538 - RNA, 2501 nt, Mus musculus
uccacccuuccaggaaaucaguuccagaccaucucuggucauccgaaacgcacgguucuaccaggcggacuacaagccccaugaugcugcggggccaagcuguaacuaacccagcacggcgcacccggguccccuccucucuuccccgcauucgcuugucccucaccguccgcucgggcugagggccgggcuaugcggcuuaggggagccggagggugcgggcgcgcgucccugcggcggcggcggcggcggcgaccccggggccggcgccccgagcgcccccgcuccagcugcgggucccugcucccuccgccgagaggcgucuuugugugcgggggugugggaggggaggcgcgaggccgcgugccgccgagugcccgcucccucccagggcgggugggggcugcuccgcgccucccgccgccgccucccgaggacgcccgccgcccgcaccacgccgggcgcgccgcccccgcccgccgccgccgccgccgcucgcacaugcccgagccgcagccccgcgagcagacagcuccggccguccgccccgcggccccgggcccgggcucccgcgccgucccuccccgcgggccgggcgccgcggccccggcaugaggagcgggcgaugauccccgccaacgccuccgccaggaaggggcccgagggcaaguacccgcugcacuaccucguguggcacaaccgccaccgggagcuggagaaggagguccgcgccggccagguaggagcgccgucggggaccauggccccgcacgcccgcgcggcguggggagggggcgcggcgccgccugucccgccuccccggcuaguuugcagcgcuucuuuguuugcagcugcggcuuuugugcucguugaccugaagugggugauggcagcagcccccgccugcuucucugguuccaggaccgguggcccacacguguuccgggcucuccgagacugguguggaaggacccuguguucuucuccguuggggcuugaagggauucuagggagggguugucgguucugucugggcuccauguggugggagaguccaccccacucgaucuagacgcgacaugacaucccgcgugaaugugcagggacgggaaaggccugcguggggagggggcccacauaagaucggggaacaagcuguguugcacccucgggcauuccagccccacccagugcccucucacuuccuggugaaccaggucucuguuuguuuagaguggacagagccuaugggugcuucagaugccagcccuggcuucggagccaggagugagaaagacccuauugggaugcuccggagggccuuguccaggugcugaaaggcgcucuccugccucuuggugcuagggccuaccuucucaccguggaggaagccagggggccauaggaaggacuugagguccugcacagaacagggguucccugcuuucugccaaucagagaaaccugugggucagacagcuuuggguugggcagcgacuucaaagaagccggggagcuagaaguggcagugcaugccuguagucucagcaccggggaggcagaggcaggaggauugccacaaguguaaggucagaggguggacuucauguugcagagcagccagggcuacauagugagacccuguauuugaaaacccaggaagccugggggaugauuucucggucauucuucaggacaaaggugggugcaaagucacuaauaguccucaauugugccuugccaccccagcugacaacuggcaaagcagugacggugccaacauuacccuccacccccucaggcgaagcagugggcagagcuggacccaggcuacccuggguugcuuaaagauucaaauuugcaggcuugauuagggucugaagcuuagggauuuuagguccacuacaaucaugguagcucagugugaagaccuguguaauucccaagggaaggggccaaggcuggacaucagacugugaagcagagaggguuggaccgucugacauucacucccagccuccagaccgguacagcacuugacucugcauuucaucccguuuaauaauaacauaaccugggccugcaagccuccgggccagccuagggguucacuuccuuucugccuuugcuuccaccaggucaccccaaguuaguuuaucugucauaaaggcuuuguaaagacaggaggucagagagcugggaaaagcaaauacaagguaccaaggccugcccuggaggagauuugguucugggauuacagugugaggaagacaggacguaaagauccaauccuguuuucucuggcugcucuucauuuuccuugccugaggaagucccuaaagaucuagagauuguuaggaggcuagaaacugaauccucagacugucucagcucuacucccuuacaaagggugugggugguccuuuuccuaaaacuagagaggaguggcuuuaucaucaagaccucugcugacagaccucaagucagccaucuugcuggug

SEQ ID NO: 10539 - RNA, 2501 nt, Mus musculus
ggccaggcgaaggagagagagauaacacgucucuagcugcaaaggcagcagcgaguggggaaagugaagccagcgagggaucagcgcuuugcucccuucuugcuuuuuugcuacuccucaauagcggauccugagggugcagugacccagggucuccccuggagccagacuucauugagggcaaggguagaagcaggcaccucccguucacccaggccuccagccucacccccuccccaauccuuuccuagcacuccuuguuccgcucucucugguuggcccucagguccucgcucccgcuuuguggcccggcucucuuucacccucugcuccagcuugucgcaaucgcuguacaaagggcugggggcgggagugggggggcgggcgaggggagcucgacccgaacuggcugucuccuccugaccacgaccaauccggagcgcgcgcgcccuccugcuugggaggacucuugacagccacgggcggccgggcggagccgcgcggacagaacgaggagcccgacgagaggacagcuccgcuccccgcagcccagugccucccuccggggacuguccugccaggccaugccuccgugggcggccgcucuagcgcugcuacuggcggcgcucgccuugcuccuccugcgacccuggaagcgcgcugucggagcgcgaaccucaguccgggaccacgaggagcaggagguggcgagcggaggccccgcggaucaguucagcgaccggcgcgaagcgcuccccggaggcugcagccucauuugcaagccgucggcgcuggcccagugccugcugcgcgcucugcgacgcucggcggcgcuggaacccagcccccgcuccuggcugucgggaccccaccugcaaaccuucugccacuucauccugccagucgggcccgggccugagcuagcccgugaguaccugcagcuggcagaugaugggcugguggcucuggauugggucauaggaccuugugccaggggccgccgggucaccaacccugggagccucccuccagugcuguugguaauccccaaugcauggggacgccucacucgcaauguacuggggcucugccugcucgcccuggagcgcggcuacuacccggucaucuuccaucgccgcggccaccacgguugcccgcuagucagccccagacuacagccuuucggggacccguccgaccucaaggaggcggugacuuacauucgcuuccgacacccggcggccccccuguucgcggugagcgaggguucaggguccgcgcugcugcuguccuacuugggggaguguggcuccuccagcuaugugacuggcgccgccugcaucucgccagugcuacgcugucgcgagugguucgaggcuggcuugccuuggcccuaugaacguggguucuugcugcaccagaaaaucucucucagcagguggguaacgggaacagaagucuacagcucugccugguaugggaacagagcuuuguggguagguuggggcaaaguucucacgagguuuccaaagcuguucaaacccuauaauugacauagagccaggaaaguggguuucaaagccauauuagccccagggccuccguuagggccccaucaguucaucucagucgcagguguccuagcaaccgguggucagcagaggccugcaccuggcauuuaccacuuaguccauagcuagauaggucaacaaacagggcucuggaagcaauugcggccgauuaucuguccagaauauuuaccuucaggcucugagccaggagguggcaggaaugagagauguacagucuuugguuuuuuuaaauccuucaaucugacagauguuuuacauauuucuaggugaguacacaacacuuauuccuguguuuguucuuucugagucaaggucucauacaacucuggcugcacagcugagggugugugucccugaacuccagacccucagccuuugccuccuaagugccaaaauuacaggcaucagacaccgcacacauaaaaaacaaaaacaaaaacaaaacccagaucuccagagggagaacaguuuuaacaccaggcaagacugucccacagaaacuacuugaaugacauuuccagucuuuccuaagagauggcagaaaugaggucagaggcauucuggcaacaaauaggaaaacccaggauaugggaucaggccuggcuggggucaaauccugaauuugcagggaaucagccagccccuuuaaggcuugcucccccuucagcugaguagaguuaauaacaacaccucugcaggugcugugaccauuacaugaaagcacaggacccugacuugccaaccagaacucuuucuuucuuuuuuuuuuuuuuuccuuugcuauuuuaccuccuccuauuuugcaaaggucaaauccugaggcugaacgagaggugcugccauggcaacucagagguuugcuccagggacagaguacucuagucuagcuuaacugccugccaugguuuu

SEQ ID NO: 10540 - RNA, 2501 nt, Mus musculus
aaaaccauggcaggcaguuaagcuagacuagaguacucugucccuggagcaaaccucugaguugccauggcagcaccucucguucagccucaggauuugaccuuugcaaaauaggaggagguaaaauagcaaaggaaaaaaaaaaaaaaagaaagaaagaguucugguuggcaagucaggguccugugcuuucauguaauggucacagcaccugcagagguguuguuauuaacucuacucagcugaagggggagcaagccuuaaaggggcuggcugauucccugcaaauucaggauuugaccccagccaggccugaucccauauccuggguuuuccuauuuguugccagaaugccucugaccucauuucugccaucucuuaggaaagacuggaaaugucauucaaguaguuucugugggacagucuugccugguguuaaaacuguucucccucuggagaucuggguuuuguuuuuguuuuuguuuuuuaugugugcggugucugaugccuguaauuuuggcacuuaggaggcaaaggcugagggucuggaguucagggacacacacccucagcugugcagccagaguuguaugagaccuugacucagaaagaacaaacacaggaauaaguguuguguacucaccuagaaauauguaaaacaucugucagauugaaggauuuaaaaaaaccaaagacuguacaucucucauuccugccaccuccuggcucagagccugaagguaaauauucuggacagauaaucggccgcaauugcuuccagagcccuguuuguugaccuaucuagcuauggacuaagugguaaaugccaggugcaggccucugcugaccaccgguugcuaggacaccugcgacugagaugaacugauggggcccuaacggaggcccuggggcuaauauggcuuugaaacccacuuuccuggcucuaugucaauuauaggguuugaacagcuuuggaaaccucgugagaacuuugccccaaccuacccacaaagcucuguucccauaccaggcagagcuguagacuucuguucccguuacccaccugcugagagagauuuucuggugcagcaagaacccacguucauagggccaaggcaagccagccucgaaccacucgcgacagcguagcacuggcgagaugcaggcggcgccagucacauagcuggaggagccacacucccccaaguaggacagcagcagcgcggacccugaacccucgcucaccgcgaacaggggggccgccgggugucggaagcgaauguaagucaccgccuccuugaggucggacggguccccgaaaggcuguagucuggggcugacuagcgggcaaccgugguggccgcggcgauggaagaugaccggguaguagccgcgcuccagggcgagcaggcagagccccaguacauugcgagugaggcguccccaugcauuggggauuaccaacagcacuggagggaggcucccaggguuggugacccggcggccccuggcacaagguccuaugacccaauccagagccaccagcccaucaucugccagcugcagguacucacgggcuagcucaggcccgggcccgacuggcaggaugaaguggcagaagguuugcagguggggucccgacagccaggagcgggggcuggguuccagcgccgccgagcgucgcagagcgcgcagcaggcacugggccagcgccgacggcuugcaaaugaggcugcagccuccggggagcgcuucgcgccggucgcugaacugauccgcggggccuccgcucgccaccuccugcuccucguggucccggacugagguucgcgcuccgacagcgcgcuuccagggucgcaggaggagcaaggcgagcgccgccaguagcagcgcuagagcggccgcccacggaggcauggccuggcaggacaguccccggagggaggcacugggcugcggggagcggagcuguccucucgucgggcuccucguucuguccgcgcggcuccgcccggccgcccguggcugucaagaguccucccaagcaggagggcgcgcgcgcuccggauuggucguggucaggaggagacagccaguucgggucgagcuccccucgcccgcccccccacucccgcccccagcccuuuguacagcgauugcgacaagcuggagcagagggugaaagagagccgggccacaaagcgggagcgaggaccugagggccaaccagagagagcggaacaaggagugcuaggaaaggauuggggagggggugaggcuggaggccugggugaacgggaggugccugcuucuacccuugcccucaaugaagucuggcuccaggggagacccugggucacugcacccucaggauccgcuauugaggaguagcaaaaaagcaagaagggagcaaagcgcugaucccucgcuggcuucacuuuccccacucgcugcugccuuugcagcuagagacguguuaucucucucuccuucgccuggcc

SEQ ID NO: 10541 - RNA, 2501 nt, Mus musculus
auaagagaggacaggagcuacggguucccaagccaccgguguuucugggcccuguugacacuaagccuaauggaagacacuuccucccaccaccacuucuaguccccuccacccgccaccauucuaagguucccugcuccuccacacugcgcccaucccuuuccuucaacaagcggaacggcuucucaggggucuccgcuuccagggaagcgaaagcagcaaucgaauacuaggcaaggaacaccugcaacacccagcgcugacaaaggacgcggccggugcacacuggcuagccgcggggugcacgggccgcgcugaguuccaaccaccccccaccccccaacuccagcucaggucuaggaggggcggagccuggggaggcucggguccuuuugucugcagccccgccccgccccgcccccacgcgggcccgcggcgcgcggcagacacgagcggcugacacgagcggccgccgcgggcggaggcugcgcgccgcagacccgggcggugcgagcgcgauggcgaaggcggcagcgcggggcuugggcuagcugccggcggcgcggauggcggguggcgcgggcugggcgggcgcccccgcggcucugcugcgcuccgugcgccgccugcgcgaaguguucgaggugugcggccgcgaccccgacggcuuucuacgcguggagcgcgucgcggcgcucggccugcgcuucgggcaaggagaggagguaaggagcucgggcgcguccccgggccggggaaaccgcagggaccccgcgcagucacauuccgggccucucuguggaucacauggcaugcccgcgguggccggccggcccaccugccguucccccuggucugucuccaaucccccuugauguuuggggaggggaagaggugcccuuaaaauccagucucugagcacccccucccacacacaaccaagucacagggcuaugugugcaccgugccaggccuacgggugacagggauaagcagggauguucugcagucucugguccuuagcuguaccuacccaaccuagaaaagaagggaugucugcuccgggccacccuggauucugguccaguuccuggugaccuuccacucaagcuaaaugggcaggccuagcuggcagcagacugugcuggcugcagagggccaagcaggaccaagccgggagugguuagcugagccucugguguugguguugggccgcauggguggcagagagcagaauuguggguacugucagccaaugugaaauggcagggucugaacugccaguguguaacgaauaccuaugcguugggcuaguguccuccugccauccucacaggggcuaguauccgugucugagagaagggcaggacaccguguuaaugaaacccugcaguguugagcgucucuggauucaaaagaccugguugaacuuuggguuucuaaggucaucugagacccucugggccuugguuucaacugcuguacuggauggcaagugggaggugaugacaaccccuuucuagguggcugggcacucgccagaaccuggaaauccccgagagcaggagguggaggagggaggcaggugucaggugugaggacucugguccccagucucagacagcuuacuacugcaguucuccuuaaaguccuuuaucuccucucugguuugcucgggagcaucuccugcugcuaccucagccuuucuucuacagaggaugccagcgucccacuucuuggccaauaccuucuaccugagcaggcugagcagcccaggaggcuacaggcugcugguguggagaauucuccuugcuuugggcggaaaccugggauccagaaucagaaaaccucaggcauggggauggcccccacuggggccucuggcagagggcuggcuggagccguuuaauaguauuccuaggcuggacaaacaccucccauccuuagauccucuucccuccgcauuccagacaccaaccagcuugucacugggucauugugguucugcacaggaaccuaccuggguuucccuucugcacuguagccuauaaaccuuugaaaacaucacuccucuacccuugucccuugccacccuuucaccccugucugaagcuccaaaccguuuccaagccaacuaccaggagcuagauuccuacagaggcugcuggugaauugucagacuguuuucuuagcauuagugggccuggaccugaucaauacacacucauggggugggggcuaccuuuucagugguccuacacacucuccacucuuaccaaguuucuggcuacuagaaccucuggagauguguuuggaaaacuucugccuaggcagagcuccucuacccuggggccggccagcgguucuugugcuuuccuaaauccacgagucguagcaggaguuucugugacuacagcagguugcaaauguggacagucaaaaauagauccguuauauuucugucccccagggaggugacacucuggucaccuccuucacaa

SEQ ID NO: 10542 - RNA, 2501 nt, Mus musculus
uugugaaggaggugaccagagugucaccucccugggggacagaaauauaacggaucuauuuuugacuguccacauuugcaaccugcuguagucacagaaacuccugcuacgacucguggauuuaggaaagcacaagaaccgcuggccggccccaggguagaggagcucugccuaggcagaaguuuuccaaacacaucuccagagguucuaguagccagaaacuugguaagaguggagaguguguaggaccacugaaaagguagcccccaccccaugaguguguauugaucagguccaggcccacuaaugcuaagaaaacagucugacaauucaccagcagccucuguaggaaucuagcuccugguaguuggcuuggaaacgguuuggagcuucagacaggggugaaaggguggcaagggacaaggguagaggagugauguuuucaaagguuuauaggcuacagugcagaagggaaacccagguagguuccugugcagaaccacaaugacccagugacaagcugguuggugucuggaaugcggagggaagaggaucuaaggaugggagguguuuguccagccuaggaauacuauuaaacggcuccagccagcccucugccagaggccccagugggggccauccccaugccugagguuuucugauucuggaucccagguuuccgcccaaagcaaggagaauucuccacaccagcagccuguagccuccugggcugcucagccugcucagguagaagguauuggccaagaagugggacgcuggcauccucuguagaagaaaggcugagguagcagcaggagaugcucccgagcaaaccagagaggagauaaaggacuuuaaggagaacugcaguaguaagcugucugagacuggggaccagaguccucacaccugacaccugccucccuccuccaccuccugcucucggggauuuccagguucuggcgagugcccagccaccuagaaagggguugucaucaccucccacuugccauccaguacagcaguugaaaccaaggcccagagggucucagaugaccuuagaaacccaaaguucaaccaggucuuuugaauccagagacgcucaacacugcaggguuucauuaacacgguguccugcccuucucucagacacggauacuagccccugugaggauggcaggaggacacuagcccaacgcauagguauucguuacacacuggcaguucagacccugccauuucacauuggcugacaguacccacaauucugcucucugccacccaugcggcccaacaccaacaccagaggcucagcuaaccacucccggcuugguccugcuuggcccucugcagccagcacagucugcugccagcuaggccugcccauuuagcuugaguggaaggucaccaggaacuggaccagaauccaggguggcccggagcagacaucccuucuuuucuagguuggguagguacagcuaaggaccagagacugcagaacaucccugcuuaucccugucacccguaggccuggcacggugcacacauagcccugugacuugguugugugugggagggggugcucagagacuggauuuuaagggcaccucuuccccuccccaaacaucaagggggauuggagacagaccagggggaacggcaggugggccggccggccaccgcgggcaugccaugugauccacagagaggcccggaaugugacugcgcggggucccugcgguuuccccggcccggggacgcgcccgagcuccuuaccuccucuccuugcccgaagcgcaggccgagcgccgcgacgcgcuccacgcguagaaagccgucggggucgcggccgcacaccucgaacacuucgcgcaggcggcgcacggagcgcagcagagccgcgggggcgcccgcccagcccgcgccacccgccauccgcgccgccggcagcuagcccaagccccgcgcugccgccuucgccaucgcgcucgcaccgcccgggucugcggcgcgcagccuccgcccgcggcggccgcucgugucagccgcucgugucugccgcgcgccgcgggcccgcgugggggcggggcggggcggggcugcagacaaaaggacccgagccuccccaggcuccgccccuccuagaccugagcuggaguugggggguggggggugguuggaacucagcgcggcccgugcaccccgcggcuagccagugugcaccggccgcguccuuugucagcgcuggguguugcagguguuccuugccuaguauucgauugcugcuuucgcuucccuggaagcggagaccccugagaagccguuccgcuuguugaaggaaagggaugggcgcaguguggaggagcagggaaccuuagaaugguggcggguggaggggacuagaagugguggugggaggaagugucuuccauuaggcuuagugucaacagggcccagaaacaccgguggcuugggaacccguagcuccuguccucucuuau

SEQ ID NO: 10543 - RNA, 2501 nt, Mus musculus
aaggucacuuacaagagcauggugucucaaaagaaacggcaccgccaaaagcccaaccagugugaaugccuauucacgaaugcuguuuagcuagaucucccuguucaccaugcaggcaacucuagcaaaggguccucucuccccaaccuuaugaaucuuguacuuuucugaacuuacaagugcagacauaaugaggaaauagccacacuagucucacaugccucuuuuccagaugugggcaauaggguacagagcgacugaauaaaccauggucucuagccaggcuagauuagaucugguguaguucugucccuccccuuaggcgguggagcuuggcugagcugccuuggggcggggcauauuauccaggggcgucuccgaagaccuggaggcggggccugcugucccgugggcggggucggcgaccgaacuguccuggagccuuggggaucugaauccuucuccggcggacagggaaacgccggaccaugggcguccaggagcgggaagcacagagguggcaggguugagccccgcugagaccucugggccggccaugggcgaccgcgagcgcaacaagaagcggcugcuggagcugcugcaggcugcgggcaccggcaacgggcacugcgccgacugcggggcagcggguaagggcgcggugugcgggacaggugcagccagccacggccccagcuccuggcccacccgcuccuucccuaggagcacgucaacgcgcuacucagacucgcucucgcuuggaaccccaguccuucucacuggagaguuucgggcggccccgacgguucuccgucucccugcucccgaagcccaggaccucgguccccgcuccgcaucagaugcgguccaugcccugggucccucucgcucucucacccggcaccuuaccacccaggacccugcucuggacaccauuuccgauccccggcccuuaccgcgcccuuggacccugagguccucacccuggugccuccugggcccccgcgacccucacugccgcgcgcgaugacugaggaugcugauguggcuggccccgaacccugagccuccaagcgagucccucacuugccugcucuccuccguucccccuuccgaggucuccugggugucaucgagccaaagggugggcuaggcacgguucacgcugucaccucaguuguccaagguuggggaccaagagaaaaaggauugccggcgugggcagagcuugccuccgacccagaauccuaacuguccagcccagccugucccugcacccuaguccaggccuuguccagcucagcggagguccugcucuuccacccugcagauccugauugggccucuuacaagcuggggauuuucaucugucuccacugcucuggcguccaccgcaacuucccagacaucagcaaaguuaaauccgugagacuggacuucugggacgacaguaugguggagguagacuggcacgcaugugcagauucuuggacuugggcgugagggagaagaggagggacgcagguguuccuccuauuccacagaggaggaaaaugaagcccagagaggugcaaugauuaaugagaggaaacacagugucuuagcaaaggcccugaguuuguguguguguguguguguguguguguguguguguguguguguguguguguguauguguguguguguguaucccugaguguauguaugccacacaugcgcaggagcucagaggucagaggaaggcaccagauccucuggaauuggaguaaccaauaguugugagcggccaugguggugcugggaaucgaacccauguccucugcgagagcaguaagugcucuucauucuugagcccuccagcccuggcgcuagggccuuauucuugacucuggaguauguuuccacacccauguaguggacaugucuauaagcccagacacaaagugaauuaaguuacugucaucauucguaggagacgggaagugaggaagagaaacaucagauucauagccuaaggucccucgcccuuucccagcccacucugcuucccugccaaguuaguauguuggaauccucagcuuaggggguaaaggcguuuuggccagaaaaccuuaagagaacaggcaggccaacgucacacuggugaacacagagguuuaagggccacgggggaagcggguaacauuaccgaguacuucccuuuuauggugggaucuggacugggcuuuuuaccauucaauccacacagacaucacuggaagccuacucuguucugugugggaaagagcacacugaaaagacaaaguggcuuacccauucaaggcuucuauuccaggggaaggaaagguggguacucagccagcuagcccauacacucacagguuuuugccuucuaagccccugcaaugucuucacuuggggcaagugagaucaccaggaguccaaaggcaauacaugucuaugacacagcuccaggguccccagggagcaagauaggguuc

SEQ ID NO: 10544 - RNA, 2501 nt, Mus musculus
gaacccuaucuugcucccuggggacccuggagcugugucauagacauguauugccuuuggacuccuggugaucucacuugccccaagugaagacauugcaggggcuuagaaggcaaaaaccugugaguguaugggcuagcuggcugaguacccaccuuuccuuccccuggaauagaagccuugaauggguaagccacuuugucuuuucagugugcucuuucccacacagaacagaguaggcuuccagugaugucuguguggauugaaugguaaaaagcccaguccagaucccaccauaaaagggaaguacucgguaauguuacccgcuucccccguggcccuuaaaccucuguguucaccagugugacguuggccugccuguucucuuaagguuuucuggccaaaacgccuuuacccccuaagcugaggauuccaacauacuaacuuggcagggaagcagagugggcugggaaagggcgagggaccuuaggcuaugaaucugauguuucucuuccucacuucccgucuccuacgaaugaugacaguaacuuaauucacuuugugucugggcuuauagacauguccacuacauggguguggaaacauacuccagagucaagaauaaggcccuagcgccagggcuggagggcucaagaaugaagagcacuuacugcucucgcagaggacauggguucgauucccagcaccaccauggccgcucacaacuauugguuacuccaauuccagaggaucuggugccuuccucugaccucugagcuccugcgcauguguggcauacauacacucagggauacacacacacacacauacacacacacacacacacacacacacacacacacacacacacacacacacacaaacucagggccuuugcuaagacacuguguuuccucucauuaaucauugcaccucucugggcuucauuuuccuccucuguggaauaggaggaacaccugcgucccuccucuucucccucacgcccaaguccaagaaucugcacaugcgugccagucuaccuccaccauacugucgucccagaaguccagucucacggauuuaacuuugcugaugucugggaaguugcgguggacgccagagcaguggagacagaugaaaauccccagcuuguaagaggcccaaucaggaucugcaggguggaagagcaggaccuccgcugagcuggacaaggccuggacuagggugcagggacaggcugggcuggacaguuaggauucugggucggaggcaagcucugcccacgccggcaauccuuuuucucuugguccccaaccuuggacaacugaggugacagcgugaaccgugccuagcccacccuuuggcucgaugacacccaggagaccucggaagggggaacggaggagagcaggcaagugagggacucgcuuggaggcucaggguucggggccagccacaucagcauccucagucaucgcgcgcggcagugagggucgcgggggcccaggaggcaccagggugaggaccucaggguccaagggcgcgguaagggccggggaucggaaaugguguccagagcaggguccugggugguaaggugccgggugagagagcgagagggacccagggcauggaccgcaucugaugcggagcggggaccgagguccugggcuucgggagcagggagacggagaaccgucggggccgcccgaaacucuccagugagaaggacugggguuccaagcgagagcgagucugaguagcgcguugacgugcuccuagggaaggagcgggugggccaggagcuggggccguggcuggcugcaccugucccgcacaccgcgcccuuacccgcugccccgcagucggcgcagugcccguugccggugcccgcagccugcagcagcuccagcagccgcuucuuguugcgcucgcggucgcccauggccggcccagaggucucagcggggcucaacccugccaccucugugcuucccgcuccuggacgcccaugguccggcguuucccuguccgccggagaaggauucagauccccaaggcuccaggacaguucggucgccgaccccgcccacgggacagcaggccccgccuccaggucuucggagacgccccuggauaauaugccccgccccaaggcagcucagccaagcuccaccgccuaaggggagggacagaacuacaccagaucuaaucuagccuggcuagagaccaugguuuauucagucgcucuguacccuauugcccacaucuggaaaagaggcaugugagacuaguguggcuauuuccucauuaugucugcacuuguaaguucagaaaaguacaagauucauaagguuggggagagaggacccuuugcuagaguugccugcauggugaacagggagaucuagcuaaacagcauucgugaauaggcauucacacugguugggcuuuuggcggugccguuucuuuugagacaccaugcucuuguaagugaccuu

SEQ ID NO: 10545 - RNA, 2501 nt, Mus musculus
auucccaaagaaucugauucgccaccaucugacuacaucuccaggcuugcuaccugcagacaaccuggaggcuuucugcucuccucacccucccccccucccccuugccaaggcaccccaacuuuguccagcucucucaccugaacccccgaagcgcaguuucuucuuucuggacuaaagccgaaccugucgcuaguggaaaggucccccacccccacccagcccaggcugcaagccgcuugcuuuaccaguccaaaggucaccuaaaguuuggcugauaaacagaaucgguagagaagauuuggagccccccagcgugaguagaaugggcucuggcaagucccaaucccggcccaagucucucgcuccguuggacugucccuuagguucucccacuuucucgguuuuuccccccuccccaccaccauuugcaucuugccgaaagcugagcccuucccacucauuugcauaucuuauauggccuaaugguggagaucauggcaaguuagaaguuuucugacuccucucggaggagucuccgggaccccagagaguaacaggugucugaaagcuaaaggguggagggguuccaggacuuggaguucucuuguaaaacuccccuccacccuccucucucacacccacccauccccucaaccccuucuuuuuccguccuuggaaaaugguguccaagcucacgucgcuccagcaagaacuccugagugcccugcugagcuccggagucaccaaggaagugcugauccaggccuuggaggaguuacugccguccccgaauuucggggugaagcuggagacacugccccugucccccgggagcggggcggaucucgacaccaagccgguuuuccauacucucaccaauggccacgccaagggccgcuugucuggggacgagggcucagaggacggcgacgacuaugacacuccucccauccucaaagagcuccaggcgcucaacaccgaggaggccgcggagcagcgggccgagguggaccggaugcucagguaggcaagcgagcgagguacgcccuggagcccgagcagucucuggaguccccggccccucaccggaggcaugagguguacacugcucuccccaagccccuuccccacgggaaaaauagcccgggggcacuccgcuucucugcuaacuauugaaccuggcccuccaccgggcgaccuggaacccccaggcuucgucugccuccaccuaugcgggcagccuggacccaggcacuuuguuggugguacccagucacgagaaccgaaggugcggagccuuaggucacaugaccagaggggcuggugggugcagcgaaaaggcugcaauugcccccggacccaccaaacuucccaaaccccaagccacguauuaaucccugcgaucugcaguucucugcaaaagaccuggcagcaucaguggccgaggccugggaagcaaguucucugauuguguccuuacagagccaaguuuagaauuauaaaguggaaaguuuguuguagggucaccagugccgggcaaaagaaaccaugaacaaagggagagagaauaggugcuccuaagaccaccaugcccuuuugcagaggugggcguguacgcaucucacuaacgacaccccagcaggcuuaggggagcccaggcuggcuggcggucccuccgguggcugggaucacuugccgguccucucgcccgggccuacgcuuugacagcuaguuacuaauuauccaaggagccaagcggcucccuuagacugcgcgucgcuccggggccacuuggcuucagaaaggagccccucgcguggccucugacucuuaagcccugcggcuucaaaguuucagaguuccggagugacuguggcggccucccuggcucggcuuccucuccugcagcgcgcgcuuggggugggauaugaccuugcauuugaauuugcgcuuuggggacccggccgcucgcccucuagccaaggcaaucuggaggacuucuaaaaguuuuuuguuuuuuuuguuuuuuuaaccccuaaaaugauuuugcucuaauuuaaaagcuuggguuucuuucguugcuguuucuccacguagcaaugauuuuuuuuuucccccucuggcugaguuuagcggccuggauggugucagggguagaggguacagacugagguaccgagccccucggaagguuugggacggcaggcuggcagaaaauuuauccuggggccuggcucagggacccggcaucccgucgccagcccccuggggccuagguccuuccuccugagagccacugucuaguucgccucggagccgacuuagggaagcccgggaggccgagggcgccucuccaccgugguccccaccccgggcuggacagagcggagauguaacauaaacugcagcacguggaguugggguguuauuaauuuauuccuauaaaucaucaacagaaaguacacaaaacgugauuagguugaaaagagaggcggguu

SEQ ID NO: 10546 - RNA, 2501 nt, Mus musculus
aacccgccucucuuuucaaccuaaucacguuuuguguacuuucuguugaugauuuauaggaauaaauuaauaacaccccaacuccacgugcugcaguuuauguuacaucuccgcucuguccagcccgggguggggaccacgguggagaggcgcccucggccucccgggcuucccuaagucggcuccgaggcgaacuagacaguggcucucaggaggaaggaccuaggccccagggggcuggcgacgggaugccgggucccugagccaggccccaggauaaauuuucugccagccugccgucccaaaccuuccgaggggcucgguaccucagucuguacccucuaccccugacaccauccaggccgcuaaacucagccagagggggaaaaaaaaaaucauugcuacguggagaaacagcaacgaaagaaacccaagcuuuuaaauuagagcaaaaucauuuuagggguuaaaaaaacaaaaaaaacaaaaaacuuuuagaaguccuccagauugccuuggcuagagggcgagcggccggguccccaaagcgcaaauucaaaugcaaggucauaucccaccccaagcgcgcgcugcaggagaggaagccgagccagggaggccgccacagucacuccggaacucugaaacuuugaagccgcagggcuuaagagucagaggccacgcgaggggcuccuuucugaagccaaguggccccggagcgacgcgcagucuaagggagccgcuuggcuccuuggauaauuaguaacuagcugucaaagcguaggcccgggcgagaggaccggcaagugaucccagccaccggagggaccgccagccagccugggcuccccuaagccugcuggggugucguuagugagaugcguacacgcccaccucugcaaaagggcaugguggucuuaggagcaccuauucucucucccuuuguucaugguuucuuuugcccggcacuggugacccuacaacaaacuuuccacuuuauaauucuaaacuuggcucuguaaggacacaaucagagaacuugcuucccaggccucggccacugaugcugccaggucuuuugcagagaacugcagaucgcagggauuaauacguggcuugggguuugggaaguuugguggguccgggggcaauugcagccuuuucgcugcacccaccagccccucuggucaugugaccuaaggcuccgcaccuucgguucucgugacuggguaccaccaacaaagugccuggguccaggcugcccgcauagguggaggcagacgaagccuggggguuccaggucgcccgguggagggccagguucaauaguuagcagagaagcggagugcccccgggcuauuuuucccguggggaaggggcuuggggagagcaguguacaccucaugccuccggugaggggccggggacuccagagacugcucgggcuccagggcguaccucgcucgcuugccuaccugagcauccgguccaccucggcccgcugcuccgcggccuccucgguguugagcgccuggagcucuuugaggaugggaggagugucauagucgucgccguccucugagcccucguccccagacaagcggcccuuggcguggccauuggugagaguauggaaaaccggcuuggugucgagauccgccccgcucccgggggacaggggcagugucuccagcuucaccccgaaauucggggacggcaguaacuccuccaaggccuggaucagcacuuccuuggugacuccggagcucagcagggcacucaggaguucuugcuggagcgacgugagcuuggacaccauuuuccaaggacggaaaaagaagggguugaggggaugggugggugugagagaggaggguggaggggaguuuuacaagagaacuccaaguccuggaaccccuccacccuuuagcuuucagacaccuguuacucucuggggucccggagacuccuccgagaggagucagaaaacuucuaacuugccaugaucuccaccauuaggccauauaagauaugcaaaugagugggaagggcucagcuuucggcaagaugcaaauggugguggggaggggggaaaaaccgagaaagugggagaaccuaagggacaguccaacggagcgagagacuugggccgggauugggacuugccagagcccauucuacucacgcuggggggcuccaaaucuucucuaccgauucuguuuaucagccaaacuuuaggugaccuuuggacugguaaagcaagcggcuugcagccugggcugggugggggugggggaccuuuccacuagcgacagguucggcuuuaguccagaaagaagaaacugcgcuucggggguucaggugagagagcuggacaaaguuggggugccuuggcaagggggagggggggagggugaggagagcagaaagccuccagguugucugcagguagcaagccuggagauguagucagaugguggcgaaucagauucuuugggaau

SEQ ID NO: 10547 - RNA, 2501 nt, Mus musculus
ggagaaggaagaggcagggacuggaauaaagcuggagccucuaagcucaacuuggagaaccaacaagcugggagaaccagaaaacgucuuugguugcuggagagcuuggcuucgggaaaggcaagcgagagcugcaaccccgaggcugcuccaccucucccucgccuuguuagggcugcugagcugaagccaucucagacccuuucuucccaggcgcgggcagccaaacccggaccacgcuuuccagaaccaaguacuacagcugauguguuuauaaaaagauaaagagaaaauuaauauaucucgcaauaccgacuagcuuccuaaaagguagaagcgggaaaagacugggcugcccuaguaaaaggcagcuccuaacgcggcugcuagagccacacagaccucugauccgaagcuggccuggaagggcccauggggaaggagcaacagaggcgcgggagggaaguacucaccggaagaagucguuuuuacaguagagcuugccuucccgggagaagcacuucucggucagguugcauuuacauucacagcacuggacgcacuugacgugccaggcccuguccaacacguucaagaggaaacgguccaggaugggccuuuugcagcccgcacagugcaccauggucuuugguuugguccggugaggcccggagcgacagggcaauuagagucgaggggaugacuucugaagacaaccagcuccuccaaaaagaagaaacccucucuaguugggcaagcaaaaaacccguacuagcaaaucaaaagggggagagaccaggcugguagagggcagccccggagucccggggcaacgggauggagcagcgccaccucagcucaccgggcgaggaaaaucagucucaagcgggcuagaaagcggcucuucugcucaaagcccgcgaaggagugaaggucaccgugagaggcggcgggacguaaauaaauaaaauggaaacagacgaaaaggaagacgccaagagcucaggauucgggaaagcuggguucucuccagcuugagguagagcugucagaagucaaagugcaucugcuuuugucagaguaugaaggcagguugugugcgugucagacugcccaccaccggguuuuccccuuuaaaaaaaacacggaaagaaaagaacacgggaguagaaagcuuuggauccuacauugccgguuucuugcagugaguugggacgcucugggcgcccgcgcugggccuggggagggggcgggggcagaccgaggugugggggagauggcggguuggguaggauauuuuguugauuguaguuguugcuuagguagcccccaccccuuuggagaguuuucuuuuuugugccagucaaaaauggaaagggaccguccgcuucgggcggacgcagccgggcgcacucgcucgcuccccaccgccccagcccugucaccucggccgguggccugccaggcagucugccgcguccuccgagcggcccucccugcgcuuggacuccuggggaggcaacacggucuggcucuucacugcgccuggacgagcauccuggcuucagucacaacucgcggccgcuugggcgcgcagccuugcaucgcucggcccacgaucccgcugccuguguuccggccccacagucgcucgacuuuuuuuuuuuuccuugucccccccaccucucuuuuugugcgguggcaaaucuggguuuucuuucuagucuccuuccuuucuuuuucccucccuuuuucuuuuccuuggucaacgcgagaagccaggggagggggcgucuuggagagcuuuagaauguccuggggcugcggcuauagaaggccagcggcuggaacaguuuggcgcggauugccggugucgcuguccggcccgcggguuccuuguuggcucuccccaggcgcgcgucccucggucccuagucuccuggcccagucuuccgcgcgucucuccccagcuccagcggcucggucacugcuccuggcuguuggcugagcccuggaagcccccucgccuuaaugcagcgcccgccgacgucacggcagucugugaccaaucagcgccucgcgguccuucuguaaaccauucugcgucccccccggccggggagaaugcggggagaccgcguuuagaggaucaguggcggcgggcccgcgcggugccggcgacuagcagcgagauguccuggccccuuccagguuugguaagacguccguuucggcaucaaggauugacaguaggcgggaggaagcgcggaaaggaggcgcggaggaagucagaguucuggguggggguaaaagcaaaccuauauauuuaaaaagacuuguugggauuagauugcagcgagaucuggaagcuugggagguccuaguacacugguuuugcaaaucacuagguguugauagcccgccccuuguucguuuggccuggaaauugcccccggcguagcucgagucuaaggagagguagggggcgcuuggcagcguaa

SEQ ID NO: 10548 - RNA, 2501 nt, Mus musculus
uuacgcugccaagcgcccccuaccucuccuuagacucgagcuacgccgggggcaauuuccaggccaaacgaacaaggggcgggcuaucaacaccuagugauuugcaaaaccaguguacuaggaccucccaagcuuccagaucucgcugcaaucuaaucccaacaagucuuuuuaaauauauagguuugcuuuuacccccacccagaacucugacuuccuccgcgccuccuuuccgcgcuuccucccgccuacugucaauccuugaugccgaaacggacgucuuaccaaaccuggaaggggccaggacaucucgcugcuagucgccggcaccgcgcgggcccgccgccacugauccucuaaacgcggucuccccgcauucuccccggccgggggggacgcagaaugguuuacagaaggaccgcgaggcgcugauuggucacagacugccgugacgucggcgggcgcugcauuaaggcgagggggcuuccagggcucagccaacagccaggagcagugaccgagccgcuggagcuggggagagacgcgcggaagacugggccaggagacuagggaccgagggacgcgcgccuggggagagccaacaaggaacccgcgggccggacagcgacaccggcaauccgcgccaaacuguuccagccgcuggccuucuauagccgcagccccaggacauucuaaagcucuccaagacgcccccuccccuggcuucucgcguugaccaaggaaaagaaaaagggagggaaaaagaaaggaaggagacuagaaagaaaacccagauuugccaccgcacaaaaagagaggugggggggacaaggaaaaaaaaaaaagucgagcgacuguggggccggaacacaggcagcgggaucgugggccgagcgaugcaaggcugcgcgcccaagcggccgcgaguugugacugaagccaggaugcucguccaggcgcagugaagagccagaccguguugccuccccaggaguccaagcgcagggagggccgcucggaggacgcggcagacugccuggcaggccaccggccgaggugacagggcuggggcgguggggagcgagcgagugcgcccggcugcguccgcccgaagcggacggucccuuuccauuuuugacuggcacaaaaaagaaaacucuccaaaggggugggggcuaccuaagcaacaacuacaaucaacaaaauauccuacccaacccgccaucucccccacaccucggucugcccccgcccccuccccaggcccagcgcgggcgcccagagcgucccaacucacugcaagaaaccggcaauguaggauccaaagcuuucuacucccguguucuuuucuuuccguguuuuuuuuaaaggggaaaacccgguggugggcagucugacacgcacacaaccugccuucauacucugacaaaagcagaugcacuuugacuucugacagcucuaccucaagcuggagagaacccagcuuucccgaauccugagcucuuggcgucuuccuuuucgucuguuuccauuuuauuuauuuacgucccgccgccucucacggugaccuucacuccuucgcgggcuuugagcagaagagccgcuuucuagcccgcuugagacugauuuuccucgcccggugagcugagguggcgcugcuccaucccguugccccgggacuccggggcugcccucuaccagccuggucucucccccuuuugauuugcuaguacggguuuuuugcuugcccaacuagagaggguuucuucuuuuuggaggagcugguugucuucagaagucauccccucgacucuaauugcccugucgcuccgggccucaccggaccaaaccaaagaccauggugcacugugcgggcugcaaaaggcccauccuggaccguuuccucuugaacguguuggacagggccuggcacgucaagugcguccagugcugugaauguaaaugcaaccugaccgagaagugcuucucccgggaaggcaagcucuacuguaaaaacgacuucuuccggugaguacuucccucccgcgccucuguugcuccuuccccaugggcccuuccaggccagcuucggaucagaggucuguguggcucuagcagccgcguuaggagcugccuuuuacuagggcagcccagucuuuucccgcuucuaccuuuuaggaagcuagucgguauugcgagauauauuaauuuucucuuuaucuuuuuauaaacacaucagcuguaguacuugguucuggaaagcgugguccggguuuggcugcccgcgccugggaagaaagggucugagauggcuucagcucagcagcccuaacaaggcgagggagagguggagcagccucgggguugcagcucucgcuugccuuucccgaagccaagcucuccagcaaccaaagacguuuucugguucucccagcuuguugguucuccaaguugagcuuagaggcuccagcuuuauuccagucccugccucuuccuucucc

SEQ ID NO: 10549 - RNA, 2501 nt, Mus musculus
ucccguucccgcccgugccggccccaucaggguucugccauggcuccccacucaccggcuccggacaccugauucggcuccgggaccucggccgcccgagccuccugauuugcccgcccaccggccucgcuuuccagugcccgcagccucccucugaagugcauggacccggggcggugaccgggaguggggugggaggccaggcugggucgcaggcaagagcggccgggccucccggcgcgggagggaaagggcgcccccucuccucuccggaacgugucaaugcuuugcacuuggggccggcaugcggcuaggggguccuuccccaaggccccgggacccgggcgcccccugccucaggcccuuacggcgggucagaucgguccucugcgcuuuccagcccucgcccaggcagcggcgggcgcgggcggcgaggugggggccaggccagggggaggggucucggggcccgcuggcccgucauugguuaauauuuuauucuguugacauguuuucuuacugcugaggcuuccgacaccuucucccuggccuccccucccguccagagcuuggccugagcugucaaaaccccgcccccggagacccacaauugguccaaaaagcguaaaaucagcaaucaaggggggccuggcucguuagcgcaggggauccgaacagggcaggacaugugagauagucacaguuuuccagagaucaggacaagaucuaaccagucgcgcgugguccccggcgccggagccggccagcccagcccagcccagcccagcccagccccgcgcagcgcccccuccgcccccgcguccagagcccugcgccccuugaggugcgcgggacggggagccgggagaagccgcugccgcgcccgccgcccgggccguccguccuccgcgcgcgccgccgcccgggccggggguccgaggcgcgcgcccccggccccggccccggcucccaggagccugggccggaugucccgaugagagagccggcgcuggcagccagcgccauggcuuaccacccguuccacgcgccacggcccgccgacuuccccauguccgccuuccuggcggcagcgcagcccuccuucuucccggcgcuagcgcugccgcccggcgcgcuaggcaagccucugccggacccgggccuggcgggggcggcggccgcggcagcagcggcggcggcggcggccgaggcggggcugcacgucucggcacucggcccgcacccgcccgccgcgcaucugcgcucgcucaagagccuggaacccgaggacgagguggaggacgaccccaaggugacgcuggaggccaaggagcugugggaccaguuccacaagcugggcaccgagauggucaucaccaaguccgggagguaggacgggccgggcgggcgggcucggggaccgcacagcacccaccaccacugggucgaugcucucucggauugcccccgcuccggcccuggcgccacacuccuuuccacagacaagcaagcugacuuuuuuuuuuuuccguuuggcuccggagcgaauuaaaaaagaaaaagaaaagcaaacaucucucgauugaaauaaaacgaaaacacguuccuaaagaauagucccaacuguucugagucucaaagccccggagacucuggcgggucuccacagccccuugcggucucacuguuuuuuuuuuguuuuguuuuguuuuguuuuguuuuguuuuuguuuuuguuuuuuccgucuccuggacggucuggaaguuccuaagaaaagggaucuuucccggauucuccgcucugaucacuggaguccauagugggacuagcaucccgccuccugcuagcuccaggcugaccacuugguuccggcagagaguuguccagcccacagcuaggccuuggagagagucuugcuuguccuuggagcuuggagcacuggaccagccaccucuugaggccuuaaagccagaagaaaaauaaaauccccaaucuucccagcacuccagucucugaaaguccaggccucagguucacccuguucccccgaaauucuaggcuaggguucccugauuaagccucuaaaucguuucucccagacaaagaccuugauaguuuauuucuucaagcccugucccaagaguuuauuuccucucuacgaauuucaaggcaauucagaaaagccuaguguaucucuaaagggccuaguuuccuuuccugggcaucaacccucaucuuagaucagaguggaggaaaggucuccagacugagugcaaaacgcauccaaagcuuuacaaaacaggcucuggccggcagaaauaggaugucuugggaguaagaagcacaggcugggucuuuccagguagcaacacagcacaaguggaggacauugugacaaauuauguagauagggaagcuucaaguaggaugucaugucauugucgggaagguaaagggacaaaaaagagccgggucccaauggcaugucccccuucccuccc

SEQ ID NO: 10550 - RNA, 2501 nt, Mus musculus
gggagggaagggggacaugccauugggacccggcucuuuuuugucccuuuaccuucccgacaaugacaugacauccuacuugaagcuucccuaucuacauaauuugucacaauguccuccacuugugcuguguugcuaccuggaaagacccagccugugcuucuuacucccaagacauccuauuucugccggccagagccuguuuuguaaagcuuuggaugcguuuugcacucagucuggagaccuuuccuccacucugaucuaagaugaggguugaugcccaggaaaggaaacuaggcccuuuagagauacacuaggcuuuucugaauugccuugaaauucguagagaggaaauaaacucuugggacagggcuugaagaaauaaacuaucaaggucuuugucugggagaaacgauuuagaggcuuaaucagggaacccuagccuagaauuucgggggaacagggugaaccugaggccuggacuuucagagacuggagugcugggaagauuggggauuuuauuuuucuucuggcuuuaaggccucaagagguggcugguccagugcuccaagcuccaaggacaagcaagacucucuccaaggccuagcugugggcuggacaacucucugccggaaccaaguggucagccuggagcuagcaggaggcgggaugcuagucccacuauggacuccagugaucagagcggagaauccgggaaagaucccuuuucuuaggaacuuccagaccguccaggagacggaaaaaacaaaaacaaaaacaaaacaaaacaaaacaaaacaaaacaaaaaaaaaacagugagaccgcaaggggcuguggagacccgccagagucuccggggcuuugagacucagaacaguugggacuauucuuuaggaacguguuuucguuuuauuucaaucgagagauguuugcuuuucuuuuucuuuuuuaauucgcuccggagccaaacggaaaaaaaaaaaagucagcuugcuugucuguggaaaggaguguggcgccagggccggagcgggggcaauccgagagagcaucgacccagugguggugggugcugugcgguccccgagcccgcccgcccggcccguccuaccucccggacuuggugaugaccaucucggugcccagcuuguggaacuggucccacagcuccuuggccuccagcgucaccuuggggucguccuccaccucguccucggguuccaggcucuugagcgagcgcagaugcgcggcgggcgggugcgggccgagugccgagacgugcagccccgccucggccgccgccgccgccgcugcugccgcggccgccgcccccgccaggcccggguccggcagaggcuugccuagcgcgccgggcggcagcgcuagcgccgggaagaaggagggcugcgcugccgccaggaaggcggacauggggaagucggcgggccguggcgcguggaacgggugguaagccauggcgcuggcugccagcgccggcucucucaucgggacauccggcccaggcuccugggagccggggccggggccgggggcgcgcgccucggacccccggcccgggcggcggcgcgcgcggaggacggacggcccgggcggcgggcgcggcagcggcuucucccggcuccccgucccgcgcaccucaaggggcgcagggcucuggacgcgggggcggagggggcgcugcgcggggcugggcugggcugggcugggcugggcuggccggcuccggcgccggggaccacgcgcgacugguuagaucuuguccugaucucuggaaaacugugacuaucucacauguccugcccuguucggauccccugcgcuaacgagccaggccccccuugauugcugauuuuacgcuuuuuggaccaauugugggucuccgggggcgggguuuugacagcucaggccaagcucuggacgggaggggaggccagggagaaggugucggaagccucagcaguaagaaaacaugucaacagaauaaaauauuaaccaaugacgggccagcgggccccgagaccccucccccuggccuggcccccaccucgccgcccgcgcccgccgcugccugggcgagggcuggaaagcgcagaggaccgaucugacccgccguaagggccugaggcagggggcgcccgggucccggggccuuggggaaggacccccuagccgcaugccggccccaagugcaaagcauugacacguuccggagaggagagggggcgcccuuucccucccgcgccgggaggcccggccgcucuugccugcgacccagccuggccucccaccccacucccggucaccgccccggguccaugcacuucagagggaggcugcgggcacuggaaagcgaggccggugggcgggcaaaucaggaggcucgggcggccgaggucccggagccgaaucagguguccggagccggugaguggggagccauggcagaacccugauggggccggcacgggcgggaacggga

SEQ ID NO: 10551 - RNA, 2501 nt, Mus musculus
ggcaguaugggagcgucccuaauccuuaaauuguucugggagcauauguguaaggguaaaaacuguccagauaguacuagucugagauaaaucccuucacuuugguaaauacuuccacuauauuuaagugucugaaucauguaauuuuuuuaaaauggcauucuguagguccuuuucugugauaguuaaaaaaaaaaaaaaagaaauacucaaccauuaaugcuguuuauccccagguggugguauuacacgccauuuuauuuuugcauuuccccaaaacacacaauuccccugguaauugaacaguauuuuaaaauuaauuacuggaugguuuauaaaguguggcauccgcacaguccaauucuacagaucugcucaguggcuuuucccuuugacaggcugcugcuuuuaacaggagaaugguuugaucaguugucuaugaggucugaugaagacaaaauagcuuucuuuucuagcccccuccaggcuuuggagaaauccaggaaguggguuugaacuuagccgcagugaaucuugcgauaguaaacuuuugggguggucagaguaacaccuuucauuacaacuauuagcugaauggcaaaagacucucggguuucccaguguuugcagaggcauuauuucagaacaauuccauuuggaaagaaacgcgauuguaaaccguuucuauuucaagcccauaaaaagcagaacucggaugaaaggcaaagccuugaccuuucuauuuuagacuugcaucuggguagcuaagccaucugcuuuucucccaccucccaccccaucuacuuaauggacugaaaauacugcacuuaauugcaauuuuauccaaccaggcugacuuuucugacuuacgaccucgucuuuucaccuaacggcuugcucgguaggguuuuacuuacccuuccuucccaauuccucccuaccgcucucaauuauaugcugucaaaugucugcaaaguaugauacuaggcucucacguaagaaagccaucuauagagccuuuucauuucaacagugagcgccugacggaaaaucuaggggucugggcuccucugggcaccgacgguauuagcuuuguugcgguuauguagaaaggcaccucuuacugccuguaaaggagucgcgcguccccaccgcccaacaaggaacgcagcccgggaaaggacagacagacgaaggugggaggaaaccccgggaagaaaggcgcagggaagaauggggagcccaagacgggagggaagaccuuggcaggaagguucuggaggaaggugugcgaaguggccgagaagcuggccgagagggccagcgaagaggggccgggggcaggcgggggggaccccgcccgggugccccgcggggacauggguagcggggacgggaacccaggccggcaccccggggauggcggcccacccgcggccgagccccgcuacuuaacuauuuguagagcugcugcaggcacagguccaggcucucgcccuccaccuccucucgggugaugcgcuccgacagcggccgugggagcgggggcagcgguggcagcuggggcugcggcgguggcggcacggccgagugccccggggcagccgcuuccuccucuuccuccuccucgcccuccgucgccgucuccuccuccaccgccucgucuucgggcucggggucuugguccugcucccccuccucggucgccucuaccgucgcagcguccucccccgguuccucccccgaagccucggccgccucagccgcgacuagcucggcuucgggcucgggcucgggcucggauucggguucgggcucuggcucgccgccaccgcacgguccgcggaacucgcccaggaacagcuccaggaagcgccgguaaguuuucuccucagggaugcagcccgccaucguugcucaugccccgagguccaccgggaagggggugggaggugagcccaggaggaggagggggcugcuucggagccucgccucccgcuacggagggggaacggccgcacgggcaccggcgaucagcacuggguugccuggagagggcucccgcaggcgugcgcgccaccgagcucggacgugcgcggcccgggggcgggggcggagcgcgccaccccgcuccggucuggagggaaaguugguggcgggcgcgcgcacaggguccagcggcggcccacccgcaaucccuaccgagagcucagcccacgcugccuagagacugucgccauggcaaccgguucuaauuaagaauuccaaggucccucccgucgagucuguggagugguaaggacgcuggacuccugcacuccaacuucgaauggucuuuguggggugaagacccuaguuucaugauaagcacugagacaucucuguugguuccaccaggaguguacugacuucaguuuccuuaucugcuugccuugccguaguauaucucuugauccgauggcacgcaguaaacaccuuuuacuaaugauauguguugaaaa

SEQ ID NO: 10552 - RNA, 2501 nt, Mus musculus
uuuucaacacauaucauuaguaaaagguguuuacugcgugccaucggaucaagagauauacuacggcaaggcaagcagauaaggaaacugaagucaguacacuccugguggaaccaacagagaugucucagugcuuaucaugaaacuagggucuucaccccacaaagaccauucgaaguuggagugcaggaguccagcguccuuaccacuccacagacucgacgggagggaccuuggaauucuuaauuagaaccgguugccauggcgacagucucuaggcagcgugggcugagcucucgguagggauugcgggugggccgccgcuggacccugugcgcgcgcccgccaccaacuuucccuccagaccggagcgggguggcgcgcuccgcccccgcccccgggccgcgcacguccgagcucgguggcgcgcacgccugcgggagcccucuccaggcaacccagugcugaucgccggugcccgugcggccguucccccuccguagcgggaggcgaggcuccgaagcagcccccuccuccuccugggcucaccucccacccccuucccgguggaccucggggcaugagcaacgauggcgggcugcaucccugaggagaaaacuuaccggcgcuuccuggagcuguuccugggcgaguuccgcggaccgugcgguggcggcgagccagagcccgaacccgaauccgagcccgagcccgagcccgaagccgagcuagucgcggcugaggcggccgaggcuucgggggaggaaccgggggaggacgcugcgacgguagaggcgaccgaggagggggagcaggaccaagaccccgagcccgaagacgaggcgguggaggaggagacggcgacggagggcgaggaggaggaagaggaggaagcggcugccccggggcacucggccgugccgccaccgccgcagccccagcugccaccgcugcccccgcucccacggccgcugucggagcgcaucacccgagaggagguggagggcgagagccuggaccugugccugcagcagcucuacaaauaguuaaguagcggggcucggccgcgggugggccgccauccccggggugccggccuggguucccguccccgcuacccauguccccgcggggcacccgggcggggucccccccgccugcccccggccccucuucgcuggcccucucggccagcuucucggccacuucgcacaccuuccuccagaaccuuccugccaaggucuucccucccgucuugggcuccccauucuucccugcgccuuucuucccgggguuuccucccaccuucgucugucuguccuuucccgggcugcguuccuuguugggcgguggggacgcgcgacuccuuuacaggcaguaagaggugccuuucuacauaaccgcaacaaagcuaauaccgucggugcccagaggagcccagaccccuagauuuuccgucaggcgcucacuguugaaaugaaaaggcucuauagauggcuuucuuacgugagagccuaguaucauacuuugcagacauuugacagcauauaauugagagcgguagggaggaauugggaaggaaggguaaguaaaacccuaccgagcaagccguuaggugaaaagacgaggucguaagucagaaaagucagccugguuggauaaaauugcaauuaagugcaguauuuucaguccauuaaguagauggggugggaggugggagaaaagcagauggcuuagcuacccagaugcaagucuaaaauagaaaggucaaggcuuugccuuucauccgaguucugcuuuuuaugggcuugaaauagaaacgguuuacaaucgcguuucuuuccaaauggaauuguucugaaauaaugccucugcaaacacugggaaacccgagagucuuuugccauucagcuaauaguuguaaugaaagguguuacucugaccaccccaaaaguuuacuaucgcaagauucacugcggcuaaguucaaacccacuuccuggauuucuccaaagccuggagggggcuagaaaagaaagcuauuuugucuucaucagaccucauagacaacugaucaaaccauucuccuguuaaaagcagcagccugucaaagggaaaagccacugagcagaucuguagaauuggacugugcggaugccacacuuuauaaaccauccaguaauuaauuuuaaaauacuguucaauuaccaggggaauuguguguuuuggggaaaugcaaaaauaaaauggcguguaauaccaccaccuggggauaaacagcauuaaugguugaguauuucuuuuuuuuuuuuuuuaacuaucacagaaaaggaccuacagaaugccauuuuaaaaaaauuacaugauucagacacuuaaauauaguggaaguauuuaccaaagugaagggauuuaucucagacuaguacuaucuggacaguuuuuacccuuacacauaugcucccagaacaauuuaaggauuagggacgcucccauacugcc

SEQ ID NO: 10553 - RNA, 2501 nt, Mus musculus
uaaagaaaaaagaaacuccaagcuccuggaggggaagcggggcagccgggcggggcggaguuccaaggcuggcgccuagggucccggccgaggcaguggccugaagugcugacucccagcuacugcuccuuauguccucgccgcccuccccgggacggacuuuuugccuccgcccccgggugccuggccgccccgcugacguggggacuccgggcggccgcacggaagcucaccuggccgagccuucuccuuccccuccuccucgugcucccgcccccaccugcccuccuccucuccaagugggaaggcgucgggauccguaggcgaggaaauaacgaccccugcaguugcauugcggaaaaucucggcggcggugcuaguugcgggcgauggaagcgaggcaauugcggggucuggggagcccuggaaaauagcagaaaagcggaaagcgcgcgugcaacgagggggagucagugagacucccgacgcaccccaguccugggagccuagccuugggcucggcguccuggaagcaucgccugaagccagcuuggaggcggcaggcggcucgaggacuuggggagcagggagggucaacggaggcagcuggugaccuguguuugcgggcaauaauccccgcuucucuuucuuucucugugugcggugucugcuccucucuccccaccccuccggaagcaggagaacuggccugaucagagacagcagucacccuuugaccaugccccggugaaggggggcggacuucgagggcaacuugucgcggacuaccugggcucagcuagccuacggaaagagagcaagagcccagaacucuacagcucggcccagcggggggcuguugucuaugucuucuuggggcgcccggcggaucggggucucgguuuugcaggaaaagcccagugcuguuggcuucagguggcugccgccgccgccaccgcggucgccgcaagugccauuucugccacuggugagaggagcagagauacaagagaggggagaccuccgaggcaacgaggcaucggacaugugucagcacaucuggggaguacauccgaagagcccgaggggagauuugccgaaacaauucaaacugcguuauugaucuugggggugccugucccuggccggcugucgggugggagcgcgagugugcgcucucuggagagagugugcguguguguauguguguaccgugucgggcuccccccuuccccccuguuuucccgucgagugaugcaccuggaaugagaaucagaggauggaaauagucugggaggugcuuuuucuucuucaagccaauuucaucgucugcauaucagguacgggacgugcugggguugcuggcggggugguguguucuguggugguguuuagaaugugugguuauuauuauuauuauuuuuauuuuuaucgugugcagacuuagggcgggaagcaaagagguggcacgggccuuuuucguucuguggcuuugcuaucuuaugaaucaaagaccuucuaagcccaagggugugugcacgggcuuguguguccauauaugugugacucuguguguguguguguguguguguguguguguguguguguguguguguguguagguguguguaggugugccgcuauggguaggaucuuuguagcguccuggaagggagaagggauggagacugaaaaugaggaggcaaauggguguugauuuucaacugcuuuccuggcugagaacucuggcgccgaaaucugagccuugguaucccccacccccaaccccuggcuuccaaaguucccaaacucagugguuccugcuggcaaaauagaugcagagccuugguuugguaucuaggcgcuuuaaagugacugcaggaagaugcgagacuggggaauacccccuaccccuccaucuaccuucuccaggugcugaagacuguauccuggugucugaaacccaguggcauagcccucccaccgcaaacacaccugaaacaauacaguauuagaaaugcugcuuuagauuaaggucuuaauucccaguagcaagaaugugcuggcucaguugcugaucacaggcuacuugugccagcuuguggcucccccccccccccccaggguggguguugaggugacuaaggcaggguuugugcuugccuguaucuuaguauccuguguugggaggaacugucauuuccaagauguaucuuucuuggugcaggaauauaggcuuggagggaacuauguagacauuucccaguccuuuggcuccucccaucgaccagcacccacucccuugcaccugccauuuaagcgcucaggguguagcccauuugcaguucucucuucugccugcauucccucugcagaauuagggacugagccaacuucccaugaagucuccauagguagaugagcaggagcccugccuuuuugagcagauaugcuugggcagcuuuggaguaggacagguuucaugccuccuccuuuaguuu

SEQ ID NO: 10554 - RNA, 2501 nt, Mus musculus
aaacuaaaggaggaggcaugaaaccuguccuacuccaaagcugcccaagcauaucugcucaaaaaggcagggcuccugcucaucuaccuauggagacuucaugggaaguuggcucagucccuaauucugcagagggaaugcaggcagaagagagaacugcaaaugggcuacacccugagcgcuuaaauggcaggugcaagggagugggugcuggucgaugggaggagccaaaggacugggaaaugucuacauaguucccuccaagccuauauuccugcaccaagaaagauacaucuuggaaaugacaguuccucccaacacaggauacuaagauacaggcaagcacaaacccugccuuagucaccucaacacccacccugggggggggggggggagccacaagcuggcacaaguagccugugaucagcaacugagccagcacauucuugcuacugggaauuaagaccuuaaucuaaagcagcauuucuaauacuguauuguuucagguguguuugcggugggagggcuaugccacuggguuucagacaccaggauacagucuucagcaccuggagaagguagauggagggguaggggguauuccccagucucgcaucuuccugcagucacuuuaaagcgccuagauaccaaaccaaggcucugcaucuauuuugccagcaggaaccacugaguuugggaacuuuggaagccagggguugggggugggggauaccaaggcucagauuucggcgccagaguucucagccaggaaagcaguugaaaaucaacacccauuugccuccucauuuucagucuccaucccuucucccuuccaggacgcuacaaagauccuacccauagcggcacaccuacacacaccuacacacacacacacacacacacacacacacacacacacacacacacacacagagucacacauauauggacacacaagcccgugcacacacccuugggcuuagaaggucuuugauucauaagauagcaaagccacagaacgaaaaaggcccgugccaccucuuugcuucccgcccuaagucugcacacgauaaaaauaaaaauaauaauaauaauaaccacacauucuaaacaccaccacagaacacaccaccccgccagcaaccccagcacgucccguaccugauaugcagacgaugaaauuggcuugaagaagaaaaagcaccucccagacuauuuccauccucugauucucauuccaggugcaucacucgacgggaaaacaggggggaaggggggagcccgacacgguacacacauacacacacgcacacucucuccagagagcgcacacucgcgcucccacccgacagccggccagggacaggcacccccaagaucaauaacgcaguuugaauuguuucggcaaaucuccccucgggcucuucggauguacuccccagaugugcugacacauguccgaugccucguugccucggaggucuccccucucuuguaucucugcuccucucaccaguggcagaaauggcacuugcggcgaccgcgguggcggcggcggcagccaccugaagccaacagcacugggcuuuuccugcaaaaccgagaccccgauccgccgggcgccccaagaagacauagacaacagccccccgcugggccgagcuguagaguucugggcucuugcucucuuuccguaggcuagcugagcccagguaguccgcgacaaguugcccucgaaguccgccccccuucaccggggcauggucaaagggugacugcugucucugaucaggccaguucuccugcuuccggagggguggggagagaggagcagacaccgcacacagagaaagaaagagaagcggggauuauugcccgcaaacacaggucaccagcugccuccguugacccucccugcuccccaaguccucgagccgccugccgccuccaagcuggcuucaggcgaugcuuccaggacgccgagcccaaggcuaggcucccaggacuggggugcgucgggagucucacugacucccccucguugcacgcgcgcuuuccgcuuuucugcuauuuuccagggcuccccagaccccgcaauugccucgcuuccaucgcccgcaacuagcaccgccgccgagauuuuccgcaaugcaacugcaggggucguuauuuccucgccuacggaucccgacgccuucccacuuggagaggaggagggcaggugggggcgggagcacgaggaggaggggaaggagaaggcucggccaggugagcuuccgugcggccgcccggaguccccacgucagcggggcggccaggcacccgggggcggaggcaaaaaguccgucccggggagggcggcgaggacauaaggagcaguagcugggagucagcacuucaggccacugccucggccgggacccuaggcgccagccuuggaacuccgccccgcccggcugccccgcuuccccuccaggagcuuggaguuucuuuuuucuuua

SEQ ID NO: 10555 - RNA, 2501 nt, Mus musculus
aguuagggagaccacacuccucagagucccucuucuccuuucuucgguuuagagaggaaggaaggaaggaaggaaggaaggaaggaaggaaggggcaaaggauugggagggcugaggggagcuucucaaagacucacggaguguagagcagcgggugggggcacucagcuuacauccugcuuugcgcacuagaggcaguggcugcagagggcagcaucaagcucucccgcugccccugugcuccaaagcggagccggacuuggguucucaggggcuacaggguaaaccuggggucucccagccugacucccagagagccucugggcuagaagaagagaaucagaagaggcuaucccuuacugggauagccauaccagccagccccccaccuuuccaguaccccagagaugggcgucagucaagccagugagugcuuugugcuagggguuugguuuuauuuuuaaaaaagaggaucagggguucccugaccacgccaggcuaagcagaggugaggcugagaaucaaaauucaucugccuggaauguugggcaugcguuccuaaaacccauccacagaguaggcuuaaggagcuggaccucaguccuccuuaaugaacacacuggcagucucugguccccccaauacuuucagacgacugcgguuucccauaccuggucugccaucagccggaacacucugauuugugaaaggggaggcguaguguggccgagcuuaaucccaucccccacuugccggcgcuuuugucagucucccccccccccuuagaaaaacaaaaaacaaaaaaccaagcacaaaacuccccaacccaaccuuagcacucaacaucagauaaagaauugagguggggagggcgcuggccgcauugggcucucucugaaaggggcuccaguccagcucugggggcagacagcucccccuucaccacaucuuguucucauucugcaccccugacaucagccgccgccgaaaucuccuuguugugccuccaacccgcggauugggaggguguuggggggacaggaccugcccccaccccccguuucccgcuaggucaguaaaaaccucagccuucaggacuacuagaucgggggacuggacccuagaauccgccgcaaacuuuggggcgggggcauaaggaaaccccaggagauugcggucuccccuccuccguccccgcagcuuccucuccaccccugcccccaaacucgaaaaccaaacccagcucgcuaacccgcggcuggcgggcuggcggaguagaaagcccaggcuccugaagcugcccacaucuggaggaugacgacccuccucugcccacaucuguagagcauccagaugcuuaccagagggucaccucuccucucuuuuccuagcuuggauuucaacccuccaccccucacccccgcccaaggaaggcugagguguguguauucggagguggggcucgucugggguacccaccagucuccgcuucuacucggacgcccccuccccuccuuaacagucccccacucaacuguucacaguccaggcucacuucuccaacucaccuggcuuacgguccccucuggcaacacggcccgcccuccuguggaccccccuaguccggcccaucgcugugccccgaaggauauggguuacagaccgugcggagacaccagcuccgcgggcggcuguccuggcucaaguagaagaaaaccaccggggccagcgccggguagggcagccccuccgccucggaguccgcgcugcccggguccuuuuccgucgaccccggccccugccggcccccggccccagacaggucguugagcugcgugaagcuccggggcugucccgacuccucggcgcccgcuccauccucuuccucauccauccucuggccagcuggggucccggggguccgaagaggggcgaucggagccccuccgaggagguguccucacacaaccgggggaccccggugggggagcauguggggggcucuagagagcuugcugagcccccaggagggccaguucagcucagcucccccugcccucaggggcaugcugcccgcggggcgccgggucccagggaagccccgccuggcgagagucccgcuuccccuggguucccgggggcuccccgacuagccggccggcuuccccucacuuuguuccggcuucuucccuucgcgcccaggcuccgguugcccgaaugggcgcuaccuucggugaagcagcccccgagaggaggaggaaaaaaggggccacccggugaagggcggggguccggggaggggcgcccccucuucccucggcgcagcuggagcaggaucuaaggggucagcaucgucccggcuccacgccagagacggcggggggagggggaggggaggagggaucucuuuggggguggguuuggagggggugggggcuggcuccuuccuccgccccgcggcgggcuagaggaccgggaggggcggggagaccguggggggc

SEQ ID NO: 10556 - RNA, 2501 nt, Mus musculus
gccccccacggucuccccgccccucccgguccucuagcccgccgcggggcggaggaaggagccagcccccacccccuccaaacccacccccaaagagaucccuccuccccucccccuccccccgccgucucuggcguggagccgggacgaugcugaccccuuagauccugcuccagcugcgccgagggaagagggggcgccccuccccggacccccgcccuucaccggguggccccuuuuuuccuccuccucucgggggcugcuucaccgaagguagcgcccauucgggcaaccggagccugggcgcgaagggaagaagccggaacaaagugaggggaagccggccggcuagucggggagcccccgggaacccaggggaagcgggacucucgccaggcggggcuucccugggacccggcgccccgcgggcagcaugccccugagggcagggggagcugagcugaacuggcccuccugggggcucagcaagcucucuagagccccccacaugcucccccaccggggucccccgguugugugaggacaccuccucggaggggcuccgaucgccccucuucggacccccgggaccccagcuggccagaggauggaugaggaagaggauggagcgggcgccgaggagucgggacagccccggagcuucacgcagcucaacgaccugucuggggccgggggccggcaggggccggggucgacggaaaaggacccgggcagcgcggacuccgaggcggaggggcugcccuacccggcgcuggccccggugguuuucuucuacuugagccaggacagccgcccgcggagcuggugucuccgcacggucuguaacccauauccuucggggcacagcgaugggccggacuagggggguccacaggagggcgggccguguugccagaggggaccguaagccaggugaguuggagaagugagccuggacugugaacaguugagugggggacuguuaaggaggggagggggcguccgaguagaagcggagacugguggguaccccagacgagccccaccuccgaauacacacaccucagccuuccuugggcgggggugagggguggaggguugaaauccaagcuaggaaaagagaggagaggugacccucugguaagcaucuggaugcucuacagaugugggcagaggagggucgucauccuccagaugugggcagcuucaggagccugggcuuucuacuccgccagcccgccagccgcggguuagcgagcuggguuugguuuucgaguuugggggcagggguggagaggaagcugcggggacggaggaggggagaccgcaaucuccugggguuuccuuaugcccccgccccaaaguuugcggcggauucuaggguccagucccccgaucuaguaguccugaaggcugagguuuuuacugaccuagcgggaaacggggggugggggcagguccuguccccccaacacccucccaauccgcggguuggaggcacaacaaggagauuucggcggcggcugaugucaggggugcagaaugagaacaagauguggugaagggggagcugucugcccccagagcuggacuggagccccuuucagagagagcccaaugcggccagcgcccuccccaccucaauucuuuaucugauguugagugcuaagguuggguuggggaguuuugugcuugguuuuuuguuuuuuguuuuucuaagggggggggggagacugacaaaagcgccggcaagugggggaugggauuaagcucggccacacuacgccuccccuuucacaaaucagaguguuccggcugauggcagaccagguaugggaaaccgcagucgucugaaaguauuggggggaccagagacugccaguguguucauuaaggaggacugagguccagcuccuuaagccuacucuguggauggguuuuaggaacgcaugcccaacauuccaggcagaugaauuuugauucucagccucaccucugcuuagccuggcguggucagggaaccccugauccucuuuuuuaaaaauaaaaccaaaccccuagcacaaagcacucacuggcuugacugacgcccaucucugggguacuggaaagguggggggcuggcugguauggcuaucccaguaagggauagccucuucugauucucuucuucuagcccagaggcucucugggagucaggcugggagaccccagguuuacccuguagccccugagaacccaaguccggcuccgcuuuggagcacaggggcagcgggagagcuugaugcugcccucugcagccacugccucuagugcgcaaagcaggauguaagcugagugcccccacccgcugcucuacacuccgugagucuuugagaagcuccccucagcccucccaauccuuugccccuuccuuccuuccuuccuuccuuccuuccuuccuuccucucuaaaccgaagaaaggagaagagggacucugaggaguguggucucccuaacu

SEQ ID NO: 10557 - RNA, 2501 nt, Mus musculus
ucuauguuggaacuccuuccuccucgguuaaccuuuuauuggggggcggggcaggaaguaauagaaugaaguaucaacccucccaccucaauuuucucuacugguccauccacccugcaaugcccaggaguaagucucccauagcuuggccagcaggaguagccacacuucucuaggaaucuucccuguguccuucuccagugccucgggugcacgcccccuccagaacuuaaagagucuuucccgcuccugggcccacaguucucaggcuugggaagucccauuuggcugaaucaagacuacaccggaccacgucuguucuguucaacggcgguccccuucugcuucagcgccccaggcuggccgcucgcccggcaaaugcuuguugaauaagagaaucagaagcccucacagacccugcagaggagauggaaagccccgugcguccuaaggcgggaccgccucccuggucgcuucccugccauucgcgcgcagacucccuagcgcugagacucccgcgguccgagaaguagcggcaauugggaucccggggccggccgcgggcacccgccgccuccuccccucgguccuagcugcuuccgccccgcccgcccuccucuucccuccuucccuaccguucuuugucucccgggcgcucggccuccccauaagcguaucgccccccccgccccccccgucgccuuaucccgggcgaccccccacggaccuagccacugcgacgcuacacaaaucggccgguggcgcgaggguucgcgacccccgggguuuggcgggggcggggcgggagguggcguucagguucucucucucucucucucucucucucucucucucucucucucacacacacacacacacacacacacacacacauacacguacacgcacgcacacacggagcauccucccgucagguuuccccguccagccccgcccgcgccuccugcuucccgcagaccuucucccugcaucccuacacaccucgccucuccauucuuuccgggacucuccccgccgaucccccacaacacccuggaauggagcgacuccagccagcccggagccccccgcgaccggggugaaaguccuucgccccucuccugcccggcagucgccccgaacaccaugggccugagggguucccggggcgccggacgcugaaaaugacggaugcuggaggugaggggccggguccccuaggguggaaggggaagcguggcuagcgacuacuggacucaaggugggacccucaguagggcuaaauggauuuaagccacaagggccuuucuuucucuaucccuagggagaccucacuggaggggggagcugggcugucgggagggagcagaaauaggguuugugucccuaaucccauuucucccgccugaggaaauuaauaagagagagaggagagaaagggagagagagagagagagagagagacagagagagagagagagagagagagaagagaagagaagagaagagaagagaagagaagagaagagaagagaagagaagagaagagaagagaagagaagagaagagaagagaagagaagagaagaggagaggaaagaaugaagagaaaaagaaauaagaaaaacuggugugggggcagggggagaggccuuaacuccuuccuaucuggcaguuagaccuauggguugaagaaacuguucuauccucugagauuggggagaggggauucuaugauagguguaggugcacuguccauuaaccccauuuucuaggacgcuuggaagagcugucaaacuccugcggacagcuccaagccuggggcuggcugaagacugggggccugggaggggcucggcuccuuagcugcucuacaacugccucccccaucuccagccugcaugucaaccacuucugggacuugucggcucugugugugugugugugugugugugugugugugugugugugugucugugugucugugugugugugugugugugucugugugucugugugucugugugugugugucucuuuucugacuccaucucucugucucucugucucucugucucucucccuccccuacucaggauccuucucccuucuugcuuguggggcaggcauucuguucuauucucucaccccaugauggggugucagggcuacccagcugcuuucccugagccuccugggucuguucuuucuugaucuuucuucccagcucccaguggacacugccagucucucccucugcaucugcuaguuccuccuucuguuccacccgcagguuguagaccuuuuguuuggcuuucuccuucccuugggcuccagguagcuuggaacucaccugccuuuccuuuuuccagagaaaggucagaggucccuaaugguccuccaggaacuggaagcuguuggggaagggaguggucuguugaccagggagcccagagguuguccaaggggacagguucauuugcauccuuguguaguuaacac

SEQ ID NO: 10558 - RNA, 2501 nt, Mus musculus
guguuaacuacacaaggaugcaaaugaaccuguccccuuggacaaccucugggcucccuggucaacagaccacucccuuccccaacagcuuccaguuccuggaggaccauuagggaccucugaccuuucucuggaaaaaggaaaggcaggugaguuccaagcuaccuggagcccaagggaaggagaaagccaaacaaaaggucuacaaccugcggguggaacagaaggaggaacuagcagaugcagagggagagacuggcaguguccacugggagcugggaagaaagaucaagaaagaacagacccaggaggcucagggaaagcagcuggguagcccugacaccccaucauggggugagagaauagaacagaaugccugccccacaagcaagaagggagaaggauccugaguaggggagggagagagacagagagacagagagacagagagauggagucagaaaagagacacacacacacagacacacagacacacagacacacacacacacacacacagacacacagacacacacacacacacacacacacacacacacacacacacacagagccgacaagucccagaagugguugacaugcaggcuggagaugggggaggcaguuguagagcagcuaaggagccgagccccucccaggcccccagucuucagccagccccaggcuuggagcuguccgcaggaguuugacagcucuuccaagcguccuagaaaaugggguuaauggacagugcaccuacaccuaucauagaauccccucuccccaaucucagaggauagaacaguuucuucaacccauaggucuaacugccagauaggaaggaguuaaggccucucccccugcccccacaccaguuuuucuuauuucuuuuucucuucauucuuuccucuccucuucucuucucuucucuucucuucucuucucuucucuucucuucucuucucuucucuucucuucucuucucuucucuucucuucucuucucuucucuucucucucucucucucucucucucugucucucucucucucucucucucucccuuucucuccucucucucuuauuaauuuccucaggcgggagaaaugggauuagggacacaaacccuauuucugcucccucccgacagcccagcuccccccuccagugaggucucccuagggauagagaaagaaaggcccuuguggcuuaaauccauuuagcccuacugagggucccaccuugaguccaguagucgcuagccacgcuuccccuuccacccuaggggacccggccccucaccuccagcauccgucauuuucagcguccggcgccccgggaaccccucaggcccaugguguucggggcgacugccgggcaggagaggggcgaaggacuuucaccccggucgcggggggcuccgggcuggcuggagucgcuccauuccaggguguugugggggaucggcggggagagucccggaaagaauggagaggcgagguguguagggaugcagggagaaggucugcgggaagcaggaggcgcgggcggggcuggacggggaaaccugacgggaggaugcuccgugugugcgugcguguacguguaugugugugugugugugugugugugugugugugagagagagagagagagagagagagagagagagagagagagaaccugaacgccaccucccgccccgcccccgccaaaccccgggggucgcgaacccucgcgccaccggccgauuuguguagcgucgcaguggcuagguccguggggggucgcccgggauaaggcgacggggggggcggggggggcgauacgcuuauggggaggccgagcgcccgggagacaaagaacgguagggaaggagggaagaggagggcgggcggggcggaagcagcuaggaccgaggggaggaggcggcgggugcccgcggccggccccgggaucccaauugccgcuacuucucggaccgcgggagucucagcgcuagggagucugcgcgcgaauggcagggaagcgaccagggaggcggucccgccuuaggacgcacggggcuuuccaucuccucugcagggucugugagggcuucugauucucuuauucaacaagcauuugccgggcgagcggccagccuggggcgcugaagcagaaggggaccgccguugaacagaacagacgugguccgguguagucuugauucagccaaaugggacuucccaagccugagaacugugggcccaggagcgggaaagacucuuuaaguucuggagggggcgugcacccgaggcacuggagaaggacacagggaagauuccuagagaaguguggcuacuccugcuggccaagcuaugggagacuuacuccugggcauugcaggguggauggaccaguagagaaaauugaggugggaggguugauacuucauucuauuacuuccugccccgccccccaauaaaagguuaaccgaggaggaaggaguuccaacauaga

SEQ ID NO: 10559 - RNA, 2501 nt, Mus musculus
auuuuaaaagugaucaaaauauuuucauggacccugggucuuugccacuuucugucugucauuugcauagaccacacauacaucauuaaggaccaccuccuuccacaaacacccaauggguaaauuccccuccuuccucaucucaccuaagcccaccccuggccacuaaaacagaccgauuaguagauccugggggcuccgcacagccaaccccuccgcacauuugggggauuuaucggagguagagcauaggaggaacacaguggcgcuggggggaguguguguguguguguguguguguguguguguguguguguguguauuagggguaacaacaaagaggguugagaggguugggggagccagugagaaagcgcgagcguguuuugccucgaaggcaagacuugcagccaaucagcgcgcaggagccucccucggcgacuccaacauugagucuauaaccggcuggccgggcggagcuggcagcauuugacuguggcuugggacgcggagagaggcacgcagcgacugaccgacagccggcgauggucuaagcgccccucggccacccccucccccagacgcgaccgcguccugcccucgcccucuggacacacacccccaccugggcuccuccgcccguucggcgcuccucggaggaggcccgggguguugcggcgcucgccagcaugagcggcuccuucgaucgcaagcucagcagcauccucaccgacaucuccagcucgcucagcugccaugcgggcuccaaggacucgcccacccugcccgaaucuacagucacugaccugggcuauuacagcgcuccucagcaugacuacuacucgggccagcccuacggccagacggugaaccccuacaccuaccaccaccaguucaaucucaaugggcucgcaggcaccggcgcuuacucgcccaagucggaauauaccuacgggggauccuauaggcaguacggagcguaccgggagcagccuuugccugcccaggacccaggugaggaugcccggguuguggagagggugcgagggacucuaagguucccaagcaagaggaagucugggaauaggagcugaaaucuagggaaacucgagguuaagaaauggaagcguuggagauuagaggagaccggguuagaugaccuccagaggggugaacgacacuccgaagaggcgcgcacugugcgccgcggucucuuggagauuccagggcagcuggagccaccgggagcuccuucugagugaucaugggggccuucaaugcugccaucccgcuggcacuugagccggagacgaaagacggucgccgagagcuggaggggagucagcgaggacuggagguuccagggcccuucuuuuggaugccgucaggggaaacccggaguagugaaaggcuuguggagaaagacccaaagaagucccagaaauggaggagagacugggaaguagagaugcggagagagaaguggggacggcgagaaagaaauguggggggggcgguaagauaaagcgcacagcagaaagcaacagaggaaaugaagaaagggcggggaggaaagaaagaaaaaggaggaaagaagagggaaggaagaaaaagaaaacagagagaaagggaaaagagacagagaaaacgcuuguacuguccuugcaaauuuuuuccugaaacaaaugauccugaacuagaaagcguauuaaaaggagauggggaggaggggggacaagaagugggagacgccaccgcggcuaggugggucaccagagaagaguggcugagccgggaaggcgucgugagcgagccgcgcgguccucgcccagucgguugcuggcgccggagucggcgcuccgaggccccgggugccgagcugggagcgccgcgucgugggcggccgccgguccggcugggucgcugcgguuccuccccgggcgcgggcggcacuacgcuccuccaagaagucccggggagaucagugggccggagggugcggcguccgacggugggaaaucuuggagaacgcgguggucgcaggcugagacuaaacugguguuuuuccccuacagugucggugaaagaggagccggaagccgagguucgcauggugaacggcaagcccaaaaagguccgaaagccgcgaacgaucuacuccagcuaucagcuggcugcccugcagcgccguuuccagaaagcccaguaucuggccuugccugagcgcgccgagcuagcugcacagcugggccucacacaaacacagguugguacugaacgcuccagggucucaggagggaucugggauucccuagguaccccugagccuggcuggcccaugaagcaccccuuugcccugccccugcccggcagcucgcugcaggaacucuugccugcccuuccagugacuugagucucagcuuucagagaaaggguuacaguagggagcauagaagggugcagugugcaucuuugugaacuuuugcaacuguguauggcgu

SEQ ID NO: 10560 - RNA, 2501 nt, Mus musculus
acgccauacacaguugcaaaaguucacaaagaugcacacugcacccuucuaugcucccuacuguaacccuuucucugaaagcugagacucaagucacuggaagggcaggcaagaguuccugcagcgagcugccgggcaggggcagggcaaaggggugcuucaugggccagccaggcucagggguaccuagggaaucccagaucccuccugagacccuggagcguucaguaccaaccuguguuugugugaggcccagcugugcagcuagcucggcgcgcucaggcaaggccagauacugggcuuucuggaaacggcgcugcagggcagccagcugauagcuggaguagaucguucgcggcuuucggaccuuuuugggcuugccguucaccaugcgaaccucggcuuccggcuccucuuucaccgacacuguaggggaaaaacaccaguuuagucucagccugcgaccaccgcguucuccaagauuucccaccgucggacgccgcacccuccggcccacugaucuccccgggacuucuuggaggagcguagugccgcccgcgcccggggaggaaccgcagcgacccagccggaccggcggccgcccacgacgcggcgcucccagcucggcacccggggccucggagcgccgacuccggcgccagcaaccgacugggcgaggaccgcgcggcucgcucacgacgccuucccggcucagccacucuucucuggugacccaccuagccgcgguggcgucucccacuucuuguccccccuccuccccaucuccuuuuaauacgcuuucuaguucaggaucauuuguuucaggaaaaaauuugcaaggacaguacaagcguuuucucugucucuuuucccuuucucucuguuuucuuuuucuuccuucccucuucuuuccuccuuuuucuuucuuuccuccccgcccuuucuucauuuccucuguugcuuucugcugugcgcuuuaucuuaccgccccccccacauuucuuucucgccguccccacuucucucuccgcaucucuacuucccagucucuccuccauuucugggacuucuuugggucuuucuccacaagccuuucacuacuccggguuuccccugacggcauccaaaagaagggcccuggaaccuccaguccucgcugacuccccuccagcucucggcgaccgucuuucgucuccggcucaagugccagcgggauggcagcauugaaggcccccaugaucacucagaaggagcucccgguggcuccagcugcccuggaaucuccaagagaccgcggcgcacagugcgcgccucuucggagugucguucaccccucuggaggucaucuaacccggucuccucuaaucuccaacgcuuccauuucuuaaccucgaguuucccuagauuucagcuccuauucccagacuuccucuugcuugggaaccuuagagucccucgcacccucuccacaacccgggcauccucaccuggguccugggcaggcaaaggcugcucccgguacgcuccguacugccuauaggaucccccguagguauauuccgacuugggcgaguaagcgccggugccugcgagcccauugagauugaacugguggugguagguguagggguucaccgucuggccguagggcuggcccgaguaguagucaugcugaggagcgcuguaauagcccaggucagugacuguagauucgggcagggugggcgaguccuuggagcccgcauggcagcugagcgagcuggagaugucggugaggaugcugcugagcuugcgaucgaaggagccgcucaugcuggcgagcgccgcaacaccccgggccuccuccgaggagcgccgaacgggcggaggagcccagguggggguguguguccagagggcgagggcaggacgcggucgcgucugggggaggggguggccgaggggcgcuuagaccaucgccggcugucggucagucgcugcgugccucucuccgcgucccaagccacagucaaaugcugccagcuccgcccggccagccgguuauagacucaauguuggagucgccgagggaggcuccugcgcgcugauuggcugcaagucuugccuucgaggcaaaacacgcucgcgcuuucucacuggcucccccaacccucucaacccucuuuguuguuaccccuaauacacacacacacacacacacacacacacacacacacacacacacuccccccagcgccacuguguuccuccuaugcucuaccuccgauaaaucccccaaaugugcggagggguuggcugugcggagcccccaggaucuacuaaucggucuguuuuaguggccaggggugggcuuaggugagaugaggaaggaggggaauuuacccauuggguguuuguggaaggaggugguccuuaaugauguauguguggucuaugcaaaugacagacagaaaguggcaaagacccaggguccaugaaaauauuuugaucacuuuuaaaau

SEQ ID NO: 10561 - RNA, 2501 nt, Mus musculus
aauaaacaucucugucaaggggacagaggacaggaaaugagggcccgcgggguggagguggagguguugggggggggcgacaagacuaccuccucuuuaauuacccugucgggccucucccgcagcucugaggcuggggcgcucucccucccuguaugcugguccuccccccccccccaaucugccuggggagagggcuccucagccugcgucccuccugaggcagcccgcugcuugccuccgccucuccuccgcccccaucgccccauguugagaaccccccuuccuguaaaagcgggaggggcccgggcggcccggcagcucaggcugagguuacguggccgccggagcccugacgugauagcacauugcaucagcauaaaacaauccauccuggauauggaaugcggugaggacggaugacagcgcgagcgcagcccccucgcccgauugauuuaugucggagcugacgcuuuaucaggcaguccgcaaaacuuugaccaaucauuuugcaaggagcuccgagccgggcugcuccacuguacuuuguuggcugagaaguugagcagggggugggggugggagggugggggucuggggggggucgcguccgaaagcccucugcaccggguccgugugccaccuuuucccugcuugggcgccgcggcgcgagcgcuucccuucccccugcgagcgcgcggauaaugucugagaauguccauuucugggacgcuuagcagcuauuaugucgacucgaucauaagucacgagagcgaggacgcgccuccagccaaguuuccuucgggccaguacgcgaacccgcggcagccgggccacgccgagcaccuggacuuccccucgugcagcuuccagcccaaagcgccgguguucggcgccuccugggcgccgcugagcccgcacgccucggggagccugccgucugucuaccaccccuaccugcagccccagggcgcgccggcggccgaaagcagguaccuccgcaccuggcuagagccggcgccgcgcgccgaggccgccccggggcagggccaggcggccgugaaggcggagccgcugcugggcgcgccgggggagcugcucaaacagggcacgcccgaguacaguuuggaaacuucggcgggcagggaggcuguccugucuaaucaaagagcuggcuacggggacaauaaaauuugcgaaggaagcgaggacaaagagaggccggaucaaaguaaguuauaaaaaaaaaaaaaagugaggaaaucccccccaggcugcaggccaggcccgggggaggggaggggagaggccauaaagcggacaauguaaagggacagagcgccuggggccgcagggcuagaguggguggagggaagaggaaggaaggggcuggcaaagcaaaaagcuggguguccaggagggggacacugaggcuaccccccacuccuccuuguggcgcagggacugagacucagggaccaagucucucuaguccuucauucuuccccaggcucgggcuggaaaaagggagagggaccugcgauagaacuguaggaggccgggccgauggccagcgcggcccggagcccgcgcgggcacggggccgaagagcacucggcagagccgccugcgccacgcgcagaccgucccugccggccaaggggaagggggagggggcucauuaggauuuuauuugcgaugcaacagcuuggcggaggauuguuccuagcagaucucacgcaguagccgcgucgggucggcagcaggcgccgggaggggcgggggaagcccaggaugcggugacggagcccccuccccggugcgccggccccuccccgggagccuucccuccgggggucccccgcccuucuagggcauccucgacaggacggccguuucuccuccugcgguugcacgcugaucuccgcggggcuuccgaucacuuaggccgggcaguucaccucuccgagagucuaggcaucacuugcuaaagacagggccucccucuagaauggaggagaagacacccaaagggaccccgggggagggagggggaggacugcgcaggggcggagaacucuacccuugguggagaguuucuuaccaccucccacuccuaaaagcacccuugcuaaaauaaaaccccaaguggaaacugcugcuggcugagaguagaggaggcuuacuuuuagggguuuguuuuuaaggauggggaagacaaacugguuuggggcucgcucuuggucccaaacaauacgggacaaacugacaggucaacuccucaccucuuccuccucugggcaaauaguuugguccuugcucgcccuauuggaugccccaccaacagagaggccaauggguccucugggggcaugcuugcccucugaaaagcaaggagagacacuauuccccugugacccuugugguccccucauaccuccaacuugccaggcugaguuauuaaggagcucauauccccaaaacagcuccucccaaagcuc
